United States Patent 10,501,513 (MODIFIED POLYNUCLEOTIDES FOR THE PRODUCTION OF ONCOLOGY-RELATED PROTEINS AND PEPTIDES) - sequence listing, part 18

SEQ ID NO: 31013 - DNA, 870 bp, Artificial Sequence
  Description of Artificial Sequence: Synthetic coding sequence
tgatggtacacccctacccctttttactcatcattggaagcggcactcctgaattttcgcccttccgctcctgtattccgcatgcttgaagtgagtatccctacaccccatcgttacgtgcgtgggaagtctaatttgatggatgctatctctttcgttctcggggagaaaaccagcaacctccgggtgaagaccttaagagatttgattcacggcgcaccagtgggcaagcctgcggcaaaccgcgcatttgtgtcaatggtttactctgaggaaggagcagaagatagaaccttcgcgcgtgtgatcgtcgggggatcatccgagtacaagattaacaacaaagtcgtccagctgcatgaatattctgaggagttagaaaagttgggaatcctcattaaagcacgcaattttctggtgttccaaggggctgtggagtctatcgccatgaagaatccaaaagagcgcaccgccctatttgaagaaatttctagaagtggagaactggctcaagagtatgacaaaaggaagaaagagatggtgaaagctgaagaggatacccagttcaactatcacagaaagaagaacattgccgcagagcgaaaggaagccaaacaagagaaggaggaggctgacagataccaaagattgaaggacgaggtggttcgggcacaggttcagctgcaactctttaagctgtaccataatgaggtggagatagagaagcttaataaagaactggcctctaagaacaaagagattgagaaggataagaagaggatggacaaagtggaggacgaactaaaggagaaaaagaaggagctggggaagatgatgagggaacaacaacaaattgagaaggagatttag

SEQ ID NO: 31014 - DNA, 1995 bp, Artificial Sequence
  Description of Artificial Sequence: Synthetic coding sequence
atgtccggtgtccggggtctatctcgcctcctgtctgccaggaggctggcactggcgaaagcctggcctactgttctgcaaactggaaccaggggttttcattttactgtggacggcaacaagagggcgtccgcaaaagtgtctgattcaatttccgcacaataccctgtggtagaccacgaattcgacgccgtggtggtgggggcagggggagctggcctgagagccgcattcgggttgtccgaagccggatttaacacggcctgtgtaacaaagctgtttcccacacgatctcacacagtggcagctcaagggggtattaatgccgcactcgggaatatggaggaggataattggcggtggcatttttacgacaccgtgaaaggttctgactggctgggagatcaggacgcaatccactatatgacggagcaagccccagctgccgtcgtggagcttgaaaactatggtatgccgttcagccggactgaggatgggaaaatttaccaacgcgctttcggcggacagtcactcaagttcggaaagggcggtcaggcacatcggtgctgttgcgtcgcggatcgcaccggtcacagccttctccacacactgtacgggagaagcctgagatacgacacttcttacttcgtggagtacttcgccctggatctgctcatggagaacggggaatgtcggggagtaatagccctgtgtatcgaagatgggtccatacatagaatcagagcaaagaatacagtggtggccacagggggttatgggcgtacatactttagttgtaccagcgcccatacttcaaccggtgatggcaccgcgatgattaccagagcaggactcccatgccaggatcttgaattcgtgcagttccatcccacagggatctatggcgcaggatgtttaatcacagaaggatgccgaggcgaaggtggaatcctcattaactcacagggcgaaaggtttatggaacgctatgccccagtggccaaagatctggctagtcgcgatgtggtgtccagatctatgactctggagattcgagagggcagaggatgcggccctgaaaaggaccatgtctatctccagctgcaccacttgccaccggaacagcttgctactcgcctgcctggtatatcagaaactgctatgatcttcgctggggtggatgtcacaaaggagccgattccagtactaccaacagttcactataacatgggcggaatacccacaaactacaagggtcaggtgctgcgccacgtgaatggccaggatcagatagttcctggcttgtacgcttgtggagaggccgcttgcgcatcagtgcacggcgctaaccgcctcggggctaactctctgctcgaccttgtggtattcggtagggcctgcgcattgagtattgaggagagctgtcgtcccggagataaggtgccacccataaagcccaatgcaggggaagagtccgtcatgaatctcgataaattgagatttgctgatggctcaatcagaacctcagagctgagactcagcatgcagaagtctatgcagaaccatgccgcagtgttccgtgtgggctccgtgttacaggagggttgcggcaagatttccaagctttacggcgatcttaagcacctgaagacttttgataggggaatggtgtggaacacagatcttgtcgaaacactggaattacagaatcttatgctgtgcgcactccaaaccatttatggcgcagaagcacgcaaggagtcacgtggggctcacgcacgcgaggattacaaagtgaggatagatgaatatgactacagcaaaccgatccagggacaacagaaaaaaccatttgaagaacactggcggaagcacactctgtcttacgtggacgtcggtacggggaaagtcacgcttgaatatcggcctgtgatcgacaaaactctcaacgaggccgactgtgccaccgtcccgcctgctattcgtagctactag

SEQ ID NO: 31015 - DNA, 1560 bp, Artificial Sequence
  Description of Artificial Sequence: Synthetic coding sequence
atgagcggagtgcggggactgtctcgactgttatccgcaaggcggctggctctcgcgaaagcatggccaacggtactgcaaaccggcacccggggatttcatttcacggtggacggaaataagcgcgcaagtgcgaaggtctccgacagtatctccgctcagtaccccgtcgttgatcacgagtttgacgctgtggtggtcggagccggaggcgctggcctcagagccgcatttggattaagcgaagccggttttaatacagcctgtgtgaccaaactcttcccgaccaggagccacacagttgctgcgcaggggggaatcaatgccgctctgggaaatatggaggaggacaattggcgctggcatttctatgacacttctacgggggacggcactgccatgatcaccagagccggactcccatgtcaggaccttgaatttgttcaatttcacccgaccgggatatacggggctggctgcttaattacagaaggatgccgcggtgaggggggaatattgatcaacagtcaaggtgaacgatttatggaacgctacgcacccgttgcaaaggatctggcatcgagagacgtagtgtcacgcagcatgaccctcgaaatccgggaagggaggggatgcggcccagagaaagatcacgtgtacctacaattgcaccacttgccccctgaacagctcgccacacgtttgcctggcatctccgagactgctatgatctttgccggagtggatgtaacaaaggagcccattcccgtgctacccaccgtgcactataatatgggagggattcccacgaactacaaaggccaggtgttaaggcatgtaaacggacaggatcagatcgtgcccggattgtacgcttgcggcgaggccgcttgcgcttctgtccacggtgccaatcgcttgggtgccaactcccttctagatttggttgtgttcggcagggcttgtgctctcagcattgaagagtcttgtcggcctggcgataaggtccccccaatcaagcctaacgcgggagaggaaagcgtgatgaatttggacaagctgcgttttgccgatggctccatccgcacttctgaattacgattaagtatgcagaagtcaatgcaaaatcatgcggctgttttcagggtgggctcagtcctgcaggagggatgcggaaaaatcagtaagctgtatggcgacctgaaacacctgaaaaccttcgacagagggatggtgtggaacacagatctggtggagacactcgagctgcaaaatctgatgctctgcgcacttcagacaatctatggtgccgaagctcgtaaggagagtaggggggctcatgccagagaggattataaggtgaggatcgacgaatacgactattcgaagcctatccagggccaacagaaaaaaccttttgaggaacattggaggaaacacacattgtcctacgtggatgtcggcactgggaaggtaacattagagtacagacctgtcattgacaagactctgaatgaggccgattgtgccaccgtgccgccagccatccggtcatattag

SEQ ID NO: 31016 - DNA, 6644 bp, Artificial Sequence
  Description of Artificial Sequence: Synthetic coding sequence
atgaagcggaaggaacgaatagctaggagactcgaggggatagaaaatgatacacagcccatcctccttcagtcatgcacagggttggtcacacaccgcctgcttgaggaggacacgccccgatatatgagggcctctgatcccgcttctcctcacatcggcagaagcaatgaggaggaggaaactagcgactctagtttggagaagcaaaccagatctaaatattgtaccgaaacatctggggtacatggagattccccatacgggagtggaaccatggatacccactctctggagagcaaggctgagaggatcgcgagatataaagcggagagacgccgacagttggccgagaagtacggcctgacgttggacccagaggcagatagtgaatacctctcacggtatacgaaaagccgaaaagaacccgatgccgtggaaaagcggggaggaaaatcggacaagcaggaagaatccagtcgcgacgctagctcgttgtacccgggaacagagaccatgggcctgcgaacgtgtgctggcgagtcgaaggattatgccctgcacgtgggggacggaagctcagacccagaggtgcttctaaatatcgaaaaccagagacgcggacaagagcttagcgctacacggcaagctcacgacttaagtccagcagctgagtcaagcagcacattcagcttttccggtagggattccagtttcacagaagtccctcgcagtccgaaacatgcccacagttcttctttgcagcaggccgcaagcagatcgccctcctttggagatccccagctgtctccggaggccagaccttctaccggcaaacctaaacacgagtggttcctccagaaagattcggaaggcgacacgccatcgctcattaattggccatctcgggtgaaggtgcgcgaaaagcttgtcaaggaggagagtgcaaggaactcaccagagctcgcctctgaatccgtcacccaaagaagacatcagcccgcaccagtacattatgtgtcctttcagagtgagcactcagcatttgacagggtcccttctaaggccgcaggaagcaccagacagcccattcggggatacgtccaacctgccgatacgggtcatacagccaaactcgtcacacccgagacacctgagaatgcctcggaatgtagctgggtggcgtccgccacacagaatgttcctaagccaccttctctcacagtcttggagggcgatgggagggactcgcccgtcctccacgtatgtgaatccaaagctgaagaagaggagggagagggagaaggcgaagaaaaggaagaggatgtatgcttcactgaggccctggagcagtctaagaaaaccctactggcccttgaaggtgatggactcgtgcgcagccccgaggaccccagcagaaacgaggactttggcaagccagctgtgtccaccgtgacactggaacaccagaaggagttggaaaatgtcgcccagcccccacaggcaccacatcagcctaccgagcgaacagggcgatccgagatggtgctgtatattcagtccgaacctgtttctcaggatgcaaagcctaccggtcataaccgcgaagcttctaagaagaggaaggtgagaacccgatcactcagcgattttaccggccctccacagctacaggccttaaagtacaaggacccagccagccggagagaattagagttaccctcctccaagactgaaggaccttacggagagatctcgatgctagacactaaggttagcgttgcacagcttcggtcagcgttcctagccagtgccaacgcgtgtagaaggcccgagctaaaaagtagagtggaaagatccgctgagggccctggcctccccaccggggtggaaagggagcggggatctaggaaaccccgtaggtattttagccccggagagtcacggaagaccagtgaacggttcagaacccaacccattacatccgcagaaaggaaagagtcagatcggtgcactagtcactctgagacaccaaccgtggacgacgaggagaaggtcgacgaaagagccaagctgagcgtggcagctaaaagacttctgtttcgtgagatggaaaaaagttttgacgagcagaatgtcccaaaacggcgaagcagaaacaccgctgttgagcagaggttacggaggttgcaggatcgcagcctgacacagccaattaccacagaggaggttgtgattgctgccacagagcccattcctgcctcatgcagtggcggaactcatcccgttatggcaagactaccttcaccaaccgtggcccgatctgccgtccagccagcccgattgcaggcctcagctcatcagaaggccctggccaaggaccagacaaacgaaggaaaggaactggctgaacagggcgagccggacagctcaacactctccctcgcagaaaagctggcgttgttcaacaagctgagtcagcccgtgtctaaggctatctctactagaaaccgcattgacacccgccagcgccgaatgaacgccaggtaccaaacccagcctgtcacgctgggcgaagtggagcaggtccaaagcgggaagctgatccccttcagtcccgcagtgaatactagtgtgtcaaccgtcgcatccacagtggcgcctatgtacgcgggtgacctgaggactaagccaccactcgaccacaatgcgagcgccacagattacaagtttagttccagtatagaaaatagtgacagccctgttcgcagcatcctcaaatctcaagcatggcaacctctggttgaaggctctgagaacaaggggatgctgcgagaatatggcgagaccgagagtaaaagggcgctgaccggaagagactccggaatggagaaatacggctctttcgaggaggccgaagcatcttatcctatcctgaatcgcgctcgcgaaggcgacagccacaaagaatccaaatacgcagtgcctcggagaggaagtctcgagcgggctaacccccctatcacccacctcggagacgagccaaaagagttttcaatggctaagatgaatgctcagggaaacctggatctgcgagatagactccctttcgaggagaaagtggaagtggaaaatgttatgaagcggaagttctccctgcgtgccgctgagttcggggaaccaaccagtgaacagacaggaacagctgctggcaagaccatcgcacagactactgcaccggttagctggaagccccaagattcaagcgaacagccacaggagaaactgtgcaagaatccttgcgctatgtttgctgcgggagagatcaagactcccaccggggagggattgctggactcaccctccaagaccatgagcattaaagaacgactggcccttcttaagaaatctggagaggaagactggcggaaccgcctcagtcgcaggcaggagggaggtaaggctccagcgtccagccttcatacccaggaagccggaagaagcctgatcaaaaagagggtcaccgagtcccgggaatctcagatgaccatagaggagagaaaacagctgatcactgttagagaagaagcttggaagactaggggcaggggggcagctaatgattcaacccaattcacggtggctgggcgtatggtgaagaagggcctcgcctcccctaccgctatcacaccggtggccagccctatctgcggaaaaacccgaggtacaacacccgtttctaaacccctcgaagacatagaagccagacctgatatgcagctggaatccgacctcaaactcgaccgattggaaactttcctgaggaggttgaacaacaaggttggaggcatgcacgagacggtgctgactgtaaccgggaaaagcgtcaaagaagtgatgaagccagacgatgatgagacctttgcaaagttttaccggagcgttgactacaacatgcctaggagtcccgtagaaatggacgaagactttgatgtgatttttgacccgtatgcacctaaacttacatcgtctgtggccgagcacaaacgcgcagttcgcccaaaaaggcgggtgcaggccagcaagaaccccttgaagatgctggccgcaagggaggatctgctacaggagtataccgagcagcggctaaacgttgcgttcatggagagcaagaggatgaaggtcgagaaaatgtcctccaactctaacttttctgaggttaccctggctgggcttgcgtccaaagagaacttcagcaacgtcagtctgcgctccgttaatctgaccgagcagaattctaacaacagcgcggtgccctacaagagactcatgcttctgcaaattaaaggcaggcgccacgttcaaactagactggttgagcctagagccagtgctctgaacagcggcgactgttttcttctgctgagccctcattgctgcttcctgtgggtgggcgagtttgccaacgtgattgaaaaggccaaggcatcagagctggctacactgatccagacaaaaagagagttgggatgcagggccacttacatccagaccatcgaggagggtatcaatacccacactcacgctgcaaaggatttctggaagcttctcggtggccagacgagttaccagtccgcaggcgacccaaaggaagatgaattgtatgaggccgctattatagagaccaactgcatatatagactgatggacgacaagctggtgcccgacgacgattattggggaaagatcccaaaatgttctttgttgcaaccaaaagaagtgttggtgttcgactttggatctgaggtttatgtctggcacggtaaagaggtcaccctggcccagcggaaaatcgcatttcagcttgcaaagcatctgtggaacggaacctttgactatgagaattgcgacatcaatcctctggaccctggagaatgtaatccgttgatcccacgaaagggacaaggacggccagattgggccatctttggcagactgaccgaacacaacgagaccatcctgtttaaggaaaaatttctggattggacagagctaaagagatctaatgagaaaaacccaggagagctcgcccagcacaaagaagacccgagaacagacgttaaagcatacgacgtcactcggatggtctccatgccacagaccactgccggaaccatactggatggcgtaaacgttggaagggggtacggattagtggagggccatgatcgaagacagttcgaaatcacctcggttagcgtggatgtctggcacatcctggagtttgactattcacgcctgccaaaacagtccattggtcaatttcatgagggagatgcttacgtcgtaaagtggaaattcatggtgtccacagctgtgggttcaagacagaaaggtgaacacagcgtgagggccgctggaaaggagaagtgcgtctacttcttttggcaaggccgacactcaactgtgtcagaaaaggggacctctgctttgatgacagtggaactggacgaagagcgaggtgcccaggtgcaggtgctccagggcaaagagcctccatgtttcctgcagtgctttcaaggagggatggttgttcactccggtcggagagaagaggaggaagagaacgtgcagtcagaatggagactgtactgtgtcaggggagaagtccctgtggagggcaatcttctcgaggtggcatgccactgtagctcgctgagatcaagaacaagcatggtggtcctgaatgttaacaaggccctgatttatctttggcacggatgcaaagcgcaggcccataccaaggaggttggacggacggcagccaataaaattaaggaacaatgccccctcgaagctggattgcattcttcaagtaaggtgactatccacgaatgcgacgaggggagcgaacctcttggattctgggatgctctgggccgtcgcgacagaaaagcttatgactgtatgctgcaggatcccggttcatttaatttcgcaccaaggctgttcatactgtcgtccagtagcggagactttgccgcaaccgagttcgtgtaccccgcacgggctccctctgtggtgtccagcatgccttttcttcaggaagacctgtatagtgctccgcaaccagcgctctttctcgtagacaaccaccatgaggtgtatctgtggcagggctggtggccgatcgagaataaaattaccggttctgctcgcattcggtgggcgtccgacagaaaatctgccatggaaaccgtccttcaatattgtaagggaaaaaacctgaagaagcccgctccaaaatcttacctaatccacgctgggctcgagcctttaacattcacaaacatgttcccttcttgggagcatcgggaagatattgccgagattactgagatggacacggaggttagtaaccagatcacgctcgtcgaggacgtgttggcaaagttatgtaagaccatctatccgctggcagatttactggccaggcccctgcccgaaggagttgacccactgaaattggaaatttatcttaccgatgaagacttcgagttcgccttagacatgacaagagacgaatacaacgcgttaccagcctggaaacaagtcaaccttaagaaagctaagggcctatttta

SEQ ID NO: 31017 - DNA, 6644 bp, Artificial Sequence
  Description of Artificial Sequence: Synthetic coding sequence
atgaagcgcaaggagcgaatcgccagacggctagagggcatcgagaatgatacacagccgatcctactgcagtcatgtactggccttgtcacacataggctcctggaagaggacacccctcgctacatgcgagccagcgatccagccagcccccatatcggcaggagtaatgaggaggaagagaccagtgactctagcctcgagaagcaaacccgctcaaaatattgtaccgagacatcgggcgtgcacggcgactcaccctatggaagtgggacgatggatactcactcattagagagcaaggctgaacgaatcgccagatataaggccgagcgaagacgacagctggctgagaaatatggacttaccctggacccggaggcggacagcgagtatctatcgcgatacaccaagagtagaaaggagcccgacgccgttgagaagcggggaggcaaatcagacaaacaagaagagtcctcgcgagatgcgtcatccctctaccctggaacagaaactatgggcttgaggacttgtgccggagagtcaaaggattacgccttgcatgtaggcgatgggagtagtgatccggaagtactcctcaatatcgagaatcagcggcgtgggcaagaactgtcggcaacgcgacaggctcacgacctctcacccgctgctgaatcatcttctaccttttcattctctggaagagattcctctttcacagaggtcccacggagtcccaagcacgcccattctagcagcttacagcaggccgcttccagatctccctccttcggcgatccacaactttctccagaggccaggccttccacaggcaagcccaagcacgaatggtttctccagaaggacagtgagggtgacaccccatctctcattaactggccctctcgagttaaggtgcgggagaagctggtcaaggaagagagtgccaggaactcacctgagctggcctctgagagcgtcacccaaaggcgccaccagcccgcaccggtgcactatgtttcctttcagtccgagcacagcgcgttcgatagggttcctagtaaggcagcaggaagcacacggcagcctatacggggatatgtgcaaccggctgacacagggcataccgccaaattggtaaccccggagacgcccgaaaatgcaagcgaatgtagctgggtggcgtctgcaacacagaatgtgcctaagcccccttccctgaccgtcctggagggcgacgggagagactctcccgtgctgcatgtctgcgagtctaaagccgaagaagaggaaggggaaggagagggcgaagaaaaagaagaggatgtgtgctttactgaggcccttgaacaaagtaagaaaacactgttggcactcgagggggatggcctagtgcggtccccagaagatcccagtcgaaacgaagattttggaaagccggcagtgtctactgtgaccctagagcaccagaaagagcttgagaacgtggcacaaccacctcaggcaccccaccagcctacggaaaggaccggtagatccgaaatggttctatacatccagagcgagccagtgtctcaggatgctaaaccaacaggacataatagagaagcgtccaaaaagaggaaagtacggacacgaagtttgagtgacttcacgggacctccccagttgcaggcactaaagtacaaggatccagcatctcgaagagaactagaattgcccagttcaaaaacagaagggccatacggggagatatccatgctagacactaaggtctccgtcgctcagttaaggtcagccttcttggcctcagccaatgcctgccgcagacccgaactgaagagccgcgttgaacggagcgctgagggccctgggctgcccacaggcgtggagcgggaacggggttctaggaagccacggaggtatttttctcccggtgagtcccgcaagacctcagaaagattccggacccagccgataacaagtgcagagaggaaggaaagtgaccggtgtacctctcattctgaaactcccaccgtggatgacgaggaaaaggtggatgagcgggctaagctaagtgtggccgcaaagaggttactgttccgcgagatggagaagtcttttgatgagcaaaacgtccccaaacggaggagccgcaacaccgcggtcgagcaaaggttgcggcgtctccaggatagaagtttaactcagcccataacaaccgaggaggtggtaattgcggctacagagccaataccagctagctgttccggcggaactcatcccgtcatggccaggcttccgagtcctacagtcgccaggtctgctgtacagcccgctaggcttcaggcttccgcccaccagaaggccttggcaaaggaccaaacgaacgagggtaaggaactcgcagagcagggagagccagatagctctacgttgtctttggctgaaaaactggctttgttcaataaactgtcacagcccgtctctaaagccatcagcactaggaatcggatcgacacgcgtcagcgcagaatgaatgccaggtatcagactcagcccgttacacttggcgaggtggagcaagtgcaatccggaaagctgatcccttttagccccgcagtgaacacctcagtgtcgaccgtagctagtactgtcgctccaatgtatgccggtgatctaagaactaaacctccgttggaccataatgcctcagctaccgattataagttctcaagttctatcgagaatagcgattcccctgtgaggagcattctgaaaagccaagcctggcagcctctcgtcgagggatctgagaataaaggcatgctgcgggagtatggcgaaacagagtcaaagagggccctgaccggccgagattccggcatggagaagtacggatcctttgaagaagcagaagcatcttaccccatactgaaccgagcccgagaaggagatagtcataaggaatctaagtacgccgtcccaaggcggggtagtcttgaacgagcaaacccaccgatcacgcatctgggcgacgaacctaaggagttcagtatggccaagatgaatgcccagggaaacttggatctgcgggatcgtttgccatttgaggagaaagttgaagtcgaaaacgtgatgaagaggaagttctcgctacgtgctgcagagttcggtgagcctaccagtgaacagaccggcacagctgccggaaaaaccatagcccagaccaccgctcctgtcagctggaaacctcaggattccagcgagcagccccaagagaaattgtgcaaaaatccatgtgctatgttcgccgcaggagaaatcaagacaccgaccggcgaaggcctactggactcacccagcaaaactatgtcaatcaaagagaggcttgctctgctgaaaaaatcaggagaagaggattggaggaatagactgtctcgccgacaggaaggagggaaagctcctgcaagctcgctgcacactcaagaggccggacggtcccttatcaagaagagggtcactgagagtcgggagtcacagatgactattgaagaacgtaaacaacttatcaccgtgagggaggaggcctggaagactaggggacgaggggctgccaacgatagtacacaatttactgtggctggcagaatggttaaaaagggtttggcatctccgacagcaatcaccccagtggcgagcccgatctgcggaaaaacaaggggcacgactcctgttagcaaacctctggaggacattgaagcaagacctgatatgcagctggagtccgatctgaagctcgatcggcttgagactttcctgaggaggttgaataacaaggtcggcggtatgcacgaaacagtgctcactgtgaccggtaagagcgtcaaggaagtgatgaagccggatgatgatgagacttttgctaagttctacagatcagtggactacaatatgcccagatcgccagtggagatggacgaggatttcgatgtcatctttgatccctacgctcctaagttgaccagttccgtcgccgaacataaaagggccgtaagacccaagcggcgagtgcaagcaagcaaaaaccctttaaagatgttagccgcacgggaggacctcctacaggagtacactgaacagaggctgaatgtggccttcatggaatctaaaaggatgaaggtggagaagatgagctccaactcaaacttcagcgaggtgactctggctggcctggctagtaaagaaaatttctcaaatgtgagcctgaggagtgtgaatctgactgagcagaattccaacaatagcgcagtgccgtacaaaaggctcatgctgctgcagatcaagggacggagacacgtgcagacaaggctggtggagcctcgggcaagcgccctcaattcaggggattgtttcctgctgttgagcccccattgttgtttcttatgggtgggcgagttcgccaacgtgatcgagaaggctaaagcatcggagctggctaccttaattcagactaagcgcgagttaggttgtagagccacctacattcagactattgaagagggtattaatacacacactcacgccgctaaagatttttggaagctccttggcggtcagactagctaccagtctgcaggggacccgaaggaagacgaactctacgaagcagccatcatcgagaccaattgtatctacaggttgatggacgataaacttgtgcctgacgatgattactggggcaagataccaaaatgcagcttgctgcaacctaaagaggtgctggtgttcgatttcgggagcgaggtctacgtgtggcatggcaaggaagtaacattagctcaaaggaaaatcgccttccaactggcgaaacacctttggaacgggacttttgactatgagaactgtgacattaatccgttggatcccggtgagtgcaacccccttatcccgaggaaagggcaggggcgtcccgattgggccatatttggtcgcctcacagagcataacgagaccatcctcttcaaggaaaaatttctagattggaccgagttaaagcgctcaaatgagaagaaccctggggaattggcccaacataaggaagaccccaggactgatgttaaggcttatgacgttacacggatggtctctatgccacagacaaccgcaggcacaatcttggatggagtgaatgtgggaaggggatatggactggtagagggtcacgaccgcagacagttcgagatcaccagcgtttctgtggatgtgtggcatattctggagtttgactattcacggctgcccaaacagtcaatcggccagtttcacgagggggatgcctatgttgttaaatggaaatttatggtgagtactgcggtgggatctagacaaaagggagagcacagcgtgagggccgcaggaaaggaaaagtgtgtgtacttcttctggcaaggcagacacagcactgtgagcgaaaaggggacctcagccctcatgacagttgagctggacgaggagcgcggtgcccaagtgcaagttctacaagggaaggaaccgccatgttttctgcagtgtttccaggggggtatggtggtccactccggccgaagggaggaggaggaggagaatgtgcagtcagagtggcgcttgtactgtgtacgtggcgaagtgcctgtcgaaggtaacctcctggaagttgcatgtcactgctctagcttaagatcacgaacatccatggtggttctgaacgtgaataaggcgttaatatatttgtggcacggctgcaaggcccaagcccacaccaaagaagtcggacggacagctgccaataagatcaaagagcaatgccccctggaagcagggctgcactcctcaagcaaggtgactatccatgagtgcgacgagggttccgagcctcttggattctgggatgccctcggccgtcgcgaccgcaaagcttatgattgtatgttacaggacccaggcagcttcaactttgcacctcgactgttcattctctcatctagttctggcgatttcgctgccacagagttcgtgtaccctgcacgcgcacctagcgtagtcagttcaatgccctttctacaggaggatctatatagtgcacctcagcctgcccttttcctggtagacaaccaccacgaagtatatttatggcagggatggtggccaattgagaataaaattactggctccgcgcgaatcagatgggcttcagatcgtaagtcagccatggaaactgtcttacagtactgtaaagggaagaacttgaaaaagcccgcacctaagtcttacttgattcacgccggacttgaacccctgacatttacaaacatgttccctagctgggaacaccgcgaagacatcgccgagatcacggaaatggacacagaggtgtctaatcagattaccctggtggaggatgtgctggcgaaactgtgtaaaacaatctacccgctcgcagacctgctcgcccgaccccttcctgaaggagtagaccccctgaagcttgaaatttatctcactgacgaagatttcgagttcgctctggatatgacccgtgacgagtataatgccttgccagcatggaaacaggtgaaccttaaaaaggctaagggcctattcta

SEQ ID NO: 31018 - DNA, 5367 bp, Artificial Sequence
  Description of Artificial Sequence: Synthetic coding sequence
atgaagcgaaaggagcggattgccaggcgtctcgaaggcatcgagaacgatacacaacccatccttctccagtcttgcaccggcctagtgacccacagactactagaggaggatacacctaggtacatgcgtgcaagtgatcccgctagtccacacatcgggcgttcaaacgaggaggaggagacgtctgattcaagtttggagaagcagacccgctccaagtattgtactgagacatctggtgtgcatggtgactcaccctatgggagcggaaccatggatactcactccctcgagagtaaggccgaacgaatagccaggtacaaggcagaaaggcggcgtcaacttgccgagaagtatggtctgaccctggatcccgaagcagacagtgagtatctatctcggtacactaaaagcagaaaggaacctgatgccgtggagaaacggggaggaaagtccgataaacaggaagagagcagccgcgatgcatccagtctgtatccaggcactgagacgatggggcttcgcacctgcgcaggagagtcaaaggactacgcgctgcatgtgggggacggttcttcagaccccgaggtattattgaacattgaaaaccagcgacggggacaggaactcagtgcaaccagacaggctcatgatctctcgccagcagcagagagcagttcaacattctcctttagcggcagagacagtagtttcactgaggttcccaggagtcccaagcatgcccacagctctagcctgcaacaggcggcatcccgatctccaagctttggagatccacagcttagtcccgaagcgcgtcccagatgtaccagccattccgagacacccaccgtggacgatgaggaaaaagtggatgagcgcgcaaaattgagtgtggccgcaaaaaggctcctgttccgggagatggagaagtctttcgacgagcaaaatgtacccaaaaggagatctaggaataccgcagtcgagcagaggttgcggagattgcaggatcgttctctgactcaaccgattaccacagaggaagttgtcatcgccgcaacactgcaggcgtccgcacaccagaaggccttggctaaagaccagaccaatgagggcaaggagcttgccgagcagggggaacctgatagttccaccctgagcctcgccgagaagctcgctctgttcaacaaactgtcccagcctgtctctaaggccatttcaactcgcaacagaatagatactcggcagcgcagaatgaatgcaaggtaccagacacagcccgtcacgttgggagaggtcgaacaggtccaaagtggcaagctgatcccattctcccctgctgtgaacacatcagtgtcgactgtggctagcactgtcgcccctatgtacgctggcgacctcagaaccaagccacctctcgatcacaacgctagcgcaacagattacaagttctctagtagcatcgagaatagtgatagcccagtcagatctatactcaagtcccaagcgtggcagcccctagtggaaggctccgagaacaaaggtatgttgagggaatacggggagactgaatccaaacgagccctcaccggccgtgactcaggcatggagaaatatggcagcttcgaggaggccgaagccagctaccccattctgaatcgggctagggagggggattctcacaaggagagtaagtatgccgtgccacgtcgcggtagcttggaacgagcgaacccccctatcacacatcttggagacgagcctaaggagttttccatggctaaaatgaatgcccagggaaatctcgatctgcgggatagactgcctttcgaggagaaggtggaagtcgagaacgtcatgaagcggaagttctctctccgggctgccgagtttggcgagcctacatctgaacaaactggcactgccgctggcaagaccattgcacaaaccaccgccccagtatcctggaagccccaggactcttcagagcagcctcaggaaaagttgtgtaagaatccctgcgccatgttcgcggctggggagatcaaaacacctactggtgagggcctgctcgactccccatcaaagacaatgtcaatcaaggaacgtcttgctctattgaagaagtctggagaggaggactggagaaatcgcctgtctagacgccaggagggagggaaggcacccgcatcctcactgcatactcaggaggcaggcaggtccctgatcaagaagagagttaccgaaagcagagaatcacaaatgacaatcgaagagcggaaacagctgattactgtccgtgaggaggcgtggaaaactaggggcagaggtgctgcaaacgactccactcaattcactgtcgctggcaggatggttaaaaaaggactcgcaagtccaaccgccatcacacccgttgcctcgcctatatgcggtaagaccaggggaaccacaccggtttcaaagcctcttgaagatattgaggcgcgtcccgacatgcaactggaaagtgacctgaaactggatcggctggaaactttccttcgacgacttaacaacaaggtgggaggtatgcatgagactgtcctgactgtcaccggtaagtcagtcaaagaagtgatgaagcccgatgacgatgagaccttcgcgaaattttatcgctccgtcgactacaatatgcctagatcccccgttgagatggatgaggattttgacgtaatattcgacccatacgcccctaagctgacctcaagcgtcgccgaacataagcgggcagtacggccaaaaaggcgagtgcaggccagtaaaaacccgctcaagatgttagctgcccgagaggatctgctgcaggaatatactgagcagaggctgaacgtggccttcatggaatccaagagaatgaaggtcgaaaagatgtcatcaaacagcaattttagcgaggtcacactggctggcctcgcaagcaaggaaaatttttcaaatgttagcctgcgtagtgtcaacctaaccgaacagaacagtaacaactccgccgtcccatacaaaaggctgatgctgctccagattaaaggacggaggcatgtccaaactcggctggtggaaccacgcgcttccgcactcaacagcggcgattgtttcttgttgctaagcccccactgttgttttctgtgggtcggagaatttgcgaacgtaatcgagaaggccaaggccagcgagcttgcaacgctcattcagactaagcgggagcttggttgcagagccacctatattcagactatcgaagaaggaattaatacacacacacacgctgcgaaggatttctggaagctcttagggggacaaactagttatcagagcgccggagatcctaaggaagacgaattgtatgaagcagctatcatcgagaccaattgcatctatagattaatggacgacaaactcgtccccgatgacgattattggggcaaaattccaaagtgtagccttcttcagccaaaggaggtgttggtctttgattttgggagtgaggtatatgtgtggcacggaaaagaagtgaccttggcccagcggaagatcgcattccagctcgccaaacacctctggaacggcacctttgattacgagaattgtgatatcaatcctctcgatcctggcgagtgcaaccccctgatcccccgaaaaggtcagggtaggccggactgggccattttcggcagactgacagaacacaatgagacaatccttttcaaagagaagttcttggactggacagaattaaagagaagtaacgaaaaaaacccaggagagcttgcacaacacaaagaagaccctcgcaccgacgtaaaggcctatgacgtgacacggatggtgtccatgccgcagacaacagcaggcactatcctcgacggagtcaacgtgggcagaggttacggactcgtggaggggcatgaccgtcggcagtttgagattaccagtgtgtctgtagacgtctggcacatcctggagttcgattattctaggctgcctaagcagagcatcgggcaattccatgaaggagatgcatacgtggtaaagtggaagtttatggtcagcaccgcggtgggttcaagacagaaaggggaacattctgtgagggccgctgggaaggagaaatgcgtctactttttctggcagggcagacatagtactgtttccgaaaagggaacctcagcactcatgaccgtggagctggacgaggagaggggtgcacaggtccaggtactccagggcaaagagcccccatgcttcctccagtgttttcaggggggaatggtggtgcatagtggcagacgagaggaagaggaggaaaacgtgcaatcagagtggcgactgtactgcgtccgcggagaggtacccgtggaggggaacctgttggaggtggcctgtcactgctcttccctgcgatcaagaacttctatggtggtgcttaatgtgaacaaagcattgatctatctgtggcatgggtgtaaagcccaagctcacactaaggaagtaggaagaactgcggctaataagatcaaggaacagtgccccctggaggcaggactgcactcaagctctaaggttactatacacgaatgcgacgaaggaagcgagccattgggattttgggatgctctgggacgtcgcgatcgaaaagcctatgattgcatgctgcaggacccaggttcctttaattttgctcccaggctgttcattctgtctagctcatctggggatttcgccgcaacggaatttgtctaccccgcacgcgctccttcagtagtgtcctcgatgccgtttctgcaagaagacctgtattctgcccctcagcctgctttgtttttagttgacaatcaccacgaggtctatttatggcaggggtggtggccaattgagaacaaaatcaccggatccgctaggatccgttgggcttcagacagaaagagtgctatggaaacggtgctgcaatattgcaaggggaagaatctgaagaaacccgcacccaaatcctatctaattcacgccggactcgagccactgaccttcaccaatatgttcccgtcatgggagcatcgcgaggacatagccgagatcaccgaaatggacaccgaagtatcaaatcaaattactttggttgaagatgtattggcgaaactgtgcaaaactatttatccgctggccgacctgctggctaggcccctgccggaaggtgttgacccactaaagctcgaaatttatctgacagacgaagatttcgaatttgccctggatatgactcgcgatgaatacaatgcacttcctgcttggaaacaagttaacttgaaaaaggctaagggcctcttctag

SEQ ID NO: 31019 - DNA, 3387 bp, Artificial Sequence
  Description of Artificial Sequence: Synthetic coding sequence
atgttcgctgccggtgaaattaaaaccccgaccggtgaaggcctgttggatagtccaagcaaaacaatgtcaatcaaggaacgcctggccttattgaaaaagtccggggaggaggattggagaaatcgattgagcaggcggcaggagggtggaaaagcgcctgccagttccctgcacactcaagaagctggccgttccctcatcaagaaagaggaggggggtgttgccgacgattcggccataagcaacctcctctggcgggtcaccgaatcacgcgaatctcagatgaccatcgaagaaagaaaacaactgatcactgtccgggaagaggcgtggaaaacccgaggcaggggtgctgcaaatgactctactcaatttacagttgccggaaggatggttaagaaggggttggcctcccctaccgccatcaccccagtggccagtccaatctgtggtaagaccagaggtaccacaccggtgtcgaagcctctggaggatattgaggccaggcctgacatgcagctcgaatccgatcttaaactggatcgattggagactttccttcgcagactgaataataaagttggagggatgcacgaaactgtccttactgttactggcaagagtgtgaaggaagtaatgaaaccagacgacgacgagacctttgctaaattttacaggtcagtggactacaatatgcctaggagcccggtggaaatggacgaggacttcgatgtaattttcgatccatacgcccctaaactgaccagcagtgtggccgagcataaaagggccgtgcgccctaagcgccgagttcaggccagcaagaacccactaaaaatgctggcagcccgagaagatctgcttcaggagtacacagaacagcggttaaacgttgctttcatggagtctaagagaatgaaggtagagaagatgtcctctaattccaatttctcagaagtaactctggctggactggcttccaaggagaatttcagtaacgtgagtctgcggtcagtcaatctgacagaacagaactccaataactccgccgtaccctataagaggctaatgctgctgcagatcaaagggaggcgacacgtgcaaacaaggctcgtggaacctagagctagcgccctgaactctggcgactgctttctgctgctgtcacctcactgttgcttcttgtgggtgggggaatttgccaacgtgatcgaaaaggcgaaagcaagtgagctcgcaactttaatccaaaccaagagggagcttggatgtagagccacctacattcagaccatcgaagagggtattaatacccacacccacgctgccaaagatttctggaaactcttgggcggacagacttcgtaccagtcagctggagatccaaaggaggatgaactgtatgaagccgctatcatcgagaccaattgtatctatcggctcatggacgataaacttgtgcctgacgacgactactggggcaaaataccaaagtgctctctgctgcaacccaaggaagttttggtgtttgattttggctccgaagtctatgtttggcacgggaaggaggtgacactggcacaaagaaagatcgcattccaactggctaaacacctgtggaacggtacattcgactacgagaattgtgacataaatcctctcgatccaggcgagtgtaatcctctgatcccacgcaaaggacaggggaggcctgattgggccatcttcggaaggctcactgaacacaacgaaacaattttgtttaaagagaaatttctagattggactgagctcaaaaggtccaatgaaaagaatcccggtgagctcgcccagcataaagaggaccctaggaccgacgttaaggcatacgacgtgacaagaatggtgagcatgccccaaactaccgcgggaacgattctggatggagtcaatgtcggccgagggtacggtctggtcgaagggcacgatagaagacagtttgaaatcacaagtgtcagcgtggacgtttggcacatactggagtttgactactctcggcttcccaagcagtcaatcggacagttccacgagggagatgcatatgtcgtcaaatggaagttcatggtaagcaccgcagtgggttctcgccagaagggcgagcactcagtaagagctgccggtaaggaaaaatgtgtgtattttttttggcagggcaggcactcaacagtgtcggaaaaggggacgagtgccctaatgaccgtggaactcgacgaggagcgtggtgcacaggtgcaggtccttcaagggaaggaacctccgtgctttctccagtgttttcagggcggaatggtagtgcacagcgggcgacgggaggaggaagaggagaatgtgcagtccgaatggaggctctactgtgtcagaggagaggtgcctgtggaaggcaatcttttggaggtggcttgtcactgctcatccctacgctccagaacaagtatggtcgtgctcaacgtgaataaagctttaatctacctgtggcatgggtgcaaggcacaggcccatacaaaagaagtcgggagaaccgccgctaacaaaatcaaggaacagtgccccctggaagccggactccactctagcagcaaagttaccatccatgagtgtgatgagggatctgagccattggggttttgggatgccctaggtaggcgcgaccggaaagcctatgactgtatgttgcaggaccccggaagcttcaattttgccccacgacttttcattctctccagcagctctggggatttcgcggctacagagtttgtgtaccccgctcgcgcaccctcagtcgtctccagtatgccatttctccaggaagatctgtattcagcacctcagcccgctctgttcctggtcgataatcaccacgaggtttatttgtggcagggatggtggccgatcgagaataagattaccggatccgccaggatccggtgggcatctgaccggaagagtgccatggagaccgtactccagtattgcaagggcaaaaatctgaaaaagccggctcccaaaagttatctaatccatgccggactagagccactaacatttacaaatatgtttccaagttgggagcaccgtgaggatatcgctgaaattaccgagatggatacggaagtcagcaatcaaatcaccctggtcgaagacgtcctggccaagttgtgcaagactatctaccctctagccgacttgctggcaaggcccttgccggagggagttgatccccttaaattggagatctatctaacagacgaggactttgaatttgccctggacatgacgcgcgatgagtacaatgccttgccagcatggaagcaggtgaacttaaagaaggccaagggcctgttttag

SEQ ID NO: 31020 - DNA, 2301 bp, Artificial Sequence
  Description of Artificial Sequence: Synthetic coding sequence
atgaaacgaaagttctctctgcgagctgccgagtttggtgagccaacaagtgaacagaccgggactgccgctgggaagacaatcgcccagactactgcgccagtgtcctggaaacctcaggattcgtctgagcagcctcaggagaagctgtgtaagaatccctgcgcaatgtttgccgctggcgaaattaagacccctacgggggagggcttgctcgatagcccttccaaaacaatgtccattaaagaaaggctggcactcctgaagaaatctggcgaagaggactggaggaatagactttcacggaggcaggagggtggcaaggcccctgccagctcccttcacacccaagaggccggtaggtctctgataaaaaagagggtcacagagagtagagaatcccagatgacaatagaggagcgcaagcagctcatcaccgtccgggaggaggcctggaagaccaggggcaggggagcagctaatgacagcacccagttcaccgtagcagggaggatggtaaaaaaagggctggcttcacctactgcaataacccctgtggcgtcccctatttgtggcaaaacaaggggcaccacaccagtgagcaagccgctagaggacatagaggcaaggcccgatatgcagcttgaaagcgacctgaagctggacagattggaaacttttcttagacggttaaataataaagtgggagggatgcatgagacagttttaaccgtgactgggaagagcgtgaaggaagtaatgaaaccagatgacgatgagacatttgccaagttttacaggtccgttgactacaacatgcccagatctcccgtggagatggacgaggacttcgacgtcatttttgacccgtatgctcctaaattgactagctctgtcgcagaacacaaacgagcagtaagacccaagaggcgcgtgcaggcctcaaaaaacccccttaaaatgctcgccgcaagagaggacctgctccaggagtacactgagcaacggctgaatgtggcctttatggaatcaaaacgtatgaaggtagagaagatgtcctcaaacagcaacttttcagaagtgacgctggccggactggcaagcaaggaaaattttagcaatgtctccctgcgctctgttaatctgactgaacagaatagcaataatagtgctgtcccatataaacgactgatgcttttgcaaattaagggaagacggcatgttcagacccgccttgtagagcctagagcaagtgcgctgaactcaggagattgcttccttctcctgtctccacattgctgctttctgtgggtcggcgagttcgctaatgtgattgagaaggccaaggcctccgagcttgcaaccctgattcaaactaaacgagagttaggatgtcgggcaacctatatacagacaatcgaagaggggataaatacccatacccacgccgctaaggacttctggaaattattggggggacagacgtcataccagtctgccggtgatccaaaagaagatgagctgtacgaggctgctattatagaaaccaattgcatctaccgcctcatggacgataaattagtgcctgacgatgattattgggggaaaatccctaaatgtagcctgctacagccaaaagaggtgcttgttttcgacttcggctcagaagtttatgtttggcatggtaaagaagtaacacttgcacagcgcaaaattgctttccagctggcaaaacacctatggaacggcacatttgactacgagaactgtgacattaatcctctggatcccggagagtgcaatccacttatcccacgaaaaggacagggacgcccagattgggccatctttggcagactcactgagcacaacgagaccattttgttcaaggaaaagttcctcgattggacagaactaaagcggtcaaatgagaagaatcctggagaactggctcagcataaggaggacccacgaactgacgtgaaggcatacgatgtcacgagaatggtttcaatgcctcagactacagccggaactatactggatggagtgaatgtcggaaggggctacgggctcgtcgagggccacgaccgaagacagttcgagattacctccgtgtctgttgacgtgtggcacattctagaatttgattattcacgcctaccaaagcagtcaatcggtcaattccatgaaggagatgcatacgtcgtaaagtggaagtttatggtgtcaacggccgtgctgagagcctggcgcggagctcgtggacgagagttcgcaggatcaggactctcattgtag

SEQ ID NO: 31021 - DNA, 1758 bp, Artificial Sequence
  Description of Artificial Sequence: Synthetic coding sequence
atgaattcgagcgatgtgtcatccctgaaacacccttcttccttggcttcaccgacagcaattacacccgtggcatcacctatctgcggcaagaccagaggtacgacccctgtgtcaaaaccgttagaagatattgaagcacgtcccgatatgcaactggaaagcgatctgaaactcgaccggctcgagaccttccttaggcgcctaaataataaagtgggtggaatgcatgaaacagttctgacggtgacgggaaagagcgttaaggaggtcatgaaacccgacgatgacgaaactttcgcgaaattttatcgcagcgtggactacaacatgcccagatcccctgtggagatggacgaagatttcgacgtcatttttgacccgtatgctcccaagcttaccagcagcgtagcagaacataaacgtgccgtgaggccgaaaagaagggtacaggccagcaaaaatcctctcaagatgctggccgctcgggaagacctgctccaggagtacacagagcagagactcaacgtagcattcatggaatcaaaaaggatgaaggttgaaaaaatgtcttctaattcaaacttcagcgaagtgactctggcgggactcgcttccaaggagaattttagcaacgtgtcccttcgctcagtgaacctcaccgagcagaattcaaacaacagcgctgtgccctataaacgcctcatgctcctgcagattaagggaaggcgtcacgtgcagacccggctggtggagcccagagcatcagctttgaatagtggtgattgcttcctgctactctccccacattgctgcttcctttgggttggcgaatttgccaacgtgattgagaaggccaaggcttctgaattggcgaccctaatccagactaaacgtgaactgggctgtagagccacctatatacagacaatcgaggagggaatcaatacccatacacatgctgctaaggacttttggaagctgctgggtgggcagacatcttaccagagcgcaggagatcccaaagaagatgagttgtatgaggccgcaatcattgaaacaaattgcatctacagactgatggacgataagttggtgcctgacgatgattactggggtaaaatcccgaagtgctccctcttgcaacctaaggaggttctcgtgttcgattttggaagcgaagtttatgtttggcatggaaaagaggtcacccttgcacagcgcaaaatcgccttccaacttgcaaagcatttgtggaacggaaccttcgactacgagaattgtgacatcaatcctttagacccgggtgaatgcaaccctctcatccctcggaaaggccagggccgacccgactgggccatcttcgggaggctcaccgagcataacgaaaccatcctgtttaaggaaaagttcttggactggacagagcttaagaggagcaacgaaaagaatcccggagagctggcccagcataaagaggacccgagaacagacgttaaggcttacgatgtgacgcggatggtcagcatgcctcagacaacggccggtactattctggatggtgttaatgtgggtcgcggttacggtttggtagagggtcacgatcgaaggcagtttgagattaccagcgtgtctgtcgatgtgtggcatattctcgagttcgattactccagattacccaaacaatcaatcgggcagttccatgagggggatgcatatgtagtgaagtggaaattcatggtttccaccgccggttag

SEQ ID NO: 31022 - DNA, 636 bp, Artificial Sequence
  Description of Artificial Sequence: Synthetic coding sequence
atggtagctcataaccaggtggcggctgataacgccgtgagtaccgcagccgaacccaggaggagaccagagccttcctccagctcaagcagttctcctgccgctcctgcccgaccgcgtccatgccccgcagtgcccgctcccgctcccggagatactcattttagaacttttagaagtcatgcagattaccggagaattacaagagcttctgccttgcttgacgcttgcgggttctattgggggcctctaagcgtgcatggtgcacatgagaggcttcgtgccgaacccgttggtacattcttagtcagggactcccggcaaaggaattgcttctttgccctgtcggtgaagatggctagcgggcctacctccattagggtccatttccaagccggaaggttccacctggacgggagcagagagtccttcgattgcctcttcgaattattggaacactacgttgccgctcccagacgtatgctcggcgcaccactccggcaacgacgtgttcggcctcttcaggagctctgtagacagcgtatagtggccactgtcggacgagaaaacctggcaagaattccactgaaccccgtgctacgtgattacttgtccagttttccctttcagatttag

SEQ ID NO: 31023 - DNA, 678 bp, Artificial Sequence
  Description of Artificial Sequence: Synthetic coding sequence
atggtgacacattccaaattccccgctgcagggatgagcagaccacttgatacctccctcagactgaagaccttttcctccaagtcagagtaccaactggtcgttaacgcagttaggaagctgcaggagtcgggattttactggtctgcagttacaggcggtgaggctaacctgctgctgagtgccgaaccggcaggcacctttctcatacgcgatagttccgatcagagacacttcttcaccctgtctgtaaaaactcagtccggcaccaaaaatctgagaatccaatgtgagggtggctcattctctctccaaagcgatccacgtagtacccaaccagtgccgaggtttgactgcgttcttaagctcgtacatcactacatgccccctcctggtgcgcctagctttcccagcccgcctaccgagccttcctcagaggtcccagaacaaccttcagcacagccattgccaggctcacctccgagaagggcttattacatctattctggaggcgagaaaatcccgttagtgttgagccgaccactgagctccaacgtggctactttacagcatctgtgccggaaaactgtaaatggccacctggatagttatgaaaaggtcacacagttgcccggacccatacgagaattcctggaccagtatgacgcccctctgtag

SEQ ID NO: 31024 - DNA, 1302 bp, Artificial Sequence
  Description of Artificial Sequence: Synthetic coding sequence
atggctgagctgagaccttccggtgctcctggcccaacggcaccacccgctcccggtccgacagccccacccgcattcgcttcactgtttccccctggtcttcacgctatctatggcgagtgtaggcgattgtacccagaccagccaaacccactgcaggtgacagctattgtgaagtattggctgggaggcccagatcctctggactatgtctccatgtataggaacgtcggaagcccaagtgcaaacatccccgagcattggcactacatcagctttggcctgtcagacctgtatggagataatagagttcacgaattcacaggcaccgacggcccttcaggttttgggttcgaacttacctttcggcttaaacgcgagactggagaaagcgcccctccgacatggcctgccgagttaatgcagggtctggccagatatgtgttccagagcgagaacaccttttgctctggggatcatgtgagctggcatagccccctcgataatagtgagagcagaatccagcacatgttgctaacggaggatcctcagatgcagcctgtgcagaccccatttggcgtggtcaccttcttgcaaattgttggggtgtgcaccgaagaactgcactccgcccagcaatggaacggccaggggatcctggagcttcttagaacagtgcctattgctgggggaccttggctgatcacggacatgcgcagaggtgagacaattttcgagattgacccgcatttgcaagagagggtagacaaggggattgaaacagatgggtcgaatctatctggggtgtccgccaaatgcgcctgggacgacctgagtagacccccagaagatgatgaagattctcgtagcatctgtatcggtacccagcctcgacggctgtccggcaaggacaccgagcagattcgagagaccctacggaggggcctggagataaactctaaaccggtgctaccccctatcaacccacagcggcaaaacggcctggcacacgatcgtgcaccttcccgcaaagatagcctcgaatccgactcttccacagccattattccacatgaattaatccgtacaagacaattggagtcagtccatttaaagtttaaccaggagtctggcgctctaatccctctgtgtctgcgaggacgcctactccacggtagacattttacatataagtcaattaccggcgacatggctatcacgttcgtgagcaccggagtggagggggctttcgcaacagaagaacacccatatgctgcccacgggccttggcttcagctttag

SEQ ID NO: 31025 - DNA, 1455 bp, Artificial Sequence
  Description of Artificial Sequence: Synthetic coding sequence
atggccgaactgaggccgagcggtgccccaggcccaacagcgcctcccgctcccggacctactgcccctccagcgtttgcgagcttgtttcctccaggccttcatgccatatacggcgaatgtagaaggctgtatccagaccagccgaacccgttacaggtaactgctatagtgaaatactggctcggaggacccgatccactggactatgtaagcatgtacaggaatgttggcagtccatccgcaaatattcccgagcactggcattatatctcgtttggcctttctgatctgtacggtgacaatagagttcacgaattcaccgggacagacggtcccagcggcttcgggttcgaactgaccttccgtctcaagcgggaaacaggcgaatccgctcctcccacatggcctgccgaattaatgcagggtctggctcggtacgtctttcagtccgaaaacacattttgtagtggagaccacgtgtcatggcattcccctcttgataacagtgagtctcgcatccaacacatgctgctcacagaggacccgcagatgcaaccagtgcagacacccttcggcgtggtaacgttcctccagattgtgggcgtttgtaccgaggagctgcattcagcgcagcagtggaatggccaaggaatcctagagttactgaggacggtgccaatcgctggaggcccatggctgattaccgatatgcgacgaggtgaaaccattttcgagatcgatccccatctgcaagagcgggtggataagggcattgaaacggacggaagcaacttgtccggggtctccgctaagtgtgcttgggatgacctgtcaagacccccagaggatgacgaggactctaggagcatttgtataggcactcaaccccgtagactgtcaggcaaggatacagaacagatccgagaaactctgcgacggggactggagattaactccaaaccagtgctgccccctataaaccctcagcggcaaaacggactagcacatgatcgcgctccgtcgaggaaagactccctggagtctgactcctccaccgccatcattccccacgaactcatccggaccagacagttagagtctgtccacctgaaattcaaccaagaatccggcgctctgataccactgtgcctgcggggtcggcttcttcacggcaggcacttcacgtacaagagcattaccggcgacatggctatcacctttgtgagcactggtgtggaaggagccttcgcgactgaggagcacccctacgctgcacacggtccatggctccaaatcttactaactgaagaattcgtggagaagatgcttgaggacctcgaagatctgacttctcccgaggaattcaagctgccaaaagagtattcgtggccagagaagaagctcaaggtcagtattctgcccgatgtcgtcttcgactcaccactgcactag

SEQ ID NO: 31026 - DNA, 240 bp, Artificial Sequence
  Description of Artificial Sequence: Synthetic coding sequence
atggcgaggtcacgactgactgcaacgagcgtgtcccaggtgcaggagaacggctttgtgaagaaactggagcccaagagcgggtggatgacatttctggaagtgactgggaagatctgtgaaatgctcttctgcccagaggctattctcctgacaagaaaagataccccttactgcgaaaccggcctcattttcctcactctgaccaagacgatcgccaacacatacttctacttttag

SEQ ID NO: 31027 - DNA, 240 bp, Artificial Sequence
  Description of Artificial Sequence: Synthetic coding sequence
atggcccgttcgagactgacagccacctctgtgagccaagtacaggagaacggatttgtaaaaaaacttgaacccaaatcaggttggatgaccttcctggaggtgacaggaaagatctgcgaaatgctattctgcccggaggccatactgctgacccgcaaggatactccctactgcgaaacaggacttatattcttaacactgacaaagacaatcgccaatacttacttttatttctag

SEQ ID NO: 31028 - DNA, 1245 bp, Artificial Sequence
  Description of Artificial Sequence: Synthetic coding sequence
atgaacctgcagcgctactggggcgagattcccatcagcagctcccagaccaacagatctagcttcgatctgctgcctcgcgagtttcgactggttgaagttcacgatccccctctccatcagccaagtgctaataaacccaagccccctactatgctggacataccaagtgaaccgtgttctttgacaatccataccattcagctgatccaacataatagaaggctgaggaacctgatcgccaccgcccaagcacaaaaccagcagcagacagagggtgtaaagacggaggagtccgaacctctgccatcctgccctggctctccacctctccctgatgacctgctacccttggactgcaagaatcccaatgccccatttcagattcgacattctgatccagagagtgacttttatcggggaaagggagagccagttaccgaactcagttggcactcttgtaggcaattgctgtatcaggccgtggccactattttggcacacgcaggcttcgactgcgcaaacgagagtgtgttggaaacactgacagatgtggctcacgagtactgtttgaaatttaccaagctactcaggttcgcagtagatcgcgaggctagacttgggcagacaccctttccggacgtcatggaacaggtctttcacgaggtgggaatcgggagtgtgctctctcttcagaagttttggcagcataggatcaaagattaccactcctacatgctgcagatctctaaacagctgagcgaggaatatgagagaatcgttaaccccgagaaagcaacagaggacgccaaacctgtgaagatcaaagaagaaccagtgtctgatatcacatttcccgtttcggaggaactcgaggccgatctggcctccggtgatcagtcccttcccatgggtgtgctgggtgcccagtcagagagatttcccagcaatctggaggttgaggccagtcctcaggcaagctctgcagaggttaacgccagccctctgtggaatctcgcccatgtgaagatggagccccaggaatccgaggaaggaaatgtgtctggccatggcgtgctgggaagcgatgttttcgaagaacctatgtccggcatgtcagaagcaggcattccccagagcccagacgactctgactccagttatggcagccactccacagatagcttgatgggaagctcccctgtcttcaatcagcgctgcaaaaagcgaatgcgcaagatctag

SEQ ID NO: 31029 - DNA, 840 bp, Artificial Sequence
  Description of Artificial Sequence: Synthetic coding sequence
atgaacctgcagagcggaaagggcgagcccgtcactgagctcagctggcattcctgccggcagttgctctaccaggccgtcgccacaattctggcgcacgcaggatttgactgtgcgaacgaatccgtactcgaaacactcacagacgtggcccacgaatattgcctgaagtttaccaagttgttaagattcgccgttgaccgggaggcccgtctcggccagactcctttccccgatgtgatggagcaggtcttccacgaagttggcattgggagcgtcctcagtttgcagaaattctggcagcataggatcaaagattaccacagctacatgctccaaattagtaagcagttgagcgaggagtatgaacggattgtgaaccctgagaaggcaaccgaggacgcaaagcccgtgaagatcaaagaggaacccgtttccgacatcacctttccggtgtcggaggaactcgaagctgatcttgcctctggggatcaatccctgccaatgggagtgctcggcgcacagtctgaaaggttcccgagcaacctggaggtggaagcaagtccccaggccagttccgcagaggtgaacgcgtcacctttatggaacttggcccacgttaagatggagcctcaagaatctgaggagggcaacgtgtcagggcacggggtcttgggctccgatgtttttgaagaacctatgagcggtatgtccgaagctggcatccctcagtctcccgacgatagcgactcaagttatgggagccacagcaccgattctctgatgggttcctcgcccgtctttaaccagagatgtaagaaaagaatgcgcaagatctag

SEQ ID NO: 31030 - DNA, 1239 bp, Artificial Sequence
  Description of Artificial Sequence: Synthetic coding sequence
atgctgcgatactggggcgaaattcctattagcagctcccaaaccaatcgatcttcctttgatcttttgcctagggaatttcggctggtggaggtgcatgatccccctttacatcagccttctgcaaacaagccaaaacctcccactatgcttgacatcccatcagaaccctgttccctcacaatccatacaattcaattgattcagcacaatcgtcgtcttaggaatttgatcgctactgcccaagctcagaatcagcaacagacagagggcgtcaagacagaggagagtgagccactccctagctgtccaggttccccacccctgccagacgacctactgcctctcgactgtaaaaaccctaatgcccctttccagatcaggcattcagaccctgagagcgacttttaccggggtaagggagagcctgttacagaactgtcctggcactcttgccgacagttgctataccaagccgttgccaccattctagcccacgccggattcgattgcgccaacgaatcggtcctggagactctaaccgatgttgcacatgaatactgtcttaagtttaccaagctgttgagatttgcagtggatagagaggcaagactgggacagacccccttcccggatgttatggagcaggtgttccacgaagtaggcatcgggagtgtgttgagtttgcagaagttttggcaacataggatcaaagattaccactcttatatgctccagatttccaaacagttgagtgaggaatacgagaggatcgttaacccagaaaaggctacagaagacgccaagccagtaaagattaaagaggagccggtgagcgacattacatttcctgtctcggaagagctggaggccgacctggcatctggggaccaatccctgcccatgggagttctgggagcccaatcagagaggttcccaagcaacttggaagttgaggccagtccccaggcatcaagtgccgaggtcaatgcaagcccattgtggaacctcgctcacgtgaaaatggagccccaggaaagtgaggaaggaaacgtatctggccatggcgtgcttgggtccgatgtgtttgaggagccgatgtctggtatgagcgaagccggaattccccagagtcctgacgactcagattcctcctacggcagccactcaacagattccttgatgggttctagccccgtctttaaccagcgttgtaaaaagcggatgagaaaaatttag

SEQ ID NO: 31031 - DNA, 1239 bp, Artificial Sequence
  Description of Artificial Sequence: Synthetic coding sequence
atgctaagatactggggagagatccccattagttccagtcagacgaatagatcgagtttcgatctactgccacgagaattcagattggttgaagtccacgatcccccactgcatcaaccaagcgccaataaacccaagccacctactatgttggacatcccctcggagccttgctccctgacgatccacactatccagctgatacagcacaacagacgcctccgcaatctgatagcgaccgcacaggcccagaaccaacagcagacagagggagtgaagacggaggaatctgagcccctgccatcttgccctgggtcccccccactaccagatgacctgctccctctggattgtaagaaccccaatgcaccatttcagattcgacacagtgatccggagagcgacttttacagaggcaagggcgagccagtgaccgaactgagctggcacagttgcagacagttactgtatcaggctgtcgctacaattctggcacatgccggttttgactgcgccaatgagagcgttttggagaccctaactgacgtggcacacgaatactgcctgaaattcacgaagctcctgaggttcgccgtcgatagggaggcgagacttggtcagactccttttcccgatgttatggaacaggtgttccacgaagtagggattgggtccgtactcagtctgcagaaattttggcaacacagaataaaggactaccactcctatatgttacagatctctaagcagctgtctgaagagtatgaaagaattgtcaaccctgaaaaagctactgaagacgcaaaacctgttaagattaaggaagagcctgtctccgacatcacatttccggtctccgaggagcttgaagccgacctggcttccggcgaccagtctctgcctatgggagtgttaggggctcagtctgagcgctttccgtcaaatcttgaggtggaggcaagtccacaggcctcgagcgccgaggtgaatgcctcccccctgtggaatcttgcccacgtgaagatggagcctcaggaatccgaggagggcaatgtgtcgggacatggtgtgttgggcagcgacgtgtttgaggaaccgatgtcaggcatgtcagaggctgggattcctcagtcgcctgacgacagtgatagcagctacgggtcgcacagtactgacagcctcatgggctcatcccctgtcttcaatcagcggtgtaagaaaaggatgagaaaaatatag

SEQ ID NO: 31032 - DNA, 1239 bp, Artificial Sequence
  Description of Artificial Sequence: Synthetic coding sequence
atgctccgatattggggggagattcccatctccagttcgcagaccaatcgcagctcattcgacttactcccaagagagttccgtcttgtagaggtgcacgatccacccctgcaccaaccatccgctaataagccaaaaccaccaacaatgttggacattcccagtgagccatgctcactgacaatccacacgatccagctgattcagcacaataggcgcttgcggaatctgattgcgacagctcaagcccagaatcagcaacagaccgaaggcgtgaaaactgaggagtccgagccgctgccaagttgtccgggtagcccccctctaccggatgacctgctgccgctcgactgtaagaatccgaatgcgccttttcagatacgacactccgaccccgaatctgatttttatcgaggcaaaggcgaacccgtcaccgagctgagctggcactcttgcaggcagctcctctatcaggctgtggctaccatactggcccacgctgggttcgactgcgctaacgaatctgtcttagaaactctgacggacgtcgcccacgaatattgcctgaaattcacgaaattactccgcttcgcagtcgatcgggaggcacgactgggtcagactccttttcccgacgtgatggagcaggtatttcacgaggtgggcataggcagtgttttgagtctgcagaaattttggcaacaccgtattaaggattatcactcttacatgctgcagatctctaaacagttgagtgaggagtacgagcggatcgttaaccccgaaaaagctacagaagacgcaaaaccagtcaagattaaggaagaaccggttagcgatatcacattccccgtgtcagaggagttggaggcagacctggcctccggtgaccagagcttgccgatgggtgtgttaggcgcacaatccgagaggtttccatcaaacctggaagttgaagcttcaccgcaggcgtctagcgctgaggtgaacgcctctcctttatggaacctcgctcacgtgaagatggagccccaggaatccgaggaaggcaatgtatcgggccatggcgtgctggggagcgacgtgtttgaggaacctatgagcggtatgtccgaagctggcattcctcagtcacctgacgacagcgactccagttacggttcacactctacagactccctcatgggatcatcccccgtctttaatcagagatgcaaaaagaggatgcgtaaaatatag

SEQ ID NO: 31033 - DNA, 1272 bp, Artificial Sequence
  Description of Artificial Sequence: Synthetic coding sequence
atggtggggatgtcacgcctgagaaatgatagactggctgatcctctcacaggttgtagcgtctgctgcaagagctcttggaatcagctccaagacctctgccggctagcgaaactaagctgccctgcccttggcattagcaagcgaaatttgtatgattttgaagtggaatatctctgtgactacaagaaaatacgcgaacaagaatactacctcgtgaaatggaggggttatcctgacagtgagtcaacctgggaacccaggcaaaatcttaagtgtgtgaggatactgaaacagtttcataaagacttggagcgagagctgctgcgccgacaccataggtcgaagacccctagacacctcgatcccagcctagctaattaccttgtacagaaggctaaacagagaagggcactcaggcgctgggagcaggagctcaacgcaaagagatcccatctgggaagaattacggtcgagaatgaagtggacttggacgggcctccacgagccttcgtctacattaacgagtacagggtcggcgaggggataactttgaatcaagtggctgtgggctgtgaatgtcaggactgtctgtgggcccctaccggcggatgctgcccaggggcttcactccacaaattcgcctataacgaccaggggcaagtgaggttgcgcgctggcctgcccatttacgagtgcaacagtcgttgcagatgtggctacgactgccccaatagggttgtccaaaaggggatccgctacgatctgtgtatctttcgtactgatgatggcaggggctggggagttaggaccctcgagaagattcgcaaaaattcatttgtgatggagtacgtgggggagataattacaagcgaggaagctgaaaggcgagggcagatttacgacaggcaaggcgctacgtatctatttgacctagattacgtggaggatgtgtacacagtggacgctgcctattatggaaacatttcccacttcgtcaatcattcctgcgaccccaacctccaggtgtataatgtgtttatcgacaatttggatgagagactgccacggatcgcatttttcgccacacgtaccattcgcgcaggagaggagctgactttcgactacaacatgcaggtggatcccgtggatatggagagcacgcgcatggatagcaattttgggctggccggactgccaggttctccaaaaaaacgagtgcgcattgagtgtaaatgtggaacagaaagctgtcgcaagtatctgttctag

SEQ ID NO: 31034 - DNA, 1239 bp, Artificial Sequence
  Description of Artificial Sequence: Synthetic coding sequence
atggcagaaaacctcaaggggtgcagcgtgtgctgcaaaagctcatggaaccagctccaggatctctgtcgtctagcgaaactctcttgccctgcgctcggaatctccaaacgcaacctttacgatttcgaggtcgagtatttgtgcgactataagaaaatacgcgagcaggaatactaccttgtcaagtggcgtggatatcccgactctgagagcacttgggaacctaggcaaaatctgaaatgtgtgcggatcctgaaacagtttcacaaagatctcgagagggaactactaagacggcatcaccgctccaaaacacctagacatctcgatccatccttggccaattacctggtgcagaaggcaaaacagaggcgagcactaaggagatgggaacaggaattgaatgctaagaggtctcatctggggaggattactgtggagaatgaagttgatttggatggcccacctagggccttcgtatatataaacgaatatcgagtcggcgaaggtattacactgaatcaggtggccgttggctgcgagtgccaggactgtttatgggctcccacggggggatgctgtcctggagcctcattacacaagtttgcttacaatgatcagggtcaggtgcgcttgagagccggactgcccatctatgaatgtaacagtcggtgtcgttgcggctacgattgcccaaaccgggtggtgcagaagggaattcgatatgatctgtgtatatttaggaccgacgatgggagggggtggggggttcggactctcgagaagattcggaaaaattcattcgtgatggagtacgtcggcgagatcataacttcagaggaagccgaaagaaggggccagatatacgaccgtcagggcgctacttacctatttgatctggattacgttgaggacgtgtatacggtcgacgcagcatattacggtaacatctcccacttcgttaatcattcatgcgaccctaatctgcaagtctacaatgtattcatagacaacttagatgaacgactgccgcgtatagccttttttgccacccggacgatccgagcaggagaagagctcacctttgactacaacatgcaggtggatcccgtcgatatggaatcgactagaatggacagtaatttcggtctggctgggcttccgggtagcccaaagaagcgcgttagaatcgagtgcaagtgtggcactgaatcctgtagaaaatacctgttttag

SEQ ID NO: 31035 - DNA, 648 bp, Artificial Sequence
  Description of Artificial Sequence: Synthetic coding sequence
atggcttggatctcgagattgcgtgagcacctcgacggaccaccgagggcattcgtttatatcaatgagtatagggttggggaggggataacactaaatcaggttgcagtgggctgtgaatgtcaggattgtctttgggcgccaacaggaggatgctgccctggcgcatccctacacaaatttgcgtacaacgatcagggccaggtcagactgagggccggattacctatttacgagtgcaattcacgttgtaggtgtgggtatgattgcccgaatcgagttgttcagaaggggatcaggtacgatctctgtatctttagaacggacgatggtcgtggctggggagtcagaacattggagaagattaggaaaaactcattcgtgatggatcccgctttgttaaccgtgtgcttgaaattacctgcatttcctatgggcaaagcctgggaaacagatctgtctgtaaccggaactttaggtcgcggatgcggcaggggcgaggacagactgcaggaatctccgttcccagtgcccgcaccatcagtaggatgtacatataagccacctcccacgtttcgtaactcattctccacttctcgtctctcagtcgtcggaattcacggcctgcttcgaaggtctaagggttag

SEQ ID NO: 31036 - DNA, 1230 bp, Artificial Sequence
  Description of Artificial Sequence: Synthetic coding sequence
atggcagagaaccttaaagggtgtagcgtgtgttgtaaaagttcctggaaccagctgcaagatctgtgtcgcctagcgaagctctcgtgccccgctctgggcattagcaagcgaaatctgtatgatttcgaggtagagtatgtcaggctgcaggaagaccccagaactggcattctgcctggcgaaatggcatggatttctcgcctcagagaacatctcggggctacagcagagtctcaagtgtgtgcctatccacaagctgtcccccagggcctgcgcaaaggcgctgcccctgcagcccctcccgtgaaggaccccccagcgccaggtcctaagctgggtcaactgccaggagccgaagggcaggctgaggctggcgctcctagcttaggggctggagcacaatgccaggctcacctcggtagaattactgtcgaaaatgaggtcgacctcgatggtcctcctcgggcattcgtctatatcaacgagtaccgcgtgggtgagggcattacacttaaccaggtagctgtcggatgcgaatgccaagattgcttgtgggctccaacaggcggatgctgccctagacactgtacatccctgccaacaatgactagagccagatgcgggttcgaaccgggttgtcccagcacatcggctacccccgctgcagctgccgctatgaccgcgcaaatcgtctggtatcggcgtgtttcagatatgactagcgccagcagtgcccgaatgatgggcgtcgctggagccagcgccccatggaggagatttgccagaacagcatccagttggtcgacctgggagcgctctttgccacagagacgccagagcggagggcagatctatgataggcagggggctacatacttgttcgacctggactatgtcgaagacgtgtacaccgttgacgccgcttactacggaaatatctcccactttgttaatcactcgtgcgacccaaatctgcaggtttacaacgttttcatcgataacctcgacgaacgcttgccatctctgagtcttccccaggaacccagtggccaggccagatccagcccactgattactacctgcaaatggaccccatggacatggagagcaccagcttggacccccacgctggcatggctgggttcccttgcccctctgaggagtggctcagtgctgaacgcgtccgttggactctctcccgcagctaacacttccagcagcccttag

SEQ ID NO: 31037 - DNA, 555 bp, Artificial Sequence
  Description of Artificial Sequence: Synthetic coding sequence
atggcttggattagtaggttgagggagcacttaggagctacagccgagtcccaggtgtgcgcatatcctcaggccgttccccaaggcctaaggaagggagcggctcccgctgcccctccagtgaaggacccgccagcaccaggtccgaagctcgggcaactacctggggctgagggacaggcagaacctggctgtcctagtactagtgcaactccagccgcagctgccgcaatgacggctcagattgtctggtatcgcagagtctccgacatgacatcagcctccagcgccagaatgatgggcgtagctggcgcttctgcaccttggcggaggtttgcaaggaccgcttccagctggtctacttgggagcgttcattgccccagcggaggcagagcggaggcgctcggagcacgaccgtgcgcgcacctcctacatcactgacctggacaacctggagaacttgtaccccatggatgccccctacaatggcgacgagccctaccctgtcaactacggtagtgactcccacatgtcgctgtacaacaagctcctag

SEQ ID NO: 31038 - DNA, 285 bp, Artificial Sequence
  Description of Artificial Sequence: Synthetic coding sequence
atgcgagctggattcagtgattttcagctgatcagagatcaagtattgttcctgcaggatcaagcgcagaggctcactgaatggctgcagctgtcagggttcgagaatccagtgtctgagagtacaactctgtgtctgagggagagggagaaacggattcccacctgtgtggccgtttgtgtgccttcaccaggcacagtccacactgccctgttgcatcccacaaccctctcccagtctcgcagttcctccgaagctaagatgctcatcatccataccgcatag

SEQ ID NO: 31039 - DNA, 594 bp, Artificial Sequence
  Description of Artificial Sequence: Synthetic coding sequence
atggatgtcggctctaaagaagtgctcatggaaagtccgccagactactctgccgctccacgcggaaggttcggtatcccctgttgtccagtacaccttaaacggcttctaatagtggtggtggtggtggtgttgattgttgtagtcatagtgggcgcactcttaatgggattgcacatgtctcagaagcatactgagatggtcctggagatgtcaattggagcgccagaagctcagcagcgtcttgcgctgtcagagcatctggtgactactgccactttctcaatcggcagtacggggctggtggtgtacgactaccaacagcttcttatcgcatataagcccgctcctgggacatgctgctatataatgaagattgccccagaatctatcccatctttagaggccctgactagaaaggtccacaatttccagatggaatgttcattgcaggccaagcccgctgtgcccacaagtaaacttggacaagccgagggtcgggatgccggttctgccccatctggaggagacccagcttttttgggaatggcagtcagtactctgtgtggggaggttcctctatattacatctag

SEQ ID NO: 31040 - DNA, 576 bp, Artificial Sequence
  Description of Artificial Sequence: Synthetic coding sequence
atggatgtgggcagcaaagaagtattaatggagtccccgcctgactactctgctgcaccccgaggtcgctttggaataccatgttgtccagtccatctgaaacggttgctgattgttgtggtggtggttgtgcttattgttgtcgtgattgtgggggctcttctcatggggctacatatgtcccagaaacataccgaaatggtacttgaaatgagtatcggcgctcccgaggcccagcagaggcttgccctctctgagcacttagtcactacagcaaccttcagcataggcagcaccggcctggttgtgtatgattaccaacagctccttattgcttacaaaccagctccaggcacatgttgctacattatgaagatcgcccctgaaagtattccttctcttgaagctcttactagaaaagtacacaacttccaggctaaacccgcagtcccaactagcaaactggggcaggccgaaggccgtgacgctggatccgccccaagtggtggagatccggcatttctgggcatggctgtatcaactctatgcggcgaggtgccattgtactatatctag

SEQ ID NO: 31041 - DNA, 1158 bp, Artificial Sequence
  Description of Artificial Sequence: Synthetic coding sequence
atgatgatgatggctttgtcgaagacgttcggtcaaaagccagtcaaattccagttagaggatgacggcgagttctacatgattggctcggaagtgggcaattatctgcgcatgtttagaggctccctgtacaagagatatccaagtctgtggaggaggctcgcaacagtggaagaaaggaagaaaatagtggcatctagccatggtaagaagacaaaacctaacacaaaggatcatggttatacaaccttggccacttccgtgaccctcctcaaagcttcagaggtggaagaaatactcgatggaaatgatgaaaaatacaaggctgtgagtatttcaacagagccacctacctacctgcgggaacagaaggcaaagaggaatagtcagtgggtgcctactctgccaaattcttcgcatcacctggacgccgtcccctgtagtaccaccatcaacaggaatcgtatgggcagagataagaagaggacattccccctctgttttgatgatcacgatccagctgttattcatgagaacgcgtcccaaccggaagtcctggtgccaatccgtctcgatatggaaatcgacggccagaagctgcgcgacgcattcacttggaacatgaatgaaaagctgatgactcccgagatgttttcggaaattctctgtgacgacttagaccttaaccctttaacattcgtacctgccattgcatccgctatcagacaacagattgaatcctatcctactgactcaattttagaagatcagagtgatcaaagagtgattattaagctgaatattcacgtgggaaatatcagcctggtcgaccagttcgaatgggacatgtcagaaaaggagaattctcccgaaaaatttgccctgaaactctgtagcgaactcgggctggggggagagtttgttaccacaatcgcgtatagcattaggggccagctgtcatggcatcagaagacttacgccttttctgaaaatcccttgccaaccgtggaaatcgctatccgcaacactggggatgccgaccagtggtgcccactgctggagaccctcaccgatgccgagatggagaagaagattcgtgaccaggaccggaatacccgacgaatgcgacgtctggccaacacggcacctgcctggtag

SEQ ID NO: 31042 - DNA, 1131 bp, Artificial Sequence
  Description of Artificial Sequence: Synthetic coding sequence
atgatgatgatggctttgagcaaaaccttcgggcagaaacctgtgaagtttcagctcgaggatgacggggaattctatatgattggctcagaagtgggaaactatctccgtatgtttagaggctccctctataaacgctatccctcactgtggagacggctggcaactgttgaagagcgaaagaaaatagtggcgagcagccatgatcatggctataccacacttgccaccagcgttactctcttgaaggcgagtgaggtggaggaaatcctggatggaaatgatgagaaatacaaggccgtatccatcagtactgaaccccctacttatctgagggagcaaaaagcaaaaagaaattcacaatgggtgccgaccctgcctaactcttcgcaccacttagatgccgtaccctgctcaactacaatcaaccgaaaccgaatgggaagggacaaaaagagaacatttccgctctgcttcgacgatcacgatcccgctgtgatccatgagaatgccagccagcctgaggtgttggttccaatccgcttggacatggaaatagacggtcagaagcttagggacgcctttacctggaacatgaatgaaaagctgatgactcctgaaatgttctcggagattctgtgcgacgacctggatctgaaccccctgaccttcgtccctgccatagcctccgctatcaggcagcaaattgaaagctacccaaccgattctatccttgaagatcagtctgaccagagggttattataaagctcaacatccacgtcggtaatatatcacttgtggatcagttcgaatgggacatgagcgagaaggagaacagcccagaaaagttcgccctgaaactgtgcagtgagctcgggctcgggggtgagtttgtgaccaccattgcttacagcatccggggacaattgtcttggcaccagaagacgtacgcgttcagtgagaaccctctgcctacggtggagatagccatccgcaacactggggacgccgaccagtggtgccccctgctggagaccctcaccgacgccgagatggagaaaaaaatacgagaccaggatcgcaataccagaaggatgcggagacttgctaatacagccccagcttggtag

SEQ ID NO: 31043 - DNA, 81 bp, Artificial Sequence
  Description of Artificial Sequence: Synthetic coding sequence
tggcggagattagctaccgtagaagagcgtaagaaaattgtggccagttctcatgccctgatgactatgacccagctctag

SEQ ID NO: 31044 - DNA, 7625 bp, Artificial Sequence
  Description of Artificial Sequence: Synthetic coding sequence
atggtcgcgctgagcctcaaaataagtattggaaacgtcgtcaaaactatgcagtttgagcctagtaccatggtttacgatgcatgccggataattagggaacgcattccagaggctccagccggacctccgagcgacttcgggctgttcctgagcgatgacgacccgaaaaagggtatctggctggaggcagggaaagcactggattattatatgctcagaaatggagacacaatggagtaccgtaagaagcagaggcctctgaaaattagaatgctcgacggtactgtgaagaccattatggtagacgattctaagaccgtgactgacatgctgatgaccatctgtgccaggattggcattacaaatcacgatgaatatagcctggtgagggaactgatggaggaaaagaaagaggaaatcacggggactctgcgcaaagataaaaccctgctccgagacgaaaaaaagatggaaaaactcaaacagaagctgcacactgacgatgaactcaattggctggaccatggaagaactctcagggagcagggtgttgaggagcatgaaacacttctgctgcggagaaagttcttttatagcgatcaaaatgtcgattctcgggatccagtgcagctaaacctgctgtacgtccaagcacgagacgacatcctgaatggctcccatccggtttcctttgataaagcatgtgagtttgccggttttcagtgccagatccaattcgggccacataatgagcagaaacataaagccggatttttggacctgaaggacttcctcccaaaggagtacgtcaaacagaagggggaacggaagattttccaggcccacaaaaactgtgggcagatgtctgagattgaggcaaaggtgaggtatgtgaagctggcgaggagtttaaaaacctatggagtgagcttcttcttggtaaaggaaaagatgaagggcaagaataagctcgtgcccagactcctgggaattactaaggaatgtgtgatgagggtcgacgaaaagactaaagaagtgatccaggagtggaatttgacaaatatcaagaggtgggcagctagtcctaaatcattcacactggacttcggcgattaccaggacggatattatagcgtccagactacggaaggcgaacagatagcacagcttatagccggttacattgatatcatactgaaaaagaagaagagtaaagaccattttggtctggagggagacgaagagagcacgatgctggaagatagcgtgagccctaaaaaatccactgtgctgcaacagcagtacaatagggtggggaaagtggagcacggcagcgtcgctctcccagccataatgcgatcaggagcatctggcccagagaacttccaggttggttctatgccgccagcacagcaacagataaccagcggccaaatgcaccgtggccacatgcctccactgacatccgcccagcaggcccttaccggaactatcaattcatcgatgcaggcggtccaggctgcgcaggctactctggatgactttgatacgctgcccccactgggacaggacgccgctagcaaggcctggaggaagaataagatggatgagagcaagcacgagattcatagccaggtggatgccatcacagctggcacagcaagcgttgtgaaccttacagcgggtgacccggctgagaccgactatactgcagtaggatgcgctgtcacaaccataagctcgaacttgactgaaatgtcacgaggcgttaagctactcgctgctctgctcgaggacgagggaggaagcggcaggccgctgctacaggccgcaaagggcctggcgggagctgtaagcgaattactgcggtctgcccaaccagcgagtgctgaacccaggcaaaacctgctgcaggctgccggaaacgtcgggcaggcaagtggagagctgttgcagcaaataggagaaagtgacaccgatccccatttccaggacgccctgatgcaactcgccaaagctgtcgcatcggctgccgcagctcttgtcctgaaggccaagtctgtcgctcaacggacggaagacagcggactacagacgcaggtgatcgcagccgcaactcagtgcgctctgtctacctcgcagttggtggcctgcacgaaagtggttgcccctacgatttcaagccccgtttgtcaggagcaactggtggaggcgggtcgactcgtggcaaaggctgtcgagggctgcgtcagtgcatcgcaagcagctactgaagacggacagctgctgcggggtgtgggggcagctgcaaccgctgtgacccaggccctcaacgaactcctgcagcatgtcaaggctcatgccaccggagcgggtcccgctggacgatacgatcaggcgactgacaccatcttgacggtgaccgaaaacatcttttctagcatgggcgacgccggtgaaatggttcgccaggctcgcattctggcccaagctacctccgatctagtgaacgcaattaaagcagatgctgagggagaatctgacctggaaaatagcagaaagcttctgagtgctgccaagatcctcgccgacgccactgccaaaatggtggaggcagctaagggtgcagccgctcatcctgattcagaggagcagcaacagcgtttgagagaggctgccgaaggtctgagaatggccacgaatgccgctgcacaaaatgcaatcaagaagaaattggtccagcgcctcgagcatgccgcaaagcaggccgcagccagcgccactcagaccattgcggctgcccagcacgccgcatccacaccaaaagctagcgccggaccacaacccctgttggtacagagttgcaaagccgtggcggagcagattccactacttgtgcaaggagtgcgagggtcccaggcccaaccagacagtccaagcgcccaactcgcgttgatcgccgcttctcaaagcttcctgcagcctgggggaaagatggttgcagccgctaaggcttccgtacctacaatccaagaccaggcctccgcgatgcaactgtcccagtgtgccaagaacctcggtactgcccttgccgagctccggacggccgctcaaaaggcccaggaagcgtgcggccctttggaaatggattcggcattgagcgtcgttcagaatctggaaaaagaccttcaagaggtgaaagctgcagcgcgtgacggaaaactgaagcccctgccaggggagaccatggagaaatgtacccaggacctcggcaacagtacaaaggccgtgtctagcgccatagcacagttactgggggaggttgcgcaggggaacgagaactatgccggtatcgcagcgagggacgtggcaggagggctcagaagtctagcccaggctgcgaggggcgtggccgcactgacaagtgaccccgcagtgcaggcaatcgtgctggataccgcctctgatgttttggataaggcaagtagcctgatcgaagaagctaaaaaagcagccggtcaccccggtgacccagaatcgcaacaaagattagcccaggtcgcgaaggccgtcactcaggcccttaatcggtgcgtctcctgcctgcccggacagcgcgatgtcgacaacgccctcagagccgtgggtgacgcgagcaagaggttgctgtctgattcactgcccccatcaaccgggaccttccaggaggcacagtcccgtctgaatgaggccgcagccggtctgaatcaggcagcaacggaactggtgcaggcctcacgcggaactccacaggaccttgcgcgagcgtctgggcgattcggacaggatttttcaactttccttgaggcaggggtggagatggccggtcaggccccttctcaggaagaccgggctcaggtggtgtccaatctgaagggcatcagcatgagtagctctaaactgctcctggccgcaaaggcactttcgaccgatcctgccgctccaaacttgaagagccagcttgccgcagccgctagagccgtgaccgattcaatcaaccagcttatcacaatgtgcacccaacaagctcctggccagaaggaatgtgataacgccttgcgggagttggaaaccgtcagagaactcctggaaaacccagtccaaccgatcaatgatatgtcctattttggatgtctggacagtgtgatggaaaactccaaggttctgggcgaagcgatgacaggtataagtcaaaatgccaaaaacggtaacttgccagagttcggagatgctatctcgactgccagcaaggctctgtgcggcttcacggaggccgctgcccaggcagcttacttagtgggagtcagtgaccccaactcgcaggctggccagcaggggctcgtggagcccacccagttcgctcgggctaatcaagccattcagatggcttgccagtctcttggcgaacctggttgcacccaggctcaggttctgagcgccgctaccatcgtggcaaaacacacctccgccttgtgcaactcttgcagactcgcatccgcgaggacaaccaatcctacagccaaacggcagttcgtccaatccgccaaggaagtggccaatagtacggcaaaccttgtgaaaacaattaaggccttggacggcgcatttacggaggagaaccgcgcacagtgcagggcggctacggcccctctgcttgaagcagtggataacttgtccgctttcgcgtcgaatcccgagttttcaagtattcctgcccagattagtcctgagggccgtgcggctatggaacctatcgtgattagcgctaagacgatgttggagagcgcgggtggactgattcaaacagctagggcgctggctgtgaatccaagagaccccccaagttggagcgttctggccggacattcccgcactgtatcggattccattaaaaaactgataactagtatgcgggacaaggcccctggacagttggaatgcgagactgctatagctgctctgaactcctgcttgcgagacttggaccaagcttcactggcggcagtgtctcaacagctggccccacgtgaggggatttcacaggaggccctccatacacaaatgctaactgctgtccaggaaatcagtcaccttatcgaacctctggcaaatgccgcacgggcagaggctagtcagctgggccacaaagtctcacagatggcccaatatttcgagcctctgacacttgccgctgtgggtgccgctagtaaaactttgtcacatcctcagcagatggcacttcttgaccagaccaaaactttggcggagtccgccctgcagctactttacaccgctaaggaggctggcggaaatcccaaacaggccgcacacacccaggaagcccttgaggaggccgtgcagatgatgactgaggctgttgaggatttaaccacaacactaaatgaggccgcatctgccgcaggtgtggttggcggaatggtggacagcatcacgcaagctattaaccaacttgatgaaggaccgatgggggagccagagggctcattcgtggactaccagaccacaatggttagaacagctaaagccatcgctgtcaccgtgcaggagatggtgaccaagtccaacaccagtcccgaggagcttgggccattggctaaccaactaacctcggattacggaagacttgcttcggaggcgaaaccggctgctgtggctgctgaaaatgaagaaattgggtcacacatcaaacatagggttcaggaactcggacacggatgcgcggcactagttaccaaagccggtgctcttcagtgtagcccctcagacgcatacacaaagaaggaactcatcgagtgcgctagacgagtgtccgaaaaagtcagtcacgtcctcgctgccctacaggccggaaataggggcacccaggcttgtattacggcagctagcgcagtgtctggcattatcgcagacttagacaccacaattatgtttgcgaccgcaggaactcttaaccgggaaggaaccgagacattcgcagatcatagggaaggcatcttgaaaactgcaaaggtgctcgttgaggatacgaaggtgcttgtgcaaaatgcagcaggtagccaggaaaaactagcccaggccgctcagtcaagcgtcgctacaataacccggctggccgatgttgttaaactgggagcagcctcactcggggcagaggaccccgagacgcaggtagtgctgatcaatgccgttaaggacgtagctaaggctcttggagaccttatcagcgctactaaggcagcagcgggtaaggtgggtgacgatcctgcagtgtggcaactaaaaaattccgctaaggtgatggtcaccaatgtcacttcacttctgaagaccgttaaggctgtggaagacgaagctacaaaagggacccgagccctggaagccacaacggagcacatcagacaagagctcgccgtcttctgcagtccggaaccacccgcaaagacatcaacacctgaggactttatccgaatgacgaaaggcatcaccatggctactgcaaaggcggtcgcagcaggaaatagttgcaggcaggaagacgtaattgcgactgccaatctaagtcggagggcaatagccgacatgctgagagcatgtaaagaggctgcttaccatcccgaagtcgctcctgatgtacgactgagagctctgcactacggaagagagtgtgccaatgggtacttggagctgttagatcacgtcctcctgaccttacagaagccctccccagagcttaagcagcaattgaccggacattctaagagggtggccggatctgtaacagagctgatacaagcagcagaagccatgaagggaactgaatgggtagatcctgaagatcctaccgtgatcgccgaaaacgaactcctgggagccgcagccgctatcgaagcagccgctaaaaagctcgagcagctgaagcccagagccaaaccaaaggaggcagatgagtccctgaattttgaagaacagattctggaggccgctaaaagcatcgctgctgcaacgtccgccctggtcaaggcagcctccgcagctcaacgagaactggttgcgcaggggaaggtgggcgctatccccgcaaacgcactcgacgacggtcagtggtctcagggcctgataagtgctgcaagaatggtggctgcagcgacaaacaacctgtgtgaggccgctaacgctgcagtgcaaggtcacgcttcacaggagaaactcatctcatcagcaaaacaagtagctgcttctaccgcacagctcctggtagcctgcaaggtgaaggccgaccaggatagcgaagctatgaaaagactccaggccgctgggaatgctgtgaagcgggcatcagacaacctggtaaaagccgctcagaaagctgccgcttttgaggaacaagaaaatgagactgtcgtcgtaaaagagaaaatggtgggcggaatcgctcagatcatagcggcacaagaggaaatgttgagaaaagagcgggagctggaagaggctcgaaaaaagcttgcccagatccggcagcagcaatacaaatttctgcctagcgaactgagagacgaacatta

SEQ ID NO: 31045 - DNA, 7289 bp, Artificial Sequence
  Description of Artificial Sequence: Synthetic coding sequence
atggtcgctctgtccttgaaaataagcataggaaacgtcgttaaaacaatgcagttcgaacctagtaccatggtctatgatgcttgccgcattattagggagcgtatccctgaagccccagccggtcccccaagtgactttggcctgttcctgtcagatgatgatccaaagaaagggatctggctggaagccggaaaagcgctggactattatatgctgcgtaatggcgatactatggagtacaggaagaaacagcgaccactgaagattagaatgctggatggaaccgtaaaaactataatggtggacgactcaaaaaccgtgaccgatatgcttatgacaatctgcgccagaatcgggataacaaatcatgatgagtacagtctcgttagagaacttatggaagaaaagaaggaggaaataaccggcactcttcgaaaggacaagactctgcttagggacgagaagaaaatggagaagctcaagcagaagctgcatacagacgatgagctgaattggctggatcatggcaggaccctgagggaacagggggttgaggaacacgaaacacttctattacgccgtaagttcttttactccgaccagaatgtagacagtagagatcccgttcagcttaatctgttatacgtgcaagcacgtgacgacatcttgaatggatcccacccagtttccttcgataaagcatgtgagttcgctggcttccagtgtcaaattcagttcgggccacacaacgaacagaaacacaaggccggttttctggatcttaaagacttcctacctaaagaatatgtcaagcagaagggcgagcggaagatatttcaggcacacaaaaactgtggacagatgagcgaaatagaagctaaggtccgctacgtgaagttggccaggtcccttaaaacgtatggggtgagttttttccttgttaaggagaagatgaaaggcaaaaataaactggttccacggctgctgggtataacgaaggaatgcgtcatgcgggtggacgaaaaaaccaaggaggtcatccaagagtggaatttgaccaacatcaaacgttgggcagcctcgcccaaatcattcaccctcgactttggcgattaccaggacgggtattacagcgtccagacgacagagggcgagcagatcgctcaactcatagccggatacatcgatatcatactgaagaagaaaaagtctaaagatcattttggtctggagggtgatgaagaatccacgatgttggaggatagtgtgtccccaaaaaagtccacagtgttgcaacagcagtacaatcgagtgggtaaggtggagcacgggtccgttgcactccctgctatcatgcgctctggcgctagtggccctgagaatttccaggtgggctcaatgcccccagcccagcaacagattacaagtggacagatgcacagaggtcacatgccccctctgaccagcgcacagcaggcgctgaccggaacgatcaattcctcaatgcaagccgtgcaagctgcccaagcaactctcgacgattttgacacgctgccaccgctgggccaagacgcagcctccaaagcgtggagaaagaacaaaatggacgaatcgaagcacgagattcatagtcaggtcgatgctataactgctgggaccgcctcagtggtgaacttaacggccggagacccggcagagacagactatacggccgtgggctgtgcggttactacgatatcctctaacctgacagaaatgtccaggggtgtgaaactcttggccgcactcttagaggacgaaggtggatcagggagacctctcttacaggccgcaaaaggattggccggagcagtgagcgagctgctccgcagtgcacaacccgcaagcgctgagccaaggcagaatttactgcaagccgctggtaatgtggggcaggcatcaggggagctcctccaacagattggagaatcagatacagacccacactttcaggacgcccttatgcagttggcgaaagccgtcgcatcagcagcggcagcgctggtgctgaaagccaagtccgtagcacaacgaacggaggacagcggtctccagacccaagtcatagccgctgcaacacaatgtgccttgtcaacatctcagctagtcgcctgcactaaggtggtagcgcctacaattagttccccggtgtgccaggagcagttggtggaagccggacggctggtggcaaaggctgtggaaggatgtgtgagcgcctcgcaagccgctaccgaggacggtcagttgttacggggagtcggggctgccgctaccgccgtcactcaggcgctcaacgagcttcttcagcatgtgaaggcgcatgccacgggcgcaggacccgcaggacgatatgatcaggctacagatacaatccttacagtgacagaaaacatattctcctccatgggggatgccggtgaaatggtccgacaggcaaggattctcgcccaagctacatccgacttggtgaatgcaatcaaagctgatgccgagggggaatcggacctggagaattctagaaagctactctcggcagccaagattctggctgatgcaaccgccaaaatggtggaggctgcaaaaggcgcagctgcccatccggacagcgaggagcaacagcagcggctgcgcgaagccgcagagggtctgagaatggccacaaatgcagccgcacagaacgcaatcaagaagaaactggtccagcgcctggagcatgcagctaaacaggcggctgcctcagccactcagacgattgccgcagcccaacacgccgcatccactcccaaggcgtccgcaggacctcaacctttgctggtgcaaagttgcaaagcagttgccgagcagattcccctgttggttcagggcgtacgtggaagtcaggcgcagccagacagcccaagcgcccagctggctctgatagccgcaagccagtctttcctgcagcccggaggcaaaatggtggccgcagcaaaggctagcgtgccgacaattcaagaccaggcatctgccatgcagctgtcccaatgcgctaagaatcttggcactgccttagctgaactacgcactgctgcacagaaggcccaggaagcttgcggccctcttgagatggactcggccctgtctgtggtccagaacctggagaaggacctgcaggaagtcaaggctgcggctcgggatggtaagctaaaacctctgcctggggagactatggagaagtgtacgcaggatctgggcaacagcaccaaggctgtgtctagcgccatagcccagctgttgggcgaagtggctcaggggaacgagaactatgccggtatcgctgctcgagacgttgccggtggtctcaggtcactggcacaggcggcacgaggtgtagcagctctaacaagtgaccctgcagtgcaggcaattgtgcttgacactgccagcgacgtgctggataaagccagctcccttatcgaggaagccaaaaaagccgcaggccaccccggagacccggaatcacagcagcggctagcccaggtggcgaaggcagtcacccaggccctcaaccgatgcgtcagttgtctgcccggtcaacgtgatgtggacaatgccctcagagctgtaggtgacgcttctaaaaggttgctaagcgatagcctgcccccatcgaccggtacattccaggaggctcaatctaggctaaacgaggccgcagcagggctgaatcaagcagctactgagctcgtccaggctagtagaggcactccccaggatcttgcgagagcttccggcagatttggccaggacttcagcaccttcctggaagccggagtggagatggcaggacaagctccgagtcaggaggatagggcccaggtggtgagcaacctcaaaggaatctccatgagctcttccaagcttctgctggccgctaaggcactgtccaccgaccccgcagctcccaacctgaagagccaactggccgctgcggctagggccgtgaccgacagcataaaccaacttatcaccatgtgcacacagcaggcacccggtcagaaagagtgcgacaatgccctcagggagcttgaaaccgtacgcgagcttctcgagaatcctgtacagcccatcaatgatatgtcctattttggatgccttgatagcgttatggaaaactccaaggtgctgggtgaggcaatgactggaatttcacaaaacgccaagaacgggaatttgcctgagtttggcgatgcaattagcacagcttctaaagctttatgtggctttacagaagctgctgcccaagctgcatatcttgtgggcgtcagcgaccctaacagccaggcgggtcaacaggggctggtggaacctacacaatttgcacgcgcaaaccaggccatacaaatggcatgccagagtttgggggagcccggttgcacgcaggctcaagtgctgtcagctgccacgattgtcgccaagcatacttctgccttgtgcaattcctgtaggttggcctccgccaggacaaccaaccctactgctaagcgccagttcgtgcagtctgccaaggaggtggccaacagcaccgcaaatcttgtgaagacaatcaaagctctggacggcgcatttaccgaagaaaatcgggctcagtgtcgggcagctaccgctcctctgcttgaggccgtggacaacctgagtgcctttgctagtaatcccgagtttagctctattcctgcgcaaatctcacccgagggtcgtgcggcaatggagcccattgttatcagcgcaaaaacgatgctggaatctgcaggaggcctgattcagacggccagggcgctagcagtgaatcccagagacccaccaagttggtccgtgttggccggtcactcgcgaaccgtcagcgattccattaagaaactgattacttcaatgagggacaaggcccctggacagctagaatgcgaaaccgccattgctgctttgaattcgtgcctacgtgacctggatcaagcttccttggcagccgtctcccagcagctcgcccctctccaggagatatcccatttgatcgagcctctggctaacgcggctcgcgcagaggcttcacagcttgggcacaaagtatcccagatggcacagtacttcgaaccccttacgctcgcagccgtcggcgcagcgtcaaagacactctcccatccacagcagatggctctgctggatcaaactaagacgttggctgagtccgctttgcagctgttgtatactgccaaagaagctgggggaaacccaaagctcgacgaggggcctatgggagaacctgaaggcagttttgtggattatcagacaaccatggtgcgcaccgctaaagccattgccgtaactgtccaggagatgatcgggtcccacatcaaacatagggtccaggagctcggacatggatgcgctgcactggtgacaaaggcgggtgcacttcagtgtagcccgagtgacgcctacaccaaaaaggagctaatcgagtgtgccagaagagtcagcgagaaggtctcccatgttcttgccgctctccaggcaggtaatcggggaacgcaagcctgcatcacggccgcaagcgcagtgagcgggataattgccgatttggatacaactataatgtttgccactgcgggaacgttgaacagggaagggacagaaaccttcgccgaccaccgagaaggtatactaaagactgcgaaggtactggtagaggacactaaggtactggtccagaatgcagccggatcccaggaaaagctggctcaggccgctcagtcatcagtagcaactattactcggcttgccgacgtcgtgaagctcggcgcagcgtctctgggtgccgaagatcctgaaacacaagttgtcctgattaatgcagtgaaagatgtagctaaggcgctgggagatctcatctctgcgacaaaagccgcagccggaaaagtcggcgatgaccctgctgtgtggcagctcaaaaactcggccaaagtgatggtgaccaacgtcactagcctccttaagacggtgaaggctgttgaagatgaagcaactaagggaacgcgagctctggaggccactactgagcatatcaggcaggaactggcgcctcccgctaagaccagcacgcccgaggactttatccgcatgactaagggcatcacaatggcaacagcaaaagctgtggccgctggcaattcttgcaggcaggaggacgtcattgccacagccaatttatcgcgtcgcgctatagccgacatgctgcgagcttgtaaggaagccgcataccaccccgaggttgcaccggatgtcagactcagggcactgcattatgggagagagtgtgcaaatggataccttgaactactggatcacgttctattgaccctccagaaacctagccccgagctgaagcaacagttaacggggcacagcaagcgggtagcgggaagcgtcacggagttaatccaggctgcagaagctatgaaggggaccgaatgggtagatccagaggatcccactgtcatagccgaaaacgagttgctcggcgctgccgcagccatcgaggcagccgctaagaaactcgagcagttgaaacccagagccaagcctaaagaggccgatgagagcctcaacttcgaggagcaaatcctcgaagctgctaagagtatcgcagccgctacttccgcgctcgtgaaggcggctagtgctgcccagcgcgagctagtcgcacagggaaaggtcggagctattcctgcaaacgctctggatgatggccagtggtcgcagggacttatcagtgccgctcgcatggtagcagcagccacaaacaatctctgcgaagcagccaatgctgccgtccaggggcacgctagccaggaaaagttaatctcttcagcaaaacaggtcgcagctagtacagctcagcttctcgttgcgtgcaaggtgaaggcggaccaggacagtgaggccatgaaacgcttacaagccgcagggaatgcagtcaagcgtgcgagtgacaatcttgtgaaggccgctcagaaagccgctgcattcgaagagcaggaaaatgaaaccgtggtggtgaaagagaaaatggtggggggaatcgcccagataattgccgctcaggaggagatgctgcgcaaagagcgcgaattggaggaagccaggaaaaagttggcccagatccggcagcagcagtataaattcctcccttcagaactgagagatgagcacta

SEQ ID NO: 31046 - DNA, 3984 bp, Artificial Sequence
  Description of Artificial Sequence: Synthetic coding sequence
atggcggcttctaggcgctcccagcatcatcaccatcatcaccagcagcagctgcagccagcaccgggtgcttctgcgccaccaccgcctccccctccacctctttcacccggtttagcacctggtacgacacccgcttcgccgaccgcgagcggcctcgcccctttcgcatctcctagacatggactcgccctgccagagggagacgggtccagagaccctccagaccgccctaggagtccagaccctgtcgacgggaccagttgttgttcaaccacatctacaatctgcaccgtggccgcagctccagtggtcccggctgtgtccaccagttctgcagctggagtcgcgcctaaccccgcaggctccggatccaataattccccatcctcttcttcaagcccaacctccagttcctcctcttcaccaagttctcctggtagctcactcgctgagagtcccgaggctgccggtgtgtcaagtacggctccactgggccctggcgcagccggacccggaactggcgtacccgctgtaagtggagcactgagagagctgctcgaggcttgtcggaacggagatgtgtccagagtgaaacggctcgttgatgcggcaaatgtcaatgctaaagacatggccggacggaaaagtagtccactgcactttgcggctggctttggcagaaaggacgtggtggagcatctcctgcaaatgggagcgaacgtgcatgctcgagatgatgggggtctaatcccccttcacaacgcctgcagttttggccacgccgaggttgtgtccctgctgctttgtcagggggcagatcccaatgcgagggacaactggaactatactccactccatgaggccgcaatcaaagggaaaattgacgtttgcatcgtgctgttacagcatggtgccgaccctaatatccgaaatactgatggcaaaagtgctctggacctagccgatccatccgccaaagcagtactgacgggagaatataaaaaggatgaacttttagaggcagcacggtcagggaatgaggagaaattaatggccctgctcacacctttaaatgtcaattgccacgcctccgacggtagaaaatccactcctctgcacttggccgcaggatacaatcgcgttcgaatagtgcagctcttactgcagcacggcgcagacgtgcatgctaaagacaagggcggtctggtgcctctgcataacgcttgttcatatggccactatgaggttaccgagctgttgctgaagcacggtgcatgcgtgaacgctatggatctctggcagtttacacccctgcacgaggctgcctctaaaaaccgcgtcgaagtttgttccctattactctcccatggggcagaccccactctagtgaattgccatggcaaatctgcagtggatatggcacccacacccgaattgcgcgagaggctgacctatgaattcaaaggccatagcctgctccaggcagcaagggaagccgacctggccaaagttaagaagactctggcgcttgagatcattaatttcaaacagccgcagagtcatgaaactgcactgcactgtgccgtagcgagtctgcatccaaaacggaaacaggtcactgagctgttactcaggaagggagccaacgtcaatgagaaaaacaaggacttcatgacccccctgcacgtcgctgctgagcgcgcacacaacgatgtgatggaagtacttcataaacacggagcaaagatgaatgcactggatacactgggacaaacagctcttcaccgtgctgcgctagcaggtcacctgcagacttgccgcctgctgcttagctacgggtctgatccatctatcatctcccttcaaggctttaccgccgctcagatggggaacgaagccgtgcagcaaatcctaagtgagtctacccccatcagaacctctgatgtggattacaggctcttagaagctagtaaagcaggcgatctggagaccgtcaaacagctatgcagttcccagaacgtgaactgtagagacctggaagggagacacagcactcccctgcatttcgccgctggatataaccgcgtgtccgtggtggaatacttgctgcaccatggcgctgatgtacatgctaaggacaaaggtggcctcgtcccactgcataacgcgtgctcctatggtcactacgaagtcgccgagttgttagtgcggcacggagcctctgttaatgtagctgacctgtggaagtttaccccccttcatgaagcagctgctaaaggtaagtatgaaatatgcaagctactgctgaagcacggggctgacccaaccaagaagaaccgggatggtaacacgcctctagacctggtgaaggagggggacacagacatccaagacctcttacggggtgatgccgcacttctggacgccgctaaaaagggatgtcttgccagggtgcagaagctgtgcacacctgagaatatcaattgtcgggacacgcagggtagaaacagtactcccctacacctagcggctgggtacaacaacctggaggtagccgagtacctgctcgagcatggagctgacgtgaacgcccaagataaaggagggcttattcctctgcacaatgcggctagctatggacacgtggatattgccgctctgctgatcaaatataatacctgcgtgaatgcgacagacaagtgggcctttaccccactgcacgaagccgctcaaaagggcagaactcagctgtgcgcgctcctgctggctcacggagctgatcctaccatgaaaaatcaggagggtcaaacccccttggacctggccacagccgacgatattcgcgctctgctgattgatgccatgcccccagaggctctcccaacatgcttcaagccacaggccactgtagtctctgcctctctcatttccccagcctccacccctagctgtttgagtgccgcttcttccattgataatctcacaggaccactggcagagttggccgtcggaggggcttctaatgccggtgatggggctgctggtactgaacgcaaagaaggagaggtcgccggtctggatatgaatatatctcagttcctgaaaagcctgggcctcgaacatcttagagacattttcgaaactgaacagatcaccctcgatgtccttgctgacatgggacatgaggagctcaaagaaattggcatcaacgcctacgggcacaggcacaagctaatcaagggcgtggaaagactgctggggggacaacaggggactaatccgtatttaacctttcactgtgtgaaccagggaacaatccttcttgatttagcacccgaggacaaggagtatcaaagcgtagaagaggagatgcagtcaaccatccgggagcatcgggacgggggtaatgctggcggaatattcaacaggtataacgtgattcggattcaaaaagttgttaataaaaaactgcgcgaacggttttgtcaccgccagaaggaagtgagtgaagaaaaccacaatcatcataacgaaaggatgttattccacgggagtcccttcattaatgctattattcataagggttttgatgagagacacgcctatatcggtggcatgtttggagctggcatctactttgcagagaattcgtctaagagtaaccagtatgtgtatggcatcggagggggaaccggctgccctacacataaagatagaagctgctacatttgtcatcgacagatgctgttttgtcgtgtaaccctaggaaagagctttctgcaatttagtaccatgaaaatggcgcatgcaccgcctggccatcacagcgtcattggacggccaagcgtgaacgggctcgcttatgctgaatacgtaatttacagaggagaacaagcctatcccgaatacctgatcacgtaccaaattatgaagcctgaagcccctagccagacagccactgccgcagaacaaaaaacctag

SEQ ID NO: 31047 - DNA, 3501 bp, Artificial Sequence
  Description of Artificial Sequence: Synthetic coding sequence
atgtctggcagacgatgcgcgggtggaggggctgcctgcgcgagcgccgctgcagaggccgtggagcccgcagctagggaattattcgaggcgtgccgaaatggggacgtggagcgggtgaagcggctggtcactccagaaaaggtcaactcacgagacaccgctggcaggaaaagcacacccctgcactttgccgcaggatttggcaggaaggacgtggtggagtacctgctgcagaatggggcaaacgttcaagcgagggatgacgggggtctaatccctttgcacaacgcttgtagtttcggtcatgccgaggtggttaacctgctgttacggcatggtgccgacccaaacgccagagacaattggaattatacccctctccatgaagctgctatcaagggtaaaatcgatgtgtgtatcgtccttctccagcacggcgcagagcctaccatccggaacaccgatggtaggacggctctggacttggctgatccctccgcgaaggcagttttgaccggggagtacaaaaaagatgagctactggagtcagcccgttcaggcaatgaagaaaagatgatggcgctgctgaccccattgaatgtgaactgtcacgcctctgacggaaggaagagcacacctcttcacctcgctgcaggttataaccgcgttaagatcgtgcaactgctgttgcagcatggagcagacgtgcatgctaaagacaaaggcgacctcgtgccgctgcacaacgcatgcagttatggccactacgaggtgaccgaattgctggttaaacacggagcatgcgtgaatgctatggacctgtggcaattcactccccttcacgaggccgcaagtaagaatagagtggaggtttgcagcctcctgttgagctatggggctgacccaacgttactgaattgtcacaacaagtctgccattgatctggctcctactccgcaactcaaagaacggctggcctacgagttcaagggccatagcctcctccaggccgcacgggaagcagatgtgacccgtatcaagaagcacctgtccttggaaatggtgaattttaaacacccacagactcatgagacagctctacactgcgcggctgccagcccttatccaaagcgcaagcagatttgcgaactgctgttaagaaagggggcaaatataaacgaaaaaacgaaggaatttcttacgcctttgcatgtggcaagtgagaaggcccacaatgacgtggtagaagtggtggttaagcatgaagctaaagtgaatgccttggataacctaggccagacctccctacacagggcggcttactgcggccaccttcagacttgcagactgctgttgtcgtatgggtgtgaccccaatatcatatcactgcaggggtttaccgccctccagatggggaatgagaacgtgcagcaactgctccaggaggggatcagcttgggtaattctgaggctgatcgacagctcctcgaggcggctaaggccggagatgtcgagacagtgaagaaactctgcacagtacagtcggtgaattgcagagacatcgaaggtaggcaatccacgcccctgcatttcgccgcagggtacaatagggtgagcgtagttgagtacttactgcagcatggagcagacgtgcatgccaaggataaagggggactggtgcccttacataacgcttgtagctacgggcactatgaggtggccgaactgctggtgaaacacggcgcagtggtgaatgtggctgacctgtggaagtttaccccactgcatgaggccgctgcgaagggcaagtacgagatttgcaagcttttgcttcaacacggagctgaccccactaaaaagaaccgtgatggcaacactcctctcgatctcgtaaaagatggtgatactgacatacaagacctgctgaggggggacgccgctttgttggatgcagcgaagaagggttgtcttgcgagggtaaaaaaactctcatcccctgacaatgtgaattgtcgcgatacgcagggacgacactccacccctttgcacttggccgcaggttataataacttggaggtagcagaatatcttcttcaacatggagcggacgtcaatgcccaagacaagggagggctaattcctctgcacaatgcggcttcctacggccatgtcgacgtcgccgctctgctgatcaaatacaatgcatgcgttaatgctaccgataagtgggcgttcaccccgctgcacgaggcagcgcagaagggcagaacacagctgtgcgccctcctgcttgcacacggggcagatcctactctgaagaatcaggagggacagacacctctagacctagttagcgcagatgacgtgtctgcgttactaaccgcagcgatgccaccgagcgctctgccttcttgctataaacctcaggtactgaacggagtgcgctccccgggtgctaccgcagatgctctatcttctggacccagttctccatcatctctttcagctgcctcttctttggacaacttatcaggcagtttctccgaattgtcatcggtcgtcagcagctctggcaccgaaggcgcttcttcactagagaagaaggaggtccccggtgtcgacttttcaattactcagttcgtgcggaacctgggactggaacatctgatggacatctttgaacgggagcagatcactctggacgtactggtggagatgggacataaagaactgaaggagatcggcattaacgcctatggacacaggcacaaactcattaaaggagtggagaggttgattagcggccaacagggactcaatccatacttgaccttaaatacgtcagggagcggcactatcctgatcgatctatcccccgacgataaggaattccaatccgttgaggaagaaatgcaatctacagttcgagagcaccgtgatgggggacacgcaggcggaatatttaaccggtataatattctcaagatccagaaggtatgtaacaagaagctgtgggaacggtacacacacagacggaaagaggtgtcagaggagaaccacaaccacgcaaatgagaggatgttattccatgggagtcctttcgtgaatgccatcatccacaagggcttcgatgagcgccacgcttacattggtggcatgttcggagctggcatctacttcgcagaaaattcctctaagtctaaccaatatgtttacgggattggagggggaaccggatgcccagttcataaagataggtcttgttacatctgccacagacaactccttttctgcagagtcaccctggggaagagtttccttcaattctccgctatgaagatggcccacagcccaccgggtcaccattctgtgaccggccgaccatcggtgaatgggcttgcgctggccgagtacgtgatctacaggggtgaacaggcctatcccgagtatctgattacctaccagataatgcgtccagagggcatggtggatggctag

SEQ ID NO: 31048 - DNA, 2139 bp, Artificial Sequence
  Description of Artificial Sequence: Synthetic coding sequence
atgcgggagcccgcattggcagcatctgcaatggcttatcacccctttcatgctcccaggccggcagactttcccatgagcgccttcctcgcagcagcccaaccctctttcttccctgctctcgctctgccacctggggcattggccaagccgcttcccgacccgggacttgccggagccgcagcggctgctgcagcggcagcagccgcagccgaggcaggattacacgtcagtgctctcggcccacaccccccagctgctcatctgcgttccctgaaatcgctggaaccggaagacgaggtagaggacgatcctaaggtaacactcgaagccaaggagctgtgggaccagttccataagctcggcacggagatggtgataacaaaatcaggacggagaatgtttcctcctttcaaggtcagagtgtcagggctggacaaaaaagcgaaatacatcttgctgatggacattgtcgcggcagacgactgccgctacaaatttcacaactccaggtggatggtggcaggcaaagctgaccctgagatgcccaagcgcatgtatattcaccccgactctcctgccaccggagaacagtggatggcaaagcctgttgcttttcacaaactcaagctgaccaataatatcagcgacaaacacggcttcactattctcaacagcatgcacaagtaccaacccagattccacatcgtgcgtgccaacgatatcctgaagctgccatactctactttccgaacatatgttttcccggagacagactttatagccgtgaccgcctatcagaacgataagatcacacagctgaagattgacaataatcccttcgccaagggatttcgggatacaggtaatgggagacgggagaagcggaagcagctgactctgccgtctctcagactgtatgaagaacactgcaaaccagagagggatggagccgagtcagacgcttcgagctgcgatccgcctcccgcaagagagcccccaacttcacctggagccgcaccctcacccttgcgcttacaccgtgcacgggcagaagagaaaagctgcgcggctgattcagatcccgagccagagcgcctttcagaagagcgagcgggagcacctttagggagatcccccgcaccagactccgcatcccccacaaggcttaccgagcccgagcgggctagggagcgccgatcccccgaacgcggaaaggaaccagccgagtccgggggtgacggaccttttggactgcgcagtctggaaaaagaacgagccgaggccaggcgaaaagatgaaggtcggaaagaggcagcagaaggtaaggaacaaggcctggctcctttagtggtccagacagacagcgcttcaccactcggggcagggcatttacccggtcttgccttctccagccatctgcacggccagcagtttttcggtcccctgggcgctggccagccactgtttctgcatcccggacagttcactatgggccctggcgcattctctgccatgggcatggggcacctgctggcgtctgtggcagggggaggcaatggcggaggtggcggacctggaaccgctgcaggtcttgacgcaggcggactggggccagctgccagtgcagcttctacagccgctccctttccttttcacctgtcccagcacatgctggcgtcccagggtatccccatgcctacgtttggtggtctatttccttatccctatacttacatggcagccgctgctgctgctgcatctgcgctgccagctacctctgcggcagccgctgccgctgcagcagccggttctctttcgagaagtcccttcttggggtccgcgagacctcggcttagattttcaccttatcagatcccagtcactattcctccgtcaacttctttactgaccactgggttggcatccgaggggtccaaggcagccggtggcaactcccgggagccatctcctcttcctgagctggcccttaggaaagtcggcgcacccagcaggggtgctctgagccccagcggatcagccaaggaggccgctaatgaactccagtctatacagagactcgtatccggcttagaatcgcagcgcgcattgagcccaggacgggagtcccctaaatag

SEQ ID NO: 31049 - DNA, 981 bp, Artificial Sequence
  Description of Artificial Sequence: Synthetic coding sequence
atgagcgcctttcttgctgccgctcaaccctcctttttccccgctctagcgctccctcccggagctctggctaagcccctaccagaccctggactggctggagccgctgcagccgctgccgcagctgctgcggctgccgaggctggcctgcatgtctctgctctcggccctcaccctcccgctgcccacctccgctcactcaaaagcctagaaccagaagatgaggtcgaagacgaccctaaggttaccctggaagctaaggagctctgggaccaattccacaagctcggcacggagatggtgattaccaagtcaggaagaagaatgttccctccttttaaagtgcgcgtgtcggggctggataagaaagccaaatatatacttctcatggacatagtggcagctgatgactgcagatacaagtttcacaattccaggtggatggtagctggcaaggcagatccagaaatgccaaagcggatgtacattcacccagattccccggctactggggaacaatggatggctaaacctgtagcatttcataagctgaaactgaccaataatatctcagataagcacggtttcacgattctgaactcaatgcacaagtaccagcccaggtttcacattgtgcgtgccaatgatatcctgaagctaccttatagcacctttcggacgtatgtgtttccagagactgacttcatcgcggtgaccgcttatcagaatgataagattacccagttgaagatagataacaaccccttcgccaaaggcttccgagacaccggtaacgggcgaagggagaaacgaaaacaactgacgctccctagtctcagactgtatgaggagcattgcaagcctgaacgcgatggtgctgaatcagatgcctcctcctgcgacccgccacccgcaagggagccgccaacatctcctggggctgcgccatctccactaagactccaccgcgcaagaggttag

SEQ ID NO: 31050 - DNA, 996 bp, Artificial Sequence
  Description of Artificial Sequence: Synthetic coding sequence
atgaccgagaggccacctagtgaggcagccaggagtgacccacaactggaggggagggacgccgctgaggccagtatggctccacctcacctggtcctgttgaacggagttgcaaaggaaacctcccgggctgcagctgcagagcctcccgttatcgagctgggcgcaaggggaggtcccggaggaggaccagcgggagggggtggagctgccagggacctgaagggacgcgatgcagctaccgccgaagctcgccacagggtccctactaccgagctctgcagaccgcctggtccagcccctgccccagcgccagcaagtgtgacggcggaactaccgggtgacgggcgtatggtgcaactgtctcccccagctctggcagccccagcagcccctggaagagccctactctactctctgagtcagccactggcgtcactggggtctggcttttttggggagcctgacgcgtttcccatgtttaccacaaacaatagggtgaaacggaggccgtctccttacgagatggagattacagatggacctcataccaaggtggtacgcagaattttcaccaattctcgggagagatggagacagcagaatgtgaatggagcgttcgctgagctccgtaagctcattcctacgcacccacctgacaaaaagctgagcaagaacgagatactcaggcttgccatgaaatatatcaattttctagcaaaactgctgaacgatcaggaggaggagggcacacagagggcaaagaccggtaaagatcccgtagttggtgccggaggtggaggaggcggaggtggcggaggagctcccccagatgatctgttacaggacgtgctgagccctaactcttcctgcgggagttctttagatggcgctgccagccctgattcttatacagaagagcctgctcctaaacacactgcaagaagtttacatccagcaatgctgcctgctgccgatggcgcaggccctaggtag

SEQ ID NO: 31051 - DNA, 1002 bp, Artificial Sequence
  Description of Artificial Sequence: Synthetic coding sequence
atgacagagcggcctccctcggaggcagcgcgttcagacccacagttggagggtcgcgacgcggcagaggctagcatggcccctccacacctcgtgctgctgaacggcgtggcgaaagaaaccagccgagcagccgctgccgagccaccagttatagagttgggtgcgaggggcggacccggtggtggtcctgccggtgggggaggcgcagccagagatttgaaggggagggatgcagctactgccgaggctcgacacagggtgccaacaaccgaactatgtcgccctcctggtcctgccccagcacctgctcccgcttccgtgacagcggagctaccgggtgatggacgcatggtacagctgagccccccagctttagctgcaccggcagcacctggcagggcactactctattccctctcacagcccctcgcatctcttgggtctcactccgggttttttggcgaaccagacgccttcccaatgtttacaacaaataatcgagtaaagcgcaggccaagcccctatgagatggaaatcactgatggcccacacaccaaagtggtccgccgtatttttactaatagccgcgagcggtggaggcagcagaatgttaatggtgcattcgcagagctgcgaaagttgattcccacacatcctcctgataagaagttaagcaaaaacgagatcttacgcttggctatgaagtacataaactttcttgccaaactccttaacgatcaagaagaagagggcacacagcgggcaaaaaccggcaaggatccggttgttggcgcaggaggtgggggaggcggagggggagggggagcacccccagacgatttattacaggatgtactatcaccaaatagctcctgcggaagttctcttgacggagctgcctcccctgatagctatactgaagaacccgcacccaagcataccgctcgatcgctccacccggctatgctcccggctgccgatggcgctggtccgcgttag

SEQ ID NO: 31052 - DNA, 996 bp, Artificial Sequence
  Description of Artificial Sequence: Synthetic coding sequence
atgaccgagaggcccccttccgaagccgcaaggagcgatccccagctcgagggtagggacgccgctgaggccagcatggctccccctcatctggtgctcctcaacggcgtggctaaagagaccagccgcgcagctgccgcagagccccctgtgatcgagctaggcgcacgcggtggccctgggggtggaccagcaggcggaggtggggcagctagggacctcaaggggcgtgatgccgcaactgctgaggcccgacacagagtcccaactactgagctgtgtagacccccagggccagcaccagctcccgctccagcttccgtgacagcagagctgcccggtgatggcaggatggtccaacttagtcctcctgctctggccgctccagcagctccagggagggctctcttatattccttgtcccagcctctggctagtctcggctccgggttctttggtgaaccggatgcgtttccaatgtttaccactaataacagggtgaaacgccgaccttctccatacgagatggagatcaccgacggacctcacacaaaggtagtgcgtcggatctttactaattcccgggagaggtggagacagcaaaatgttaatggagccttcgccgagctccgaaagctgatccccacccatcctccggataaaaagcttagcaagaacgaaatactgcggctggccatgaagtatatcaattttctagccaaattgttgaatgatcaggaggaggaaggaacacagagagcgaagaccggcaaagaccccgtcgtaggcgctggtggaggcggtggcggaggtggaggaggtgcaccccctgacgacctgctccaggatgtgctttcaccaaattcatcttgtgggtcgagtttagacggcgctgcatcccctgattcatacacggaggagcctgcccctaaacacacggccagatccctgcaccccgcaatgttgcccgcagccgacggagccggtccaaggtag

SEQ ID NO: 31053 - DNA, 993 bp, Artificial Sequence
  Description of Artificial Sequence: Synthetic coding sequence
atggaacacctcggccctcatcacctccaccctggtcatgccgaacctatatcctttggaatcgaccagatcctgaacagtcctgaccaaggcggttgcatgggcccagccagccggctacaggacggcgagtatggactgggatgtctcgtcggaggggcatacacatacgggggtgggggatcagcagctgcaaccggggctgggggagcgggagcttatggcactggaggccctggcggtccaggaggaccggcaggcggaggcggagcctgctcaatgggccctcttaccggatcctacaacgttaacatggccctagccggaggcccagggccagggggtggcggaggaagtagcggcggagcaggagcgttgtcagcggctggtgtgatacgtgtgcctgcccatcgcccactggctggcgctgtggctcacccccagccattggctactggtttaccaaccgtcccgagtgtgccagccatgcctggggtgaacaacctgacaggtctcaccttcccatggatggagtccaacaggagatatacaaaggacaggttcaccgggcacccttaccagaatcgaactccaccaaaaaaaaaaaaacctagaaccagctttacaagactgcagatttgcgaactcgaaaagagatttcaccggcagaagtacctcgctagcgcagaacgcgctgccctggcgaaggcactgaagatgacagatgctcaagtgaagacatggtttcagaatcggagaacaaaatggcgacggcagacggctgaagagagagaggccgaaaggcagcaagcaaaccgcatacttctccagctacaacaggaggcgttccagaagtctctagcccagcctctgccagccgaccctctgtgcgttcataactcctcgctcttcgccctgcagaacctgcagccttggagtgatgactctactaaaatcacctccgttaccagtgtcgcgtcagcttgcgagtag

SEQ ID NO: 31054 - DNA, 774 bp, Artificial Sequence
  Description of Artificial Sequence: Synthetic coding sequence
atggaacatctggggcctcatcatctccatcctggccatgccgagccaatcagcttcgggattgaccagattcttaattccccggaccagggagggtgcatgggtcctgctagtaggctccaggatggagaatatgggttgggatgtctggtgggcggtgcttatacatatggcggaggcggatccgccgcagccactggtgcgggaggggctggggcatatggaaccggagggcctggaggcccagggggacccgctggtgggggtggcgcttgttctatgggaccacttaccggttcctacaatgtgaatatggcactcgccggagggccagggcctggcggtggcggtggaagtagcggcggtgctggcgctctctccgccgctggggtcatccgcgtcccggctcatcggccactcgctggtgctgtagctcaccctcagcccctcgccactggtttgccaaccgtgccttccgttcctgccatgcccggagttaacaacttgacagggttaacattcccttggatggagtccaatcgaaggtacaccaaagataggttcaccggccacccctaccagaatagaactccaccgaaaaagaaaaagcctagaactagctttacacggctacagatctgtgaacttgagaagcggttccaccggcagaagtacctggcctctgctgagagagccgcactggcaaaagctctcaagatgactgatgctcaggtaaagacctggttccagaatcggcgaactaagtggaggtag

SEQ ID NO: 31055 - DNA, 345 bp, Artificial Sequence
  Description of Artificial Sequence: Synthetic coding sequence
atggccgaatgtccaacgcttggtgaggccgtaacagatcacccggaccggctttgggcatgggaaaaattcgtgtacctggacgaaaagcagcacgcatggctgccactgaccattgagattaaggatcgcctccagctgcgggtcctgcttaggcgtgaagacgtcgtcctgggacggcctatgaccccgactcagatcggaccctctttgctgcccatcatgtggcagctgtacccagatgggaggtacagaagcagcgatagttctttttggaggctcgtttaccatatcaagatcgatggggtggaagacatgctcttggagctgcttcctgacgactag

SEQ ID NO: 31056 - DNA, 345 bp, Artificial Sequence
  Description of Artificial Sequence: Synthetic coding sequence
atggccgagtgcccaacgctcggcgaagctgttacagatcacccggatcgtctgtgggcttgggaaaaatttgtgtatctcgacgaaaagcagcatgcatggttgccccttaccatcgagatcaaggatagactccaactgcgggtgctcttacgcagggaggacgttgtgctggggagaccaatgaccccaacgcagatcggacctagcctgcttcctatcatgtggcagctgtatcccgatgggcgttatcggagctctgacagctctttctggcgcctcgtttatcacataaaaattgacggtgtggaggacatgctcctagagttattgcctgatgattag

SEQ ID NO: 31057 - DNA, 345 bp, Artificial Sequence
  Description of Artificial Sequence: Synthetic coding sequence
atggccgagtgtccaaccctgggcgaagcagtgacagaccatccagacaggctgtgggcttgggaaaagttcgtctacctggatgagaagcagcacgcgtggttacccctgacaatagagatcaaggaccggctacaactgcgtgttctgctgcgccgtgaagatgtggtcctcgggaggcctatgaccccaacccaaattggccctagcctactaccgatcatgtggcaactatatcccgacggacgatacaggtcatccgatagctcattctggaggctggtgtatcacataaagatcgacggcgtggaggatatgctattagagctgctccccgatgattag

SEQ ID NO: 31058 - DNA, 345 bp, Artificial Sequence
  Description of Artificial Sequence: Synthetic coding sequence
atggccgagtgtccgacgttgggcgaggcagtgactgaccatcctgatcgcctttgggcatgggaaaagttcgtgtacctggatgagaaacagcatgcctggctgcccctgaccatcgagattaaagaccgcctgcagctacgggtcttactcagaagagaggacgtggtcctgggacgccctatgactcctacccagattggaccatctcttctcccaattatgtggcagctttatcccgacgggaggtataggtctagtgactccagtttttggaggttggtctaccacatcaaaattgatggagtcgaagacatgctgctggagctcctaccagacgattag

SEQ ID NO: 31059 - DNA, 1407 bp, Artificial Sequence
  Description of Artificial Sequence: Synthetic coding sequence
atggatagcttagcctcgttggtgctatgcggcgtgtctctactgttgagcgggacagtggaaggcgctatggatctcatcctcattaactcacttccgttagtgagtgacgccgaaacctccctgacatgcattgctagcgggtggcgaccccacgagcctattactattggtagggatttcgaagccttaatgaaccagcatcaggatcccctcgaagtcacccaggatgtgactcgtgagtgggcaaaaaaggtggtctggaagagggaaaaggctagcaagataaacggagcttacttctgtgagggccgtgtgaggggcgaggctattaggatcagaaccatgaagatgcggcagcaggcctcattcctgcccgcaacattgactatgacagtggataagggtgacaacgtgaatatatcgtttaaaaaagttcttatcaaggaggaggatgccgtaatttataagaacggatccttcatacactccgtgccacgccatgaagtccctgatattctggaagttcatctgcctcacgctcagcctcaagatgcaggcgtttatagtgcccgatatatcggagggaatctgtttacgagcgccttcactagactgatcgtgcgcagatgtgaagctcagaagtggggccctgaatgtaaccatctgtgcaccgcttgcatgaataatggtgtgtgccacgaggacactggcgagtgcatctgcccacccggattcatgggtaggacctgcgagaaggcttgcgagcttcacacttttggcagaacctgtaaggagagatgctctggccaggaaggctgcaaatcgtatgtattttgcttacctgacccctacggctgttcgtgcgccactgggtggaaaggactgcaatgcaatgaggggatccagaggatgacccccaagattgtggacctgcccgaccatatagaggttaactccgggaagttcaacccaatctgcaaggcgtccgggtggcctttgccgacgaacgaggagatgacattggtgaagcccgacggcactgtgctgcatccaaaagattttaatcataccgaccacttcagcgtggcaatcttcactatccatcgtatcctaccacctgactcaggggtgtgggtttgctctgtgaacactgtggccggaatggtcgagaagccctttaacattagtgtgaaggtattacctaaacccctgaacgccccaaacgtgatcgacaccggccataattttgcagtcatcaatatttcctccgagccatactttggcgatggccctataaagagcaagaagttgctgtacaagccagtcaaccattatgaggcctggcaacatattcaggtgtcaatggaaaagcaaagactgaccaaagccaattccgacatctag

SEQ ID NO: 31060 - DNA, 3375 bp, Artificial Sequence
  Description of Artificial Sequence: Synthetic coding sequence
atggacagtttggcaagtctggtgttgtgtggcgtaagtctcttattgtctgggacagtggaaggcgctatggatctcatcctgatcaactctctgccactggttagcgacgctgagaccagcctgacctgcattgctagtgggtggcgacctcacgagcccattacaatcggacgggattttgaggctctaatgaatcagcaccaggaccctctggaagtgactcaagacgtgacacgcgagtgggctaagaaggtggtgtggaaacgggagaaagctagtaagatcaatggcgcatatttttgcgaaggacgagtccgcggagaggccatcagaatccgcaccatgaagatgcgccagcaagccagctttctgccagctacactgaccatgactgtggataagggcgataatgtgaacatttccttcaagaaggtactgatcaaggaagaggacgcggtgatttataagaatggtagctttatacacagtgttcctcggcacgaggtgcccgatattctggaggtccacttaccgcatgcccagccacaggacgcaggcgtctactccgctcggtatattggtggaaacctgttcaccagcgctttcaccaggttgatagtcaggcggtgcgaggcacaaaaatgggggcctgagtgcaatcacctgtgtaccgcatgcatgaataatggggtttgccacgaggatacaggcgagtgcatctgcccacctggctttatggggaggacctgcgaaaaagcctgcgagctgcatactttcgggaggacttgcaaggaacgatgctccggacaagaaggctgcaaatcgtatgtcttttgtctccccgacccgtatggatgtagctgtgcaaccggatggaaggggttgcaatgcaacgaggcctgtcacccaggtttttatggacctgattgtaaactgcgatgctcctgtaacaacggtgagatgtgcgaccggttccaaggctgtctctgttccccaggctggcagggcctgcaatgtgaacgagagggcatccagagaatgacccctaagattgttgatttgcctgatcatatcgaagtcaattcaggcaagtttaatcccatctgcaaagctagtggatggcctttgccgactaatgaggagatgactttagtcaagcccgatggcacggtcttgcaccccaaggattttaaccacacggatcacttctctgtggccatctttacaattcaccggattttacccccagactcaggagtatgggtgtgtagcgtaaataccgtcgccggtatggtggaaaaaccttttaacatatctgtgaaagttctgcctaaacctttgaacgctcccaacgttatcgacaccggccataacttcgccgtgatcaacatctctagcgagccttatttcggcgacgggccaattaagagtaagaagctcttatataagcctgtgaaccattatgaggcctggcaacatattcaggtgactaacgaaattgtaaccttaaactatctggaacctcggaccgagtacgagctttgcgttcaactggtgaggcgcggagaaggcggagagggtcatccagggcctgtgcgtcggtttacgactgcctccatcgggctgcctccgcctcgcggtttaaatcttctcccaaagtctcagactactctcaatctgacgtggcagcctatttttcccagctccgaagacgacttctacgttgaagtcgagaggcggagcgtgcagaagtccgatcagcagaacataaaagtcccagggaacctgacgtccgtgctactgaataatctccatccgcgagaacagtacgtggtgagagcacgggtgaataccaaggctcagggagagtggagcgaggatctaacagcctggactttgtcagatatcctcccaccgcaaccagagaacattaagatctccaacattactcacagcagtgccgtaatttcttggacaatcttagacgggtatagcatcagttccataaccattcgctacaaggtacagggtaagaatgaagaccagcatgtggatgtcaaaataaaaaatgcaacaataacccagtaccagttgaagggtttggagccagaaacagcctaccaagtggacatcttcgcagagaataatatcggctcgagtaatccagctttcagtcacgagctggtgactctccctgagtcccaggctcctgctgaccttggtggagggaaaatgctgctcattgcaatcctgggcagcgccggaatgacatgcctgacagtcctcctggctttcctgattatcctgcagcttaagcgggcaaatgtgcagcgtcgcatggcccaggctttccagaacgtccgggaagagcccgcagtccagttcaactctggaacactcgccctcaataggaaagttaagaacaatcccgatcccacaatatatcccgttcttgactggaacgacattaagtttcaagatgtgatcggggaaggcaattttggacaggttcttaaagccagaatcaaaaaggatggactgcgcatggacgcagctatcaagagaatgaaagagtacgcttctaaagatgaccaccgggatttcgcgggagaactggaagtgctctgcaaactgggccatcatccgaatattattaacctgctcggcgcatgcgagcaccgtggttacctatacttggcgatcgaatacgctccacacgggaacctcctggacttcctgaggaagagtcgcgtgctggagaccgaccctgccttcgccatagcaaactcaactgcctccaccctctccagccagcaactacttcacttcgctgcagatgtagcaagaggaatggactacctgagccagaaacaattcatccatagggaccttgccgctcgtaacattctggtcggagagaattacgttgccaagatcgccgatttcggcctcagtcggggacaggaggtgtacgtgaagaaaacaatgggcagactgcctgtgcggtggatggcaatagaatccctaaattacagtgtttacactacaaacagtgatgtgtggtcctatggcgtgttgctctgggagattgtgtcactaggcggaactccttactgtggaatgacatgcgccgagctgtacgagaagctccctcagggctacagattggagaagccgcttaactgcgatgatgaagtctacgacttaatgagacagtgctggagggagaaaccgtatgaaagacctagctttgcgcagatcctcgtaagcctgaaccgaatgctggaagaaagaaaaacgtatgtcaatactacactgtatgaaaaatttacttacgcaggtattgattgcagcgccgaagaggccgcttag

SEQ ID NO: 31061 - DNA, 3246 bp, Artificial Sequence
  Description of Artificial Sequence: Synthetic coding sequence
atggacagtttagcatccctggtgttgtgcggcgtctccctgttgctgagcgggacagtggagggcgctatggacttgatcctcattaacagcctgccgcttgtgtcagatgctgagacatctctcacttgcattgcctccggctggagacctcacgaacccattacgattggcagggacttcgaggccctgatgaaccagcatcaggacccattagaagtgactcaagatgtgacccgagagtgggctaaaaaggttgtctggaaaagggaaaaggctagcaagattaacggcgcatacttctgcgagggacgggtcaggggcgaggctatccggattcgaaccatgaagatgcggcagcaggcaagttttctacccgcaacactgacaatgacagtagataaaggtgataatgtgaacattagctttaaaaaggtgctaattaaggaggaggacgcagttatttacaagaacggctctttcatccactctgttcccaggcacgaggtgcccgacatactggaagtacacctgcctcacgctcagccacaagatgccggagtctactccgctcgctatatcggaggcaatctgttcacatcagcatttacgcgcctgatagtgcggagatgcgaggcccagaagtggggcccagaatgcaatcatctctgtacggcatgtatgaataatggtgtttgtcatgaggacaccggcgagtgtatttgcccccctggcttcatgggcaggacatgcgagaaggcatgcgaattgcacactttcggaaggacctgcaaggagcgctgctccggccaggaggggtgcaaaagctacgtattctgtcttccagacccttacggttgtagttgtgccacgggttggaaaggtctccaatgcaatgaaggaatacagaggatgacccctaagatcgttgacttacctgaccacatcgaagtaaatagtggaaagttcaatcccatttgcaaggcttccggttggcctttgccgactaatgaggagatgactttagtgaagcccgacgggaccgtgctgcatccaaaagacttcaatcacaccgatcatttctcagtagccatttttaccattcaccgcattttaccgcctgattcgggagtgtgggtgtgcagcgtgaacactgtagcgggaatggtcgagaagcccttcaatatctccgtcaaggtgctgccaaagccattgaatgctccaaatgtgatagacactgggcataatttcgccgtgattaatatttcgagtgaaccctatttcggagatggccctatcaaaagcaaaaaattgctctataaacccgtgaaccactacgaagcttggcagcatattcaggtcacaaacgagattgtgacccttaactacctggaaccccgaaccgagtacgaactctgtgtccaattggtgaggcggggtgaaggcggagagggacacccgggaccggtacgacgattcaccactgctagcattggacttcccccacctcggggattgaatctgctccctaagtcgcagactaccttaaatctgacatggcaaccaatattcccgtccagcgaggatgatttctatgtggaggtcgagcgcaggtccgtccagaagagcgatcagcagaatataaaagtgcctggtaacttgacttccgtattgcttaataaccttcacccgagggaacaatacgtcgtgagagcccgagtaaacacaaaagcacagggcgaatggtctgaagacctcaccgcctggacattgtcagacatccttccaccccagcctgaaaacatcaagatctccaacatcacacattcaagcgccgtaatttcatggaccatactggatggttattcaatttctagtattacaattcgatataaggtgcaggggaagaatgaagaccaacacgtcgacgttaagatcaagaatgctaccattactcaatatcagcttaagggccttgagcccgagactgcttaccaggtggatattttcgctgagaataacataggatcatcaaacccagctttttcccacgagctggtgacattaccagaaagccaagccccagctgacctggggggaggcaaaatgttgctaattgccattctaggatccgctgggatgacatgtctcaccgtgctcttagcatttctcatcattctacagttgaaacgagctaatgtgcagcgcagaatggcccaggcttttcaaaacgtgagagaagagcctgctgtacaattcaattcgggcacattggctttgaatcgcaaggtgaagaacaaccccgaccccacaatttacccagtgctggattggaatgatatcaaatttcaagacgtcattggggaaggcaattttgggcaagtgctgaaggcacggattaagaaggatggcttgcggatggacgccgcaattaagaggatgaaagagtatgctagcaaagatgatcacagggattttgctggagaactggaggttctgtgtaagctcgggcaccaccccaacataataaacctgctgggtgcctgcgaacaccggggatacttgtatcttgctatagaatacgcacctcatggcaacctcctggattttctgcgtaagtcccgagtcctggaaacagatcccgcattcgctatcgctaacagcacagcctctacgctgagcagccaacagttgttgcacttcgccgcagatgtggcacgcggtatggactatcttagccagaagcagttcatccacagggaccttgctgccagaaatattctcgtgggggaaaattacgttgccaagatagccgacttcgggctcagtcggggacaagaggtgtacgtgaaaaagacaatgggtaggctgcccgtgcggtggatggccattgagtccctgaactacagcgtgtacacgacgaattccgacgtgtggagctatggggtattactttgggaaatcgttagtctggggggtacgccatattgtggcatgacttgtgccgagttatacgaaaagttgccccagggctacaggctggaaaaaccactgaattgtgatgacgaggtgtatgacttgatgagacagtgttggcgggagaagccttacgagagacccagctttgcgcagattttggtttccctgaacagaatgctggaggagcgaaagacctatgtaaataccacactgtacgagaagttcacctacgcaggcatagactgcagcgcagaggaggcagcttag

SEQ ID NO: 31062 - DNA, 3375 bp, Artificial Sequence
  Description of Artificial Sequence: Synthetic coding sequence
atggattccctcgctagtcttgttctctgtggcgtgagtctcctgctgtccgggactgtggagggcgcaatggatctcatccttatcaacagtctacctttagtctcagacgctgaaacaagcctgacctgcatcgctagtgggtggcgtccccacgaaccaatcactatcggaagagacttcgaagctctgatgaatcagcaccaggatcccctggaggtgactcaggatgtcacccgggagtgggccaagaaggtggtgtggaaaagggagaaagcatccaagattaacggcgcatacttttgcgaaggccgagtccgcggagaagctatccggatccggacgatgaagatgagacagcaagcctccttcctcccggctacactgactatgaccgtagacaagggggacaacgtcaacatctcttttaaaaaagtcctgatcaaagaggaggatgctgttatatataagaacggcagtttcattcactcagtgcccagacacgaagtaccggatattctggaggtccacctgccccacgcccagccacaagacgcgggagtttactctgctcgttatatcggaggtaacctattcactagcgcattcacccgcctcattgtcagaaggtgcgaggcacagaaatgggggcctgagtgcaaccacctctgtaccgcttgtatgaataacggcgtgtgccatgaggatacgggtgagtgcatttgcccaccaggattcatgggtcgcacctgtgagaaggcttgcgaactacatacgtttgggaggacatgtaaagagaggtgttctggtcaggagggttgcaaaagctatgtgttctgtcttcccgacccgtacggatgtagttgtgccacgggctggaaggggctgcagtgtaacgaagcttgccaccccggtttctatgggcctgactgtaaactgcgctgctcatgcaacaacggcgaaatgtgcgatcgattccagggttgtctctgctcacctggctggcaagggttgcaatgtgagagggagggcatacagcggatgacacccaagatcgtagatctgcccgatcatatcgaggtcaatagcggaaagttcaatcctatctgtaaggcctccggctggccattgccaacaaatgaagagatgacattagtgaaaccagacggcaccgttctacatccgaaggattttaatcacactgatcatttttccgtggccatattcactatccatcggatcctgcctccagactcaggcgtgtgggtatgctcagtcaatacagtcgcgggtatggtggagaagccattcaacatttctgtgaaggtgctgcctaagcctctgaacgcccctaatgtaatcgacactggacacaactttgccgtaattaatatcagtagcgagccgtattttggcgatgggcctatcaagtctaagaagttgttatataagcctgtcaaccactacgaggcctggcaacacatccaggtcactaacgaaattgtgaccttgaactacttggaacccaggaccgagtatgaattatgcgtccagctcgttcggagaggcgagggtggggagggacatcctggacccgttaggcgttttaccaccgcctcaatcggactgccccctcccagagggttaaacctgttgcccaaaagtcagaccacactaaacctcacttggcaacccatctttcctagctccgaagatgatttttatgttgaagtcgaaaggaggtctgtccaaaagtctgatcagcagaacattaaggtgccgggaaatcttaccagtgtgcttctgaacaacttgcatccacgcgagcagtatgtagtccgcgctcgagtgaatactaaagcccagggtgagtggtccgaagacctgacagcctggacactgtccgacatcctacctccacagcccgaaaatattaaaatcagcaacattacgcactcaagcgctgtgatctcttggactatcctcgatggatattccatcagctcaatcactattcgatacaaggtgcaaggcaagaatgaggaccagcacgtcgacgtcaagatcaaaaatgcaaccataacacagtatcagttaaagggactggagccagagacagcataccaggtagacatctttgctgagaataacatcgggtctagcaatcccgctttcagccacgaactggttacactgccagagtcccaggcaccagcggacctcgggggtggaaaaatgctcctcattgcgatactcgggtccgccggtatgacctgcctgaccgtgctgttggcatttctcatcatcttacagttaaaacgggctaacgtgcagcgtcggatggcccaggcttttcagaatgtaagagaggagcccgctgtgcagttcaatagcggtacactggccctgaatcggaaagtcaagaataaccccgatccaaccatctaccccgtgctagattggaacgacatcaaatttcaagatgtgatcggcgaaggcaacttcggccaagtgctcaaagctcgcattaaaaaggacggcctcaggatggacgctgccatcaagcgcatgaaggagtacgcatcaaaggacgatcatcgggacttcgccggagagctggaggtcctctgtaaactggggcaccacccaaatattattaacttactcggagcatgtgagcatcgtggctacctttacctggcaattgaatatgctccccatgggaacttgctcgattttcttcgcaaaagtcgcgtgctcgagaccgaccccgctttcgcaattgcgaactctactgcatcaactctttcctcacaacagcttctccacttcgcggcagacgtcgcaaggggtatggattacctgtcgcagaaacaatttatacacagagatctcgccgcacgcaatatcctggtcggtgagaattatgtggccaaaatcgctgattttggactgtcccggggtcaagaggtgtatgttaagaaaaccatggggcgactgcccgtccgctggatggccatcgagtcccttaactatagcgtttatactaccaactctgacgtgtggtcctatggggtcctgctgtgggaaattgtatcactggggggaactccctattgtggcatgacttgcgccgagctgtatgagaagctacctcagggatacaggctcgagaagcctctgaactgcgatgacgaagtgtacgatctgatgcggcaatgctggcgcgaaaagccatacgaacgacccagctttgcacaaatcctggtgtccttaaacagaatgttagaggaacggaagacctacgtgaacacgaccctgtatgaaaaatttacctatgctggaatcgactgcagcgcagaggaagccgcttag

SEQ ID NO: 31063 - DNA, 2931 bp, Artificial Sequence
  Description of Artificial Sequence: Synthetic coding sequence
atggacagtctggcctcactcgtcttgtgcggcgtttctttgctactctccgcgagctttcttcctgcgacgctcacaatgaccgttgataagggtgataacgtaaacatatccttcaagaaagttctgatcaaggaagaggatgcagtcatctataagaatgggtcattcatacactctgtgccccgacacgaagtgcctgatatccttgaagttcaccttccacacgctcagcctcaagacgcaggggtgtactccgctcgctacataggagggaatctctttacgtcagcttttacaaggctgatcgtccgtaggtgcgaagctcagaaatggggcccagaatgcaaccacctctgcaccgcctgtatgaacaacggcgtctgccatgaagacacaggagagtgcatttgccccccagggtttatggggagaacgtgcgaaaaggcttgcgagcttcacacgtttggcagaacctgtaaggagcgatgctcggggcaggaggggtgcaagtcttacgtgttctgcctgccagatccatatgggtgctcttgcgccacaggttggaagggactgcagtgcaatgagggaatccagcgcatgacaccaaaaatcgtggacctacccgaccatatcgaagttaactcaggcaaattcaatccaatctgtaaagcctcaggctggcccctccccaccaatgaagagatgaccctcgttaagcctgatggaacagtactccaccccaaggatttcaatcacacagaccacttctcagttgccatcttcaccatccaccggattctgccgccagattccggcgtgtgggtgtgctccgtcaatacagtcgccggaatggtcgagaagccattcaatatcagtgtgaaagtcctgcccaagcctttaaatgccccaaatgttatcgacacaggtcacaactttgcggtcataaacatctcctcagagccatacttcggagatggacctattaaaagtaagaaacttctctataagccagttaaccattatgaggcatggcagcacattcaggtcacaaatgaaatcgtaacgttaaactatctagaaccaaggaccgagtacgaactgtgcgtccagcttgtcaggaggggagagggaggagagggccatcctgggccagtgagacgattcaccaccgcgagtattgggctgccacccccaagggggttgaatctgctgcccaagtcccagacgacactcaacctaacctggcagccaatcttcccaagctcagaggacgatttctacgtagaagtggagcgcaggtcagtgcaaaagtctgatcagcagaacattaaagttcccggaaatttgacgtctgtccttcttaacaacctgcatcccagggagcagtacgttgtgcgagcacgggtcaacactaaagcccaaggggaatggtccgaggatctgaccgcgtggacattgagtgacattctgccccctcaacctgagaatattaagatttcaaacatcacgcatagcagcgcagtgattagttggaccatcctggatgggtactcaataagttccatcacaattagatataaagtccagggcaaaaatgaagatcagcatgttgacgttaagattaaaaatgcaacgataactcaatatcagctcaagggattagagccagagactgcctaccaagttgatatctttgctgagaacaacatcgggtcatcaaaccccgctttttcccacgagcttgttactctcccagagtcacaggcccctgccgacttggggggtggtaagatgctgctaattgccatcctgggctcagctggaatgacatgcttgaccgttcttttggctttcctgatcattctgcagctgaagcgcgcaaatgtccaacggcgaatggctcaggcgtttcaaaatcgagaggaacccgctgtgcagtttaactcaggtacattggccctgaataggaaagtcaagaataatccggacccaaccatctatccagttctcgactggaatgatattaagttccaagatgtgatcggtgaaggaaacttcggtcaggtgctgaaggctagaataaaaaaagatggcctgaggatggatgccgcaattaaaagaatgaaggagtacgcctcaaaagacgatcacagagactttgccggagagcttgaggtgctgtgcaagctcgggcatcacccaaacatcattaatttactcggtgcctgcgaacatcggggatatttgtaccttgccattgagtacgctccgcatggtaatctacttgactttttacggaagtccagggtgctggagacagacccagcctttgctattgctaattcaaccgcatccacactgtccagtcagcaattgctgcactttgccgcagatgtcgcaaggggcatggattatctgagtcagaaacaattcatccaccgtgatcttgccgctcgcaatattctagtgggggaaaattatgttgctaagatcgccgacttcggactgagtcggggtcaggaggtgtacgtcaagaaaaccatggggaggctccccgtaagatggatggcgattgagagcctgaactattccgtttatacaacaaactccgatgtgtggtcctatggagtgttgttgtgggagattgtgagcctgggagggacgccttattgcggaatgacttgcgctgagctgtacgaaaagctgccgcagggctatagactcgagaagccactaaactgtgacgacgaagtttatgatttaatgagacaatgctggagagaaaaaccctatgagagaccctcatttgcccagattctggtaagcctgaatcggatgttggaagaacgtaagacatatgttaacaccacgctgtatgaaaagttcacatacgctgggatcgattgctccgccgaggaggcggcatag

SEQ ID NO: 31064 - DNA, 7884 bp, Artificial Sequence
  Description of Artificial Sequence: Synthetic coding sequence
atggagaagctccatgggcacgtctcggcacatccggacatcctctctctggagaacagatgcctggcaatgctgcctgacctgcagccactcgagaagttgcaccaacatgtgagcacccactccgatattttgagccttaagaatcagtgtttagccacactgcctgatttgaagaccatggaaaaaccacacggctatgtaagtgctcaccctgacattctctccctcgaaaaccagtgcctggctaccctttcagacctgaagacaatggaaaagcctcacggtcacgtctcagctcatccagatatacttagcctggagaacagatgcttagcgactctgagcagtctcaaaagcacagtgtctgccagtccgttattccaatctctccagatctctcatatgacacaggcggacctgtatcgcgtgaataattccaattgcctgctgtctgaaccgccatcttggcgagctcagcattttagcaaagggctggatttgagtacctgtccaattgctctcaagtccatctccgccactgaaacagcccaggaggcaacgctggggagatggttcgattctgaggaaaagaagggagctgaaacacagatgccttcatattcattatcattaggggaggaagaggaggttgaggatttggccgtaaaacttactagcggggacagcgaatctcacccagaacccaccgaccacgtgcttcaggagaaaaagatggcacttctttccctgctctgcagtacactggtgtccgaagtgaatatgaacaacaccagtgaccctactctggctgctatatttgagatttgtcgggaacttgctttgctggaacccgagttcatcctgaaggctagtctgtacgcaagacagcagcttaacgtcagaaacgtggcaaataatattttagctatcgctgccttcctgccggcttgtcggcctcaccttaggcggtatttctgcgccatagtgcagctccccagcgactggatccaggtggctgagctgtatcaatctttggctgaaggggacaagaataagcttgtacccctgccagcctgcttgcgtaccgcaatgactgacaagttcgctcagtttgatgagtaccagctagccaaatacaaccctaggaagcacagggcaaagaggcaccccagacgcccaccacggtcccctggtatggagccacctttttcacataggtgtttccccaggtatattggcttccttagagaagaacagcggaagttcgaaaaggcaggggacacagtgtccgagaagaagaacccacctagatttacactgaagaaattagtgcagagacttcatatccataaaccagcccaacatgtgcaggccctgttggggtaccggtacccatccaacctgcagctcttttcacggagccgactgccgggaccatgggattcatcccgagctggtaaacggatgaaactgtcaagacctgagacttgggagagggaattaagtctgcgaggcaataaggcctctgtgtgggaagagttaatcgagaatgggaagctacccttcatggctatgttacgcaacctgtgcaatttgctccgggtgggaattagctcacgccaccatgagctgatcttgcaaaggttacagcacgctaaatcagtgatacacagccggcagtttccattcagattcttgaacgcacacgacgcaatcgatgccctcgaggcccaactgcgcaatcaggccctgccatttccttctaatatcactctgatgcgaagaattttgacccgtaatgagaaaaacaggcccagacgacgctttctgtgccacctgagtaggcaacagctgaggatggccatgaggataccagtgctatacgaacaactgaaacgagagaagctacgcgtgcataaggcgaggcagtggaagtatgacggcgagatgctgaatagatataggcaagcactggagacggctgtgaacctgagtgtgaaacactccttaccactgcttccgggacgaactgttttggtctaccttacagacgccaatgccgatagattgtgccctaagtctaatcctcaagggcctccactcaactatgctttactcctgattggcatgatgatcactcgcgctgaacaggtggatgtcgttttgtgcgggggagatacgctgaaaacagctgtcctgaaagctgaagaagggattctgaagaccgctattaagctgcaggctcaagttcaagagttcgatgagaacgatggctggagcctcaatacatttgggaaatacctgctgtcactcgccggtcagcgtgtgccggtggaccgggtcatcctcctgggacagtccatggacgatggtatgatcaacgtcgctaaacagttgtactggcaaagggtaaacagtaagtgcctatttgtaggtatcctactgcgcagagtacagtacctcagcactgacttgaatcctaatgatgtaactctctccggatgtaccgacgctattctgaagttcatcgcagagcatggtgcgtctcatctcttggagcacgtcggtcagatggacaagatcttcaagattccacctcctcctggcaaaaccggcgtgcagagtcttcggccacttgaagaagacactccgtcccctctggccccagtcagtcagcagggatggagatcaatacgtctgttcatttctagcacgtttcgcgatatgcatggtgagagagatctgcttctgcgttccgtgctgccagcattacaggccagggccgctccccatagaatcagtttgcacggtatagacctccggtggggagtgacggaagaagagacccggaggaacagacagctagaggtttgtttaggcgaagtggagaacgcccagttgtttgtgggaattctgggatctcgatatggatacatacctccctcttacaaccttcctgaccaccctcattttcactgggcccaacagtacccaagcgggcgtagtgtgaccgaaatggaagttatgcagtttctcaaccgcaaccagagactccaaccatctgcgcaggctctcatttacttcagggatagcagctttcttagctccgttccagacgcctggaaaagtgactttgtgtccgagtcagaagaagcagccagacgtatctcagagctgaagtcctatctaagtcgacagaaggggataacttgtaggagatacccttgtgagtggggcggagtggccgcaggcagaccctatgttggaggattggaggagttcggacaactcgtactacaggacgtgtggaacatgattcaaaaactatatttacaaccgggagccctccttgagcagccagttagcatccctgacgacgacctcgtgcaggctacattccagcaactgcaaaaaccgcctagtccggctcgccctcgcttgctccaggatactgtgcaaagactaatgctccctcacggacgcctttcgctggtgacaggccaatctggacagggaaaaacagcattcctggcatctttggtgtccgccctgcaggcacccgacggagccaaagtagcctccctggtcttttttcatttctctggtgccagacccgaccaaggtctggctctgactcttctgcggcgactctgtacatatttgagaggacaattgaaggagcccggagccctgccatcaacttacaggagcctggtctgggagttgcaacagcgcttgttgcctaaatccgccgaatccctccaccccggacagactcaggtgttgataattgatggggctgatcgattggtcgaccagaacggacaactgatctccgactggatacccaaaaaattgcccaggtgcgtgcatctcgtgctgagtgttagctctgatgcaggactgggagagacactcgagcagtcccagggggctcacgtgcttgcacttggcccactggaggcttctgcccgtgcaagactggttcgggaggaactggctctctacgggaagcgactggaagagagcccttttaataaccagatgcggttattgctggtcaagcgggaaagtggacgtcctttatatcttaggctggttactgatcacctaaggttattcactctgtacgagcaggtttccgaacgtctgagaacccttcctgccacggttcctctgctgctgcaacacatcttgtccactctggaaaaagaacacgggcctgatgtgctgccgcaggctctgaccgcgctggaggtcaccaggagtggtttgactgtggatcagctgcacggcgtgctgtcagtttggagaaccctccccaagggtactaagagttgggaagaggcagttgcagccggaaacagcggagacccttaccccatgggcccatttgcttgtctcgtacagagcctccgcagtctcctgggtgagggtccccttgaacgaccaggcgctcgtctatgcttgccagacggcccactcaggactgcggcaaagagatgttacggcaaaagaccgggacttgaggacacagctcacatcctcattgctgcccaactgtggaagacgtgtgacgcagatgcttcagggactttccgctcctgtcctcctgaggcacttggtgatctaccctaccacctgctccagtctggcaaccgcggtttgctcagcaaatttcttaccaacttgcacgttgtcgcggctcacctcgaactcggactcgtcagtcgcttgctggaggcccatgcactctatgcaagttccgttccaaaggaggagcagaaactgccagaagcggacgtcgcagtgttcagaacgtttctgcgccagcaggccagtatcctcagccagtaccctcggctgttgccacagcaggccgctaaccagccgttagactccccgctgtgccaccaagcctcattgcttagtagacgatggcacttgcagcataccctgcggtggcttaataaacccaggactatgaaaaaccagcagtcctcctccttatctcttgccgtgagcagttcacccactgcagtggctttttctacaaacggccagagggctgcggtcgggactgccaacggcacagtatacctgttggacctgcgcacttggcaagaagagaagagtgtagtgagcggctgtgacgggatttccgcgtgccttttcctttctgacgataccttgtttttaaccgcattcgatgggctgctggagctgtgggatctgcaacacgggtgccgggttctgcagacaaaggctcaccagtatcagattacagggtgctgtctgtccccagactgtagactgctggccacagtgtgccttggagggtgtcttaagctgtgggatactgttagaggccaactggccttccagcatacttaccccaagtcacttaattgcgttgcattccaccccgagggccaggttatagccaccggttcgtgggccggttccatatcttttttccaggtcgatggattaaaagtgacgaaggaccttggcgcaccgggtgcctcaatacgcaccctggccttcaacgtgcctggcggagtggtggcagtgggacggctggatagcatggttgagctatgggcctggcgggaaggggcaaggcttgctgcgtttcctgcacatcacggctttgtggccgcagccttgtttcttcacgcaggatgccaactgctaactgcgggagaagacgggaaggtccaagtgtggtctgggagcctgggacggcctcgaggccacctgggctcactttcgctgtctcctgccctgtctgtggcccttagtcccgacggcgatcgcgtggccgtggggtatagagctgatggcattcgcatttacaagatttcttccggttcccaaggggcacagggacaagcgctggacgtggcagtctctgctctagcttggctgtccccaaaggtcctagtgtccggcgctgaggatgggtctctacagggatgggctctgaaggaatgctctctgcagagcctctggctgctgagccgtttccaaaaacccgtgcttggtcttgcgaccagccaggagctgctggccagtgcttccgaggatttcactgtgcagctctggcctcggcagctgctcaccagacctcacaaggcggaggacttcccctgtgggacagagctccgcggacacgagggaccagtgtcctgctgctccttctctaccgatggaggatccttggcaactgggggtagagaccgatcactcctttgttgggacgtgaggacccccaagactccagtactcatacactcatttcctgcctgtcaccgggactgggtcacagggtgtgcctggaccaaggacaatctgctgatttcctgcagttcagatggaagcgttgggctgtgggatcctgaatccggccagagactaggccagtttttgggccaccagagcgcggtttccgcagtcgctgcagtggaggagcatgtggtatctgtgtcaagggacggcactctgaaggtttgggatcatcagggtgtggagctcacttccatcccagcacactccggccctatcagccattgcgcagcggctatggaaccacgggcagcgggacaaccaggctcggaactgctggtcgtgactgttggtctggacggagccacacgcctctggcatcctctcctagtatgccagacccacaccctgcttggacactccgggcctgttcgcgctgcggcagtctccgaaacaagcggcctcatgctgacagcttccgaagacggctcagtgcgactgtggcaggttcctaaggaggcggatgatacgtgcatacccagaagcagcgctgcggtgactgctgtagcttgggcaccggacggttctatggccgtgagtgggaaccaggccggagagctgatactctggcaggaggcgaaggcggtggccacagcacaggcccctgggcatattggagcactgatttggagtagtgcccacaccttcttcgttctgagcgccgacgagaagatctcagagtggcaagtcaagctgcgaaagggctcagctccaggaaacctgtcactccacttaaatagaattctccaagaagacctgggggtgctgacttccctcgattgggcgccagatggccacttcctgatactcgctaaggcagacctcaagctgctttgcatgaagcctggggacgccccaagcgaaatttggtcatcctatacggaaaaccccatgatcctttcaactcacaaggagtatgggatcttcgtgttgcaacctaaggaccccggagttctaagctttctgcgacagaaggaaagcggagagtttgaagaacggttaaacttcgacattaatttggagaacccctcaaggacgctcatctccattactcaggccaagccggaatctgagagcagtttcctgtgcgcatccagcgatggaatactgtggaatctcgcaaaatgttcccccgagggcgagtggacaacagggaatatgtggcagaagaaggcaaacactcccgaaacacagacccctggaacagatcccagcacctgtcgagagtccgatgccagcatggacagcgatgcgagcatggacagcgaacccactccccatctgaagactcgccagagaagaaagatacattccggcagtgtcactgccctgcatgtcctgccagagctgttggtgacagcttccaaagacagggatgtaaaactgtgggagagaccatctatgcagctcttgggcctgttccggtgtgaaggctccgtgtcctgtctggagccctggctgggagcgaacagtacactacagctggcggtaggcgatgttcagggcaacgtctactttctcaactgggaataa

SEQ ID NO: 31065 - DNA, 7859 bp, Artificial Sequence
  Description of Artificial Sequence: Synthetic coding sequence
atggaaaagctccacggacacgtcagtgctcaccctgacattctcagtctcgagaaccgatgtctggccatgctgcccgatctccaaccacttgagaaattgcaccaacacgtgagcactcattccgacatcctttctcttaaaaaccagtgcctggcaacactaccggatctcaagactatggagaagccccatggatacgtatccgcccaccccgacattctgagccttgagaatcagtgtctggccactttatctgatttgaaaacgatggagaaaccccatggacacgtgagcgcacatcccgacatcctgtctctggagaaccggtgcctcgctacgctgagttctctgaagagcaccgtgagcgcaagtccgctgttccagagcctacagatcagccacatgacacaggctgacctctacagagtcaataacagcaactgccttttatcagagccccctagctggagagcacaacacttcagtaagggcctggacctgagcacttgcccaatcgcactcaaaagcattagtgctactgagacagcccaagaggcgactctcggcagatggttcgatagcgaagagaaaaaaggtgccgagacccagatgccatcatacagtttaagtctgggcgaagaagaagaggtagaagacctggcagtgaaactgacatctggggattctgagtcccatcctgagccaaccgaccatgtgcttcaggagaagaagatggccctgctgagcctgctgtgttctaccttggtctcagaggtgaacatgaataatacatcagatccaacccttgccgctatcttcgaaatatgtcgggagcttgccctgttagagccagagtttattctgaaggcctctctgtatgccaggcagcaactgaacgtaagaaacgtggcgaataatatcctggctatcgccgcattcttacccgcatgccgcccacatcttaggagatacttttgcgccatcgtgcagttgccttccgactggatacaggtggctgagctgtaccagtccttagctgagggggacaaaaataagctggtgccactacctgcgtgcctgaggaccgctatgactgacaaattcgcacagttcgacgaatatcagttggctaaatacaatccacgcaagcaccgagcaaagcgtcaccctcgtcggcctccacggtcccccggaatggaaccaccattttctcaccgttgcttcccgagatacatcggattcctgcgtgaagagcagagaaagttcgagaaagccggtgatacagtaagcgagaagaagaaccctccgaggtttacattaaagaaacttgtccagcgactgcacatccataaaccagcacaacatgtccaggccctgcttggatatcggtacccttcgaacctccagctgttctccagaagtcggctgccgggtccctgggattcaagccgcgcaggcaaacgtatgaaactgagcaggccagaaacgtgggagcgcgaattaagcttgcgcggtaataaggcgtccgtgtgggaggaactcattgaaaacggaaagctcccgtttatggctatgctgaggaacttgtgcaaccttctgagagtcggtatttctagccgacatcacgagctaattctgcagcggttacaacatgcgaagagcgtgattcatagccgtcagttccccttccgatttctcaatgctcacgatgccatcgatgcgttggaggcacagctgaggaaccaggcactgccatttccttccaatataactctgatgagacggatcttgacacgcaacgaaaaaaatagacccaggaggaggtttttatgccatctgtctcgccaacagctgcggatggcaatgagaattcctgtgctgtacgagcaactcaagcgcgagaaacttagagttcacaaagctcggcagtggaagtacgatggcgagatgcttaatagataccgccaggctctagagactgctgtcaacttgtctgtgaaacacagcctccctcttctgccgggtcgcacagtcctcgtgtacctgactgacgcgaatgccgaccgattgtgccctaaatcaaacccgcagggcccaccgcttaactacgctttactcctgattgggatgatgattaccagggctgaacaggttgacgtggtgctgtgcgggggagacacactgaaaaccgcagtgttgaaggccgaagaaggaattctgaaaacggccatcaaattacaagcccaggtccaggaatttgacgagaatgacggatggagcttgaatacctttgggaagtacctactgagcctagccggacagcgcgtcccggttgaccgcgtcatcctgttagggcagagtatggatgatggaatgatcaacgtcgctaaacagctctactggcagcgcgtcaacagtaaatgtctgtttgtgggcatcctgctgcgcagagtgcagtaccttagcactgatttgaacccgaatgatgtgactttatcaggctgcactgacgccatcctcaaatttatcgcggaacatggggcaagccaccttctggagcacgttggtcagatggataaaatctttaagattccaccccctcctggaaagaccggcgtccagtccctgaggcccctggaagaggataccccttctccactcgctccagtctcacagcagggatggcggtcgattcgattattcatctcatccaccttcagagatatgcacggggaaagagacctgctactccgatcggtgctgcccgcactacaggccagagccgctcctcacagaatatccctgcacggcatcgatttgaggtggggggtgaccgaagaagagacaaggcgcaacaggcagctcgaagtgtgcctgggggaagtggagaacgcccaactctttgtcggcatcctgggcagccgttacgggtacattccaccctcttataacctcccagatcatccacactttcactgggctcagcagtatccttcaggaagaagcgtgacagaaatggaggtaatgcaattcctgaatcgtaatcagagactgcaaccctcagcgcaggctctgatctatttccgggacagctccttcttatcttccgtgcccgacgcttggaagtcggactttgtaagtgagagcgaagaggccgcacggagaataagcgagttaaaatcctatctctctcggcagaaagggatcacctgtcggcgatacccttgtgaatggggcggagtggccgctggacgtccctatgtggggggacttgaagagttcggtcaactggtcctgcaggacgtgtggaacatgatacagaagctgtacttgcagccgggagcgctgcttgagcagccggtgtctatacccgacgacgatcttgttcaggctaccttccagcagctacagaagcctccgagtcccgcacggcctcgcttgctccaagataccgtgcagaggctaatgttgccccatggcaggctgagcctggtcacaggccaatctggccagggaaagactgctttcctggcatcgctggtcagcgcgcttcaggctccggacggcgcaaaagtcgccagtttagtgttctttcatttcagcggcgcacgcccagatcaaggcctcgcgctaacactgctgagaagactatgcacttacctccgcggtcagctaaaagaaccaggcgctttgccaagtacttatcgctcccttgtgtgggagctgcagcagaggctgctgccaaaatcagctgaatcccttcaccctggtcagactcaggtgttgatcattgatggagccgaccgactggttgaccaaaacggacagttaatctcagattggattcccaagaaactgcccagatgtgtgcacctagtcctctcagtctcttctgacgcagggctcggggaaaccctggagcagagccagggcgctcatgttctagccctgggccctctcgaggcctcagctagagcaagactggttcgtgaagagctcgctctgtacggcaaacgtcttgaagaaagccctttcaataaccagatgcggctgctcctggtgaagagggagtctggtcgccctttatatctcaggctggtgactgatcatctcaggctgtttactttgtacgaacaggtgagcgaacgtctgcggacacttcccgcaactgtgccactactcttacaacatatccttagcacactggaaaaggagcacgggcctgacgtacttccccaggctctgacagccctggaggtgactcggtccggtttaaccgtggatcagctgcacggagtgctcagcgtttggcgcaccttacccaaaggcactaaaagctgggaggaggccgtggccgctgggaattcaggggacccttatccgatggggcctttcgcctgcttagtccagtccctgcgatcgctattgggtgagggccctcttgagagacccggagctcgtctttgcctccctgacggccctctaaggacggcagctaaacgatgctacgggaaacggccaggcctggaggataccgcccacattcttatagccgctcagctctggaaaacttgcgacgccgatgcatcaggtacgtttaggagctgcccacccgaggctcttggcgacttgccataccacctgctccagagcggaaaccgcggattactgagcaagtttctgaccaacctgcacgtggtagccgctcacctcgagctcggactggttagcaggctgctcgaagcccacgccctctacgcatcctctgtccccaaggaggaacagaagttgcccgaggccgatgtggccgtttttcggacattccttcgccagcaggcctccatcctgagccagtatcccaggctcctccctcaacaggccgctaaccaaccactggactcacccctgtgccaccaagcctccctcctgtccagacggtggcacctccagcacacattgcgatggctgaacaagcccaggacgatgaagaaccaacagagttccagtctgagtctggcagtgtccagttcccccacagccgtggcattttctactaacgggcaacgtgccgctgtggggaccgctaacggcacagtgtatctcctcgatctgaggacttggcaggaagaaaaaagtgtggtctcaggctgcgatggcatctcagcctgcctctttttaagcgacgatactcttttcctgacagccttcgacggtctgttggagctctgggatcttcagcacgggtgcagagtcttgcagaccaaggcccaccagtaccagatcaccgggtgctgcttgtcgccggattgtcggctgcttgctactgtgtgccttggtggctgcctgaaactgtgggatacagtccgaggccagctggccttccaacacacctatccaaagagcctcaattgtgtggccttccacccagagggccaagttattgctaccggctcctgggctggctccatctcattttttcaagttgatggactcaaggtaaccaaagacctgggggctcccggagcatccatccgtaccctggcatttaacgtgcccggaggagtagtggcagtgggccgtctcgacagtatggtggaattgtgggcgtggcgagagggcgctcggcttgccgcatttcccgctcatcatggattcgtggcagcagccctctttctccatgctggctgtcagttgctgacagcaggagaagatggcaaagtccaggtttggtcgggatctcttgggagacccaggggccatctgggatccctgagcctttctccagcgctgtccgtagccctcagccccgatggcgacagggtcgcagtcgggtacagggctgatggcatccgcatctacaagatttcatctgggagccagggcgcacaggggcaagccctggatgtggctgtcagcgcattggcttggctctcccccaaagtcctcgttagcggggcagaggacggctccctgcaaggatgggctctcaaagaatgctcgctccaatctttgtggctactgtccagatttcagaaacccgtgttagggcttgccaccagtcaggaattgttagcgtcagcctctgaggactttacagtgcaactgtggcccaggcaactgctgacaagacctcataaagcagaagacttcccctgtgggaccgaacttcgcggtcacgaaggaccggtaagctgttgctccttctctacagatggtggctcgcttgcaacggggggtcgagaccggtctctgctgtgctgggacgtgcggacccctaagacgcccgttctaattcactcatttcctgcttgccaccgggactgggttaccggatgtgcgtggaccaaggataacctgctgatcagttgttcctccgacggctcagtgggcttgtgggaccccgagtctggtcagaggctgggtcagtttctggggcaccaaagtgcagtctctgctgtggccgcagttgaagagcatgtggttagcgtgagcagagatgggacgctgaaagtctgggatcatcagggagtagagcttacctccatccccgctcatagcggaccaatttcccattgcgctgctgctatggaaccacgagctgctgggcagcctggaagcgagctgctcgtcgttacagtgggcttggatggggctactaggctgtggcaccccctgttggtttgccagacccatactctgctgggacattccggcccagttcgggctgccgctgtgagcgagactagtggcctgatgctaaccgcgtctgaggacggttcggtgagactgtggcaggtgcctaaggaagcagacgacacttgcatccccaggtctagtgcggcagtgacggcagttgcatgggctcccgatggatctatggcggtgtctggcaaccaggcaggcgaactgattctgtggcaggaagccaaggcagtggctaccgctcaggccccaggtcacattggagcactgatctggagctcagcacacacctttttcgtgctcagtgctgatgagaaaatctccgagtggcaggttaaacttaggaaaggcagtgcccctggaaatctcagcctgcatctgaaccgaatcctgcaggaggatcttggggtcttgacaagcttggattgggctccagacggccattttctcattcttgccaaggccgatctgaagctattatgtatgaagcctggtgacgcccctagcgagatatggagctcctacactgagaaccctatgatcttgagtacgcataaagagtatggtatattcgtgttgcagcctaaagaccctggggttctttcgttcttacgccagaaggagagcggggagttcgaagaacgccttaactttgacataaatctggaaaacccttcgaggactctgattagcatcactcaggccaagcccgaatccgcgctgatgggaagctacggtacatggccaaatgccgcacagaaggagaacgggcctcaggtcacctgcgggagaaaaaagaatacccccgagacccagacacctggtactgacccctctacctgcagagaatcagacgctagtatggattctgacgccagtatggacagtgagcccaccccccacctgaaaacccgtcagcgtcggaaaatacatagtggatcagtcactgccctgcacgtccttcccgaattgctcgtgaccgcatctaaggacagggacgtcaagctatgggaacggccatcaatgcagctgttaggactttttaggtgtgaggggagcgtgtcttgcctcgagccttggctgggggctaatagtaccctgcaacttgccgtcggagacgttcagggaaacgtgtacttcttgaattgggagta

SEQ ID NO: 31066 - DNA, 2031 bp, Artificial Sequence
  Description of Artificial Sequence: Synthetic coding sequence
atgaagaaccagcaaagctcatccctctccctagctgtaagcagttcaccaactgcagtagcattctccacaaatggccaacgtgccgcagtggggacagccaacgggactgtataccttctcgatctcaggacctggcaggaagaaaaaagcgtcgtctcagggtgtgacggaatctctgcatgtcttttcctcagtgacgacactttatttctgacagcttttgacggccttctcgaactctgggacctgcagcacggatgccgggtgctgcagaccaaagcccaccagtaccaaattaccgggtgttgccttagccccgattgtcgccttctcgccaccgtgtgcctcggaggatgcctgaaattatgggatactgtgcggggacagctagcattccagcacacctatccaaagagcctcaactgtgtggcctttcaccccgaaggacaggtgattgctacaggatcgtgggccggttccatttccttcttccaggttgacggattaaaagtcaccaaagacctaggcgctccaggggcttccatccgaacactggctttcaacgtacctggaggggtggtggccgtcggacgcctggattcgatggtggagctgtgggcttggagggaaggtgctcgcctcgccgcattcccagcgcaccatggattcgtggcggcagctctcttcttgcacgcagggtgccagctgcttacagcgggtgaggacggaaaggtccaggtgtggtcggggagcctgggaaggcctcgtggccatctgggctctctgagcctcagccccgcattgtcagtagctctgtctccagatggcgatcgagtcgctgtcggttaccgagctgacgggattcggatttacaaaatctcctcaggctcacaaggcgcacagggccaagccctagacgtagctgtgagtgccctggcttggttatcgcccaaagtgctcgtgagtggggctgaggacgggtctctgcagggctgggctctgaaggagtgttctctccaatctctgtggctgttatctaggtttcagaagcctgtactcggcttggctacatctcaagaattgctcgcgagcgcatccgaagattttacggttcagctgtggcccagacagctgctgacacggcctcacaaagctgaggacttcccatgcggaaccgaattgcgagggcacgaaggtccggttagctgctgctccttcagcacagatggaggctcattggcaacaggagggagggataggtctctgctgtgttgggatgtgaggactcctaaaacacctgtgctgattcactcatttccagcctgccacagggattgggtgactggatgcgcctggaccaaggataacctgctcattagttgctccagtgacgggtctgtgggactttgggatcctgagagcggacagcggctcggacagttcctgggccatcagtctgccgtgtcagccgtggccgcagttgaagaacacgtagtgtccgtgtctcgcgatgggacactgaaggtgtgggaccaccagggcgtcgaactgacttctatcccagcccacagcggcccaatttctcattgtgccgcagctatggagcccagggctgctggacagcctggatccgagctgctggtcgtcacggtggggctcgacggtgcgacccgcctgtggcatccgcttctggtgtgccagacccataccttgctaggtcacagtgggcctgtgagagccgctgctgtctcagaaacgtccggactaatgctgaccgccagtgaggacggctcagtgaggttatggcaggtccccaaagaagccgatgatacatgtatcccccgaagcagtgctgccgtcacagccgtggcctgggcaccagacgggagcatggcagtgagtgggaaccaggctggcgaactgatcctctggcaggaagccaaggccgtcgcaaccgcccagagtagcccagagcctaattccacgggaggcctgcggggagccgataaatcagggttaggatcctag

SEQ ID NO: 31067 - DNA, 501 bp, Artificial Sequence
  Description of Artificial Sequence: Synthetic coding sequence
atggaaaaactgcacggccacgtgtccgcccacccagatatcctctcattggaaaatagatgtctggctatgcttcccgatctccaacctctggagaagctccatcaacatgtgtcaacacactccgatattctgtccctaaagaatcagtgtttagccactttgccggaccttaagaccatggagaaacctcatgggtacgtgagtgcccacccagatattctttctttggaaaaccagtgcttagccaccttgtctgatctgaagaccatggagaagccacacggccatgttagcgctcacccagatatcttgtccctggaaaatcgatgtctggcgacgctgtcgtctcttaaaagcaccgtctcagcatctcctctcttccagtcactccagatctcccatatgacccaggcagatttgtatcgcgtcaataattcgaattgccttctgtccgaaccaccttcctggagagctcagcacttttccaagggactgtag

SEQ ID NO: 31068 - DNA, 1260 bp, Artificial Sequence
  Description of Artificial Sequence: Synthetic coding sequence
atggccgaagatgtatcatctgccgctccaagcccccgtggttgcgcagacggcagggacgccgatccaactgaagaacagatggcagaaacagagcggaatgatgaggagcagttcgagtgtcaggagctactggagtgtcaggtccaggtcggcgcacccgaagaagaggaggaggaagaggaggacgccggactcgtggcggaagctgaagctgtagctgccggatggatgctggattttttgtgtctctcactttgtagagctttccgggatggtcgctcagaagactttagaagaaccagaaattccgcagaagcgattattcacggcttgtcatcacttacagcttgtcagttgcgtactatttacatctgccaattcctgacgcgcattgccgcaggtaagactttggacgcccagttcgagaacgacgaaaggattaccccgctggagagcgccctgatgatctggggaagcatcgagaaagagcacgataagctccacgaggaaatccagaacctgatcaagatccaggcaatagccgtgtgcatggagaacgggaacttcaaagaggccgaagaagtcttcgaaaggatttttggggaccccaattcccacatgcctttcaaatcgaagttgctgatgatcatttctcagaaggacacttttcacagcttttttcagcacttcagctataaccacatgatggagaaaattaagagctatgttaattacgtgctgtctgaaaaatcttcaacatttttgatgaaggctgcagccaaggtcgtagagagcaaaaggacccggaccattacatcacaagacaaaccctccggcaacgacgtggaaatggaaaccgaagccaatctggacactcggaaaagatcccacaagaacctgttcttatccaaactgcagcacgggacccagcagcaggatctaaacaaaaaagagcggagggtggggacaccacagagtacaaaaaaaaaaaaggagagtaggcgcgcaacagaaagccgtattccggtgagtaagagtcagccggtaacgcctgagaaacaccgggctcgcaagagacaagcctggctgtgggaggaagataagaatctccgctcaggcgtgaggaaatacggggagggcaattggagcaagatccttctgcactacaagttcaacaacagaacgtccgtcatgctgaaggacagatggcgcacaatgaagaagcttaagctgatcagcagcgatagcgaggactag

SEQ ID NO: 31069 - DNA, 1320 bp, Artificial Sequence
  Description of Artificial Sequence: Synthetic coding sequence
atggcggaggacgttagtagtgcggctccttccccacgcggttgcgctgacggcagggacgcggacccaaccgaagagcaaatggcggagaccgaacgcaacgatgaggagcaatttgaatgtcaggagctgctggagtgccaagtccaggtgggtgctccggaagaggaggaggaggaagaggaagatgccggactggtcgcagaagctgaagcagttgctgcgggttggatgctggactttctctgcctcagcctctgccgagcctttcgagacgggcgatctgaagacttccgtaggacacgaaactctgccgaagccattatccatgggcttagcagtctaactgcatgccaactccggaccatctacatctgccagtttcttacccgaatcgccgctgggaaaactctggacgctcagtttgagaatgacgagcggataacccctctcgaatcagctctgatgatttggggatcaattgaaaaggagcacgacaagctgcacgaggaaatccagaacttgataaagatacaggcgatagcggtgtgtatggaaaatggcaactttaaggaagccgaagaggtgttcgagcgaatcttcggtgatcccaactctcatatgcccttcaaatcaaaattgcttatgatcatttcccaaaaggacacatttcactccttttttcaacattttagttataaccacatgatggaaaaaataaaatcttatgtgaactatgtgctgagtgaaaagagcagcactttcctgatgaaggccgctgccaaagttgtcgagagcaaaaggaccagaactatcacatcgcaggataagccatccggaaacgacgtggagatggaaaccgaagccaatctcgatactcgaaaatcagtgagcgataaacagagcgctgtgaccgagagctctgaaggaactgtgtcactcctcagatcccacaaaaacctctttctctctaagctccagcatggaacacagcagcaagaccttaacaagaaggaacggagggttggcaccccgcagtctaccaaaaagaaaaaagaaagcagaagggccaccgagtccaggattcccgtctctaaatcccagcccgtgactccagaaaagcatcgggctcgcaaacggcaagcttggctttgggaggaggacaaaaatctccgaagcggggtgaggaagtatggcgaaggaaattggtccaaaatcttgctacactacaaattcaacaatcgtactagtgttatgctgaaagaccgatggaggaccatgaaaaaattgaagttgatctcctcggatagcgaggattag

SEQ ID NO: 31070 - DNA, 153 bp, Artificial Sequence
  Description of Artificial Sequence: Synthetic coding sequence
atcttcagtataattcacggtttgtctagcctgaccgcctgtcagctgcgcacaatctatatctgccagtttctcacccgcatcgcggcaggcaagacgttggatgcccagtttgagaacgatgagcgaattacaccacttgagtccgcctag

SEQ ID NO: 31071 - DNA, 1503 bp, Artificial Sequence
  Description of Artificial Sequence: Synthetic coding sequence
atggccggaggaggaggcagctctgatggctcaggccgagcagctggtaggcgagcgtctagaagttcaggtcgcgctcgccgtgggaggcacgaaccaggtctggggggacccgcagaacgtggggctggtgaagctagactagaggaagctgtgaaccgatgggtcctcaaattttacttccatgaggctttgcgcgctttccgcggttcccgttacggtgatttcaggcaaatcagggacatcatgcaggcactgcttgtccgtcccttgggcaaagagcatacagtgtccagactgctgcgggtaatgcagtgtctgtcccgcatcgaggagggggaaaatttggactgtagttttgacatggaggccgagttgactcctctggagtcagcaataaatgtgcttgaaatgatcaagaccgagttcaccctgacagaggctgtggtggagtcttcccgaaagttggtcaaggaggccgctgtgattatttgcatcaagaataaggaattcgagaaggccagcaaaatcctgaagaagcacatgagcaaagatcctaccacccagaagctcaggaatgatcttctgaacatcataagggaaaaaaacctcgcccatcctgtgatccagaatttcagctatgagactttccagcaaaagatgctgagatttctagaatcacacctggacgatgctgaaccatacctcctcacaatggccaagaaggccctgaaatctgaaagcgccgcatcatccacaggaaaagaggacaaacaaccggcacctggccctgtcgagaaacccccaagggagccagctcggcagttgagaaaccccccaactacaattggcatgatgaccctgaaggcggcatttaaaacactgagtggtgctcaggattctgaggcggcattcgctaagttggatcaaaaagaccttgtgctccccactcaggcccttcctgcgtcacccgctctgaaaaataagcgacccagaaaggatgagaatgagagctccgccccagccgacggagaaggtggctcagaattgcaaccaaaaaacaaaaggatgactatcagccggttagtactggaagaggatagccaatccacagaaccgtcggcaggactgaattccagtcaagaggcggctagtgctccccctagcaaacctaccgtcctcaatcaacctcttccaggagaaaaaaacccgaaggtgccgaaaggcaaatggaacagctcaaacggtgtggaggagaaagagacctgggtcgaggaagatgagttgtttcaggtccaggctgccccagacgaagatagcacaacgaacatcactaaaaagcagaaatggaccgtagaagagtccgaatgggtcaaagcaggcgtgcagaaatacggggaggggaattgggctgccatcagcaaaaactatcccttcgttaacagaaccgcagtgatgattaaggatagatggagaacaatgaagagactggggatgaactag

SEQ ID NO: 31072 - DNA, 1200 bp, Artificial Sequence
  Description of Artificial Sequence: Synthetic coding sequence
atggcagaggccatggatctgggcaaagacccaaacggtcctacccacagcagtaccctttttgttcgagacgacggctcctcaatgtcattctacgttaggccatcccccgcaaagagaaggttaagcaccctcattttgcatgggggagggaccgtctgcagggtgcaggagccaggtgccgttttgcttgcccagccaggcgaggctctggccgaggcttccggagatttcatttctacgcaatacattctcgattgcgtggagcgaaatgaacgcttagaattggaggcgtacaggctgggtccagccagtgccgctgataccgggagcgaggccaaaccgggagctctagctgaaggggcagctgagccagaaccccagcggcacgccggacgcatcgccttcaccgacgccgacgacgtcgcgattttgacatatgttaaggagaacgctcggtcaccttcgtctgtcacgggcaatgcgctttggaaggccatggagaaatcgtctttgactcaacactcctggcagagcctgaaggacaggtatctgaagcacttgcggggtcaagaacataagtatctattaggggacgctccggtgtctccatcaagccaaaagttgaaacgcaaagctgaagaagaccccgaggcggctgacagcggcgagcctcagaataaaagaacaccagacctcccagaggaagagtacgtgaaagaagagatccaggaaaacgaagaggccgttaagaagatgttggtggaagctactcgcgaattcgaggaggtggtggtagacgagtcaccaccagacttcgaaatacatataacgatgtgtgatgatgacccacctacacctgaagaagattcagagacacagcccgacgaagaagaggaagaagaggaagagaaagtctcccagcccgaggtcggcgcagcaatcaaaataattcggcaactaatggaaaagtttaatctggatctctcgactgtaactcaggcgttccttaaaaactccggtgagctggaggcaacctcagcgtttctggcttccgggcagcgcgctgacggatatcctatatggtctcgtcaggacgacatcgacctgcagaaagacgatgaggacacccgggaagctttagtcaaaaagttcggggctcaaaacgtagcaagaagaatcgagttcaggaaaaaatag

SEQ ID NO: 31073 - DNA, 12735 bp, Artificial Sequence
  Description of Artificial Sequence: Synthetic coding sequence
atgatgccagcgcaatacgctctgacctcttccctggtgcttctggtgttgctctctactgccagggcaggtccgttcagctcgagaagcaatgtaaccttgcccgctccacgaccgcctcctcagccaggtggccacaccgttggggctggggtggggtcacctagctcccagctatatgagcatacagtggagggaggtgaaaagcaggtcgtgtttacccatcggataaacctgccaccttccaccggctgtggctgtcccccaggaacggagccccctgttttggcctcagaagtgcaggccctcagggttcggctcgagatcctcgaggaacttgtgaaaggcctgaaagagcagtgcaccggcggttgctgtcccgcaagcgctcaagcaggaaccggtcagaccgacgtcaggaccctgtgtagtctgcatggggtatttgatctctcccggtgtacttgttcttgcgaaccaggttgggggggtcccacatgctctgaccccaccgacgcagagattcccccttctagcccaccctctgccagcggtagctgtcccgacgactgtaatgatcagggaaggtgcgtgaggggcagatgtgtgtgctttccagggtacacaggaccatcctgcgggtggcccagttgccctggcgattgccagggtaggggtcgttgcgtccagggagtttgtgtatgccgagcgggattttctggtccagactgctcccaacggagctgccctagagggtgctctcagagagggaggtgcgagggaggaaggtgcgtttgtgaccccggatatactggcgacgattgcggaatgagatcatgcccacgcggatgctcccagagaggtagatgcgagaacggacgatgcgtttgtaaccccggttatacaggcgaggactgtggcgttaggtcctgccccaggggctgctcccagcggggtaggtgcaaggacggcaggtgtgtgtgcgatccaggttacacaggcgaggactgcggcactaggtcctgtccctgggactgtggagaaggaggcagatgtgtcgacgggaggtgcgtgtgctggccaggctacaccggcgaggactgctccacacggacatgcccccgagactgtagaggtcgcggacgatgcgaagacggagagtgcatctgcgacacagggtactctggggatgattgtggcgtcaggtcctgtcccggagattgcaatcagaggggaagatgtgaagatggcaggtgcgtgtgttggcctggatacactggaacggattgcgggtcaagggcctgtccgagggactgccgcggaagggggcgatgtgaaaacggggtgtgtgtttgtaatgccggatacagcggagaagattgcggcgtccggagctgcccaggtgactgccgaggtagggggagatgtgagagcgggcgatgtatgtgctggcctgggtataccgggagagattgcggtacgcgagcctgcccaggagactgcagaggtagaggtagatgtgtggacgggcgttgtgtctgcaacccaggatttacgggcgaggactgtggcagtagaaggtgtccgggtgattgccggggacacgggctgtgtgaagatggggtttgcgtctgtgacgcaggttactccggtgaggattgttccacccgcagttgcccaggcggatgtcgaggacgaggccaatgccttgacggacgctgcgtgtgcgaagacggctatagtggggaggattgcggcgtgcgtcagtgcccaaatgattgttcgcaacacggggtttgccaggacggtgtttgtatctgctgggaaggttatgtatccgaggactgtagcatccggacgtgtccgagcaactgccatgggagaggcaggtgtgaagagggccgttgtctgtgcgaccccggatatactggccctacctgcgcaactcgaatgtgtccggctgattgcaggggcaggggtcgctgtgtgcagggggtgtgcctctgtcacgtaggctacggcggagaggattgtgggcaggaggagccacccgcttccgcgtgccccggaggctgcggtcccagggaactctgccgcgcaggacaatgtgtgtgtgtcgaaggttttagaggacctgactgcgccatccagacctgccctggcgattgcagggggcgaggggaatgtcacgatggttcctgcgtttgcaaagacgggtatgccggtgaagattgcggcgaagaagttcccacaatagaagggatgaggatgcatttgctggaggaaaccacagttcgtacggagtggacccctgcacctggtccagtggatgcctacgagatccagttcatccctacaactgagggcgctagtcctccattcactgctcgggtcccttcatctgcttccgcttatgatcagcgcggactggctcccggtcaggaataccaggtgaccgtgagggctctgaggggcacgagttggggattgcccgcatcaaagactatcaccacaatgattgatggtccccaggatctgagagtggtggccgtgacccctaccaccctcgagctgggctggcttcggcctcaagccgaggtggaccgcttcgtagtgagctatgtgagtgcaggaaatcagcgcgtgcgcctggaggtgccacctgaagccgacggtacccttttaacggatctcatgcctggggtcgaatacgtagtgaccgttacagctgagcgcggacgtgcagtgtcataccccgctagcgtgcgtgcgaataccggatctagcccgctcggcctcctaggcaccacagatgaacctcccccaagtggaccaagtaccacacagggcgctcaggcacctctactccagcagaggcctcaggagcttggagagctgagggtgctgggcagagacgaaacaggaagattacgagttgtatggaccgcacagcctgatacctttgcttacttccagctcagaatgagggtgccagaagggccaggagcacatgaggaagtgcttcccggagacgtccggcaggccttggtcccacccccaccgccaggcacgccctacgagctatcattgcatggcgtccctccgggtggaaaaccatccgaccccattatataccaaggcataatggataaagacgaggagaagcccggaaagtctagtggtccacccagacttggagagctgacagtaactgaccggaccagcgatagtctactgctgcggtggactgtccccgaaggggagttcgacagtttcgtcatccagtacaaagatagggatgggcagccacaggttgtccccgtcgaagggcctcagaggtctgccgtgatcacctctctcgatccgggacgcaagtataaattcgtgctgtacggcttcgtgggaaaaaagcgacacggtccattagtagcagaagccaaaatactgcctcagagtgacccttcgcctggaacaccaccccacctaggaaatttgtgggtgactgacccgactcctgattccctgcatctctcttggaccgtaccggaggggcagttcgacacttttatggttcagtatcgggacagagatggaagacctcaggttgtccccgttgaaggtcctgaaagatcgttcgttgtcagtagcctggatcctgatcataaataccgtttcacattattcggtatagcgaataaaaagcgctatggtcctttgaccgccgatggcactacggccccagagaggaaagaggaacctccgcgacccgaattcctcgagcagcccctgctcggcgagctgactgtgacaggagttactcctgattcactgagactgagctggacagtggctcaaggccctttcgatagttttatggttcaatacaaagacgcgcagggtcaaccacaggccgtgcccgtggccggtgatgaaaatgaagtgacagtgcctggtcttgatcccgatcggaagtataaaatgaatctttacgggctacggggaaggcagcgggttggacctgagagcgttgttgcgaagacagctccacaggaggatgttgacgagacaccttcccccacagagctcggcaccgaagcccctgagagcccagaggagcctctgctcggcgagctgaccgttacaggatcatcccctgactctctctctttattttggactgttccacaggggagcttcgacagttttactgtccagtacaaggacagagatgggagacctagggctgtgcgcgtggggggaaaggaatcagaggtgacagtaggcggtctcgaacccggacataagtataaaatgcacttgtatggcctgcacgaggggcagcgcgtcggtcccgtctccgcagttggagtgacagctccacaacaagaagaaacaccacctgccactgagtcacccttggaacctcggctcggggagcttactgtcacagatgtcaccccaaattccgtcggcttgagttggaccgttcctgaagggcagtttgattctttcatcgtgcagtataaggacaaggacgggcagccgcaagtggtgcccgtagctgcagaccagcgggaggtgactgtgtacaatctggagcctgagcggaagtacaaaatgaacatgtatgggctccacgatggtcaacgtatgggcccactaagcgtagtcatcgtcacagccccattgcctcccgcacctgcaaccgaggcctccaaacctccactggagccaagactgggggagttgactgtaacggacataacacctgattccgtgggactaagttggacagttccagagggagagtttgattcctttgttgtgcagtacaaggatcgggatgggcagccccaggtggtgccagtagcagcagatcagagagaggtgaccattccagatctggagccgtcccgcaagtataagtttctgctctttggcattcaggacggcaagagaagatcccctgtgagcgttgaagccaaaaccgtggctagaggggatgcctcccccggagctcccccaagactcggcgaattgtgggtcaccgatccaactcctgactctttacggctctcttggaccgtcccggaaggacagtttgattcatttgtagtacaattcaaggacaaagatggaccgcaggtggtaccggtggagggccacgaaagaagcgtaacagtcactcccctcgacgcgggtcgcaagtacaggtttcttctctatggcctgttgggtaagaaacgccatgggcctctcaccgctgatggaactacagaggcacggtctgcaatggacgatacaggtactaagcggccaccaaagccccgattgggcgaggaacttcaggtgactacagtcacgcagaactccgttggcctgtcctggacagttccagagggacagtttgactcattcgtggtgcaatataaagatagagatggtcagcctcaggttgttcccgtggagggaagcttgcgcgaagtcagcgtacccggactcgatcccgcacatagatataagctactgttgtatggattgcaccacgggaagagagtgggcccaatcagcgcggtcgccattacggccggacgtgaggaaaccgagacagaaaccacggctcctaccccacctgctccagagccccacttaggagagttgacggtcgaggaggctacgagccacaccctgcacctctcttggatggtcacggagggtgaatttgacagttttgagatccaatatactgatcgcgatggccagttgcagatggttagaattggaggggatcggaacgatattaccctaagcggcctggagagtgaccacagatatctggtgacactgtatggcttctcagatgggaagcatgtgggccctgtgcacgtcgaagccctaaccgtgccagaagaagagaagcctagcgagccaccgacggccacacccgagcccccaattaaaccccgtctgggcgaattgaccgttactgatgctacccccgactcattgagtctgtcatggacagttcccgagggccaattcgatcactttctagtgcagtatcggaacggtgatggacagcctaaggctgtcagagtccctggtcacgaagaaggagtgaccattagcgggttggagcctgatcacaaatataagatgaacctctacggattccacgggggtcagagaatggggccagtaagtgtcgtgggagtcactgcagctgaggaggaaactccatcccccacagagccttcaatggaagccccagaaccggctgaagagcccctgctgggtgagctgacagtaactggcagctctcctgactccctcagtctgtcatggaccgtgcctcaagggagatttgatagcttcactgtgcagtacaaggatagagatgggaggcctcaagtagtgagagtgggaggcgaagagtcagaggtcacggttggtggtctcgaacctgggaggaagtacaagatgcacttgtacggcttgcacgaagggagacgggtcggccctgtttctgcagtgggcgtgaccgcccctgaggaggagtcccccgatgcacctctggcgaaactaagattgggacaaatgactgtgagagatataacttccgacagtttgtcactctcgtggacggtgcctgagggtcagtttgaccacttcctggtccagtttaagaacggagacggacaaccaaaggctgtgcgcgtgccaggccacgaagatggagttactatatcgggactggagcccgaccataagtacaaaatgaacttatatggtttccacggtggacagcgggttggccctgtgtcagctgtcggtctgactgccccaggcaaagatgaagaaatggcccctgccagtaccgagccaccaacgcccgaaccgcctatcaaaccccgtctcgaggagttaacggtaacagatgccactcctgactccctgtcactgagctggacagtccccgagggacagttcgatcatttccttgtgcaatacaagaacggggacgggcagccgaaagctacacgcgtcccaggccatgaggaccgcgtcacaatttcaggactagagcccgataataagtacaaaatgaacctgtatggttttcatgggggacaacgagtcgggcctgtgtccgctatcggtgtcacagctgctgaggaggagactccttcaccgacagaaccatccatggaagcacctgaacccccagaggagccactgttaggtgagttaactgtaacggggtctagtcccgacagcttgtccctatcctggactgtaccacaagggcgatttgatagcttcaccgtccagtataaggacagggatggtagaccccaggtggtgcgcgtcggaggcgaagagtccgaggtgaccgtgggcggactagagcctggacgcaagtacaaaatgcatctgtacggcctgcacgaaggacgacgcgtgggccctgtgagcactgtgggtgtgaccgcgcctcaggaagatgtggacgagacaccctccccaactgaacctgggaccgaagcccctgggccaccagaagagccgctgctgggggaactcacagtgactggatcctctcccgattcactgagccttagctggactgtgccacagggcaggtttgattcctttacagtgcagtacaaagacagggatgggagaccacaagctgtcagggttggtggccaagagagcaaggtcaccgtccgagggctggagccagggcgaaagtacaagatgcacctgtacggactgcacgagggaaggagactggggccagtgtctgccgttggagtgacggaggatgaagcagaaactacacaggccgtccctactatgacaccagagcctccaatcaaacctcgcctcggggaactgacaatgaccgacgcgactcctgactcactatcactctcttggactgtccctgaggggcagttcgaccactttctagtgcagtataggaatggcgatggacagccaaaggcagttagggtgcccggacacgaggacggggtgacaatctccggactggagccagaccataaatataaaatgaatctgtatgggtttcatggtggccagcgcgtgggccctatctccgtgataggcgtaacagcagctgaggaggagacccccagtcctacagaactgagcactgaagcccctgaaccgcctgaagagcccctgttaggcgagctgaccgttaccggcagcagtcctgatagcctttctctgtcctggaccatcccacagggacacttcgactcatttaccgtccagtacaaagatagggatggtcgtccccaagtaatgagagtgagaggtgaagagtccgaagtgacagttggcggattggagcctggtaggaaatacaagatgcacctttacggccttcatgagggtcggagagtgggcccagtgtctacagtcggagttaccgcccctgaggatgaggcagagacaacacaggcagtgccgactacaacccccgaaccacccaataaacctagattgggggagctaaccgttaccgacgcaacccctgatagcctttcacttagttggatggtgcctgagggacagttcgatcattttctggtgcaatatcgcaatggcgatggccagcctaaggtggttcgggtgcccggtcacgaggacggcgtgacaatttctgggcttgaacccgaccacaagtataagatgaatctttacggtttccatggcggtcagcgagtgggacctatcagtgtgattggggtgactgctgctgaggaggaaacacccgcaccaactgaaccatccactgaagccccagaaccgccagaggagcctctgctcggagaactgaccgtgacgggatctagccctgactcattatccctttcctggacgatcccccagggcaggttcgacagctttacagtacagtacaaagatcgggatggcagaccccaagtggtgagggtccgtggagaggagtccgaagtcacagtcgggggactggagcccggttgtaaatataagatgcatctctacgggttgcacgaaggtcagcgggtggggccagtgtccgccgtgggagtcacagcccctaaagacgaagccgaaaccactcaggccgtgccgaccatgacccccgaacctcctattaagccacggctcggagaattgactgtgacagacgcgaccccagactcactctctctgtcatggatggtccctgaaggtcaattcgatcatttcctcgtgcagtatagaaacggggatggtcagcccaaggcggtgagggttcccggacacgaagatggtgtcaccattagcgggctcgaacctgaccacaaatataagatgaatctttacggcttccacgggggtcaacgcgtgggacccgtgtccgccatcggagtgacggaggaagaaacaccctcccctacagagcccagcacagaagccccagaggcaccagaggaaccgcttcttggcgagttgaccgtcactggatctagccccgactccctctctctgagctggaccgtaccccaggggaggtttgactcttttaccgtgcagtacaaggatcgcgatgggcagccacaggtggtacgggttaggggggaggagtccgaagttaccgtggggggtcttgagcccggaaggaaatacaagatgcatctgtatggcctccacgagggccaacgagtgggaccagtaagtaccgtgggaatcactgcccctctgcctaccccgctgccagtcgaaccacgcttaggcgaacttgctgtggctgcagtcactagcgattctgtgggactctcttggacagtggcccagggtcctttcgactccttcttggtccagtatagggatgcccagggacagccccaggctgtgcctgttagtggggacctccgcgcagtggcagtgtccgggctagatcccgcaagaaagtataagtttctgctcttcggtttgcagaacggcaaaaggcatggaccagtcccagtggaggccagaactgccccagacaccaagcccagtcccagattgggggagctgactgttaccgacgcaacccccgattccgtgggactgagttggactgttcccgaaggtgagttcgactcatttgtggtgcagtataaggataaagatggcaggctccaagtagtcccggtagccgcaaatcagcgagaagtcaccgtgcaggggttggagccgagccgaaagtatcggttcctgctttatggactcagcggccgaaagaggttaggcccaatatctgccgactctaccactgcccctctggagaaggagcttccccctcatctgggggagctcacagtggcagaggagacttcatctagcctgcgcctatcctggaccgtagcccagggccctttcgattcatttgttgttcagtaccgggatactgacgggcaacccagggcggtccctgtggccgctgaccagagaactgtcaccgtggaggatttggagcctggtaagaaatacaagttcctgttgtacggattgctgggcggaaagagactgggaccggtctcagccctgggcatgactgccccagaggaagatacaccagctccggagcttgctccggaggccccagaaccccctgaggagccgcgactaggagtgctcaccgtaaccgacactaccccagacagcatgaggctgtcgtggagcgtcgcacagggtccatttgatagtttcgtggtgcagtacgaagacacaaacggtcagccccaggcactccttgtggacggcgaccagtctaagatcctcatttccggattggaaccatcgactccatacagatttctgctttatggcctgcacgagggaaagagacttggtcccctctctgccgagggcaccaccggtctggcaccagccggtcagacctctgaagagtctaggccgcgactgagccaactgtccgtgactgatgtgactacctcaagcctgcggctgaactgggaggctcccccaggcgcattcgatagttttttactccgcttcggggtaccctccccatcaacacttgaaccgcacccacggccacttttgcagagggaactgatggtgccgggtacacgtcacagcgcggttctccgcgatcttagatccggtacactttattccttaaccctgtacgggctgcgcggaccgcacaaagcagattcgattcaaggaacagccagaacactaagccctgtactcgagagccctagggacctacagttctctgagattcgagagacatctgctaaggtgaactggatgccgcctccttcaagagcggactcctttaaggtgagctatcagctggctgatggtggagagccgcagtctgttcaggtcgatggccaggctcgtacacagaagctgcaggggctgatacccggtgctcgctatgaggtcacagtcgtctccgtgaggggcttcgaagagagtgagcctcttacaggctttctgaccaccgtgcccgacggacctacgcaacttagggccctgaacctgaccgaaggtttcgcggtcctgcattggaaacctcctcagaatcccgttgacacgtacgacgttcaggtgacagctcctggcgcaccacctctacaggccgagaccccaggttccgcggtggactaccctctccacgatttagttctacacactaactatacagccaccgttaggggcctcagagggccaaacctgaccagtccagcctcgattacattcactactggcctcgaagctcctagagatctcgaggcaaaggaggttacccccaggactgcactgttgacatggacagagcccccagtcaggcccgcaggctacctgctctcattccacacccccggaggacagaatcaggagatactgcttccaggaggcatcacttcccatcagctcctgggcctgtttccttcaacgtcatacaacgccagattgcaagccatgtggggacagtcacttctccctcctgtgagtactagcttcactactggagggcttagaatcccatttcctcgagattgtggagaagaaatgcagaatggtgctggcgcttcccgcacctcaactattttcctaaacgggaatagggagcggcctctgaacgtgttttgtgacatggaaaccgatggcggaggctggctcgtgttccaacgcaggatggatggccaaacggatttctggcgggattgggaagattatgctcacgggtttggaaacatttcaggtgagttttggctcgggaatgaagccctgcattcactcacacaggccggtgactatagcatgcgagtggacttaagagcgggtgacgaggccgtctttgcacaatacgatagttttcatgtcgacagcgccgctgaatattatcgccttcaccttgagggataccatggaaccgctggggattccatgtcctatcattctggttcagtattctccgccagggacagagacccgaatagcctcttgatcagctgtgccgtatcatacagaggcgcttggtggtaccgaaattgccactatgctaatcttaatggattatacggaagcacagtggaccatcagggcgtgtcctggtaccattggaaagggttcgagttcagcgtgccttttaccgagatgaagctgcggccaaggaatttccgcagccccgcagggggtggatat

SEQ ID NO: 31074 - DNA, 12729 bp, Artificial Sequence
  Description of Artificial Sequence: Synthetic coding sequence
atgatgcctgctcaatatgccctgacaagttctctcgttctattagtgctcctgagcaccgcgagagctgggccatttagtagcagatctaatgtcacgctgccagctccacgaccacccccacagcccggagggcacacggtaggcgctggggtaggctcacccagttcacagctttacgagcataccgttgaaggaggggaaaagcaggtggtgtttacgcaccgaatcaatctccccccaagcaccgggtgcggctgccctccgggaacagagccaccagtgctagcctcagaggtccaggctctacgagtgcgactcgagattcttgaggagctggtgaagggcctgaaagaacaatgcactggcggatgctgccctgcgtccgcgcaagccggaacaggccagaccgatgtcaggactctctgttcactccacggagtctttgatctgtctcgatgtacgtgtagctgcgaaccaggatggggcggacctacatgcagcgacccgacagacgctgaaattcccccttctagcccaccttccgcatccggttcgtgtccagacgactgcaatgaccagggtagatgtgttagaggccgttgtgtgtgctttccaggctacaccggtcccagttgcggctggccaagctgccccggagactgccaagggaggggccgttgcgtccagggcgtgtgtgtttgtcgcgctggattttcaggtcctgattgctcccagagatcatgcccccgaggttgcagccagaggggcaggtgcgagggcggaagatgtgtctgcgatccgggatataccggcgatgactgcggcatgcggtcatgcccgagagggtgctcacagaggggcaggtgtgagaacggacggtgcgtttgtaaccccggatatacgggcgaggattgtggggttcgaagctgcccaaggggatgctctcagaggggtaggtgtaaagacggacgctgtgtgtgcgaccccggatacaccggcgaagattgtggcacgagatcctgcccttgggattgcggtgaaggagggaggtgtgtcgatggccgttgtgtatgttggcccggttacacgggagaggattgttccacgcgcacctgcccgagagactgccggggaaggggcagatgcgaagatggcgaatgtatctgcgacaccggatactctggcgatgactgcggggttaggtcatgtccaggagattgtaaccagcgcggtagatgcgaggatgggaggtgcgtgtgttggcccggatacaccggtacagattgcggatctagagcatgtcccagagactgccggggaagaggacggtgcgagaacggggtgtgcgtgtgcaatgcgggatattccggggaagactgtggcgtgagatcttgcccaggcgactgtagagggaggggacggtgtgagagtgggcgttgtatgtgctggcccggatacacagggagggactgtggtactcgggcatgcccaggcgactgccgaggtcggggaaggtgtgtggatgggcgttgcgtgtgtaatccaggctttaccggagaggattgtggaagtaggcggtgccccggagattgcagagggcatggcctttgcgaagacggggtgtgcgtttgcgatgccggttattcaggagaggattgtagcacacgctcctgtcccggaggatgccgcggtcgcggtcagtgcttagacgggagatgcgtgtgcgaagacggctactctggagaggattgtggtgtgaggcagtgtcccaatgattgctctcagcacggcgtgtgccaggatggtgtttgcatttgctgggagggatatgtgtcagaagactgcagcattagaacatgccccagcaactgtcacggcagagggagatgtgaggaagggcgttgtctctgtgaccctggatacaccggaccaacttgtgctacacgcatgtgccccgcagattgcagaggtcggggaaggtgcgttcagggtgtgtgtctctgccacgttggctatggcggtgaagactgcggacaagaggagcctcccgctagcgcctgcccaggcggatgtggacctagggaactgtgtcgcgctgggcaatgtgtctgtgttgaaggcttccggggtcccgactgtgctattcagacctgcccgggagactgccgaggtagaggagaatgccatgacggatcctgcgtctgcaaggatggatacgcgggtgaagattgcggagaggaggtccctaccatagagggtatgagaatgcatctgcttgaggagaccacggtgcgcaccgagtggacacccgcacctggccctgtggacgcctacgaaatacagtttattcctacaactgagggagcaagccctccatttaccgccagagttccgagcagcgcctcggcttatgaccagcgcggactcgcacctgggcaggagtaccaagttacggtccgtgccttgagaggcactagctggggcctgcccgctagcaaaacgataacaacaatgattgacggccctcaggacctaagagttgtggctgtgacccctaccaccctagagctaggctggctgaggccccaggcagaggtggatcgcttcgtggtgtcatacgtcagtgcgggaaaccagagggtccgtctggaggtgcctccagaggccgacggcaccctgctgaccgatctcatgcccggtgtggaatatgtggtgaccgtgaccgctgaaagaggaagggccgttagctatcctgctagcgtaagggccaataccggtagctcgcccctgggattgctcggcacaacagacgagccacccccatctgggccttctacgactcagggtgcccaagctcccttattacagcagcggccacaggaactgggagaactaagggtgctaggccgagacgaaaccggcaggctgcgcgtcgtgtggacagcacagcctgacactttcgcctacttccagctcaggatgagggtgccggagggcccaggggcacatgaagaggtgctgccaggcgacgtaagacaagctttagtcccaccgccaccacctggcaccccttatgaactaagcctgcatggggtcccgcctgggggtaagccttccgacccaataatctatcagggcatcatggataaggacgaggagaaacctggtaagtccagcggcccacccagactgggagaattgacagtaacagatagaacgagtgacagcctactgctccgatggactgtgcctgagggagaattcgactcgttcgtgattcagtataaggatagagacggccagccccaggtggtgcctgtcgaaggccctcaaaggagcgcagtgataactagcctcgacccagggagaaaatataagtttgttctctatggattcgttggcaagaaacggcacggacctctggtggcggaggccaaaatcttacctcagtccgatccttcccctggaacgccgccacacttgggcaatctgtgggttactgatcccacccctgatagtctgcatctctcttggaccgtgcctgagggacaattcgacaccttcatggtgcaataccgggatcgcgatggaaggccacaggttgtgccagttgagggaccagagagaagttttgtagtgagcagcttagacccagatcacaagtacaggttcacactgttcggtattgccaacaaaaagcggtacggccctcttacagctgacggaacgaccgccccagagcgcaaagaggagccaccccgaccagagtttctggagcagccactcttgggtgagcttaccgtcactggggttacccccgactcacttcgcctgtcatggacagtggcccaaggccctttcgatagcttcatggtgcagtataaggatgcccaaggtcagccccaggccgtgcctgtcgccggagatgagaacgaggtaaccgtgccgggactcgaccctgacaggaagtacaagatgaatctgtatggcttgagaggtcgccagcgtgttggcccagagtctgtggtggccaagacagccccacaagaagacgtcgacgagaccccatcccccacggaattggggacagaggcacctgagagtccagaggaacctctgctgggagagctgaccgttacgggctcatctcctgatagcctctcacttttctggaccgtgccccaagggtcttttgatagctttacagtgcagtataaagatagggatggcaggccaagagccgtccgagtcgggggtaaagagtccgaggtgaccgtgggcggtctggagcctggtcacaagtacaaaatgcacctatatggcctacatgaagggcagcgagtcggcccagtttctgctgtgggagtgaccgctccacaacaggaggagactccgccagcaacggagtctcccctggagccaaggctgggagaactgacagtgactgatgtcactccaaacagtgtggggctgtcctggaccgtccctgaaggccaattcgatagcttcattgttcagtataaagataaagatggccagccacaggtagtacccgtcgctgcagaccaaagggaggttactgtgtataacctggaacctgagcggaagtacaagatgaacatgtacggcctgcacgatggtcagcggatgggcccactctcggttgtgatcgtgaccgctccactgccaccagccccagcaaccgaagccagcaagccccctctggaaccacgtttgggcgagctaaccgttaccgatataactcctgattcggtggggctgagttggactgtgcccgaaggcgagtttgactcatttgttgtgcagtacaaagatcgagatgggcaacctcaggttgtaccggttgctgcagaccagcgggaggttacaatccccgacctagagccctccaggaaatacaagtttctcctgtttgggatccaggacggaaaacgcaggtccccagtgagcgtagaggctaagacagtcgcacgtggagatgcctccccgggagctcccccacggctgggggagctgtgggtgactgacccaaccccagatagtctcagactatcatggacggtgcccgaggggcagttcgattcatttgtcgtccagtttaaggacaaagacgggcctcaggtggtcccggttgaagggcacgagaggtccgtgaccgtgacaccattagatgccggtaggaaatatcgatttctgctgtacggcctgctcggaaaaaaaagacacggcccactcaccgcagacggaactaccgaggctcggagcgcgatggatgatacaggcaccaagcggcctccaaaacccaggttgggagaggagctgcaggtgaccacggtgacacagaactctgttggactgtcatggaccgtacctgaaggtcagtttgactcctttgtcgttcagtacaaagatcgcgacgggcagccacaggtggtgcctgtggagggctccctgcgtgaggttagcgtcccaggcctggatcctgcgcacagatacaagctgctcctctatggtctgcatcatggcaaaagagtaggacccatttctgcggtagcgattacagcgggtcgcgaggagactgagactgagacaacggcccctactccccctgcaccggagcctcacttgggagaactgactgttgaggaggccacctctcacaccctgcatctgtcatggatggtgaccgaaggggagtttgatagcttcgaaattcagtataccgatcgagatggacagcttcagatggtcaggatcgggggtgataggaacgatattacgctgtccggactagagagtgatcataggtatttggtgactctgtatggattttcagatgggaaacacgtagggccagtacatgtcgaggctcttacagttccggaggaagagaagccctctgagcccccaacagctacacctgaacctccaataaagccaaggctgggtgagctgaccgttacagatgctacccctgatagccttagtttgagctggactgtgcctgaggggcaattcgaccacttcctggtccaataccggaacggcgatggtcagcccaaggcggtgagggttccaggccacgaagaaggcgtaaccatatcaggtctggagcccgatcacaagtacaagatgaacctatacgggtttcatggaggacagcgtatgggcccagtgtctgtggtgggcgtaaccgcggcagaagaggaaaccccctcaccgaccgaaccaagcatggaagccccagagcctgccgaagagcctctgctcggggagctgactgtgacgggatcctctcctgatagcctgagtctgtcatggaccgtgccccagggcagattcgatagtttcacagtgcagtacaaggaccgcgatggacgtcctcaagtggtcagagttggaggcgaggagagtgaagtgacggtcggcggtctcgaacctggcagaaaatacaaaatgcacctatatggactgcacgaggggcgaagagttggcccagtgagcgctgtgggagtgaccgctcctgaagaggagtcccccgacgcacccctcgccaagttgagactcggccagatgacggtccgggacattacgtccgattctttgtcccttagctggaccgttcccgagggccagtttgaccactttctcgtacagtttaaaaatggggacgggcagccaaaggccgtcagagtgccaggccatgaggacggcgtgacaatctctggcctggagcccgatcacaaatacaaaatgaatctgtacggcttccacggtggacagagggttggtcctgtgtccgcagtaggactgacagcgccaggcaaggacgaggagatggccccagcttccacagagccccctacaccagaacccccaattaaaccgaggttagaggagttaactgttactgatgctacccccgacagcctaagcctcagctggacagtgcctgaaggccaatttgatcacttcctggtacagtacaagaacggtgacggtcagcctaaagctaccagagtacctggtcatgaagacagggtgactataagtgggcttgagcctgacaacaagtataagatgaatctgtatggcttccacggcggacagcgggtgggtcccgtcagcgcaatcggagtaacagcagcagaggaagagacaccctctcccaccgagccgtccatggaagcccctgaacccccagaggaaccactgctgggcgaactcactgtgacaggcagtagtcccgactcgttaagtctgtcatggactgtgccccagggccgttttgactcattcacagtgcagtataaggatcgagacggcagaccccaagtggtgcgcgtaggaggcgaagaatccgaagtaaccgttggtggcttggaacctggtcgcaaatacaaaatgcatctgtacgggctgcatgaaggtcgcagagttgggcctgtgagcaccgtcggcgtaacggcccctcaggaggatgtcgacgagaccccttccccaaccgaacctgggacagaagcgcctggccctcctgaggagccccttcttggggaactaactgtcaccgggtcctctccagactcactcagcttgagttggactgtccctcaagggcgtttcgatagctttaccgttcagtacaaagacagagacgggagacctcaggctgtccgcgtagggggacaggagagcaaggtcactgtacgaggtctcgagcccggtcgaaagtacaagatgcatctatacgggcttcacgaaggacgacggcttgggccagtgtccgcagttggtgtcacagaggatgaagcagaaaccacccaggctgttccaaccatgaccccagagccaccaattaagccgcgtctgggcgaattaaccatgacagacgccacccctgacagcctgtcgctgtcctggaccgttcccgaggggcaatttgatcacttcttagttcagtaccggaacggcgatggccagcctaaagccgtgagggtcccagggcatgaggatggtgtgacaataagcgggctcgaacctgaccacaagtacaagatgaacctctatggatttcatggcggtcagcgcgtgggccctatctctgtgatcggcgtgactgcggctgaggaggagaccccgagcccaacagaattgtctacagaggctccggaacctcctgaggagccactgctcggcgagttaactgttactgggtcctcccccgatagcctcagcctttcctggaccatcccacagggccacttcgactcctttacggtgcagtacaaagatagggacggaaggccccaagtcatgagggtcaggggtgaggaatctgaggttaccgtaggcggtctcgaacctggacgcaagtacaaaatgcatctgtatggtctgcacgaagggcgtcgagtgggtcctgtatctaccgtgggcgtaaccgaagacgaagcggaaaccacacaggcagttcctaccacaactccagaacccccaaacaagcctcgcctgggggagctcactgttacagatgctacaccagattcgctgtctttgtcgtggatggttcccgaaggccagtttgaccactttctggtgcagtaccggaacggtgacggtcagcccaaggttgtacgcgtccctgggcatgaagacggagtgacgatttcaggacttgagcctgatcataagtacaaaatgaatctatatggttttcatggcggacagcgagtcgggcctatttcagtcattggggtgaccgctgccgaagaagagacgcccgcacccaccgagccatcaactgaggctcctgaacccccagaggagcccctactcggcgagctgactgtcacaggaagcagccccgactcgttaagtttgagttggaccattcctcaaggcagatttgactccttcaccgttcagtacaaggatcgcgatggcagaccacaggtggtccgcgtccggggagaggagagtgaagtcactgttggcggactcgagcctgggtgcaaatacaagatgcatctgtatggtttgcacgaggggcagagagtcgggcctgtgtccgccgtgggcgtcacagcgccaaaagacgaagcagaaaccacccaggccgtacctaccatgacccccgagccaccaattaagcccagactcggcgaactgacagttactgacgctacccctgactctctcagcctttcttggatggtcccagagggccaatttgatcactttttggtccagtatcgcaatggagatgggcagcccaaggcagtgcgagtgccgggacatgaggacggtgttacaataagcggactggaacccgatcacaagtataaaatgaatctctatggcttccatggtggtcagcgcgtgggacccgtgagtgctatcggcgtgacagaggaagaaactcccagtcctactgaaccgtccactgaagcgcctgaagcacccgaggagcccctgctcggagagctgacagttaccggctcatctccagacagccttagcttgagctggaccgtacctcagggaagattcgactcattcacagtgcaatacaaggatagggatggacagcctcaggtggtgagagtgagaggcgaagagagcgaggtcaccgtcggcggactggagcccggacgcaagtataagatgcatctctatggcctgcatgagggccagcgcgttgggcctgtctctacggtgggtattaccgctcctctgcctacaccattgcctgtggaaccacggcttggcgagttggccgtggctgctgtgacctctgattccgtgggcctgtcttggactgtggcccagggcccattcgatagtttccttgttcagtacagggatgctcaggggcagcctcaggccgttcccgtctcaggggaccttagagccgtcgcagtctcaggactggatccagccagaaagtacaagtttctcctctttggtctgcagaacggaaaacgccacggcccagtacctgtcgaggcgaggaccgccccagacaccaagccctcacccagactgggcgaactaacggttactgatgcaacacctgattcagtcggattatcttggaccgtccccgagggtgaattcgactcctttgtggtacagtataaagacaaggacggaaggctccaggtggtaccagtggccgcaaaccaaagagaagttacagtgcaggggcttgagccaagtagaaagtaccgctttctcctctacgggctgtccggaaggaaacgactcgggccaattagtgcggattcaacaaccgctcccttagagaaggagttgcctcctcacctaggcgaactgacggttgccgaggagaccagttcatcgttacgcctgagttggaccgtcgctcagggcccttttgactcgttcgtggtgcaatatcgtgatacggacggccagcctcgcgctgtgcccgtggcggcagaccaacggactgtcacagtggaggacctggagccagggaagaaatacaagttcctgctgtacgggctgttaggtgggaagaggctggggcctgtttccgccctgggcatgactgctcccgaggaggatactccggcaccggagctggcccctgaggcccctgaacctcctgaggaaccgcgactgggggtgcttacagtgacggacactactcctgattccatgaggttgtcatggagtgtcgctcaggggccattcgactccttcgtggtgcagtacgaagatactaacggacagccacaggcactgcttgtagacggggaccaatcaaaaatactgatcagcgggctggagcctagcactccctaccggttcctgctctacggcctgcacgagggaaagcgtttgggtcctctttctgccgagggaacgacagggttggcacctgccggtcagacatccgaagaaagccgcccaaggctatcacagttaagcgtcaccgacgtgaccacaagctccctcaggttgaactgggaagcaccaccaggagcattcgacagttttctgctcagattcggtgtcccgtcaccttccaccctcgagcctcatccacgcccactactccaaagggaactcatggtgcctggcacacgacattctgccgtgctacgcgacctacgtagcggcacactgtacagcttgactctgtacggtctgaggggaccacataaggcggatagtattcagggtactgcgaggactctctccccggtgttagagtctccacgtgacttacagttctccgagatcagggagacttccgcaaaggttaactggatgccgcctccatcacgggcagattccttcaaagtctcgtaccaactggccgacgggggagagcctcagtcagtgcaggtggacggacaggctagaacccagaagcttcagggcctgattcccggagcacgttatgaggtgactgtggtgtctgtcaggggctttgaagagtccgaaccactaacagggttcctgaccaccgtgccagacggcccaacacagcttagggctctgaatctcaccgaggggttcgcggttctccactggaagcctccacagaaccccgtagacacatacgatgtccaagtgaccgctccgggagctcctcccttgcaggcagagacccctgggtccgcagttgattatccactgcacgatctggtgttgcatactaattacaccgctaccgtaagagggttgcgtggacctaacctaaccagccctgcatcaattaccttcactaccggactcgaggcccctcgtgatctggaagctaaggaggttacacccagaactgcgctcctaacttggaccgagccacctgtgcggccagccggatacttactgtctttccacactcccggaggacagaatcaggagattctactccctggaggtattacctctcaccagctcctggggttgttccccagcacaagctacaatgctcgattgcaagccatgtggggccagagcctgctgccaccagtgagcacctcttttaccacaggcggactgaggatcccttttccgagagattgtggcgaagagatgcagaacggagcaggggcttcacgcacgtcgacaatcttcttaaatggaaacagagaacgccctctaaatgtattttgtgacatggagacagatgggggaggctggcttgtatttcagaggcggatggacggccagacagatttctggagagactgggaagattatgctcatggcttcggcaacatttctggtgaattctggctcggaaacgaagcgcttcacagtctcacacaagccggtgattactccatgcgagtggatctgcgcgctggcgacgaggccgtatttgcccagtacgatagttttcatgtggacagcgcagccgagtactaccgtttacatctggaggggtatcacggcaccgcaggggacagcatgtcctaccacagcgggtctgtattctccgccagggacagggaccctaattctctcttaatatcttgtgccgtgtcatatcgtggcgcttggtggtatcggaactgccattatgccaatttgaacggactgtacggcagtaccgttgaccaccagggcgtgtcctggtaccactggaaaggctttgagtttagtgtgcccttcaccgaaatgaagctgcggccaagaaattttaggagccccgcagggggtgggtag

SEQ ID NO: 31075 - DNA, 2022 bp, Artificial Sequence
  Description of Artificial Sequence: Synthetic coding sequence
atgaggctgtcctggtccgtcgcccagggccctttcgactccttcgtcgtacagtacgaagataccaacggccagccacaggctctgttggtggatggagatcagtctaaaatactgatcagtgggcttgagccgagcactccctacagatttttgctgtatggcctgcacgaaggcaagagactgggacctcttagtgctgaagggacgacgggcttggctcctgctggacagacatctgaggagtctagaccaaggctcagccagttgtctgtcacagatgtaaccacatcttccctgcggcttaactgggaagccccacccggagcctttgatagttttctactccgattcggtgtccctagcccttccaccttggagccacaccctagaccattgctccagcgcgagctgatggttccaggtactagacactccgccgtcctgagagacctacggagtggaacactgtactccctgactctctacgggttgcggggaccgcacaaagctgattccatccagggtacggccaggacgctgtccccagtgctcgagagtcctagggatctgcagttttcagagattcgggaaacttccgccaaagttaactggatgcctcctcctagtagagccgattcatttaaagttagctaccagcttgctgacgggggtgagccccagtcggtgcaggtggacggccaggcacgcacccagaaactgcagggcctgatccccggagcccgttacgaagttactgtggtgtccgtgcgaggtttcgaggaaagcgagcctcttactggtttcctgacaacagtgccagatgggcctactcagctgagagcactcaatctcacagaggggttcgcagtgctgcattggaaaccgccacagaaccccgtcgacacatacgatgttcaggtaacagcccctggagcccctcccctccaggccgagacaccaggctccgcagtagattaccctctccatgatctggtcttgcatactaactacaccgcaactgtccggggtttaagaggaccaaatctcacttcccctgcttcgattacctttactacaggcctagaagcccctcgagacttagaggcgaaagaggtgacccctaggaccgcactactcacatggacagagccgcctgtacgcccagccggatatctgctctcgttccatactcccggaggccaaaatcaggagatactactccctggcggaattaccagtcaccaactgcttgggctattccccagcactagttacaatgcgagactccaggccatgtggggccagtctctgcttcctcccgtgagcacgtcttttactacaggtggcctgcgtatcccatttcccagagattgcggtgaggaaatgcagaacggcgctggagcgtcccgcacgtctaccattttcctgaacggcaacagggaacggccactcaatgtgttttgtgacatggagactgacggcggtggatggcttgtgttccagagacgcatggacggtcagaccgacttctggagagactgggaggactacgcgcacgggttcggcaacatatctggcgaattctggctggggaacgaggcactgcattctctgacgcaagccggagattactccatgcgtgtggatttaagagctggcgacgaggcagtcttcgcccaatacgactcatttcacgtcgattcggccgctgagtattacaggctacacctagaaggatatcacggaactgccggagatagcatgtcatatcatagcgggagcgtcttctccgcccgagatcgagatcccaattcgcttctgataagttgtgctgtttcttataggggagcatggtggtatcgcaactgccactacgcaaatctgaatggactgtacggcagtacagtcgaccatcaaggggtcagctggtatcactggaagggattcgaattctccgtcccattcaccgaaatgaaactgcgtccacgcaactttcgaagtcctgccggagggggatag

SEQ ID NO: 31076 - DNA, 954 bp, Artificial Sequence
  Description of Artificial Sequence: Synthetic coding sequence
atggctaagaaccccccagagaattgtgaagattgccatattctgaacgctgaggcttttaaaagcaagaagatttgtaagagcttgaagatctgcggcctcgtgtttggtatactagccctgactctgatcgtactcttttggggtagtaagcacttttggcccgaggtgcctaagaaggcctatgacatggagcatacattttattccaacggggagaaaaagaagatctatatggagattgaccccgtgacacgtacagagatcttcaggtcgggaaacgggactgacgaaaccttagaagtgcacgatttcaaaaatggctacacgggaatttactttgttggcctgcaaaaatgtttcatcaaaactcagatcaaggtgattcccgagttttcagagcctgaggaagaaatcgacgagaatgaggagatcacaactacattctttgagcaaagcgtcatctgggtccctgcagagaagcctatcgagaatagggatttcttaaaaaattccaaaatcctggaaatttgtgataatgttaccatgtactggatcaaccccaccctcatctcggtgtctgagttgcaggacttcgaagaagagggggaagacctgcattttcctgctaacgagaaaaaaggaattgaacagaacgagcagtgggtcgtgccccaggtgaaagtggaaaaaactaggcatgcccgtcaggccagcgaggaggaactgccgatcaatgattataccgaaaatggtatcgaattcgatcctatgctagacgaacgcggttactgctgtatctattgtaggcggggtaaccgctactgcagaagggtctgcgagccgctcctgggttactatccatatccctactgctatcaggggggtagagttatctgcagagtgatcatgccgtgcaactggtgggtggctaggatgctcggtagggtgtag

SEQ ID NO: 31077 - DNA, 1356 bp, Artificial Sequence
  Description of Artificial Sequence: Synthetic coding sequence
atggcaactcctttggtggcgggtcccgctgcgctacggtttgctgccgctgccagctggcaagttgtgcgcggaagatgtgtggaacatttccccagggtcttagaattcctcagatcactgcgcgcagtcgcgcctggtcttgtgaggtataggcaccatgagcgcctgtgtatgggccttaaagcaaaagtggtcgtggagctcattctgcagggacgcccatgggcccaggtgttgaaggcgttgaaccaccactttcccgaatctgggccaatcgtgagggaccctaaagctacaaagcaggatctgcgcaagatcctggaggcacaggagacattttaccaacaagtcaagcagctctcagaggctcccgtggatctggcttctaagttgcaggaactcgagcaagagtacggtgagcccttcctggcagcaatggaaaaacttttgtttgaatacctgtgtcagctggagaaagcgctccccactccgcaggcacagcagctgcaggacgtccttagttggatgcagccaggtgtgagtatcacttcctccctagcctggcgacagtacggggtagacatggggtggctgttaccggaatgttcggttacagatagtgtgaatctggctgaacctatggagcagaatccaccgcagcagcagcgcctggccctgcataacccgttaccgaaggctaaaccaggcacccacttacctcaggggccaagttccagaactcatccagagcctctggcaggcaggcacttcaatcttgctcccctgggaagacgcagggtacagtcacagtgggccagcacaaggggcggtcacaaggagaggccaaccgtgatgctgtttccgttccggaacctgggtagtccgacccaggtcatctccaagcccgagtctaaggaggaacatgcgatttacactgctgatctggcgatggggacccgcgctgcctcaaccggtaagagcaagtccccctgccagactttgggaggcagggcgctgaaggagaatcctgtcgacttgccagcaaccgagcaaaaggaaaactgtcttgactgctatatggatccccttagactgtccctgctgcccccacgggctcggaaaccagtgtgtccacccagtctttgcagctctgtaatcactattggagatctcgtactggattctgatgaagaggagaatggccaaggtgaagggaaagagtccctggagaattaccagaaaaccaagttcgatactctgatacctactctgtgcgagtacctccctcctagcggccacggagctattcccgtcagtagttgtgattgccgcgactcatcccgcccactgtag

SEQ ID NO: 31078 - DNA, 1065 bp, Artificial Sequence
  Description of Artificial Sequence: Synthetic coding sequence
atggctactcctctggtggctggccctgccgcactacgcttcgcagccgctgcatcatggcaggtggtcaggggccgttgcgtggagcattttcctcgagtccttgagtttcttagatctcttcgagcagtcgcaccagggcttgtgcgctacagacaccacgagcggttgtgcatggggctgaaagctaaagtggtggtcgagctgatccttcagggcaggccctgggcccaagtacttaaagcactcaaccaccactttcctgagtcagggcctatagtgagagaccctaaggccacaaagcaagatttgaggaaaattctagaagctcaagagaccttctatcagcaagttaaacagcttagcgaggcaccagtggaccttgcctccaaattgcaggagctcgagcaggagtatggtgagccattcctagcggctatggagaaattactgtttgagtatctgtgtcaacttgagaaggcccttccaaccccccaggctcaacagctccaagatgtgctgtcttggatgcaacctggagtctcaatcactagcagcttagcctggcgacagtatggtgtcgacatgggctggctgttgcctgagtgcagtgttaccgacagcgtcaatctggcggagcccatggagcagaacccaccacagcagcagcggctggctcttcacaaccctctaccaaaggcaaagcccggaacgcacctaccacaagggcctagctcaaggactcatccagagcccctggcaggacgccactttaacctggcccctcttgggcgacggcgagtgcagtcccagtgggctagcacaagaggcggacataaagaaaggccaacagtcatgctgtttcctttcagaaacctgggctctcccacccaagtcatcagcaaaccagaatccaaggaggaacatgctatctataccgccgacctggctatggggacacgggcagctagtacagggaaaagcaagtcaccctgtcagacactcgggggtagagccctaaaggaaaaccctgtggatctgccagccactgagcagaaagaatag

SEQ ID NO: 31079 - DNA, 423 bp, Artificial Sequence
  Description of Artificial Sequence: Synthetic coding sequence
atggagcaaaaccccccacagcagcagaggctggcactgcataacccactaccaaaggccaaacctggcactcacctcccacaaggcccttcatctaggactcaccctgagccactggctgggcgacacttcaacctggctccgctgggacggcgtcgcgttcaatctcaatgggcatcaactagaggcggacacaaggaaaggccaaccgtcatgttattcccctttcggaacctggggagccccacccaggttatttccaagccagagagcaaagaggagcatgccatatacactgctgacctggccatgggaacgagagccgctagcacaggcaaaagtaaatctccatgccaaacactcggcggaagagcactgaaggaaaatccggttgacttaccagcaacggaacaaaaggaatag

SEQ ID NO: 31080 - DNA, 1251 bp, Artificial Sequence
  Description of Artificial Sequence: Synthetic coding sequence
atggctacaccgttagtggctgggcctgcagccctgcgctttgccgcagccgcatcctggcaggtcgtgaggggcagatgtgtggaacacttccccagggttctggaattcctgcggtccctccgcgctgtcgctcccggtctggttcgttacaggcatcatgagcggctgtgtatggggctaaaagctaagactaaacaggacctgaggaagatattagaagcccaagaaaccttttatcaacaggtgaagcaactatcagaggcgcctgtagacctagcctctaaactgcaagagctagaacaggagtacggagagcctttcctggctgccatggagaagttgttgtttgaatacctatgtcagctggagaaggccttacccaccccccaagcccagcagctccaggatgtgctgtcatggatgcagccaggggtgtccatcacatcatccctggcttggcgccagtacggagtggatatgggctggctgctacctgagtgtagtgtcaccgactccgtgaatctggccgagcccatggagcagaatccaccgcagcagcagcggctcgccctgcataatccccttcctaaggccaaaccagggacgcacctgccccaggggccttctagcaggacacatcctgagccacttgcagggagacattttaaccttgctcccctcgggaggcgccgtgtgcagtcccagtgggcgtccaccagagggggacataaggagcgacctacagtgatgttattcccattccgcaacttgggcagccctactcaagtgatttccaagccagagtcaaaagaggaacacgccatttataccgccgacctggccatgggaacccgcgcagcctccacagggaagtcaaagagcccctgccaaaccctgggaggcagggcactcaaagaaaacccggtggacctgcccgctaccgaacagaaggagaactgtctggattgctatatggatcccttacgactgtctttgttaccccctcgagcacgcaagcctgtctgtccaccgtctctgtgtagcagtgtgatcacgattggggacctggtcttggactctgatgaagaggagaatggtcagggcgaggggaaagaatctctggagaattatcagaaaacaaaattcgatactctgatacccacactgtgcgagtatctgccaccatctgggcacggggcaattcccgtttcctcgtgtgactgcagggactcctcccggcctctctag

SEQ ID NO: 31081 - DNA, 3498 bp, Artificial Sequence
  Description of Artificial Sequence: Synthetic coding sequence
atggaacaagaccgaacgaatcacgtggaaggaaatcggctctcgccgtttcttatcccctcgcctccaatctgccagactgaacccttggccacaaagttacagaatggcagtcctttaccagagcgagctcatccagaggtgaatggagacacgaagtggcacagcttcaagagttattatggtataccgtgtatgaaaggaagtcagaactcacgcgtgagcccagattttactcaagaatctagggggtactctaaatgcctccagaacggaggcattaagcgcaccgtctctgaaccgtcattgtctgggctcttacaaatcaagaagctaaagcaagatcagaaagctaatggagaaagacgaaactttggcgtgtctcaagaaagaaatcctggcgaatcttcccagccgaacgtctcggaccttagcgataaaaaagaatctgtttcgagtgtggcccaggaaaatgcggttaaggacttcacaagcttctccactcacaactgttctgggcctgaaaaccctgaattgcagattttgaacgaacaagaggggaaatcagcaaattaccacgataagaacatcgttttactaaagaacaaagccgtgctcatgccaaacggggctacagttagcgcatcttcggttgaacatacacacggtgaactccttgaaaagacattgagccagtattacccggattgtgtctctattgcagtccaaaaaacgacttctcacatcaatgccattaactctcaggctacaaatgaattgagctgcgaaattactcaccctagtcatacttctggtcagatcaacagcgcccagacttccaattccgaactgccacctaagccagccgcagtcgtctcggaggcttgtgacgccgatgatgccgacaacgccagcaagctcgcagcaatgctgaatacctgcagctttcagaagcccgagcagctgcaacagcaaaaaagtgtctttgaaatttgtccatctccagcagagaacaacattcagggcactaccaagcttgcctcaggcgaggaattttgcagtggctcatctagcaatttacaggccccaggtggttcctcagagaggtacttaaaacaaaacgagatgaacggggcttacttcaaacagagctccgtattcacaaaagacagcttttccgccaccactacccccccacctccttctcagctcctgctgtctcccccaccccctctgcctcaagtaccacagctgccatctgaaggaaagtccacgttaaacggcggagtactggaggagcaccatcactatcccaatcagtcaaataccaccctgctgcgggaggtgaagatagaaggaaaacccgaggcccctccgtcacagagccccaacccttcaacacatgtatgctccccatcacccatgctgagcgaaaggcctcagaacaattgcgtcaaccggaatgatatccagaccgcgggaacaatgaccgtgccactttgtagcgagaagacacgcccaatgtcagagcacctgaagcacaatccgccaatttttgggtcaagtggcgagctacaagacaactgccagcagttgatgcggaacaaagagcaggagatcctgaagggacgcgacaaagaacagacccgcgatctcgtgccacctacccaacattacctgaagcctggctggattgagctgaaagcccctcgcttccatcaggccgaaagccatctcaaaaggaacgaggccagcctaccctccattctgcagtaccaacccaacctgagcaatcaaatgacctctaaacaatacaccggcaacagcaatatgcctggaggcctccctagacaagcctacactcaaaaaaccacacagctggaacacaagagccaaatgtatcaggtcgagatgaatcagggccagtcacagggaactgtcgaccaacacctccaatttcagaagccgtcacaccaggtgcactttagcaagacagaccacttgcccaaagcacacgtacagtctttgtgtggtacacgcttccactttcagcagcgcgcagattcccagacggaaaagctgatgtctccggtcctgaaacagcaccttaatcagcaggccagcgagaccgagcccttctccaattctcacctgctccaacacaagccacacaaacaggcggctcagacacagcctagtcagagctcccacctaccacaaaatcagcagcagcagcaaaaactccaaatcaaaaataaagaggagatactgcaaactttccctcacccacagagcaataatgatcagcagagagaaggatctttcttcggacagacaaaagtggaggaatgttttcacggcgaaaaccagtactccaaatcatccgaattcgagacacacaatgtccaaatgggcctcgaagaagtccagaacatcaatcggaggaactctccatattcccagaccatgaagtctagtgcctgtaaaattcaggtgtcctgctcaaacaacacccacctggtatctgaaaacaaagaacagaccactcaccccgagctgtttgctgggaacaaaacgcagaatctgcaccatatgcaatacttccctaacaatgtaatcccgaaacaagacctcctccacaggtgcttccaggaacaggaacagaaatctcaacaggcatcggtgctgcaggggtataaaaaccggaaccaggatatgtctgggcagcaggccgctcagctcgcccaacagaggtacctgatccataaccatgccaacgtgttccccgtgccagatcaggggggaagccatacacagacaccacctcagaaggatacacaaaaacacgcagctctgcgatggcacctgctccagaaacaggaacagcagcagacccagcagcctcagactgaatcatgccattcacagatgcatcgtcccatcaaagtggagcctggttgtaaaccacatgcctgcatgcacacggcccctcccgaaaacaaaacttggaagaaagtaacaaagcaggagaatcctcctgcctcttgtgacaacgttcagcagaaatcaatcattgagacaatggaacagcatcttaagcaattccacgccaaatccctctttgatcacaaggccctgaccctaaagagtcagaagcaagtgaaggttgagatgagtgggccagtgactgtgctgacaaggcagaccacagcagcggaactggatagccacactcctgcattagagcagcagaccacctcgtctgagaagaccccaactaaacggactgcagcttctgtgctaaacaacttcatcgagagcccgtccaaactccttgatacccctattaaaaatctattggacacccccgttaaaacacagtatgattttccgtcatgtaggtgcgttggtaaatgccagaagtgtacagaaacgcacggagtgtaccctgagctggcaaacctcagctcagacatgggattctcttttttcttctag

SEQ ID NO: 31082 - DNA, 6008 bp, Artificial Sequence
  Description of Artificial Sequence: Synthetic coding sequence
atggaacaggaccggacaaatcacgtggaagggaacaggctgagcccatttctgattccttcacctcctatctgtcagacagagccactcgctaccaagttgcagaacggaagcccgctccctgagagagcacaccccgaggtcaacggggatactaaatggcacagctttaaatcgtactacggcatcccctgtatgaagggcagccagaatagcagggtaagcccagattttacccaggagagccgcggttactccaaatgtctgcagaatggtggaatcaagcggaccgtcagcgagccctccctgtcaggattgctccagatcaaaaaacttaagcaggaccagaaggctaacggcgagagaaggaactttggcgttagccaggaaaggaaccctggtgagtctagtcagcctaatgtgagcgatctgtccgataaaaaagagtccgtgtctagtgttgcccaggagaacgcagtgaaagatttcacatcatttagcactcataattgttcgggcccagaaaatccagaactgcagattctgaacgagcaggagggaaaaagcgcaaactaccatgataaaaatatcgtactgctaaagaataaggcagtcctcatgccaaacggagccaccgtcagcgccagctccgtggaacacacccacggcgagctcctggagaagaccctttcccaatattatccagactgtgtgtcgatcgcagtgcagaagaccacaagccacataaatgcaatcaattcccaggcgacgaacgaactgagctgtgaaatcacacacccaagccacacaagcggccagatcaacagtgcccagacatcgaatagcgaactgcccccaaaaccagccgctgttgtgagcgaagcttgcgatgctgacgatgcagacaatgcttccaagcttgcagcaatgttgaatacatgtagtttccagaagcccgagcaactccagcagcagaaaagcgtgttcgagatctgcccctctcccgctgaaaataacattcaggggactacgaagctcgcctctggcgaggaattttgttctggcagcagctcaaatcttcaggcccctggaggttcttcagaacgctacctgaaacagaacgagatgaatggggcatatttcaaacagagctctgtgttcaccaaggattctttctctgcgaccactacccctccccctcccagccagctgctgttgtctccacctccgccactcccgcaggtcccacagctgcctagcgaaggcaagagtactctgaacgggggagttctcgaggaacaccatcactaccccaatcagtctaatacaacccttcttagggaggttaagatcgagggcaagcctgaagccccaccatcccagtctccgaatcccagtacccatgtgtgtagccctagccccatgctgtcagaacgacctcaaaacaattgcgtcaacaggaatgacatccagaccgccggtacgatgaccgtccctctgtgttccgagaagactaggcccatgtcagagcacctcaagcacaaccctcctatctttggctcaagtggcgagctgcaggacaactgccagcagctcatgcgtaacaaagagcaggaaatccttaaagggcgagataaagaacagactcgggatttagttcctcccacacagcactatcttaagcccggttggatcgagcttaaggctccaaggttccaccaggccgaatcccacctcaaacggaatgaagctagccttccatctatcttacagtaccagcctaacttgagcaaccaaatgaccagcaagcaatacaccggcaactccaacatgcccggtggcctccccaggcaagcctacactcagaagaccacccagcttgagcacaaatctcagatgtatcaggtcgagatgaaccagggacagagtcaaggcaccgttgatcagcacctgcagtttcaaaaaccctcacatcaggttcacttttcaaaaacggatcatttgcctaaagcacatgttcagagtctatgtggtactcgttttcactttcagcagcgagctgattctcagacggagaagttgatgagtccagtcttgaagcagcatctcaatcagcaagctagcgagactgaacctttctcaaacagccacctactccagcataaaccccataaacaggccgcacagacgcagccaagccagtccagtcatctgcctcagaatcagcagcagcagcaaaaacttcagatcaaaaataaggaggagatactacagactttcccacaccctcagagcaacaacgatcagcaaagggaaggatccttttttgggcagactaaggtcgaggagtgcttccacggcgaaaaccagtattctaagagctctgaatttgaaacacataacgtgcagatgggtttggaagaagtgcagaacatcaaccgaaggaattctccgtactctcagaccatgaagtcatcagcgtgcaaaattcaggtgtcctgttcaaataacactcatctcgtttctgaaaataaggaacagaccacgcaccccgagctgttcgctgggaataagactcagaacttacaccacatgcagtactttccaaataacgtgatcccaaagcaagatctgctccacaggtgctttcaggagcaagagcaaaaatctcagcaggcttcagttttacaaggctacaaaaaccgcaaccaagacatgtcgggtcagcaagctgcccaactagcccagcaacggtacctcatccacaatcacgccaacgtgtttcctgttcccgatcaggggggatcccatacccaaaccccgccacaaaaggacactcagaagcatgccgcactgcgctggcacttgttacaaaaacaagagcagcagcagacccaacagccccagaccgagagctgccattcccaaatgcaccgccctataaaggtggaaccgggatgtaaaccccacgcttgtatgcacacagcaccaccagaaaataaaacgtggaagaaagtgactaagcaggagaacccgcctgccagttgcgacaatgtgcagcaaaagagcatcattgaaactatggagcagcacttaaaacagttccatgccaagagcctgttcgatcataaggcccttaccctaaaaagccagaagcaggttaaggtggaaatgagtggcccagtcaccgtactgactagacagactacagccgcagagctggactctcacacccccgctttagaacagcaaacgacgagttcagaaaaaacgccaacaaagagaaccgctgcatcagtgctgaacaacttcattgagtccccctcaaagctccttgatacaccaatcaaaaatttgctggataccccagtgaagacacagtacgattttccctcctgtcggtgtgtggaacaaataatagaaaaagacgaaggcccattctacacacacctgggagctggcccaaacgttgccgctatccgagaaatcatggaggagcgtttcggacagaaaggcaaggccattcgcatcgaaagggtgatttacaccgggaaagaaggaaaatctagtcagggctgccctattgcgaagtgggttgtccggaggtcttcctcagaggagaaactcctctgtttggtgcgcgagcgcgcaggacatacgtgtgaagccgcagtgatcgtcatactgatcctggtctgggagggaatccctttaagccttgccgataaactttactctgagctcacggaaacgctcaggaaatacggaacccttacgaatcgacgatgcgccctgaacgaggaacgcacttgcgcatgccaggggctcgaccctgagacctgcggcgcatccttctccttcggatgctcatggtcaatgtattacaatggatgcaagttcgctagaagcaagatccccagaaagttcaaactcctcggggatgaccccaaggaggaggagaagttggaaagccacctccagaacctgtctaccctaatggccccaacttataagaagttggcacctgacgcatataacaatcaaattgagtacgaacacagagcccctgaatgccgcctagggttaaaggagggtcgacccttctctggagtaaccgcctgtttggatttttgtgctcacgctcatagggacctgcacaatatgcaaaatggttcaaccctagtttgcactctgaccagagaggacaaccgggaatttggtgggaaacccgaggacgagcagctccacgtgctgcccctttacaaggtctcagatgtagacgagttcggctctgtcgaggctcaagaggaaaagaaacggagtggcgctatccaggtgctgtcttcatttagacgtaaagttagaatgttggcagaacccgtcaaaacatgcaggcagagaaagttagaggccaagaaggcagcggcagaaaagctgtcctcattggagaacagtagcaataaaaacgaaaaggaaaagtcggcaccttcccgcaccaagcagacagagaatgcttcgcaagccaagcagttggctgaacttttgaggctctccggaccagtgatgcagcagtctcagcagccacagcctctgcagaaacagcctccacaacctcagcagcagcagagaccacagcagcagcagccacatcatcctcagacggagagcgtgaactcgtactcggccagcggaagtactaacccctacatgaggagacctaaccccgtgtccccatatcccaatagttcccatacttctgacatatacggcagcacttcccccatgaatttctatagtacgagttcccaagccgctggcagctatttaaatagcagcaatccaatgaatccataccctggtctcctaaaccagaatacccagtaccccagttatcagtgcaatggcaatctaagcgtggataactgctccccatatctgggatcatatagtcctcagtcccaacctatggacctgtataggtatccatcccaggatcccctctctaagctgtcgctgccccctatccacacattataccaaccacgattcggtaatagtcagtccttcaccagtaaatatttaggttatggaaaccagaatatgcagggtgacggttttagcagctgcaccattaggcccaacgttcatcatgtgggtaagttgccgccttatcctacccatgaaatggatggtcacttcatgggcgcaacctccaggttgccccctaacctgtccaatcctaacatggactacaagaacggggagcaccactctccatctcatatcattcacaattactctgcggcacccggaatgttcaattcctcgctgcatgcccttcatcttcagaacaaagagaatgatatgctgagtcacaccgcaaacggactttctaagatgcttcccgctctgaaccatgacagaaccgcttgtgtgcaggggggactgcataagctgtctgacgccaacggccaggaaaagcaacctctggccctcgtgcagggtgttgctagcggcgcagaagataacgatgaggtgtggtctgattccgagcagagcttcctcgaccccgacatcggtggagttgcggtcgcccctactcacggctccatcctcattgaatgcgcgaagcgggaacttcacgccaccaccccattgaagaaccccaacagaaatcaccctaccaggatctcacttgttttctatcagcacaagagtatgaatgagccgaagcacgggctggcactatgggaggccaaaatggctgaaaaggccagagagaaggaggaagagtgcgaaaagtacgggccagactatgtcccacagaagtcccacggcaagaaggtgaagcgcgaacctgctgaacctcacgagacaagcgagccgacctaccttaggtttattaaatccctggccgaacgaaccatgagcgtgacaaccgatagtaccgtgaccaccagcccgtatgctttcacgagggtcaccgggccatacaatcgttacatcta

SEQ ID NO: 31083 - DNA, 3498 bp, Artificial Sequence
  Description of Artificial Sequence: Synthetic coding sequence
atggaacaagacagaaccaatcacgtggagggtaataggctgagcccgtttctcatcccttctcctcccatttgccagacagagcctctcgctaccaaactccaaaatggatcgccactaccagagcgggcacacccagaggtcaatggcgataccaaatggcatagctttaagagttattacggaatcccttgcatgaaggggtcacaaaattctcgggtgtcgcctgatttcactcaggaatccagggggtactccaagtgtctgcagaatgggggaatcaaacggaccgtttccgagcctagcctgtccgggctcctccaaatcaagaagctcaagcaagaccagaaggctaacggcgaaagacgcaactttggggtgagccaggaaaggaaccctggcgaatcttcacagccaaacgtgagcgacctatccgataaaaaagagagcgtatcatctgtagcacaagagaatgcagtcaaagacttcacttcattctctacacacaactgtagcggccctgaaaatccagaactgcaaattcttaatgaacaggaaggtaaaagtgctaattatcatgataagaatattgtgctgctcaagaacaaggccgtgctgatgcccaacggagcaaccgtatcggcgagcagcgtggaacatacacatggggagctgctggaaaaaaccctgagccagtactaccccgattgcgtttcgatcgctgttcagaaaaccacaagccacatcaacgctataaattcccaggctacgaatgagctgagctgtgagattacacatcccagtcacacttccgggcagatcaatagtgcccagaccagtaacagtgagttgcccccaaaaccggcagccgtcgtgagcgaagcctgtgatgctgatgacgccgataatgcctccaaattggccgctatgctgaatacctgtagtttccagaaaccagagcaattgcaacaacagaagtctgtcttcgagatatgtccttctcccgcagaaaataacatccaggggacaacaaagctggcttctggggaggagttttgttccggttccagcagcaacctgcaggcacccggtggaagcagcgagagatatctgaagcagaacgaaatgaacggagcttacttcaagcaatcctctgtgttcacaaaggattccttttccgcgacgacaacacctccccctccatcccagctgcttctgtcacccccaccaccgttgcctcaggtccctcagctgccctcagaaggaaagagtaccctcaacggaggtgttctggaggagcaccatcactatcccaatcagtctaacacgacactgttgcgagaagtgaagatcgagggcaagccagaggcccctcctagtcagagccctaaccccagcactcacgtgtgttccccgtccccaatgttgagcgaaaggcctcagaataattgcgttaatagaaatgacatccagactgccggtacaatgacagtaccgctttgtagcgagaagacccggccaatgtctgaacatctgaaacataaccctccaatattcggctcttctggggagctccaggacaattgccagcaactgatgaggaataaggagcaggagatccttaaaggccgtgacaaagaacagactcgggatctcgtcccacccacccagcactacctcaaacctgggtggattgaacttaaggcccctaggtttcaccaagcagagagtcacctcaagagaaacgaagccagtcttccctcaatcctgcagtaccaaccaaacctaagcaaccagatgacctcgaagcaatatacaggtaattccaatatgccaggtgggctgccaagacaagcgtacactcagaaaaccacccagctggaacataagagtcagatgtatcaggtcgagatgaaccagggacagagccaggggactgttgatcagcacctgcagtttcagaaaccgtctcatcaggtgcatttctccaaaacggatcaccttccgaaggctcacgtgcagtcactttgtgggacccgcttccactttcagcaacgggcagactctcagactgagaaactcatgagtccagttctgaagcagcatcttaatcagcaggcatcggagaccgagcccttttcaaattcacaccttctccagcacaagccacacaaacaggctgcccaaacccagccctcgcagagctctcacctccctcaaaatcagcagcagcagcaaaaactccagataaaaaacaaggaggaaattttacagacttttccccacccccagtctaacaacgatcagcagagggagggctccttcttcggacagaccaaagttgaggagtgctttcacggtgagaatcagtattccaaaagttccgaatttgaaactcacaatgtgcagatgggccttgaggaagtccagaacatcaacaggagaaatagtccatatagtcaaaccatgaagtcatcagcatgcaaaatccaggtcagctgctccaataacacccatctggttagtgaaaacaaggagcagactacacaccctgagctgtttgccggtaacaagacccaaaatctgcaccacatgcagtacttccccaataatgtgattcccaaacaagacttgcttcaccggtgttttcaagagcaagaacagaagtcacagcaggcctccgttttacaaggctataagaatcggaaccaagacatgagcggtcaacaggcagcgcagctggcccaacagcgttatcttatccacaatcacgccaatgtcttcccagtccctgatcagggaggttctcacacccagacgccccctcagaaagacacgcagaagcacgcagcccttcgctggcacctgctccagaagcaggagcaacagcaaacacagcagccacagactgagtcatgtcacagccagatgcatagaccgattaaagtggaaccaggctgtaagccacacgcgtgtatgcacactgcgcctcctgaaaataagacttggaagaaggtgaccaagcaggagaacccccctgcaagttgcgacaacgtgcagcagaagtctatcatcgagacgatggagcagcacctaaagcagtttcacgccaagagcttatttgatcataaagccctgactctgaaatcacagaaacaggtaaaagtcgaaatgtccggtccggtgacagtgctgacacgacaaactactgccgcagagctcgattctcacactcccgctctggaacaacaaacaactagctcagaaaaaactccaactaaacggacagccgcatctgttttgaacaacttcattgagagccccagcaagttacttgataccccgattaagaatctcttagacacccctgtgaagacacaatacgacttccctagttgccggtgcgtgggaaagtgtcagaaatgcaccgaaacccatggcgtttatcctgaactggcaaatttgtcctcagatatgggtttttcttttttcttctag

SEQ ID NO: 31084 - DNA, 333 bp, Artificial Sequence
  Description of Artificial Sequence: Synthetic coding sequence
atggaacaagatagaaccaatcacgtggagggaaacagactttctccctttctgattccaagtcccccaatatgtcaaacggaacctctggcgacgaagctgcaaaacgggtccccactccctgaaagggcccaccctgaggtgaatggtgataccaaatggcattcctttaaaagctattatggaatcccatgcatgaagggctcacagaatagccgggtttctcccgattttacacaggagtctcgaggctattctaagtgcctgcagaatggcggaattaagcgcaccgtctcagagccaagtctgtccggtctcttgcaaatcaaatag

SEQ ID NO: 31085 - DNA, 1914 bp, Artificial Sequence
  Description of Artificial Sequence: Synthetic coding sequence
atggagcaggatagaactaatcacgtggagggcaataggctcagcccattcctcatacctagtcctccgatttgtcagactgaacctttagcaaccaagcttcagaacggcagtcccctgcccgagagggctcatccagaagtgaacggcgacactaagtggcactctttcaagagctattacggcatcccatgtatgaaaggttcacagaactcacgcgtctctcctgactttacccaggaaagcagaggatattccaagtgcctgcagaacggagggatcaaaaggactgtgtctgagccgtccctgagtggtctgctgcagataaagaaacttaaacaggatcaaaaggccaacggcgagaggagaaacttcggagtctctcaagagaggaaccctggggaaagcagccagcctaacgtaagtgatcttagcgacaagaaggagtccgtaagcagcgtggcacaggagaatgccgtcaaagatttcacaagcttttctacccacaattgcagcggacccgagaaccctgaactgcagatattaaacgagcaggaaggtaagagtgctaattaccacgataagaacatcgtgcttcttaagaacaaggcagtgctcatgccaaacggcgctacagtgagcgcctcttccgtcgagcacacacatggcgagctgctggagaaaactctgagccagtactacccagactgcgtcagcattgccgtccagaagaccacaagtcatatcaacgccatcaatagccaggctacgaatgagctgtcatgcgagattactcatccttcacacactagcgggcaaataaatagcgcccaaacgtccaactcagagttgccccctaagcctgcagccgtcgtgagcgaggcatgtgatgccgatgatgccgacaacgcctccaagctggcggcaatgttgaacacttgctcgtttcaaaagcccgagcagctgcaacagcaaaaatcagtcttcgaaatctgcccctccccagctgaaaataacatccaggggacgactaaactcgcttccggcgaggagttctgctccgggtcttcaagcaatctgcaagcacccggtggatcttccgaacgctatctcaagcagaacgagatgaacggcgcatacttcaaacaatcctctgtctttacaaaggactcctttagcgccacgacaaccccacccccaccaagccaactactcttgtcaccccctcccccacttcctcaagtcccccagttgccaagcgagggcaagtcgaccctgaacggcggagttctagaggaacaccaccactatcctaatcaatcgaacacaactctactgagggaggtgaaaatcgaagggaagcctgaagcccctccctcccagagtccaaatcccagtactcatgtgtgctcccctagtcctatgctttcagagcggccacagaacaactgcgtcaatcggaacgatatccagacagccggaaccatgaccgttcccctgtgtagcgaaaaaacccgtcccatgagcgagcatctaaaacacaacccccctatattcggcagttccggtgagttgcaagacaattgccagcaactaatgcgaaataaagagcaggagatcctgaaaggtcgggacaaggaacaaaccagggaccttgtccctccaacccagcattacctcaaacctggctggatagaactgaaggcgccacgattccaccaagcagagtcacacctgaagcgaaatgaggcaagcctgcccagcatactgcaataccagcctaatttaagcaaccagatgacatccaaacaatatactggaaactccaacatgcctggtgggctccccagacaagcttacactcaaaagacaacacagctcagcacgtctcacaagtgcacaaagttaaaatag

SEQ ID NO: 31086 - DNA, 6008 bp, Artificial Sequence
  Description of Artificial Sequence: Synthetic coding sequence
atggagcaggatagaactaatcacgttgaagggaatcggctctccccctttctgatcccaagtccacccatctgccagaccgagccccttgccaccaagttgcagaatgggagcccactgccagaaagggcccaccctgaggtgaatggtgacacaaaatggcatagctttaagtcttactacgggattccctgcatgaaaggatcccaaaatagtcgagtttccccggacttcacgcaagagagcaggggctactctaaatgcttgcagaacgggggaattaaacggactgtgtccgaaccttctctctcaggactcctgcagataaagaaactgaagcaggatcagaaagctaacggggaacgtcgaaattttggtgtatcacaagagagaaatcccggagaatcatcacaacctaacgtgtcagacctgtccgataagaaagaatcagtgtcatcagtcgcacaggagaacgccgtgaaagacttcactagctttagcacccacaactgttccggaccagaaaatcccgaattgcagatcctaaatgagcaagaggggaagagcgccaattaccatgacaaaaacatcgtgctcctgaaaaataaggcagtactaatgcctaatggggcaaccgtgtccgcttcctccgtagaacacacacatggtgaattgctggaaaaaacattatctcaatattacccagactgtgttagcattgccgtgcagaagaccactagccatattaacgccataaactcccaagcaaccaatgaacttagctgcgagatcactcacccttctcatacgtccggtcagatcaactctgctcaaacttccaatagtgaactgccccctaagccggcagctgtggtttcagaagcttgtgatgcggacgacgccgacaacgcctcaaaacttgccgctatgctaaatacttgctctttccagaagcccgaacagctccagcagcagaaatcagtcttcgagatctgcccaagtcccgcagaaaataatatccagggtaccaccaaacttgcctctggcgaggaattctgtagcggtagcagttccaacctacaggctcctggtgggtcctctgagcggtatctaaaacagaatgagatgaatggcgcatatttcaagcagtcatcagtgtttacaaaagacagttttagcgccaccaccacgcccccaccaccatcccagttactgctcagccccccaccccctctcccccaggtgccacaactgccgtcagagggtaagtccactcttaacggcggagttctggaggaacaccatcactaccccaatcaatcaaacacaacacttctgagagaagttaagatagaagggaagccagaggcccctccttctcagtccccgaatcctagcacacacgtgtgtagcccatctccgatgttgagcgaacgaccccagaacaattgtgtgaatcggaacgatatccaaaccgcgggaactatgaccgtccctctctgctccgagaagacccggccaatgtccgagcatctaaagcacaatccgcctatcttcggatccagtggagagttgcaggataactgccaacaactgatgcggaacaaagagcaggagattttgaagggacgcgacaaagaacaaacgcgggatttagtgccacccacgcagcactatctcaaacctggttggatagagctgaaggcccctaggtttcaccaggcagaaagccacctgaagcgaaacgaagcttcacttccatcaatcctgcagtaccagcccaacctgagcaaccagatgacaagtaaacagtatactggaaacagcaacatgcctggaggtcttccccgacaggcatatacccaaaagactacccaactggaacataaaagtcagatgtatcaagttgagatgaatcagggccaatcgcaagggaccgtcgaccagcaccttcagttccagaaaccatcgcaccaagttcacttcagcaagactgaccacctgcccaaagctcacgtgcagtccctgtgcgggactcgctttcacttccaacagcgagctgattcccagacagaaaagctcatgtcccctgtgctgaaacagcacctgaatcaacaggcctcagaaaccgagccctttagtaactcacaccttctccagcacaagccccataaacaggccgcacagactcagcctagtcagtcatcacacctcccgcagaatcagcagcagcagcagaagcttcaaataaaaaacaaggaggaaatattgcagaccttcccgcatccccagtcaaataatgaccagcagcgggagggctctttcttcgggcagaccaaggtggaggagtgttttcatggagagaatcagtacagcaagagttctgaattcgaaacacacaacgtgcagatggggttggaggaagttcagaatataaaccgacgaaattccccttattcccagacaatgaagtctagtgcttgtaagatccaggtatcatgtagcaacaatacacatcttgtttctgagaataaggaacagacaacacatcctgagctgtttgcgggtaacaaaacccagaacctgcaccatatgcaatactttccaaacaacgtgattccaaagcaagacctcctccacagatgtttccaagagcaggagcagaaatcacagcaagcatccgtgttacaggggtataagaaccgcaaccaggacatgtctggccaacaggcggcacagctggcccagcagcgatatctgatacataaccacgcaaacgtcttccccgtccccgaccagggaggatcacacacccagaccccccctcaaaaagatacacaaaagcatgcggctttgcgctggcatctgctccagaagcaggaacagcagcaaacgcagcagccccagactgaatcttgccactctcaaatgcacaggccaattaaagttgagccgggttgtaagccacacgcctgtatgcatacggcaccccctgagaacaagacctggaaaaaggtgacgaagcaggaaaatcccccagcctcttgcgacaacgtgcaacaaaaatctatcatcgaaacgatggaacagcaccttaagcagtttcacgcaaagtcccttttcgatcacaaggcccttacccttaagagccagaagcaagtgaaggtggaaatgagtgggccagttaccgtgctaaccaggcagacgaccgctgccgagctcgactcccacacaccagctctcgaacagcagaccacttcaagtgagaaaacacctaccaaaagaacggctgcctcagttttgaacaatttcattgaatcacccagcaaactgctggataccccaattaaaaacctgctggatactcctgtcaagacccagtatgacttcccctcctgtcggtgcgtggaacaaattatcgagaaggacgagggacctttctatactcacttgggtgccggtcccaatgtggcagctattcgcgagattatggaggaaaggtttggtcagaagggcaaagctatccgcattgagagagtgatttatactggaaaggaagggaaatcctcccaaggatgccctattgctaagtgggtcgtgcgacgctctagctcggaagaaaaattgctgtgcctcgtgagagaaagggccggacatacctgtgaggccgcagtgatcgtcatccttatcttggtgtgggaggggatcccactgagcttagctgacaagctgtatagcgagttgaccgagaccctaaggaaatatggaacattaaccaatagacggtgtgcactgaacgaggagcgcacttgtgcttgccagggccttgatccagagacatgtggcgcttccttcagtttcggatgctcttggagcatgtactacaatggatgtaagtttgcgaggagcaagatcccgagaaagtttaagctcttgggcgacgacccaaaggaggaagagaaattggaatctcatctgcagaacctgtccaccttgatggcccctacttataagaagctggcccctgatgcctacaataaccagatcgagtacgaacaccgagccccagagtgcagattgggcttgaaagaaggcagaccgttctccggagtgacagcatgtctggacttctgcgctcatgctcaccgagacttacataacatgcagaacggatcaaccctggtgtgtaccctaacaagagaagataacagggagtttggcggaaagcccgaggacgagcagctccacgtgctgcccctgtacaaagtaagcgacgttgatgaattcggatctgtggaggcacaggaagagaagaagcgatctggcgctatccaggtcctcagtagcttccgcaggaaagtgcgaatgctggctgaaccggttaagacctgcagacagcggaaactggaagctaaaaaagctgccgctgagaaactgtccagtcttgaaaatagttcaaataagaacgagaaagagaaatctgctccgagccggaccaagcagacggagaatgcttcccaggcaaaacagctggccgaactattgagactttcaggtcccgtgatgcagcagtctcagcagccacagcctctgcagaagcagccaccccagccacagcagcaacaaaggccacagcaacaacagcctcaccacccccaaaccgaatctgttaactcatattccgcttctgggagcactaacccatacatgcgtagacctaacccagtgagtccttatccaaattcatcccacacaagcgatatttacggatccactagcccaatgaacttctatagcacctctagccaagccgcaggcagctatctgaattcctctaaccccatgaatccgtatcctgggttattaaaccagaatacccaataccccagctaccagtgcaacgggaatttgtccgtggataattgttccccttatcttgggagttactcacctcaaagtcagcccatggatctttacagatacccatcacaggatcctttatcaaaactgtcattgccgccaatccatacactgtatcaacctagatttggcaattcccagagcttcacctccaaatatcttggctacgggaatcagaacatgcaaggcgatggcttttcctcttgtactattcgacctaacgtgcaccatgtgggaaaacttcctccctacccaacacacgaaatggacgggcatttcatgggagccactagtaggctacccccaaacctgagtaatcccaacatggactataagaacggagagcaccactccccaagccatattattcacaattactctgcggctcccggtatgtttaatagcagtctgcatgccctccacttgcagaataaggaaaacgacatgctgtcccacactgccaatggattgtcaaaaatgctgcccgcactgaatcatgaccgcactgcctgtgttcaagggggactccataagctttccgacgcaaacggccaggaaaaacaaccactcgctcttgtacagggtgtggcttcaggagcagaggacaacgacgaagtgtggtcagactccgaacagtctttcctcgaccccgatatcggaggagtcgctgtcgcaccaactcatggatccattctcattgagtgcgcaaagcgggagctccacgccactactccactcaaaaatcccaatcgcaaccaccctacgagaatcagtctagtcttctaccagcacaagtctatgaacgaacccaaacacggactggcgctatgggaggcaaaaatggccgagaaggcccgtgaaaaagaagaggaatgtgaaaaatacggtcctgactacgtccctcagaagtcgcacgggaagaaggtaaaacgggaacccgcagagccacacgaaacctccgagccaacatacctgaggttcataaaatcactggctgagcgaacaatgtctgtgacaacagattctactgtgacgacgagtccctacgcattcacacgggttacaggcccatataacagatacatcta

SEQ ID NO: 31087 - DNA, 3585 bp, Artificial Sequence
  Description of Artificial Sequence: Synthetic coding sequence
atggagcaggatcgaacgaaccatgttgaaggaaatcgcctctctccctttctgattccaagtcctcctatctgtcaaacggagccactggcgaccaaattgcagaacggctcacctctccctgagcgggctcatccagaagtgaacggcgacacaaagtggcactccttcaaatcctattacgggattccctgcatgaaaggctcacagaatagcagggtgagtcccgactttacacaggagagcagggggtattctaagtgcttgcagaatggcggtatcaaaagaacggtctcagaaccttcactctcagggcttctccagattaaaaaattaaaacaggatcagaaggctaacggagaaagacggaatttcggcgtgtcacaggaaagaaacccaggcgaatcctcacagcccaatgtgtcagacctgtctgataagaaggaaagcgtatcttccgtcgctcaggagaacgctgttaaagattttacttccttctcaacccacaactgctctgggccagagaatccagagctgcagatcctcaacgagcaagagggaaagagcgctaattatcatgacaagaatatagtcctgctaaagaataaggctgtgctaatgcccaacggcgcaacagtctcagcgagttccgtggagcatacccatggagagctgctggaaaagaccctgagccagtactatccggattgcgtctctatcgcagtgcagaagacaacttcacacatcaacgccatcaattcacaggccacaaacgaattgtcttgcgagataacccatccatcccatacgagcggccagatcaactcagcccagacctcgaactctgagcttccgcctaaaccagcagcggtcgtatccgaggcttgcgacgcagatgacgcagataatgccagcaaactggctgcgatgctaaacacttgttcgttccagaaaccagagcaactacaacagcagaagtccgtgttcgagatctgcccatcacccgcagagaataatattcaggggacgacaaagctagcctccggcgaagaattctgcagcgggagcagcagcaatctccaagcccctggcggatcctctgaaaggtatctcaaacagaatgagatgaacggcgcatacttcaaacagtcctcggtctttacaaaggactccttctctgccactacgacgcccccacctccatctcagctcttactgtctccccctccgccactgcctcaagtgcctcagctgccttcagaaggtaaaagcacgcttaacggtggggtgcttgaggagcaccatcactacccaaatcagtctaacaccacccttctgcgtgaagtcaaaatcgagggtaagcctgaagcgcctccctctcagtccccaaatcccagcacccacgtttgttcccctagtccaatgctctctgaaaggccccaaaacaactgcgtgaacaggaacgacatccagaccgctgggactatgaccgtgcccctgtgttctgagaaaactaggccaatgagtgagcatctaaagcacaatccgccaatcttcggtagcagtggagagttgcaagataattgccaacagttgatgaggaacaaggaacaggagatactgaaaggaagagacaaggagcagacccgggacctggttcctccaacccagcattatctcaaacctggttggatcgagctgaaggcgcctagattccaccaggccgagtcacaccttaagcgcaatgaggcctccttgccctcaattctccagtatcaacccaatctgtcgaatcagatgactagcaagcaatacactggaaattccaacatgccaggtggtttaccgaggcaggcttatacccagaagaccacccagctcgaacacaagagtcagatgtaccaggtggagatgaatcagggccagtcccagggcacagtggatcagcacctccaatttcagaaaccgagccaccaagtgcacttttcgaagaccgatcatcttcccaaagctcatgtccagtccctctgcggcaccagatttcactttcagcaacgtgcagattcccagaccgaaaaactcatgagcccagtgctgaaacagcaccttaatcaacaggcctcagagaccgagcctttctcgaattcccacctgttgcagcacaagcctcacaaacaggccgcacagactcagccctctcagagctcacacctcccccagaaccaacagcagcagcaaaagctgcaaattaagaacaaggaggagattctgcagaccttccctcatccccagagtaacaacgaccaacagagggagggtagttttttcggccagaccaaggtcgaggagtgcttccacggcgagaaccagtatagtaagtcgtccgagttcgaaactcacaacgtgcagatgggcctggaggaggtgcaaaatataaaccgaagaaattctccatatagccagactatgaagagtagcgcctgtaagatccaagtatcttgcagcaataatacacatctggtgtccgagaacaaggagcagacgacccatccggagttattcgcgggaaacaaaacccagaatttgcaccacatgcaatacttcccaaacaatgtaatccctaagcaggacctgctgcaccgctgctttcaggagcaggagcagaagtctcagcaggcttccgtactgcagggatataagaaccggaatcaggatatgagcgggcagcaggctgcacaactcgcccaacagcggtatctgattcacaaccacgctaatgtattcccagtgccagaccagggtggatcgcacacccaaaccccccctcaaaaagatacacagaaacacgccgctctcagatggcacttactgcaaaaacaggaacagcagcaaacccagcagccccagaccgagagttgtcatagccagatgcaccggccaatcaaggtggaaccaggctgtaagccccacgcatgtatgcataccgcaccccctgagaacaagacatggaaaaaagtcaccaagcaggagaatccccctgctagttgcgataacgtgcagcagaaaagtatcattgagacaatggagcaacatcttaaacagttccatgccaaatctctgtttgaccacaaggccctcacgttaaagagtcaaaaacaggtgaaggtggaaatgagcggcccagtcactgtgcttacccgacagaccaccgctgccgagttagacagtcacacccctgctctcgagcagcaaactacaagttccgagaaaaccccaaccaaacgaactgcagccagcgtgctgaataactttattgaaagccccagtaagttgctcgatacacctataaaaaatcttttagatacccccgtgaaaacacagtatgattttcctagctgtaggtgcgttggccttgacagacgtgtaaaattactgggccttaaagaaagctctatcttagtgaaaaaagcgaaggtcctaagagatgtgttgctgcttagcgggtggtttgccgaagccgcagtcaagcggagttattgtgtgtggtgcgggtccgagctggcaacgcctgtcagactacagtag

SEQ ID NO: 31088 - DNA, 6071 bp, Artificial Sequence
  Description of Artificial Sequence: Synthetic coding sequence
atgatccaggaggagcagatccagctggaaggaagtctggtggacggacctgaagcctcactgatggagcaagatcggaccaatcatgttgaagggaacagactctctcccttcttgattccatcaccgcctatttgtcagactgagcccctggctaccaagctgcagaacggcagcccattgccagaacgggctcaccccgaagtgaacggagacacaaaatggcacagtttcaagagttactatgggataccctgtatgaaaggctcacagaacagcagagtgagcccagatttcacccaggagtcaagaggctacagcaaatgcctgcaaaacggtggaatcaagagaactgtcagcgaaccgagcctctcgggcttactccagatcaaaaagctgaagcaagaccaaaaggccaatggcgagcggaggaactttggggtgtcccaggaacgcaatcctggagagagctcccagcctaacgtgagcgacctcagtgataagaaggagtctgtgtccagcgtagcccaggaaaacgccgttaaagacttcacttctttctctacccacaattgtagcggacccgagaatccagagcttcaaattctgaatgagcaggaagggaaaagcgccaactatcatgacaaaaacattgtcctgctcaaaaataaagctgtgctgatgcctaatggtgcgactgtaagcgccagttcggtggaacacactcatggggaattgttggaaaagactctgtcacagtactaccctgattgcgtgagcattgctgtccagaaaactacctcacacattaatgcaataaattcccaggccacaaatgagctctcgtgcgagataacccacccctcacatacgagcggtcagataaactctgcgcaaacttccaattcagaattacctcctaagcccgctgctgtggtaagtgaagcatgcgatgccgatgatgccgataacgcaagcaagcttgctgccatgctgaacacatgctccttccagaagcccgagcaactgcagcaacagaagtccgtgtttgagatatgtcccagccctgctgagaataacatccaaggcaccaccaaactggcatcaggcgaggagttctgttctggatcatcgagcaatttacaggctccgggaggctcatcagaacgctacctcaaacagaacgaaatgaacggtgcctattttaaacagtctagcgtcttcactaaagactcgttcagcgctacaactacgccacccccacctagtcagctccttctttctccaccaccccctttgcctcaggtcccacaactgcctagtgagggcaaatccaccctgaatggcggagtgctggaggagcatcaccactatccaaaccagagtaacactactctgctacgggaagtcaaaatcgaaggcaaaccagaggctccaccaagccagtcccccaatccttccactcacgtgtgttcaccttctcctatgctgtctgaacggcctcagaacaattgcgtgaaccgaaatgatattcagactgccggaaccatgacagtcccactgtgcagcgaaaagacccgtccgatgagtgagcatctgaaacataacccgccaatcttcgggagctccggcgagctgcaggacaattgtcagcagctcatgaggaacaaggaacaggaaatcctgaaaggtcgtgataaggagcagacaagggacctggtgcctcctacccaacattacctgaaaccaggctggatcgagctgaaggccccaagatttcaccaagctgagtcacaccttaagcgcaatgaagcgagtctgcctagcattctgcagtatcagccaaatctttcaaatcagatgacatccaaacagtacaccgggaatagcaatatgcctggagggttgcccaggcaggcatatactcagaaaactacacagctcgagcataaatctcagatgtaccaagtcgagatgaaccagggacagagccaaggaacggtggatcagcatctccagttccagaaaccctcccaccaggtgcatttttccaaaacggaccatctgcctaaggcgcatgtgcagtccctgtgcggtactcgctttcattttcagcaacgagccgacagtcagacagaaaagctaatgtctccagtacttaaacagcacctgaaccagcaggccagcgaaacggaaccattttctaatagccaccttctgcaacataaaccccacaagcaggctgcccagactcagccatcgcaaagtagccacctgccacagaaccagcagcaacaacaaaagctgcagattaaaaacaaagaagaaattctgcaaaccttcccacatcctcaaagcaacaatgatcagcagcgggaaggatcatttttcggccaaactaaggtcgaggaatgtttccacggtgagaaccagtactccaagtctagcgaattcgagacccacaacgttcagatgggcttggaggaagtgcagaacatcaatcggaggaactccccctactctcagacaatgaaatctagcgcttgtaaaatccaggtgtcgtgtagtaacaatacgcatctcgtgagtgagaacaaagagcagactactcatcccgagctctttgctggaaacaagacccagaacctacaccacatgcagtattttccgaataacgtcattcccaagcaggacctgctccataggtgttttcaggaacaagaacaaaaatctcagcaggcaagcgtgcttcaaggctataaaaacagaaatcaggatatgagcggtcagcaggcggcacaactggcacaacaacgctacctgatccacaaccacgcaaatgtcttcccggtgcctgaccagggcggttcccacacccagaccccccctcagaaagacacccagaagcatgcagccttacgctggcatctactccagaagcaggagcagcagcagacccaacagcctcagacagagagctgccatagtcagatgcaccgcccaataaaagttgagcctggttgtaagccacatgcctgcatgcatacggccccacccgagaacaagacctggaagaaagtgaccaagcaggaaaatcctcccgcttcttgcgataatgtgcaacaaaaaagcatcattgagacaatggagcagcatctcaagcagttccacgccaaatccctcttcgaccataaagccctgacacttaaaagccagaaacaggttaaagtcgaaatgagcggtcccgtcacagtcctcaccagacagaccaccgctgctgaattggattcccacacccccgctctggagcagcagaccacatcctcggagaagacccccaccaaaaggactgcagcaagtgtccttaataatttcatcgaatcaccatctaagctactggacaccccaatcaaaaatctgctggacactcctgtgaaaacacaatacgattttccatcctgcagatgtgtcgaacagatcatcgaaaaggacgaagggcctttttacacacatcttggagccggacctaacgtcgcagcaattcgcgagattatggaagaacgattcggtcagaaggggaaagccatacgcattgagagagtgatctatacgggcaaagaggggaagagttcacagggatgtccgattgccaaatgggtggtccggaggtcttcaagtgaggagaagctcctatgtctcgtgcgtgaacgcgcaggacatacttgcgaggccgcagttatcgtcatcttgattctggtctgggagggcatccctctcagccttgccgataaactctatagcgaactcactgagacactgcgcaaatatggcaccctgactaatcgcagatgcgccttgaatgaagaacgcacctgcgcctgccagggcctcgacccagagacttgcggcgcatcattcagctttggttgctcctggagcatgtattacaatgggtgtaaatttgctcgttctaagataccacgaaaattcaaacttttaggagatgatcccaaggaagaagagaagctggagtcgcatctccagaacctcagcacccttatggctccaacctacaagaagctcgcccctgacgcttacaacaaccagattgagtatgaacatcgcgctcccgaatgcagacttggattgaaggaggggagacctttttcgggcgtcacggcctgcttggacttctgtgcccatgcacaccgcgacttgcataatatgcagaacgggtcaactcttgtttgcaccttgaccagggaggacaaccgcgagttcggtggtaagccagaggacgagcagctgcacgtgctgcccctctataaggtctcagacgtggacgaattcggaagcgtagaagcccaggaagagaagaagagaagcggcgcaatacaggtgctttcatcttttcggcgtaaagtgcggatgctcgccgagcctgtaaaaacatgtcgccaacgcaagctggaggctaagaaagcagctgcagaaaagctgtcctcattagagaattcaagcaataagaatgaaaaggagaaatcggcacccagccggacaaagcagaccgaaaatgccagccaggcaaagcagttggccgaactactacgtctttccggacctgtcatgcaacagagtcagcagcctcagccgctgcaaaaacagcctccgcaacctcaacagcagcaacgtccacaacagcagcagccgcatcatccccaaaccgaaagtgtcaattcctattctgcatctggaagtaccaatccttacatgcgcaggcctaatccagtgtctccttatcctaatagctctcacacgagtgacatttatggctctacctcaccaatgaacttttacagtacttcttcccaagccgcaggctcatatctcaacagctctaaccctatgaatccctatcccggactgctgaatcagaatactcagtatcccagctaccaatgtaatggcaatctctccgttgataattgttccccgtacctggggtcctacagtccccagtcccagccaatggatctgtatcgctacccatcccaggatccactgtctaagctgtccctcccaccaatccatactctgtaccagccaaggtttggtaatagccagtcctttacttccaaataccttggctacggcaaccagaacatgcaaggtgacgggttttcatcatgcacaataagacccaacgttcatcacgtcggtaaattgccgccatacccaacccacgaaatggatgggcacttcatgggcgcaacaagcagactccctcctaatctttcaaatccgaacatggattataaaaatggtgaacaccattcccccagccacatcatccacaattattcggcggctcccggaatgttcaattcctccttacatgcccttcacctgcagaataaagaaaatgatatgctgagtcacaccgcaaatgggttgagcaagatgctgcccgcactaaatcacgaccggactgcttgtgtacaaggcggattgcataagcttagcgatgctaatggacaggagaagcaacctttggccctggtgcagggtgtggcgtccggcgctgaggataacgacgaggtgtggtccgactctgagcagagctttcttgaccctgatattggaggggttgcggtggcgcctacccacgggagtatcctcatagaatgcgctaaacgggaactccatgccaccacccccctcaagaatcctaataggaatcaccctacacgcatttccctggtgttctaccagcacaaatccatgaatgagcccaagcacggtttggcactgtgggaagcaaagatggctgagaaagcgcgtgagaaggaggaggagtgcgagaagtatggccctgattacgtgcctcagaaatcccacggtaagaaggtaaaacgagagcccgctgaaccccatgaaactagtgaaccgacttatcttaggttcattaaatcccttgcggaaagaacaatgtccgtgaccacggactcaaccgtgacaacctcaccatacgcgtttacaagggtgactgggccatataataggtacattta

SEQ ID NO: 31089 - DNA, 615 bp, Artificial Sequence
  Description of Artificial Sequence: Synthetic coding sequence
atggtgtgtggtggatttgcctgcagcaaaaattgcctctgtgccctgaacctgctgtacactctggtgtcactgctgttgattggcattgccgcatggggcatcgggtttgggttgatctcgtccctgcgggtggtgggggtagtcatcgctgtcgggatatttctcttcctgatcgcactggtggggctaattggcgctgtcaagcaccatcaagtactcctgtttttttacatgatcatcctgctgctggtgttcatcgtgcagttctccgtgtcttgtgcctgcctggccttaaatcaggagcagcagggccaactgctggaggttggatggaataatactgcttccgcccgtaatgacattcaacgaaacctgaactgctgcgggttccgttccgtgaacccaaacgacacctgcctggcctcttgcgtaaagtctgaccattcctgcagcccatgcgccccaataatcggagaatacgccggagaggtcttgaggttcgtcggtggcattgggctgttcttcagcttcacagagatcctgggggtttggctgacttataggtaccggaaccaaaaggacccacgagccaatccatcagcttttttatag

SEQ ID NO: 31090 - DNA, 738 bp, Artificial Sequence
  Description of Artificial Sequence: Synthetic coding sequence
atggcctcaccatctcgcaggctccagaccaagccggtaatcacatgtttcaagtcagtgcttttgatatatacttttatcttttggattaccggcgtgatcctattagccgtgggaatctgggggaaagtgtccctagaaaattacttcagtctcctgaatgaaaaagcaaccaacgtgccttttgttttgatagctacgggcaccgtaataatcctccttgggacattcggttgcttcgcaacgtgtcgggcatcagcttggatgctgaagctgtacgccatgtttctcacactggtgtttcttgtggagctggtcgccgctatagtaggcttcgttttccggcacgagattaagaacagctttaagaacaactacgaaaaagctctcaaacagtataacagcacaggcgattatcgtagccatgccgtggacaagatccagaataccctgcattgttgtggggttaccgattaccgggactggacagataccaattactacagcgaaaaggggttccccaagagctgttgcaaacttgaggactgcactccccagcgggacgccgataaagttaataacgaaggttgctttattaaggtcatgacaatcattgaatctgagatgggagttgtggccggtatttcttttggcgttgcttgtttccagctgatagggatttttctcgcctactgtttatcccgcgctattaccaacaaccagtacgaaatcgtgtag

SEQ ID NO: 31091 - DNA, 684 bp, Artificial Sequence
  Description of Artificial Sequence: Synthetic coding sequence
atggcttccccctctcggagactgcagacaaaaccagtgattacttgttttaagagcgtgcttttaatttacactttcattttttggatcactggcgtgatcttgctcgctgtcgggatctggggtaaggtgagcctagaaaattactttagccttttaaacgaaaaagccacgtttgggtgtttcgcaacttgtcgcgcatcagcctggatgctcaagctgtatgcgatgttcctgactttagtttttctcgtggagctggttgctgctatcgtcgggtttgtatttcgacacgaaattaagaactcctttaaaaacaactatgagaaggccctgaagcagtataacagcacaggggattaccgctcacatgccgtggataagatacagaataccctccactgctgtggcgtaaccgactaccgtgattggactgatacaaactattattccgaaaagggctttcccaaatcgtgctgtaaattggaagattgcacgccacagcgggacgccgacaaagtgaataacgaagggtgcttcattaaagtaatgactatcattgagtcagagatgggggttgtggccggaatatctttcggggtcgcatgctttcagttgattggtatcttcctggcctattgtctgagccgcgctatcacgaacaatcaatacgagatcgtctag

SEQ ID NO: 31092 - DNA, 669 bp, Artificial Sequence
  Description of Artificial Sequence: Synthetic coding sequence
atggaaaggaagggcagcgcagccggagccaagggcaatcctagtccccctgcagcgggagaagggcagcgcccacccccaccactgtgtgtgccgggagggggaggtggggcaccagctaggggccaggttggcgcagctgcggaacctgccgagctgattaggagggctcacgaattcaagtcccagggcgcacaatgctataaggacaagaaattccgagaagccatcggcaaataccatagggcgcttttggagctgaaaggtttactgcctcccccaggtgagagggagcgcgactccagacctgcttcccccgctggagcactcaagccaggacgcctctccgaggagcagagcaagacggtggaagccattgagatagattgttacaactctctcgccgcttgtctgctccaggccgagctggtgaactacgagagggtaaaagagtattgtctgaaagtgctcaagaaagagggggagaacttcaaggctctctatcggtccggcgtggccttctatcacttaggcgactacgataaggcgctctactacctgaaggaagcccgtacacagcagcctactgatacgaacgtcatcagatatatccagctgaccgaaatgaagttatcaaggtgctctcagagagagaaggaggccatgtag

SEQ ID NO: 31093 - DNA, 258 bp, Artificial Sequence
  Description of Artificial Sequence: Synthetic coding sequence
atggtcaagcagatcgagagcaagacagccttccaggaggctctagacgctgcgggagacaagctggtcgtagtagatttttcagccacttggtgcggtccctgtaagatgatcaagccatttttccacgatgtcgcgtcagaatgtgaggttaagtgtatgccaacattccagtttttcaaaaagggacagaaagttggggaattctcgggggctaataaggaaaagttggaggcaacaataaatgagttagtgtag

SEQ ID NO: 31094 - DNA, 318 bp, Artificial Sequence
  Description of Artificial Sequence: Synthetic coding sequence
atggtcaagcagatcgagtccaagacagcattccaggaagcgctagatgcggctggcgacaagctggtggttgttgatttttccgccacttggtgtggcccttgcaaaatgatcaagccattcttccacagcctgtctgaaaagtattctaacgtgatatttttagaagttgatgtcgatgattgtcaggacgtggcatcagagtgtgaggtgaaatgcatgccgacttttcaattctttaagaagggccaaaaagtgggggaattcagcggggcaaacaaggagaagcttgaggcgaccataaacgaattagtatag

SEQ ID NO: 31095 - DNA, 1176 bp, Artificial Sequence
  Description of Artificial Sequence: Synthetic coding sequence
atggtgatgtttaaaaaaatcaaaagcttcgaggttgtattcaacgatccagaaaaggtctacggctccggagagaaggtcgctggtagggtcatcgtcgaggtctgcgaagttaccagagtgaaagccgtgagaattttagcgtgcggagttgcgaaagtattatggatgcaaggttcccaacagtgtaaacagactagcgaatatctaagatatgaggatactctgcttcttgaggaccagcctacaggggagaatgagatggttattatgaggcccggaaacaaatacgaatataaattcgggtttgagctgcctcagggcccactaggcacatctttcaaaggcaaatatggatgcgtcgactattgggtgaaagcctttctggacaggcctagccagcctactcaggagactaaaaagaactttgaggttgtggacctggtggatgtgaatactccagatttgatggctcccgtgtctgctaagaaggaaaagaaggtttcttgtatgtttatcccagacgggagggtcagcgtctcagcccgaatcgatcgaaaaggattttgtgagggagacgagatctccattcacgcggatttcgagaatacctgttccaggattgtggtcccaaaggctgccatcgtggccaggcatacatatctggcgaatggccagactaaagtcctgacgcagaagttgtcgagtgtgcgtggtaaccacatcatttctggaacttgtgcctcttggcgcggaaaaagtctgagagtgcagaagattagaccaagcatattgggatgtaatatactccgagtcgaatactccttattgatctatgtgagtgtgcctggcagcaagaaggttatcctcgatctgccattagtgatcggcagtaggtctggtctcagctcacggacctcatccatggctagccggacttcgtccgagatgtcctgggtggacttgaacatccccgatacaccggaagctcccccttgttacatggatgtaatccctgaggatcaccgtttagagagtcccacaaccccactccttgatgatatggacggaagccaggatagccccatatttatgtatgcacctgagtttaagtttatgccccctcccacctacacagaggtcgacccttgcattctcaacaacaatgtacaatag

SEQ ID NO: 31096 - DNA, 1494 bp, Artificial Sequence
  Description of Artificial Sequence: Synthetic coding sequence
atgaatggacccgaagacctccccaagagttacgattacgatctgatcatcatcgggggtgggtcgggcggattagccgcagcaaaggaggctgcacagtacggtaaaaaggtaatggtcctcgatttcgttactcctacacccttggggacccggtggggactgggagggacatgcgtaaacgtaggatgcatccccaaaaaactaatgcaccaggcagcactgctggggcaggccctgcaggactccagaaattacggctggaaggttgaggagaccgtaaaacacgactgggacaggatgattgaggccgtccagaaccatatcgggtccctcaattggggatacagggtggcccttcgggagaaaaaggtggtgtacgagaacgcgtacgggcagttcatcgggcctcacagaattaaagcaactaacaataaaggaaaggaaaagatatactctgcagagagattcttaatagctacaggcgagagaccccgttacttaggaataccaggagataaagagtattgtattagctcagacgatctcttctctcttccctattgccccggaaaaaccttagtcgtgggggcttcttatgtggccctggagtgcgccggttttttggccggtattggactggatgtgacagtcatggtccgtagcatactcctgagaggcttcgaccaggacatggccaataaaattggagagcatatggaagagcacggtatcaaattcatccgccagtttgttccaattaaagttgagcaaatcgaggcgggtacaccgggacgactccgtgtggtggcacagagcaccaattccgaagagatcattgagggcgaatacaacactgtgatgctggccatcgggcgagacgcctgcactcgaaagatcgggctggaaaccgtcggtgttaaaatcaatgaaaaaacgggaaaaatccccgtaacagatgaagagcagacgaatgttccttacatctatgccattggggatatcctggaggacaaagttgagctcacccctgtggcaatacaggccggtcgacttttggctcagagattatatgcgggatccacagtcaaatgcgactacgagaacgtgccaactacggttttcaccccgctggagtatggggcatgtgggctttccgaggaaaaggccgttgagaagttcggcgaagagaacattgaagtgtatcacagctacttctggcctctggaatggacaatcccaagccgggataataacaagtgttacgccaaaataatatgtaataccaaggataacgaacgggtggtgggctttcatgtgttagggcctaatgctggggaagtgacccaaggtttcgcggcagccctcaagtgcggtctgaccaagaagcagctcgatagcacgatcggcatccaccctgtgtgcgccgaggtatttacgacactgagtgtgactaaacgtagcggggcttctattctgcaggccggatgctag

SEQ ID NO: 31097 - DNA, 1746 bp, Artificial Sequence
  Description of Artificial Sequence: Synthetic coding sequence
atgcagcaggttatgctcacttgcaagggagtgaacagagggcacgctgtgcctgcaggcccagggcgaaagcctcgaccacgtcgctcttcacgactgctggcaggagaaaagcacctaacccgaagtgccctgctgctgtgccataccgaggacggaagggccctggaggggacactgtccgaacttgctgctgagaccgatttgcctgtagtttttgtgaagcagaggaagatcggcggtcatggcccaactcttaaggcatatcaggagggcagactgcaaaaattactaaagatgaacggccctgaggatcttcccaagtcctacgattacgacctgataattattggcggaggatctggcggactggctgctgcgaaagaggcagctcagtatggtaaaaaagtgatggtactggatttcgtgacacccacccccctgggcacaagatgggggctgggcggaacatgcgtgaacgtcgggtgtatcccgaaaaagctcatgcatcaggccgctttgctgggccaagcacttcaagattctcgtaactacggctggaaagtggaggagactgtgaagcacgattgggatcgtatgatcgaagcggtccagaaccacataggcagcctgaactggggctatagggtggcccttcgggagaagaaggtagtatatgagaacgcctatggacagttcattggtcctcatcgcatcaaggccaccaataacaaagggaaggaaaaaatttactccgctgagcgctttttgattgcgaccggagagcgacccagatacctgggcattcccggtgataaagaatattgcatttcttcggatgacctgttctcactgccgtactgccctggaaagaccctcgtcgtgggggcaagttatgtcgcactcgagtgcgcgggattcctggcagggatcggactcgacgtcaccgtgatggtgcgttcaatcctccttagagggttcgaccaggacatggctaacaaaatcggcgaacatatggaggagcacgggatcaaattcatacggcagttcgtccctatcaaagtcgagcagattgaggccggaaccccagggagactgcgtgttgtggctcagtcaacgaactcagaggagatcattgagggtgaatacaataccgtgatgctcgcaataggcagagacgcatgtactcggaagatcgggttggagaccgtcggggtcaaaattaatgaaaaaaccggcaaaatccccgtcacagatgaggagcagaccaacgtgccatacatttatgcaattggagatatactcgaagacaaagtggagctgacccctgtcgcaatccaggccggtcgcctactggctcaacggctctatgccggatcgactgtcaagtgcgactatgagaacgtgccaaccacagtgtttaccccactggagtatggagcatgtggcctgtccgaggagaaggccgttgagaaatttggcgaggaaaatatagaagtttaccattcatatttttggccactcgaatggacaattccaagtcgggacaacaacaagtgttacgcaaaaatcatctgcaacaccaaagacaatgaacgagtagtcgggttccatgtgcttgggccaaacgcgggagaggtaacccaggggttcgccgcagccttgaaatgtggtttgaccaaaaaacagttggacagcaccatcggtatccatccagtttgcgcagagttttttagcttcatctag

SEQ ID NO: 31098 - DNA, 1650 bp, Artificial Sequence
  Description of Artificial Sequence: Synthetic coding sequence
atgtcctgcgaggatggtcgtgcgctcgaaggaactttgtctgaacttgccgctgaaacggatctgcccgtggtcttcgtgaaacagcgaaagattggaggccatggccctacactcaaggcttatcaggaaggacgtcttcagaagctgctgaagatgaacggtcccgaagatctcccaaaatcctatgattacgacttgattatcatcggtgggggtagtggcggtctggcggcagctaaagaggcagcccagtatggaaagaaagtgatggtgcttgatttcgttacacctaccccactgggtacacgatggggactaggaggcacttgtgtcaacgtgggctgcataccgaaaaagctgatgcaccaggcggctctcttggggcaagcccttcaggactcgcgaaactacggctggaaggtggaggagactgttaaacatgactgggatcggatgatcgaagccgtgcaaaatcacattggaagcttgaactggggatacagagtcgctttgcgcgagaagaaagtcgtctacgaaaacgcctacggtcagtttatcggaccccatcgcatcaaagcgactaacaataaaggcaaggaaaaaatctactccgccgagcggtttctgattgcgaccggggagcgaccgagatatcttggcatcccaggcgataaagaatactgcatcagctccgacgacctcttcagtttaccttactgccctggcaaaaccctggtcgtcggcgcatcatatgtagccttagagtgtgctggctttctggctgggatcgggttggacgtcaccgtaatggtgcggtccattctattacgcggtttcgaccaagacatggccaataagatcggggaacacatggaggagcacggaatcaagttcattcggcagtttgtccctataaaggtggagcagattgaagctggtacccctgggagattgagggtcgtagcccagagcactaactccgaagagattatcgagggagagtacaacaccgtgatgcttgccattggaagggacgcctgcacgcggaaaatcggactggaaacagttggggtgaaaattaacgaaaagacaggcaagattccagtgaccgacgaagaacagactaatgtgccgtacatctacgccataggggatattttggaggataaggtcgaactcacccccgtcgccatccaggccggacgactgcttgcgcagcggctgtacgctggaagcacagtaaagtgtgattacgaaaatgtgcctaccaccgtgttcaccccattagaatatggcgcttgtggactgagcgaggagaaggccgttgaaaagtttggagaggagaacatagaagtgtatcacagttatttctggcccctggagtggacaattccaagcagagataacaacaagtgctacgcgaaaattatctgcaacacaaaagacaatgaaagagtggttggattccatgtgctcggcccaaacgccggagaagtgacacaggggtttgctgcagccctgaagtgtggacttacaaagaagcagttggattccacgattggcattcacccagtctgcgccgaggtctttacgaccttgtcagtgacaaagcggagtggcgcatctatcttgcaagctgggtgttag

SEQ ID NO: 31099 - DNA, 1626 bp, Artificial Sequence
  Description of Artificial Sequence: Synthetic coding sequence
atgctcagcagacttgtgctgaattcatgggcacaagccatcattaggcccaggcctccaaaggtactgggcctgcaagtaacaaccttctctgaagcttatcaggaggggaggttgcagaagctcctgaagatgaacgggcctgaagacttgcccaaatcctatgactacgaccttatcattatcggaggcggaagtggtgggctggctgcagccaaggaagccgcacagtatggcaaaaaagtcatggtgctggacttcgtgactcctacacccctgggaaccagatggggcctgggcggtacatgtgttaatgtcggatgtatccccaagaaactaatgcaccaagcagccctgctcggtcaggccctgcaggatagtcgcaattatgggtggaaagttgaggagactgtcaaacatgactgggacagaatgattgaggccgtgcaaaaccatattggatccctgaactggggttaccgcgtagccctgcgggaaaaaaaggtcgtttatgagaatgcttacggccagtttattgggccacaccgcatcaaggcaactaacaacaaaggcaaggagaagatctactcagccgagaggttcctgattgccaccggcgaacgacctagatacctgggcattcctggcgataaagaatattgcatctccagtgatgatctgttctcccttccctattgtcccggtaagaccttagtagtgggagctagttacgtggccttggaatgtgctgggtttttagcagggattggcctggatgttacagtgatggtcagaagtatcttgctaaggggatttgaccaggatatggctaacaagattggcgagcacatggaagaacatgggatcaagtttattcgacagtttgttcccatcaaggtagaacagatcgaggcagggacacctgggagacttcgtgtggtggcacaatccaccaatagcgaggagattatcgagggggagtataatacagtcatgctagcgatcggtagggatgcctgtactcggaagattggcctggagactgttggagttaagattaatgagaagactggtaaaataccagtgaccgatgaagagcagacaaacgtcccctacatatatgcgattggggacatcctcgaggacaaggttgagctgactccagtggccattcaggccggtcgcttacttgctcagcgtctctatgccggttctacagtgaagtgtgactatgaaaacgttccaacaaccgtattcacacccttggagtatggtgcatgtggactgtctgaggagaaggccgtggagaagttcggggaagaaaatatcgaggtgtatcacagctatttctggcccctggagtggaccataccctcaagggacaacaacaagtgctacgccaagatcatctgtaatactaaggacaacgagcgggtggtcggattccacgtcctggggccaaacgcaggtgaagtgacacaaggttttgcagctgcgctgaagtgcggccttactaagaagcagctggactcgaccattgggattcaccccgtctgcgctgaggtcttcaccacactgagcgtgacaaagagatccggcgcttctatactgcaggccggatgctag

SEQ ID NO: 31100 - DNA, 1839 bp, Artificial Sequence
  Description of Artificial Sequence: Synthetic coding sequence
atgcctgtggatgactactggttgtgcctaccagcgagctgcgctcgtcccttcgtccagaccgtgagagtcgtccagtcatgtccacattgttgctggtttccgggagtactgccaagcgttccggagccccttcgcatgcccgctatgcttccaaccgggagccattcggcagtgctcccaccctcacactgctccacagctcccccttccacaagccaggaaccgtccagttccgcggatcctaagctctgcttatcccctccaacaagcgacagccgtcaggaaaggaatgttcagtttggcctggcataccaggaggggcgactccaaaagctcctgaagatgaacggcccagaggaccttcctaaatcgtatgactacgacttgatcattatcggcggaggttcagggggtttggctgctgcaaaggaagctgcccagtatggtaagaaggttatggtgcttgattttgtgactccaacgcccctggggacaagatggggtttgggaggcacatgcgtgaatgtgggttgcatccctaagaagttgatgcaccaggcagccctcctggggcaagccttacaggacagccgaaattatgggtggaaggtggaagagactgtgaaacacgattgggacaggatgattgaggcggtgcagaatcacataggttctctgaactgggggtaccgagtggctctccgggagaagaaggtagtttacgaaaatgcttatggtcaatttattgggccacaccgcatcaaagccactaacaataagggaaaagagaagatctacagtgcagaaaggtttcttatcgcaacaggggaacgacccaggtacttaggaatccctggggacaaggagtactgcattagttcagacgatctctttagcctgccctattgtccaggaaaaacacttgttgtgggcgcatcttatgtcgccctggagtgtgcaggcttcctggcaggtatcggcctggacgtgactgtgatggtccgcagcattctgctgcgaggcttcgatcaggacatggccaataaaattggagaacacatggaggaacacggaattaaatttattcggcagtttgtgccaataaaggtggagcagatcgaggctggtacacctggccgtctaagggtggtagcccagagtacaaactccgaagaaattatcgagggtgaatacaacaccgtaatgctggccataggtagagacgcctgcactaggaaaatcggtctggagactgtcggcgtcaagatcaatgaaaagaccggcaagatcccagtgaccgacgaagaacagacaaatgttccttatatctatgctattggggacattctggaagacaaagtcgaacttactccagtcgccatacaggctgggaggctgctcgcgcagcgcttgtacgccggatcaaccgtgaagtgtgattacgagaatgtgccaacaaccgtgtttactcccttggaatacggggcttgtggcttaagtgaagagaaggccgtcgagaagttcggtgaggagaacatcgaagtctatcattcctatttctggcccctggagtggaccatccctagtagagataataacaagtgctatgcgaaaataatttgtaacacgaaggataacgaaagagtggttggctttcacgtgctgggacccaatgctggcgaggtcacacagggcttcgccgctgccctgaaatgtggcctcacaaaaaaacagctggacagcacaattggaatacacccagtttgcgccgaagtcttcacgaccctgtctgttaccaaaagatcaggtgcgagtatcctccaagccggatgctag

SEQ ID NO: 31101 - DNA, 1944 bp, Artificial Sequence
  Description of Artificial Sequence: Synthetic coding sequence
atggggtgcgcagaaggaaaggctgttgcagctgccgcaccaacagaattgcagactaaggggaagaatggtgacggtcgcaggcggtcagctaaagaccatcatcctgggaaaacactgcccgaaaatcctgcagggtttacctcgaccgccacggccgactccagagcgctacttcaagcttacatcgacggacatagcgtagtaattttctccaggtccacatgcacaaggtgtactgaggtcaaaaagctattcaagtccctatgcgtgccctatttcgttctggaattggatcagaccgaagatgggagagcgctggagggcaccctcagcgagctggcagcggaaaccgatctccccgtcgtttttgtgaagcagcgcaagataggaggacacgggccaaccctgaaagcgtaccaggaggggaggcttcagaagctgctgaagatgaacgggcctgaggatctgcctaagtcctacgactacgatcttataattattgggggaggatcagggggactagccgcagctaaggaagccgctcaatacggcaagaaggttatggtgctcgatttcgtcacccccacacctcttggaactcggtggggcttgggcggaacttgcgtcaacgttggttgcattccaaagaagctgatgcaccaggccgctttgttgggtcaggcgttgcaggattcccgaaactacggctggaaggtggaggagactgtaaaacatgattgggatcgcatgatagaagccgttcaaaaccacattggaagtctgaattggggctatagggtggccctccgcgaaaaaaaggtggtctatgaaaatgcttatgggcaattcattggccctcatcgaatcaaggctacgaacaacaagggcaaagaaaagatttatagtgccgaacgatttcttattgccactggtgaacgccctaggtacctcggaatcccaggtgacaaggaatattgcataagtagcgatgatctattctcacttccctactgccctgggaaaactttggtggtcggcgctagttatgtagccctggagtgcgccggattcttagcgggtattgggcttgacgtgactgttatggtccggagcattctcctgagggggtttgaccaggacatggccaataagatcggcgaacatatggaggagcatggcattaagtttatcagacagtttgtgcccatcaaagtggagcaaattgaggctggcactccaggaaggctaagggttgtcgcccaaagtaccaactcggaggaaattatagaaggagagtataataccgtgatgctcgcgatcgggagagatgcctgcacccgaaagatcggtctggagactgtgggggtgaaaatcaatgagaagaccggaaaaatacccgtgacagacgaagagcagacaaacgtcccatatatttatgcaatcggagacatcctggaggacaaagtggagctgacacccgtggctatccaggccggacgcttattggcccaacggctctatgctggttcaacagtgaaatgtgactatgaaaacgtgccaaccacagtgttcacccctctcgagtacggcgcttgcggtttatccgaagaaaaggcagtggagaaattcggtgaagagaatattgaggtttatcactcatatttctggccactagaatggacgataccttccagagacaataacaagtgttacgcaaagattatttgcaacacgaaagacaatgaacgagttgtgggatttcacgtccttggacccaatgcaggtgaagtcacccagggattcgcagccgcattgaagtgtggcttgaccaagaagcagcttgacagcacaatcggaatccaccccgtgtgcgctgaggttttcacgacactgagcgtgaccaaacgctctggcgcatctatcttgcaagcaggttgctag

SEQ ID NO: 31102 - DNA, 1500 bp, Artificial Sequence
  Description of Artificial Sequence: Synthetic coding sequence
atgaacggacccgaggacttgcccaagtcttatgactatgacctcatcataatcgggggtggctctgggggtctcgctgccgctaaggaagccgctcaatacgggaaaaaggtgatggtcctggattttgttacccccactcccctcggtaccagatggggccttggtggtacttgtgttaacgtcggatgtattccaaaaaagttaatgcaccaggcggcacttctgggacaagccctccaggactcccgaaactacggttggaaagtggaggagacagtgaaacatgactgggaccggatgattgaggcagtgcaaaaccacattggctctctcaattgggggtacagggtagccctgcgcgagaaaaaagtggtgtacgaaaacgcgtatggacagttcattggtccgcaccgcattaaagcaaccaacaacaagggcaaggaaaagatttactccgctgaacggttccttatagccaccggggagagacccaggtatctggggattccaggcgataaagaatattgtatcagtagtgatgatctattctcacttccctactgtccaggtaagacgctggtcgtgggcgcatcatacgtagccctggaatgtgccggttttctcgcagggatcggattggacgtgacggtgatggttagaagtatactgcttaggggtttcgaccaagatatggcaaataagattggcgaacacatggaagagcacggcatcaaatttattcggcagttcgttcccattaaagtagaacagatcgaagccggaacaccagggagactcagagtggttgctcaaagtacaaacagcgaggagatcatcgagggcgaatataatacggtcatgttagccatcgggcgagacgcttgtacccgcaaaatcggtctggagacggtgggcgtgaaaattaacgagaagacaggcaagataccagtcaccgatgaagaacagacaaacgtgccatacatctacgccattggcgatattttagaagacaaggtcgagctcaccccagtggccatacaggccggacggctcctcgctcagcgcttgtatgccggttcaacagttaagtgtgattatgaaaatgtgccaactacagtgttcacacccctcgaatatggcgcttgtgggctgtctgaggaaaaggcggtagagaaatttggagaggagaatattgaggtttatcatagctacttctggcccctggagtggaccattcccagtcgagacaacaacaagtgttacgcgaaaataatttgtaacacaaaggacaacgaacgagtcgtaggcttccacgtacttgggccaaacgccggagaagtgacccagggcttcgccgctgccctcaagtgcggtctgacgaagaagcagctggactctactatcggaattcatcctgtttgtgcagaggtatttactacactcagcgtgaccaagcggtccggcgcatccatacttcaagcaggctgcugaggatag

SEQ ID NO: 31103 - DNA, 1500 bp, Artificial Sequence
  Description of Artificial Sequence: Synthetic coding sequence
atgaacgggcctgaggacctgcctaagtcatacgactacgacttgattatcattggcggagggtcgggcggactcgcagccgcaaaggaggccgcacagtatggtaagaaagtgatggtactggacttcgttaccccaacacccctgggcacaaggtggggactgggcggaacttgtgtgaacgtgggatgtataccgaaaaagctcatgcaccaggctgccctcctggggcaggcgctgcaggattccaggaattatggatggaaagtagaggagaccgtgaaacacgattgggatcggatgatcgaagcagtgcagaatcacataggtagccttaactggggctaccgcgtcgccctgcgtgaaaagaaagtcgtctatgagaacgcatatggccagtttattggcccacacagaataaaggctacaaataacaagggcaaggaaaaaatatattccgctgagcggtttctaatcgctacgggcgaaagacctaggtatctaggcattcctggggacaaggaatattgcataagctcagacgatctcttttctttgccgtattgccctggtaaaaccttagtggtgggggcttcctacgtggcccttgagtgtgctggttttctggctggcattggattagacgtgacagtaatggtcagaagtattctacttaggggattcgatcaggatatggcaaataagatcggcgaacatatggaagagcacggaatcaagttcatacgccaatttgtacccatcaaagtagagcagattgaagcgggtacacccggaagactgagggtcgtggcccagagcaccaatagcgaggagatcatcgagggcgaatataacaccgttatgttggccattggcagagatgcctgtacacgcaagataggcctcgaaacagtaggtgtcaaaattaacgagaagacaggtaagattcctgtgacggacgaggaacagactaatgtgccatacatttacgccattggggatattctggaagataaggtagaactcactcccgtggcaattcaagccggacggttactggcccagagattgtacgctggttcaacggtgaagtgcgactacgagaatgtccctactaccgtctttactccattggaatatggtgcttgcgggctgagtgaagaaaaagccgtagagaagttcggcgaggagaacattgaggtgtaccactcttatttttggccactggagtggacgattccttctagggacaataataagtgctacgccaagattatatgcaacacgaaggataatgagcgggtggtcggatttcacgtgctgggacctaacgcaggcgaagtgactcagggatttgctgcagccttgaagtgcggacttaccaagaagcaattggacagtaccatcggcattcatcccgtctgtgctgaggtgtttacaacactgtccgtgaccaagcgctcgggcgcatctatcttgcaggctggctgcugagggtag

SEQ ID NO: 31104 - DNA, 1950 bp, Artificial Sequence
  Description of Artificial Sequence: Synthetic coding sequence
atgggctgcgccgaaggaaaggctgtggcggcagccgcacctacagagctgcagactaagggcaagaacggggacggaagacgacgatcagcgaaagaccatcatccaggtaaaaccctgccagaaaatccggctggtttcacatccaccgctaccgcggactcccgcgcactgcttcaggcttacattgatgggcacagtgtggtcatattttcccgatccacatgtacaaggtgcacggaggttaagaagctgttcaagtctctatgtgtgccatatttcgtgctggagctcgaccagactgaagacggaagagccctcgagggaacattatcagaactggcagctgaaactgacctcccagtcgtctttgttaagcagagaaagataggcggacatggacccacgctcaaggcttaccaggagggacggttacagaaattgttaaagatgaacgggcctgaggacctgccgaagtcatacgattacgatttgatcattattgggggaggtagcgggggtctggcagcagctaaagaagctgcgcagtacggaaaaaaggtcatggttctggactttgttacgcctactccacttggaacccggtggggcctcggaggaacttgtgtcaatgtgggatgcattcctaagaagctgatgcaccaggctgcgcttttaggacaggccctccaggattctaggaattacggctggaaggttgaagagaccgtaaaacacgattgggaccgaatgattgaggccgtccagaaccatatcgggagcctcaattggggataccgggttgccttacgtgaaaaaaaggtggtatacgagaatgcatacggccaattcatcggaccacataggatcaaggccacaaataacaagggcaaagagaagatctattccgccgaacgatttctgatagccacaggtgaaagaccgcgatatcttggcattcccggtgataaggagtattgtatctccagcgatgatctgtttagtctgccctactgtccagggaagacactggtcgtcggcgcatcatatgtcgcactcgaatgtgcaggcttcttagcaggcataggattggacgtcaccgttatggtgcggtccatcttgctccgtggattcgaccaggatatggctaacaagatcggggaacatatggaggaacatgggatcaaattcatcagacagtttgtccccatcaaggtggagcagatcgaggctgggactccgggacggctgcgggtggtggcacagtctaccaactctgaggagatcattgaaggtgagtacaatactgtgatgttggctatcgggagagacgcgtgcaccagaaagatcggcctggaaactgttggagtcaagatcaatgaaaagacagggaaaattccagtgacagatgaggaacagaccaacgttccgtatatatatgcaatcggcgacatactggaggacaaagttgagttgacacctgtggcaattcaggccggtcgcctgcttgcccaacgactctatgctggtagtaccgtgaagtgtgactacgaaaatgttccgacgaccgtgtttacccctctggagtacggggcttgtgggctctcagaggaaaaggctgtggaaaagttcggagaggaaaatattgaggtgtatcattcctacttttggcctctggagtggactatcccatctagggataataacaagtgctatgcgaagatcatttgtaacacaaaagacaatgagcgtgtggtggggttccacgtcctagggccaaacgctggcgaggtgacccagggctttgcggcagccctgaaatgtggtcttactaagaaacagttagattcaaccatcggtatccacccagtctgcgccgaggtcttcaccaccctatctgtgaccaaaaggagtggtgcatcaatcttacaggctggttgcugaggatag

SEQ ID NO: 31105 - DNA, 213 bp, Artificial Sequence
  Description of Artificial Sequence: Synthetic coding sequence
atgaacggtccagaagatctgcctaaatcttatgactatgacttgatcatcattggagggggttcggggggactcgctgcggctaaggaggccgcacagtacgggaaaaaagtgatggtgcttgacttcgtgacacctacaccactcggaacccgatgggggctggggggaacttgcgtgaatgtgggctgcatacctaaaaaactgatgtag

SEQ ID NO: 31106 - DNA, 1632 bp, Artificial Sequence
  Description of Artificial Sequence: Synthetic coding sequence
atgctgtcacggctggtgttgaacagttgggctcaagccatcatacgccctcggccacctaaagtgttaggtcttcaggtaacaacattctcagaggcgtaccaagagggtagattgcagaaactgttgaaaatgaacggccctgaagatctgcctaaaagctacgattatgatctcatcattatcggcggtggaagcggcggtctcgcagccgcaaaagaagccgctcagtacgggaagaaagtcatggtcctggactttgtaacacctacccctctggggactcgatggggcctgggcggaacctgcgttaatgtgggttgcattccaaaaaagcttatgcatcaggctgccttgttaggccaggcattgcaggatagccgcaattatggttggaaggtagaagagaccgtgaaacatgactgggatcgcatgatagaggcagtccagaatcatataggtagtttaaattggggctatcgagtggctctaagggaaaaaaaggtggtttatgagaatgcatacggccaattcatcgggcctcatagaataaaagccaccaacaacaagggaaaggaaaagatttacagcgccgaaaggttcctcattgctacaggagagcgcccacggtacttgggcatccctggggacaaagaatattgtatctcttccgatgacctattctcgcttccatactgtccaggtaagacactagttgtgggcgcatcctacgtggcactggagtgcgccggattcctggccggaatcggcctggacgtgactgttatggtgcgaagcatacttttgcggggatttgatcaagacatggcaaacaagattggggaacacatggaggaacatgggattaagttcatcaggcaattcgtgccaattaaagtagagcagatcgaagccggaacccctgggagactgagggtggtagcccagtctacaaattctgaggaaatcatcgagggcgaatataacaccgttatgctcgccattgggagagacgcgtgcactcgcaagatcggcctggagacagtcggcgtgaaaatcaacgagaaaacgggaaaaattcccgtgaccgatgaggagcaaacgaacgtaccctacatctacgcgatcggcgatattctggaggacaaggtggagctcacacccgtcgcgatccaggccggtaggcttctggcccagaggctctacgctggctccacagtgaagtgtgattacgaaaacgtgccaacaaccgtgttcacacctctcgagtatggggcttgcggcctttccgaggagaaagccgtggagaagtttggcgaggagaacatcgaggtgtatcactcttacttctggccgctggagtggacaatccccagtcgagacaataacaagtgctacgctaagattatatgtaacactaaagacaacgaacgcgtggttgggtttcatgtgctgggacccaatgccggtgaggtaacccaaggattcgcggctgcgctgaagtgtgggctgacgaagaaacagctagactctacaatcggaatacatcctgtttgtgctgaggtgttcacaactttgagtgttacgaagagatctggagcttccatcctgcaagcaggctgcugaggatag

SEQ ID NO: 31107 - DNA, 315 bp, Artificial Sequence
  Description of Artificial Sequence: Synthetic coding sequence
atgaacggcccagaagatctgcccaaatcgtacgactatgatctgataattatcggcggtgggtccggcggactggctgcggcaaaggaagcagcccagtatggcaaaaaagtcatggtgctggatttcgtgacaccgacaccactgggcacccgctggggactgggcggaacctgcgtcaatgtagggtgcattcccaagaaactcatgcatcaggccgcactcctcggccaggccctgcaggatagcagaaactatggatggaaagtcgaggagactgtaaagcacgactgggatagaatgattgaagcctag

SEQ ID NO: 31108 - DNA, 1656 bp, Artificial Sequence
  Description of Artificial Sequence: Synthetic coding sequence
atgtcgtgcgaagacggcagggcactcgaaggtacattaagcgagcttgcagccgagacagacctacccgtggtgttcgttaaacagcggaaaatcggcggacatgggcctacactgaaagcctatcaggaaggccgtctgcagaaactgcttaagatgaacggacccgaagatctgccaaaatcatacgattatgacttgattataattggaggtggctccgggggtctggcagccgctaaggaggcggctcagtatggcaagaaggtgatggtattagatttcgtgactcccaccccccttgggacgagatggggcttgggcggaacctgcgttaacgtgggttgcatacctaaaaagctcatgcatcaggctgctcttctggggcaggctctgcaagactctcgcaactatggatggaaagtcgaagaaacagtgaagcacgactgggatcgaatgattgaggctgtacagaaccatattgggagcctaaactgggggtacagggtggccctcagggagaagaaggttgtatatgaaaatgcttacggtcagttcattggcccacaccggataaaagcaacaaacaacaagggaaaggagaagatctatagcgcagaacggtttctcatcgccaccggagaacgaccaaggtacttgggcatcccgggagacaaagaatattgtatctcatccgacgaccttttcagcctaccctactgccctgggaagacgctcgtggtgggagcatcgtatgtcgcacttgaatgcgctggctttctcgcgggaataggattggacgtaaccgttatggtaagatccatcctgctacgaggctttgaccaggacatggcaaacaagatcggggagcacatggaggaacatggcataaagttcattagacaattcgtgcctatcaaagtcgagcagatcgaggcaggaacaccaggtaggctcagagtcgtcgctcagagcaccaacagtgaggagatcatcgagggtgagtataacactgttatgctcgcaattgggcgagacgcttgcacccgcaagattggtctggagacagtcggggtcaaaattaacgaaaagacaggaaagatccccgtgacagacgaagaacaaaccaacgtcccatatatatacgccatcggggacatcctggaggataaggtggaactgacccctgtcgctattcaggccggacggctgctcgctcagcgactttacgcaggatccacagtgaaatgcgactatgaaaacgttcccaccaccgtgttcactccactcgagtacggggcttgtggactgtcagaggagaaagctgtggagaagttcggcgaggagaatatcgaagtttaccacagctacttttggcccctagagtggaccatcccgtctagagacaataacaagtgctatgctaagatcatctgcaacacgaaagacaacgagagggtggtcggctttcacgtgcttgggccaaacgccggagaagtgacacagggatttgcagcagccctgaaatgcgggctcacgaagaaacaacttgattcaacaatcggcattcatcctgtgtgtgctgaagtcttcaccaccttgagcgttacaaaaaggagtggagcctctatcttgcaggctggatgtugaggctag

SEQ ID NO: 31109 - DNA, 1707 bp, Artificial Sequence
  Description of Artificial Sequence: Synthetic coding sequence
atgcccgctatgctgccgaccggatcccatagtgcggtactgccgccttcccactgttcgacagcacccccttctaccagccaagagccaagttcttctgccgaccccaagttatgcctcagtccgccaacaagcgactcccggcaggagcggaatgtgcagttcgggctcgcctatcaggaagggcgtcttcagaaattgctcaaaatgaacggcccagaagatctccccaagtcctatgactatgatttgatcatcattggtggaggaagcggcggtttggccgcagccaaggaggcagcccagtatggtaagaaagttatggtgctggattttgtgaccccgactcctttgggcacccgatggggtcttgggggaacatgcgttaacgtcggttgcattcctaaaaagctgatgcatcaggctgctttacttgggcaggccctgcaagactctaggaactacggatggaaagtggaggagaccgtgaaacacgactgggacaggatgatcgaagcagtgcagaatcatattggctctcttaattgggggtaccgggtggctcttagggagaagaaggtagtatatgaaaatgcgtacggccagtttattggtccccaccggattaaggccaccaacaataagggcaaagaaaagatttattccgccgagcgattccttattgcaacaggcgaacgacctcggtatcttgggatccccggagacaaagaatactgtatttcatctgacgaccttttttcgctcccttactgtcctggcaagaccctagtggtgggagcgagctacgtggcactggaatgtgcaggcttcctcgctggaattggcctggacgtaactgttatggtgcggtcaatcctcctgaggggtttcgaccaggatatggcaaacaagatcggcgaacacatggaagagcacggtatcaagttcatccgacagttcgttcctatcaaggtcgagcagattgaagcgggtacgccagggagacttcgtgttgtcgctcagtccacaaactccgaggagattatagagggggaatataacaccgttatgctggcaataggcagggacgcatgcacccgcaagattggcttagaaactgttggcgttaaaattaacgagaagaccgggaaaattcccgtgacggacgaggagcagacgaatgttccatacatctatgccatcggggatatcctggaggataaggtggagttaacgccagttgccattcaagccggtcgccttctggcacagcggctgtatgctggtagtacagtgaagtgtgactacgaaaacgtgcctacaacggtcttcacgcccttggagtatggagcctgcggcctcagtgaggagaaggctgttgagaaatttggggaagaaaatatagaagtctaccacagctatttctggcctctcgagtggacgattccaagtcgtgacaacaataaatgctatgctaaaattatctgtaatacaaaagacaatgaaagagtcgtgggcttccatgtgcttgggccaaacgctggagaagtcacgcagggtttcgccgctgccctcaagtgcgggctaactaagaagcagctggattcaacgatcggcatacaccccgtgtgcgctgaagtcttcaccaccctgtccgtgacgaaacgttctggcgcaagtatcctgcaagccggatgcugaggctag

SEQ ID NO: 31110 - DNA, 528 bp, Artificial Sequence
  Description of Artificial Sequence: Synthetic coding sequence
atgaacggacccgaagacctgccgaaatcctatgattatgatctgatcatcatcggagggggaagtggcggactagctgcagcgaaggaggccgcacaatacggtaaaaaggtgatggtacttgattttgtaactcccacacccctcggcacgcgctggggactggggggaacctgtgtgaacgtggggtgtatccctaaaaaattgatgcaccaggctgcgcttttaggccaggcccttcaggatagtcgaaattatgggtggaaagtcgaagaaacagtaaaacatgactgggacagaatgatcgaggcagtgcagaatcatatcggatccctaaattggggatacagggttgccttgcgggagaaaaaagttgtatacgaaaatgcctacggtcaattcattggtcctcaccgcattaaagcgaccaataataaaggcaaggaaaagatttactccgccgaaaggttcttaattgcgactggcgaacgtcctaggtacctcggcatccctggcgacaaggagtag

SEQ ID NO: 31111 - DNA, 162 bp, Artificial Sequence
  Description of Artificial Sequence: Synthetic coding sequence
atgaacggaccagaagacctgcctaagtcctacgattatgaccttattattattggcggtggaagtgggggactcgccgctgctaaggaggccgctcagtatggcaaaaaagtcatggtcctggacttcgtcactcctacccctttaggcacacgctggtag

SEQ ID NO: 31112 - DNA, 219 bp, Artificial Sequence
  Description of Artificial Sequence: Synthetic coding sequence
atgaacggccctgaggatctgccaaaatcttacgattatgacctcataatcattggtgggggatctggcggacttgcagcggctaaggaggccgctcagtacggtaaaaaggtgatggtgcttgattttgtgacacccacaccactgggtacccgctggggactgggtggtacctgcgtgaatgtgggatgtatcccaaagaagctcatgcatcaatag

SEQ ID NO: 31113 - DNA, 420 bp, Artificial Sequence
  Description of Artificial Sequence: Synthetic coding sequence
atgctgtctcgccttgttcttaactcctgggcccaggccattataaggcccaggccacccaaggttctgggtctccaagttactaccttctcggaggcgtaccaagaaggtcgactccaaaagctgctgaaaatgaatggccctgaagacctgcccaagtcatacgactacgacttgattatcataggtgggggatcaggaggtctagccgctgccaaggaggccgcacagtatgggaagaaagtaatggttctcgatttcgtcacccctacaccattgggtactagatggggccttggtggaacctgcgttaacgtcgggtgcattcccaaaaaattaatgcatcaggctgcgctccttggacaagcacttcaagactccaggaattatggatggaaagtggaggagaccggaatgtag

SEQ ID NO: 31114 - DNA, 1380 bp, Artificial Sequence
  Description of Artificial Sequence: Synthetic coding sequence
atggtcctagatttcgtgaccccaaccccgctggggacccggtggggcctgggtgggacttgcgtgaatgtaggttgtatacctaagaaactcatgcaccaggctgcattgctgggccaggcactacaggactctagaaattatggctggaaggtggaggagaccgtgaaacatgattgggaccggatgatcgaggcagtgcaaaaccatatcgggtctctgaactggggttatcgggtggcgctgcgggagaaaaaagtcgtatacgagaacgcctatgggcagttcattgggcctcacaggatcaaggccacgaataacaaaggaaaggagaagatatatagcgctgaacgctttctaatcgcaacaggcgaacggcctcggtacctgggcattcctggcgacaaggaatactgtatatcctctgacgacctcttctctctgccgtactgtccgggaaaaaccttggtggttggagcttcctatgtcgcactcgaatgtgccggattccttgcagggatagggctcgacgtcacagtgatggttagatcgatcctcctgcgaggatttgaccaggatatggcgaacaaaattggagagcacatggaggagcacgggatcaaatttatacgccagttcgtccccattaaagttgagcagatcgaagcgggtactcctggtagactgcgagttgtggctcagtctacgaacagcgaagaaattatcgaaggcgagtacaacacagtcatgctggctatcggcagggatgcatgtacacggaaaatcgggttggagaccgtcggcgtgaaaattaacgagaagaccgggaagattcccgtgacagacgaggaacagaccaacgttccctacatttatgcgatcggtgacattcttgaagataaagtcgagctcacgcccgtcgcgattcaggcgggtcgcctgctagctcagcggctctacgcgggaagcactgttaagtgtgattacgagaacgtgcctacaactgttttcaccccacttgagtacggcgcttgtgggcttagcgaggaaaaggccgtggagaaattcggggaagaaaacattgaggtgtaccattcctatttttggcccctcgaatggacaatcccctcgagggataacaacaagtgctacgccaaaatcatctgtaacactaaagacaacgagagagtagttggctttcacgtgttgggaccgaatgcgggtgaggtgacacaaggattcgctgccgcactgaaatgcgggcttacgaagaaacagcttgatagtaccattgggattcatccagtgtgcgcagaagtgttcacgactttgtcagtgaccaaacgatccggcgcatctattctgcaggccggatgttag

SEQ ID NO: 31115 - DNA, 1644 bp, Artificial Sequence
  Description of Artificial Sequence: Synthetic coding sequence
atggaagacggcagagcactagaaggcaccctgtcagagctcgctgccgagactgacctgcccgtggtttttgtcaaacaaaggaagatcggcggacatgggccaacactgaaggcctaccaagagggtaggttacagaagctgcttaaaatgaacggacccgaggacctgcctaagtcctatgactatgatctgattatcatcggcggagggagtgggggtctagccgctgccaaagaggcagctcaatatgggaagaaagtgatggttctggattttgtgactcctacacctctcgggactaggtggggtctgggcggtacctgcgtgaatgtgggctgcattccaaaaaagcttatgcatcaggccgcactgctcggccaagctctacaggattctcgaaactatggctggaaagtcgaggagaccgtgaagcatgattgggataggatgattgaggcggtgcagaaccatatcggctcactgaattggggttatcgggtggccctgcgtgagaagaaagtcgtatatgaaaacgcgtacggccagtttattgggcctcaccgcattaaggcaactaataacaagggtaaagagaaaatttacagtgctgagcgcttcctcattgcaactggtgaacggccacgctatttaggaattcccggtgacaaggaatattgtatctcttccgacgacctattcagtctcccctactgccccggaaagacgttagtcgtgggcgcttcctatgtagctctggagtgcgcagggttccttgcaggtatcggtttagacgttaccgttatggtgcggagcatcctgcttcgaggttttgatcaggatatggcgaataaaatcggcgagcacatggaggagcacgggattaagttcatcaggcaatttgtgccaataaaagtggaacaaattgaagccggaacccccggtagactacgtgtcgtggctcagtccactaacagcgaggagattatagaaggcgagtacaatacggtcatgcttgctatcggcagggacgcttgcactcgtaaaatcggtctagagaccgttggcgttaagattaacgagaagacaggcaaaatacccgttacggacgaggagcagactaatgtaccctacatttacgctattggagatatccttgaggataaggttgagcttacccccgtggccatacaagccggacggctgctggcgcagcgactgtacgccggttccaccgtaaagtgtgactacgaaaatgtcccaaccactgttttcacccccctcgagtacggggcatgcgggctgagtgaggagaaggccgtcgaaaagtttggggaagagaatatagaggtctaccatagttacttttggccactcgaatggacaattccttcacgggacaataacaagtgttacgctaagattatttgtaacactaaggataacgagcgagttgtcggctttcatgtgttggggccaaacgcgggtgaagtgacccaaggattcgccgctgccctaaagtgcgggttgactaaaaaacagttggactccactattggcatacatccagtctgcgctgaagtttttacaactctctctgttaccaaaaggagcggagccagtattctgcaggccggatgctag

SEQ ID NO: 31116 - DNA, 945 bp, Artificial Sequence
  Description of Artificial Sequence: Synthetic coding sequence
atgggatcccaggcactgcctcccggtccaatgcagacgctgatcttctttgacatggaggcaaccggactcccattcagccagcccaaagtgaccgaattatgtcttctggccgtgcatcgatgtgccctggagagcccgccaacttcccagggaccgcctcccacagtacccccaccacctcgcgtggtagacaaactgagtctttgcgtagctcccggtaaggcctgctctccagcggcttcagagatcactgggctttccaccgccgtgctcgccgcacatggcaggcagtgtttcgatgataaccttgctaatctgttgttggctttcctgagacgtcagccacagccgtggtgccttgtggctcacaatggcgataggtacgattttcctctgctgcaagcagagctagccatgctcggcctcaccagcgctctcgatggcgcattctgcgtggacagtatcactgcccttaaggcccttgaacgtgccagttcgcccagtgaacacggccctcgcaagtcctactctttaggttccatatatacacgcctttacggtcaatctccgccagacagtcacaccgccgagggagacgtgctcgcactactctccatttgccagtggcgccctcaggctttgttacgatgggtggatgcccacgccaggcctttcggaactatccgaccaatgtatggtgtgacagcaagtgccaggaccaaaccaaggccaagcgcggtcacgaccaccgcccacttagctaccactcgcaacacatcccccagccttggtgaatcaagaggtacaaaggatctgcccccagtgaaggaccctggagctctctctagggaagggctgctggcacctctggggctcctcgcgatcctgacccttgcagtggccaccctgtatgggttatcattggctacacctggcgaatag

SEQ ID NO: 31117 - DNA, 1110 bp, Artificial Sequence
  Description of Artificial Sequence: Synthetic coding sequence
atgggtcctggagccaggaggcagggtcgaatcgtgcagggtaggcctgagatgtgtttttgtccacccccaaccccacttccgcctctgaggattctcacattaggcacccacactcctacgccctgtagttctccaggctctgctgctgggacctaccctactatgggctcccaagctctgcccccaggacctatgcagactcttatctttttcgatatggaggccactggactgcctttttcccagcctaaggtgaccgagttgtgtctcctggcggtccaccggtgtgctttggagtcacccccaacaagccagggacctccacctactgtgccgcctcctccacgggtagtcgacaaactgagtttatgtgtagctcccggtaaggcttgctcgccagctgccagcgaaattactggcctgtcgactgctgtgctggccgctcacggccgtcaatgtttcgatgataatctcgctaatctgctgctggcctttctcagacggcagccgcaaccctggtgcctggtggcccacaacggagacaggtatgatttccccttgcttcaggctgagctcgcaatgcttggcttaacttccgccctggacggcgctttctgcgtcgacagtattactgcactgaaggcgctggaacgtgccagtagtcccagcgaacacggcccacgtaaaagttactcactggggagtatatacaccagactttatggtcagagcccaccagacagccatactgcagaaggcgatgtgctcgcactcctgtcaatctgtcagtggagacctcaggccctcctaagatgggttgatgcccatgctcgaccattcggcactatcaggcccatgtacggcgtgacagcttcagctaggacaaagccacgcccttctgctgtgactaccactgcccacctggctaccacccgtaacacatctccatctctgggcgagtcccggggaactaaagatctgccacccgtcaaggaccccggagctctctctagagaaggacttcttgctcccctggggctgctggccatcctgaccctggcagtggcgaccttatatggcctctcattggcaacaccaggagagtag

SEQ ID NO: 31118 - DNA, 528 bp, Artificial Sequence
  Description of Artificial Sequence: Synthetic coding sequence
atgttgggtctcaccagtgccctcgatggagcattttgtgtggattctatcaccgcccttaaagctcttgagagagccagtagccccagcgagcacggacccaggaaatcttatagtttgggatctatatacacccggctttatggccagtccccaccagattctcatactgcagagggagacgttctcgctctgctgagtatttgccagtggagacctcaggccctgctgcgctgggtcgatgcgcacgctagaccgttcgggactatccgacccatgtatggggtcacagcaagcgcaagaacaaagcctcgcccttctgcagttactactactgcccacttagccacaactcgaaatacaagcccatcactgggtgagtcaaggggcactaaagacctgccgccagtaaaggatcccggagcactctcaagagagggcctactggccccactgggactacttgccattctgacgcttgctgttgctacactctacggtttgtcccttgctacgccaggcgagtag

SEQ ID NO: 31119 - DNA, 945 bp, Artificial Sequence
  Description of Artificial Sequence: Synthetic coding sequence
atgggttctcaagcattgccacccggacctatgcagaccctaatatttttcgatatggaggccacaggattgccgttctcacagcccaaggtaacagagctctgcctccttgccgtacacagatgtgccctggaaagcccgcctacaagccaaggaccaccccctaccgtgcctccccctcctagggttgttgataagttatccctctgtgtagcccctggcaaagcctgttcacccgcagcaagtgagataactgggttaagtacagctgtgttggccgctcacggcaggcaatgttttgacgacaacctggctaatctgctgcttgccttcctgcgaagacagccacaaccatggtgtctggtagctcataacggcgatcggtacgattttccgctgctccaggctgagttagcaatgcttggtctgaccagtgccctcgatggcgcattttgcgttgacagtatcaccgccttaaaggcgctcgagcgggcatccagtccatctgaacatggacccagaaaatcctactcgttgggcagtatttacacacgtctgtacggacagtccccacccgactcccacactgccgagggagatgtgctggcgctgctgtctatttgtcagtggaggcctcaggctttgctccgatgggtcgatgcccatgcacgcccttttgggacaataaggccgatgtatggtgtgactgcatcggctaggaccaagcctagaccgtcggcggtcaccacgacagcgcacctggcaaccacccgaaacacctccccctctttgggggagtctcggggtacaaaggacctcccgccagtgaaggatccaggcgctctaagcagagagggtctgctggcgcctctgggcctgctggccatcctaacgctggcggttgctacactgtatggcctgtcactcgccaccccaggtgagtag

SEQ ID NO: 31120 - DNA, 915 bp, Artificial Sequence
  Description of Artificial Sequence: Synthetic coding sequence
atgcaaactcttatctttttcgacatggaagcaacaggactgcccttctcccagccaaaggtgactgagctgtgtctgcttgccgtccaccgctgcgcgcttgagagcccgcctaccagtcaggggccacccccaacggtccctccacccccaagagttgttgataaactgagcctgtgtgtcgcaccaggaaaggcatgctcaccagccgctagcgaaattactggcctgtccaccgctgtgctggccgctcatggaaggcagtgtttcgacgataatttagccaatctactgctcgccttcctcaggaggcagccgcagccatggtgcctggtggcacacaacggagatcgctacgattttccgctcctgcaggcggaactggcaatgttgggcctgacctccgcactggacggcgctttttgtgtggacagtatcacagccctgaaagccctggagcgggcaagtagtcccagtgaacacggaccaagaaagtcctatagcctgggatccatttatactcgcttgtacggccagagtcctcctgattcgcataccgccgagggcgacgttctcgccctactgtctatttgccagtggcgtccccaggcactgctgcggtgggtggacgcccatgcaagaccctttggcacaatccggccaatgtacggcgtgaccgctagtgcaaggacgaagccacgacctagtgcggtgaccaccaccgctcacctggcaaccactcgaaacacgagcccgtcgctgggggaatcacggggaacaaaggacttgccacccgtgaaggaccccggagccctttcccgagagggactgctcgcgccactgggcctgctggccatcctgacactggccgtggcaacactgtacggtttatcccttgctacccccggagagtag

SEQ ID NO: 31121 - DNA, 528 bp, Artificial Sequence
  Description of Artificial Sequence: Synthetic coding sequence
atgctgggattgacctcggctcttgacggagccttttgcgtcgacagcatcaccgctctgaaggccctggagagagccagtagcccctcagagcacggacccagaaagagttattccctcgggtcgatctatacgcggctgtacggccaaagcccccctgacagtcacaccgccgagggcgatgtcctggctctactgtccatttgtcagtggcgccctcaggcactgttacggtgggttgacgcgcacgccaggccgtttggcaccatccgtcctatgtatggcgtcaccgctagcgcccgaactaagcccagaccatcagcggttacaacgacagcccatttagcaactactagaaacacctcccctagcctgggggagtccaggggaaccaaagacctgccaccagttaaggaccccggagcattaagccgcgagggcctcctggctcccctggggctgctcgcaattttgactctggccgtcgctaccctctatggcttaagtttggccacacccggtgagtag

SEQ ID NO: 31122 - DNA, 3513 bp, Artificial Sequence
  Description of Artificial Sequence: Synthetic coding sequence
atgggcctggcgtgggggctcggtgtattgtttctcatgcacgtctgcggtaccaaccggattcccgagtccggcggagacaactctgtatttgacatatttgagctcaccggggctgcgaggaagggcagtggaaggcgactggtcaagggcccagatcccagttcccctgcgtttagaatcgaggacgctaacctgatcccccctgtccctgatgataaatttcaggacctggtggacgctgtgagagccgagaagggttttttgctgctcgccagcctacggcagatgaagaagaccagaggcacactgctagcgctggagagaaaagaccactctggacaggtgttttctgtggttagcaacgggaaggccggaacactggatctgagtctcaccgttcaaggaaaacagcacgtagttagcgtcgaggaagccctgctggccaccggacagtggaagtctatcacattatttgtgcaggaagaccgggcacagctctacatcgactgcgagaaaatggagaacgctgaactcgatgtcccaatccaatctgtattcacaagagacctggctagtatagccaggttaagaatagcaaagggtggagttaatgataactttcagggcgtactgcaaaacgtgcggttcgtgttcgggacgaccccagaagatattcttaggaataaagggtgcagctcatctacctcagtacttttgacactggataataacgtggtgaacggtagctcccctgctatacgcacaaactacattggtcataagactaaagatctgcaggccatatgtggcatttcttgcgatgagctatcctctatggtcctggagttgaggggactacgcaccattgttaccaccctacaggactccatccggaaagtgacagaggaaaataaagaactggccaatgagctacggaggcccccactgtgctaccacaacggggtccagtaccgcaacaatgaagaatggaccgtcgacagttgcacggagtgtcactgccagaatagtgtgacgatctgcaaaaaagtgagctgccctattatgccatgttccaacgctactgtgcctgacggtgagtgctgccctaggtgttggccgtcagacagcgccgatgacggttggtctccctggtccgagtggactagctgctcgacaagctgtggtaatggtatccagcagaggggccgtagctgtgatagccttaataataggtgcgaggggtcctctgtccagaccaggacatgtcacatccaggagtgcgataaacgatttaaacaggatgggggttggtcacattggtccccatggtcctcttgttctgtaacttgcggcgatggggtgatcaccagaatcagactatgtaactcaccgtccccccagatgaatgggaaaccctgcgagggcgaggcaagggaaacaaaagcctgcaaaaaggacgcctgtcctattaacggtggctggggtccctggagcccctgggatatctgcagtgtgacatgcggagggggtgtgcagaaacgaagccggctatgtaacaatccaacacctcagtttggcggtaaggactgtgtgggcgacgtcactgaaaaccagatctgtaacaagcaggactgtcccattgacggctgtctaagtaacccttgctttgccggtgtaaagtgcacaagttaccccgacggatcatggaagtgcggcgcttgcccgcctgggtatagtggaaatggaatccagtgtacggatgttgacgagtgtaaggaggtgccagacgcatgtttcaatcacaatggcgaacatcgctgtgagaatactgacccaggctacaattgtcttccctgtcctcccagatttaccgggtctcaaccctttgggcaaggcgttgagcacgccaccgccaacaaacaagtgtgcaaacccaggaatccctgcaccgatgggactcatgactgtaataaaaacgcaaaatgcaactacttggggcactacagtgatcctatgtaccgctgtgaatgcaaacccggatatgcaggcaatggaattatttgtggagaggatactgatctcgacggctggcctaacgaaaatttagtgtgcgtcgctaatgccacgtaccattgcaagaaagacaactgtcctaatctacctaactcgggacaggaagattacgataaagacggaatcggcgacgcgtgcgacgacgacgatgataacgacaaaattcccgacgatcgggacaattgtccttttcactacaacccagcacagtacgactacgacagagacgatgtaggagaccggtgtgataactgtccttataatcacaaccccgatcaggcggacaccgataataacggagaaggagatgcttgtgccgctgacattgacggggacggcatcctgaacgaaagggacaactgtcaatacgtctacaacgtggatcagagggacaccgatatggacggggtcggggatcagtgtgataactgcccattggagcacaatcctgatcagctggacagtgactctgaccgcattggcgatacgtgcgacaacaaccaggacattgacgaggacggtcatcagaacaacctagataactgtccttacgttccgaacgctaatcaagcagaccacgacaaggacggtaaaggggatgcctgtgatcatgatgatgataatgatggcatacccgatgacaaggataactgtagactggtgccgaaccccgaccaaaaggattcagatggcgacgggagaggggacgcatgtaaagacgatttcgatcatgacagcgttccagacattgatgacatctgtccggagaatgtcgatatctctgagactgacttccgtagattccagatgattccgctggatccaaaaggtaccagtcagaacgatcccaactgggttgtgagacatcagggcaaagagctggtacaaaccgtcaactgtgaccctgggctggcagtgggctacgatgaattcaatgcagtggatttcagcggcacattcttcatcaatactgagagagatgacgattacgcaggattcgtgtttggctaccagtcatcatccaggttttatgttgttatgtggaagcaggtcactcagtcctattgggacacaaatccgacacgggctcagggatacagcggactgtcagtgaaggtggtcaattctaccaccggcccaggcgagcacctgcggaacgcactgtggcacaccggtaacactcccggacaagttcgcaccctttggcacgatcctaggcatatcggttggaaggactttactgcttaccgctggagactcagccacagacctaagaccgggtttatccgcgttgtcatgtatgaggggaaaaagatcatggcggatagtggtcccatttacgacaaaacttatgcaggcggacgtttgggcttatttgtgttcagccaggaaatggtgtttttttctgacttgaaatatgaatgtcgagatccctag

SEQ ID NO: 31123 - DNA, 285 bp, Artificial Sequence
  Description of Artificial Sequence: Synthetic coding sequence
atgggactggcttggggattgggcgtcttgtttctgatgcacgtctgcggcacgaaccgtattccagagtcagggggagataacagtgtcttcgacatcttcgagctcactggtgctgcgagaaagggatccggtagaagactcgtaaagggcccagacccctcaagtcccgcatttcggatagaggacgccaacctgattcccccagttcccgatgataaattccaggatctggtggacgccgtgcgggcagagaaaggatttcttttgcttgcaagtctgtag

SEQ ID NO: 31124 - DNA, 501 bp, Artificial Sequence
  Description of Artificial Sequence: Synthetic coding sequence
atggccgcaggcaatgtcgttttggtgcccctggtgacagttgagatggcctcttctgctcaaatgctgatgtccgccaagaagtgtctgatgcccgctagcaccaccatggagtcgaccggagttcggacccggacacctgccaccacagcctgccccgcacctcatgcttcccctgctcacagcccgtctgctagggtatcaaatatgcccaggccaactaaccgctgtgcttcccctattccactgtgcctgtgccatagggctgggtgctattgcgaggccatcagcgagcagtggacacaaaagcattttcaagcttgccaacgccgtgaggattccttggagcttgccaataaaactaccttaaccagctccttccggaatactggctcacggggacagagcacgaaggggagggctcataccagagatgattgcatgaaaaagatctggcgtaattgttacatgttcggcactaagagcttcagtggcgattag

SEQ ID NO: 31125 - DNA, 3519 bp, Artificial Sequence
  Description of Artificial Sequence: Synthetic coding sequence
atggtctggcgtctcgtcctcctggccctatgggtgtggcccagcacgcaagccggtcatcaggacaaggatacaacatttgatcttttctccatttctaacataaacaggaagacgattggagccaagcagtttcggggacccgatcctggagtccctgcttacaggttcgtgcggtttgactacatcccacccgtgaacgctgacgacctttcaaagatcactaagattatgagacagaaagaagggttctttcttacagcccagcttaagcaggatggaaaaagtagaggcaccctgctggcattggagggccctggcctgagtcagcggcaatttgaaattgtctctaatgggcctgctgacaccctcgaccttacctattggattgatgggacgcgccacgttgttagtttggaagatgtcgggttggctgactcgcagtggaaaaatgttacggtgcaggtggcaggcgaaacctactctttacatgtgggatgcgacctgattgattcctttgctctcgatgaacctttctacgaacacttgcaggctgaaaagtccaggatgtacgtggcaaaaggaagcgccagggagtctcacttccgcggtttgttacagaatgtgcatctggtatttgagaactcggtagaggacattcttagcaaaaaggggtgccagcaggggcagggggctgaaataaatgcaatctccgagaacactgagactctaagactgggcccacatgttaccacagaatatgtggggccatcaagcgagaggcggccagaggtgtgcgaacgatcgtgcgaagaactcggtaacatggtgcaagagctctctggactccacgtactcgtgaaccagctgagcgaaaatctgaagcgagtctccaacgacaatcagtttctgtgggaacttattggaggcccaccaaaaacgagaaacatgagcgcttgttggcaggatggtaggttcttcgcagaaaacgaaacatgggtggtggacagctgcacgacctgcacttgtaagaagttcaagaccatctgtcatcaaattacatgcccccctgccacatgcgcttcccccagctttgtcgaaggagagtgctgcccgtcttgcctgcactcggtagacggcgaagaaggatggtcaccatgggctgagtggacacagtgttctgtcacttgtgggtcgggtacccagcagcggggaagaagctgcgacgtcactagcaacacatgcttaggcccttctatacagactcgtgcctgtagtctgagtaaatgcgacaccaggatcagacaggacggaggttggtcccattggagcccatggtcctcctgtagcgtcacttgtggggtcgggaatatcacaaggatcagactgtgcaattcacccgtgcctcagatgggcggaaagaattgcaaaggaagcgggcgagagaccaaggcatgccagggcgctccctgtccaatcgatggtcggtggtctccatggagtccctggtcagcctgtactgttacttgtgctggcggaatcagagaacgtacccgagtctgcaatagccccgagccccagtatgggggaaaagcctgtgtgggggatgtgcaggagcggcagatgtgtaacaaaagaagctgcccggtggatggttgtctcagcaacccttgctttcccggagcccagtgctccagcttccccgatggctcttggagctgcggctcctgtccggtcggctttttgggcaatggcacccattgcgaggacttggacgagtgcgctctggttccagatatttgcttctcaacgtctaaggtccctcgatgtgttaacactcaacctggattccactgcctgccatgcccccctcgatataggggtaaccagcctgtgggcgtagggctcgaagctgccaagactgaaaagcaggtctgtgagcctgaaaacccttgtaaggacaaaacacacaactgtcacaaacacgccgaatgtatttacttgggacatttctcagacccaatgtataagtgtgaatgccaaactgggtacgccggagacggcttgatttgtggagaggattctgatctggacggctggcccaatctcaatctggtgtgtgcaacaaacgctacatatcactgcatcaaagataactgcccccacttgcctaactctggccaagaggatttcgataaagacggcatcggagatgcctgtgacgatgatgatgataacgatggagtcactgatgaaaaggataattgccaactgttattcaacccgaggcaggccgattacgacaaggacgaagtgggagataggtgcgataattgtccctacgtgcacaaccccgctcagattgacacagacaacaatggtgagggcgacgcgtgttctgtggatatcgacggcgacgatgtcttcaacgaaagggataactgtccgtatgtgtacaacaccgaccagagggatacagacggcgatggggtgggggatcattgtgataattgtcccctggtgcacaatcctgatcagacagatgtggataatgatctggtaggtgaccagtgtgacaacaatgaagatatagatgatgatggccatcagaataaccaggataattgtccttatatcagtaacgcaaaccaggcggaccacgaccgcgatggtcagggcgatgcgtgtgaccctgacgatgataacgatggagtaccagacgacagagacaattgccgcctcgtgtttaatcccgatcaggaggatttggacggagatggacggggagatatctgtaaggacgactttgacaatgataatatccctgatatcgacgatgtttgccccgagaacaacgccataagcgaaactgacttccgcaatttccaaatggttccactggatccaaaagggactactcagatcgatcccaattgggttatccggcaccaaggtaaggagctcgtccagactgccaatagcgaccctgggatcgccgtcgggttcgatgaattcgggtctgtagatttcagcggcacattctacgtcaatacagacagagatgacgactacgctgggtttgtctttggttatcagagctcgtcccgtttctacgtggtcatgtggaaacaggtgacgcagacatattgggaggaccagcccaccagagcctacggttactccggtgtcagtctcaaggtggtcaatagcaccacgggcaccggcgaacacctgaggaatgcgctgtggcacactggaaataccccgggacaggtacgtacactctggcacgatcctagaaacatcggttggaaagattatactgcataccgctggcacttgacccatagacctaaaaccgggtacatccgagttctcgttcacgaaggaaagcaggtaatggccgattcaggacctatatatgaccagacctatgccggtgggcgtttaggcctgttcgttttcagccaggagatggtgtacttttctgacttgaagtacgaatgcagagacatctag

SEQ ID NO: 31126 - DNA, 1293 bp, Artificial Sequence
  Description of Artificial Sequence: Synthetic coding sequence
gatgatgataacgacggcgttacggacgaaaaagataattgccagttgctgttcaatcccagacaagctgactacgacaaagatgaggtgggagacaggtgcgataactgtccatacgtgcacaacccagcccaaattgacacggacaacaacggagaaggggacgcctgtagcgttgatatcgatggcgatgacgttttcaacgaaagggacaattgcccgtacgtatacaatactgatcagagagataccgacggggatggggtcggcgatcactgtgacaactgcccactagtacataatcccgaccaaactgatgtggacaatgatttagttggcgatcaatgtgacaacaacgaggatatcgacgatgacggccatcagaacaatcaagacaactgcccgtatatttccaacgctaatcaggccgaccacgatcgggacggccaaggtgatgcttgtgatcccgacgacgacaacgatggggtgcctgacgatagggacaactgtagattggtgtttaaccctgaccaagaagatctggacggagatggcaggggtgacatttgtaaggatgattttgataatgataatatccctgatatcgatgatgtctgccctgagaacaatgctatctccgaaaccgatttccgaaacttccagatggtgcccttggaccctaaaggcaccactcagattgatcctaactgggtcattagacatcagggaaaggaactggtgcagaccgccaattctgatcctggaatagctgttggttttgatgagtttggctcggtggatttttccggcacattttatgttaatactgaccgtgatgacgactatgccggttttgttttcggctaccagtcctcatcacgattctatgtcgtgatgtggaaacaggttactcagacatactgggaggatcagcctactagagcctacgggtactcaggcgtaagcctcaaggtggttaactctacgactgggaccggggaacacttaagaaacgctctgtggcacactggcaacaccccgggacaggtcagaacactgtggcacgatccaaggaacatcggatggaaggactatacagcgtaccgatggcaccttactcacaggcctaagaccgggtatattcgggttctggtgcatgaaggcaagcaggtcatggccgattcaggtcccatctatgatcagacctacgctggaggcaggttggggttattcgtcttctcccaggagatggtatactttagcgacctgaaatatgaatgtcgggttatttag

SEQ ID NO: 31127 - DNA, 252 bp, Artificial Sequence
  Description of Artificial Sequence: Synthetic coding sequence
atggtgtggagattggtccttctggccctttgggtctggccctcgacccaagccggacaccaggacaaagataccacctttgacttgtttagtatcagtaatataaaccggaagaccatcggagcgaaacagtttaggggcccagaccctggcgtgcctgcttacagattcgtgaggttcgattacatacccccagtgaacgccgatgacttgtccaaaatcacaaagatcatgagacagaaggaaggatag

SEQ ID NO: 31128 - DNA, 1449 bp, Artificial Sequence
  Description of Artificial Sequence: Synthetic coding sequence
atggccgcactgatgacacccggaaccggcgctcctcccgcaccaggtgactttagcggtgaaggcagtcagggcctccccgatccatctccggagccaaaacaactccctgaattaatcagaatgaaacgtgacgggggtcggctgagcgaggcagatatccgtggatttgtggcggcagtcgtgaacggttctgctcaaggcgctcagataggggcaatgctcatggctatcaggctgaggggtatggacctggaagaaacttctgtgctgactcaggctctcgcacagagtggacaacagttggaatggcctgaggcctggagacagcaactcgtagacaaacatagcacaggtggcgtgggggacaaagtgtcgctcgtactcgcaccagctctcgctgcatgcggctgtaaagtgccaatgatatctggccgaggcctcgggcacacaggcggaaccctggacaagctagagtccatccccggtttcaatgtaatccagagccccgagcaaatgcaggtcctccttgaccaagctggctgttgcatcgtcggccagtcagaacagctcgttccagccgacgggattctatacgcagctagggacgttaccgcaaccgtggattctcttcccctcattaccgcaagcatcctgtctaagaaactggtcgaggggctctcagccctggtggtcgacgtgaaattcggaggagcggcagtgttccccaatcaagaacaagctcgtgaattggcgaagacgctggtgggcgttggcgctagcctgggcctgcgcgtggctgcggcactgacagccatggataagcccctgggtaggtgtgtgggccatgcactcgaggttgaagaggcattactgtgtatggatggcgcaggtccgccagacctgagagacctagtgaccactctaggcggagcactcctttggctgtccggccacgcaggcacgcaagctcaaggcgctgcgagggtggcagctgcactggacgacggcagtgctctgggccgttttgagagaatgttagccgcacagggagtggaccctggcctggctcgggctctttgtagtggtagtcccgctgagagacggcaactcctcccaagagctcgcgaacaagaggaactgttggcccctgcagatggcaccgtggagctggttcgggctctgcccctggctctggtccttcacgagctgggagctgggagatcaagggccggagaacctttgcgactgggagtcggagccgagctcctggtggacgttggacaaagactgcggaggggcaccccgtggctgcgcgttcaccgtgatggccctgcattgtctgggccacagtcgagggccctccaggaggctctggtactgtccgaccgggcacccttcgccgcacccagccccttcgcagagttagttctgccaccccagcaatag

SEQ ID NO: 31129 - DNA, 1449 bp, Artificial Sequence
  Description of Artificial Sequence: Synthetic coding sequence
atggccgcactgatgactccgggtacaggagctccgccagctcccggagacttctccggagaaggcagccagggactgcctgatccctccccggagcccaagcaactgcccgagctgataaggatgaagcgggatggtggcaggctgagcgaggctgatatcagagggtttgtagccgcagtggttaatgggtcggcgcaaggagcacaaatcggggctatgctaatggctattcgactccgcggtatggacctggaggagacctccgtgctgacacaggctttggcccaaagcggacagcagctagagtggcctgaagcttggcgccagcagctggtggacaagcactccacaggcggtgtgggggataaagtgagtctagttctagcaccagctttggccgcttgtggttgtaaagtacccatgatctccggcagaggtttggggcataccggaggtacccttgacaagcttgagtcaatccccggattcaatgtgatacagagcccagagcaaatgcaagtcttattggaccaagctgggtgctgcattgtgggccagtcagagcagttggtcccagccgacggcattttgtacgcagcacgggatgtgactgccaccgtagacagcctaccccttatcacggctagtatcctctctaaaaagctggttgagggtctgtccgccctggtggtggatgtaaaattcggcggagccgctgtctttcccaaccaggagcaggcaagagaacttgcaaagacccttgtgggcgtgggggcatcactaggactgcgagtcgccgcagcgttgacagctatggacaaaccccttggtagatgcgtggggcatgcattggaagttgaggaggccctgttgtgcatggatggagctggaccgccagatctgagagaccttgtgaccaccctggggggagccctcctgtggttgagcggccacgccggtacccaggcccagggagcagccagggtagccgctgcgttagatgacggaagtgcgctgggtcgattcgagcgcatgttggctgcccagggcgtagacccgggattagcacgcgctctgtgcagcggtagtccagccgaacggcgtcagctgctgcctagggcgagggagcaagaggaactgctggccccagcagatggaacagtagagctcgttcgagctcttccactagctctcgttcttcacgagctgggtgccggacgctctcgcgcaggcgagccgcttcggctcggggtgggagcagagttactggtggatgtcggtcagagactcagacgaggcaccccctggttgagagtgcacagggatggacccgctctatctgggcctcagtctcgcgctctacaagaagccctcgtgctgagtgaccgcgctccattcgccgctccttcacccttcgccgaacttgtcctgcccccacaacagtag

SEQ ID NO: 31130 - DNA, 1449 bp, Artificial Sequence
  Description of Artificial Sequence: Synthetic coding sequence
atggccgcattgatgacacccggtactggcgcaccccctgcccctggagacttctctggggagggcagtcagggattgcctgatcctagccctgagcctaaacagctgcccgagcttattagaatgaagcgggatggcggacggctgtctgaagccgacataaggggctttgtagccgctgtcgtgaacggaagtgcccaaggagcgcaaatcggggctatgctgatggcaataagacttcggggtatggatctggaggagacaagtgtccttacacaagccctggctcagtcagggcagcagctggagtggcctgaagcctggcggcagcagctggtggacaagcactctaccggaggcgtcggcgacaaggtttcactcgtcctagcacctgcactggctgcctgtggttgcaaggtgccaatgattagtggaaggggcttaggtcatactggagggaccctcgacaaactagagtccatccctggcttcaacgtcatccagtctcccgaacaaatgcaagtcttgctggaccaggccggttgctgtatcgtcggtcagtcagaacagttggtaccagccgatggtatcctgtatgcagcaagggatgtcacagcgaccgtcgacagcctgcccttaattaccgccagcatactgagcaagaagctcgtggaggggttatctgccctggtggtagacgtgaaattcgggggagctgctgtgtttcctaatcaggaacaagcaagagagctcgcaaagacgctcgtgggggtaggagccagcctgggcctgcgtgtcgctgccgctcttactgcaatggacaagcccctcggtcgatgcgtgggccatgctctcgaggtcgaggaggcattgttgtgcatggatggtgccggaccccctgaccttagggacttggtcactacattgggaggagcccttctgtggctaagcggccacgctggtacccaggcccagggcgctgctcgcgttgccgcagcacttgacgatggcagcgctctcggacggtttgaacgcatgctggctgcccaaggcgtggaccccggtctcgccagagccctatgctctgggtctcctgcagaacgcaggcaactgctgcctagggcacgcgagcaggaggagctgctggccccagctgatggaactgtggagctcgtgcgtgccctcccgttggccctcgtcttacacgaattgggcgctggtagaagccgcgcaggggagccattgagactgggagtgggtgctgaactgctggtggacgtgggccagcggctgcgcagaggcacaccctggctgcgcgtccacagggatggtcccgctctctctggtccccagtctcgtgcattgcaggaggccctcgtcctgagcgatcgggcaccatttgcagcaccatccccttttgctgaactggtcctgcctccacagcagtag

SEQ ID NO: 31131 - DNA, 1233 bp, Artificial Sequence
  Description of Artificial Sequence: Synthetic coding sequence
atggaagcagaaaatgccggaagctactccctgcaacaggcgcaggccttttatacattcccttttcaacagttgatggccgaagcgcctaacatggcagttgtgaatgagcagcagatgccagaggaggttccagccccagcccctgctcaggaacccgtccaggaggcacccaagggtaggaaacgcaagccaagaaccacagaacccaagcagccagtggagcccaaaaagcctgtggagagcaagaaatcaggcaagtccgcaaagtctaaagagaagcaggaaaaaatcacagacacattcaaagtgaagagaaaggtggatcgcttcaatggcgtcagcgaggccgagctcctcactaagacacttcccgatatcctcacttttaacctggatatagtaattattgggattaatcccggacttatggccgcttataagggccatcactatccaggtccaggcaaccatttttggaaatgtctttttatgtccggactctcagaagtgcagcttaaccatatggacgaccacactctccctggtaagtatggaatcgggttcacaaatatggtggagagaaccacccctggatcaaaggacttgagctccaaagagtttagggaaggaggcaggatacttgtccagaaattgcaaaaatatcaaccacgcatcgccgtcttcaatggcaaatgtatctacgagatctttagtaaggaggtgttcggcgtgaaagtgaagaacctggagttcggtctccagccacataaaatccccgatacagagacactctgttatgtcatgccttcgagcagcgccagatgcgctcaattccctcgagcacaggataaggtgcactactacattaagctcaaggacctcagagaccagctcaaagggatcgaaagaaacatggatgtgcaggaagtgcagtacacgttcgacttgcagctcgcacaggaggacgcaaagaagatggcagtgaaagaggagaagtacgaccctgggtatgaagcggcttatgggggtgcctacggagaaaacccatgttcatcagagccctgcggatttagttcaaatggtttgattgaaagcgtcgaactccggggagagtccgccttcagcgggatacccaatggccagtggatgacacagagcttcaccgatcaaattccctctttctccaatcattgtggcacccaggagcaagaagaggagagtcacgcctag

SEQ ID NO: 31132 - DNA, 621 bp, Artificial Sequence
  Description of Artificial Sequence: Synthetic coding sequence
atgatcaccctgtaccagggttccatggtgctggacctgccgacatggtggaaaggaccgaggcccgctgcaaaaattagccctgggatctatgagatattctctaaagaggtctttggagtcaaggttaagaatctggagttcggcctgcagcctcacaaaatccctgatacagagaccttatgttacgttatgccctcgagcagcgctcggtgtgctcaattccccagagctcaggacaaagtgcattactacatcaagctaaaagatttgagagatcagctgaagggaattgaacgaaatatggacgtccaggaagtgcagtatacattcgacctgcagctggcgcaggaagacgctaagaagatggccgtgaaggaggaaaaatacgaccctggctatgaggctgcctatggtggtgcctacggggagaatccttgctccagcgaaccatgcggcttctcttccaacggtctgatcgagtccgtggagcttaggggcgagtctgcttttagcggcataccaaacggccaatggatgactcagtcattcaccgaccagatcccctccttctcaaatcactgtgggactcaggaacaggaggaggagtcacacgcttag

SEQ ID NO: 31133 - DNA, 3294 bp, Artificial Sequence
  Description of Artificial Sequence: Synthetic coding sequence
atgtcatcatgtcgctccctatgctgtggagatataagccagtcagcagtcctgtttttgtgccagggtaccctggcaatgctggattggcagaacggatccatggggcgatctggggaggccctcctcctggacacagcccatgtgctgtttaccctctcgtcacaaatcaaggagcctacacttgaaatgtttctgtctaggattttggcctcctggactaacagcgctattcaggtactggagagtagttcccccagtctgacagactcactgaatggtaatagctctatagtcggacgcctcctggaatacgtctatacccactgggagcaccctctcgatgcccttaggcatcaaaccaagattatgttcaaaaatctgttgcaaatgcaccgtctgaccgtggaaggtgctgattttgtccccgacccattcttcgtagaactgacagagtcattactgagactcgagtggcacataaaagggaagtacacttgcctgggatgccttgtcgagtgtattggcgtggagcatatcttggcgattgacaagactattccctcacagatactagaggttatgggcgatcagtcactggtgccatacgcgagcgacctgctggaaactatgttccgaaaccacaaaagccatctcaaatctcagaccgctgaaagcagttggattgatcagtggcacgagacatgggtaagtcccctgctattcattctctgtgaaggcaacctggatcagaaaagctacgtgatagattactatctcccaaagctgctatcgtattcccccgaatcactccaatacatggttaagatcctccaaaccagcatcgacgctaaaaccggccaggagcagtctttcccttccttgggctcttgtaatagcaggggggctctgggggctttgatggcctgcctccgtattgcccgtgcacacggacacctgcagtctgctacagacacctgggagaacctcgtatcggatgcacgcattaagcaaggcctgattcaccagcattgccaggtcaggatcgacacgctcggtctcctatgtgaatccaaccggagcacggaaatcgtaagtatggaagagatgcagtggatacagtttttcataacctataacctcaattctcaatcacccggagtgcgtcagcaaatctgcagtctgctcaagaaactcttctgccgaatccaggagtccagccaagtgctatacaaactggaacagtcaaaatccaaacgcgaacccgagaatgagctgaccaaacagcatccttccgtgtcgcttcagcagtacaagaattttatgtcctccatctgtaacagcctctttgaggccttgtttccaggctccagttacagcacccgctttagtgctctgacgatccttgggtccatcgccgaggtgttccatgtgccagagggacgaatctataccgtgtaccagctttcacatgacatcgacgtgggtcggttccagaccctgatggagtgctttactagcacctttgaggatgtgaaaattctggcattcgacctgctaatgaaactgagcaaaacagcagttcacttccaagactccgggaagctgcaggggctgtttcaggcagcactggaactgtctacatctacaaaaccgtacgattgtgtgaccgcctcatacctgttgaatttcctcatttggcaggatgccctgccgtcgtctctttcagcgtatcttactcaacaagtcgcctgcgacaacggggacaggccggcagcagtggttgaaagaaatactttgatggtgattaaatgcttgatggagaatctggaagaagaagtctcccaggcggaaaattccctgctgcaagcggcagccgcttttcccatgtacgggagagtacactgcataaccggcgctcttcagaaactgagcctcaactctttacagttggtgtctgagtggcggccagtggtcgaaaagctgttactgatgtcgtacagactgtcaaccgtggtgagcccagtgatccaatcctcttccccagaaggcctaatcccaatggatactgattctgaatccgccagtaggctgcagatgattcttaatgaaatccagcctcgcgacaccaacgattattttaatcaggctaagatactgaaggaacacgactcctttgacatgaaagacctaaacgcctcagtggtgaatattgacaccagtactgagataaagggcaaggaggtgaaaacatgcgatgttaccgcccagatggtcctcgtatgttgctggcggtcaatgaaagaggtcgccctgctcctggggatgctctgccaactactgcctatgcagcctgtgcccgagagcagcgacgggttgcttaccgtggagcaggttaaggagatcggggactatttcaagcagcacctgttacagagtcgccatcggggtgcctttgagcttgcatacacagggtttgtcaagcttactgaggtccttaatcgatgtcctaatgtgtcactgcagaaactccctgagcaatggttgtggagtgtgctagaagagatcaagtgttctgatccttcatctaaactatgcgctacaaggcggagtgcaggcattccattttacatccaggcccttttagcctctgagcccaagaagggacggatggatttgctgaaaatcacaatgaaggaactgatcagtctggcaggccctaccgacgacattcaatcaacggtgccccaagttcatgccctgaacatccttcgagccctgtttagggatacgcggctcggtgagaatattatcccctatgtagctgacggggctaaagcagccatcctgggttttaccagtcccgtgtgggcggtgaggaatagtagcaccctgctctttagtgctctgatcacaagaatttttggtgtgaagagagcaaaggacgaacattccaagacaaatagaatgacaggacgagaattctttagtcgcttcccggagctgtatccttttttactgaaacagcttgaaaccgttgccaacacggtggactcagacatgggggagccaaatcgacatcctagcatgttcctgctacttctggtacttgaacgcctctacgcttctcccatggatggaacaagcagcgccctgagtatgggccctttcgtaccctttataatgcgggtactgctgtgctgtcctggctggtccgccgtggccagatctcaactgacagccacaagtacgtcttgggtgcaggctatactccttcctcagcctcctgagtag

SEQ ID NO: 31134 - DNA, 5642 bp, Artificial Sequence
  Description of Artificial Sequence: Synthetic coding sequence
atgggcgtcaaaaagaaaaaggagatgcaggttgctgctttgactatctgccatcaagacctcgaaaccctgaagagcttcgccgatgtcgaaggaaaaaacttggcatcactcctcttgcactgcgtccagctgacagacggagtttctcagatacattatattaagcagatcgttcctctgctagagaaggcggataagaatggaatgtgcgatcccaccatccagagctgcttggatattctggccggaatttatctttcgttaagtctcaagaatcctctgaaaaaagtccttgcctccagccttaactcactcccggactttttcctgccagaagcaatgcatagatttaccagccgcctgcaggaagagctaaacaccacagacctgtacagctatcgtaaggtcacagacaatatcagttcatgcatggaaaattttaatttaggcagagcatcagtgaataaccttctgaagaacgtgctccacttcttgcagaagtccctgattgagatcctggaagagaatcggaagtgtgcaggaaaccacattatacagacacagctcatgaacgacctgctagtcggtattagggtctccatgatgctggtgcagaaggttcaggatttccagggcaacctttggaaaaccagcgacagccccatttggcaaaacatgtgtggtcttctatccatctttacaaaggtcctctccgatgatgatttattgcaaaccgtacaatcaacctcagggctcgcaattatcctttttataaagaccatgttccacccctctgaaaaaatccctcatttgatctcttccgtgcttctgcgcagtgtggattgtacaagcgtacccgaatggttcatgtcatcttgccgcagcctgtgttgcggcgacatctcccaatctgcagttctgtttctctgccagggtactctcgccatgctggactggcagaacggatctatgggaagatccggagaggccttattgctggacactgctcatgtcctttttacactgagcagtcagatcaaagagcctacactggaaatgttcctctctcggattctggcctcttggacaaatagtgcaatccaggtgctggaatccagcagtccctccctaaccgattctctgaacggcaacagctctatagtcggcagactgctggaatacgtgtacacacactgggaacaccctctcgacgccctgcgccaccagactaagatcatgttcaaaaatctgctgcagatgcatcgtctcacagtagagggcgcagacttcgtcccagatcccttctttgtggaacttacagaaagtctcttgagactggaatggcacatcaaagggaagtacacatgtctcggttgtttggtggaatgtattggagtcgagcatatactcgcaatagacaaaacgatcccaagccagatcctcgaggtcatgggtgatcagtctctggtgccatacgcctctgatcttcttgagactatgtttcggaatcacaagtcacatctaaagagtcagaccgccgagtcaagttggatagatcagtggcacgagacttgggtgtccccactgctgttcatcctgtgtgagggcaatttagaccagaaatcttatgtgattgattattacttgcctaaactgctgagctatagccccgagagtctccagtacatggtcaagatcctgcagacttctattgacgccaagaccggacaggagcagtcattcccttccctgggctcttgcaacagcaggggtgcgctgggtgccctcatggcatgcctgagaattgcccgagcacacggccacttgcagtccgctactgatacctgggagaatctagtttcagacgcaaggataaagcaaggccttatccatcagcactgtcaggttaggatagacaccctgggacttctgtgtgagagcaaccgcagcaccgaaatagtgtctatggaggagatgcaatggatccagttcttcattacctacaacctaaatagccagtctccaggggtacgacagcagatctgcagtctccttaagaagaagctcttttgccggattcaggagtccagccaggttttgtataaacttgaacagagtaagagcaaaagggaacctgagaatgagctgacaaagcagcatccaagtgtctctctgcaacagtataaaaattttatgtcctctatttgcaactctctgttcgaggccctattcccaggatcatcttacagtaccagattcagcgcacttactatcttgggatcaatcgcagaagtgttccacgtacccgaaggacgaatatacactgtttaccaattatcacatgacattgatgtggggaggttccagaccttaatggagtgctttaccagcacctttgaagatgtgaagattctagccttcgacctgttgatgaaactttccaagaccgctgttcacttccaggattccggaaaacttcagggtctattccaggccgctctggagctgtctacatccactaagccttatgactgtgttactgcatcttatttgcttaacttccttatctggcaggatgcactgccatcttccctctctgcatacctaacccaacaagtggcctgcgataatggtgaccgtcccgctgccgttgtcgagcgcaacaccctaatggtgattaagtgtctcatggagaaccttgaggaggaagtttcccaggcagagaactctctactgcaggccgcagccgcattcccaatgtacggcagagtgcattgcatcacaggagcactgcagaaattgtcactaaacagcctccagctggtcagtgaatggcggcctgtagtagaaaagctattattaatgtcttaccgactgagtacggtggtctccccggtaatccaatcctcatctcccgagggcctgattcccatggacacggatagtgaaagcgcttcccgattgcagatgatcctgaacgagatccagccaagggacaccaacgactactttaaccaggccaagatcctgaaggaacacgacagttttgacatgaaggatctgaatgcttctgtggttaacattgatacatctacggaaataaaaggtaaggaagtgaaaacgtgcgacgtcactgcccagatggtactggtttgttgttggaggtccatgaaggaggtagcattgctgctcggaatgctatgtcagctgctacctatgcagcccgtccctgaaagcagtgatggcctgctgacagtagaacaggtgaaggagataggggattactttaaacagcatctgctccaaagtcgtcataggggggctttcgagctcgcctacacaggctttgttaaacttacagaggttctcaaccggtgtcctaacgtatccctgcagaaactcccggagcagtggctgtggagtgttctggaagagatcaaatgttctgacccatcgtctaaactgtgcgcaacgcgcaggagcgctgggattccattctacatccaagccctcctggcttcagagcccaaaaaaggccgtatggacctgctcaaaatcactatgaaggaactcatttcactcgccggaccaacagacgacatacaatccactgtgccgcaggtccatgccctcaatatacttcgcgcactattccgggatacacgcttgggtgaaaatataatcccctacgtggccgacggtgctaaggccgctattctgggattcacttcgccggtatgggcagttcgcaattcttccaccctgctgttcagcgccctcatcacccggatctttggagtgaaacgggctaaggacgagcactctaagacaaaccggtgtggtcacagccctgtgtatcactcccgggaaatggccgcaagggccctggtgccctttgtgatgattgaccacatccccaataccatcaggacgctgctgtcgaccttgcccagttgcacagatcagtgcttcagacagaatcacatacacggaaccttgctgcaggtctttcacctgttacaggcttattctgactccaaacatggcacaaacagcgatttccaacacgagctgaccgacatcactgtgtgcaccaaggccaagctgtggctggccaagcggcagaacccttgtttagttactcgagcggtctacattgatatcctgttccttcttacttgctgcctcaatcgcagcgcaaaggacaatcagcccgtactcgaatcacttgggttttgggaagaagtacgtggcatcattagcggaagcgagttgatcaccgggttcccttgggcctttaaagtgcctgggctgccccagtaccttcaaagcttaacaagactggccatcgctgctgtgtgggctgccgcagccaaatctggcgagagagaaacaaacgtacccatctcattttcacagctgctcgagtcagcctttcccgaggtaaggtcgttgaccctggaggctctgttggaaaaatttctggctgctgccagtggactcggagagaaaggcgtgccccctctgctgtgcaacatgggggagaaatttcttctgctggctatgaaagagaaccaccctgagtgcttctgcaagattcttaagatactccactgtatggatcctggggaatggttgccgcagaccgaacattgcgtccatctgacgccaaaagaatttctgatttggacgatggacattgcatcgaacgagaggtccgagatccagtccgttgcccttagactcgccagcaaagtgatctctcaccatatgcagacctgtgtggaaaacagggaactcatcgctgctgaactgaaacaatgggtgcaactagtcatcctgtcatgtgaggatcaccttccaacagagagccgcttggctgtagtggaggtcctgacctccaccacacctttgttcctgaccaatcctcatccaatactggagttgcaggacacgttggccctgtggaaatgcgttcttacactgttacagagcgaagagcaggcggttcgggacgcagccactgagaccgtgaccactgctatgtctcaggagaatacctgccagagtaccgaatttgctttctgccaggtagacgcgtccatagccctggccctggctctggctgtgctgtgcgaccttctgcagcagtgggaccaactggccccagggctcccaattctgttaggatggttgcttggcgaaagcgatgatttggtggcatgcgtagagtcaatgcatcaggtggaagaggactacctctttgaaaaagcagaggtcaacttttgggcagagacactgattttcgtcaagtacctctgtaagcacctgttttgcctcctgagcaagtccggctggcgtcccccttcccctgaaatgttgtgccatctccagcggatggtgtctgaacagtgccatcttctgagtcagttttttagggagctgccacctgctgccgagttcgttaagactgtggaatttactaggctgagaatccaagaggagagaacactagcctgtctgaggctgctcgcattcctggaaggaaaggaaggagaagacaccctggttctgagtgtgtgggactcctatgccgagagcaggcagttaaccttaccccgaaccgaagccgcttgcta

SEQ ID NO: 31135 - DNA, 5861 bp, Artificial Sequence
  Description of Artificial Sequence: Synthetic coding sequence
atgggtgtcaagaaaaagaaggagatgcaagtagccgcactaacaatttgccatcaggacttagagacactgaaatcttttgctgatgtcgagggcaaaaacctcgcctccttgctactgcactgtgttcaattgacagacggagtgagccagattcactacatcaagcagatcgtccctcttctggaaaaggctgacaagaatggaatgtgtgaccctacaatccagagctgcctggatatccttgccggaatctacctctcactttctttgaagaatcccttaaaaaaggtgctggcctcttctctcaacagcttgcccgatttcttcttgccggaagctatgcaccgctttacaagccgactccaggaagaactgaatacaaccgacctttacagctatcggaaagtgactgataacatctcaagttgcatggagaatttcaaccttggccgtgccagcgttaataacctactcaaaaatgttttacattttctgcaaaaatcccttatcgagattttggaggagaaccgaaagtgcgcgggtaatcacatcatccagacacagcttatgaacgatctcttagtggggataagagtctcaatgatgttagtacagaaagtgcaggatttccaaggcaatttgtggaaaacctctgacagtcctatttggcagaacatgtgcgggttactttccatctttacgaaggtgctttctgacgatgatcttttgcagactgtccagagtacctcaggcctcgccatcatcttatttataaagactatgttccacccttctgaaaaaatcccacaccttattagcagtgtgttattgaggtcagtggactgtacctccgtgcccgaatggttcatgtcctcatgccgctcactctgctgcggtgacatatctcaaagcgccgtcttgttcctgtgccagggcacactcgcaatgctggattggcagaacggctctatgggtcgctccggtgaggccctgcttttggacacagctcacgtactgttcactctcagcagtcagattaaagaacccaccctggagatgtttctctcaaggattctggcgagttggaccaactccgctattcaggtgctcgaatcttcctctcctagtctgactgattctctgaatggtaattcttcaatcgtgggcagactcctagaatacgtctacacacattgggagcacccacttgatgccctgcgacaccagacaaaaattatgtttaaaaacctgctgcagatgcatcgtttaacggtagaaggcgcagacttcgtgcctgatccattctttgtggaactcaccgaatcgcttctgcgccttgaatggcacattaagggcaagtacacctgcctggggtgcttggttgagtgcatcggggtggaacacatcctggcgatcgacaagacaattccaagccagatcctggaggtgatgggcgatcagtcgttagtgccgtacgcctctgacctgctcgaaaccatgtttagaaaccacaagagccacctgaagagtcagactgccgagtcctcctggatcgatcagtggcacgagacttgggtctccccccttctgttcattctgtgcgaaggaaacttggaccaaaagtcttatgtcattgattattacttgccgaagttgctgtcctacagcccagaaagcctccagtacatggttaagattcttcagacctctatcgacgcaaaaactgggcaggagcagagtttcccatccttgggttcatgtaactcccgtggagctctgggagcccttatggcctgcctgaggattgccagggcgcacggtcacctgcagtccgcaactgacacctgggagaatttagtttccgacgctagaattaaacagggtctgattcaccaacattgtcaggtgcggatcgacacgctaggcctactgtgcgaatcgaaccggagtacggagatcgtgtcaatggaggagatgcagtggattcaattcttcatcacctacaatctgaatagccagagtccgggagtgaggcagcagatttgctcattgctgaaaaaactgttctgccgcatccaggaatcctctcaagtactgtataaattagaacagagcaaaagcaagcgagagcccgagaacgagttgacaaagcagcacccctctgtcagcttgcaacaatacaagaatttcatgagcagcatttgtaacagcttgttcgaggcactctttccaggcagctcttattctaccagattctcagccctgacgattcttgggtcaatagccgaggtctttcatgttccggaaggaaggatctacacggtttaccagttgagccacgacatcgacgtcggtcggtttcagacgctgatggagtgtttcaccagcacgttcgaggacgtcaagatccttgctttcgacctgctgatgaagctgagcaagacggcagtgcacttccaggattccggaaaactccaaggcctgtttcaggccgctttggagctctcaacaagtacgaaaccatacgattgcgtcacggcttcatatctcctgaacttcctcatatggcaggatgcattaccatccagcctaagcgcatatctgacccagcaggtggcgtgtgacaatggggacaggccagcggctgtcgtcgagcgaaataccttgatggtaattaaatgtttgatggagaatcttgaagaagaagtttcccaggcagagaattccctgttgcaggcagcggcagcattccctatgtatggccgagtacactgcatcaccggcgcactgcagaaactgagtttgaacagcctgcagttggtaagcgaatggcggcctgttgtggagaagcttttgctaatgagctaccggttatccactgtggtgagtccagtgattcaaagcagcagccctgagggtttgattcccatggacaccgattcagaatctgccagtaggctgcagatgatcctcaacgaaattcaaccgagagacactaatgattactttaatcaagctaaaattctgaaggagcatgactccttcgacatgaaggatctgaacgcatccgtcgtcaatatcgacaccagtacggaaataaaggggaaggaagtgaaaacctgcgacgtgactgctcagatggtcctggtttgctgttggaggtcgatgaaggaggtagcattactgctaggcatgctgtgccagctattgcccatgcaacccgtacccgagagctctgacggcctcttaactgtcgagcaggtcaaagagatcggggactactttaagcagcatttactgcagtctaggcaccggggtgctttcgaattggcctatacaggatttgttaaactcacagaggttctaaatcggtgcccgaatgtgtccctgcagaagctcccagagcagtggttatggagtgtgctcgaagaaatcaagtgttccgacccctccagcaagctgtgtgctacacggcgtagcgctgggatacctttctatatccaggctttacttgccagcgaacccaagaaggggagaatggatctgttgaagatcaccatgaaggagctgatcagccttgctggcccaactgatgacatccagtccactgtcccccaagtgcatgctctcaacatcttgcgcgcactcttcagggacacacgtttgggcgagaatatcatcccttacgttgcagacggcgctaaggcagccattctgggcttcacatcccctgtttgggcagtcagaaactctagcactttgctcttctctgccctgataacaaggatcttcggggtgaagagagctaaagatgagcattctaaaaccaaccggatgactgggagggaattcttctcaagatttccagagctatatcctttcctgcttaaacagctcgaaacagtcgccaacacagtggactcagacatgggagaacccaacaggcacccatccatgtttttgttgctcttagtcctcgaacgactgtacgcatctcccatggacggcacctcaagtgctttgagcatgggcccttttgtcccctttatcatgagatgcgggcacagcccagtataccactcccgcgaaatggccgcacgtgcgttggtgccattcgtgatgatcgatcacattccaaacaccatcagaaccctgctctctacgctgcccagttgcactgatcagtgttttcggcagaatcatatacacggaacgctgttgcaagtgtttcacctcttgcaggcctatagcgattccaagcatggcacaaatagcgactttcagcacgaactaactgacataacagtgtgcactaaagcaaagctgtggctggctaagcggcagaatccgtgtctagtgacgcgcgcagtgtacatcgatattctcttcctgctgacttgctgcctgaacaggtctgccaaggacaatcaacctgtacttgagagccttggcttctgggaggaagtaagaggcatcatatccggctccgagctgatcacagggtttccgtgggctttcaaagttccaggcctccctcaatatctacagagcctcaccagactcgcgattgccgctgtgtgggcagccgctgcgaaatcaggggaaagggagacaaatgtgcctatttccttcagccaactgctggaatccgcctttcctgaagtcaggtctttgacactggaagcccttctggagaagttcctagccgctgcctccggtttgggggagaaaggggtgcccccactgctctgcaatatgggggaaaaattcctcctgttggccatgaaagaaaatcaccctgagtgcttttgtaaaattttgaaaatcctgcactgcatggacccaggggaatggcttcctcagaccgaacactgcgttcatcttacccccaaggaattcctcatctggacaatggatattgcgtccaacgaacgcagcgagattcagagcgtggctctgaggttggcctctaaggttatttctcaccatatgcaaacctgcgtcgagaatagggagttgatagcagcggaactcaaacaatgggtgcagttggtaatactatcttgtgaagatcacctgccgactgaaagtcgtctggcggtggtagaggtgctcacttctactacaccactgtttttgactaacccacatcctatcctggagcttcaggacacactcgccctctggaaatgtgtcctaaccttgctgcaaagcgaggaacaggcggttcgcgatgcagcgactgaaacagtaactaccgctatgtcccaggaaaatacttgtcagagcaccgagttcgccttttgtcaggtggatgcctcaattgcactagcgctcgcattggcggtcttgtgtgacctgttacaacagtgggatcagctggcccctggcctcccaattctgctgggttggctgctgggggaaagtgatgacctcgttgcctgcgtcgaaagcatgcaccaggtggaggaggactacctctttgaaaaggctgaggtgaacttctgggctgaaactttgatattcgtgaaatacttgtgtaaacacctcttctgcctgctttctaagagcggatggcggcctccgtctccggagatgctctgccatctccagcgaatggtgtccgaacagtgtcatctgttgtcccagttcttccgggagctgccgcctgcagctgagtttgtgaagaccgttgagttcacccgtctaagaattcaggaggaacggacactcgcatgtttacggctactcgcctttctcgaggggaaggagggagaggataccttggtcctgtcagtgtgggacagctacgccgaatcaaggcagctgaccctgccacggaccgaggctgcctgcta

SEQ ID NO: 31136 - DNA, 5861 bp, Artificial Sequence
  Description of Artificial Sequence: Synthetic coding sequence
atgggcgttaaaaaaaaaaaggagatgcaggtggccgcattgacgatttgtcaccaagacctggaaacattgaaatcattcgcagatgtggagggcaaaaacctggcttccctgctcctccattgcgtccagctcaccgatggcgtgtcccagattcattacataaaacagattgtacctctgttggagaaggctgacaagaatgggatgtgcgacccaacgatccaatcctgtctggatattttggcgggtatctatctatcactctccctcaagaatcccctcaaaaaggtgttggcaagctcactgaactccctgccggattttttcctccccgaagccatgcaccgtttcaccagcaggctgcaggaagagcttaacactacagatctgtactcttatcgaaaggtgaccgacaatatctcttcttgcatggagaattttaaccttggtcgcgctagcgtgaacaatctactgaagaatgtgctgcatttccttcagaagagcctcatcgagattctggaggaaaacaggaagtgcgccggaaatcatattatccagacccagctgatgaatgatttgctagtaggtatcagagtgtctatgatgctggtgcagaaagtccaggattttcagggcaatctgtggaagacatctgactctcccatatggcagaatatgtgtggtttactctcaatcttcacaaaggtgctgagtgatgatgatctgttgcagactgtgcagtccaccagcggtctggctattatcttgtttatcaagaccatgttccatccaagcgaaaaaataccccatttgatcagcagtgtcctactgcgatccgtcgattgtacttccgtccccgagtggttcatgagctcgtgccgctctttgtgctgtggcgatatcagccaatctgcagtgctattcctgtgtcaggggacgctagcaatgctggattggcagaacggctcaatggggagaagtggcgaggcacttttgctcgacacagctcatgtgctctttaccctcagtagtcagatcaaggagcccaccctagaaatgttcctgagtagaatcctggctagctggaccaactctgctatccaggtactggaatcttcttcaccaagtcttacagactccttgaacggcaacagttctatcgtaggccgtctcctcgagtacgtttacacacattgggagcaccctttagacgcattgagacatcaaacaaagattatgttcaaaaatctcttgcagatgcataggctgacagtggagggcgcagacttcgtgccggatccattcttcgtcgaactgaccgagtcgctgctgaggctggagtggcacataaaggggaagtatacctgcctgggctgtctagtagagtgtatcggagtggagcatattctcgcaattgacaaaacaatccccagccaaattttggaggtaatgggtgatcagtctctggttccgtatgcttctgatctcctggagactatgttccgcaaccataagtcgcacctgaagtctcagacggcggagtctagctggatcgaccagtggcacgagacctgggtgtcccctctcctcttcatactttgcgaaggtaatctcgaccaaaagtcatatgtcatcgattattatctgccgaaactgttaagttactcacccgagtcattgcagtacatggtcaagatactgcagacgtccatcgatgcgaaaacaggccaggagcaatctttccctagcctgggatcttgcaattcgagaggcgcactcggagctctcatggcttgtttgcgaatcgccagggcccacggccatctgcaatcggccaccgatacatgggaaaacctggtcagcgacgccagaataaaacaaggtctgatacaccagcactgccaggtccgaatcgataccttaggactgctttgcgaatccaaccgaagcactgagatagtgagcatggaagagatgcaatggattcagttttttatcacctataaccttaattcccaatctcccggagtaaggcagcaaatatgctctctgctgaagaaattattctgccgaattcaggaatcaagtcaggtcctctataagttagagcagtccaagagcaagagagagcctgagaacgagctaacgaagcagcacccaagcgtatcactccaacagtacaagaacttcatgagcagtatctgcaatagcttatttgaagctctcttcccaggctcctcttattccacaagattttctgcattaactattctgggctcaatagcggaagtgttccatgttcccgaggggaggatttatacagtctaccaactgtcccatgatatagacgtgggtcgtttccaaaccctgatggaatgctttacatcaacttttgaagacgtcaaaattctagcattcgacttactgatgaagctcagcaaaacagcggtccacttccaggattccgggaagctccaggggctgttccaagccgctcttgagctgagcacctccacgaaaccctatgattgcgtcacagcttcctatctgcttaacttcctgatctggcaggacgctctgccttccagcctgtctgcataccttacacaacaagtggcgtgcgacaatggagacagacccgctgccgtggtggagagaaacacgttgatggtgatcaaatgtttaatggagaacttagaggaagaggtatctcaggcagagaactctttgctgcaggcggctgctgcattcccaatgtacgggagagttcactgcatcaccggagccctccagaaactgagtcttaatagcttacagttggtttcagagtggcgcccagtcgtggaaaagttactgcttatgtcctaccgcctgtcaaccgtggtgtctcctgtgatccagtccagctcccccgaggggctgataccaatggacactgattcggagtcagccagcaggctgcagatgattctcaacgagattcagcctcgtgataccaacgattactttaatcaggcgaaaattttgaaagagcacgactcattcgatatgaaggaccttaatgcttccgtcgttaacattgacacatccactgagatcaaggggaaggaggtgaagacttgtgatgtaaccgcacaaatggtgctcgtgtgctgttggagatccatgaaggaagttgccttgctgctaggtatgctttgccagcttcttcctatgcagccagtgcccgaatcaagtgatggcctgctgaccgtcgaacaggttaaagaaatcggcgactattttaagcagcacctgctccagagtcggcatagaggggcattcgaactcgcctacacaggattcgtgaagttgacggaggtcctaaacaggtgcccaaatgtgtccctgcagaaactccccgaacaatggctctggtccgttctagaggagatcaaatgcagtgatccctcatctaagctctgcgccactcggaggtccgcagggatcccgttttatatccaagccctcctcgcctcagaaccgaagaagggccgtatggaccttctcaaaatcacaatgaaagaactgatttctctggccggtcccactgacgatatccagtccactgtccctcaggtgcacgccctgaacatactgagggccttattccgggataccagattgggagaaaacataattccttacgtcgccgacggcgctaaagccgcaatactcggtttcacttcccccgtttgggccgtgcgaaatagttccacccttctgttctcagcccttataactcgcatctttggggtgaagagggctaaagacgagcactctaagaccaatagaatgactgggcgagagttcttttcccgcttccctgagttatatccctttctcttgaaacaactggaaacagttgcaaatacagtcgactctgatatgggggaaccaaatcgccatccatccatgttcctgctcctactggtgctggagaggctgtatgcttcccctatggacggtacatcctctgccctctcgatgggtccattcgttcctttcatcatgcgatgcggacatagtcctgtctatcacagccgagaaatggccgcacgcgctctggtgcctttcgtaatgatcgaccacatccctaataccattcgcactctccttagcacactcccgtcatgcactgatcagtgcttcagacagaaccacatccatgggaccttgctgcaggtcttccacctccttcaggcttacagtgattctaaacatggtaccaacagtgattttcagcacgagttgaccgacattacagtgtgcactaaggctaagctgtggctggccaagcggcagaatccctgcctcgtgactagagctgtttatatcgatatcttattcttactaacttgctgtcttaataggtctgccaaggataatcagccagtgttggaaagtttgggcttttgggaagaggtgaggggcatcataagtggttccgagctgatcactggatttccatgggcatttaaggttcccggtctgcctcagtatctccagagcctgacacggcttgcgattgctgcagtgtgggcagccgcagcgaagtctggagaaagagagaccaacgtgcccatcagctttagccagttgctcgaatctgccttcccagaagtgcggagccttactttggaggcgctcctggagaagtttctagccgctgcctcgggcctcggtgaaaaaggggtccctcctctgctgtgcaatatgggcgagaaattcctcctcttggcgatgaaggagaatcatccggaatgcttttgtaagattctaaaaatcctccattgtatggaccctggggaatggcttcctcaaaccgagcattgcgtgcacctgacgccaaaagagttccttatctggaccatggatatagcgtccaatgagagaagcgaaatccagagcgtcgctttgcgactcgcaagtaaggtgatctcccatcatatgcagacttgcgtcgaaaatcgggagttgattgccgctgagctgaagcagtgggtgcaattggtaatcctttcgtgtgaggaccacctcccaacggagagcagattggccgttgtcgaggtgctcacatcgaccactcccctttttctcacaaatccacaccctattctggagctccaagacacgcttgctctgtggaagtgtgtgctcacattgctgcagagcgaagaacaggctgtcagggatgccgcaaccgagaccgttacaacagcgatgtcccaggagaatacatgccagtccacggagtttgccttttgtcaggttgatgcttctattgccctcgccctggcgttggctgtgctctgtgatctactgcaacaatgggatcagctagccccaggccttcccatacttctggggtggcttctgggggagagtgacgatctcgtggcttgtgtcgaatccatgcaccaggttgaggaagattatctatttgaaaaagctgaagttaatttttgggcggaaactctgatcttcgtgaaatatttatgcaaacacctattctgcctactgtcgaagagcggatggcgacctccctctcccgaaatgctctgtcatctgcagagaatggtgtcggagcagtgtcacttactgagccagtttttccgtgagcttccgcctgcagcagaattcgtcaagacagtggagttcacccggctgcggatccaggaggagcggaccctggcttgtctgaggctgttagcctttttagaggggaaggaaggcgaggacaccctggtgctttcagtgtgggattcttatgctgaaagccgtcagcttactctcccacggacagaagctgcttgtta

SEQ ID NO: 31137 - DNA, 4905 bp, Artificial Sequence
  Description of Artificial Sequence: Synthetic coding sequence
atgagttcgtgccgatccctctgttgcggagacatcagccaatccgcagttctgtttctctgccagggtactctggcaatgcttgattggcagaacggtagcatggggagatccggcgaggcacttctcctggacaccgctcacgttctcttcaccctaagcagtcaaattaaggaaccaacactggaaatgtttctttctcggatcctggcaagttggacaaattccgcaattcaagttcttgagtcttcatctccttctctgaccgacagcctgaacggaaattcttccattgtgggcagactccttgagtacgtatacacacactgggagcatcctctggatgctctgagacaccaaaccaaaattatgttcaagaatctgctgcagatgcatcgtttgactgtggaaggggctgatttcgtgcccgacccttttttcgtggaacttaccgagagccttctccgactggaatggcatataaaggggaagtacacatgcctggggtgcttggtggaatgcataggcgtagaacacatcctagctatcgacaagacgatcccttctcagattctggaggttatgggggaccagagcctggtcccttatgcaagcgacctgctggagactatgttcaggaaccataagtctcatctgaagagccaaaccgcagagtcttcatggattgatcagtggcacgaaacttgggtgtcccccctgttattcatcctgtgcgagggaaatctcgatcagaaatcttatgtgattgactactacctccctaaactgttgagttatagtcctgagtctctgcagtacatggttaaaatcctacagacaagcatcgatgcaaaaacgggacaggagcaatcctttcctagtttgggatcatgtaacagccgaggagccctcggcgcattgatggcttgtttacggatcgcgagagctcatggacacctccagtcagccactgatacctgggaaaaccttgtctcagatgccagaattaaacagggactcatccaccaacactgtcaagtacgaattgacacccttggcctgttgtgcgaaagtaatcgaagcacggagatcgttagtatggaagagatgcagtggatccaattcttcatcacgtataacctgaatagtcagtcaccaggggttaggcagcaaatatgttcccttttgaagaagcttttttgtaggatccaagaatcctctcaggtgctatataagttggagcagtcaaaatctaaaagagagccagaaaacgagttgacaaaacagcacccatcagtgtccctacaacagtataagaattttatgtcatctatatgcaactcactgtttgaggcattatttccaggaagttcatatagcacacgattctctgcgttaacaattctgggatctattgcagaggttttccatgttccggaaggcaggatctacacagtgtaccagctttcccatgatattgatgtgggccgatttcaaaccctgatggagtgtttcacatctacgttcgaagacgttaagatcctggcgttcgacctgctgatgaagttgagcaaaacagccgtgcacttccaagacagcggaaagctccagggcctgttccaagccgctcttgagctttccactagtacgaagccctatgactgcgtcactgcgtcatacctcctcaatttcctgatttggcaagatgccctcccaagcagtcttagtgcttacttaacccagcaggtggcttgtgacaatggcgaccgtcccgcagcagtcgtggagcgtaacaccctgatggtgattaagtgcctcatggaaaatctcgaggaggaggtcagtcaggctgagaattccctcttgcaagcagctgcagcatttcccatgtatgggagagtacactgtatcactggggcattgcagaaactttcattgaattccctgcagcttgtgtcagagtggcgaccagttgtggagaagctgctgctcatgagttacaggctgagtacagtcgtctcccctgtgatacagtcaagtagtcctgagggtcttatccccatggacactgattcagagagcgcttctaggctccagatgatccttaatgagatccagcccagagacactaatgattacttcaaccaagcaaagatcttgaaggaacacgacagttttgacatgaaggacctgaacgcctctgtagtgaatatcgatacctccacagagatcaagggcaaagaggtcaagacctgcgacgtcaccgcacagatggtacttgtgtgctgctggcgaagtatgaaggaggtggccctgcttcttggaatgctttgccagcttcttccgatgcagccagtgcctgagtccagcgatggccttttaactgtggagcaggtgaaagagatcggcgactatttcaaacagcatttactccaaagtaggcatagaggcgcattcgaattggcctataccggattcgtgaaacttaccgaagtgctgaatagatgtcctaacgtgagccttcagaagctcccagaacagtggctgtggagcgttctcgaggaaattaaatgcagcgatccttcttctaagctctgtgcaacgcgaaggtccgccggtattccgttctacatacaggctcttctcgcgagcgagcccaagaaaggtaggatggacctcttgaagatcacaatgaaggaattgatctcactggcgggtcctaccgatgatatccagagcaccgtcccccaggtgcatgccctgaatatccttcgggctctgttcagagacacgcgcctgggcgaaaatattatcccctacgttgctgatggcgctaaggccgcaatactgggctttacatcaccagtttgggcctcacagatgacagggagagagttcttcagccgcttcccagaactctatcctttcctgttgaagcagctggagaccgtcgccaatactgtggactcagatatgggcgagcccaaccgtcacccatccatgttcctgttactacttgttcttgaaagactgtacgccagtccgatggatggaactagcagtgccctgtcaatgggacctttcgtgccatttattatgcgctgtggccactccccagtataccatagccgagaaatggcagcacgggctctggtgccgtttgtgatgatcgaccacatccccaatactatccgaaccctactgtctacccttccaagctgtacagatcagtgttttcgacagaaccatatccatggcactctgctgcaagtcttccacctgctgcaggcctattccgactctaaacacgggacaaactcagactttcaacatgaactgaccgatataaccgtatgtactaaagccaagctgtggctcgcgaagaggcaaaatccgtgcttggtcacccgcgctgtttacatcgacattctcttcctgctgacgtgttgccttaacagatctgccaaggataaccagcctgtgctggaatccttgggattctgggaggaggttcggggaattataagcggtagcgaactcattaccgggttcccctgggctttcaaagtccccggacttccacagtacctgcagtcactgaccagactggccatagccgctgtatgggccgcagcagccaagtcaggggagagagaaacaaacgttccaattagcttctcccagcttctggaatccgcctttccagaagtcagatctttaaccctggaggctctgctagaaaagtttctggcagccgctagcggactcggagaaaagggcgttccgccactactctgcaacatgggggagaagtttctccttctagccatgaaggagaaccaccccgaatgcttttgcaagattctcaagatcctgcattgcatggatcccggagagtggttgcctcagacagagcattgcgtgcacctgactccaaaagaatttcttatttggaccatggatatagcctctaacgaaagatccgaaattcagtcagttgccttgcgcttggctagcaaggtgattagccatcatatgcaaacgtgcgtggagaatcgggaacttatcgcagctgagctcaaacagtgggtacagttggttatcttatcctgcgaagaccatctccctacagaatcccgcttggctgtggttgaggtgctcacatcaacgacacctttattcttgaccaacccacatcccatcctagaactccaggacaccctcgccctgtggaagtgtgtgctcacactgctgcagagtgaagagcaggccgttagggacgctgctaccgagacggtgacaaccgccatgtcccaggaaaacacatgtcaatccaccgagtttgcattttgtcaagttgacgcatccattgcgttagctcttgccctggccgtgttgtgcgatttgctccagcagtgggaccaactggcccctggcttgcccatattgctgggctggttactcggagagagtgacgatctagtagcctgcgtcgagtctatgcaccaagtagaagaggactacttatttgaaaaggccgaggtgaacttttgggcggagactttgatctttgttaagtatttatgcaagcatctgttttgcctcttatccaaatccggctggaggcctccgtcccccgagatgctctgccatctgcaacggatggtgagcgagcagtgtcatctccttagtcagttcttccgtgaattgcctcccgctgctgagtttgtgaagacagtggagttcacacggctccggatccaggaagaacgtaccctcgcttgtctgaggttgctggccttccttgaaggtaaggagggagaggacactctcgttctttcagtctgggattcctatgccgaatctagacagttgactctgcctaggactgaggcggcatgctag

SEQ ID NO: 31138 - DNA, 2685 bp, Artificial Sequence
  Description of Artificial Sequence: Synthetic coding sequence
atgggggtaaagaagaagaaggagatgcaggtcgccgcactgaccatttgccaccaggacctcgagacccttaaaagttttgcagacgtcgaaggaaaaaacctggcttctcttcttctgcactgtgtacagctgactgatggagtgtcccagatacactatattaagcaaatcgtgccactcctagagaaagccgataaaaacggcatgtgtgaccccactatccagtcctgcttagatatcctagccggaatatatctttccctttctttgaagaatccattaaagaaagtgctcgcttcaagcctgaatagcctgcctgactttttcctgcctgaagccatgcatcgtttcacaagtcgccttcaagaggagttaaatacaacggacctgtatagttatcgtaaggtcaccgataatataagttcctgcatggagaattttaacctggggcgagcttcggtaaataatctcctcaagaatgtgctgcacttcctccagaaaagcctcattgagatcttggaagagaataggaaatgtgcgggaaaccatatcatacagacccagctcatgaatgatcttctggttgggatcagggtcagcatgatgctagtgcaaaaggtccaggacttccaaggtaacttgtggaaaacctccgactctcctatctggcagaatatgtgcggcctcctctcaatctttacaaaagtcttatctgatgatgatctccttcaaactgtccagtctacaagcggactggctattatcttgttcattaagaccatgttccatccgtcggagaaaatcccacatctaatttccagcgttcttctgcgctcagtagattgcacctctgtgcccgagtggttcatgtctagctgcagaagcctctgttgcggcgatatctcccagtcggccgtgctgttcctttgccaaggcactctggcaatgttggattggcagaatggctctatgggcagatcaggcgaagccctcctgttggatacagcccatgtcctgtttacactctcctcgcaaataaaggagccgacgctggaaatgttcctgtctagaatccttgcaagctggacaaactcagccatccaagtcttggagagctccagcccatcactgaccgactcactgaatggtaactcctcaattgtgggcaggttgctagagtacgtttatacccactgggaacaccctctggacgctctgaggcaccagaccaagataatgtttaaaaacttactgcaaatgcatcgcctgaccgtcgaaggcgctgattttgtgcccgatcccttttttgtggaactcaccgaatcgctccttcgcctggaatggcacattaagggtaaatatacctgcctggggtgcctggttgaatgcatcggggtagaacatatcttggctattgacaaaactatccctagtcagatacttgaagtaatgggagatcaatcactggtaccctatgcctcagatctcctagagaccatgttcaggaatcataaatcgcacttaaagagtcagaccgccgaatcttcatggatcgatcagtggcatgaaacttgggtgagtccgctgctctttatcctatgcgagggtaacctggaccaaaaaagttacgttattgactattacttacccaagttactctcctattcccccgagagcctgcagtacatggtcaagatcctgcagacctccatagacgctaagacaggtcaagagcagagctttcccagcctcggttcctgcaatagccgcggagcgctgggtgccttgatggcttgtctgcggatcgccagagcccacggccatctgcagtccgcaacggatacttgggaaaatcttgtcagtgatgccaggatcaagcagggtctcattcatcaacactgccaagttaggattgacactctagggctgttgtgtgaaagtaacagatcaacagagattgtcagtatggaggagatgcagtggatccagttttttatcacctacaaccttaactctcagtcacctggcgtcagacagcaaatttgttcactcctcaagaagttattttgcagaatacaggaaagctcgcaggtgctttacaaattagaacagtcaaagtcaaagagagagcccgagaacgagctcactaaacaacacccatctgtgtctctgcagcagtacaaaaactttatgagcagcatctgtaattccctttttgaagccttatttccaggctcttcatactcgacacgcttctccgccctcaccatattaggctcaatcgccgaagtgtttcacgtgcccgagggaaggatttacacggtgtaccagctgtcccacgatatcgatgtgggtagattccagactctcatggaatgtttcacctcgacatttgaggatgtgaagattctggccttcgatttactgatgaagctaagtaagaccgcggtacacttccaggactccggaaagttacagggtctgttccaggcagccttagagctctcaacgtctacgaagccttacgactgtgtgactgcctcttatctgctgaacttccttatctggcaggacgctcttcctagcagtttatctgcctatctcactcagcaggttgcttgcgacaatggggacagaccagcagccgtggtggagcggaacaccctaatgggtctctattag

SEQ ID NO: 31139 - DNA, 2268 bp, Artificial Sequence
  Description of Artificial Sequence: Synthetic coding sequence
atgtctggcaccaatctggacggcaatgacgaatttgacgagcaactacggatgcaggagctctatggcgatggcaaagatggtgacacacagactgacgcgggaggagagcccgatagcttgggacagcaacccaccgacaccccttacgagtgggatctagataagaaggcctggtttcccaaaatcactgaagacttcattgccacttatcaggccaattatggcttcagtaatgacggagcatcgagctccaccgctaacgtcgaggacgtgcacgcgcgtactgcagaggaacccccacaggaaaaagctccagagcccacagatgcaagaaagaagggagaaaaacgcaaagcagagagtggatggtttcacgttgaagaagaccggaacacgaacgtgtacgtttctggtctcccacctgacattaccgtcgatgagtttatccagctcatgtctaagtttggaattataatgagagatccacaaactgaagagtttaaagtaaagctgtataaggataaccagggtaacctcaaaggagacggcttgtgttgctacttaaagagggagtccgtcgagttagcattaaaactactggatgaagatgagatcagggggtataagctgcacgtggaagtcgccaaatttcagctcaagggtgaatatgacgcgtctaagaaaaaaaagaaatgtaaagactacaagaagaagctgtctatgcaacaaaagcagctcgactggcgaccagaacgccgagccggaccctctagaatgaggcacgaaagagtagtaattatcaaaaatatgttccatcctatggactttgaagatgatccactggttttaaacgagattcgggaagacctgagggtggagtgcagtaagttcggccaaatcagaaagctccttttgtttgatcggcatccagacggcgtagcatcagttagctttcgggatcctgaggaagccgattattgtattcagacactggatgggcgatggttcggcggtcggcaaattactgcacaggcgtgggacgggacaacagattatcaagttgaagaaacctcaagagagagagaggaaaggctacgagggtgggaggcctttctgaacgcgccagaagccaacaggggcctccgcaggagcgattctgtcagtgcgtccgaacgcgctgggccaagcagagcccgtcacttctcagagcacccatctacgagcaagatgaacgcccaagaaacagccaccgggatggcatttgaagagcctatcgatgagaagaaattcgagaaaacagaggatggtggagaattcgaagagggggctagcgaaaacaatgccaaggaaagcagtccagagaaagaagccgaggaaggctgcccagaaaaggaatccgaggagggctgcccaaagagagggtttgagggaagctgtagccagaaggagagcgaagaaggcaatcctgtgcgcggatcagaggaagacagcccgaaaaaagaaagcaagaagaagacattaaagaacgactgcgaggagaacggactggcaaaggagtccgaggacgacttaaacaaagagtctgaagaggaagtggggccaactaaggaaagtgaggaggacgacagtgaaaaggagtctgacgaagattgtagtgagaagcaaagtgaggatgggagcgagcgcgagtttgaggagaatggccttgaaaaggacctagatgaggaaggatctgagaaagaactgcacgagaatgtgctggacaaggagttggaagaaaacgattcagaaaactctgaatttgaagacgatggaagcgaaaaagtgctggacgaggaaggttctgagagggagtttgatgaagatagtgacgaaaaggaggaggaagaggacacatatgaaaaagttttcgatgacgaatctgacgaaaaagaggatgaggaatacgcagacgagaagggcctggaagccgctgacaagaaagctgaggaaggcgacgccgatgagaagctcttcgaggagtctgatgataaggaagacgaagacgccgatggaaaagaggtggaggatgctgacgagaaactttttgaggacgatgacagtaacgaaaagttgtttgatgaggaggaggactcatctgagaaactgttcgatgattccgacgaacgaggcacgctaggaggattcgggtccgtagaggaaggaccgctttctactgggtctagtttcatattgtcttctgacgacgacgacgacgatatctag

SEQ ID NO: 31140 - DNA, 432 bp, Artificial Sequence
  Description of Artificial Sequence: Synthetic coding sequence
atgaccaagatgtataaaggtttccaggcactgggggatgctgcagacataagatttgtgtacacaccagccatggaatctgtgtgcgggtatttccaccgttcacataacagatccgaggagtttctgattgctggcaaactgcaggacggcctcctgcatatcaccacttgctctttcgtggctccatggaactcgctcagtcttgctcagcggaggggcttcacaaagacttacacagtgggctgcgaagagtgcaccgtgtttccctgtctgagcataccctgtaagctccagtctggcacccactgtctgtggacggaccaactgctccaggggtcagaaaaagggttccagtcaaggcatttggcgtgtctaccgagagaacctgggttatgtacctggcagtcccttagatcgcagattgcctag

SEQ ID NO: 31141 - DNA, 786 bp, Artificial Sequence
  Description of Artificial Sequence: Synthetic coding sequence
atgcccctgaccagcggttctagcacccctcctccatggcgagtgagcgccgacacctcgactggcccaactaccgcggctcgctctttctccttattagtaagacatcgcccaagagcactttgtcacaccaatcagtctctggggcgtgggctggcaacaactcgaggacggggaagtgacggaaacgggcctacgggcaacggagaccaccctaacttttccctcagcgaaggtcgggcttttggtagtttagccgcacagcccatcaccagttgtttgagtgtgcccgctccacccttcagccttgggaagctacaagatgggctgttacacataacaacgtgtagtttcgttgccccttggaacagtctgagtctggcccagaggaggggcttcactaagacttatactgtgggttgtgaggaatgtacggtgagcgcatggacactgacaagtaacgggagatcatttcctggcccatttcctaaatcctgggcttgctttttactgcccctggccatcctgtgtccctgcgggtgctctccaaccctccgggctgtgccagacttgagttgttacttcccaaaaccggagacagcccctctccagatcttggctgctccattcccatgcgtgcagtatcgcgtgatcacatgcccttcactggtcccccttatcctgccttgtgactactctgtcatccccttgcccgtgcccgagccacctgggctattcctcggcagcccagagtgttctccaaggacccagtcagctgttccttag

SEQ ID NO: 31142 - DNA, 291 bp, Artificial Sequence
  Description of Artificial Sequence: Synthetic coding sequence
atgccagtttattccgcctggcccgcagaacccactatggcaccatttgagccattagccagtggcattctgctgttactatggttgatcgcacccagcagagcctgtacctgtgtcccccctcacccccagaccgctttttgcaatagcgatctggtcatcagagcaaagttcgtcgggacacccgaagtaaaccagaccactctttaccaacggtacgaaattaagatgaccaaaatgtacaaaggtttccaggccctgggggacgccgcagatatcagatttgtgtag

SEQ ID NO: 31143 - DNA, 498 bp, Artificial Sequence
  Description of Artificial Sequence: Synthetic coding sequence
tagccacgggctttgtgtcacactaatcagtccctgggacgcggtttagcaacgacccgcggaagggggtctgatgggaatggacccacgggcaatggggatcaccctaacttttccttgtcggagggcagagccttcggtagcctggcagcacagcccataacatcatgcctgagcgtcccagccccaccattttctcttggaaaactgcaggatgggcttcttcacattaccacatgcagcttcgtcgcgccttggaattcactgagcctggcccagcgcaggggctttactaagacatatacggttggatgcgaagaatgtacagtgttcccatgtctgtcgataccttgtaaacttcagagcgggactcattgcttgtggacagatcaactcctgcaggggagcgagaaaggctttcagtcccgacacttggcttgcctgccaagagagcccggactgtgcacctggcagtcactgcggagccaaatcgcctag

SEQ ID NO: 31144 - DNA, 411 bp, Artificial Sequence
  Description of Artificial Sequence: Synthetic coding sequence
atggctccttttgagcctctcgcgtcaggcattttactgttgctgtggctgatcgccccttcccgcgcatgcacgtgcgttcctcctcatcctcaaaccgccttctgcaattctgacctggtaatcagggcaaagttcgttggcaccccagaagtgaatcaaactacgctttaccagagatacgagattaaaatgactaaaatgtataagggatttcaggcactaggagacgcagccgacatcagatttgtgtacacccccgctatggagtctgtgtgcgggtatttccatagatctcataataggtctgaagagttcttgattgccggagaagctccatcccccagaccagtgccacaccagcccgtccctggagctagaccgtcaaaccacgaaggcgctcgcttgtag

SEQ ID NO: 31145 - DNA, 663 bp, Artificial Sequence
  Description of Artificial Sequence: Synthetic coding sequence
atgggtgcagcggctcgcactttaaggctggctctggggctcctgttgcttgctacactgcttagacctgcggacgcctgtagctgttcacccgtgcacccgcagcaggccttctgtaatgcggacgtggtcattagggccaaggcagtgtctgagaaagaagtggattccggtaacgatatatacgggaaccccatcaagcggattcaatacgagattaagcaaattaagatgttcaaggggcctgagaaggatattgagttcatatacaccgctccctcatctgccgtgtgtggcgtttccctcgacgtgggagggaagaaggagtacctgattgccggaaaggctgagggggatggaaagatgcatattacgctatgtgactttattgtcccatgggacaccctgtctactacccaaaagaaaagcctgaaccatcggtatcagatgggatgtgagtgcaagatcacacggtgtcctatgatcccctgttatatcagctcccctgacgagtgtctttggatggattgggtgaccgaaaagaacatcaatggacatcaagcaaagtttttcgcgtgtataaagcgctctgacggcagctgcgcctggtacagaggcgctgctccgcctaagcaagagtttttagacattgaagatccctag

SEQ ID NO: 31146 - DNA, 432 bp, Artificial Sequence
  Description of Artificial Sequence: Synthetic coding sequence
atgttcaagggtccagaaaaagatattgaatttatctacacagccccatctagcgcagtatgcggtgttagtctggacgtgggtggcaagaaagaatacctcatcgctggcaaggcagagggtgatggtaagatgcatataacactgtgtgacttcattgttccttgggatacactgagcaccacacagaagaaatctctgaaccaccgatatcagatgggatgtgagtgcaagattacaaggtgtcctatgatcccttgttacatctctagtcccgatgagtgtctgtggatggactgggtcacggaaaagaatatcaacgggcatcaggctaagtttttcgcttgtatcaagcgcagcgacgggagttgtgcctggtataggggcgctgctccacctaaacaagagttcctggatatcgaggatccttag

SEQ ID NO: 31147 - DNA, 636 bp, Artificial Sequence
  Description of Artificial Sequence: Synthetic coding sequence
atgacaccttggctgggtctgatagtgcttctggggtcttggagcctcggtgactggggcgcagaggcctgtacttgttctcccagccaccctcaggatgcgttttgcaatagcgacattgtgattcgcgctaaagtggtcgggaaaaaactcgttaaagagggcccttttgggaccctagtttataccatcaagcagatgaaaatgtaccgaggcttcacaaaaatgcctcacgttcagtacattcataccgaggcttctgagtcattgtgtgggctcaagcttgaggtgaacaagtatcagtaccttttgacgggcagggtttatgacggtaaaatgtacaccggactttgcaattttgtcgagcggtgggatcagctgaccctgtcacagcgtaaaggattgaattaccgctatcatttaggatgcaattgcaaaatcaagagctgttactacctcccttgcttcgttaccagcaaaaatgaatgcctgtggacagacatgttgagcaacttcggatacccaggatatcagagtaagcactatgcctgtataagacaaaaagggggttattgttcgtggtataggggatgggccccaccagataagtccatcatcaatgccacagatccttag

SEQ ID NO: 31148 - DNA, 438 bp, Artificial Sequence
  Description of Artificial Sequence: Synthetic coding sequence
atgaaaatgtatcgaggttttacaaaaatgcctcatgttcagtacattcacacagaagcttcagaatccttgtgtggtctcaagttagaggttaataaatatcagtatttgcttaccgggagagtgtacgacggcaagatgtatacgggtctgtgtaactttgtagagagatgggaccagctgacactgtcacagagaaagggcctgaactaccggtatcaccttgggtgcaattgtaagattaagagctgttactatctcccatgctttgtcacttccaaaaacgagtgtctctggaccgatatgttgagcaacttcggatacccagggtaccagtcgaaacactatgcctgcatcagacaaaaagggggatattgcagctggtatcggggttgggcccctcccgacaaatccattataaacgccactgacccttag

SEQ ID NO: 31149 - DNA, 675 bp, Artificial Sequence
  Description of Artificial Sequence: Synthetic coding sequence
atgcccggaagcccaagaccggcaccttcatgggtccttctactgcggctgctggctctcctgcgtccccctggcttgggcgaagcctgtagctgtgctcccgctcacccgcagcagcatatctgtcactcagctctagtaattagagcaaagatcagcagtgagaaggtagtcccggcaagtgctgatcccgctgatacagaaaagatgcttagatatgagattaaacagatcaagatgtttaaaggcttcgagaaagtaaaagatgtacaatatatatacacgccattcgactccagtctgtgcggtgttaagctggaagccaacagccagaaacagtacttgctaacgggccaggtgctctctgacggcaaggtgtttatccacttatgtaattacattgagccatgggaggatctcagcctcgttcagagagagtcactcaaccaccactatcaccttaactgtggctgtcagatcacaacatgttacacagtgccctgcactatttccgctcccaatgaatgcctctggaccgactggttattggagagaaagttgtatgggtaccaggctcagcactacgtttgcatgaaacatgtcgatgggacctgtagctggtatagaggtcacctcccgctgcgcaaggagtttgtggatatcgtgcagccctag

SEQ ID NO: 31150 - DNA, 1164 bp, Artificial Sequence
  Description of Artificial Sequence: Synthetic coding sequence
atggtgcactgctcgtgcgtccttttcaggaagtacggaaacttcattgataagctccggctgttcacgagagggggatctggaggaatgggttatcccagattgggaggtgagggcggaaaaggtggggatgtttgggtcgttgctcagaaccgcatgactctaaagcagctgaaagacaggtatcccagaaaacggttcgttgcgggtgtgggggcaaatagcaagatttccgccctgaaaggctccaaggggaaggattgcgagataccggtccccgtaggcatttcagtgacagatgagaatggtaagatcatcggggagctaaataaggaaaacgatcggattctcgtagctcaaggaggactgggagggaaactgctgactaattttttgcctttaaagggccagaagaggataatacacctggacttgaagctgatagctgatgtagggctggtcgggtttccaaacgccggaaagtcctccctactttcatgcgtatcacacgcaaaaccagctatcgccgactatgcttttactacgcttaaaccagaactggggaaaattatgtatagcgactttaagcagatatccgtggctgacctgcctggcctgatcgagggagcacacatgaataaaggaatgggacacaagtttctcaaacacattgagcgtaccaggcaacttctgttcgtggttgatatttccggcttccagctgagctcccacacgcaataccgaactgcatttgaaacaataatcctgttgaccaaagaactggagctatataaggaagaactccagactaaacccgcattgctggccgtgaataagatggatctgcccgacgcccaagacaaattccacgagctgatgagtcaattgcagaaccccaaagattttcttcacctgtttgagaagaatatgatccccgaacgcaccgtggaattccagcatatcatccccatctctgccgttactggagagggcattgaagagctgaagaattgcatccgtaaaagcctggatgagcaagctaaccaagagaacgatgcactccacaagaagcagctcttgaacctgtggattagcgacacaatgagttccactgaacccccaagcaagcacgcagtcacaaccagcaaaatggacataatctag

SEQ ID NO: 31151 - DNA, 375 bp, Artificial Sequence
  Description of Artificial Sequence: Synthetic coding sequence
atggaccctgcccgacccctcggcctttcaattctcctgttatttcttacagaagcagctctgggtgacgctgcccaggaaccaacaggcaacaatgcggagatctgcctgctacccctggactatggcccatgtcgtgctctcctgctacgttactattatgaccgctacacccagagttgccggcagttcctatacggcggttgtgaaggaaatgccaataacttctacacctgggaagcctgcgacgatgcctgctggcggatcgagaaggtgcctaagctgagctctatgactagcttaaaaaagaagaagaaaatgcctaagttgcggttcgcttcgcgcattcgcaaaatacgtaaaaagcaattctag

SEQ ID NO: 31152 - DNA, 1506 bp, Artificial Sequence
  Description of Artificial Sequence: Synthetic coding sequence
atggcagcagcctcggttacaccccctggatctctggagttgttacagcctgggttctccaagacactcctaggaaccaaactggaggccaagtatctgtgtagtgcctgccgcaatgtgctgcgcaggccattccaggcgcagtgtggccaccgctattgctctttctgcctcgcatctatcctctcctctggcccacagaattgcgcagcatgcgtacatgagggaatttatgaggaaggaatatctatattagaatcatcaagtgcattccctgataatgccgctaggagggaggtagaatcgctaccggcagtgtgtccctccgatggctgcacctggaaaggtactcttaaggagtacgaatcctgtcacgaaggcagatgtccgctgatgttgactgagtgtccagcgtgcaaagggctagtgagactgggagaaaaagagcgccatcttgagcacgaatgtccagaaagaagcctgtcttgccggcattgccgcgcaccttgttgcggcgctgatgtgaaagctcaccatgaggtgtgccctaagtttccacttacctgcgatgggtgtgggaagaaaaagattcccagagagaaatttcaggaccatgtgaagacgtgcgggaagtgtagggtgccttgccggtttcacgctatcgggtgtttggaaactgtcgagggggagaaacagcaggaacatgaggttcaatggctgcgagagcatctcgcgatgctcctctcaagtgtactggaagccaaacccctgttaggtgaccagtcccacgcaggctccgagctgctccagcgatgtgaaagcctcgaaaaaaaaaccgcaaccttcgagaacatagtatgtgtgcttaacagagaggtagagagagtggccatgaccgctgaagcctgttcaagacagcacagattggatcaagataaaatagaggcgctttcttcgaaagtacagcaattggaacggtctatcggcctgaaggatttggcgatggcagatttggaacaaaaggtgttggagatggaagcctctacctacgatggagtgtttatatggaagatttccgactttgctcggaaaaggcaggaagcggtggcaggtaggatccctgccattttcagcccagcgttctataccagtcggtacgggtataagatgtgcctgagaatctatctgaacggggacggtacgggtcgagggacccacctctcccttttctttgtcgtcatgaagggcccaaatgacgcactcttacgctggcctttcaatcagaaggttacactcatgcttctggatcagaataatcgggaacacgtgattgacgcttttcgcccagacgtgacatcatctagttttcagcgaccagtaaatgacatgaacatcgcatcaggatgtcccctattctgcccagtcagcaagatggaagctaagaattcctacgtccgcgacgacgcaattttcataaaggccatcgttgacttaactggactctag

SEQ ID NO: 31153 - DNA, 1662 bp, Artificial Sequence
  Description of Artificial Sequence: Synthetic coding sequence
atggccgcagccagcgtcactccccctggttctctggagctgctccagcctggttttagcaagacccttttggggacaaaactggaggccaagtacctgtgtagcgcctgcaggaatgttctccgccgacctttccaagcacagtgtggacacagatattgcagtttttgtctggctagcatactatcctccggtccacagaactgtgctgcatgtgtacatgaggggatctacgaagagggtattagtattctagagagctcatccgccttccccgataatgcagccagaagggaggtcgaatctctccccgcagtttgtccttctgacggctgcacttggaaaggcactcttaaggagtacgaggtcaagatgcccgcttgcggaatggtgactgaggcgccagccgtgggatcacggcctaggagtccctccagctacgacctcgtgctgcacgtccctctgactggtgccgaggcctgcttaatgagcgtagaagaggaaacagagttgctcttgcgttcttgtcatgaaggcaggtgtccactgatgctgacggagtgtcctgcctgcaaggggcttgtgcgtctgggcgaaaaagaacggcacctggagcacgaatgccccgagagatcactgagttgccgtcactgcagggcaccctgctgcggggcagacgtcaaagcccaccacgaagtgtgccccaaattccctctgacctgtgacggctgcggcaagaagaagatacctcgtgagaagttccaagatcacgtgaagacttgtgggaaatgcagagtgccctgccgttttcatgccatcggttgcctggagactgtggagggagaaaaacagcaagagcacgaggttcagtggctgcgagagcacctcgccatgctgctgtctagtgttctcgaagctaagcccctgctgggcgatcaaagccacgctggcagcgaactgctccagcgctgtgaaagcctcgagaaaaagaccgccacattcgagaatatcgtgtgcgtactgaatcgggaagttgagcgagttgccatgactgcagaagcttgttcaaggcagcacaggctagatcaggataaaattgaggccctgagcagtaaagtgcagcagctggaacgatcaatcggactgaaggacttagcaatggcggatctggagcaaaaggtacttgaaatggaggcttctacttatgacggcgttttcatctggaagatatctgatttcgctaggaagaggcaagaggctgtcgccggacgtatccctgccatttttagccccgcattctacacgagcaggtacggctacaaaatgtgcctcaggatctacttgaatggtgatgggaccggcagaggaacccatctttcattattttttgtggtcatgaagggacccaatgacgctctgttacgctggcctttcaatcaaaaggtaactctaatgttgctcgatcaaaacaatcgggagcatgtcatcgatgcttttcggcctgatgtaacatcaagtagcttccaacgtcccgtcaacgatatgaacattgcttccgggtgtcctctgttttgccctgtatccaagatggaggccaagaactcatacgtgcgggacgacgcaattttcatcaaggccattgtcgacctaaccggcctatag

SEQ ID NO: 31154 - DNA, 1269 bp, Artificial Sequence
  Description of Artificial Sequence: Synthetic coding sequence
atggcggctgccagcgtaacacctcctgggagtctggagctacttcaaccaggcttttcaaagactcttctgggaaccaagctcgaagctaaatacctgtgtagcgcctgcagaaatgttctcagacgcccattccaggctcagtgtgggcatcggtactgtagcttctgcttggcatccatactctcctcagggccacaaaactgcgctgcctgcgttcacgagggaatatacgaggaggggatcagcattttggagagctcttcagccttccctgacaatgcagcgaggagggaagtcgagagcttgcccgcagtgtgcccttcagacggttgtacatggaaagggaccctcaaagagtatgaggtaaagatgccggcttgcggaatggtcacggaagcaccagccgtcggctcacgcccaagatccccctcttcgtacgatctggtactgcatgtgcctctcaccggggctgaagcttgtttaatgagtgtcgaggaagagaccgaactgctcttaaggtcctgtcacgagggccgatgtccactcatgcttactgaatgtccagcctgcaaggggctggtgagactgggtgaaaaggagaggcatttggaacatgaatgtcctgagcgttccctgtcatgtcggcattgtcgagctccttgttgtggtgctgacgtgaaacgacttgaccaggataagatagaggctctgtcctccaaagtgcaacagcttgaacggagtattgggttgaaggacctcgccatggcagacctggaacagaaggtgttagagatggaagccagtacctacgacggcgtttttatctggaagatcagcgatttcgccagaaaaagacaggaggccgtggccggacggatacccgcaatctttagtccggctttctacacgtcccggtacggatacaaaatgtgcctgcgaatctatttgaatggggacgggacggggagaggaacccacttgagtctgttctttgttgtgatgaaaggtccaaatgacgccctactcaggtggccctttaaccagaaagtgacactgatgttactcgatcagaataaccgggagcacgtcatagatgcttttcgacccgacgtgacgagctcctcctttcaacgccctgtgaatgatatgaatatagctagcgggtgccctctgttctgccccgtttcgaaaatggaggcgaaaaacagctatgttcgggacgacgccatcttcataaaggcaatagtggacctgaccgggctgtag

SEQ ID NO: 31155 - DNA, 366 bp, Artificial Sequence
  Description of Artificial Sequence: Synthetic coding sequence
atggcagccgcttcagtgacccctcccggtagtcttgagctcctccagcccggtttttcgaagacattgctcgggactaagttagaggcaaagtacctgtgctcagcgtgccgtaatgtcctgagacgtccctttcaggcccaatgcggccacaggtattgctccttttgtctggcatccatcctgtcctcaggcccacagaactgcgctgcatgcgtgcatgaaggtatctatgaggaggggatatccatactcgagtctagctccgccttccccgataacgctgccagacgcgaagtggagtccctgccagctgtgtgtccttccgacggatgtacatggaaggggactcttaaggaatattag

SEQ ID NO: 31156 - DNA, 519 bp, Artificial Sequence
  Description of Artificial Sequence: Synthetic coding sequence
atggctgctgcctcagtaacaccgcctggaagccttgagctcttacagccaggcttctccaaaacactgctgggtaccaagttggaggccaagtatctgtgctccgcatgtcgcaacgtgcttaggcgcccttttcaggcccagtgcggtcatcgctactgtagtttttgcctcgcaagcattctttccagcgggccacagaattgcgccgcttgtgtccacgaagggatatacgaggagggtatcagtatcttagaaagctcctcggcgtttccggacaatgccgctaggcgcgaggttgagtctctgcctgcagtgtgcccctcagacgggtgcacctggaaaggaacacttaaagagtacgaaagctgccacgaagggcgatgccctttaatgctgacagaatgtccagcttgcaagggacttgtccggctcggagagaaggagcggcaccttgagcacgagtgcccagagagatccctcagctgtaggcactgccgtgcgccttgctgcggttag

SEQ ID NO: 31157 - DNA, 582 bp, Artificial Sequence
  Description of Artificial Sequence: Synthetic coding sequence
atggctgctgcatcagtgaccccacccggatccctggagcttttgcagcctggattctctaagaccctgttaggtactaaactggaggctaaatatttatgcagcgcatgcaggaacgtactccgcaggccattccaggctcaatgcggccatcgatactgttccttttgtcttgcgtctattctgtcctcaggtcctcagaactgcgctgcatgcgtccatgagggcatctatgaagaaggaatctctatcctggagagcagttccgctttccccgacaacgccgcacgcagggaagtagagtctctgcccgcagtctgtcctagtgacggttgcacttggaaaggtacactgaaggagtatgagtcctgccacgagggacgatgtcccctaatgctgacagaatgccccgcttgtaagggcctcgttaggttgggtgaaaaagagaggcaccttgagcatgagtgcccagagcgtagcttatcctgtcgacactgcagggccccttgctgcggggctgatgttaaagctcaccacgaagtgtgtccaaaattccccctgacctgcgacgggtgcggatag

SEQ ID NO: 31158 - DNA, 1503 bp, Artificial Sequence
  Description of Artificial Sequence: Synthetic coding sequence
gtggctggcagggccttaagttccggtcgtgcagccactgtgggggctctctttgccggagtgaccgccttgatggcagccgcttccgtgactccaccaggttctctagagctgctccagcccggtttctctaagacactgctgggaacaaaactcgaggctaagtatctttgcagtgcctgccggaacgtgttgaggagaccgttccaggctcagtgcgggcatcgctattgtagtttctgcctggctagcatactgtcgtccggaccacaaaattgtgctgcatgtgtgcatgaaggcatttatgaagaaggaatatctattctggaaagttccagtgctttccctgataacgcagcccgtagagaagttgaatctcttcctgccgtctgtcccagcgacgggtgcacatggaaggggacactgaaagagtatgaatcttgccatgaggggaggtgtcctctgatgctgaccgagtgtcctgcctgtaaaggcctggtgcgactgggagagaaagagagacacctggagcatgagtgtcctgagcggtccctatcttgccggcactgtcgcgctccgtgttgcggtgcagacgtcaagtttcaagaccacgttaaaacttgcggcaagtgtagagttccatgtagattccacgccattggctgtctcgaaacagtagagggcgagaaacaacaggaacacgaggtgcagtggctcagagaacaccttgctatgcttttgagtagcgttctcgaggcaaagcccttattgggagaccagagccatgccggaagtgagttacttcagcggtgtgagtcgttggagaagaagaccgcaaccttcgaaaacattgtctgcgtgctgaacagagaggtggagagagtcgcaatgactgctgaggcttgcagtcgacaacatagacttgatcaggacaaaattgaagccctgagctcaaaagtccaacagctggaacgcagtatcggtttaaaagacctagccatggcggatcttgagcaaaaggtcctcgagatggaagctagcacatacgacggtgtgtttatttggaagatttccgacttcgcgcgtaaacgccaggaagcggtggcgggacgcatccccgcaatcttcagcccagcattctacactagccggtatggctataaaatgtgcttgcgtatctatctcaacggagatggcaccgggcgtggaactcacttgagtctttttttcgtcgttatgaagggtcccaacgatgctttgcttcgctggccatttaaccaaaaggtaaccttgatgctgctcgaccagaataaccgggagcacgtgattgacgcatttagacctgacgtaacttctagtagctttcagaggcccgttaacgacatgaacatagcttcaggatgcccactgttttgtcctgtgagtaagatggaggcgaaaaacagttacgtgcgcgatgatgccatattcattaaagccatcgtcgacctgaccgggctgtag

SEQ ID NO: 31159 - DNA, 1506 bp, Artificial Sequence
  Description of Artificial Sequence: Synthetic coding sequence
atggctgccgcttcagtgacacctccaggcagcctcgagctcctgcagcccggattctctaagaccctccttgggaccaagttggaggccaagtatctctgcagcgcttgcaggaacgtcctccggagacctttccaagcacaatgtgggcatcgctattgctcattctgcctggcaagcatcctatcatccggcccacaaaattgcgcagcctgtgtgcacgagggcatttatgaggaggggatttctatccttgagagtagttcagccttccccgataacgccgctagacgagaggtggagtccctgcccgctgtgtgtccaagtgacgggtgcacttggaaagggacgctgaaggagtatgagtcttgccatgaaggtagatgccccctcatgttgacagaatgtccggcttgtaaggggctggtgcgacttggcgaaaaggagagacacctggagcatgagtgccctgagcgaagtttgtcatgtaggcattgccgggcaccttgctgcggggctgacgtgaaggcccaccatgaggtgtgtccaaaattcccattaacttgcgacggttgtgggaagaagaagatccccagggaaaaattccaagaccacgtaaagacatgtgggaagtgccgggtgccatgccgattccacgcaattggatgtctggagactgtggagggcgaaaaacagcaggagcacgaggtccagtggctgcgcgagcatctcgctatgttattgagcagcgtgctggaggccaaaccactactcggcgaccagtcccacgctggatccgagctgctgcagaggtgcgagtctttggaaaaaaaaaccgcgacctttgaaaacatcgtttgcgtgctcaatcgggaagtggaacgggtggctatgactgccgaggcttgttcccgtcagcacaggcttgatcaggacaaaatcgaagcgctgtcttctaaagtgcagcagctcgaaagatcgataggcttgaaagacctggcaatggctgacttggagcagaaagtgctcgagatggaagcctccacgtatgacggcgtgtttatctggaagatctcagacttcgctcgtaagcgccaggaggccgtggcaggcagaatccctgccatattctctccagcattctacacctcacgctacgggtataagatgtgccttcgcatatacctgaatggagatgggacaggcagagggactcatctgtcccttttcttcgtagtgatgaaaggcccaaatgacgctctgctgcggtggcctttcaatcagaaggtcactctgatgctgttagatcagaataacagagaacatgtgattgacgcctttaggccagacgtaacctcctcctctttccaacgaccagtgaacgacatgaatattgccagcggatgtcctctcttctgccccgtgtcgaaaatggaggctaaaaactcctatgtgagggatgatgcgatttttattaaggccatcgtcgacctgaccggactgtag

SEQ ID NO: 31160 - DNA, 1632 bp, Artificial Sequence
  Description of Artificial Sequence: Synthetic coding sequence
atggagtcctccaagaagatggactccccgggagccctgcagaccaatcctcctctaaaactgcacactgatagaagtgctggaactccagtattcgtgcctgagcagggcggatataaggaaaagttcgtcaagaccgtcgaggataagtacaagtgcgaaaaatgccacctggtcttgtgctcccccaagcagaccgaatgtgggcatcgcttttgcgaaagttgcatggctgcgctgctctcgtcatcctctccaaaatgtactgcctgtcaggagagcatcgttaaggacaaagtgttcaaggacaactgttgcaagcgcgaaatcctagcgttacagatctattgcaggaacgagagccggggttgtgctgagcagttaatgctgggccacctactggttcatctaaaaaatgattgccattttgaggagctgccttgcgtgagacctgattgcaaggaaaaggtgctgagaaaggacctgagagaccatgtagagaaggcttgcaaatacagggaggcaacatgtagccattgtaagtctcaggtcccgatgatcgccctgcagaagcacgaggacaccgattgcccatgtgtggtcgtcagctgccctcacaaatgctctgtgcagaccttattgagatctgaaggtacaaaccagcaaattaaggcacatgaagcctcctcagcagtgcagcacgtaaatctactgaaggaatggtctaatagccttgagaaaaaagtctctctgctccagaacgagagcgtcgagaaaaacaaatcaatccaaagcctgcacaatcagatttgctcgtttgaaatcgaaattgaacgtcagaaggagatgctgcgcaacaacgagagcaaaattctgcacctccagagagtgatcgacagccaggctgagaaactgaaggagctcgacaaggagattcgtccatttcgtcagaactgggaagaggccgattctatgaagtcgagcgtggagtcactacaaaaccgtgtgacagagctggagtccgtggacaagagtgcgggtcaggtcgcccgtaatactggtttgctcgagtctcagctgagcaggcacgatcagatgctgtccgtacacgacattcgattagcagatatggacctgcgttttcaggttctggagaccgcatcttataacggggtccttatttggaagattagagactataagcgccgaaagcaggaggctgtcatgggcaaaactctgtcactttacagccagcctttctacacaggatacttcggttataagatgtgtgcacgtgtttatctgaatggtgacgggatgggcaagggtactcatttaagcttgtttttcgtgatcatgcgtggcgagtatgatgcgctcttgccatggccatttaagcagaaggttaccctgatgcttatggaccagggctcttctagaagacacctgggagacgcttttaaacctgacccaaactcaagctcattcaagaaaccgacaggagaaatgaatatagcttctggatgtcctgtattcgtggcccagacagtgctcgaaaacgggacttatattaaagacgacaccatttttatcaaggttatcgttgacacgagcgatttacctgatccctag

SEQ ID NO: 31161 - DNA, 1632 bp, Artificial Sequence
  Description of Artificial Sequence: Synthetic coding sequence
atggagtctagtaaaaagatggattcccctggcgctttacagactaatccgccattaaagctgcatactgaccgatcggccggaacccccgtgtttgttcctgaacaggggggatataaggagaagtttgtaaagaccgtcgaagataaatacaagtgcgagaagtgccatttggtcctatgctccccgaagcagaccgaatgcggacaccgtttttgtgaaagttgcatggcggctctcttgtcaagttccagcccaaaatgtacagcttgtcaggagtctatcgtgaaggataaagttttcaaagataactgctgtaagagggagatcttggccctacagatctattgtcgcaatgagtcaaggggctgcgctgaacagctaatgctgggccacctgctggtgcacctcaaaaatgactgccactttgaagagctgccgtgcgtcaggccagattgtaaagaaaaggtccttagaaaggacctcagagatcatgtggagaaggcttgtaagtaccgggaagctacctgcagtcactgtaaatcccaagtgcccatgatcgcattacagaagcacgaagatacagactgtccctgtgtggttgtcagctgcccacataaatgctctgttcaaactcttttaaggtctgagggcaccaatcaacagatcaaagctcatgaagcatcctccgcagtccagcacgtgaacctgctcaaggaatggtccaactctctggaaaaaaaggtgtcactgttgcagaatgaatcagtggagaaaaacaagtccatccagtccctgcacaatcaaatttgttcctttgagatcgagatcgagaggcaaaaggagatgttgaggaataacgaatccaagattctgcacttacaacgcgtcatagactctcaagcagaaaagctgaaagagctggataaggagatccgaccattccgtcaaaactgggaggaggccgatagcatgaagagcagtgtggagtctcttcagaaccgcgtgactgaactcgagtcggtcgataagagcgctggccaggtggcccgaaacactggacttctggaatcccagctgtctcgccatgaccaaatgctttctgtccacgacatccgtctggccgatatggacctccgcttccaggttctggagaccgcctcatataatggtgtgctcatttggaaaatcagggactataaaaggaggaagcaggaggcggtgatgggtaaaacgttgtctctttacagtcaacctttttacacaggttacttcggctataaaatgtgtgcacgcgtgtacttgaatggggacgggatgggcaaaggaacacacctgtctttattttttgtgatcatgcggggagagtacgacgctctgctcccgtggccgttcaagcaaaaggtgaccttaatgctgatggaccaaggctccagcaggcgacacctgggggacgcattcaagccagatccaaactcttcctcgttcaagaagcccactggcgaaatgaacattgcttctggatgtccagtatttgtggcacagactgtcctggaaaacggcacatacatcaaagatgacactatcttcatcaaagtgatcgtagacactagcgatctcccagacccatag

SEQ ID NO: 31162 - DNA, 1707 bp, Artificial Sequence
  Description of Artificial Sequence: Synthetic coding sequence
atggaatccagcaaaaagatggactctcctggagccctacagacaaaccctccccttaaactccacacagatcgctccgctggtacaccagtttttgtgcccgagcaaggtggctacaaggagaagttcgtcaagactgtcgaggacaaatataaatgcgaaaaatgccatttggtgctttgcagcccaaagcagacagaatgtgggcaccgcttctgcgagtcctgtatggcagccctcctctcctcctccagccctaagtgcactgcatgccaagaatctatagtcaaagacaaggtgtttaaagacaactgctgcaagagagaaatcctcgcactccagatttactgccgaaatgagagtaggggctgcgcagagcagctgatgctcgggcatctcctggtgcacctcaaaaatgactgtcactttgaagagctcccttgtgtgcgccctgactgcaaggagaaggtcctgcgtaaggacctgcgcgatcatgtagaaaaggcatgtaaatatcgcgaggcaacctgcagccactgtaagagccaggtgcccatgattgcattacagaagcatgaggatacggactgcccttgtgtggtggtgagctgcccacacaaatgctccgtgcagacgctactgagaagcgagttgtccgcccacctgtctgaatgcgtaaacgcgccttccacatgcagcttcaaaaggtacggctgcgtattccagggaaccaaccagcagatcaaagcgcacgaggcatcttctgcagtgcaacatgtaaatctgttgaaagagtggtccaactctctggagaagaaggtgtcactgcttcagaatgagagtgtggagaagaacaaaagcattcagtcactacataatcaaatctgttcctttgagatagagattgagcgccaaaaggaaatgctgaggaacaacgagtctaagattctgcacctgcagcgcgtgatagatagccaggccgagaaactgaaggagctggacaaggaaatcaggcctttccgccaaaactgggaggaggctgacagcatgaagagctcagtagagtcgttgcagaaccgcgttaccgagctggaaagtgtagacaaaagcgccggtcaggtcgctcgtaatacgggattgctggaatctcagttgagcagacacgaccagatgttgagcgtccatgacatcaggctggccgacatggacctgagattccaggtgctggagaccgccagttacaacggagtgctcatttggaaaatccgggattacaagcggcgtaagcaggaagctgtaatgggaaaaacgctctctttgtatagtcagcccttctatacaggatattttggctataagatgtgtgcgagagtgtacctgaacggcgatggtatggggaagggaactcacctctctctgtttttcgtaatcatgcgcggagaatacgacgcccttctcccctggccctttaaacagaaagtgaccctgatgctgatggaccaaggaagcagtcggaggcaccttggcgacgccttcaaaccagatccaaactctagctcctttaagaaaccaacaggagaaatgaatattgccagcgggtgcccagtgttcgtggcccaaacagtgctggagaacgggacctacatcaaggatgataccatctttatcaaagtgattgtggacaccagcgatctgcccgacccctag

SEQ ID NO: 31163 - DNA, 1458 bp, Artificial Sequence
  Description of Artificial Sequence: Synthetic coding sequence
atggagtcttctaagaagatggactcaccgggtgcgcttcagacgaacccccctctcaaactccacactgatcggtctgccggaaccccagttttcgtgcctgagcaagggggatataaagagaagttcgtcaaaactgtagaagataaatacaaatgcgagaagtgtcatctcgtactgtgttcacctaagcagactgagtgtggccatcgattttgcgaatcttgtatggctgccttactgtcaagcagttcccccaagtgtacagcctgtcaggagtctatcgtgaaggacaaggtgttcaaggacaattgttgcaagcgggaaatcttagcactccagatctattgtaggaatgaatcaagggggtgtgcagagcagcttatgttgggccacctgctggtccatttgaagaacgattgtcattttgaggaactgccgtgcgtgcgacccgactgtaaggaaaaagtcttgaggaaggatctgagagatcatgtggagaaggcttgcaagtaccgcgaagctacctgttctcactgcaagtctcaagtgcctatgatcgctttgcaggtctcactcctgcagaacgagagtgtggagaaaaacaagtcaatccaaagtctgcacaaccagatctgttcttttgaaatcgagatcgagaggcagaaggagatgttgcgcaacaacgagtctaaaattcttcaccttcaacgcgtgattgatagtcaggccgagaagctcaaggaacttgataaggagatacgaccattccgccagaattgggaagaggccgactccatgaagagcagcgttgaaagccttcagaaccgcgtaaccgaactcgagtctgtggacaaaagcgctggccaggtggccagaaacaccgggctgttggagagtcagctatcccggcatgatcagatgctaagcgtgcatgatataaggttagccgacatggacttacgctttcaggtcctggaaactgcctcctacaatggagtgctgatctggaagattcgcgactacaagaggaggaaacaggaggccgtaatgggaaagactctttccctctactctcagcccttctacaccggctacttcggatataaaatgtgtgccagagtgtacttgaatggagatggcatggggaagggaactcatctgagcctgttctttgtaatcatgcgtggtgagtatgacgcgctactgccgtggccattcaagcagaaggtgaccttgatgctgatggaccaggggtcttctaggcgccacctcggcgacgcattcaagcctgacccaaatagctctagttttaagaaaccaacgggagagatgaatatcgctagtgggtgtccagtgtttgtggcacaaactgtgctcgagaatgggacatatattaaggacgacacaattttcattaaggttatcgttgacacatccgatctgccggacccttag

SEQ ID NO: 31164 - DNA, 1707 bp, Artificial Sequence
  Description of Artificial Sequence: Synthetic coding sequence
atggaatcatcaaaaaaaatggatagtcctggggcactgcagacaaatcctcccttaaagctgcacactgatagaagtgctgggaccccagtttttgtgccagagcagggcggatacaaagagaagttcgtgaagacagtggaggacaaatacaaatgcgaaaaatgccaccttgtgttatgctcccccaaacagacagagtgcgggcaccgcttctgcgagtcctgtatggccgctttgctgagttcttcctctccaaaatgtaccgcctgtcaggagtcaatcgttaaggacaaggtctttaaagacaactgctgtaaaagagaaatccttgctctgcagatctactgccgtaatgagagccgtggatgtgccgagcaactgatgcttgggcatctgctggtgcacctcaagaacgactgtcatttcgaggaactcccttgtgtaaggccggactgcaaggaaaaggtgttgaggaaagacttgcgcgatcatgtggagaaagcgtgcaagtacagagaggcgacgtgctcccactgcaaaagccaggtgcctatgattgccttgcaaaagcatgaggacaccgattgcccctgcgtggtggtctcctgcccacataagtgttctgtacaaacactactcaggtcagaactttcagcacacctcagcgagtgcgttaacgctccatccacatgcagttttaaaagatatggttgcgtgtttcagggcacaaaccagcagatcaaagcccacgaggcttcctcagccgttcaacacgtcaatcttctcaaggaatggtccaatagcctggaaaaaaaggtttctctgctccaaaacgaatcagtggaaaaaaacaagtcaatccaaagcctgcataatcagatatgcagctttgaaattgaaattgaacgacagaaagagatgcttaggaacaatgagtccaagattctgcatctgcagagggtgatcgacagtcaagcagagaaacttaaagagttagacaaagagatcaggccttttcggcaaaattgggaggaggctgatagtatgaagagcagtgttgagtcacttcagaaccgcgttacagagttggagtccgtcgacaaatccgccggtcaggtggctcgaaacaccggactgttggagtcccagctgagccgccatgaccagatgctatccgtgcatgatattagactggccgatatggacttgcgcttccaggttctcgagacggcatcttacaatggcgttctcatttggaagatcagagattacaagagaagaaaacaagaggctgtcatggggaagaccctctccctgtatagtcaaccattctacacaggctacttcggttataaaatgtgcgcccgtgtatatctgaacggcgacggcatggggaaaggcacacacttgtctctcttcttcgtaatcatgaggggcgagtacgacgctctactaccctggccatttaagcaaaaagtcaccctgatgttaatggaccaggggagcagtcggagacacctgggcgacgcttttaaacctgaccccaactcaagctcgtttaagaaacctacaggagaaatgaatatcgcaagtggatgccccgtttttgtggcacaaactgtgctcgagaacggaacttacataaaggacgacacaatatttatcaaagtgatcgtagataccagcgatctgcccgatccttag

SEQ ID NO: 31165 - DNA, 285 bp, Artificial Sequence
  Description of Artificial Sequence: Synthetic coding sequence
atggagagttctaaaaagatggactcccctggggcactccaaacaaaccccccactcaagcttcatacagaccgttcagctgggaccccagtcttcgtgccagaacaggggggttataaggagaagtttgtgaagaccgtggaggacaaatataagtgtgagaaatgccacctggttttgtgttcacctaagcagactgaatgtggccacagattttgcgagagttgcatggcagctttgcttagcagttcttcacccaagtgcactgcttgtcaagaatcatag

SEQ ID NO: 31166 - DNA, 939 bp, Artificial Sequence
  Description of Artificial Sequence: Synthetic coding sequence
atggcagctggccagaatggccacgaggaatgggtgggctctgcctacctgttcgttgagagctctctcgacaaggtggtcctgtcggatgcgtacgcgcacccccagcagaaagtcgccgtgtacagagctttgcaggccgcactcgccgaatcggggggaagtccagacgttttgcagatgctcaagatccacagatcagatcctcagttgattgtgcagttacgcttctgtgggagacagccatgtgggaggtttttacgcgcatatagagagggggctctgcgagccgcactgcaacggagcttagcagctgccctggctcagcactccgtgccgctgcagttggaacttagagctggtgccgaacggctggatgccttgctcgccgatgaggaacgctgcctgagctgcattttagcccagcagccggatcggttgcgtgatgaggaactcgctgagcttgaggacgctctccgcaacttaaagtgcggaagtggagcaagagggggtgacggagaagtggcgagcgcccctctccagccgcctgtcccatccctctccgaagtcaaacccccacctcctccaccaccagcacagacattcctcttccagggccagcccgtcgttaatcgacctctgtcccttaaggaccagcagacgtttgccaggagtgtgggcttgaagtggagaaaggtagggcgaagtctgcagagaggctgtcgcgcacttcgggatcccgctctcgattccttggcctacgaatatgagagagagggcctttacgagcaagctttccagctgcttagacggtttgtgcaggccgaaggtcgcagggcgactctgcagcgcctcgtggaagctctagaggagaatgaactgacatcacttgccgaggatttgctgggattgaccgacccaaatggagggctcgcctag

SEQ ID NO: 31167 - DNA, 825 bp, Artificial Sequence
  Description of Artificial Sequence: Synthetic coding sequence
atggccaccaccgtatccacgcagagagggccagtatatattggggagctgcctcaggacttcctgaggataaccccaacacaacaacagcggcaagtacagctggacgcacaggccgcacagcagttgcagtacggaggtgccgtggggacggtggggcgactgaacatcaccgtggtgcaggcaaaactagccaaaaattatggaatgactagaatggatccatattgccgcctgcgcctcgggtacgctgtgtatgagacaccaactgctcataatggtgcgaagaacccacgttggaataaagtcatccactgcaccgtccctcctggggtagactcattttacttggagattttcgatgaacgcgcttttagcatggacgacaggattgcctggacacacataaccattcctgaatctctgagacagggaaaggttgaggataaatggtatagcctgtcaggcagacaaggcgacgataaggagggaatgatcaacttggtcatgtcttatgccctgctgcctgcggcaatggtgatgccaccccagcctgtggttttaatgcctacggtctaccagcagggcgtgggctatgtcccaattacgggcatgccagcagtctgttcaccgggaatggttcccgtggcccttcctcccgctgcggtcaacgcgcaaccccgttgctctgaggaggatttaaaagccattcaggatatgtttcctaacatggaccaggaagtcatcagatccgttttagaggcccagaggggaaacaaggatgccgcaatcaacagcctgctccagatgggggaggagccctag

SEQ ID NO: 31168 - DNA, 1059 bp, Artificial Sequence
  Description of Artificial Sequence: Synthetic coding sequence
caactgtcaccctctcaggcccctgctggagcgcaggaggtggccagaagagttacggtgggcagcgcctcacacggaggccgaaggagcaccatggcaaccacagtttcgacacaaaggggccctgtctacatcggggaactgccccaggacttcctccggattacccccacccagcagcaaaggcaggtgcaactcgacgcccaggctgctcaacaactgcaatacggaggggcagtcgggaccgtgggcaggttaaacatcacagtcgtacaggctaaactggccaagaactacgggatgacccgcatggacccctactgtcgcctgcggttgggctacgctgtgtatgaaacccctaccgcccacaacggcgcaaagaatcctcgatggaacaaagtgattcactgcaccgtgccccctggagtagactctttctacctggagatcttcgacgagcgcgcattctctatggacgatcggattgcctggacccatattactatcccagagtcccttcgccaaggcaaagtggaagataagtggtactctctaagcggtagacagggtgatgataaagagggcatgatcaacttggtgatgtcctacgccctactaccagctgccatggtcatgcccccacagccagttgtcctgatgccaaccgtctatcaacaaggcgtgggctacgtgcccatcaccggcatgcccgctgtatgcagccccggaatggtacccgttgcattgcccccagccgctgtgaacgcccagcctcggtgctcagaagaggatttgaaagcaattcaggacatgtttcccaacatggaccaggaggtgatccggtcggtcctcgaggctcagcgtggcaacaaggacgccgcaattccaagccacttggtcttagggggtctctccgccctcagctgtccatgggatgtgcgcttgtcttttagctgccgctccggcaagtgctcatgttgcagagaacagctactgttgccaggttgctggagatggtggtcggctttccggtttcactcctggcatttcgtgatgtag

SEQ ID NO: 31169 - DNA, 675 bp, Artificial Sequence
  Description of Artificial Sequence: Synthetic coding sequence
atggccacaacagtgtccacccaacgagggcctgctaagttggctaagaactatggaatgacccgcatggatccatactgtcggctgaggctcggatatgcagtttatgagactcccacagcacacaatggggctaagaacccaaggtggaataaggtgattcactgtaccgtgccaccaggcgtggactctttttacttggaaatattcgacgaaagggctttcagtatggatgaccggattgcctggactcacatcaccattccggagtcactgagacaggggaaagtcgaggacaagtggtactcactgtctggacgccagggggacgacaaggaaggaatgatcaacctggtgatgagctacgctctcctgcctgcagcaatggtgatgccacctcagccagtggtcctaatgcctacggtgtatcaacagggggttggatacgtgccaatcaccggtatgccggcagtatgttccccaggcatggtgccagtggccttgccaccagcagcggtgaatgctcagccaagatgtagtgaggaagatctgaaagccattcaggatatgttcccaaacatggaccaggaagttattagaagcgtgctcgaagcacaacgaggtaataaagacgcagccatcaactccttgcttcagatgggcgaggaaccttag

SEQ ID NO: 31170 - DNA, 768 bp, Artificial Sequence
  Description of Artificial Sequence: Synthetic coding sequence
atggctagctcaacctcacttccagcaccaggctcccgccctaagaagccactgggaaaaatggccgactggttcaggcagacactactgaagaaaccaaagaaacgccctaactcacccgagagtacatcttccgacgcctcccaacccacctcgcaggactccccactacctccaagtctctcaagcgtgacctctccatccctaccacctacgcacgcaagcgatagcggctcttcacgctggtccaaagattatgatgtctgtgtgtgccactctgaggaagaccttgttgccgcacaggatttagtgtcgtatttggagggctcgacggcatccctgcggtgcttcttgcaactgagggacgccaccccaggaggtgccatcgtatccgagttatgtcaggcgctaagttcctcccattgtcgtgtgctgctaattacacccggattcctgcaggacccctggtgtaagtatcaaatgttgcaagccttgaccgaggcccctggagccgaaggctgcaccatccccctcctttcgggcctgtcccgcgcagcctacccccctgagttgaggttcatgtactatgttgacggacgtggcccagacggagggtttcggcaggtcaaggaagcagtaatgcgatctaaccaggtgctgaagcacttgctctaccacggcacccctgaaatcggcgtcaaactggagacagaaaacccctgccgcgcatccgactctcacaaatgtgataagaggtatagggagtag

SEQ ID NO: 31171 - DNA, 708 bp, Artificial Sequence
  Description of Artificial Sequence: Synthetic coding sequence
atggcaagctctacaagtcttcccgctcccggttcacgccctaaaaaacctttgggcaaaatggcagactggttcagacagacgttgctgaagaaacccaagaagcgccctaattcccctgagtccacttcaagtgatgcttcccagcctacctctcaggattccccactgccccctagcctcagtagtgttacctcgccaagcctgcccccaacacacgcctccgacagtggtagttcacggtggtcaaaggactatgatgtgtgcgtgtgccatagcgaggaagacctcgttgccgcacaggacttagtgtcttatctcgagggctctaccgcctcattgcggtgcttcctgcagcttcgggacgcaaccccgggaggggcaatagtcagcgagctgtgtcaagccctcagcagcagtcactgcagagtgctgctcatcaccccgggtttcctgcaggatccttggtgcaagtaccagatgctgcaggcccttaccgaggcccctggagctgaaggctgcaccatccctctgctctctggcctgtcccgagccgcttatcctcctgaactacgctttatgtactacgtcgacggcaggggcccagatggagggttcaggcaagttaaggaagccgtaatgcgctgtaagctgctgcaggaaggggaaggcgagcgagattccgctacagtatctgatctgctctag

SEQ ID NO: 31172 - DNA, 666 bp, Artificial Sequence
  Description of Artificial Sequence: Synthetic coding sequence
atggccagtagtacgtcactgcctgcaccgggtagccgcccaaaaaagccactggggaaaatggccgactggttccgccagaccctacttaaaaaaccgaagaagcggccaaattctcctgaatcgaccagttcagacgcgagtcagccgacaagccaggatagcccgctgcctccttctctgagtagcgtgacaagtccgtccttgccaccgacccacgcttccgattcgggaagctcacgctggagtaaggattacgatgtttgcgtctgtcacagtgaggaagaccttgtggctgcccaggatctggttagctacctggagggctccactgcaagcctacggtgttttctgcagcttagggatgcaaccccaggtggggctatcgtcagcgagctgtgtcaagctctgagctcctcccactgccgggtcttgctcatcactcccggttttctgcaggacccatggtgtaaataccagatgctccaagctctaacagaagcaccaggtgcagaaggctgcaccatacctcttttatccggtctctccagagcagcttacccacccgaactgaggtttatgtactatgtggacggaagggggcctgacgggggtttccggcaggtgaaagaggcagtgatgcggtatctccagaccctatcatag

SEQ ID NO: 31173 - DNA, 666 bp, Artificial Sequence
  Description of Artificial Sequence: Synthetic coding sequence
atggcctcttctaccagccttccagctcctggatctcgtcctaagaagccactggggaaaatggctgactggtttaggcagacgttactcaaaaaacccaaaaaacgccctaatagccccgagagtacttcttccgatgcttcgcagcctaccagtcaggactccccgctgcccccatcgctaagctctgtgacatcccccagcctgcctcccacccacgcaagtgatagcgggtccagtcgttggagcaaggattatgacgtgtgtgtgtgccacagtgaagaggacctcgtggctgcccaggatctcgtgtcgtacttggagggcagtacagccagcctccgctgtttcctgcagctgcgcgatgctacccccggaggagcgattgtgtcagagctgtgccaggccctaagcagcagtcactgcagagtcttgctcatcacccccggatttctgcaggacccatggtgtaaatatcagatgctgcaggccctcaccgaggccccaggagcagaggggtgtaccatcccactactttctggtctgtccagagccgcttaccctcctgagctgagattcatgtattacgttgacggccgtgggccagatgggggatttcggcaagtgaaggaagcagttatgcggtatttgcagaccctgtcatag

SEQ ID NO: 31174 - DNA, 666 bp, Artificial Sequence
  Description of Artificial Sequence: Synthetic coding sequence
atggcgtcctctacatcattgcctgccccaggatcgcgacctaaaaaaccgctgggtaagatggctgactggtttcgccagacactactcaagaagcccaagaaacgacctaactcgcccgagagcacaagcagtgatgcaagccaaccaacatcccaggactcacctctgccgccatctctttcatccgtgacgtccccatcactacccccaacgcacgcatccgacagtggatcatctagatggtcgaaggactacgatgtttgcgtgtgccactctgaggaagaccttgtcgccgctcaggacctggtttcttacttggagggatctactgccagcctgagatgcttcctgcagctgcgggacgccaccccgggtggagcaattgtgtccgagctctgccaagcattgagttcaagccattgccgagtgctgctgattacccctggatttctgcaagacccttggtgtaagtaccaaatgctgcaagcattgaccgaagctccgggtgccgaagggtgtactataccacttctgtctgggctgtctagggcagcctacccaccagagctaagatttatgtactatgtcgacggcaggggacccgatggcggtttccggcaagtcaaagaggcagtgatgcgttaccttcaaacactcagttag

SEQ ID NO: 31175 - DNA, 2520 bp, Artificial Sequence
  Description of Artificial Sequence: Synthetic coding sequence
atgatgagcgctagccgccttgctggtactctgatcccggcaatggcctttctgtcttgcgtgaggcctgaatcatgggaaccatgtgtggaggttgttcctaatatcacctatcagtgcatggaattgaacttctacaaaatacccgacaatttgccgttctccacgaagaatctagatctcagttttaacccacttaggcacttgggatcctattcgttcttttccttcccagagctccaggtgctcgacctgagcaggtgtgagatacaaactattgaagatggcgcataccagtcactctctcacttgtccacgctcattttgacgggcaatcctatccaatcgttagccctgggcgctttttcagggcttagcagtcttcagaaactagtggctgtggagacgaatctggctagtctggagaactttccaatcgggcacctaaagactctcaaggaacttaacgtggcccataatctgatccagtccttcaagctgcccgagtacttctcgaatctgacaaatctggaacaccttgacctctcgtctaataagattcagtccatttattgcaccgacctcagagtactgcatcagatgccactcctgaatcttagcctggatttatctttgaatcccatgaactttatacagccaggggctttcaaggaaataaggctccataagctcaccctacggaacaatttcgattcacttaacgttatgaagacctgtatccaaggtctggccggactcgaagtgcataggcttgttctgggcgagttccgcaatgaaggcaacttagagaagttcgataagtccgcccttgagggactatgtaatctcacaatcgaggagttcagactcgcctatctcgattactacttggatgacatcatcgatttgttcaactgcctgaccaatgtgtctagtttcagtcttgtgtcggtgaccatcgagcgcgtcaaagatttttcttacaattttggttggcagcacttggagttagtcaactgtaaattcggccagtttcctacattgaagctcaaatccctgaagcgtcttacgttcacctcaaacaagggaggtaacgctttctccgaggttgatcttccttccctggagttcctggatcttagtagaaatggactaagcttcaagggatgttgctctcaatccgacttcgggacaacttcactgaagtacctggatctcagttttaatggcgtcatcacgatgtcctccaattttctcgggctggagcaattggaacatctggattttcagcattcaaatctgaagcaaatgagcgaattcagcgtgtttcttagcctgcgaaatcttatatacctggacatctcacatacacacacaagggtcgcctttaacggcatctttaacggattatccagtctggaggtccttaagatggctgggaattccttccaggagaacttcctgccagacatctttactgagctccgaaatttaacatttctcgatctctctcagtgccagctcgagcaattaagccccactgctttcaactctctgtcatctctgcaggtgttgaacatgagccacaataactttttttccctcgacaccttcccttataaatgcctgaacagtttgcaagtcttggattattccctgaaccacattatgacatccaagaaacaggagctgcagcattttccttcgagcttggcttttttgaatctcacccagaacgactttgcgtgcacctgtgaacaccagtctttcctgcagtggattaaagatcaacgccagctcttggtggaggtggaacgcatggagtgcgccacaccgagcgacaaacagggcatgcccgtgctgtcgctgaatatcacgtgtcagatgaacaaaaccatcatcggtgtgtcagtgctttctgtcttagtggtttccgtcgtggctgtgctggtctataaattctactttcacctgatgctgctagccggatgtattaaatatggccgaggcgaaaacatctacgacgcttttgtgatatacagctcacaggacgaagattgggttagaaacgagctggttaagaatctggaggagggcgtgccaccctttcagctttgtctgcactatagggatttcattccaggagttgctatcgcagcaaatatcatccacgagggctttcacaaatctaggaaagttatagttgttgtcagtcaacactttattcaaagccgttggtgtattttcgagtacgaaatcgcccagacatggcagtttctctcaagtcgggcagggatcatatttatcgtgctgcagaaagtcgaaaagaccctcctccgacagcaggtagaactctatagactactcagtcgtaatacctacctggaatgggaagactccgttctcggcagacacatcttttggcgtcgtctgagaaaggccctcctggacggcaaatcctggaaccctgagggaaccgtcgggaccggctgtaactggcaagaagcgacgtccatctag

SEQ ID NO: 31176 - DNA, 2400 bp, Artificial Sequence
  Description of Artificial Sequence: Synthetic coding sequence
atggaattaaatttctacaaaatccccgataacctgcccttcagcacaaaaaatctcgacctgagttttaaccctctacgccatctgggttcctacagtttctttagctttcccgaacttcaggtcctcgacctcagtagatgtgaaatacagacgatcgaggatggagcctaccaaagcctgagccatctgtcaacactgatccttaccggcaatccgatccagtccctggcactgggcgctttttctggtctcagcagcctgcagaaattagtcgcagttgaaaccaatttggcatcactggagaattttccgatcggccacctaaagactcttaaagaactgaacgtcgcccacaacctcattcagagctttaagctcccagaatacttttccaacttaacgaacctcgagcacctggaccttagcagcaataagattcaatcaatttactgtaccgatctaagggtactgcaccagatgccactgttaaacctgtcccttgatctatccctcaatccaatgaactttattcagcctggagcctttaaggagatccggctgcataagttgacattacgtaacaatttcgattctttaaacgtgatgaaaacctgcattcaaggattggctggactggaagtgcatagactagtactgggggaatttcgaaatgagggtaatctcgagaagttcgacaaaagcgccctcgaggggctctgtaatctcacgatcgaggaattccggctcgcctatttagattactatctggatgacatcatcgatctgttcaactgcctgactaatgtgtccagtttttccttggtaagtgtgacaattgagcgggtcaaggacttcagctacaatttcggatggcagcatctcgagttggtgaactgcaagttcggacagtttcctacgctcaaattgaaatctctcaagaggttgacatttaccagtaacaaggggggtaacgccttctccgaggttgaccttccatctctggagtttctcgatctttctagaaacggtctgtcatttaagggctgttgtagccagtccgacttcggaaccacgagtttgaaatatcttgatctctcttttaatggcgtcattactatgagttctaatttcttgggactggagcagctggaacatctcgactttcagcacagtaatctgaaacagatgtccgaattttcagtgttcctgtcacttagaaatttgatttacctcgatatatctcacacccacacaagggtcgctttcaatggaatatttaacggcctttcttccctcgaggtccttaaaatggcgggtaattccttccaggaaaatttcctccctgatatcttcactgaactgcggaacctcaccttcctcgatttgtcacagtgtcagctcgaacagttatctcccacggctttcaacagtttgagtagcctgcaggtactgaatatgagtcataataacttcttctcactggatactttcccctacaagtgcctgaattcccttcaagtgttagactacagcctcaaccacatcatgaccagtaagaagcaggagctgcagcatttcccatcctcactcgcctttcttaatctaacccagaatgacttcgcctgtacttgtgagcatcagtccttcctacagtggatcaaagaccaacgacaactgcttgttgaggtggaaagaatggagtgtgccaccccgagtgacaaacagggcatgcctgtccttagccttaacattacatgccaaatgaataagacgattatcggggtcagtgtactctccgtacttgtggtctctgtggtcgcagtcctggtgtataagttttactttcatctgatgctgctcgccggatgcataaaatatggtagaggcgagaatatctacgacgctttcgtgatctacagttcacaagatgaggattgggtacggaacgagttggtgaagaatctggaagagggggtcccgcctttccagctttgcctacactaccgtgatttcattcccggtgtcgcaatcgctgctaacattatccatgagggctttcataagtcacgcaaggtgatcgtcgtggtttcccagcacttcattcagagccgttggtgcattttcgagtacgaaattgcccaaacctggcagttcttgtcatctagggccggtatcattttcatagtgctccagaaggtggaaaaaacactcttgcgacagcaggtcgagctataccgtttgctcagccgaaatacctatctcgaatgggaagactcagtcttaggtagacacatcttctggagacgactgaggaaagcactgctggatgggaagtcatggaacccagagggaaccgtgggtacaggctgcaactggcaagaagcaaccagtatttag

SEQ ID NO: 31177 - DNA, 2577 bp, Artificial Sequence
  Description of Artificial Sequence: Synthetic coding sequence
atgggcgaccacctggatctgctactcggagtcgtccttatggctgggcctgtctttggtataccttcttgttccttcgacgggcgtattgccttttaccgcttctgcaacttaacccaagtgccacaggtcttgaacaccacagaacgactcttgttgagtttcaactacatcaggacagtaaccgcatcttctttccctttcttagagcagttgcaactgctggagcttggaagccagtacacaccactgacgattgacaaagaagcatttagaaatcttccgaatctgagaatacttgatttagggtcgtcaaaaatttattttttgcatcctgacgcattccaggggttgtttcatctttttgaattgaggctctacttctgcgggctgagcgatgccgttctgaaggatggctatttcaggaatcttaaagctctcactcgactcgatttgtctaaaaaccaaatccgctcactatatcttcatcctagctttggcaaactgaatagtctcaaaagcatagacttttcatctaaccagattttcttagtatgtgagcacgaactggagcctctgcagggcaagacactctctttcttttcccttgcggcaaatagtctgtattctcgggtgtctgtcgattggggcaaatgtatgaaccctttccgaaacatggtcctggaaatcctcgacgtgtctggtaatggctggacagttgatataacagggaatttcagcaatgctatctcgaagagccaggcgtttagccttatcctagcccatcacattatgggagctggcttcggcttccacaacattaaggaccctgaccagaacacttttgccggtctagcccgaagttctgttcgtcacttggatttgtcccacggctttgtcttctccctgaactcccgggtgttcgagacgctcaaagacctcaaagtcctgaacctcgcttataataaaatcaacaagatcgcagacgaagctttctacggcctggataacctgcaggtgttaaatctttcctacaaccttctgggtgaactgtactcaagcaatttctatggactccctaaagtcgcttacatcgacctgcagaaaaaccacatcgctatcatccaggaccagaccttcaagttcttggaaaagctgcaaacgctcgacctcagagacaatgccctcaccacaatccactttatcccaagtatccccgacatttttctgagcggcaataagctggtgacgctgccgaaaataaatctgaccgcaaacttgatccacctcagtgaaaatcgcttggaaaacctggatatcctatacttcctgctgagagttccacacctgcaaattctcatcctgaaccagaatagatttagctcatgcagtggggaccagacaccaagcgagaacccttcgctggaacagctgtttctgggggagaacatgctgcagctcgcttgggagactgaactctgttgggacgtgttcgaaggcctgtcacatttacaggtgttgtaccttaatcataactacctgaactctctcccacccggtgttttttctcatttaacagccctccgaggactgtctcttaactccaaccggcttactgtcctttcgcataatgatctccccgctaatctcgagatattggatatctcccgaaaccagcttctcgctcccaaccctgatgtttttgtctccttatctgtcctggacattacacacaacaagttcatatgcgagtgcgaactcagtacctttattaactggctaaatcacactaatgttacaattgcagggcctccagctgatatctactgcgtttacccagattcttttagtggtgtgagcctgttctccctcagcaccgagggatgtgatgaggaagaagtgttgaaatctctgaaattttcactgttcattgtgtgcacagttacccttacactttttctgatgactatcttgacggtcaccaagtttagaggattctgttttatttgttacaagaccgctcagagactcgtttttaaagaccacccgcaaggcacggaacccgatatgtacaaatatgatgcgtacttgtgtttctcctccaaggactttacgtgggtacagaacgcccttctgaaacacctcgacacacagtactccgaccagaatcgcttcaatctgtgtttcgaagaacgtgactttgtccctggagaaaacagaatcgccaacattcaagatgcaatctggaatagtcgtaaaatagtttgtctcgtcagccgccacttcttgagagacggctggtgtttagaggcctttagctatgcgcaaggacgctgcttgtccgatctgaactccgcattgattatggttgtggtggggtcgctgtctcagtaccagcttatgaagcatcagtctattcggggttttgttcagaagcagcagtaccttcggtggcctgaggacttccaggatgtgggctggtttctccataagctgtctcagcaaattttgaaaaaagagaaagaaaagaagaaggacaacaacattccactgcagactgttgcaactatcagctag

SEQ ID NO: 31178 - DNA, 2577 bp, Artificial Sequence
  Description of Artificial Sequence: Synthetic coding sequence
atgggcgatcacctagaccttctgctaggggtggtgcttatggctggaccggtgtttggaattccatcatgttcattcgacggacgtatcgccttctacagattttgtaacctgacccaagtgcctcaggttctgaatactactgaaaggttactgctgagcttcaattatattagaaccgtgaccgcatcaagcttccctttcctagaacagttacagctcctggagctgggttcacagtacacccctctgacaatagacaaagaagccttccggaatctgccgaatctgcgcatcttggatctgggatcatctaagatttattttctccaccccgatgcttttcagggcctgttccatctttttgaactgcggctttatttttgtggcctatcagacgccgtgctcaaagatggctacttcaggaatcttaaagcattgacaagacttgacctgtctaagaaccaaataagaagcctgtacctgcatccatcatttggtaaacttaattcactgaaaagtatcgacttttcaagcaatcagatatttcttgtctgcgagcacgaactcgagcctctccaaggaaagaccctttccttcttttcactggcggctaactctctgtattctcgcgtctctgttgattggggcaaatgcatgaaccccttccgcaatatggtgctggagattctcgatgttagtgggaacggctggaccgtcgatattaccgggaatttttccaacgccatcagtaagagccaggccttctctctgatcctagcacaccacattatgggggcaggattcggctttcacaacataaaagaccccgaccaaaacacctttgctggcttggccagaagttcggtgagacacctggacctgtctcatggctttgttttttccctgaacagcagggttttcgagactctgaaggacctgaaggttctcaacctggcctacaacaaaatcaacaaaattgccgacgaggccttttacggcctggacaatctgcaagtgctgaacctgagctataatcttctgggagaactctactcctcaaacttttacggcctgccgaaggtcgcctacattgatcttcagaagaaccatatcgcgattatccaggatcaaacttttaaatttctggaaaagctgcagacactggatctgagggataacgcactgaccaccattcatttcatcccctctatcccagacatttttctaagcggcaacaaactggtcactctccctaagatcaacctgaccgctaacctcatccatctgagcgagaacagacttgagaacctggacattctctactttctccttagagtgccccatctgcaaatacttattttgaatcagaataggttctctagttgcagtggcgaccaaacaccttccgaaaaccctagtctggagcagctcttcctcggcgaaaacatgctgcagctcgcctgggagactgagctgtgttgggacgtgtttgaaggactgagccacctgcaggttctgtatctcaatcacaactacctcaatagcctccccccaggcgtcttttctcaccttactgcactgcgcggactgtctttgaatagcaataggcttaccgtgttgtcacacaacgatctgcccgcaaacctcgaaatattggacatatccagaaaccagctgctcgcacccaacccagacgtgtttgttagcttgagcgtactggacattactcacaacaagtttatttgcgaatgcgagttaagcacattcatcaactggctgaatcatacaaatgtaaccatcgctggtccaccagcggacatctactgtgtttatcctgacagtttttccggcgtatctttattttcgctgagcaccgagggctgtgatgaagaggaagtgttgaagtccctaaagttcagtctctttattgtctgtacggtcaccctcactttatttctgatgacaatcttaactgtaaccaagttcagaggattctgctttatatgctataaaactgcgcagagactcgtctttaaggaccatcctcaaggcacggagccagacatgtacaaatacgacgcctatctgtgtttcagctctaaagactttacatgggtccagaacgcacttttgaaacatttggatacgcagtactcggatcagaatcgattcaacctctgctttgaagaacgcgacttcgtccccggtgaaaataggatagctaacatccaggacgcgatctggaacagcagaaaaatagtgtgcttagtcagccggcactttcttagggatggctggtgcctagaagcctttagctacgctcagggtcgatgtctgagtgatctaaactccgctttgatcatggttgtagtgggctcactgtcgcaatatcaactaatgaaacaccagtctatcagaggattcgttcagaaacagcaatacctccgctggccagaggactttcaagatgtcggctggttcctgcacaaactgtctcagcagatcctaaagaaagagaaggaaaaaaaaaaggataacaatattcctctacagactgtggctacaatcagctag

SEQ ID NO: 31179 - DNA, 66 bp, Artificial Sequence
  Description of Artificial Sequence: Synthetic coding sequence
atgggagatcacctggatcttttacttggggtggtgttaatggcaggtccagtattcgggatttag

SEQ ID NO: 31180 - DNA, 2577 bp, Artificial Sequence
  Description of Artificial Sequence: Synthetic coding sequence
atgggagatcacctggatctgctccttggggtggtcctgatggcgggacccgtgttcggaattccatcctgttcatttgatggcaggatcgctttctaccggttctgcaatttgactcaggttcctcaagtactgaacacaaccgaacggctgctcctcagtttcaactacataaggacagtcactgcttccagcttccctttcctggagcagctccagctcctcgagctgggctcacagtatactccgctgacgatagacaaagaggcttttcgcaatttgcctaatctacggattctggacctaggatcaagcaaaatatactttcttcaccctgatgctttccaagggttgtttcacctgttcgagctgcggttgtacttttgcggcctcagcgatgccgtgttaaaagacggctattttaggaacttaaaagctctcacgcgtctggatttatcaaagaaccaaatccgatctttgtacctccacccgtcatttgggaagttgaacagtctgaaatcaatcgacttttcctcgaaccagatctttctcgtgtgtgagcatgagctggagccactgcaaggaaaaacactctcttttttctctctggcggctaattcactctatagccgagtcagtgtcgactggggcaaatgcatgaatcctttccggaatatggtccttgaaatcctagacgtcagcggcaatggatggaccgtagacatcacaggaaatttctcaaacgccatcagtaaatcccaggcctttagcttgattttagcccatcatattatgggtgctgggttcggatttcataacattaaagatcccgatcagaacacattcgcagggctcgctagaagctcagttaggcaccttgacctgagccatggcttcgtattcagtctgaactccagagtttttgagacactcaaagacttgaaggtgttgaacctggcttacaacaagatcaataagattgcagatgaagctttctacgggctggacaacctgcaggtactgaatctgtcctataacctcttaggggagctatacagctcaaacttttatggattacccaaggtcgcctacatagatctccagaaaaaccatattgcgattatacaagaccagacctttaagttcttagaaaagcttcagaccctggatcttcgggacaacgctctaactacgatacacttcataccctctatccctgatatattcctttccggtaacaagctcgtaactttgccgaagatcaatttaactgccaacttaatacacctgtccgagaaccgcctggaaaatcttgatattttgtacttcctgcttcgcgtgccccacctccagattctaatcctcaaccagaatcggttctccagttgcagcggcgaccagacgccatccgagaacccgtcgcttgaacagcttttcctgggcgagaacatgctgcagctcgcctgggagacagaactttgctgggacgtgtttgaaggcctgtcacatctgcaggtactgtacctcaaccacaattacctcaattcgctgccccctggcgtcttttcccatttgaccgcgctgcgcggattaagcctcaacagcaataggcttaccgttctgtcgcacaacgatctgcccgctaacctagaaatcttggacattagcagaaatcaattattagcccctaatcctgatgtgtttgtgagtctgtctgttctcgatattactcataacaagtttatttgtgaatgcgagcttagcacatttatcaattggcttaaccacaccaacgtcaccatagcagggcctccagccgacatttactgcgtgtatccagactcctttagcggggttagcctattctccctgtccacagaagggtgcgatgaagaggaagttcttaagtcactcaaattctcgctctttattgtttgcactgtgactttgaccctgttcctgatgaccatccttacagttactaaattccggggattttgctttatctgctataagaccgcccaaaggctggtgtttaaggaccatccccagggcactgagccagacatgtataagtacgatgcttacctctgcttcagttccaaagatttcacctgggtgcagaatgctttacttaagcatctggacactcaatattcagaccagaacaggttcaatctgtgctttgaagagcgcgatttcgttcccggagagaaccggattgccaatatccaagatgccatatggaattcaagaaaaattgtgtgtttggtttcacgacactttctccgcgatgggtggtgcctcgaagccttctcttatgcccagggcaggtgcctctcagaccttaacagcgctctgatcatggttgtagtgggaagcctcagtcagtatcagttgatgaaacatcagagcatacggggatttgtccagaaacagcagtacctaagatggcctgaagacttccaagacgtaggctggttcctgcataagctctctcaacagatattgaagaaagaaaaggaaaagaaaaaagacaacaatatccccctccaaacagtcgcaaccatctcttag

SEQ ID NO: 31181 - DNA, 4836 bp, Artificial Sequence
  Description of Artificial Sequence: Synthetic coding sequence
caggtgagccctagtcaccccgttaatgaaaacatgcaagtcaataaaatcaagaaaaacgaggacgctaagaagagactatctgtcgagcggatctatcaaaaaaagacccaactcgagcatatcctgctgcgtcctgatacttatatcgggtctgttgagctcgtcacccagcaaatgtgggtgtacgatgaagatgtcggcatcaactaccgcgaggtcacattcgtccctgggctctacaagatattcgacgaaattctggtgaacgctgccgacaacaaacagagagaccccaagatgagctgtattcgggtgaccattgatcctgagaataacttgatttccatctggaacaacgggaagggaatccccgtggtagagcataaggtggaaaagatgtacgttcctgcccttatcttcgggcagctcctgacctcgtccaattacgatgacgacgagaaaaaagtgacaggaggaaggaacggctatggagccaagctgtgcaatatctttagcacgaaattcactgtggagacggctagccgggaatacaagaaaatgtttaagcagacatggatggacaacatgggacgggcaggggaaatggaactcaagccattcaacggggaagattacacatgcatcacctttcaaccagatctgtccaaatttaaaatgcagtctctggacaaagacatcgttgcactgatggtgaggcgcgcttatgacattgccggaagcaccaaggacgtgaaggtctttctcaacgggaataaactgcctgttaagggtttcaggagctacgtagatatgtaccttaaggataagctggatgagactggtaactcccttaaagtcatccacgaacaggtgaaccacaggtgggaggtgtgcttgaccatgtcggagaaaggcttccaacagattagtttcgttaactctatcgcaacatctaaggggggacggcatgtggattacgtggccgatcagatcgtgaccaaattggtggacgttgtcaagaagaagaataaggggggagtcgcagtcaaagcacatcagcggctcgagtgcagtggcacgatcagcgcacattgcaacctgcgcctacttggattctcggacagcctagcatctgcctcccgcgtggccgaaatcactgacatgcaccatcatatccagctgatcttcgtgtttctcatcgaaatgggcttttaccacgtcggtcaggctggcctcgagctgctcgcatccctggatccaccctcctcggcatcctgcgtatcccactgcacccagctgtttgtatcaaacttcatctacctgtttctcatctttctccggaggagcttcacattcgttactcaggccggagtgcagtgcacaatcagcccgacctcttctagcgtgctcgcccagtttttcgaatcattcttattcgttgccataggatgtgggatcgtcgagtccatcctcaactgggttaaattcaaggcccaggtacagttgaacaaaaaatgttctgccgtcaaacacaaccggatcaagggcattcctaaacttgacgacgctaacgacgccggaggaaggaattctacagaatgcacactgattctgacagagggagactctgccaagactctggccgtgtcagggctgggggttgtaggacgggataagtatggggtgtttccgctgagaggcaagattcttaacgtcagagaagcctcccataagcagattatggaaaacgcggagatcaacaatatcatcaaaatcgtgggactccagtacaagaaaaattatgaggatgaggacagtcttaagacgctgcgctacgggaagataatgatcatgaccgaccaggaccaggacgggtcccacatcaagggtcttttgatcaactttattcatcataattggccaagcttgttaaggcataggtttctggaggaatttataacccctatcgtcaaggtgtccaaaaataagcaggaaatggccttttactcgctccctgaattcgaagagtggaagtcttccacccctaatcacaagaaatggaaagtaaaatactacaaaggactcgggacaagtaccagcaaagaagctaaggaatactttgcagacatgaagaggcaccggatccagtttaaatacagtggcccagaggatgacgcagctatctcactggccttctctaagaagcagattgacgatcggaaggagtggttgaccaacttcatggaggacaggcgacagcggaaactgttaggcctcccagaggattacctctatggccagacgacaacctacctcacttataatgattttatcaacaaggaactaatcctattttccaattcagacaacgaacgcagtatccccagcatggtggatggacttaaaccagggcagaggaaggtactctttacatgctttaaaagaaatgataaaagagaggtgaaggtggcccagttggccggatccgtcgctgagatgagctcataccaccacggcgagatgagtcttatgatgacgattataaatttggcacaaaatttcgttggttccaataatctgaacttgttgcagcccattggtcagttcgggacgcgccttcacggaggaaaagactccgcctccccacgctacatttttacgatgctctcatcactagcacggctgctttttccgcctaaggacgatcataccttgaagtttctgtacgacgacaaccagcgcgtagaacctgagtggtatattcccattatacccatggtgctaattaacggcgcagagggtatcggaaccggttggtcatgcaaaataccaaattttgatgtccgagagatcgtaaacaatataaggcgattgatggatggagaggaaccgctcccaatgctgccttcatacaaaaatttcaagggaaccattgaggaattggccccaaaccaatacgttatctctggcgaggtagccatcctgaactcgacaaccatcgagatatccgaacttcctgtgcgaacgtggactcagacttacaaagaacaggtccttgagcccatgctgaatggcaccgagaagactccacctcttatcactgactatagagaatatcatacagatacaaccgttaagttcgtggtgaaaatgacagaagaaaagttggcagaagctgagcgcgtgggtcttcacaaagtgtttaagctccagaccagccttacttgtaactctatggttttgtttgatcatgttggctgcctgaagaagtatgatactgtccttgatatcttgagagactttttcgagctgcggttgaagtactatggtctgcgaaaggagtggctactgggcatgcttggggctgagagtgccaaactcaataaccaagcacgtttcatcctggaaaagattgatgggaagatcatcatcgaaaacaagcccaaaaaagaattaatcaaagtgcttatccagaggggatacgatagcgacccagtgaaggcatggaaggaggcccaacagaaggtccccgatgaggaggaaaacgaagagtctgataatgaaaaagaaacagagaagagcgacagtgtgacagactccggaccgacatttaactacctgctcgacatgcccctgtggtatctcactaaggagaaaaaggacgaactctgtagactgcggaacgagaaggagcaggagctagatactttgaaacggaaatcccccagtgatctctggaaggaagacctcgccacttttatagaagaactggaagccgtcgaggcgaaggagaagcaggacgaacaagtgggcttgcccggtaaaggtgggaaggcaaaaggcaagaagacgcaaatggccgaggtacttccctcgcctcgcggacagcgggtgatccccaggatcacgatcgaaatgaaagctgaagctgaaaaaaaaaataagaagaagattaaaaatgaaaacaccgaggggagtcctcaagaagacggagtagaactcgagggactgaaacaacgacttgaaaaaaaacagaagagggagccaggaaccaaaaccaagaaacagacaactctcgccttcaaacccatcaaaaaaggaaagaagcgcaacccctggtcagactccgaaagtgatcgcagctccgatgaatctaacttcgacgtgccaccacgagagactgagccacggagagctgctacaaaaaccaagtttacaatggatttagattccgacgaggactttagtgattttgatgaaaagacggatgacgaggactttgtcccaagcgacgcatccccgcctaaaacgaagacgagcccaaagttgagcaataaagagcttaaaccacagaaatcagttgtttccgatctggaagccgatgatgtgaagggttctgtgcctctcagcagttcaccgcctgccactcattttcctgacgaaacagaaataacaaatcccgtgcctaagaagaatgtcacagtgaaaaaaacagcagccaagagtcagtcaagcacatcaacgactggggcaaagaaacgggcagctcctaaagggactaaaagagatccagcattgaactctggagtgtctcagaaacccgaccccgcaaagaccaagaatcgtagaaaaaggaaaccgtccaccagtgacgattcagactccaatttcgagaaaatcgtgagcaaggcggtcacgagcaaaaagtctaagggtgagagtgacgatttccatatggatttcgatagcgcggttgcacctcgggctaagtccgttcgtgcaaagaagccgattaagtatctagaggagtccgacgaagatgaccttttctag

SEQ ID NO: 31182 - DNA, 4665 bp, Artificial Sequence
  Description of Artificial Sequence: Synthetic coding sequence
caagtctctcctagccatcccgtcaatgagaacatgcaagtcaacaagataaagaagaatgaggacgctaaaaaaaggctatctgtagaaaggatataccaaaagaaaacccaactggagcatatcctgctgcggccagatacctatataggtagcgttgaacttgtgacccagcagatgtgggtatatgacgaggacgtgggcatcaattacagagaggtgacttttgtgcctggactgtataagatctttgacgaaatcctggtgaacgctgccgacaataagcagagagaccccaaaatgtcctgcatccgggtcaccatcgatccagaaaacaatttaatctcgatctggaacaacggcaaaggaatcccggttgttgagcacaaagtggagaagatgtatgtaccagccctcatctttgggcagctgctgacgagtagtaattacgacgatgacgagaagaaggtgaccggtgggaggaacgggtatggggcaaagttgtgtaacatcttcagcacaaaattcacagtggagacagcttccagagaatacaaaaagatgtttaagcagacttggatggataatatgggaagggccggagaaatggaactcaaaccctttaacggagaggattacacatgcatcacttttcaacccgacctaagtaaattcaagatgcagtctctagataaggacatagtcgccctgatggtgcgccgagcctatgatattgctggtagcacaaaggacgtgaaagtcttcttaaatggtaataagttgcccgttaagggtttccgaagttatgtcgacatgtacctcaaggacaaactggacgaaacgggaaacagtctcaaggtgattcacgagcaagtcaaccatcgatgggaggtgtgcctgactatgtccgaaaaggggtttcagcagatcagctttgtcaactctatagccacctcaaaggggggaaggcatgtggactacgtggccgaccaaatagtaaccaaactggttgatgtcgtgaagaagaagaataagggaggcgtggcagtcaaagctcatcaggtcaagaatcacatgtggatcttcgtgaacgccctgattgagaaccctacattcgactcgcaaactaaagagaacatgaccctgcagccgaagtcctttggatccacttgccaactgtccgaaaaattcattaaggccgctcatctgtattccagattcctgattgatcccttcttccccaatatgatccctaatatgaatctcttccaggcgattggttgcggcatagtggaaagtatattgaattgggtaaaatttaaagcccaggtgcaactgaataagaaatgttctgcggttaagcacaaccgcatcaaaggaatccccaagctcgacgatgcgaacgacgctggaggccgtaacagcactgaatgtactttaatcctgacggaaggagacagtgcaaaaacactcgccgtgtcgggcttgggcgtcgtgggcagggataagtacggcgtcttcccattacggggtaaaattttaaatgtgcgtgaagcatcacacaagcagattatggaaaatgcagagatcaacaacatcattaaaatagtggggctccagtacaagaagaactacgaagacgaggactccctgaagacactgcggtacgggaaaattatgatcatgaccgatcaagatcaggacgggtctcacatcaagggccttttgatcaacttcattcatcacaactggccatcactgctgaggcataggtttctggaggaatttattacccccatcgtcaaggtaagcaagaacaaacaggagatggccttttactctcttcccgagtttgaagagtggaaatcttcaactccaaatcataagaaatggaaagtcaaatattacaaaggactcggtacatcaaccagcaaagaggcaaaggagtactttgctgatatgaagaggcatagaatccaatttaagtattctgggcctgaagatgatgcggcaatttccctcgctttctccaagaagcaaatcgatgatagaaaggagtggcttactaacttcatggaagataggaggcagaggaaattactgggactgcccgaggattatctctatggccaaaccaccacgtacttgacatacaacgatttcatcaataaggaactcatcttgtttagcaattctgacaacgaacgaagcatcccttctatggtcgacggtctcaaacctggccagagaaaggtgttattcacttgcttcaagcgcaatgacaagcgcgaggtgaaggtcgcccagctcgcaggcagcgttgcagagatgtcttcctaccaccacggggagatgtctctgatgatgactatcatcaatttggcccagaatttcgtgggaagcaataatctcaacttgctgcagcctatcggacaattcggcacccgtttacacggcggaaaagactccgcgtctcctaggtatatcttcacaatgctctctagtttggcaaggctcttgttcccaccaaaagacgaccacacgttaaaatttctgtacgacgacaatcagcgggttgagcctgagtggtacatcccgatcattccaatggtactgattaacggcgctgagggtattggcaccggctggagttgcaagatacctaatttcgacgtgagggaaattgttaataacatcagacgactgatggacggagaggagccacttcctatgctgccgtcctacaagaacttcaaaggcacaatcgaggaattagcgccaaatcagtacgtgatttcaggggaggtcgccattttgaattcgacaaccattgagatctcggagctgcctgtgagaacttggactcagacttacaaggaacaggtactggaaccaatgcttaatggcactgagaagacccctccattaataaccgattatagggagtaccacacagatacaaccgtcaagtttgtggtgaaaatgaccgaagagaagctggccgaagccgagcgggtgggactacacaaagtgttcaaattacagaccagtcttacatgtaatagtatggtgctgtttgaccacgtaggctgcctgaagaaatatgataccgtgttagacatcctgagggatttcttcgaactgcgactgaaatattatgggctgaggaaggaatggctattaggtatgcttggtgctgagtcagccaagctgaataaccaggcacgattcattctggagaagattgatggcaagatcatcatcgaaaataagcccaagaaggaactgattaaggtccttatccagcgagggtatgatagtgatccagtcaaagcttggaaagaggcccagcagaaagtgccggacgaagaggagaacgaagaaagcgacaatgagaaggaaactgagaaaagtgattctgtcacggactccggccctacttttaactaccttctcgacatgccactgtggtacctgacgaaggaaaagaaggacgagctgtgccgtttacgcaacgagaaagagcaagagctcgatactcttaaacgcaaaagtcctagtgatctgtggaaagaggaccttgcaacttttatcgaggagctagaggcagttgaggccaaggaaaaacaggacgagcaagtggggctccccggaaaaggaggaaaggcgaaggggaagaaaactcagatggccgaggtcctcccctcacctagggggcagcgggttattccacggataaccatcgagatgaaagctgaagctgagaagaaaaacaaaaaaaaaattaaaaatgaaaacactgaaggcagcccgcaggaggacggggtcgaactagaaggtctcaaacagaggctcgaaaagaagcagaaaagggagcccggtacgaaaacaaagaaacaaacaacccttgccttcaaacctattaaaaaggggaaaaaaagaaacccgtggtctgattcagaaagtgacaggtcatccgacgaatccaactttgatgtgccacctagggaaactgagccgagacgcgctgcaacaaaaactaaatttacaatggatttagactcagatgaggatttctctgactttgatgagaaaacggacgacgaggatttcgttccatcagatgcctccccccctaagacaaaaactagccccaagctttccaataaagagctgaagcctcaaaagtccgtggtatccgacttggaggctgacgacgttaaaggcagtgtgccgctgtcaagctcccctcccgcaactcattttcccgacgaaaccgaaatcaccaaccccgtacctaagaaaaatgtgacagtgaagaagaccgccgctaagtctcagagctcaacttcaaccaccggtgcaaaaaagagggcagccccaaaagggaccaaacgggaccccgctctaaatagcggcgtgtcacagaaaccagatccagccaaaaccaaaaaccgaagaaaaaggaagccctccactagcgatgactctgatagtaattttgaaaagatcgtatcaaaggccgtgacatccaagaagagtaaaggggaatccgatgactttcacatggattttgactctgccgtggctccacgcgcaaagtcagtgagggcaaaaaagccgattaagtacttagaagagtcggacgaagatgacttattttag

SEQ ID NO: 31183 - DNA, 4707 bp, Artificial Sequence
  Description of Artificial Sequence: Synthetic coding sequence
atggaagtcagtcctctgcagcctgtgaacgagaacatgcaagttaataaaattaagaagaatgaagatgccaagaaacgtctgagtgtggagcgtatttaccagaagaaaacacaactcgagcatattcttctgagacctgacacgtatataggttctgtcgagctcgtgacccagcaaatgtgggtgtacgatgaggatgtcggcattaattatcgggaggtgaccttcgtgcctggcctgtacaagatatttgatgagatcttggtaaacgccgcagacaacaagcaaagagaccccaagatgagctgtatccgagtgaccatcgaccctgaaaacaacctgatcagcatttggaataacggaaagggaatccctgtcgttgagcataaagtggagaaaatgtacgtgcctgctctaatctttggccagctgctcacgtcctctaactatgacgatgatgagaaaaaggtgacaggcggaaggaatggctacggagctaaactgtgcaacatttttagcacgaagttcactgtggagaccgccagtcgagaatataaaaagatgttcaaacaagctataacgtggatggacaacatgggccgagccggagagatggagctgaaacccttcaatggcgaggactatacctgcattactttccaacctgatctcagcaagtttaagatgcagagcctggataaagacatagtcgcgctcatggtgagaagggcctacgatatagccggatctaccaaggatgtgaaggttttcctgaacgggaacaagcttcccgtgaaaggcttccggtcatatgttgacatgtacctgaaagacaagcttgatgagacgggtaactcgcttaaggttatccacgaacaggtcaatcatagatgggaagtgtgtctaaccatgtctgaaaagggctttcaacaaattagctttgtgaattcaatagccactagcaaggtaattctttttctgaattatatgatttacctgtacatctatgtttttctcctgtttctgatctataaggtcgatctcaacatcggtctcgcatactttaccgggggaagacatgttgattatgtggccgatcagattgtgactaagttggtcgacgtggttaaaaagaagaacaaggggggagtcgccgtgaaggcacaccaggtgaagaatcatatgtggattttcgttaacgcccttatcgagaaccccactttcgactctcagaccaaggaaaatatgacattgcagccaaagagcttcggatccacctgccagctttctgaaaaattcatcaaggcagccataggatgcggtattgtcgaatctattctgaactgggtaaagttcaaggcccaggttcagctgaataagaagtgctctgctgtgaaacacaatcgcattaaggggataccgaaactagatgacgcgaatgacgcaggcggacgtaacagtacggagtgcaccctgatcctaacagaaggtgactcagccaaaacgcttgccgtctctggacttggggtcgtaggacgcgacaaatatggcgtcttcccactgaggggtaagatcttgaacgttagggaagcttcccacaaacagatcatggagaatgctgagatcaacaacattatcaaaatcgtcggactacagtacaaaaaaaactacgaagatgaggactcattaaagactttgcgatatggaaaaatcatgataatgacagatcaggatcaagacgggtcacacatcaaaggactgctgattaattttatccaccataactggccatctctgttgcggcatcgttttctcgaggaattcataacacctattgtcaaggtatcaaagaacaagcaggagatggcgttttacagcctccccgagtttgaagaatggaagtcctccacgccgaatcacaaaaaatggaaggtcaagtattataaaggattaggcacctccacctcgaaggaagccaaggagtactttgcagatatgaagcgccataggatacagtttaaatattcaggccctgaggacgatgccgctatttctcttgctttcagcaagaagcaaattgatgaccgtaaggaatggttgactaatttcatggaagaccgtcggcagcggaaactcctgggtttacctgaggattatctttacggtcagaccaccacctatctgacatataatgactttatcaacaaagagctgattctctttagtaattccgacaatgaaagatcaattcccagtatggttgacggacttaaaccgggacagcgaaaggtgctgttcacctgttttaaacggaacgataagcgtgaggttaaggttgctcaacttgccggttctgtggcagagatgagctcatatcaccacggagagatgtcactgatgatgacgattatcaatctagcacagaactttgtcggctcaaacaacctgaacttactgcagcctatcggacaattcggaaccaggctgcacggcggaaaggattccgcttcgcccaggtacatcttcacgatgctgtcatcactggctaggttgctctttcccccaaaagacgatcataccttgaaatttctttatgacgacaatcaaagggttgagcctgaatggtatatcccaatcattcccatggtcttgatcaacggagcagaagggatcggtacaggatggtcgtgtaaaataccaaacttcgacgttcgagaaattgtgaacaacattagacgacttatggacggtgaagagcccctgccaatgctccccagctataagaattttaaaggaactatcgaggagctcgcaccaaaccaatacgtgatatctggggaagttgccatcctcaatagtacaacaattgaaatcagcgaactaccagtgcggacgtggacccagacgtacaaggagcaggtcctcgagcctatgctcaatggaactgagaagactcctccccttatcacagactatcgcgagtaccacacagatactactgtgaaatttgtcgtaaagatgacagaggagaagttagcagaggctgaacgcgttggcctgcataaggttttcaagctccagacctcgctgacatgtaattctatggtcctgttcgatcacgttggctgcctaaagaaatacgacaccgtgttggatatcctccgcgatttctttgagttacgcctaaaatactatggtctaagaaaggagtggctgcttggaatgctcggggctgagtccgccaagttgaataaccaagcgaggttcattcttgagaaaattgatggaaagatcatcatagagaacaagcctaagaaggaactgattaaggttcttattcagcgcggatatgactcagaccccgtcaaggcctggaaggaggctcaacaaaaggtgccagatgaggaagaaaacgaggagagtgataacgagaaggaaactgaaaagagcgattcagttacggatagcggccctacttttaactacttgctggatatgcccctctggtatctaactaaagaaaaaaaggacgaactctgtcgcttgcgcaacgagaaagaacaggagctggataccctcaagcggaaatctccctctgacctttggaaagaggacttggccacattcatcgaagagttggaagccgttgaggcgaaggaaaagcaagatgagcaggtggggctgcctggcaaagggggtaaagccaagggaaagaagacccagatggcagaagtgctacccagccccagaggacagagagttatcccgagaatcactattgagatgaaagcagaggctgagaagaaaaataaaaagaaaatcaaaaatgaaaacaccgaaggatcccctcaggaggacggagtggagctcgagggactgaagcagagactggaaaagaagcagaagagggaacccggaacaaagacaaaaaagcagacaactctggcctttaaacctatcaagaaagggaaaaagcgtaacccgtggtccgatagcgaaagcgataggtcatccgacgagagtaattttgacgtcccacccagggaaaccgagccgagaagagcagcgacaaagactaagttcaccatggatcttgattccgacgaggatttctcagacttcgatgaaaaaaccgatgatgaagacttcgtgcccagcgacgccagcccccctaagactaagaccagtccaaagcaaaattgtaacaaagagctcaagcctcagaagtccgtggtgtccgatcttgaggccgatgatgtgaaaggatccgtgcccctgtcctcttcacccccagctacacattttcccgatgagactgagatcacaaaccccgtccccaagaagaacgtcaccgtgaagaaaactgcagctaaaagccaatcaagcacttcaactactggagccaagaagcgggctgcccctaagggaaccaaaagggatccggcactcaatagtggtgtgtcgcagaaaccggacccagctaaaacaaagaacagaaggaagcggaagccaagcacatcagacgattcagattctaattttgagaaaatcgtgtcaaaagcggtgacatctaagaagtctaaaggcgagagtgatgatttccacatggatttcgatagcgccgtcgctcccagggccaagtctgtgcgcgctaagaagcctatcaaatatctcgaagagagcgatgaggacgatctgttttag

SEQ ID NO: 31184 - DNA, 4596 bp, Artificial Sequence
  Description of Artificial Sequence: Synthetic coding sequence
atggaggtgtcacccctccagcctgttaacgagaatatgcaggttaacaagattaaaaaaaacgaggacgccaaaaagcgtctgagtgtagaacgcatctatcagaagaagactcagctggagcatattctgctccgacccgacacttatataggttcagtggagctggttacacaacagatgtgggtgtacgatgaggacgtcggcattaattaccgcgaggtgaccttcgtgcctggcctgtacaaaatattcgacgagattttggtgaatgccgcagacaataagcagagggatccaaaaatgtcatgtattagagtgaccatcgacccggagaacaatcttatatctatttggaacaatgggaaaggtataccagttgttgagcataaggttgagaagatgtatgtccctgccctcatcttcggccagctgctcacctcatctaactacgatgatgacgaaaagaaggtgacaggcggacggaatggttatggagcaaaactttgcaacatatttagtacaaagtttactgtcgaaaccgcttccagggaatataagaagatgtttaagcagacatggatggataatatgggcagggccggagaaatggagttgaaacctttcaacggcgaagactatacgtgcattactttccagcctgatctttccaagtttaaaatgcagagcctcgacaaggatatcgtggctctgatggtgaggagagcatatgatattgcaggttctacaaaagacgtgaaagtgttcctcaatgggaataagcttcctgttaagggatttcggagctatgtcgacatgtacctgaaggacaagctggacgaaacgggcaattccctgaaggtgatccatgagcaagtgaatcacagatgggaagtttgtttgactatgagcgagaaaggcttccagcaaattagctttgtaaattctatcgcgacaagtaaagggggacggcacgtcgattacgtggcagaccagattgtcaccaagttggtcgacgtggtcaagaagaagaacaagggaggcgtggcggtgaaggcccaccaggtcaagaaccacatgtggatcttcgttaacgccttgatcgagaaccccacattcgattcacagacaaaggaaaacatgaccctgcagcccaaatctttcggctccacatgccaactgtctgagaagttcataaaggctgctatcgggtgcggcattgtggagagcatcctgaattgggtgaaattcaaggcacaggtgcagctaaacaaaaagtgctctgctgtaaaacataatagaattaaaggcatacccaagctcgacgatgccaacgatgccggtggcagaaattccaccgaatgtacattgatcctgacagagggggatagcgctaaaactctcgcggtgtctggacttggtgtcgtcggcagggacaaatacggcgtgtttcccctgcggggtaagattcttaacgttagagaggcttcgcacaagcaaatcatggaaaacgcagagatcaataatatcataaagattgtcggactgcagtataagaaaaattatgaggatgaagacagtttaaaaactctgcgttacgggaaaattatgatcatgacggaccaagaccaagatgggtcacacataaaggggttactgatcaattttatccaccataactggccatcactcctgcgccatcgcttcctggaggagtttatcacccctatcgtgaaggtttctaagaacaagcaggaaatggcattctattcactgccagagtttgaagaatggaagtcttctacccccaaccataagaagtggaaagtgaagtactacaaagggctcggcacgtccacatctaaggaagccaaagagtacttcgcggacatgaagcgtcaccggattcagtttaaatactccggtccagaggacgatgcagccattagcttggcttttagcaaaaagcaaatcgacgaccgtaaggaatggctcaccaatttcatggaggatcgacgccagagaaagctactgggactgccggaggattacctgtacggccaaactaccacctatctgacatacaatgattttattaacaaggaactcattttgttctctaacagcgataacgagagaagtatcccctccatggtcgatggcctgaagcccggtcagagaaaggtcctcttcacatgcttcaaacggaacgacaagcgggaggtgaaagtcgcacagttagccggatccgtagcagagatgtcaagttaccatcatggcgagatgagcctgatgatgacgattatcaacctggcccagaattttgtgggcagcaataatctgaatctcctacagcccattgggcagttcggcacacggctccatggcggaaaggacagtgccagtcccagatacatctttaccatgttgtctagcctggcaagactgctgtttccccctaaggatgaccacacattaaagttcctgtatgatgacaatcagagagtggaacccgagtggtatataccgatcatccctatggttttgatcaacggcgctgaggggattggcactgggtggagttgtaagattcccaactttgatgtgagggagattgtgaacaatatcaggcgtctcatggacggggaggagccactgcctatgttgcccagttataaaaattttaaaggtacaatcgaggagctcgcgcctaaccaatacgtgatttcaggggaggtggccatacttaacagcaccacaattgagatttctgagctgcctgtccggacatggacccagacgtacaaggagcaggtgctagagccaatgcttaacggaactgaaaaaacccccccattgataacagactaccgggaataccatacagataccaccgtaaagttcgtggtgaaaatgacagaggagaaactagcggaggctgagagggtcgggctgcacaaggtgttcaagttgcaaacaagccttacttgtaactccatggtgctgttcgaccacgtggggtgtctgaagaagtacgatactgttctggacatcttgcgagacttctttgaactgcggttaaaatactatggtctgcggaaggaatggctccttgggatgttgggagctgaatcagccaaactgaataatcaagccagattcatcctggaaaagattgacggcaagatcatcatcgaaaataagccaaagaaagagcttattaaggttttaatccagagggggtatgactccgatccggtcaaagcttggaaagaggcacaacaaaaagtgcctgacgaggaagagaatgaagagagcgataacgagaaagagaccgagaagagcgatagcgtgaccgattcgggacccacattcaactacctgctcgatatgccactgtggtatctgaccaaggagaaaaaagatgaactgtgccgactgcgcaatgaaaaggagcaggaacttgacaccttaaaaaggaaatctcctagtgacctgtggaaagaggacctggccacatttattgaagagttggaggcagttgaagctaaagagaagcaggatgaacaagtcggacttcccggtaaagggggaaaggctaaaggaaagaagacccaaatggcggaggtcttaccaagtcctcgcggtcaaagggttattcccaggatcacaatcgaaatgaaagctgaggccgaaaagaaaaacaagaagaaaatcaaaaatgagaacactgaaggttccccacaggaggacggagttgaacttgaaggcctcaaacagcgcttagagaagaaacagaagcgcgagccgggaacaaagaccaaaaagcagacgacactggcattcaagcctataaagaagggcaagaagagaaacccttggtccgatagtgagtccgatcgtagtagtgatgaaagtaactttgatgttccaccacgcgagacagagccacgcagagcagctactaagacgaagtttaccatggatctggactccgatgaagatttcagcgattttgacgagaaaaccgacgatgaagatttcgtgcctagtgatgccagcccaccaaaaaccaagacatcaccaaaactgagtaataaagaactgaagccgcaaaaatccgttgtgagtgatctggaagcggatgatgtaaaaggctctgtccccctgagtagctcgcctccggcaactcatttccccgacgagacagagatcaccaacccagttcccaagaagaacgtgaccgtgaaaaagaccgccgcaaaatcacagagcagtacctcaaccacaggagctaagaaacgagcagcacccaagggcacaaaacgggatcctgccctgaattccggtgtgtcccagaagcccgatcctgccaaaacgaagaacaggcggaagcgaaaaccgtcgacttccgatgattcagactctaacttcgaaaagattgttagcaaagcagtcactagcaagaaaagcaagggagagagtgatgattttcatatggactttgacagcgccgtcgccccaagagctaaaagtgtgcgtgccaagaaaccaataaaatacctggaggagtccgatgaggacgatttgttctag

SEQ ID NO: 31185 - DNA, 4881 bp, Artificial Sequence
  Description of Artificial Sequence: Synthetic coding sequence
atggcgaagtccggaggttgcggcgctggagcaggagtgggcggtggaaacggcgcactcacttgggtcaccctttttgatcagaataatgccgctaagaaggaagaatctgaaacagcgaataaaaatgacagtagcaagaagttgtccgttgaacgggtgtatcagaagaagactcagttggaacatatcctcctgagaccagatacttacatcgggtccgtggagcccctgacccagtttatgtgggtctatgatgaggatgtcggcatgaactgccgcgaggtcacattcgtgcccggactgtataagatattcgatgaaattcttgtcaacgcagctgataacaagcagagggacaagaatatgacttgcattaaggtgagcatagaccctgagagcaacattatctccatatggaacaacggtaaggggatcccagttgtggagcacaaagtggaaaaagtgtacgttccagccttaatcttcggtcagctactgacctcctctaactacgacgatgatgagaaaaaggtgactggagggagaaatggatacggcgcaaaactgtgtaacattttttcaaccaaattcaccgttgagacggcttgcaaggaatacaagcacagctttaaacagacctggatgaataatatgatgaagacctctgaggccaagattaaacacttcgacggtgaagactacacttgcattacctttcagcccgacctcagcaaattcaagatggaaaagttggataaggatatcgtggccctgatgaccagacgtgcatatgacctggcagggagctgccgcggagtgaaggtgatgtttaacggcaagaagttgccggtcaatggctttaggagctatgtggatctctatgtcaaagacaagctggatgagactggcgtcgctcttaaggtcatacacgagcttgccaacgagagatgggacgtctgccttacactgagcgaaaaaggcttccaacagatatcctttgtgaattctatcgcaactacaaagggaggccgtcacgtggattacgtcgtagatcaggtagtaggcaaactcatcgaagtagtcaagaaaaagaataaagctggtgttagtgttaagccctttcaagtgaagaatcatatctgggtgtttataaactgcctcatcgagaatccaacattcgacagccagaccaaagagaacatgacccttcagccaaagagttttggaagcaaatgccagctgagtgagaagttcttcaaagccgctagcaactgtgggatagtggaatccatcctgaactgggtgaagtttaaggcccaaactcagctcaacaaaaaatgttcttccgtgaaatactccaagataaaaggtattcctaagctcgacgatgccaatgacgccggaggaaaacatagtctggagtgtactctcatcttgactgaaggggatagtgctaaaagccttgcagtttccggcctcggagtgattgggcgtgaccgctatggagtgttccccctccggggaaagattctgaatgttcgtgaggcgtcccacaagcagatcatggaaaatgcggagatcaacaacattataaaaatcgttggactgcagtataagaagtcctatgatgacgcagaaagccttaagacactccgctatgggaaaattatgataatgaccgatcaggaccaggatggctcccacattaagggacttctgatcaacttcatacaccacaattggccatccctgctgaaacatggttttctggaagagttcattactcccattgtgaaggcaagcaagaataagcaagaactgtccttttactccattcccgagtttgatgagtggaaaaagcacatcgagaaccagaaagcttggaagattaagtactacaaaggactgggcacctcaaccgccaaggaggccaaagagtactttgctgacatggaaagacaccgcatcctgttccggtacgcaggacccgaagatgatgctgctattacgcttgctttctccaagaaaaagatcgatgacagaaaggaatggctgacgaactttatggaggacaggcgccagagacgcctgcacggactgccggagcaatttctctacggaacggcaacgaagcacctgacctataatgattttattaacaaagagttgattctgtttagcaactctgacaatgagagaagtatcccctcactagttgatgggttcaaacctggccaaagaaaagtcctctttacgtgctttaagcgtaatgataagcgagaagtgaaagtcgcccagctggcagggtccgtggccgaaatgagtgcatatcatcacggggaacaggccctgatgatgactattgttaaccttgcccagaattttgtgggttctaacaatatcaaccttctgcagccaattggtcagttcggcacacggctacacggaggcaaggacgccgcttctcccaggtacatctttaccatgctgtccacactggctaggctgctctttcccgctgtggacgataatttactgaagttcctgtatgacgataatcaacgcgtcgaacctgaatggtatattcctatcatccccatggtcctgattaacggcgctgaaggaatcggcacaggatgggcttgcaagcttccaaattatgatgccagagaaatagttaacaatgtgagaagaatgcttgatgggctggatcctcacccaatgctgcctaattataaaaacttcaagggcacgatccaggagctgggacaaaatcagtacgccgtatcgggcgaaatcttcgtggtcgataggaacacggtggaaattacagagctccccgtgcgaacgtggacacaagtgtataaagaacaggtcctggagcctatgctcaacggcaccgacaagacacctgctttgataagtgactacaaagagtaccacacagacacgacggtgaagtttgttgttaaaatgacagaggaaaagctggcgcaggcggaggccgcaggcctgcacaaggtgttcaaacttcaaactacgctcacatgtaacagtatggtcttgttcgaccacatgggttgcctgaagaaatatgaaactgtgcaggatattctcaaggaattttttgaccttcgcctgtcttactacggtctccggaaggagtggctggtgggaatgctgggcgctgaaagcaccaaactcaacaaccaggccaggtttatactggagaaaatacagggcaagatcacaattgaaaacaggtcaaagaaagatcttattcagatgctggtccagagggggtacgaatctgatcccgtgaaagcttggaaagaggcccaagagaaggccgctgaagaggatgaaactcaaaaccagcatgatgactccagcagtgatagcggaaccccttccggtcctgattttaattacatcctaaatatgagtctgtggagtctaacaaaagagaaggtggaggagctgatcaagcagagagatgccaaggggagggaggtgaacgatcttaaaaggaagtctcctagtgatctgtggaaagaggacctggcggcattcgtggaggaactggataaggtcgagagccaggagcgggaagatgtgttagccggaatgtctggcaaagccatcaaagggaaggtgggcaagcccaaggtgaaaaagctgcagctggaagagacaatgccctcgccctacggccgaagaatcattcccgagatcacagccatgaaagccgacgcttctaagaaactgctgaaaaagaaaaagggcgatctagacaccgccgcagtgaaggtggagttcgacgaggagttctctggggcacctgtggagggtgctggtgaagaagctctgaccccctctgttcctatcaataaggggcctaagccaaagcgggagaaaaaagaacccggtacccgggtgagaaagactcccacatcatccggtaagccaagtgctaagaaagtcaagaagaggaacccctggtcagacgacgaatccaaatccgaatctgacctggaagaaactgaaccagtcgtcattccgagagactccctattgcgcagagccgctgctgaacggcctaagtacaccttcgatttcagcgaagaagaagacgatgatgccgacgatgacgatgacgataataacgatttggaagagctaaaagtcaaggcttcacctataactaacgatggcgaagatgagtttgtaccctcagatggattggacaaagacgagtacacattcagtccaggaaaaagcaaagccaccccagaaaaatctctacatgataaaaaatctcaggatttcggaaacctgttttcgtttcctagttattcccagaaatccgaagacgactccgctaagttcgatagcaacgaagaggacagcgccagcgtgttcagcccctctttcggcctaaaacagactgacaaggtgcccagtaagaccgttgctgcgaagaagggcaaaccgagcagtgatacagtgccaaagcctaaacgcgcacccaagcagaagaaagtggttgaagctgtcaattccgactccgattccgaattcggtattcccaagaaaaccactactccgaaaggaaaaggccgtggtgcgaaaaaacgcaaagcctccggctcagagaacgagggcgattacaatcctggacgcaagacctcgaagaccacgagtaagaagcctaaaaagaccagtttcgatcaggattctgatgtggatatcttcccatcagatttccccacagaacctccaagtctgccccgtactgggagggccagaaaggaagttaagtacttcgcggaaagcgacgaagaagaggacgatgtggactttgctatgtttaactag

SEQ ID NO: 31186 - DNA, 3453 bp, Artificial Sequence
  Description of Artificial Sequence: Synthetic coding sequence
atggcgaaaagcggcggttgcggggcaggcgcaggagtggggggagggaatggagcactcacctgggtcaataacgccgctaaaaaagaggaatccgaaactgctaacaagaatgacagtagtaaaaagctgagcgtagagagggtgtaccagaaaaaaacccagctggagcacattttactgagaccagacacatacatcggaagtgtggaaccactgacacagttcatgtgggtgtacgatgaagatgtgggtatgaactgtcgggaagtgaccttcgtgcccggactctacaagatttttgatgagattctcgtaaacgcggcagacaataagcagcgcgataagaatatgacgtgtataaaggttagcatcgatcccgaatctaacatcatcagtatctggaataatggcaaaggtattccagtagttgaacacaaagttgaaaaagtctacgtgccagctctgatctttggtcagctgctgacatctagcaactatgatgacgatgagaagaaggtgacggggggaagaaacggctacggggctaagctctgcaatatttttagtaccaaatttacagtagagaccgcttgtaaggaatacaagcacagcttcaaacagacttggatgaacaacatgatgaaaacatcagaagcaaagatcaaacattttgacggcgaggactatacttgcataaccttccagccagatttgtctaagtttaagatggagaaactggacaaagacatcgttgccttgatgacaagaagagcatacgacctggcgggatcttgcagaggcgtgaaagttatgtttaacggcaaaaagttacccgtgaatgggttccggagctatgtcgatctctacgtgaaggacaagctcgatgaaactggtgtggccctcaaggtcatccacgagcttgcgaatgagcgttgggatgtctgtctgacactgagcgaaaagggcttccaacaaatctccttcgttaattcgattgctacgactaaggggggtagacatgtcgactacgtcgttgaccaggtggtggggaaacttatcgaggtggtcaaaaaaaagaacaaagcgggagtaagcgtcaagcctttccaggtcaagaatcacatttgggtcttcataaattgcctgatcgagaacccaacatttgattcacagactaaagaaaacatgacactgcagccaaaatctttcggctccaagtgtcaattatccgagaagttcttcaaggcagcaagtaattgcgggatagtggaatctatactaaactgggtgaaatttaaggcacagacacagctgaataaaaaatgttccagcgttaagtacagcaagatcaaaggcattccaaagttggatgacgccaatgatgctggaggcaaacactccctcgaatgtactctcatcctgaccgaaggggatagtgccaaatcgctggccgtgtccggccttggcgtgatcggcagagatagatatggcgtctttcctctccgtgggaaaattttgaatgtccgtgaagcatctcacaaacagattatggaaaatgccgagatcaacaacattataaagatagtaggacttcagtacaaaaaatcatacgatgatgccgaaagcctcaagactttacggtacggcaagatcatgatcatgaccgaccaagaccaggatgggtctcatatcaaaggattgcttataaacttcatacatcacaactggccttctctgctgaaacacggtttcctggaggagtttatcacccccatagtgaaagcgtcgaaaaacaaacaggagttgtctttctactccatccctgagtttgacgagtggaagaaacatatcgaaaaccagaaagcttggaagatcaaatactataaggggttaggtacatctactgcaaaagaggcaaaggaatattttgcagacatggagcgccaccgcattctctttcggtatgcgggtccagaggatgacgccgctatcacgcttgctttttccaagaagaagattgacgatcgaaaagaatggctgactaactttatggaggataggcgccagagaaggctacatggacttccggagcagtttctgtatggcacagctaccaagcacctgacatacaacgatttcatcaataaagagcttatactgttctccaatagcgacaacgagcgtagtatcccctccctggtcgacggttttaaacccggtcagaggaaagtcctgtttacatgtttcaagcgtaatgataagcgggaggttaaggtggcccagctggcaggatctgtggcagagatgtctgcgtatcaccatggggaacaagccctgatgatgacaatcgttaacctggcccagaattttgtgggctctaataatatcaatcttctccagcctattggacagttcgggacgagacttcatgggggaaaggatgccgcaagcccgagatacatctttaccatgctctctaccctagctcggctgctttttcccgctgtagacgacaacctgctgaagttcctgtatgacgataatcagagagtcgagccggagtggtacattccaatcatcccaatggtgctgattaacggagctgagggtatcgggacaggatgggcgtgcaaactgcctaactacgatgctcgcgaaatcgtgaacaatgtgagacggatgctcgatgggctggatcctcaccccatgttgcccaattataaaaacttcaaggggacaatccaagaactgggacaaaaccagtatgctgtaagtggagagatctttgtggtggaccggaacactgtcgaaatcacagagcttcctgtgaggacttggacacaggtgtataaggaacaggtgctggaacccatgctgaacgggactgacaaaacaccggctctgatttccgattataaggaataccacaccgacaccacagtgaaatttgttgtcaaaatgaccgaagagaagctagctcaggccgaggccgctgggcttcataaggtcttcaagctgcagacgaccttaacctgtaactctatggttcttttcgatcacatgggatgtctcaagaagtacgagaccgtacaagacatccttaaggagtttttcgatttgcgtctgagctactacggactgcgcaaagaatggctggtggggatgctgggagcagagagtaccaaactgaacaaccaagcacggttcatcctagagaaaattcaaggcaagatcactatcgagaataggtcaaaaaaggatctgatacaaatgctggtgcagcgcggttatgagtccgatcccgttaaggcttggaaagaagctcaggaaaaggcggcagaggaggatgagacacagaaccaacacgatgactcttccagcgactccggcaccccgtctggccctgattttaactacattctcaacatgtctttgtggtccctaacctag

SEQ ID NO: 31187 - DNA, 4866 bp, Artificial Sequence
  Description of Artificial Sequence: Synthetic coding sequence
atggctaagagcgggggatgtggagccggtgctggcgtgggtggcggaaacggagccttgacctgggtcaataatgctgcaaaaaaggaagagtcagaaaccgcaaacaaaaacgactcttcaaagaagctgtccgtggaacgagtgtatcagaagaaaacacagctggagcacatcctgctgagacccgatacctatattggctctgttgaaccattgactcaatttatgtgggtctacgatgaagacgtggggatgaattgtcgtgaggtgaccttcgtgccaggtttgtacaagatttttgatgagatccttgtgaacgctgctgataataaacagagagataagaacatgacttgtattaaggtgtctatagacccagaatcaaatataatcagcatctggaataatggcaagggcattccggttgttgagcataaagtcgagaaagtttacgtgccggctctcatttttggccagctgcttacttcctctaactatgatgatgatgaaaagaaggttactggaggtaggaacggttatggagccaaactctgtaatatcttcagcactaagttcaccgtggaaactgcttgcaaggaatataaacatagtttcaagcagacttggatgaacaatatgatgaaaaccagcgaggccaagatcaagcacttcgacggcgaggactatacctgcattacctttcaacccgacttgagtaaatttaagatggaaaaactggacaaagacatcgtggcccttatgactagacgagcatacgacttggctgggagttgtcggggtgtgaaagtcatgtttaatggcaaaaagcttccagtgaatggctttcggtcctatgtggacctgtacgtaaaggacaagctggacgagactggggtggcgctgaaggtaattcatgaactggcaaacgaacgttgggacgtgtgcctaacactcagtgaaaagggcttccagcaaatttcatttgttaattcaatcgccaccaccaagggagggagacacgtggactatgtcgtggatcaggtcgtgggaaaactaatcgaggttgttaagaaaaaaaataaggccggagtttccgtgaagccattccaggtcaagaatcacatttgggtgttcatcaactgtctaattgaaaatcccacttttgacagtcaaactaaggaaaacatgactcttcagccaaagtcattcggctctaaatgccaactgtccgaaaagttctttaaggcagctagtaattgcggtatagtggagtctatcctcaactgggtcaaatttaaagctcaaacgcagctaaataagaaatgtagcagcgtcaagtattcgaagattaaggggattcccaaactcgacgatgcaaacgatgccggagggaaacattctctcgagtgtacgttaattctaactgaaggtgacagtgcgaagtctctcgctgtcagcggtttgggggttatcggccgagaccggtatggagtgtttccactgaggggaaaaatccttaacgtgcgtgaggcttctcacaaacagattatggaaaatgctgaaatcaataatatcatcaagattgtgggtctacagtataagaaaagctacgacgacgctgaatctctgaagacgctgagatacggaaagataatgatcatgactgatcaggatcaggacggaagtcatattaagggtcttctaattaacttcatccaccacaactggccatccctcttgaaacatgggttcctggaagagtttataacacctatcgttaaggccagcaaaaacaagcaggaactcagcttttatagcattcctgagttcgacgagtggaagaagcacatcgagaaccaaaaggcttggaaaatcaaatactacaaggggctgggaacgagcaccgccaaagaagcgaaggagtatttcgcagatatggaaagacaccggatcttgttccgttatgccggtccggaagatgacgccgctataaccctcgcttttagcaaaaagaagatcgatgaccgaaaggagtggctgacaaattttatggaagatcgtcgacagaggaggctgcacggattgccagagcagttcctgtacggcacggccacgaaacatttgacctacaacgacttcatcaacaaagagctgattctgttttctaactccgacaacgagagatccattccgagcctcgtggatgggttcaagcccggtcagcggaaagtccttttcacgtgtttcaagagaaatgataagcgcgaggtgaaagtggcgcagctggccggttcagtggccgaaatgtcagcttaccaccacggagagcaagccttaatgatgaccatcgtgaacctcgcccaaaacttcgtgggttctaacaatatcaatctcttgcagccaatcggacaattcgggacgagactgcacggcggaaaagatgctgcgagtccacggtatattttcaccatgctgtccactctggccaggctactcttccctgctgtcgatgacaatctgcttaagttcctctatgacgacaaccaacgtgtcgagccagagtggtatatccctattatacccatggtgttgattaatggtgcagagggcatcggcaccggctgggcctgcaagctacccaattatgacgcgagggagatcgtgaacaacgtgaggaggatgctcgacggactcgatcctcacccaatgttaccaaactacaaaaacttcaagggtacaatccaggagctaggccaaaatcagtacgccgtgagcggcgaaatttttgtagtcgataggaacaccgtggagatcaccgagttgccagtaagaacttggacgcaggtctataaggagcaggtgctagagccaatgctgaatggcacggataaaacccctgccttgatttcggattataaagagtatcacaccgataccacagtgaagttcgtggtgaaaatgacggaggagaagctagcgcaggctgaagcagccggattgcataaagtgttcaagctccagactaccctgacatgtaacagtatggtcctgttcgatcatatgggttgcttgaaaaagtatgagacggtgcaggacattctgaaggagttctttgatcttcggctgtcctattacggtctgaggaaggagtggttagtggggatgctgggggctgagtcgacaaagctaaataatcaggctaggtttatcctggagaaaattcaaggtaaaatcaccattgaaaacaggtctaaaaaggacctgattcagatgcttgtgcagagaggttatgagtcagatccagtaaaagcatggaaggaggcacaagagaaagccgctgaggaagatgagacacaaaaccagcacgacgatagctcatccgactctggtacccccagcgggcctgactttaattacatactcaatatgtccctgtggtccctgaccaaagaaaaagtcgaggaactcatcaaacagagagacgcaaaaggtcgagaagtcaacgacctaaaacgcaaatccccatccgatttatggaaggaggacttagcagccttcgtggaagagctggataaggtggaatcgcaggagagggaagacgttttagccggtatgtccggtaaggcgatcaaaggtaaagttgggaaacccaaagtaaagaaacttcagcttgaggaaaccatgccgtctccatacgggagacgcatcatcccagaaattacagcaatgaaagcggatgcctcgaaaaagctcctcaagaaaaaaaagggcgatctcgataccgccgcagtcaaagttgaatttgatgaagagttttccggcgcacctgtggagggcgctggggaagaagctctgacaccaagcgtgcccatcaataaaggtcctaaacctaaacgcgaaaagaaggaacctgggactagagtgagaaaaacacctacttcctccgggaagccaagcgcgaagaaggtgaagaaaagaaatccttggtcagatgacgagtccaagagcgagagtgacctcgaggagaccgagccggtggttattcctcgggatagtttactcagaagagccgctgcggagcggccaaagtacacgttcgacttcagcgaggaagaggacgacgatgctgatgacgacgatgacgacaacaacgacctggaagaattgaaagtgaaagcctcgcccattacaaatgacggggaagacgagttcgtcccttcagacggtttggataaggatgagtacaccttctcccctggcaaatcaaaggctacccccgagaaatccctccatgacaaaaaaagccaggacttcggtaacctcttcagttttccatcatacagtcagaagtctgaagatgattcagctaaatttgattctaatgaagaggattcagccagcgtgttttctcctagcttcggtctgaaacaaacagataaagttcctagcaaaacagtcgcagctaagaagggtaaaccctccagtgacacagtgcccaaacccaagcgcgctcctaagcagaagaaggtcgtcgaggctgttaactcggactcagattcagaattcgggatccccaagaagactactacccctaaaggcaaagggagaggtgctaagaagcgaaaggcatccggctccgagaacgagggggattacaatccaggtagaaaaacatcaaagacaacctccaagaaacctaaaaaaacatcattcgatcaggactcggacgtggacattttcccatccgacttcccaacagagcctccatctctccctaggacgggtcgtgcccgtaaggaggtgaagtattttgcagagtcagacgaggaggaggacgacgtggacttcgccatgtttaactag

SEQ ID NO: 31188 - DNA, 174 bp, Artificial Sequence
  Description of Artificial Sequence: Synthetic coding sequence
actctctttgatcagaataatgccgcaaagaaagaagagtccgagaccgctaacaagaatgactctagcaaaaaactgtccgtggagagagtataccagaagaagacccagctagagcacattctgcttcgtcccgacacatacattggatccgtcgagcccctgacacagtag

SEQ ID NO: 31189 - DNA, 1437 bp, Artificial Sequence
  Description of Artificial Sequence: Synthetic coding sequence
atgtccctttggtcgctaactaaagagaaggtcgaggagctcatcaaacagagagacgcgaaggggagggaggtaaatgacctgaagcggaaatctcctagcgatttgtggaaggaggatctagctgcttttgtggaggagttagataaggtggagagtcaggagcgggaagatgtacttgccggtatgtccggaaaggctataaagggcaaggtgggcaaacccaaggtgaagaaattacaactagaggagacaatgccgagcccatacggtaggagaatcataccagagattacagcaatgaaggctgatgcctcaaagaaactgttgaaaaagaaaaagggagatctcgacacggccgcagtgaaagtcgaatttgacgaggagttctctggggctccagtcgaaggtgcaggtgaagaagccctcacgcctagcgtccccattaacaagggcccaaaaccaaagagggaaaagaaggagccaggcacacgagtgcgcaaaacacccacctcaagtggtaaacccagtgccaaaaaagtgaagaaacggaatccatggagcgatgatgaatcgaagtccgagtcagacctcgaggagactgaaccagtggttatccccagggattcccttttacgtcgcgctgctgcagaaagaccgaaatatacctttgacttcagtgaggaggaggatgatgatgccgatgatgacgatgacgacaataacgacctcgaagagcttaaggtgaaagccagtcctattaccaacgatggcgaagacgaattcgtgccttccgatgggcttgacaaggacgagtatactttctcgccgggaaaatctaaggcaactcctgagaagtcccttcatgacaaaaagagccaggacttcgggaatctgttcagctttcccagctactcgcaaaagagcgaggatgactccgccaagttcgactccaatgaggaagatagcgcctccgtcttcagcccttcttttggattaaagcagactgataaggtcccatctaagaccgtcgctgccaagaagggcaagcccagctctgacaccgtgcccaagcccaagagagcccctaagcagaaaaaagtggtggaagcagtgaattcagattccgactccgagtttgggatcccaaaaaagaccactacaccaaaaggaaaaggacggggagcgaaaaagagaaaggcgtctggaagcgagaatgagggggactataaccctgggaggaaaacaagcaagacaacttccaagaagccaaaaaaaacctcctttgatcaagattcagacgttgacatcttcccttctgattttcctacagagccgcctagcctgccacggacagggcgagcgcgaaaagaggtcaagtactttgcggaaagcgacgaggaagaggacgatgtggactttgccatgttcaactag

SEQ ID NO: 31190 - DNA, 1437 bp, Artificial Sequence
  Description of Artificial Sequence: Synthetic coding sequence
atgagtctatggagcctgaccaaggagaaggtggaggaactgatcaaacagagagatgctaaaggtagggaagtcaatgatctaaaacggaaatcaccctccgacctctggaaagaagatctggcagccttcgtggaggaactcgataaggtggagagtcaggagcgggaagatgtgctcgctggaatgtctggaaaagcaataaaagggaaagtgggcaagccgaaagtgaagaaattgcagctcgaagaaaccatgccgtctccatatggtcggcgaattatacctgagatcacggctatgaaagctgacgcttcaaagaagctcctaaagaagaaaaaaggagatctggacacagcagcagtcaaggttgagtttgacgaggaatttagtggtgcacccgtggaaggcgctggagaagaggcgctcacacccagcgtgcccatcaataaaggaccaaagcccaagagagaaaagaaagagcctggcactcgggttcgtaagactccgactagctccggaaagccatcggcaaagaaagtgaaaaagcgaaacccttggagcgatgacgaatctaaaagtgaatctgatttggaggaaacggagcccgtggtgatacctcgcgactcccttctgaggagagccgctgcagaaaggcccaagtacacttttgactttagcgaagaagaagatgacgatgccgacgacgatgatgatgataataatgatctcgaggagctgaaggtaaaagctagtcccatcacaaatgatggggaagatgaattcgtccctagtgatggactcgacaaggatgagtacaccttctccccagggaaatcaaaggcgacccctgaaaaatcattgcacgacaagaaaagtcaggatttcggtaatctgttcagttttccctcctattcccaaaagtcagaagatgattcagccaaattcgatagcaacgaggaggatagcgcttctgtgttctccccgtcttttggtctgaagcagacagacaaagtcccgtcaaagacagttgctgcaaaaaagggcaaacctagcagtgataccgtcccaaaaccaaagcgggctccaaaacagaagaaggtagtggaagcagttaactccgatagcgattccgagtttggcatacccaagaagaccaccactcccaaagggaaggggcgtggagccaagaagcggaaggcttccggtagcgaaaacgagggggattataaccccggacgtaaaacctccaaaaccacctcaaagaagccaaaaaagacttcatttgaccaggattcagacgtggacattttccctagcgactttccaactgagccaccgagcctacctaggactgggagggcaaggaaggaagtgaagtatttcgcggagagtgacgaggaagaggacgacgtcgactttgccatgttcaactag

SEQ ID NO: 31191 - DNA, 3006 bp, Artificial Sequence
  Description of Artificial Sequence: Synthetic coding sequence
atgattttcccagtggcccgatatgcacttaggtggttgcggcgaccagaggatagggccttctctcgagcagcaatggagatggcactgcggggagtgcgtaaggtgttatgtgtcgctgagaaaaatgatgccgctaaaggaattgctgatttactatccaacggacgtatgagacggcgagaaggactttcaaaattcaataagatctacgagttcgattatcacttgtacggccagaacgtgacgatggtcatgacatcagtgagtggccacctccttgcccatgatttccaaatgcagttcaggaagtggcagtcctgcaaccctctcgttctgtttgaagctgaaattgaaaagtattgtccagagaactttgtggacatcaagaaaaccctcgagagagaaactaggcagtgccaggcactagtgatttggaccgactgtgacagggaaggggagaacattgggtttgagattatccacgtgtgcaaagcagttaaaccgaatctccaggtgctccgagcaagattctcggagatcaccccgcacgccgtcagaaccgcatgtgagaatctgacggagcctgatcagagagtttcagacgccgtagacgtgcgtcaagaactggatctgaggattggagcagcattcactcgcttccagacactaagactacagaggatttttcctgaggttctggcagagcagcttatttcatatggaagctgccagttcccgactctcggattcgtagtggaaaggttcaaggctattcaggcatttgtgcccgagatatttcaccgtatcaaagtgacccacgatcacaaggatgggatagtggagtttaactggaagcgccaccggctgtttaaccacaccgcttgtttggtgctctaccaactgtgcgtggaggacccaatggccactgtggtggaagtaagaagcaagcctaagtctaagtggcgaccacaggccctcgacaccgtggaactggaaaaactggccagccgcaaactgcggataaatgcaaaggagacaatgcgcatcgcggagaaactttacacccaagggtacatcagttacccacgcacagaaacgaatatctttccaagagacctcaatctcaccgttcttgtcgagcaacaaactccggaccctcgctggggcgcattcgctcagagtattttagaaagaggtggtccaactccacggaatggaaacaaaagtgaccaagcacacccacccatccatcccaccaagtacactaacaaccttcagggggatgaacagaggctctacgagtttatagtgagacacttcctagcctgctgcagccaggatgcacagggccaagaaacaactgtcgaaatcgacattgcccaggaacgcttcgtggcccatggtctcatgatactggcaaggaattacttggacgtctacccttacgaccattggtccgacaaaatcttacctgtgtacgagcaggggtcacatttccagcctagcacagtggaaatggttgacggagaaactagcccacccaagcttttaacggaggccgacctgattgctctcatggaaaagcatggcataggtactgacgctacccatgccgaacacatcgaaaccattaaggcacgaatgtacgtcgggcttactcctgacaagaggttcctgccgggtcaccttgggatggggttggtagagggttacgattcaatggggtatgagatgagtaagccggatctgcgggctgaactggaagccgatctcaagctgatctgcgacggtaaaaaggataaattcgttgtgctccgtcaacaggtccagaaatataaacaggtgttcattgaggccgtggccaaggctaagaaactggatgaggctttagcccagtactttggcaatgggacagagctggcccaacaagaagatatttaccccgctatgccggagcccatccgcaaatgtcctcagtgcaataaagatatggtgcttaaaaccaaaaagaacggcggattttacctgtcttgcatgggcttccccgaatgcaggtcagctgtgtggctcccagattcagtccttgaggccagcagggattcatctgtctgccccgtgtgtcagccccaccccgtatatagactgaagttgaagtttaaaagaggcagcctacctcccactatgcctcttgagtttgtgtgttgcatcggcggttgcgatgatacactcagagagatcctggatctccgctttagcggagggcctcctagagcatctcagccctctggcaggctgcaggcaaaccagtccttgaaccggatggacaacagtcaacaccctcagcctgctgacagccgccagacaggctcttctaaagccctggcccagaccctcccaccgcctacagccgctggagagtccaattctgttacgtgcaactgcggccaggaagctgtcctgctcaccgtgcgcaaggaggggcctaatcggggtcgtcagttttttaagtgcaacgggggatcctgcaactttttcctttgggctgattctccaaacccaggcgctggagggccaccagccctggcctataggccactcggtgccagtttagggtgtccccctggtcccggaatacatctgggtggctttgggaatccaggagatggctctgggagcgggacttcatgcttgtgctcgcagcccagcgttacacggacggtgcagaaagacgggccaaacaaaggccgacagtttcacacgtgtgcaaagccccgagagcaacaatgtggattcttccagtgggtcgacgagaatactgcgcctggtactagcggggcacccagctggactggggataggggtcggaccctggaatcagaagctaggtcaaagcggcctagggcctcatcaagtgacatgggatcgactgcaaaaaagcccagaaagtgcagcctttgccaccagcccggacataccagacctttctgcccccagaacagatag

SEQ ID NO: 31192 - DNA, 1170 bp, Artificial Sequence
  Description of Artificial Sequence: Synthetic coding sequence
tgatcacgtgccgctatggagatggctttgcggggagtcagaaaagttctttgtgtggctgagaaaaacgacgcggcaaaagggatagctgatttgctgtcaaacggcagaatgaggcgtcgagagggactatcgaagttcaataagatttatgagtttgattatcacctatacgggcaaaacgtgaccatggtgatgacctccgtcagcggccaccttctcgcacatgattttcagatgcaattccgtaaatggcagtcatgcaatccgttggtactgttcgaggcagagattgagaaatattgtcctgagaactttgtggatattaagaagacgttggaacgagaaactcggcaatgtcaggcactggtcatctggacggattgcgaccgtgaaggcgagaacatcggtttcgagattatccatgtctgcaaggccgtgaagcccaatcttcaagtgctcagagccaggttttcagagatcacacctcatgccgtgcgcaccgcttgcgaaaatctgaccgagccagaccaaagagtgtcagatgccgtcgacgtgcggcaggagctcgacctgaggatcggcgctgccttcacgcgattccagacgcttcgattgcagaggatctttcccgaagtgttagcggaacagcttatcagctacgggtcttgccaattccctaccctcggatttgtcgtggagagattcaaggctatccaggcgtttgtacctgagattttccataggattaaggtgacacatgatcataaagatggtattgtggagttcaactggaagcgacacaggctctttaaccacactgcctgtctggtgctatatcagctgtgtgttgaggacccgatggctaccgtggtcgaggttcggtctaaacctaagagcaaatggcgcccacaggcactggatacggttgagctagaaaagctggcatctcgtaaactccgcatcaacgccaaagagaccatgaggatagctgagaagctatacacccaaggttacatctcatacccacgaaccgagaccaacatatttccaagggatttaaatttaacagtgttagtagaacagcaaactccggatccacggtggggagcttttgcccagagtattctagagcggggagggccaaccccccgtaacggtaacaaatag

SEQ ID NO: 31193 - DNA, 1596 bp, Artificial Sequence
  Description of Artificial Sequence: Synthetic coding sequence
atgattctggctcggaattacctcgatgtgtacccgtacgatcattggagcgataagattctgcccgtttacgaacagggttctcatttccaaccaagcacagtggagatggtagacggcgaaacctccccgccaaagctcctgaccgaagcggatcttatcgctctgatggagaaacacggtataggcactgacgccacccatgcggaacatatagaaactattaaagcccgtatgtacgtgggtttgactcccgacaagcgttttctgcctgggcaccttgggatgggtctggttgagggatatgactcgatgggctacgaaatgtccaagcccgatctgagggcagaattagaggcggatctgaaactgatatgtgacgggaagaaagacaagttcgtggtgttgaggcagcaagttcagaaatacaaacaggtctttatagaggccgtggccaaggctaaaaagctggacgaagcccttgctcaatactttggcaatggcactgagctcgctcagcaggaggacatctatccagcgatgccagagcccatccgcaagtgtccccagtgcaacaaagatatggttctgaaaaccaagaaaaacggaggtttctacctgtcatgcatgggatttcctgaatgtaggagcgcagtgtggctacctgactccgtcttggaagccagtcgagatagttctgtttgccctgtttgtcagcctcaccctgtgtacaggttaaagttaaagttcaaacggggaagtctgccgcctaccatgccattagagtttgtctgttgcatcgggggatgtgacgatactctccgtgaaatactggatttgaggttctcagggggaccaccgagagctagtcaacccagtggaaggttgcaggctaatcagtcgctgaacagaatggacaattcccagcacccacaacccgcagactcacggcagacagggagctccaaggcactggctcagacactgcccccacctaccgctgcaggcgagtccaattctgtgacatgtaattgcggccaagaggccgttctgctgacagtgcggaaggaaggaccaaacaggggcaggcagttttttaagtgcaacgggggaagctgcaatttcttcctgtgggccgattcacctaacccaggggctggagggccacctgcattggcctatagacctctgggtgccagcttgggatgccctcccggtccaggcatacaccttggagggtttggaaatcccggagatggtagtggctccgggacaagctgtctatgcagccaaccatcagtgactaggactgtacagaaggacggccctaacaagggtcggcaatttcacacctgcgcaaaaccaagggaacagcagtgcgggttttttcagtgggtggatgagaacaccgccccaggcacaagcggtgccccttcttggacaggggaccgcggaagaaccttggaaagtgaagcgcgttccaagcggccacgagctagctcttctgacatgggcagcaccgcaaagaaacccaggaagtgttctctttgtcaccaacccggacacacacggcctttctgtcctcagaatagatag

SEQ ID NO: 31194 - DNA, 2721 bp, Artificial Sequence
  Description of Artificial Sequence: Synthetic coding sequence
atgaatctcatcattatctgtatggctagacagtcctgcaacccacttgtcttgttcgaggctgaaatcgagaagtactgtccagagaacttcgtggatattaagaagaccctggagcgggaaaccaggcagtgccaagcattggtgatttggactgactgtgatcgagagggtgaaaatatcggctttgagattattcatgtctgtaaagccgtcaaaccaaatctacaggtcctccgcgctcgcttctccgagatcacaccccacgctgttcgcacagcatgtgagaacctgaccgagcctgatcaacgggtgagcgatgcggtggatgtgaggcaggaactcgatctaaggatcggggcagcgtttacaaggttccagaccctgagacttcagcgtatttttcctgaggttctcgctgaacaattaattagttatggtagctgtcagtttccaacactcggctttgttgtcgaacgcttcaaggctatccaagctttcgtaccagagatctttcaccggattaaagtcacccatgatcataaagatggcatcgtggaatttaactggaagcggcaccgcctattcaatcacaccgcttgcctggtgctgtatcagctgtgcgtggaggaccctatggcgaccgtagtcgaggtgcggagcaaaccaaaatccaaatggcggcctcaggcattggacactgtcgagctcgagaaattggcctccaggaagctgcgaatcaatgctaaagagacaatgcgtatcgccgaaaagctatacacccagggttacatctcctaccctagaacagagaccaatattttccccagggacctgaatctgactgttctggtggagcagcagacacctgaccccagatggggagcctttgctcagagtatccttgagcgcggagggccaacacccaggaacggtaacaaatcagatcaggcccatcctcctattcatccgacaaaatatacaaacaacctccaaggagatgagcagcgactgtacgaatttattgtcagacattttttagcgtgctgttcccaggacgcacaagggcaggaaactacagtggaaatcgacatagcgcaggaaagatttgtcgcccatggcctgatgattttagcccgaaattaccttgatgtctacccttacgaccactggtcagataagatcctgcctgtgtatgaacaagggtcacacttccaaccttctactgtggaaatggttgacggagaaaccagccctcctaaactgctcaccgaggcagatctgatcgcactgatggaaaagcacgggattgggaccgatgcaacacatgccgagcatatcgagaccatcaaggctcgtatgtatgtgggccttactccagataagcgattcctgcccggtcatctggggatggggctggtcgaggggtacgactccatgggatacgaaatgagcaagcctgacttgcgtgctgagctagaggctgatctgaaattgatatgtgacggaaaaaaggacaagtttgtggtgctcagacagcaagttcagaagtataaacaggtgttcattgaggccgtggctaaagccaagaagctggatgaggcattggcacaatacttcggaaatggaaccgaactcgcgcaacaggaggatatctaccctgccatgcccgagccaattcggaagtgcccacagtgcaataaagacatggtcctgaagaccaagaagaacggcggtttttatctctcctgcatgggatttccagaatgtcgtagcgcggtgtggctaccagacagtgtgctcgaggcgagcagggattctagtgtttgtcccgtctgccaacctcacccggtctaccgactgaaactgaagtttaagcgaggtagcctgcccccaacaatgcccctcgagttcgtctgttgtatcggcggatgtgatgatacgcttcgcgaaatattagacctccggtttagcggtggtcccccacgagcttcccagccgtcaggtcgactgcaggccaatcagtccctgaacaggatggataactcccaacacccccagcccgcagactctaggcaaactggctccagcaaggccctggcccagaccttgccaccacctacagcggcaggcgaatccaattccgtcacctgcaactgcgggcaggaggctgtgctgctgacggtgcgcaaggaggggccaaaccgtggccgacagtttttcaaatgtaacggaggctcatgcaattttttcctgtgggccgacagccctaaccctggcgcaggtggccctcccgcactggcatacagacctcttggagcaagcctgggatgtcctccagggccaggaatccacctagggggtttcggcaatcccggagacggtagcgggtcaggcacaagctgcctgtgctcacagccatccgttacacgcacagtgcagaaggatggtccgaataaaggccgacaattccatacgtgcgccaaacccagagaacagcagtgtggattcttccaatgggtcgatgaaaatacggccccaggaacaagtggtgcaccctcctggaccggggacagggggagaacactggaaagcgaagctaggtcaaagcgccctcgggcttcctctagcgacatgggcagcacagcaaaaaagcccagaaagtgctctctctgccaccagcccggtcatacacgccctttctgccctcaaaacaggtag

SEQ ID NO: 31195 - DNA, 2589 bp, Artificial Sequence
  Description of Artificial Sequence: Synthetic coding sequence
atgaaaactgtcttaatggttgccgaaaagccctccctggctcagagcattgcaaagatcctatcacgcggatccttatccagccataagggtctcaatggagcctgctccgtacacgagtacactggcactttcgccggtcagccagtgcggttcaagatgacaagtgtgtgcggtcacgtcatgactctcgatttcctcggcaagtacaacaagtgggacaaagtcgatcccgctgaactcttttctcaggcacctacagaaaaaaaagaagctaacccaaagttgaacatggtgaaatttctacaagtggagggcagaggttgcgattatatcgtcctctggcttgattgcgacaaagagggcgaaaacatctgctttgaggtgctagacgctgtactcccagttatgaataaggcacatggcggtgagaagactgtgttcagggcgcgttttagcagcatcaccgacacagatatctgcaacgctatggcatgtctcggggaacccgatcataacgaagctctgagtgttgacgcacggcaggagctcgacttgcgtatcggttgcgcttttactcgcttccagaccaaatacttccaggggaagtacggcgatttggactccagcctgatctcatttgggccttgtcagaccccaactcttggtttttgtgtagaacgccatgataaaattcagagcttcaagcctgagacatattgggtcctgcaggccaaagtgaataccgacaaagaccgctccctactgcttgattgggatcgcgtgcgtgtgttcgaccgggagatagcccagatgtttctcaatatgactaaactggagaaagaagctcaggttgaggcgactagtagaaaggagaaggctaagcagagaccgctggctctcaacacagtggagatgctgcgggttgcgagctcctcactgggcatgggccctcagcacgccatgcaaactgccgagcggttgtatacccagggatacatttcatatcctagaaccgagacaacacattaccccgagaattttgacttgaagggctccttgcggcagcaagctaatcacccctactgggctgacacagttaagaggctgctagcagaggggattaatagacccaggaagggccacgacgctggcgatcaccctcctattaccccaatgaaatccgcaaccgaggctgagcttggaggagacgcatggcgcctatacgaatacatcacaagacattttatcgcgacagtgtcccatgattgcaaatacctgcaaagcacgatctcttttcgtattgggcctgagctgtttacatgtagtgggaaaactgtcctcagtcctggatttacagaagtgatgccttggcagtctgtgccactggaggaaagcctcccaacgtgccaacggggagacgcctttcccgtaggcgaagtgaaaatgctggagaagcaaaccaatccccctgattacctgacagaggcagaactaataacgcttatggagaagcatggcattggcaccgatgcatcaattcccgtgcatataaacaatatttgccagcgaaactatgttaccgtggagtcagggaggcgccttaaacctactaacctcgggattgtgctggtccacggctactataaaatcgatgctgaattggtccttcctaccatcaggtcagcggttgagaagcagctgaacctgattgcccaaggtaaggccgactatcgacaggtgctgggtcacacactcgacgtctttaagaggaagttccactacttcgttgactccatcgcgggaatggacgaattaatggaagtctctttctccccccttgcggctacggggaagcccctgtctagatgtgggaagtgccaccggttcatgaagtacatccaggcgaagccaagcaggttgcactgtagccactgcgacgagacctatactttaccacagaatggcacaattaaactgtataaagagttgcgctgccccctagacgatttcgagctggtactgtggtccagcggcagcagaggaaagagctaccctttatgtccgtattgctataaccatcccccatttcgggacatgaaaaaaggaatggggtgtaacgagtgcacacacccctcatgccagcactcgttatcaatgttgggaattgggcagtgtgtggaatgtgagagcggtgtgctggttctggatccaacctctggaccgaagtggaaagtggcatgtaacaaatgcaacgtggtggctcactgtttcgagaatgcgcaccgtgtccgtgtctccgccgacacctgctccgtatgtgaggctgccttactggatgtcgacttcaataaggccaagtcaccgctcccaggtgatgaaacacagcatatgggttgcgtgttttgtgatcctgtttttcaggaactcgtggagctcaaacatgctgcctcctgccatccaatgcacaggggaggacccggtcggcgacagggcagaggtcggggaagggctcgtaggccccctggcaaaccaaaccctcggagacccaaagataaaatgagtgcccttgcagcgtacttcgtctag

SEQ ID NO: 31196 - DNA, 2589 bp, Artificial Sequence
  Description of Artificial Sequence: Synthetic coding sequence
atgaagactgtgttgatggtagctgagaaaccaagcttggctcaaagcatcgctaagatcctctcccgaggatctctctctagtcataagggccttaacggcgcatgctcagtacatgagtatactgggacattcgcaggacaacctgtacggtttaagatgaccagcgtgtgcggacacgtgatgacactagacttcctcggaaagtacaacaaatgggataaggttgacccagcagagctgttcagtcaggcccctaccgagaaaaaagaggcaaatcccaagttgaacatggttaaatttttacaggtcgagggtaggggatgcgactacatagtgctatggttagactgcgacaaggaaggcgaaaatatttgtttcgaggttctcgacgccgtgctcccagtcatgaacaaggcccacggtggggaaaaaaccgtttttagagcgaggttctcatcgattactgacaccgatatctgcaacgccatggcgtgtctgggtgaaccagatcacaacgaagcactgagcgtggacgcccgtcaagagctggatctccgtatcggctgcgcatttacgcgttttcagacgaagtacttccaggggaagtatggagacctggattcgtctctcataagcttcgggccttgtcagacccctaccttaggcttctgtgtagagagacacgacaaaatccaaagttttaaaccagaaacatattgggttctgcaggcgaaggtgaacacggataaagatcgtagcctgttgctggattgggatagggtgcgcgtattcgaccgagagatcgctcagatgttcctcaatatgacaaaactggagaaagaggctcaggtggaagccacctcacgtaaagagaaggctaagcaacggcctctggctcttaacactgtggaaatgttaagggtcgcttccagctctctgggtatggggcctcaacacgcgatgcaaaccgccgaacgcttgtacacccaaggttatatatcctatccacgcacggagaccacccactacccggagaacttcgatctcaagggatcactccgccaacaggctaaccacccgtactgggctgacacagttaaacgactgttggcggaggggattaacagacccaggaagggccatgacgccggtgaccacccccctatcacccccatgaagagtgccacggaggctgagctgggaggcgatgcctggaggctgtatgaatatattacgaggcattttattgctactgtctctcacgactgcaagtatctgcagtctacaattagctttagaatcggcccagagttgtttacttgctcgggtaaaacggtgctttctcctggattcaccgaagttatgccatggcagagcgtcccactagaggagtctctgcctacgtgtcagcgcggagatgccttccccgtcggggaagtaaagatgcttgagaaacagactaacccaccagactatcttaccgaggcggaactcattacactgatggaaaaacacggaatcggtaccgacgcctctattcctgtgcacataaataacatttgccaacgaaactacgtgaccgtggaatctgggaggaggctgaagcctacgaacctgggcatcgtcttggtgcacgggtattacaagatcgatgctgagctggtccttccaacaatccggagcgcggttgaaaaacagctgaacctgatagcccaggggaaggccgactaccggcaagtgctgggacacaccttagacgtttttaaacgtaagttccattacttcgtcgactccatcgcgggtatggacgagttaatggaggtaagcttttccccactggctgccactggcaaacctctgtctcgctgcggtaagtgtcatcgattcatgaaatacattcaagctaagcccagccggttgcactgtagccactgtgacgagacttacaccctgccccagaacggcacaattaagctctacaaggaattgaggtgccccttggacgactttgagctcgtcctgtggagtagcggttcacggggtaagagctaccccctgtgcccatactgctacaatcatccgccttttcgcgacatgaagaagggtatgggctgcaatgaatgtactcatccttcctgtcagcacagtctaagtatgctggggattggtcagtgcgtggagtgtgaatctggggttctcgtgctcgatccaacctctggacctaagtggaaggtggcgtgtaataagtgtaatgtggtggctcactgtttcgagaatgcccatcgcgtacgggtgtctgcggatacctgttctgtttgtgaagcagccttgcttgacgtcgacttcaacaaagcaaagtcgccattgcccggagacgagacccagcacatggggtgtgtgttctgcgacccagtgttccaggagttagtggaacttaagcacgccgctagttgtcatcccatgcatcgaggaggacccggtaggcggcagggcagggggaggggcagagccaggcgaccccctggcaaacctaaccctcgacggcctaaggacaagatgtctgccctagccgcttattttgtgtag

SEQ ID NO: 31197 - DNA, 849 bp, Artificial Sequence
  Description of Artificial Sequence: Synthetic coding sequence
atgtttttgaatatgactaagctcgagaaagaggctcaggtggaagctacctcccggaaagagaaggcaaagcagcggccactagcattgaacacagtggagatgctacgtgtggctagttctagcttggggatgggccctcaacacgcaatgcagacggccgaaaggctctacactcaggggtatatctcatacccacggaccgaaaccacccattaccctgagaactttgatttgaagggatcattgcggcagcaggccaatcacccttactgggctgacacagtgaagcggctgttggcagaaggaattaacaggcctcggaagggccatgacgcaggggatcaccccccaataactcccatgaaatcagccactgaggccgaactgggcggagatgcctggcgcctttacgaatacatcactcgacacttcatagcaaccgtgtctcacgactgtaaatacctgcagtccacaattagtttcaggatcggacccgagctcttcacttgttcagggaaaacagttctgagccccggattcacagaagtgatgccgtggcagtccgtcccactggaagagtctctgcccacctgccagagaggtgatgcattccctgtgggggaggtcaagatgctcgaaaagcagactaacccacccgactacctcactgaagctgaactaattaccctgatggagaaacacggtattggcggatgtgcctgccctggcccacgagccggttctgtgtcttccactcaagcttcatctctgctaacaaagctccctaggcagccttgtgttcccagccctgcacccctccacggtctggtctccggcaactggtag

SEQ ID NO: 31198 - DNA, 741 bp, Artificial Sequence
  Description of Artificial Sequence: Synthetic coding sequence
atgaagacggtgttaatggtagcggaaaagcctagcttagctcagtccattgctaaaattctgtctcgcggatcgttatcatcccacaaaggactgaatggcgcatgttccgttcatgaatataccggcacgttcgcgggacagccggtgcggttcaagatgacgtctgtctgcggccacgtcatgacattagacttccttggtaaatacaataagtgggacaaagtggacccagcagaactcttctctcaggccccaacggagaagaaagaagcaaatcccaagttgaatatggtgaagtttctccaggtagaagggcgtggttgcgattacattgtcctgtggcttgattgtgataaagaaggggagaacatctgtttcgaggtgctcgacgctgttctgccagtgatgaacaaggcacacggcggtgagaagactgtgtttcgtgcaagatttagttccatcactgacactgacatttgtaacgccatggcatgcctcggagagccagatcacaatgaggcccttagtgttgacgcccgacaggaactcgatctcagaatcggctgcgcattcacgaggtttcagacgaaatactttcaaggcaaatacggagatctggacagtagtttaatttccttcggaccctgtcaaacacctaccttgggcttctgcgtcgagcgccacgacaagatccaaagctttaaaccagagacctactgggtgctgcaggcaaagtag

SEQ ID NO: 31199 - DNA, 366 bp, Artificial Sequence
  Description of Artificial Sequence: Synthetic coding sequence
atgaagaccgtgctcatggttgccgaaaaaccttccctcgctcagtcaattgcgaagatcctatcgcgaggatcgcttagtagccataagggtctgaatggagcatgttcggttcacgaatatacaggtacctttgccggacagcccgtaaggttcaaaatgactagtgtgtgtggtcacgtcatgacgctggattttcttggaaaatacaataaatgggataaggtggatcctgccgaactgttttcacaagctccaaccgagaaaaaagaagccaaccccaaactcaacatggtgaagttcttgcaagtggaaggcaggggatgcgactatattgtgctctggctcgactgcgataaagagtag

SEQ ID NO: 31200 - DNA, 66 bp, Artificial Sequence
  Description of Artificial Sequence: Synthetic coding sequence
atgaagaccgtcctcatggtggctgagaagcccagcttggcccagtccatcgctaagatactctag

SEQ ID NO: 31201 - DNA, 129 bp, Artificial Sequence
  Description of Artificial Sequence: Synthetic coding sequence
atgaagaccgtgcttatggtggcagagaaaccaagtctggcgcagtcaatcgctaagattctctctcggggttctttgtctagtcacaaggggctgaatggggcatgtagcgtgcacgagtacacttag

SEQ ID NO: 31202 - DNA, 369 bp, Artificial Sequence
  Description of Artificial Sequence: Synthetic coding sequence
atgaaaactgtgctgatggtcgctgaaaagcccagccttgctcagtctatagccaaaatcctgagcaggggctctctctcttcccataagggattgaacggagcgtgctcagtgcatgaatacactggaacattcgccggtcagccagtgcgcttcaagatgacaagtgtctgcggtcacgttatgacattagactttctggggaagtacaacaaatgggacaaggtcgaccctgctgaattattttcacaggcaccaacagagaagaaggaggctaatcccaagctgaatatggtgaagttcttgcaggttgaaggaagaggatgcgattatattgtgctctggcttgactgtgataaggaggggtag

SEQ ID NO: 31203 - DNA, 144 bp, Artificial Sequence
  Description of Artificial Sequence: Synthetic coding sequence
atgaaaaccgtgctgatggtggccgaaaaaccctcactggcccagagcatcgccaagatactcagtagggggtccctgtcctcccataaagggctcaacggtgcctgttcagtgcatgagtatacgggcactttcgcagggtag

SEQ ID NO: 31204 - DNA, 399 bp, Artificial Sequence
  Description of Artificial Sequence: Synthetic coding sequence
atgaagactgttctcatggtcgccgaaaagccctccttagcacagtcaatcgctaaaatcttgtctcgtggaagcctgtcttctcataagggactcaacggggcttgcagcgtgcacgaatataccggcaccttcgccggtcagcccgtgaggtttaagatgacaagtgtgtgcgggcatgtcatgaccctcgattttctaggcaaatataacaagtgggataaagtagaccccgctgaactcttctctcaggccccaacagagaagaaagaggccaatcctaaactgccccaggcctctgtttgcactcaagcagcccctggtgtgcggccacatccttgtccaccagccgcagctagggttgcagacagggtagtaccatgtgggccagtgacttag

SEQ ID NO: 31205 - DNA, 183 bp, Artificial Sequence
  Description of Artificial Sequence: Synthetic coding sequence
atgaagaccgtcttaatggtggcggagaaaccatcattggctcagtctattgccaagattcttagccggggttccctgagctcccacaagggcctgaacggcgcatgcagcgtacatgagtacacagggacttttgctggccaacctgtgaggttcaagatgactagcgtgtgcgggcactag

SEQ ID NO: 31206 - DNA, 186 bp, Artificial Sequence
  Description of Artificial Sequence: Synthetic coding sequence
atgaagaccgtacttatggtcgccgaaaaaccctctctagcacagtcaatcgccaagatattgtcacgaggatcgctgagctcgcacaaggggctcaatggggcttgcagtgtgcacgaatacactggcaccttcgctggtcaaccagtgcggtttaaaatgaccagcgtctgcggacacgtgtag

SEQ ID NO: 31207 - DNA, 1578 bp, Artificial Sequence
  Description of Artificial Sequence: Synthetic coding sequence
tgacttgactcctccctgatctcatttggtccctgccagactcccaccctggggttctgtgttgaacggcatgataaaattcagagcttcaagcccgagacgtactgggtgttacaagccaaggtgaacacggacaaagacagatccctgttactcgactgggaccgggtacgggtgttcgatagagaaatcgcgcaaatgtttctgaatatgactaagcttgaaaaagaggcgcaagtggaggcaactagcaggaaggagaaagctaaacagcgcccactcgcgctgaatacagtggaaatgcttcgggtggctagcagcagtctaggcatgggaccacagcacgccatgcagactgccgagcgactgtacacgcagggctacatctcctacccacgtaccgagaccacccactatcctgagaacttcgatctgaaaggaagcctacggcagcaggccaatcatccgtactgggccgataccgttaaaaggttactcgctgagggaatcaaccgccctcggaaaggacacgacgccggagaccatccgcctataacccctatgaaatcagccaccgaagctgaacttgggggagacgcttggcggctgtatgagtacataacaagacattttatcgctacagtatcccacgattgcaaatatctacaatcgacaatcagttttaggattgggcctgaactttttacttgcagcggaaaaaccgtcctttcgcccggtttcaccgaagtcatgccttggcagtcagtgccgcttgaagaatccctgccgacctgccagcgcggagatgcttttcccgtgggcgaggtgaagatgctggaaaaacagaccaatccaccagattatctgaccgaggctgagttaattactctgatggaaaaacacggcatcgggactgacgccagcattcctgtgcacattaataacatttgtcagcgcaattacgtcactgtggaaagcggccgaagattgaaacccacgaatctaggcattgtgctcgtgcatgggtactacaagatagacgccgagctggtgcttcctacaatcaggtcggcagtagaaaagcagctaaacttgattgctcaaggcaaagccgattataggcaagttctcgggcacactttggatgttttcaagcgaaagtttcactacttcgtggattctatcgccggtatggatgagctcatggaggtttccttcagccccctcgccgctacagggaagcccttgtcccgttgtgggaagtgccacagatttatgaagtacatacaggcaaaaccctccaggctccattgttctcactgtgatgagacatacaccctcccacagaacggcacaattaaattgtataaagagctccggtgtcctctcgatgattttgaattagtgctgtggtcttccggctctcggggaaagtcatatcccctgtgtccctattgttacaaccatccacctttccgagatatgaaaaaaggggagtgttcccactctctgctgtctactgggagctgcagccttttctccgtccccaccccagctctccatcaggccggactgtag

SEQ ID NO: 31208 - DNA, 951 bp, Artificial Sequence
  Description of Artificial Sequence: Synthetic coding sequence
atgtcagccgaggtggagacatccgagggtgttgatgaatctgaaaagaagaactctggtgccctggaaaaagagaatcagatgcggatggcagatctaagcgaactgttgaaagagggcaccaaagaagcacacgaccgggctgaaaacacacagttcgtaaaagacttcctgaaggggaacatcaaaaaagagctcttcaagctggccaccacagcactctacttcacatactcagccctggaggaagaaatggagcgtaacaaagaccacccagccttcgccccactctactttccaatggagctgcatcgcaaggaagccttgaccaaggatatggaatatttcttcggcgagaattgggaggaacaggtgcagtgccctaaagcagcgcagaagtatgtggagagaatccactacataggccaaaatgaacccgagctcctggtagctcacgcttatacccgctacatgggggatctctcaggcggtcaggtgctgaaaaaagtggcccaaagggctctgaaactgccatccacaggggaaggcacccagttttatctatttgaaaacgtggataatgctcagcagttcaagcagctctaccgggctcgcatgaatgccctggatctcaatatgaagactaaggagcggatagtggaagaggccaacaaggctttcgagtacaatatgcagatctttaacgagttagaccaggctggatcaaccctcgcccgtgaaaccctagaggatggtttcccggtgcacgacggaaaaggcgacatgagaaaatgtccattctatgccgctgagcaggataagggtgctcttgagggatcctcctgccctttccggacagccatggcagtgctaagaaagccaagtttacagttcattttggccgctggagtagctctcgctgccggactcctcgcatggtattacatgtag

SEQ ID NO: 31209 - DNA, 1716 bp, Artificial Sequence
  Description of Artificial Sequence: Synthetic coding sequence
atgaaatgtcaaccacgcagtggagcccgtagaattgaggagcgcctccactacctgataaccacctaccttaagttcggaaacaacaataactatatgaatatggcagaggcgaacaacgcattcttcgcggcatctgaaacatttcacactccatcgctgggggacgaggaatttgagatcccacccattactcccccacccgagagtgaccccgctttaggaatgcccgatgtgctgcttccctttcaggctctttccgaccccctgccgagtcaaggcagcgaatttactccacagtttccgccacagtccttggatctgccctcgatcactattagccgaaacctcgttgagcaagacggcgttctgcattcgagtgggctgcacatggaccagtcccacacacaggttagtcaatacaggcaggacccatcgctaatcatgagatctattgtgcacatgacggacgccgctagaagtggggtgatgccccctgctcagctgacgacgattaaccaatcccagctgtccgcgcagctgggtcttaatctgggcggagccagtatgccacatacttctcctagccctcctgcgtccaaatccgccacgccaagcccgagtagttctattaacgaagaggatgctgatgaggccaatcgtgccattggagaaaaacgtgccgctcctgactcaggcaagaaaccaaagacacctaagaagaagaagaaaaaagacccaaatgaaccacagaagccagtatccgcttatgcgctgtttttcagagacacccaggccgcaataaagggtcagaaccccaatgcgacgttcggcgaagtatccaagatcgtagcttctatgtgggactccctgggcgaggaacaaaagcaggtgtataaacgcaaaacagaagcagccaaaaaagagtaccttaaggctctcgcagcatatcgcgcttctctggtctcgaaggccgcagctgaaagcgcagaagcccagactatacgaagtgtgcagcagacattggcaagtacaaatttaaccagctccctgcttctgaatacccccctaagccagcatggaactgtgtcagcaagtcctcaaaccctacagcaatccctgcctagatcaatcgcaccaaagccattaacaatgaggctacccatgaaccagatcgtaacgagcgttacaatagccgcaaatatgccttccaacataggggctcccctaatcagcagcatgggtaccaccatggtgggatctgcgccatcaacgcaggtgtcccccagtgtgcagactcagcagcatcaaatgcagttgcagcaacagcaacagcagcaacagcagcaaatgcaacaaatgcaacagcaacagctgcaacagcaccaaatgcaccagcagattcaacagcaaatgcagcagcagcacttccagcaccacatgcagcagcacctccagcagcagcagcagcatctccagcagcagatcaaccagcagcaactccagcaacagttgcagcagagactgcagctgcaacagttacagcatatgcagcatcagtcccagccaagcccacggcagcactcccccgtggcctcccaaatcactagcccaatacctgccatcggttctcctcagcccgctagccagcagcaccagtcccagattcagtcacaaactcagacccaagtgctaagtcaggttagcatcttctag

SEQ ID NO: 31210 - DNA, 5816 bp, Artificial Sequence
  Description of Artificial Sequence: Synthetic coding sequence
atgcagtcattccgtgagcagtcctcttatcatgggaatcaacagtcatatcctcaggaagtccatggaagcagccgactggaggagtttagccccaggcaggctcagatgttccagaattttggtggcacagggggatcttccggctccagcggtagtgggtctggcggaggaagaaggggcgcagcggcagccgcagccgcaatggcttcagagacaagcgggcatcagggataccaggggttccggaaggaagcaggagacttttactatatggcaggcaataaggatcctgttactactggtactcctcagccgcctcagagacgcccaagtggacccgttcagtcgtacgggcctccacaggggtcttcgttcggaaatcagtatggctctgaaggtcatgttggtcaatttcaggcgcagcattctggtctcgggggtgtgagccattaccagcaggattacacagggccattctcccccggatcggcacagtatcagcagcaagcttcttcgcagcagcagcagcagcaggttcagcagctgcgtcagcaattataccagagtcatcagcccctgcctcaggcgacaggtcagccggcatctagcagcagccacctacagcctatgcagagacccagcacactccccagtagcgccgctggctatcagctgagagtggggcagttcggtcaacactaccagtcgtctgctagctcgagctcctcatcctctttcccctccccacagaggttcagccagtccgggcagagctacgacggctcctataacgtaaatgcaggttcccaatacgagggtcacaatgtgggctcaaacgctcaggcttacggaacccagagcaattactcttaccagccgcagtctatgaaaaattttgaacaggctaaaattccgcaggggacgcagcaggggcaacaacagcagcagcctcaacagcagcaacacccctcccaacacgtgatgcagtacaccaacgcagctactaagcttcctctgcagtcacaggtcgggcaatataaccaaccagaagtgcccgtgcggtctccgatgcaatttcaccagaacttcagtcccattagcaaccctagccccgctgcatcagtggtgcaaagcccttcttgctcttcaacacctagccctctgatgcagactggcgagaacctgcagtgcgggcaaggcagtgtccccatgggttctcgcaatcggatcctgcaattaatgccgcagctctcgcctaccccaagtatgatgccgagccccaactcacatgccgctgggttcaagggcttcggactggaaggcgtacctgagaaaaggctgacggacccaggcctatccagcctttcagcactgagtacccaagtagctaatctgcctaacaccgtccaacacatgctactctcggacgcgttgaccccccagaaaaaaacttccaagagaccttcttccagcaaaaaggctgactcctgtactaatagcgagggctctagtcagccggaggagcaattgaagagccctatggctgaaagtctggatggaggctgctcttcctcttcagaagaccagggagagcgggtgaggcagttgtcagggcagtccacttcctccgacacaacctacaagggcggtgctagtgagaaagctggcagctctcctgcgcagggggctcagaacgagccccctagactgaacgctagccctgcagccagagaggaggctaccagccccggagctaaggacatgcctctcagcagcgatgggaatccaaaggtgaacgagaaaactgtgggtgttatcgtaagccgggaagccatgactggccgagtagaaaaacctggtggacaggataagggcagccaagaggatgatccagctgccacccaacgacctccttctaatggcggagccaaggagacctctcacgccagcctgccccagcctgagcctcccggaggcggaggcagtaaaggaaacaagaacggcgataacaactctaaccataacggagaaggcaatgggcagagtgggcactcggcggctggcccagggtttacgagtcgaacagagcccagcaaatccccagggagtctgcgctatagttataaagatagcttcgggtctgcagttcctaggaacgtctctgggttcccccagtatcccaccgggcaggaaaagggcgacttcacagggcacggcgagcggaaagggcgtaatgagaaatttccctccttgttgcaggaggtcttgcagggttatcaccaccatcctgaccgacgctatagtcggtcaacacaagagcaccagggcatggccggaagtctggagggcaccacccgcccaaatgtgctcgtctcacaaaccaatgaactggccagccgaggactcctgaataaatccatcggctccctgctggagaatccccactggggaccttgggaacggaagtcttcatccacagcacctgagatgaagcaaataaacttaactgactatcccatccctcgtaagttcgagattgagccccagagcagcgcgcacgaacctggcggtagcctttccgagagacgcagtgtgatttgtgatatttcccctctgcggcaaatagtgagggaccccggtgcacactcattagggcacatgtcagctgacacccggatcggtcggaacgatcggctaaatcctaccctttctcagtcggtaatccttcccggagggctggtttcaatggagaccaaactcaagtcccagtctggtcagattaaggaagaagacttcgagcaatcaaaaagccaagccagtttcaataataagaaatccggcgaccattgtcatccaccttccattaaacacgagagctaccggggaaacgcctcacccggtgcggctacccatgatagcttgtccgattacggtccccaggatagccggcctacccccatgcgccgtgtcccagggagagtcggcggacgggagggaatgaggggacggtccccctctcaataccatgactttgctgagaaattaaaaatgagtcctggcaggagccggggtcccggaggagacccccatcatatgaaccctcatatgaccttttccgagagggctaatcggtcgtcgctgcacacgcccttttccccaaatagcgaaacattggcatctgcataccacgcgaatacgagggctcacgcatacggcgaccctaatgccggattgaattcccaactgcactacaagagacagatgtatcagcaacagccagaagaatataaagactggtcatcaggttctgctcaaggtgtaatcgcagcagctcagcatcggcaggagggtccacggaaaagcccaagacaacaacagttccttgatagggtgcggagccccctgaaaaacgacaaagacggcatgatgtacgggccacctgtcggaacatatcatgatccaagtgctcaggaagcaggcagatgcctgatgagttcagatggcctgcccaataagggaatggagctaaaacatggatcacagaagctccaggagtcctgctgggatctatccagacaaacttcaccagcgaaatcatccggccctcccggtatgtcatcgcagaaacgctatggccctccccatgagaccgacggacatggacttgcagaagccacgcagtcctctaaacccggaagcgtgatgctgcgcctgcctggacaggaggaccactcctcgcagaaccccttaattatgaggaggagggttagatcttttatttcccccattccctcgaaacgacagagccaggatgtcaaaaactcaagcaccgaggataaaggccgtctcctgcacagctcgaaggaaggcgcagataaagccttcaattcatatgctcatcttagtcatagccaggatattaaatctatccccaagagagatagcagcaaagatctaccgtcccctgactctaggaactgtcctgccgtgacactgacttctcctgctaaaaccaagattctccccccacgaaaaggaaggggactgaaactggaggccatcgtgcagaagatcactagcccgaacattaggagatctgcttcatctaactctgctgaggctgggggtgacactgtgaccctggacgatatcttatcccttaagagcggcccaccagagggcggatctgtggctgtacaggacgccgacatcgaaaagcgcaagggcgaggtggcctccgatctggtgtctcctgcaaaccaagagctccacgtcgaaaagccgcttccacgcagctctgaagaatggcgcggttctgtcgatgataaggtcaaaaccgaaactcatgcggagacggtgacggcgggaaaagagcctcctggagcgatgactagcactacaagtcagaagcctggttcgaatcaggggcgaccagatggatctttggggggaactgcacctctgatttttcccgactccaaaaacgtgcctcccgtgggcatcctggcccctgaggccaacccgaaagcggaggaaaaagagaacgatacagtgactatatctcccaaacaggaaggcttcccgccaaagggctatttcccttctgggaaaaagaaaggcagaccaatcggctccgtgaacaagcagaaaaaacagcaacagccaccaccgcctcctccccaaccacctcagatcccagagggcagcgccgacggggaacccaaacccaaaaaacagcgacagcgtcgcgaacgcagaaaacccggagctcaacccaggaaacgcaagacaaagcaggcagtgccgatcgtagaaccacaggagcctgagatcaagctgaagtacgctactcagcccctggacaaaactgatgccaaaaacaaatcattctacccatatatccacgtcgtgaataaatgcgagcttggtgcagtttgcaccattattaacgctgaggaggaggagcaaacaaagctggttcgtgggcgtaagggacaacggagtctgacaccccctcctagtagcactgagtctaaggcgctgcctgcatcctcctttatgctgcaagggccagtcgtgacagagtcaagtgtcatgggccatctggtctgttgcctgtgtggtaagtgggcctcttacagaaatatgggagacctgtttggaccattctatccccaagattacgctgccacactgcccaaaaaccctccgccaaagcgggcaactgagatgcaatcaaaggtgaaggtcaggcataagagcgcaagcaatggttcaaagaccgataccgaggaggaagaggaacaacaacaacagcagaaagagcagagatctttggccgctcacccacggtttaaacggagacatcgctcagaggattgtggcggaggtcccaggtctcttagcaggggtctcccctgcaaaaaggctgcaaccgagggctcgagcgaaaagaccgtactggacagcaaaccaagcgtacccacaacaagcgaaggaggccctgagttagaactgcaaatacccgagctccccttggacagcaacgagttttgggtgcacgagggctgtatcctttgggccaatggcatttatctcgtgtgcggaaggctttatggcctgcaggaggctcttgaaatagcacgtgagatgaagtgtagccactgtcaggaagctggtgctaccttaggatgttacaacaaaggttgttctttccgctaccactacccgtgcgctatagacgccgactgtctcctgcacgaagaaaattttagtgttagatgcccaaagcacaaggtacgcttgtggcgcta

SEQ ID NO: 31211 - DNA, 5882 bp, Artificial Sequence
  Description of Artificial Sequence: Synthetic coding sequence
atgcagtctttccgagagcagtccagctatcacggtaaccagcagagctatcctcaggaggttcatgggagcagcaggctagaggaattctcacccaggcaggcccagatgttccaaaattttggcggaactggcggatctagcggctcatcaggatccggctctgggggaggcaggcgcggtgccgcagccgcagctgcggcaatggcatcggaaacatcaggacaccagggttatcagggcttccgaaaggaggcaggcgacttttactacatggccggaaacaaggatccagtgactaccgggaccccccagccaccccagcgaagaccaagtggacctgtgcagtcatatgggccaccccagggcagtagctttgggaatcagtacggttctgagggccacgtgggccaattccaggcccagcacagcggtttaggaggcgtctctcactaccagcaggattacactgggccattctctccagggtcggcccagtaccagcagcaggctagctctcaacagcagcagcagcaggtgcagcagcttaggcagcaactgtaccaatcacatcaaccactccctcaagcgaccgggcaacctgctagcagcagtagtcacctgcagcccatgcaacgccctagcaccctcccgagttctgcggcaggttatcagcttcgcgtagggcagttcgggcaacactaccagtctagcgcaagtagtagtagtagttcttccttcccatccccacagagattttcccagagtggccagtcgtatgacggcagctataatgtgaatgcaggctcgcagtacgaaggtcacaatgtcgggagtaacgcgcaggcttacggaacgcagagcaattattcttaccagccacagagcatgaaaaactttgagcaagccaaaattccacaaggcacccagcagggccagcaacaacaacagccccaacaacaacagcacccatcacagcacgtgatgcaatacaccaacgcagccaccaagctgcccctacaatctcaggttggacagtacaatcagcctgaagtgcccgttcgtagtcccatgcagtttcaccaaaactttagtccaatctctaatccttcccccgctgctagtgtggtgcaaagtccatcttgcagctccacgccttctcctctgatgcagaccggagagaacttacaatgtggacagggctccgtaccaatgggttcacgtaaccggatcctccagctcatgccgcaactgagcccaaccccgagcatgatgccatcacctaacagccatgccgctggatttaagggatttggcctcgagggagtgccagaaaagcggctgaccgaccccggtctctcttctctctccgccctctccacacaggtggctaacctcccaaacacagtgcagcacatgctgctgagtgatgctctcacacctcagaagaagacaagcaagagacctagtagctccaagaaggccgactcctgtacaaacagcgagggctcctctcagcctgaagagcagctgaaaagtccgatggccgagtctctggacggaggctgctcatcttctagcgaggaccagggcgaacgggtcagacagttgtcaggtcagtctacgagctcggacaccacttacaaaggcggagcctccgaaaaagccggtagcagccctgcacagggagcacagaacgaacctccgcgactgaacgcttctcctgccgctagagaggaggccacttcacccggtgccaaggacatgcctctcagctctgacgggaatcccaaggtgaacgaaaaaaccgtgggagtcatagtgagccgtgaagcaatgactggccgtgtagagaagccgggaggccaagataaggggtcgcaggaggacgatccagccgctactcagcggccaccctccaacggaggcgcaaaagaaacgagtcacgcttctctgccccagcctgagccccctggcggtgggggttctaaagggaataagaacggcgacaacaactccaatcataacggcgaaggaaatggccaatcaggacacagcgcagccggtcccggtttcacatcgcgaactgaaccctctaagtccccagggagcttacgatatagctacaaagattctttcggttcagccgtccccaggaacgtaagtggtttcccccagtatcccactgggcaggagaaaggggatttcaccgggcatggggagcggaaggggagaaatgaaaaattcccctccctgctccaagaggtactgcagggataccaccaccatcccgaccggagatactcaagatcaactcaagagcaccaggggatggcaggttcgctggagggcacgactagaccaaacgtcctagtatctcagacaaatgagttggcatctaggggtctgctgaacaaatcgatagggtctttgttggagaaccctcactggggaccatgggagaggaaatcgagttccactgcacctgaaatgaagcaaataaatctcacagattacccgataccgaggaaatttgagatcgaaccacagagttctgcccatgagccaggcggtagcctgagtgagcgccgttccgtgatatgtgatatatctccactccggcagatagtccgggaccccggtgcccactcccttggacatatgtctgctgacacccggattgggaggaatgaccgcctaaatcctactctgtcccagtcagtcatcctgccgggtgggctcgtgagtatggagaccaaactcaagagtcagagtggacaaattaaggaagaggactttgaacaaagtaagagccaggcatcgttcaataacaagaagtctggggatcactgccatccaccaagcatcaagcacgaaagctatcggggaaacgctagcccgggagctgccacccacgactcactgtcagactatgggccacaggactctaggcccactcccatgagaagggtacccggacgcgtgggcggtagggaggggatgcgcggtcgcagtccctctcaatatcatgacttcgctgaaaaactcaagatgtctccgggtcgaagtcgtggcccagggggtgatcctcatcatatgaatccccatatgacatttagcgagcgggctaatagaagctctctacatacaccctttagtccaaactcggaaacccttgcctcagcctatcacgccaatacccgggctcacgcctatggcgaccccaacgccggacttaattcacagttgcactacaaacgccagatgtaccagcagcagccagaggagtacaaggactggtcctccgggagtgcacagggagtaattgccgctgcccagcataggcaggaaggccctcgcaagtctcctcggcagcaacagttcctagacagggtgagaagccccttgaaaaatgacaaagacgggatgatgtacggacctccggtgggaacataccacgacccatctgctcaggaggctgggagatgcctaatgtcaagtgacgggctccctaacaagggtatggaattaaaacacggcagccaaaagttgcaggagtcctgctgggatctcagtcgacaaacatcaccagcaaagagttcaggacctcctggcatgtcctcacagaaaaggtacggacctccacatgaaacagatgggcatggactggccgaggcaactcagtcaagcaagcctggatcagtcatgctgaggctgccagggcaggaggaccactcttcgcaaaatccattgattatgagacgacgggtacggtcgttcatttcaccaattccttcaaaacgacagtcacaggatgtaaaaaatagctctacagaggataagggtcgtctattgcactcatcaaaggaaggcgctgataaagcttttaactcttacgctcatctgtcacactcacaggacatcaagtctatcccaaagcgcgacagctccaaagacctgccttcgcccgactctcgcaactgtcccgcagttacattaacctctcccgctaagacaaagattcttccccctcgaaaaggtcggggtttgaaactggaagccatcgtgcagaagatcacctcgccaaatatacggaggagtgcatcttcaaattccgcagaagccggaggagacactgttacattggatgatatcctgagcttgaaatctgggcctccagaaggaggctctgtagccgtgcaagacgccgacatcgaaaagcgcaagggagaagtcgcctctgacctcgtcagccccgctaatcaggagctccacgtggaaaagccccttcccaggtcttccgaggagtggcggggttcagtcgacgataaagtgaaaaccgaaactcacgccgaaacagtaaccgcgggaaaagagcctcccggtgccatgacttctacgacgagtcagaagcccggatccaaccagggccgtcccgatggcagcctgggcggaaccgccccactcatcttccccgattcaaaaaacgtgccccctgtgggcattctggctcccgaggccaacccgaaggccgaagagaaggagaacgacacagtcactatatcacctaaacaggagggattccctcctaaaggctatttcccctccgggaaaaagaagggtcggcctatcgggagcgtcaataagcagaagaagcagcaacagccccctccccctccacctcagccgcctcagatcccggaaggttctgcagatggcgagcctaaaccaaagaaacaacgccagcggcgagagcgccgaaaacccggtgcccaaccacggaaaaggaaaaccaagcaggccgtacctatcgtggaacctcaggagcccgaaatcaagctgaagtacgccacacagcccctggataagactgacgcaaagaataaatctttttacccttatattcacgtcgtgaacaagtgtgagttaggtgccgtttgcaccattatcaacgcagaggaagaggagcagacaaagttggtgcggggtcgcaagggccagagatccctgaccccccctccatcttcaacagagtccaaggctctgcctgcgtcaagctttatgctgcagggtccagttgtgaccgagagtagtgtcatggggcacctggtgtgctgcttgtgcgggaaatgggcaagttatcgtaatatgggagacctcttcggccctttctacccgcaggactatgccgctacactgcccaagaaccctcccccaaaacgcgcaaccgagatgcaatcgaaagtgaaggtgaggcacaaatcggcgtccaacggatccaagactgacactgaagaggaagaggagcaacagcaacaacagaaggaacagcgttctctagcggctcatcctagattcaagagacggcaccgctctgaagactgtggaggcggacccaggtccctatcccggggtctcccctgtaagaaggctgctacagagggctctagtgaaaaaaccgtcctggacagcaagccttctgtccctacaacctcagaggggggacccgagttggaactgcagattccagagctgcctctcgacagcaacgagttttgggtgcacgagggctgtatcttgtgggcaaatggcatctatctggtttgcggtcgcctgtatggccttcaggaggctctcgaaatcgctcgagagatgaagtgtagccactgtcaggaagctggcgctactcttggatgctataataaggggtgtagtttcagataccactatccgtgcgcaattgacgccgattgcctgctgcatgaggaaaatttttctgttagatgtcctaagcataaacccccacttccttgcccccttcctccactgcagaataaaacagctaaagggtccctgtccactgaacagagcgaaagaggcta

SEQ ID NO: 31212 - DNA, 540 bp, Artificial Sequence
  Description of Artificial Sequence: Synthetic coding sequence
atgtcaacagggagcctttcagatgtggaggacctgcaggaggtcgaaatgctggagtgcgacggattgaagatggactccaataaagagttcgtgacctccaacgagagcacggaggaatcctccaactgtgagaatggtagtcctcagaaaggcaggggcggtctggggaagcgccgaaaggccccaactaagaagtctcccctttccggagttagtcaggagggtaagcaagtccaaaggaatgctgctaatgccagagaaagggctaggatgagagtgttgtcgaaagcctttagccgcctgaagaccacactgccttgggttcctccagacaccaagcttagtaaactggatactttgcgtttagcatccagctatatcgctcacctccgacagatcctggctaatgacaaatacgagaacggctatatccatcctgtaaatctgacatggccattcatggtggcaggaaagcccgaaagcgaccttaaagaggtggtgacagcatcgcggctatgtgggaccacagctagctag

SEQ ID NO: 31213 - DNA, 540 bp, Artificial Sequence
  Description of Artificial Sequence: Synthetic coding sequence
atgagcactggctccctctccgacgtcgaggatttgcaggaagtggagatgctggaatgtgatgggctgaagatggattctaataaagaattcgtgacaagcaacgagtcaacggaagagtccagcaactgcgaaaacggcagcccccagaaaggaaggggcggattgggcaagcgcaggaaagccccaactaagaagtctcccctgtctggtgtcagtcaagagggcaagcaggtgcaaaggaatgccgcaaacgcgagagaaagggcccgaatgcgagtgctgagcaaggccttctcacggctgaagactaccctgccttgggtgccaccagacaccaagctgagtaaattggacacgctcaggctggcttcatcatacattgcacatttgcgacaaatcctcgctaatgacaagtacgaaaacggctacatacaccctgtgaaccttacctggccatttatggttgctggaaagcctgagtccgacctgaaggaggttgtaacagcatcaaggctgtgcggaactacagcttcatag

SEQ ID NO: 31214 - DNA, 1965 bp, Artificial Sequence
  Description of Artificial Sequence: Synthetic coding sequence
atgaatcagcctcagcggatggcaccagtggggaccgataaggagctctccgatctcctggatttttcaatgatgtttccgctgcctgtgaccaacggaaaaggcagacccgcttcattggcaggcgctcagtttggcggatccgggctggaggacagaccctcatctggttcatggggaagcggcgatcagtcatctagttcctttgatcctagccggaccttcagtgaggggacgcactttacggagagccattccagccttagttcaagcacattcctcggtccaggtctgggcggaaaatcaggcgagcgaggggcatacgcgagcttcggcagagacgcaggcgtggggggacttacccaggctggatttctcagcggagaacttgcgctcaacagccccggtcctttgtcaccgtccggcatgaaggggactagccaatattaccccagctattcaggctcttctcgcaggcgcgctgccgacggctctctggacacccagcccaagaaagtgcggaaggtgccccctggcctgcccagctccgtataccccccttcaagcggtgaagattacggtagggatgcaacggcctacccttctgcgaaaacgccatccagcacataccccgctccattttacgtcgccgacggctccttgcatcccagtgctgaattatggagccccccaggacaagctggattcggcccaatgctcggcggtgggtccagtcccctgccactgcccccaggcagcggccctgtgggtagctccggaagtagtagcactttcggaggcctccatcaacacgagcgaatggggtatcaattgcacggcgcagaagtcaacggcggacttccttcagcatcatcctttagttcagccccaggcgcaacctacggcggtgtgtcatctcacaccccacctgtttctggggctgactcactgctaggctctcgcggtaccactgcaggaagcagcggcgacgcccttggaaaagccctcgcttccatttattcacctgatcactccagcaacaatttctcaagttcacctagtacaccagtaggctcccctcaaggactggctggaacctcccagtggccgagggctggggcacccggtgctctgtcgcctagttacgacggcggattgcatggcttgcagtccaagatcgaggatcatctggatgaagcaatccacgtcctgaggtctcatgccgttggtaccgcaggggatatgcacactctgctcccagggcacggcgctctcgcttctgggtttaccgggccaatgagtctgggcggaaggcatgcgggtttggtggggggatcgcatcctgaggatggcctcgctgggagcacaagtctgatgcataaccatgctgcactgccttctcagccgggaactcttccagacctttctagaccacctgatagttactctggtctgggtcgcgcaggtgccactgctgctgcatccgagataaaacgtgaagagaaggaggacgaagaaaatacttccgcggcagaccattctgaggaggaaaagaaagaattaaaggctccacgggcaaggacttcccccgatgaggatgaggacgatctccttccacccgaacaaaaagccgagagggaaaaggaacggagagtcgcgaataacgctcgggaacgcctccgggtccgggacatcaatgaggcttttaaagaattaggccgaatgtgccagttgcatcttaattcagaaaagccacagacaaaactgcttatcctgcaccaggccgtgtctgtgattctgaatttggaacagcaggtgagagaaagaaacctgaatcccaaggccgcttgcctcaagaggagggaggaagagaaagtcagcggagtcgtgggtgacccacagatggtgctatccgctccacaccccggattatctgaagcccataatccagctggacatatgtag

SEQ ID NO: 31215 - DNA, 1956 bp, Artificial Sequence
  Description of Artificial Sequence: Synthetic coding sequence
atgaatcagcctcagcgcatggcgcctgtgggcacggacaaggagctgtccgatctgctggatttcagtatgatgttccccttgccggtcacaaatggcaagggcagacccgctagtctggccggagcacagttcggaggatccggactggaggatagaccatcttccggcagctggggcagcggagatcagagctcatcttccttcgatccaagtagaacctttagcgaaggaacacatttcacagagtcccacagctccctatcctcttccacattcctgggtccaggtctcggagggaaaagtggcgaacggggagcatacgcctcatttgggagagatgccggagttggcggtctgacccaggccggattcctgtcaggtgaactcgccctaaacagcccgggaccgctaagtccatccggaatgaaaggaacctcccagtactatccgtcatacagcggatcatctaggagacgagctgcagatggcagtctggatacacaacccaagaaggtgcggaaggttcctccagggctgcctagtagtgtgtacccaccgtcatctggcgaagactacggccgagatgcaaccgcctatcccagcgcgaagactccctcctcaacataccccgcacccttttatgttgccgacgggtcactgcacccatccgcagaactgtggtcccctcccggtcaggccggtttcggccctatgttgggaggcggaagtagccccctgccccttccgccaggctctggacccgtgggtagctctggctcttccagtacatttggcggtctacaccaacacgaaagaatgggataccaactgcacggagctgaggtgaacgggggactgccctccgcgtcatctttttccagtgcgccaggcgctacctacggcggagtgtcaagccatacccctccagtgtcgggcgcagattccctgttgggcagtagaggcactaccgctggcagctctggcgacgctctggggaaagctctggcctctatctatagcccagaccattcgagtaacaattttagcagtagcccttctaccccagtgggctctcctcagggcctggcgggaacaagccagtggccgcgtgctggcgctccaggcgcattatcgcctagttatgacgggggactccacggcctccagagcaagattgaggatcacctggacgaagcgatccatgtgcttcggtcccatgccgtggggacagccggagatatgcacacgctgcttcccggacacggtgccctggcttccggatttactggaccaatgagcctaggtgggcgtcacgctggtctggttgggggtagccatcccgaggacggcctggcgggatcgacctccctgatgcataaccatgccgctctgccttcgcagcctgggacactcccggatctttctcgtccccctgactcttatagcggccttggacgggctggcgcaaccgctgccgcatcagagataaaacgggaagagaaagaggacgaggagaatacatccgcggcagaccactccgaggaggaaaagaaggagctcaaggcaccccgagccaggacctcctccaccgatgaggtgctgtccctcgaggaaaaggatctgcgcgatcgtgagcgcagaatggctaataatgcccgtgagagggtacgagtgcgcgacattaatgaggccttccgtgaactgggtagaatgtgtcaaatgcacttaaaaagtgataaggcgcagaccaagctgctgatcttgcagcaggctgtccaggttattctgggcctagaacaacaggtcagggaacggaatctaaacccgaaggccgcttgccttaagagaagggaggaagaaaaagtgagtggggtcgttggagatccccagatggtactcagcgccccacatcccggactgtctgaggcccataacccagcaggacacatgtag

SEQ ID NO: 31216 - DNA, 1977 bp, Artificial Sequence
  Description of Artificial Sequence: Synthetic coding sequence
atgaaccagccacagcggatggctcctgttgggaccgataaagagttgagcgatctattggatttttcaatgatgttcccactccccgttactaatggaaaggggagacccgcatcactggctggagctcagttcggaggttccgggaaatccggcgaaaggggggcttacgcttcttttggcagagatgctggcgtgggtggactaactcaggcaggctttctgagcggtgagctagcactaaattctccgggacctctctctccttctggaatgaaaggtacttctcaatattacccatcatattcaggctcttcccgacgccgtgcagccgatgggtctcttgatacccagccaaaaaaggtcaggaaagtcccgcctggattgcctagctccgtataccccccatccagcggtgaggattatggacgagacgcaacagcctacccttccgccaaaacaccgagcagcacctacccagctcctttctatgttgcagatggatctttgcatccctctgcggagctctggtctcctccgggtcaggctgggttcggaccaatgcttgggggaggctcatctccccttcctctccctccaggatccggacctgttggatcttcggggagttcctccacatttggcggactgcaccagcatgagcggatggggtaccagttacacggcgctgaggtgaacggaggtctcccctctgcatcttctttctcttccgctcccggtgctacatacggcggagtcagttcgcacacgcctcctgtatcaggggctgacagtctcctgggtagtcgcggaaccactgcgggttctagtggggatgcgcttggcaaggcgctggcctccatctattcaccggatcacagtagcaacaatttctctagcagcccaagtacccccgtaggcagcccccaaggccttgctgggacttcgcagtggcccagagctggcgcacctggggctctttccccctcttatgacggaggcctccatggtcttcaaagcaagatagaggaccatttagacgaagctatccatgtactgcgaagccacgcagttggaaccgctggagacatgcacactttactgcctggacacggggctctcgctagtggcttcacaggcccaatgagcctgggtggaaggcacgctggattggtaggaggctcccacccagaggacggcctagcaggatctaccagtcttatgcataatcatgcagcgctccccagtcagccgggtaccctgcccgacttgagccgcccacctgacagctactctggtctcgggagggcaggagcaaccgcagcagcttcagagatcaagcgagaggagaaggaggacgaagagaacacgtctgccgctgatcattccgaggaggagaagaaggaacttaaggcaccgagggcacgtacacggtgccagcctactccaagacacagccctcctagtcctcaccaggatgcccacgtccaccgaccccacgcccatcggactcataccgggcgaccttccgccggacctaccctatttccgcagccgcactgcctccctctcgcgccatcacggagacctccccactccccagacgaagacgaggacgacctcttgcccccagaacagaaagctgaaagggagaaagaacgcagggtcgccaacaatgctagagagcgcctccgcgtcagagatatcaacgaagcgttcaaggagttggggcgtatgtgtcagctccacttgaacagcgaaaaacctcaaactaagctgctcatactgcaccaggccgtgtctgtcattttaaatctggagcagcaagtccgtgagagaaatctgaatcctaaggctgcttgtttgaagagacgggaagaggaaaaggtttcaggcgtagtgggagatcctcagatggtcctatctgctccacacccaggtctgagcgaagcccacaatcccgcagggcacatgtag

SEQ ID NO: 31217 - DNA, 1956 bp, Artificial Sequence
  Description of Artificial Sequence: Synthetic coding sequence
atgaaccagcctcagagaatggcccctgtcgggaccgacaaagagttgtctgatctgcttgacttcagtatgatgttcccgctaccagtgaccaacggcaaaggcagacccgcatccctggctggcgcacagttcgggggttcaggactggaagaccggccaagcagcggatcctggggtagcggagatcagagcagttcttcttttgacccctccagaaccttcagcgagggcactcactttaccgagtcacattcctccctctcgagtagcacttttctgggccctggactgggaggcaagagcggggaacggggtgcctacgcatccttcgggcgtgacgctggcgtgggagggttgacacaggccggattcctgtctggggaactagcactgaattctcctggtcccctttcgccatctggtatgaaggggactagccagtattatccaagttacagtggtagtagcagacgcagggcagccgatggctctctggatactcaacccaaaaaggtgcgcaaagttccccctggcttaccctcatccgtgtatccacctagtagcggggaggattatggacgggatgcaactgcctaccccagtgccaaaaccccaagttccacataccctgctcctttttacgttgcggatggctccttgcacccttcagctgagctgtggtcacccccaggtcaggctggattcggacctatgttaggcggtggctctagtccactgcctctgccccctggctcaggacccgtcggctcatcgggcagtagctcaacattcggcggactacaccaacatgagcggatgggttaccagctccatggcgctgaggtgaacggtgggttgccgtccgcttccagcttttccagcgcccctggggctacctacggcggtgttagcagtcatacaccccctgtgtcaggggctgattccctgctgggctctagaggtacgaccgccggttcgagtggtgatgcgctcgggaaagccctcgcttctatttattcccccgatcactcatcaaacaacttttcgtccagcccatcaacccccgtgggatcccctcaggggctcgccggaacctctcaatggcctagggcaggcgctcctggcgcactgagtccctcgtacgacggaggtcttcacggacttcagtctaagattgaagaccatttggatgaagcaatccacgtgttgagaagccatgccgtgggaaccgcaggtgacatgcataccctcctgccaggccacggggcactggcctccgggtttaccggtccgatgagtcttggaggccgacacgctggcctggtgggcggttcccacccagaggatggactagccggttcaacctccctcatgcacaaccacgcggctctgccctcccagcctggaacactcccagacctgtctagaccaccagatagctactcaggcttaggcagagccggagccacagcagctgcctccgagataaagcgcgaggaaaaagaggacgaggagaacacttcggccgctgatcactcagaagaagaaaagaaagaactaaaagctccacgggctagaacaagttcgactgatgaagtgttaagcctggaagaaaaagatttaagagaccgggagcggaggatggccaacaatgcaagggagagagtgagggtgcgagatattaacgaggcctttcgagagctggggaggatgtgccagatgcacctgaagagcgacaaagcccaaaccaagctgctcattctgcagcaggctgtgcaagtcatcctcggcctagaacagcaagtccgggagcgaaatttgaaccccaaagccgcttgcttgaagcgccgagaggaggaaaaagtcagcggggtggtgggggatccacagatggtgttgtcagctcctcacccgggtctaagtgaggctcataaccccgctgggcatatgtag

SEQ ID NO: 31218 - DNA, 474 bp, Artificial Sequence
  Description of Artificial Sequence: Synthetic coding sequence
atgggttaccagctccatggtgcggaggtgaatggaggccttccctcagcttcttccttttcatccgctcccggagcaacatacgggggagtaagcagccatactcctcctgtgagcggggctgacagtctactcggttccagaggaactaccgccggatcctccggagacgcacttggaaaggccttggccagtatttacagccctgatcactcaagtaacaacttttcatcctcaccgtctacccccgtcggctccccacagggacttgctggaacatctcaatggcctcgggcaggcgcacccggagccttatccccctcttacgacggaggacttcatggcctcgtgggaggctctcatcctgaggacgggctggctggatccacgtctctcatgcacaaccatgccgcactcccctcacagccaggcaccctcccagacctatcgcgacccccagactcttattcttag

SEQ ID NO: 31219 - DNA, 2016 bp, Artificial Sequence
  Description of Artificial Sequence: Synthetic coding sequence
atgcatcatcagcagcggatggccgcactgggtactgacaaagaactttctgatctcctggacttttcagccatgtttagccctccagtgtccagcggaaagaatggccctacctcccttgctagcgggcacttcactgggagcaatgtggaagaccgatcatcctccggaagttggggtaacggcggacatccttccccctcccgcaactatggagatggcaccccctatgaccatatgacttctagggacctgggatcccatgacaacctgtccccacccttcgtcaattcccggatccagtccaagacggagcgcggaagttattcatcgtacggtagagaaagcaacttgcagggatgtcatcagcagtctctgctgggcggagacatggacatgggaaatccaggtacgctgagccccacaaaacccggttctcagtactaccagtattcatccaataaccccagacggagacctctgcactcgagtgccatggaagtgcagactaaaaaggtgcgcaaagtaccgcctggcctgccctcctctgtgtatgcccctagcgcttctactgccgactacaatagagattcaccgggatatcccagcagtaagcccgctacctccaccttccccagttctttcttcatgcaagatggccaccatagctcggatccctggtcctcatcctcgggaatgaatcagcctgggtacgcgggtatgttagggaactcctcccacatcccacagtccagctcctattgttccttgcacccccatgagcggctctcatacccaagtcattctagtgcagacatcaattccagccttccaccaatgtctacctttcaccggtctggcaccaatcactactccacctcttcctgcacaccccctgccaacggcacagactctattatggctaacaggggcagtggggctgccggatcgtctcagacaggcgacgcactgggcaaggccctggctagcatttattcccctgatcatacaaataattctttcagctccaatcctagcacacctgttggctccccaccgtccctgtccgccggtaccgcggtctggtcacggaatgggggacaggcgagctccagtcccaactacgaggggccattacactctctgcaatcacggatcgaggataggcttgagcgcctcgacgacgcgatacacgtactcaggaatcatgccgtgggacccagcactgccatgccaggagggcatggcgacatgcatggcattatagggccatcacacaacggggcaatggggggactcggctcaggatatggcacgggcctgctgtccgcgaacagacatagccttatggtcgggacacatcgagaggatggggtcgcgctgcgtggctcccacagtttgctgcctaatcaggtgccagtcccacagctgccagtgcagtcggcgacctccccagaccttaacccccctcaggatccctaccgcggaatgccacctgggttgcaaggccagagcgtttctagcggcagcagcgagatcaagtcggatgatgagggcgatgaaaatctccaggatacaaaaagctccgaggacaagaagctggacgacgacaagaaagatattaagagcatcaccagaagtagatccagcaacaacgacgacgaagacctgactccagagcagaaagctgagcgtgagaaagaacggaggatggccaacaatgccagggagaggctccgcgtacgcgacatcaacgaagcatttaaagaactgggccgtatggttcagcttcacctgaagtcggataagccccagaccaagttgctcatcctccaccaagccgtcgccgtgattctgtcccttgaacagcaggttcgcgagaggaatctaaatccaaaggcggcatgcctcaagaggcgggaggaagagaaggtcagcagcgagccccctccattaagcctagcgggacctcatccagggatgggtgatgcttcaaaccacatgggccagatgtag

SEQ ID NO: 31220 - DNA, 2004 bp, Artificial Sequence
  Description of Artificial Sequence: Synthetic coding sequence
atgcatcaccaacagcgcatggccgcattgggaacggataaggagctatccgatttgttagattttagtgcgatgttttcccccccagtctcttcaggcaaaaacggcccaactagcctcgcaagcggtcacttcaccggctctaatgttgaggaccgaagctcaagtggtagttggggtaacggaggacacccaagtccatctagaaattacggggatgggaccccctatgaccatatgacatcacgggacttaggcagccacgacaacctcagcccaccgtttgtcaatagccgaattcagtccaagaccgaacggggtagctacagcagctatggcagagagtccaacttgcagggttgtcaccagcagtcccttttggggggagacatggatatgggcaaccccggaacactctctcccactaagcctggctcccagtattatcagtatagttccaacaatcctcgacggcgtcccctgcactctagcgctatggaggtacagacaaagaaagtgagaaaggtgcccccaggcctgccttccagtgtctacgcgccaagtgcctctacagcagactataaccgagactcaccgggataccctagttctaaaccagccacctctacttttcctagctccttcttcatgcaggacggacaccactcatccgacccgtggagctccagctctgggatgaaccagcccggatacgccggtatgctaggaaattccagtcatatcccccaaagcagttcttactgttcactgcaccctcacgaaaggttgagctaccctagccacagcagcgcagacataaacagtagcctgccacctatgtcaaccttccacaggagcgggactaaccattatagcacctccagctgcactcctcccgctaatggcacagactcaatcatggctaatcgaggatccggtgcggctggtagtagccagactggcgatgctctgggcaaagctttagccagtatctactccccagatcatactaataactcgttttcctccaacccctctaccccagtgggttcccctccttcattgagcgccggaaccgccgtgtggagcagaaacggtggtcaggcttccagctctccaaattatgaagggccactgcacagcctgcagagtcgcatagaagaccgattagagcggctcgacgacgctatccacgtactgaggaaccacgcagtaggaccttccacagcaatgcctggtggccatggggatatgcacggaatcatcggacccagccacaacggagctatggggggtctgggtagcgggtacggtaccggattgctatcagctaaccgacatagccttatggtcggcacgcacagggaggacggcgtggccttaagaggctcacactccctgctacctaatcaggttccggtccctcagctgcctgtgcaatcagctacaagtcctgacctaaatcctccacaagacccctacagaggcatgcctccaggtctccaggggcaaagcgttagttccgggagcagcgaaatcaagtctgatgacgaaggggacgagaacctgcaggatacaaaatcatccgaggataaaaaattggacgatgataagaaagacataaagagcattaccagtaataatgacgatgaagatctaacacctgagcagaaggctgagagggagaaagaacgtcgtatggctaataatgcacgagagcgactgagagtcagggacatcaatgaggcctttaaggaactgggacgaatggtgcagctccatctgaagtcggataaaccacagaccaaattgcttatacttcatcaggcagtcgccgttatcttgagccttgagcagcaggtgcgcgagcgtaatctaaatccgaaagccgcatgtctgaaaagacgcgaggaagaaaaagttagtagcgaaccgccaccattgagcctggctgggcctcaccccggaatgggcgacgcgtctaatcacatgggccagatgtag

SEQ ID NO: 31221 - DNA, 2322 bp, Artificial Sequence
  Description of Artificial Sequence: Synthetic coding sequence
atgttttccaaaagattggaaaaaatcgcacaggtgcccttgctattccctttcattttcattattctgactaactactctaaaatggagggtgccgtagaaagtcagccttctttctttaagacctctcaggatattgtgacctgtacgtgggttgaaaactgctattcctccttttcacgtagaccgctcgaacagatgttttgcaagcatcagtccaaaaatatcatctcttggaccgggatggtggcccatacctgtaaccccagcactctcgggggacagggtctttgcgacttcgcgaagatgcaccaccagcagcgcatggctgcactcggcacggacaaagagctcagtgaccttctcgacttcagtgccatgttttcgcccccagtctcgagtgggaaaaatggcccaacatctttggcatcgggccatttcacgggctccaatgtcgaggatcggtcatcgtcaggatcgtggggcaatggtggacacccatcaccttcccgcaactacggtgatgggaccccatacgatcatatgaccagtcgggacttaggctctcacgataacctgtctcctcccttcgtaaattctcgcatccagtccaagaccgaacgtggcagctattcttcatatggacgggaaagtaacctgcaggggtgtcaccagcagagccttctgggtggcgacatggatatgggcaaccctggcactctgagccccactaaacctgggagccagtattaccagtactcgtctaataaccctcggcgaagacctctgcattcctccgccatggaggtacaaacaaagaaggtccggaaggtcccacctggactgccctcatccgtgtatgcgccatccgcttctaccgcggattacaaccgggatagccccggataccctagctccaagccagcaacatcaacattcccatcgtcctttttcatgcaggatggccatcactcatccgatccttggagtagcagcagcggtatgaaccagccaggttatgccggaatgctcggcaactcctcacatattcctcagagcagttcttactgcagcctgcacccgcatgaacgactctcctacccttcccattcaagtgccgatatcaacagctccctcccccctatgagcacattccaccggtctgggaccaaccactattctacatctagctgtacaccgccagcaaacggaacagattcaatcatggctaacaggggcagcggcgctgccggttcctcacagaccggggatgcccttgggaaggcgctagcctctatttactctccggatcacactaataacagtttctcaagtaatcctagcacacctgttgggagccctccaagtctctcggcgggaaccgcagtgtggtctaggaatggtggacaagcaagcagcagccctaactacgagggtcccctgcactccttacaaagtcggattgaagaccggctagaaagacttgacgacgcaattcacgtattacgtaatcacgctgttggaccctccacggctatgccaggcggacatggcgacatgcacgggattattggcccaagtcataatggggctatgggaggccttggctccggatacgggactggcctactgagcgccaaccggcacagcttgatggttgggactcaccgtgaagacggggttgccctgcggggatcacatagtctcctgcctaaccaggtgcctgtgccccagctacccgtacagagcgccacctcccctgacctgaacccaccgcaggatccctatagaggcatgccacccggtttgcagggccagagcgtttccagtggcagtagtgaaataaagtcagatgacgagggcgacgagaacttgcaagataccaaaagctccgaggataagaagttggatgacgacaaaaaggatattaaaagtatcacccggtctcgcagctccaacaacgacgacgaggatctcacccctgagcagaaagctgagcgagagaaggaacgtcggatggccaacaatgcacgggagcggctgcgggtccgggatatcaacgaggctttcaaggagcttggacgcatggtgcagctgcatctcaaatccgataagcctcagaccaaactattgatcttgcatcaggctgtggctgtgattctaagcctggaacagcaggtacgggagcgtaatttgaatcctaaagcggcttgtctcaaacgcagggaagaggagaaagtcagcagcgaaccaccccctctgtccctggcagggcctcaccccggaatgggcgacgctagcaaccatatgggccagatgtag

SEQ ID NO: 31222 - DNA, 1536 bp, Artificial Sequence
  Description of Artificial Sequence: Synthetic coding sequence
atgtattgcgcctataccataccgggaatgggaggaaacagtctcatgtattactacaacggcaaggccgtgtatgctccctcagcctctaccgccgactataatagggactctcccggatatccaagctcaaagcccgcaacgtctaccttcccctcttcatttttcatgcaagacggacaccattccagcgatccgtggagttcaagcagcggcatgaaccagcccggttatgcgggaatgctgggcaattcatcccatatcccgcagtccagcagctactgctccctgcatccacatgagagactgagctacccaagccacagctccgccgatatcaactctagcctgccacccatgtcaaccttccatcggtcaggcacaaaccactattctacatcctcctgcaccccgccagccaacggcactgactcgataatggctaatagaggctcaggcgctgcgggaagcagccagaccggcgatgccctggggaaagctctggcaagtatctattcaccagatcatactaacaattcattttcctctaacccatccacccccgtgggctcaccccctagcctgtcagcagggacggcagtgtggtctaggaacggaggccaggcctcttcaagtcccaattatgagggacccctgcatagtctgcagtccagaatagaagatcgccttgaaaggttagatgacgccattcacgtgttgaggaaccacgccgtggggccatctacggctatgcctggcggtcatggtgacatgcacggaatcattggtccttctcacaacggggctatggggggacttggctctggatatggcactgggttgctgtcagcgaaccggcacagcttgatggttggcacacaccgggaggacggcgtagctctcaggggctcgcactcactgttgccaaaccaagtgcctgttccgcagctccccgtccagagtgctacctctcccgacctgaatcctccccaagacccttacagaggaatgccacctgggctgcaaggtcaaagcgtttctagcggctccagcgagatcaaatcggacgacgaaggtgatgaaaacctgcaagataccaagtcgtccgaagacaagaagctggatgacgacaaaaaggatatcaagagcatcaccaggtccagatcctccaacaacgatgacgaagacctcacacctgagcagaaggccgagagagagaaggagaggagaatggctaacaacgctagggagcggctcagagttcgggacattaatgaagccttcaaggagttgggaaggatggtccagcttcatctcaaatccgataagccgcagactaagttgctgatattgcaccaggccgtcgcagtgattctgtcactggagcaacaagtgcgagagaggaatctgaaccccaaagcagcctgcctcaagcggagggaagaggaaaaagtgtccagcgagcccccaccattaagcttagccggaccacacccgggaatgggcgatgcttctaatcatatgggccaaatgtag

SEQ ID NO: 31223 - DNA, 1944 bp, Artificial Sequence
  Description of Artificial Sequence: Synthetic coding sequence
atgtttagtccgcctgtgagctctggcaaaaacgggccaacatccctagcttccgggcacttcaccggctccaatgtggaagaccggagtagctctggatcttggggaaacggcggtcatccatctccttcaagaaattacggtgacggtacgccgtatgatcatatgacatcaagagatctcggatctcacgacaatctgtctcctccctttgtgaactcacggatacagtctaaaaccgagagaggcagctattcttcatacggcagggagtcgaatctgcaagggtgccatcagcagtcccttctgggtggtgatatggatatgggaaaccctggaacacttagtccaacaaaaccagggtcccagtactatcagtactctagcaacaaccccaggagaaggcccttacatagctctgcaatggaagtgcagacaaaaaaagtcagaaaggttcctcctggtttgcccagcagcgtgtacgccccatccgcaagcactgccgactataatcgggactcccctgggtaccccagcagcaagcccgcaacatctacattccccagtagtttcttcatgcaggacggacatcactcaagtgacccttggagttccagctcaggtatgaaccagccagggtacgctggcatgctcggaaattcctctcatattcctcagagtagcagctactgctccctgcacccacatgagcgcctttcctacccgagccactctagtgccgacataaattcttctctgcctcctatgagtacctttcacagatccgggaccaatcactattccacatcatcttgcactccaccagccaacggcaccgacagtattatggccaataggggctcaggtgctgctggaagctctcagaccggcgatgcattaggaaaagcgcttgcctccatatattctccagatcataccaacaactctttctcgtctaacccatctacccccgtgggcagccccccatctcttagcgctgggactgcagtgtggtctcgcaacgggggacaggcttctagcagtcccaactacgaaggccctctgcactcacttcagtctagaattgaggaccgcctcgaaagattagacgatgccatccatgttctgaggaatcacgccgtcggtccatcgaccgcaatgccagggggtcacggtgatatgcacggcatcattggacctagtcacaatggtgccatgggcggactaggttcgggctacggcaccggtttactgtccgcaaataggcatagtctaatggtaggcacacatcgtgaggatggagtggccctgcgcggtagccacagtcttctgcccaaccaggtgccagtcccacaattaccagtccagtccgccacgtccccggacctaaacccaccgcaggacccttacaggggaatgcctccgggtttgcagggccagagtgtgagcagcggatcttctgagataaagtccgatgacgagggagatgaaaatcttcaggacacaaagagctcagaggataaaaagcttgacgacgataaaaaggacattaagtcgatcacaaggagcaggtcatccaacaacgatgatgaggatttgacgcctgaacagaaagcagaacgggagaaagagagacggatggccaataatgcgagagagcgccttagagttcgtgacattaatgaggccttcaaagaattgggacgcatggtacagctgcatctcaagtcagataagccccagaccaagctgttgatcctccaccaagctgtcgctgtgatactctctttagaacagcaggtacgcgagcgcaatctcaatccgaaggccgcttgcctcaagcgacgagaggaggaaaaagtgagcagcgagccacctcctctcagtctggctggaccgcatcctggaatgggggacgcgagtaatcatatggggcagatgtag

SEQ ID NO: 31224 - DNA, 1614 bp, Artificial Sequence
  Description of Artificial Sequence: Synthetic coding sequence
atggatatggggaacccgggtacactctcacccacaaaaccgggtagtcagtactatcagtactcatcaaacaaccctcgccgtcgccctctgcacagttcagccatggaagtgcagactaagaaggtcaggaaggtgccgcctggccttccttccagcgtctatgctcccagtgcttccaccgcagactataatcgagatagtcctgggtacccgtctagcaagccggcaacgagcacttttcccagctcgtttttcatgcaggatggccaccattccagtgacccctggagctcatccagtgggatgaaccagcctggctacgctggcatgctaggcaactcttcgcacataccacaatcaagctcgtactgctcactgcaccctcacgagagattgagctatcctagccatagctcagctgacattaactcaagcctcccaccaatgtctacgtttcacaggtccggaaccaatcactactcaacctctagctgtacccctccggctaacggaacagacagtataatggccaatagaggaagtggcgctgcaggctctagccagacaggcgatgccttaggaaaggcactcgcctccatctattctcccgaccatacaaacaattccttcagttccaatccatcaacacccgtcgggagccccccaagcctatccgctggcacagccgtctggtctcgcaatggcggacaggccagcagctctcctaactacgaaggccctcttcacagcttacaaagcagaatcgaggatcgattggaaagactcgacgacgccattcacgtcctccgcaatcacgcagtgggccctagtaccgcgatgccaggagggcacggcgatatgcatggtatcatcggaccatcccataacggagccatgggaggtttaggaagtggctacggcacgggattgctctccgccaatagacacagtctgatggttgggacacatcgggaagacggagtggctctgcgcggttctcattctttgctgcccaaccaagtaccagtgccccaactacctgtacagtcggccacctcccctgatttaaatccaccccaggacccctaccgaggcatgccacccggacttcaagggcagagcgtgagcagtggaagcagcgagatcaaatccgatgatgaaggagacgagaatcttcaggatacgaagtcatctgaggataagaaactagacgacgacaagaaggacatcaagtccatcacctcgaataacgatgatgaagatctgaccccagaacagaaagccgaacgggagaaggagcggagaatggccaacaatgccagagagagactgagagtgcgtgacattaatgaggctttcaaggagctgggacgaatggtgcaactccacctcaagagtgacaaaccacagacgaaattgctgatcctgcaccaggccgttgctgttattctgagcttagagcagcaggtgagagagcgcaacctaaatcctaaggcagcgtgtcttaagcggcgagaagaagaaaaagtgagctccgagccaccccctctgtctctggccggaccccatccaggaatgggtgacgcctctaaccatatgggccagatgtag

SEQ ID NO: 31225 - DNA, 1932 bp, Artificial Sequence
  Description of Artificial Sequence: Synthetic coding sequence
atgttctctcccccagtgtcaagcggcaaaaatgggcctaccagcctggcctctggtcactttaccggctccaacgttgaggaccgctcctcctccgggagctggggcaatggcggacatccatccccctccagaaactacggggacggcaccccctacgatcatatgacatcccgtgatctgggctctcacgacaatttaagtcccccatttgttaactcccgaatacagagcaagacagagcgtggaagctacagttcttacgggcgtgagtccaatctgcagggctgccatcagcaaagtctgttagggggtgacatggacatgggcaacccgggtactctcagtcctaccaaaccgggttcacagtattaccaatattccagcaataatccccgtcgaaggccactgcattcatcagcgatggaggtgcaaactaagaaagtacgtaaagttccccctggcctgccatcctccgtgtatgctccaagcgcttcaacagctgattacaaccgggactctcctggatacccttcctctaagccagccacatccacttttcctagcagtttctttatgcaggacgggcatcactcctcagacccatggtcgagctctagtggaatgaatcagcccggatacgccggaatgctgggcaacagctcacatattccacagtctagcagttactgcagtcttcatccccatgagcgtctgtcttacccgtcccactcctccgccgacatcaactcctcgctgcctcccatgtcgacattccataggtccggtactaaccactactcaacatctagctgcacccctcccgcaaacggaactgatagtattatggctaacagagggagtggcgcagcaggaagctcccaaactggtgatgctctggggaaggctttggcgtcgatttactctccagatcacaccaataactcattctctagtaaccctagcactccagtcgggtcccccccaagcctgagtgccggaaccgccgtgtggagccgaaacggcggtcaggcatcgtcttcccctaattacgaaggccctttacattccctgcagagccggatcgaggacagattggagagactggatgatgcgatacacgtgctccggaaccacgcagttggaccgtcaaccgccatgcccggagggcatggagatatgcatggtatcatcggaccttctcataacggtgcaatgggtggccttggctccggctacggcaccggcctgctcagcgctaaccggcacagtttaatggtgggaacccacagagaagatggtgtggcccttagaggctcacactcactgctgcccaaccaggtgcccgtgccacagctacctgtccaaagcgccactagtcccgacctgaatccccctcaggacccctatagagggatgccccctggcctgcagggccagtcagtgagtagtggatcttccgagatcaagtccgacgacgaaggcgacgagaacctccaggacaccaagtcttctgaggacaagaagttagacgatgataaaaaagacattaaatcgatcacctccaataatgacgatgaagacctcacacccgaacaaaaggccgagagagagaaagagcgacgcatggccaacaatgccagggagagactgagggtgcgggacattaacgaagcgtttaaagagcttggccgaatggtgcagcttcacctaaagagtgacaaaccccagaccaaactcctgatcctgcaccaagccgtcgcagttattctttccctcgaacagcaggtacgagaacgaaatctgaatcccaaagcggcatgtctgaagcggagagaagaagagaaagtcagctcagaacccccacccctttccctggccggaccccaccccggaatgggcgatgcctccaaccatatggggcagatgtag

SEQ ID NO: 31226 - DNA, 1878 bp, Artificial Sequence
  Description of Artificial Sequence: Synthetic coding sequence
atggaagaggatagccgggatgtggaggaccgttcttcctctggaagttggggcaacggcggacacccgagtccctcccggaactacggtgatggcactccgtatgatcacatgactagtcgggatctgggctcacacgataacctgtcaccaccgtttgtgaactctagaatccaatccaaaacggagcgaggttcctactcatcgtatggaagagaatcgaatctgcaaggctgtcatcagcagtcactcctggggggagatatggacatgggcaaccctggcaccctgagccctactaagcccggatcccagtactaccagtacagctcgaacaaccctaggcgaagacctttacacagtagcgccatggaagtccagacaaaaaaagttcgaaaagtcccacctggattgcctagcagtgtctacgctccgtctgcatcaacagcggattacaaccgcgatagccccggttacccctcatcaaagcccgcaacttctacgttcccgagttcattcttcatgcaggatggtcaccacagtagtgatccttggtcctcctccagcggtatgaatcagcccggatacgctggaatgctgggcaatagttctcatattccacagtcgagtagttattgtagcctgcatccccacgagaggctgagctacccatcccattcttcagctgacataaacagctcacttcctcccatgagcacatttcatagatctggtacaaatcactactctactagcagttgcactccacccgctaacggaaccgactctattatggccaatcggggatcaggggctgccggtagctcccagacaggcgacgccctcggcaaagcactggcatctatctattcccctgaccatacaaataattccttttcatctaatcctagcacccccgtggggtcacccccaagcctgagcgctggaaccgccgtgtggagccgcaatgggggtcaggcctcctccagccccaactatgaaggcccattacactctttgcaatcgagaattgaggaccgccttgagcgtctggacgacgccattcacgtactacgaaaccacgctgttgggccaagcacagcaatgcctggagggcacggcgatatgcatgggatcatcgggccaagtcacaatggagccatgggcggattgggcagcggctatgggacaggcctactgtctgcgaatagacacagcttgatggtgggaacccatcgggaggacggtgtggctttaagagggtctcattccctgctgccaaaccaggtacctgtgccgcaactgcccgtgcaatcagccacatcacctgatctcaaccccccacaagatccatatcgagggatgcccccagggttgcagggccagagcgtcagctccggatccagtgaaattaagtctgatgacgaaggtgacgagaatttgcaggacactaagtcttccgaggacaaaaaattagacgacgataagaaggatatcaaatcaattacctctaacaacgacgatgaggatctgacaccagaacagaaagctgaaagagagaaagagagacgcatggccaataacgctcgcgagcgcttgcgagtgagagacattaatgaggctttcaaggagttaggtcgcatggtacagctccacctgaagtcagataaaccccaaactaagctgcttatattgcatcaagcggtggctgtgatcctctccttggagcagcaagtgcgggagcggaatttaaatcctaaagctgcttgcctgaagcgcagggaggaggagaaggttagcagtgagcctccaccccttagtctggccggtccccatcccggaatgggtgatgcctcaaaccatatggggcagatgtag

SEQ ID NO: 31227 - DNA, 1803 bp, Artificial Sequence
  Description of Artificial Sequence: Synthetic coding sequence
atgaaagatattttctttcaattcattatcgcccgtgtgagaaagtgctatagcctgtcttgcctgcatacgctgcctgtggtgcctactttacggaaaaccgaacggggatcttattcaagctacggcagggagtctaacctacaggggtgtcaccaaagccttctgggaggcgatatggacatgggtaaccctggcactctcagcccaaccaagccaggcagtcaatactatcagtacagcagcaacaacccgagacggagacccctgcacagtagcgccatggaggtgcagacaaagaaagtgagaaaggtgcctccgggattaccctcaagcgtttacgctccctccgcttcgaccgcagattataatcgggactccccaggttacccgagctccaaacctgccacatccaccttcccctcaagctttttcatgcaggacgggcatcacagttcagatccctggtcaagcagcagcggcatgaaccaacccggatatgccggtatgctcggcaactcatcgcacatcccgcagagctcgagctactgcagtctgcaccctcatgagaggttgtcctaccccagccattcctccgcagatattaattcctcactgccgccaatgagcacctttcacagatcagggactaatcattactctacatcttcatgtacccctccagctaacggtaccgactcaataatggccaaccgaggtagtggtgctgcaggctctagccagaccggagacgcgcttggcaaagctctggcaagcatttattctcccgaccacacgaataactccttctcaagtaaccctagtaccccagtaggaagccctccatccttgtctgccggaactgcagtatggtcgcgtaatggcggtcaggccagctcctcacccaattacgagggacccctgcatagcctacagtcacgcattgaggatcgactggagcgacttgatgacgccatacatgtcctgcgcaatcacgccgtggggccatccacagcaatgcctggcggacatggagatatgcatgggattattggaccatcgcataacggtgccatgggtggcttagggagtgggtacggtactgggctcctctccgccaacaggcactcactgatggtggggacccaccgggaggatggggtcgccttaaggggctcgcattcactactccctaatcaagtgccagttccacagctgcccgtccagagtgccacatctcctgatcttaatccaccccaagatccttataggggcatgccacctggactccagggccaaagcgtttccagcggtagcagtgagataaagtccgatgatgagggcgacgaaaatctccaggatacaaaatctagtgaggacaagaaactggacgacgataagaaggatataaagtctattacacgcagtaggagctcaaacaacgatgatgaggatctgacaccggagcagaaagctgagagagagaaagaaaggcgaatggccaacaacgccagggagaggctgcgcgtcagggatataaacgaggctttcaaagaattgggacgcatggtacagttacacctcaagtcagataaacctcagacgaaacttctgatcctgcatcaggcagtcgcggttatactctctttggagcagcaggtgcgcgagaggaacctcaatccaaaggcagcctgcctcaaacggcgagaggaagaaaaggtgtcttcagagcccccacccctgtcactcgctggtcctcatcctgggatgggagatgctagtaatcacatggggcagatgtag

SEQ ID NO: 31228 - DNA, 1233 bp, Artificial Sequence
  Description of Artificial Sequence: Synthetic coding sequence
atggcaaaagatgccggtctgatcgaagcgaacggagagttaaaggtgttcatcgaccagaacttgagtccaggcaagggcgtggtgtccctggtggccgtgcatcccagcactgtgaaccctttggggaagcagttgctacccaaaacttttgggcaatccaacgtgaacatcgcgcagcaggtggtgattgggactcctcagcgacctgccgcatccaacaccctcgttgtcggatccccccatacaccgtccacccattttgcttcccagaaccagccatctgattcttctccgtggagtgccggtaagaggaatagaaagggggaaaagaatggcaaaggactgagacacttttccatgaaagtctgcgagaaggtgcagagaaagggcacaacgtcatacaacgaagtggcagacgagctcgtcgctgagttctctgcagctgacaatcacatacttccgaatgagtcagcttacgaccagaaaaacatccgtcgcagggtatacgacgcattgaacgtgctgatggccatgaacatcatctcaaaagaaaaaaaggaaattaaatggatcggcctaccgactaactcggcccaggagtgtcaaaacctcgaggtggagaggcaacgaagattagaacggattaagcaaaagcagagccagcttcaggagcttatcctgcagcagattgcttttaagaatcttgtacagaggaaccggcacgcagagcaacaggcctcccggcctcccccaccaaattccgtgattcacctgcccttcattattgtgaacaccagcaagaaaactgtaattgactgcagcatcagcaacgataagttcgaatacctgtttaatttcgataatacgttcgagattcacgacgacatcgaggttctcaagagaatgggaatggcctgtggactcgagtccggcagttgttccgcagaagacttaaagatggcccgatctctggtgcccaaggctttagagccttatgtaactgagatggcacagggtacagttggaggggtgtttataaccaccgcagggtcgaccagtaatggcactcggtttagcgcatctgacctcacgaacggggcagatggtatgcttgccacgtcaagcaacggctcccagtactcgggctcacgagtggagacacctgtatcctatgttggcgaagacgacgaagaggatgatgacttcaatgaaaatgacgaggacgactag

SEQ ID NO: 31229 - DNA, 711 bp, Artificial Sequence
  Description of Artificial Sequence: Synthetic coding sequence
atggcgaaggatgccggattgatagaggccaacggggaacttaaggtgtttatcgatcagaacctatcccccggaaagggggttgttagccttgttgccgttcacccatctacagttaaccctttgggtaaacaactgctgcctaagaccttcggtcaatcaaacgtgaacatcgctcagcaagtggttattggcaccccccagcgccctgctgcctctaatacgctggtagtcggttccccgcataccccaagcacacatttcgctagccagaaccaacctagtgacagcagcccttggagcgcagggaaacgcaataggaaaggcgaaaagaacggaaagggactgcgtcactttagcatgaaggtctgtgaaaaagtgcagcggaaaggcactacctcatataatgaggtggcagatgagctcgtagccgaattttctgctgcagataaccacatcttacccaatgagtctgcctatgatcaaaaaaacatcagacgcagagtctatgacgccctgaacgtactgatggcaatgaacattatcagtaaagagaagaaagaaattaagtggataggcctgccaacaaattccgcacaggagtgccagaatctggaggtggaacgccagaggcgcctggagcgtattaagcagaaacagagtcagctgcaggagctgatattgcagcaaatcgccttcaaaaacctttag

SEQ ID NO: 31230 - DNA, 480 bp, Artificial Sequence
  Description of Artificial Sequence: Synthetic coding sequence
atggccaaagacgctggtctcattgaggcgaacggggaactcaaggtattcatcgatcagaacctgtcacccggaaaaggagtcgtgagcctcgtggccgtacacccatccactgtgaaccccttaggcaaacagctgctgcccaagacattcgggcaatctaacgtgaacatcgcacagcaggtggtcatcggtacgccccagcggccagcagctagtaatacgctggtggtcgggtccccgcacacacctagcacacatttcgcatcacagaaccagccatccgatagctcgccttggagcgcaggtaagcggaatagaaagggcgaaaagaacggcaagggcctccgacattttagcatgaaggtatgcgaaaaggtccagcgcaagggaactacaagctataatgaggttgctgatgagttagtggccgagttcagcgccgctgataatcacattttacctaacgaatcagtctag

SEQ ID NO: 31231 - DNA, 936 bp, Artificial Sequence
  Description of Artificial Sequence: Synthetic coding sequence
atgagtactctcccaagcaaatggaagcgtaatcgaaaaggggaaaagaacggtaaagggctgaggcatttttccatgaaggtgtgcgagaaggtacagcggaagggaactactagctacaatgaagttgcagatgagctggtggccgagttttccgctgctgataatcatattctgcccaacgagtcagcctacgaccagaaaaatattagacgtcgcgtgtatgacgctctaaacgtgctaatggctatgaatatcatttccaaagaaaagaaggaaattaaatggatcgggctacctacgaattcagcacaggagtgccagaacctggaagttgaacggcagaggaggttggagcgaattaaacagaaacagtcacagttgcaggaactgattttacaacagattgcctttaagaacctcgtgcagcggaaccggcacgcagagcagcaggcttccaggccaccccctccaaactccgtgatccacctgccctttattatcgtgaatacatctaagaagacagtcatcgattgcagtatatccaacgataagttcgaatacctttttaactttgacaacaccttcgagattcacgatgatatcgaggtcctcaagagaatgggcatggcatgcgggctggaaagcggcagctgttctgcagaagatctgaagatggctagaagcctcgttcccaaagcgctggagccatacgttactgagatggcacaaggcactgtgggtggtgtgttcatcactacggccggatctacaagcaatggtacatctgaccttacgaacggtgcagacgggatgttagccacctcatctaatggctcccagtatagcgggagcagagttgaaactcctgtcagctatgtcggggaggatgacgaagaggacgatgatttcaacgagaacgacgaggatgactag

SEQ ID NO: 31232 - DNA, 1146 bp, Artificial Sequence
  Description of Artificial Sequence: Synthetic coding sequence
atgagtactttgcctagcaaatggaagagaaatcggaaaggcgaaaagaatggtaagggactccggcacttcagcatgaaagtgtgtgaaaaagttcagcggaaaggtacaacaagttataacgaggttgccgatgagcttgttgccgaattcagtgcggcagacaatcacatcctgcctaacgaatcagcctacgatcagaaaaacatacgtcggagggtgtacgacgccttgaacgtgctaatggctatgaacataatcagcaaggaaaaaaaagaaataaaatggattggtctcccgaccaatagcgcccaggagtgtcagaacttggaggtggaaaggcagaggagacttgagcgtattaaacagaagcagagccagctgcaggaattgatcctccagcagatcgcatttaaaaatttggtgcagagaaatcgccatgctgagcaacaggcttctcgtcctcccccaccaaactccgttatacacctccccttcatcatcgtgaatacatccaaaaagaccgtgatagactgttcaatttctaacgataagtttgagtacctgttcaatttcgacaatacattcgagatacacgacgatatagaggtgttgaaaaggatgggcatggcctgtggcttggagagcgggtcatgttccgcagaagacctgaagatggctcggtctctcgtgcctaaagcattggagccctacgtcaccgagaaaaccgggctctgtgactgtacagccggttgccctgccccatggcgcagtgtcgaaaataccgggcaggctaaagacataaggaaactgctgcaaccttccgtgctctggaactgcgccagcttctgctggctgcctgtccgtttggtgttattcctctttcacgaccactccttgatcttttttcccttttctgaaatggcacaggggacggtgggaggcgttttcattactactgcgggatcgacctcaaatggtacgcgtttttccgctagcgatctgaccaacggggctgacggcatgctagccacttcaagtaatggaagccagtactcagggtcacgagttgaaacgccagtgtcatatgtgggcgaggatgatgaagaggacgatgacttcaacgagaacgatgaagacgactag

SEQ ID NO: 31233 - DNA, 1161 bp, Artificial Sequence
  Description of Artificial Sequence: Synthetic coding sequence
atgataatttctaccccacaacggctgacaagcagcggctcagtgttgatcggatccccttacactccagcgccagccatggtgacgcagacgcacatagcagaggccactggctgggtaccaggtgatcgcaagagagccagaaagttcattgacagcgatttcagtgaaagtaagcggtcaaaaaaaggcgacaagaatggtaagggtctgcggcatttcagtatgaaagtgtgcgaaaaagtgcagcggaaaggcacaacatcctataatgaggtcgctgacgaattagtgtcggagttcacgaacagcaacaatcatctggcggctgactcccaggcctatgaccagaagaatatcaggaggcgcgtctacgacgctcttaacgtgcttatggcaatgaatattatcagcaaggagaaaaaagaaattaagtggattggcctgcctacgaactccgctcaggagtgtcagaacctggaaatcgagaagcaaaggaggatagagaggatcaagcagaagcgcgctcagctgcaggaactgctgctgcagcagatcgccttcaagaatctggtgcagcggaaccgacagaacgaacagcaaaatcaagggccaccggcacttaacagtaccatacagctccccttcataatcattaacaccagccggaaaacagtgatcgactgcagcatcagtagcgacaaatttgaatatctgttcaacttcgataacacatttgagattcatgacgacattgaagtgctgaaacgcatgggaatgtcctttgggctcgagtccgggaaatgttcactggaggatcttaaactggccaagagccttgtgccaaaggcactcgaaggctacatcacagacatcagtactggcccaagctggctcaaccagggtcttttacttaatagtacacagtccgtgtccaacctggaccttaccacaggtgccacccttccccagtcttccgtcaatcaggggctgtgtctggatgcagaggtggcgcttgcgacgggccagttcctcgcccctaactcgcatcaatcttcttccgctgcgtctcattgctcagaaagccgaggagaaaccccatgcagctttaacgacgaggacgaggaggatgatgaggaggattcctcctcccccgaatag

SEQ ID NO: 31234 - DNA, 1113 bp, Artificial Sequence
  Description of Artificial Sequence: Synthetic coding sequence
atgatcatttcaaccccccagcgccttacttccagtggctccgttcttatcggttcaccttacactccagcccctgccatggttacacagacccatatcgctgaggcaaccgggtgggtgccagggaaacggtcaaagaaaggggacaagaacggtaaaggcctccgccattttagcatgaaggtctgtgagaaggtccaaagaaaggggacaacctcctacaatgaagtggctgatgagctggtcagtgagttcactaactctaacaaccacctggctgccgactcccaagcatacgatcagaagaacattaggcggagggtctacgatgctttgaacgtgctcatggccatgaacatcatctctaaggagaaaaaagagatcaagtggatcggcctgcccaccaactcagctcaagaatgtcagaacttggagattgaaaagcagcgcagaatcgagaggatcaaacagaaaagagctcagctgcaggagctactgctgcagcagatcgcatttaagaacctggtccagaggaaccgccaaaatgaacagcagaaccaaggcccaccagctctaaattccaccatccagttgccctttattattatcaatacgtccagaaagaccgtgattgactgctcgatcagctcggacaagttcgaatacttatttaacttcgacaacacctttgaaatacatgacgatattgaagtccttaagagaatggggatgagcttcggcttagaatcaggcaagtgttccctcgaggacctaaagcttgccaagtcccttgtgccgaaagccctggaggggtacattaccgacatatccaccggacccagctggctgaatcagggtcttctgctaaattccacacagtcagtgtctaacctcgatctgacaaccggcgctactctgcctcagtcttcagtcaaccaggggctgtgtttagacgccgaggtggccctggccaccggtcaatttcttgcccctaactcacatcagtccagcagtgcggctagccactgttctgagagtcggggagagaccccttgcagcttcaatgatgaagatgaggaagacgacgaagaggatagctctagcccggagtag

SEQ ID NO: 31235 - DNA, 1257 bp, Artificial Sequence
  Description of Artificial Sequence: Synthetic coding sequence
atgcagcccgaagggattatcttcgaagcagaaaataagccaagtcccggtactgagtccgctggcacctttatcctggatctgagcgctacctcaagaaccataatctccacccctcagcgcctgacttcatccggatctgtgctcatcggcagtccttatacacccgctccagccatggtgactcagacacacatcgcggaagccactggctgggtgccaggcgaccggaagcgcgctcgaaaattcatagactccgatttctccgaatccaagcggtctaaaaagggggataaaaatgggaaggggctcagacacttcagcatgaaggtgtgtgagaaggtccaaagaaagggaacaactagttataacgaagtagccgatgaacttgtgagcgagttcacaaattccaacaaccacctggccgcagatagcgcttatgatcagaaaaatatccgccgtcgggtgtacgatgctctcaatgttttgatggctatgaacattatcagcaaggaaaagaaggagattaagtggatcggcctccctactaactccgcgcaagagtgccaaaatctggaaatagagaaacagcggagaatagagcgtattaagcagaagcgggctcaattgcaggagctgctgctgcagcagatcgcttttaagaacctggtccagcgaaaccgccagaatgagcagcagaaccaggggccaccagcactgaattccactattcagttgcccttcattatcatcaacacgagtcggaagacagtgatcgactgttctataagcagtgataaattcgagtacctgttcaactttgataacacgttcgagatccatgatgacatagaagtcctgaaacgtatgggcatgtccttcgggctcgagagcggaaaatgctcactggaagatctgaaactcgccaagtcactagtacccaaagctttggaagggtatatcaccgatatctccaccgggccaagctggctaaaccagggcctgctactgaattccacccagtccgtctctaatctcgatctgaccaccggggctacactgccacagagtagtgtcaaccaaggcctctgcctggatgccgaagttgccctcgccactgggcagttcctggctcctaatagtcatcagtccagctccgctgcatcacattgttctgaatcccgcggagagacaccctgttcttttaatgacgaggatgaggaagacgacgaggaggatagctccagtccagagtag

SEQ ID NO: 31236 - DNA, 1161 bp, Artificial Sequence
  Description of Artificial Sequence: Synthetic coding sequence
atgattatatcaaccccccagaggctgacctcatccggatctgtgctgatcggatccccctacacccctgcccctgcaatggtcacacagacacatattgcagaagcaacagggtgggtgccgggagaccgaaaaagggcccgtaagtttattgacagcgacttctctgagagcaaaaggagtaagaaaggtgacaagaatggtaaaggcctgagacacttcagcatgaaggtgtgcgagaaggtgcaaaggaaaggcaccacctcatacaacgaagtggctgacgagcttgtgtcagaattcaccaattctaacaatcacctggccgctgacagccaggcctatgaccagaaaaatattcgcaggagagtctatgatgcccttaatgtcctgatggccatgaacataatctctaaggagaagaaagagatcaaatggatcggcttacctacgaatagcgcccaggaatgtcagaacctggagattgaaaaacagcggagaatagagaggatcaagcagaagcgcgctcaacttcaagagctactcctccaacagattgcatttaagaacttggttcaaagaaataggcagaacgagcagcagaaccaaggcccaccagcccttaactctaccattcagctgccatttatcatcataaatacctccagaaagacagtgattgactgtagcattagcagcgataaattcgagtacctattcaattttgataatacatttgagatccacgacgacatagaggtcctgaagcgtatggggatgtcctttgggttggaatctggcaaatgttccctggaagatctgaagctagccaagtccctggtgcccaaagccctggagggctacatcaccgacatcagcacgggcccatcttggctgaatcagggtctgctcctgaactctacccagtcggtgtccaacctcgacctcaccaccggtgccaccttgccccaatcatctgtgaaccagggcctgtgcctcgatgccgaggtagccttagcaacgggccagttcctggcacccaactcacaccagagctcttctgcggcatcccactgcagtgaaagcagaggcgaaactccctgctcttttaacgacgaagatgaggaggacgatgaggaagactcgtctagcccagagtag

SEQ ID NO: 31237 - DNA, 261 bp, Artificial Sequence
  Description of Artificial Sequence: Synthetic coding sequence
atgaccgcaaaaaacgtgggactgacctcaacgaatgccgaggtgcgaggcttcattgatcaaaatctcagcccgacaaagggcaacatttccttcgtggcctttccggtgtccaatactaactcaccaacaaaaattctgcccaagacgctaggacctatcaacgtcaatgttggaccacagatgattatttctactcctcaaaggctgaccagctctgggagtgtgctgatcggctctccttacaccccagctccatag

SEQ ID NO: 31238 - DNA, 141 bp, Artificial Sequence
  Description of Artificial Sequence: Synthetic coding sequence
atgattataagcacaccacaaaggctgacgtccagcggttccgtgctgattggatccccgtacaccccggcacccgctatggtaacacagacccacatcgctgaagccaccggctgggtgcccggagaccgcaaacgctag

SEQ ID NO: 31239 - DNA, 1158 bp, Artificial Sequence
  Description of Artificial Sequence: Synthetic coding sequence
atgataatcagcaccccacagcggttgacatcgagcggaagcgtactgatcggaagcccgtatacaccagccccagccatggtgacgcagacccacattgcggaagctaccggatgggtccctggggacaggaagagggcaagaaagtttatagactctgacttctctgagagcaaacgcagcaagaaaggcgacaagaacggcaaagggcttcgccacttttctatgaaggtgtgcgaaaaggtgcagaggaaaggcaccacttcgtacaatgaggtagcagacgaattggtgtcagagtttaccaattccaacaatcacctcgccgctgactctgcctatgatcaaaagaacattagaagaagggtgtatgacgcactgaatgtcctgatggcaatgaacataatctccaaggagaagaaggagataaaatggatcggcctgccgacaaacagtgcgcaagagtgccaaaacttagagattgagaagcagaggcgaatcgagcggattaaacagaaacgcgctcaactgcaggaactgctgctgcagcagattgcctttaaaaacttagtgcagcgtaaccgccagaatgagcaacagaaccagggaccaccagccctcaacagcaccatccagctcccctttattatcattaatacatctcgaaagactgtcatagactgttccatttcttccgataaattcgagtatctctttaatttcgataacacattcgagattcacgacgatatcgaagttctgaagagaatgggaatgtcgtttgggctcgaaagcggcaaatgttcccttgaggatctcaaactcgcaaagtccctggttcctaaggctctggaggggtatattacggacatctctacaggcccatcctggctaaatcagggcttgcttttaaatagcacacagagcgtctcaaatctggatcttactacaggagcaacactgcctcagtcttctgtgaaccaggggctgtgtctcgacgccgaagtggctctggccaccggccagttcttagctccgaattctcaccagagcagtagcgcagcatcgcactgctccgagtctcgaggcgagacaccctgtagctttaacgacgaagacgaggaagatgatgaagaggatagtagtagtcctgaatag

SEQ ID NO: 31240 - DNA, 270 bp, Artificial Sequence
  Description of Artificial Sequence: Synthetic coding sequence
atgattatctctaccccacagcgtttaacaagttccgggtcggtgctgattggatcaccttacaccccggctccagccatggtcactcagacccatatagctgaagctacaggatgggtcccaggagaccggaaacgggcaagaaaattcattgattcagatttctccgaaagtaagcgctctaagaagggggataagaacggtaagggcctgcgacactttagtatgaaggtttgtgagaaagtgcagaggaagggcactacatcatag

SEQ ID NO: 31241 - DNA, 1341 bp, Artificial Sequence
  Description of Artificial Sequence: Synthetic coding sequence
atgaccgccaagaacgtggggcttacaagcactaacgcagaggtcaggggcttcatcgaccagaatctgagtccaactaagggtaacatatcttttgtggcatttccagtgtctaacactaactctccaactaaaatcctgcccaaaacgctgggccctattaacgtgaatgtggggccacagatgatcattagtaccccacaacgacttacgagctcaggtagcgtgttgatagggtcaccctatacgcctgcacccgctatggtcacacaaacccacattgctgaggccaccggctgggtcccaggggataggaagagggccaggaaatttatagattctgatttttccgaaagtaagcgaagcaaaaaaggcgacaaaaacggcaaaggactgcgccacttctctatgaaagtttgtgaaaaggtacagcgaaaggggacaaccagctacaatgaagtggctgacgagctggtgtcagagtttacgaacagcaacaatcacctggcggctgacagcgcctacgaccagaaaaatatcagacggcgagtgtacgacgccctgaacgtcctgatggccatgaacataatatctaaagaaaagaaggagataaagtggatcgggctgcccacaaactcagcacaggagtgccagaacctcgaaattgaaaaacagagacgaattgagaggataaaacaaaagcgcgctcagctgcaggagcttcttttacagcagatcgcctttaagaacctggtgcaacgcaacaggcaaaatgaacagcagaaccagggcccaccggctctgaattctacaattcagttgccttttattatcatcaacacgagccgtaaaacggttatagactgcagcatctcaagcgataaattcgaatacctgtttaatttcgataatacatttgagatccatgatgacatcgaggtgctcaagagaatgggaatgtctttcgggctcgagagtggaaagtgcagcctcgaagacctaaaattagcgaagtccttggtgccaaaggctttggagggctatatcaccgacatctccacaggtccaagttggctgaaccagggccttctcctgaattccacccagagtgtaagcaatcttgacctgactactggggcaaccttgcctcagagctctgtaaaccagggcttatgcttagatgcagaggtggctctcgctaccggtcagttcctggctcctaatagtcatcagtcctcttccgctgcaagccattgcagcgagtcacggggagagaccccatgctcctttaacgatgaagacgaggaggacgacgaagaggatagttcgagccctgagtag

SEQ ID NO: 31242 - DNA, 84 bp, Artificial Sequence
  Description of Artificial Sequence: Synthetic coding sequence
atgattatttcaaccccacagagactaaccagctcgggttcagtgttaatcggctcaccgtatacacctgcaccagccatgtag

SEQ ID NO: 31243 - DNA, 1050 bp, Artificial Sequence
  Description of Artificial Sequence: Synthetic coding sequence
atgttagaccctaagtgtgacaggaaacgcgcacgcaagttcatcgattctgattttagcgagagcaagcgctctaagaaaggtgataagaacggtaaagggcttagacatttctctatgaaagtatgcgagaaagtccagaggaaaggtaccacctcgtacaatgaggtggccgacgaactagtctccgaatttaccaattcaaacaatcatcttgccgcagactctgcctacgatcagaaaaacatccgccgtcgcgtatacgacgctctgaacgtgctcatggcgatgaacatcatttctaaggaaaaaaaggagataaaatggatcgggctgccaaccaactctgcacaggagtgccagaacctcgaaatcgaaaagcagcgccgaatcgaaaggattaaacagaaaagagcgcaactccaagagcttcttctccagcagatcgccttcaaaaacctggttcagcgaaatcggcagaacgaacagcagaatcaggggccacccgcactgaacagcaccatacagttaccctttataatcatcaacacttcccggaagaccgtgatcgattgctcgatttcctcagataaattcgaatatctcttcaattttgacaatacctttgaaatccatgatgatatcgaggtgctcaagcggatgggaatgagctttggacttgagtctggaaagtgcagtctggaggatctgaagctagcgaagtcccttgtccccaaagccctcgaaggatatataaccgacatcagtactggcccatcatggctgaaccagggcctcctgctcaattctacacagtctgtgtctaacttagatctgaccaccggtgctaccctgccccagagctccgtcaatcagggcctgtgcctagacgctgaggtggcattagccaccggccagttccttgcaccaaacagccaccagagctcctccgctgcatcccactgcagtgaatcccggggagagaccccatgtagttttaatgacgaggatgaagaggacgacgaagaagactctagttcccctgagtag

SEQ ID NO: 31244 - DNA, 663 bp, Artificial Sequence
  Description of Artificial Sequence: Synthetic coding sequence
atgatcatcagcacaccccagaggcttacctcctctggatccgtgctaataggctcaccttacacgccagctccagctatggtgactcagacacacatagctgaggccaccggatgggtgcccggagaccgaaaacgagcaaggaagttcatagatagcgactttagcgagtcaaagagatccaaaaagggtgacaaaaacggaaagggactacggcatttcagtatgaaagtgtgtgaaaaagttcagagaaagggcacaacctcttacaatgaggtggcagacgaattggtgtccgaatttaccaactctaataatcacctggcagctgattctgcctacgatcagaagaacattaggagaagggtctatgacgcactgaacgtgctgatggccatgaatatcataagcaaagaaaagaaggagattaagtggataggcctgcctacgaacagtgcccaggaatgccagaacctcgagatcgagaagcagcggagaattgaacggattaaacaaaagagggcacaactacaggaactgctgctgcaacagatagcctttaagaacctggttcaacgcaatcgtcaaaatgaacagcaaaaccagggtcccccagctttgaattccactatccagctgccattcatcattatcaacacatag

SEQ ID NO: 31245 - DNA, 1161 bp, Artificial Sequence
  Description of Artificial Sequence: Synthetic coding sequence
atgataatctctactcctcagagactcaccagcagcggtagcgtactcattgggagcccttatacacccgcacccgctatggtgacccaaacccacattgctgaggccaccggctgggttcccggtgacagaaaacgagctcgcaagttcatcgattcagacttttctgagagtaaacgatccaaaaagggtgataagaacggtaagggcctccgacacttctcaatgaaggtgtgcgaaaaagtgcaaaggaaggggaccacatcgtacaatgaggtggctgacgaactggtttcggagtttaccaacagtaacaaccatctggccgctgattcccaagcttatgaccagaaaaatatccgtcgtcgggtctatgacgccttgaatgtgctgatggccatgaacatcatctccaaagaaaagaaggagatcaagtggattggccttccgaccaactccgcacaggagtgccagaaccttgagatcgaaaaacagcgtcggatcgagcggatcaaacagaaacgcgcacaactgcaggaactgctgctacaacagattgcatttaagaatttggtgcagagaaatcgccagaacgagcagcagaatcaggggcctccggctttgaactccacaattcagctgcccttcattatcattaatactagccggaaaaccgtcattgactgttctatttcatccgacaagtttgagtacctgttcaacttcgacaacacctttgaaattcacgatgacatcgaggtccttaaacgcatgggcatgtcctttggcctggagtcaggcaaatgcagtctggaggacctcaagctggcgaagtctctggttccaaaggcgctcgagggctacataactgacattagcactggaccaagctggctgaaccagggcctgttacttaactctacccaatcggtgtctaacctggacctgaccaccggagcaaccctgcctcagagttccgtgaaccagggcctctgtcttgacgcagaggtcgctttggccactggccagttcctcgcaccaaactctcatcagtcctctagtgctgcttcccactgctccgagtctcgcggagaaaccccctgctcatttaatgacgaggacgaggaagatgacgaggaagacagcagttccccagagtag

SEQ ID NO: 31246 - DNA, 933 bp, Artificial Sequence
  Description of Artificial Sequence: Synthetic coding sequence
atgaaggtgtgcgaaaaggtacagcgcaagggaacgacttcctacaacgaagtagcagacgaacttgtgagcgaattcactaattctaacaaccacttagctgccgatagtgcttacgaccagaaaaacattcgtagaagagtgtacgatgccttgaatgtgctgatggccatgaacatcattagcaaggaaaaaaaggagatcaagtggatcggtctacctaccaattccgcccaggaatgtcagaatctggaaatcgaaaagcagaggcggatcgagaggattaaacagaaacgcgcacaactgcaggagcttctgctgcagcagatagcctttaaaaatctggtgcagagaaaccggcagaacgagcagcagaaccaaggacctccagccctcaatagcaccattcagcttccgttcattatcattaatacaagtcgtaagaccgtaatagactgtagcattagttcagacaagttcgaatacctgttcaattttgacaacaccttcgaaatacacgatgacatagaagttctaaaacggatgggcatgagctttggcctggagagtggaaaatgtagtctggaagacctgaaactggcaaagagcctggttccaaaggctcttgaggggtacattacggatatctccactggcccaagctggctgaaccaggggctgctgctgaatagtacacaaagcgtctccaaccttgatttaaccaccggcgctactctgccccaaagttcggttaaccaaggcctctgtctcgacgcagaggtggctttagctaccggccagtttctcgctcccaacagccatcaaagctcaagtgctgcatctcactgctctgagtcaaggggggagaccccctgcagttttaatgatgaagatgaagaagacgatgaggaagatagctcatctcctgaatag

SEQ ID NO: 31247 - DNA, 1335 bp, Artificial Sequence
  Description of Artificial Sequence: Synthetic coding sequence
atgcccaggagcggcgctcctaaggagaggcccgctgagcctcttacacccccaccatcctatggacatcagcctcagacgggaagcggggaatccagcggcgcaagtggagacaaggatcatctttacagcacagtctgtaaaccgagatctcctaagcccgctgccccagccgctccaccgttttcctcctccagcggcgtcctgggaaccggcctgtgcgagctcgacaggctgttacaggaattgaacgccactcagttcaacatcaccgacgaaatcatgagccagtttccgagcagcaaggtggcatccggcgagcagaaggaggaccagagcgaagataagaagcggccttcgctcccctccagcccctcacctggactcccaaaggccagcgccacctctgctaccctggaactggaccggctgatggccagcttatccgacttcagggttcagaatcacctcccagcatccggaccaactcagcctcccgtcgtaagcagcaccaacgaagggagcccctctccacctgaacccacaggtaaggggtccttagatacaatgctgggcttgctgcaaagtgacctgtcccggagaggagtcccaactcaagcgaagggcctgtgcggatcttgcaacaagcccattgccggacaggttgttactgctctcggcagagcctggcaccccgagcactttgtgtgtggtggatgcagcaccgcactggggggtagtagttttttcgaaaaagacggggctcctttttgcccagaatgctatttcgagcggttttcccccaggtgcggattctgtaaccagcccatcagacataagatggtgactgctctaggaactcactggcatcccgagcacttctgttgtgtgtcttgtggtgaacctttcggggacgagggtttccatgaaagggaaggcaggccttattgtcgcagggactttttgcagctctttgcgcctaggtgccagggatgccagggaccaattctggataactacatcagcgcactgtctgccctgtggcatccagattgcttcgtatgtagagaatgctttgcccctttttctggcggatcgttctttgaacacgagggcagaccgttatgcgaaaaccatttccatgccaggcgcggaagtctgtgtgccacttgtggccttcctgtgacaggcagatgtgtttcagcccttggtcgcagattccaccccgatcacttcacgtgcacgttctgtctgcggccactgactaagggatctttccaggaaagggccggaaaaccttactgccagccgtgttttctgaagctgttcggctag

SEQ ID NO: 31248 - DNA, 1335 bp, Artificial Sequence
  Description of Artificial Sequence: Synthetic coding sequence
atgccaagatctggggctcctaaagagcgacccgcagagcccctgactcctcctccgagttacggacatcaaccacagactggttccggcgagagttccggtgccagcggagataaggaccatctctatagtacggtgtgcaaacccaggtctccaaaacctgccgctccagctgcaccccctttttcctcatcttcaggcgtcctcggaactggcctgtgcgaactcgatagactgctccaggaattgaacgctacccagttcaacatcactgatgaaatcatgagtcagtttccatccagcaaggtcgcctcaggcgaacagaaagaggaccagtccgaggacaaaaagcggccaagcttaccatcctctccctcacctgggctgcctaaagcttccgccactagtgccacgctagagctggacagactgatggcaagtttgtcagactttcgtgtgcaaaatcaccttcccgcttcggggccaactcagcccccagtggtgagcagcaccaacgagggcagcccaagcccacctgagcccactggcaaagggtcactggatactatgttgggcttactgcagagcgacctgtccaggcggggagtccctacacaggctaagggcttgtgtggaagctgtaacaaacctatcgcaggccaggtggttacagcactgggcagagcttggcaccctgaacattttgtttgtggtggctgctctacagctttgggcggaagcagcttttttgagaaagatggagcccctttctgtccagagtgttatttcgaacggttctcgcctcggtgtggtttctgtaatcaacctatcagacataaaatggtgaccgccttggggacacactggcaccctgaacacttctgctgcgttagctgcggcgaacccttcggagacgagggtttccatgagagggagggacgcccatactgccgtcgcgacttcttacagctgtttgctcccaggtgccagggttgccaggggcctatacttgacaactacatcagtgcattgagcgcactctggcatccagactgttttgtttgccgggagtgttttgctcccttttcaggaggttctttttttgaacatgagggcagaccgctgtgtgaaaaccatttccatgcaaggagggggagcctgtgcgccacatgtggcctaccagtaacagggcgatgcgttagtgcccttggtaggagattccaccccgaccactttacctgcactttctgtctgcgtcccctgaccaagggctccttccaagagcgggctggaaagccatactgccagccgtgttttctcaaactgtttggctag

SEQ ID NO: 31249 - DNA, 1386 bp, Artificial Sequence
  Description of Artificial Sequence: Synthetic coding sequence
atggaggacctggacgccctgctcagcgacctggaaactaccacctcccacatgcctcgttcaggggctccgaaggagcgccctgcagagccactgaccccgccaccttcttatgggcaccagccacaaaccggctctggcgagtcctccggtgcttccggggacaaggaccatctctacagcaccgtctgtaaacccaggtcccccaagccagcagctcctgccgctcctcccttcagctcctcctccggagtgctcggaacagggctatgcgagctcgaccggctgttacaagaactgaatgctacacagttcaacatcacagatgaaattatgagccaatttcccagcagtaaggtggctagcggtgaacagaaggaggaccagtcagaagataagaagaggccctcccttccaagcagccctagccccggtctgccaaaagcttcagccacctcagctaccctggagttggacagactgatggcttctttatccgattttcgggttcaaaaccacctgccggcatcaggtcctacccagccacctgtggtctcctccactaacgagggctctcctagccccccagaacccactgggaagggctccttagatacaatgttaggcttattgcaaagtgatttgagtcgacggggtgtgccaacccaggccaaagggctttgtggtagttgtaacaagcccatagctggacaagtagtcacagcgctgggacgcgcatggcaccccgagcacttcgtttgcggaggatgcagtactgccctcggaggcagtagcttctttgaaaaggacggagcacctttctgtccagagtgttatttcgagagattctcaccacgctgcggattctgtaatcagcctattagacacaaaatggtcacagctttaggcacccactggcatcctgagcacttctgctgtgtgagttgtggcgaaccatttggcgacgaaggcttccatgagcgagagggccgaccatactgccggagggattttctccagctgtttgcaccacgctgccagggttgccagggccctatcctagataactacatttccgccctgtctgctctctggcaccctgactgcttcgtttgccgagagtgcttcgcgccattttctggtggttcttttttcgagcacgagggcagacccctgtgcgagaatcacttccacgcacgcagagggagcctgtgcgcgacctgtggactgcccgttactggcaggtgtgtgagtgccttggggcgtaggtttcacccagatcacttcacctgtacgttttgcctgcggcctctcacaaagggctcctttcaagagcgtgcaggaaaaccttattgccaaccctgcttcctaaaactattcggctag

SEQ ID NO: 31250 - DNA, 783 bp, Artificial Sequence
  Description of Artificial Sequence: Synthetic coding sequence
atggtttggcccgctctctgggagctataccgggagctcggactttttcaagggcctgcactaggcctgcggaaccacctgggccgtaagttaagaaggcgcaaaaagaagaaggccaagcgaactacaaattggaaaataataaccgaccgccctggcttccatgatgagtcagccatttatccagtggggtactgttctactcgaatatacgctagcatgaagtgccctgaccaaaaatgcttgtatacttgtcagatcaaggatgggggagtgcagccccagtttgaaatagtgccagaggatgacccccagaatgccatcgtgagtagttccgctgacgcatgccatgctgaactgctgaggaccatcagcacgacaatgggtaaactgatgcccaaccttctgcctgcgggagcagacttcttcggattcagtcaccctgccatccacaacctgatacagtcctgtccaggagctagaaagtgtatcaattatcagtgggtcaagttcgatgtctgtaaacctggggatggccagttgcccgagggtttgcctgaaaatgacgccgctatgagctttgaggcattccagagacagatttttgacgaggatcagaatgatcctctcctgcctggctccctggatttgcccgaactccaacctgccgcatttgtctcctcatatcagccaatgtatctaacccacgaacctctcgtcgatacacacctccagcacttgaaatcaccaagtcagggctcaccaatccaatcctcagactag

SEQ ID NO: 31251 - DNA, 1236 bp, Artificial Sequence
  Description of Artificial Sequence: Synthetic coding sequence
atgagtctcctggacggcctggcttctagtccacgagcccctctgcaaagtagcaaagccagaatgaaaaaactgccgaagaagtcacaaaatgagaaatatcggttaaagtatctccgtctgcggaaggcggctaaagcgaccgtattcgagaatgctgccatttgtgatgaaatcgcacgcctagaagagaaatttttgaaggccaaggaggagcgccgatatctcctgaagaaactgctgcagctgcaggccctaacggaaggcgaggttcaagcagctgctccatcccactcctcctccctgccgctaacttacggggtggcatcgagtgtgggcactattcagggagccggacccatctccggaccttctactggcgcagaagagcctttcggcaaaaagactaagaaagaaaaaaaggagaagggcaaggagaacaacaaattggaggtgctgaagaagacttgcaaaaagaaaaaaatggccggaggcgctcggaagttagtgcaaccaatcgccctggatccatctggcaggcctgtttttccaataggactcggagggctgaccgtgtattcactgggcgagataattaccgaccgcccaggatttcatgatgaatcagctatttaccctgtcgggtactgtagcactaggatctacgccagtatgaagtgcccggaccaaaaatgcctctacacatgtcagataaaagacggaggtgtccaaccccagttcgagatcgtacccgaagatgacccacagaatgccatagtctctagctctgcggatgcgtgtcatgctgaactactccgtaccatcagcacaactatgggtaagctgatgcctaacctgctcccagcgggagcggatttctttggcttttcacaccctgctatccacaatctcatacaatcctgccctggggctcgtaagtgtattaactatcagtgggttaaatttgacgtctgcaaaccgggagacggtcaacttccagaggggttgcccgaaaacgatgcggcaatgtccttcgaggccttccagcgacagatcttcgatgaagaccagaacgaccctctgttaccagggtcacttgatctgccagagctccagcccgcagctttcgtttccagctaccagccgatgtaccttacacatgagcccctagtggatacacacctgcaacatttgaagtcaccctcccaaggttctcccatccaaagttccgactag

SEQ ID NO: 31252 - DNA, 1281 bp, Artificial Sequence
  Description of Artificial Sequence: Synthetic coding sequence
atggaggccgctgttgcagccccaagacccagactgctgctgttggtactggcagctgccgcagcggcagcagctgctttgctccctggagcgacggcactgcagtgcttttgccatctatgtacaaaggacaacttcacttgcgtaacagacgggctatgtttcgtctcggtgaccgagaccactgacaaagtgattcacaactctatgtgcattgctgaaatagatctgattcccagagatcgtccattcgtgtgcgccccaagctcaaaaacgggctccgttacaaccacctactgctgcaaccaagatcactgtaacaagattgaactgcctaccactggcctgcctctccttgttcagcgtacaatagcacgaaccattgtattacaggagagtatagggaagggtcgttttggagaagtctggcggggaaagtggcgtggtgaagaagtggcagtgaagatcttttctagccgggaggaacgttcctggttcagggaagcagaaatctatcaaacagtaatgctgaggcacgagaacattctgggctttattgctgcggacaataaggacaatggaacttggacacagctgtggttggtaagcgactaccatgagcatggtagtctatttgattacctgaaccgctataccgtcaccgttgaggggatgataaagcttgccctctctacagcttccggactggcccacttgcacatggagatagtggggacgcagggcaagcccgctattgcacacagggatctaaagtctaagaatatcctggtgaagaagaatggcacctgctgcattgctgatttgggactcgccgttcgtcacgactctgcaaccgatactatcgatattgccccaaaccatagggtggggaccaaaagatacatggcacccgaagtccttgatgactcaattaacatgaaacactttgaaagtttcaaacgggctgatatctacgcaatggggctagtcttctgggagatcgctcgccgttgctccattggtggaatccatgaagactaccagctgccctactacgacctggttcccagcgatccgtctgtcgaggagatgcgtaaggtcgtgtgcgagcaaaaactgaggccgaatattccaaaccggtggcaatcttgtgaggctctgcgcgtgatggctaagatcatgagggagtgttggtacgccaacggtgccgcaaggctgaccgcactcagaatcaaaaaaacactctcacaattgtcacaacaggagggcatcaaaatgtag

SEQ ID NO: 31253 - DNA, 1512 bp, Artificial Sequence
  Description of Artificial Sequence: Synthetic coding sequence
atggaggccgcagtagcagcccctagacctaggctgctcctcctcgtcctggccgcagccgctgctgccgctgcagcacttctgccaggtgctactgctcttcagtgtttctgccacctgtgtaccaaggacaattttacgtgtgtcaccgatggactctgcttcgtgagcgtcactgagaccaccgacaaggttatccacaactccatgtgcattgccgaaattgatcttatcccacgcgaccgtccattcgtgtgtgctccttccagcaagaccggcagtgtgacaaccacatactgttgcaaccaggatcactgtaacaagatcgagttgccaaccactgtgaagtcttctcccggactgggtccagtagaactggcagctgtcattgccggacctgtgtgcttcgtctgtatatcacttatgctcatggtgtacatttgtcataatcgaaccgtgatccaccaccgcgtcccaaacgaggaggatccctctctcgacaggccgttcattagcgaaggcaccactcttaaggacctgatctacgatatgaccacttcaggttctgggagtggactaccccttctggtacagcggacaatcgcccgaacaatcgtgctacaggaaagtattggaaaggggaggtttggagaggtgtggaggggaaagtggcggggagaagaagtcgccgtcaagatattctcttccagggaagagaggagctggtttagggaagcagagatttaccagaccgtgatgctgaggcatgagaacattttgggttttatcgccgcagacaataaggacaacggcacatggacacaactctggctcgtgtctgattaccacgagcacggtagtctcttcgactatttgaacaggtatactgtgaccgttgaagggatgatcaagctagccctctcaaccgcatccgggctagcccatctgcacatggaaattgttggaacacaggggaagccggcaatcgctcatcgcgacctcaagtccaagaatatactcgtgaaaaagaatggcacctgctgtattgccgacctgggtcttgctgtgagacatgactctgctactgacacaatcgatattgctcctaatcaccgcgtaggtaccaaaaggtacatggctcctgaagtactcgacgactccataaacatgaagcattttgaaagctttaagagagctgacatttacgccatgggacttgtattttgggagatcgcacgacggtgttccattggcggtatacatgaggactaccagcttccatattatgacctcgtgccatccgatccaagtgtggaggaaatgcgcaaggtggtatgtgagcagaagcttagaccaaacatcccaaatcggtggcaatcctgcgaggccctgagggtgatggccaagataatgagggaatgttggtacgcaaatggtgcagctagactcactgctctgagaatcaagaagacattgagtcaactgtctcagcaagagggaatcaagatgtag

SEQ ID NO: 31254 - DNA, 1398 bp, Artificial Sequence
  Description of Artificial Sequence: Synthetic coding sequence
atggaagccgcagtggcagccccacgtcctcgcctgctcctcctggtgctcgccgcagcagccgctgccgcagccgcattacttccaggggcaacggctcttcagtgtttctgtcatttgtgtacaaaggacaactttacttgcgtaacagatgggctgtgttttgtgagtgtcactgaaaccacagacaaggtcatccacaactcgatgtgtatagcagagattgatctgatcccccgagatagacccttcgtgtgcgctcccagtagcaagaccggaagtgtcacaaccacatactgctgtaaccaagaccactgcaataagatagagctgcctacaaccgtcaaatcaagtcccggactaggtcctgtggagttagccgcagtgatcgcgggacctgtttgtttcgtatgcatctcgttgatgcttatggtgtacatctgccacaatagaaccgtgattcaccacagagttccaaacgaggaggatccaagtctcgataggccttttatttctgagggtacaacactgaaggacttaatttatgacatgacaacttccggctccgggtccggccttcccctcctggtacaacgcaccatcgcacggaccatcgttctgcaggaatccatcggcaaggggaggtttggagaggtatggagaggcaagtggcgcggagaggaggtggctgttaagatatttagctcccgtgaagaaaggtcttggttccgtgaagccgagatctaccagaccgtaatgctcagacacgagaatatcttgggcttcattgctgctgacaataaagataatggaacatggactcaattatggctcgtgtctgactaccatgaacacgggtcgctatttgactaccttaacaggtatacagtaacggttgaggggatgattaagctggcactaagcactgcatctggcctggctcatctgcatatggaaatcgtgggtactcaaggcaaaccagccatcgctcccaaccaccgcgtgggcacgaaaaggtacatggctccggaagtgctagacgactcgatcaacatgaagcacttcgagtccttcaaaagagcagatatctacgccatggggctagtcttctgggagattgccaggcgctgctcgatcggcggtattcatgaagactatcagcttccctactacgacctggtgcctagtgatccctctgtggaggaaatgcggaaggtggtgtgtgagcagaaactgcgcccaaatattcccaaccgctggcagtcgtgcgaggcgcttagagtgatggcgaaaatcatgagggagtgctggtacgccaacggcgcagcgagactgacagccctgcgaattaagaaaactcttagccagttaagccagcaggagggtattaagatgtag

SEQ ID NO: 31255 - DNA, 216 bp, Artificial Sequence
  Description of Artificial Sequence: Synthetic coding sequence
atggaagcagccgtggctgccccacgacccaggctcctgttggcttctacgagccttcagtgtttttgtcacctctgcaccaaagacaattttacgtgtgtcaccgatggcttgtgctttgtctctgtgaccgagaccactgataaggtgatccataactccatgtgtatagcagaaatcgatttaattccacgcgatcgacctttcgtctgttag

SEQ ID NO: 31256 - DNA, 1305 bp, Artificial Sequence
  Description of Artificial Sequence: Synthetic coding sequence
atgtgcatcgctgagatagaccttattccgagagaccgtcccttcgtgtgtgccccttctagtaaaacaggatctgttaccactacgtactgctgcaaccaggaccattgcaacaaaattgagcttccaactactgtgaagagcagtcctggccttggaccggtcgaattagccgctgtgattgcgggtcctgtgtgctttgtgtgtatctctttgatgttaatggtctatatctgccacaacaggacggtgattcatcatagggtgccgaacgaagaagacccttctctcgataggccatttatctccgagggcacaaccttgaaggacctgatctatgatatgactacgtctggaagcggctctgggctgccattgctggtacagaggaccatcgcaaggacgattgttttgcaggagtccattggcaaaggcagattcggcgaagtatggagaggcaagtggcgcggagaagaggtagcagtcaagattttctcctctagagaggaacgttcttggtttcgggaggccgagatataccagacggtcatgctgagacacgaaaatatcctggggttcatcgccgctgataataaagacaacgggacctggactcagttgtggttggtctcagattaccacgaacacggatctctctttgattacctcaatcgctacaccgtgaccgttgaaggtatgatcaagttagcgctctccaccgcgtcagggctcgcgcatctgcatatggaaatagtcggcacacagggaaaaccggctattgctcatcgtgatctcaaatctaagaatatcctcgtgaaaaaaaatggcacctgctgtatcgccgatttaggattagccgtgcggcacgactccgcgacggacaccatcgatattgccccaaaccacagagtgggcactaagaggtatatggcccctgaggtcctggacgattccatcaacatgaagcactttgaatccttcaaaagagctgatatttatgcaatgggcctggtattttgggagattgctcgcagatgttctatcggtgggattcacgaggattatcagctgccatattacgatttagtaccctctgacccaagcgtggaggaaatgagaaaagtggtctgtgaacagaagctgaggccaaacataccaaaccgctggcaatcctgtgaagctctgagagttatggctaaaattatgcgcgaatgttggtatgccaatggagccgctcggctgaccgcattgaggatcaagaaaacgttatcccaactttcccagcaagaaggaatcaaaatgtag

SEQ ID NO: 31257 - DNA, 411 bp, Artificial Sequence
  Description of Artificial Sequence: Synthetic coding sequence
atgaaagatagtaaccgctgttgttgtgggcagtttacaaaccagcacatcccaccgttaccatcagccaccccgtccaaaaacgaagaggaatctaaacaggtagaaacgcagcctgagaaatggagtgtcgctaagcacacccagtcataccctacagattcgtacggagttctggagtttcaggggggaggatactccaataaggcaatggtgcgtaaagccttcaggcatggggcaacgaggatcactgcctttatcggagggcagtcacccagtccaaagctccagatccccggacttttacacggttgcggctccatctttttggacatttcactaaagaaccaggagatttatctgtgtacctggctgctcgccatgcggctgggtaattggacgccactgtag

SEQ ID NO: 31258 - DNA, 4878 bp, Artificial Sequence
  Description of Artificial Sequence: Synthetic coding sequence
atgggccagaaatcctggatcgagaagaccttttgtaaaagagaatgcatctttgtgatccccagcatgaaagacagcaaccggtgttgctgcggacaattcactaaccaacacattccaccactgccatcggctaccccatctaagaacgaagaagaatcaaagcaggtagaaactcagccagagaaatggtcagttgctaaacacactcaatcctaccccaccgacagttacggagttctggagtttcagggcggagggtacagcaataaagctatgtacatccgtgtgagctatgatacgaagcccgactcattgttgcatctgatggtaaaggactggcaactcgagctccccaagctgctgatcagtgtgcatggcggtctccagaacttcgagatgcagcctaagctaaagcaggtttttggcaagggcttgataaaggcagcaatgaccacaggggcatggatcttcactggtggcgtttccaccggcgtaatctctcatgtgggagatgcgttgaaggatcactcctccaagagccggggtcgagtctgtgcaatcgggatcgccccttggggcatcgttgagaataaagaagaccttgtgggcaaagatgtgacccgggtctaccagacaatgagtaaccctttgagcaaactgtctgtcctcaacaactcacatactcactttatactcgctgacaatgggacgctgggaaagtatggtgccgaagtgaagctgcgaaggctgttggaaaagcacatctcactgcagaagatcaataccagactggggcagggtgttcccctggtgggactcgtagtggagggtggtcccaatgtagtgtccatagttctggagtacctccaggaggagccacctattccagtggtaatttgtgatggcagcgggcgtgcaagcgatatattgtcattcgcccacaaatattgtgaagagggtgggatcattaacgagtcccttagagaacagctcttggtgaccattcagaagacttttaactacaataaagcccagtctcatcagctctttgccataataatggaatgtatgaaaaaaaaggaacttgtgacggtctttagaatgggatccgaaggacagcaggatatcgagatggccattctgacagctcttttgaaggggacgaatgtgagcgcccctgaccaactctcactagctttggcttggaatcgagtggacatcgctcgctcccaaatatttgtcttcggtcctcactggccccctctcggctctctggctccccctacggactccaaggctaccgaaaaggaaaaaaaacccccaatggccactaccaaaggtggcaggggaaagggaaagggtaagaaaaagggcaaagttaaggaagaggtggaggaagaaaccgatcccaggaagattgagctgttgaattgggtgaacgcgctggagcaggctatgttggatgccttagtccttgatcgggtggacttcgtgaagctgctgatcgaaaacggagtgaatatgcagcacttcttaacaatacctcgccttgaagaactttacaacactagactcggccctcccaataccctgcatctgctagttagggacgtgaaaaagtcgaatctcccacctgattatcacatcagcctgatcgatataggactggttcttgaatatctgatgggcggagcctataggtgtaattatacgagaaagaattttcgtacgctgtataacaacctgttcgggccaaaacgtcctaaggctctcaagctgcttggtatggaggacgatgaaccgcctgccaagggcaaaaagaagaagaaaaaaaaaaaggaggaggaaattgatatcgatgtggacgatccagcagtcagtcgcttccaatatccgttccacgagctcatggtgtgggccgtgttaatgaagagacaaaagatggctgtcttcctgtggcaacgtggagaggagtcaatggctaaggccctggtcgcatgtaagctgtacaaagctatggcacacgaatccagcgagagtgacctggtagacgatatcagccaggacttagataacaattccaaggactttggccaactggctctggaattgctggatcaatcttataagcacgatgaacagatcgctatgaaattgctgacatatgaacttaaaaactggtcaaattccacgtgtctgaagctcgctgtggcggctaagcatagagactttattgctcacacttgcagtcaaatgctcctcactgatatgtggatggggaggctcaggatgagaaagaaccctgggctcaaggtgattatgggaattttgctcccgcctactatcctgtttctggagttccgcacatacgacgacttttcctatcagacgtccaaggagaacgaagacggtaaggagaaggaggaagagaacactgatgccaacgccgacgcgggttccaggaaaggcgatgaagagaacgagcacaaaaaacagcggagcatccctatcggcaccaagatttgcgagttctataatgcacccattgtcaagttttggttctacactatcagttacttggggtacctgctgttattcaactatgtcattctggtgcgcatggatggttggccgtcccttcaagagtggatcgttatcagttacatagtttctttggcactggaaaagattagggaaatcctgatgtccgaacccggtaaactgagtcagaagataaaggtatggctccaggagtattggaacattaccgatctggtggcgatcagcacttttatgattggagccatactacgtctccagaatcaaccctacatggggtacgggagggttatatactgcgtggatatcatattttggtacattcgcgtattggacatatttggcgtgaacaagtaccttggaccatatgtaatgatgataggtaagatgatgatcgacatgttgtactttgtggtcataatgctggtggtgctgatgtcctttggcgtggcccgtcaggccatcctgcacccagaggaaaaaccctcctggaagctggctcggaacatattctacatgccctattggatgatttacggcgaagtgtttgccgaccagattgatctgtacgcgatggagataaaccccccatgcggtgaaaacctctacgacgaagaggggaagaggctgcctccatgtatccccggagcctggctgacgcctgctttaatggcctgttacctactcgtggccaatattctcttggtgaatctcctgatagcagtcttcaataacacattcttcgaggtgaaatctatctccaaccaggtgtggaagtttcagcgctatcagctcatcatgacgtttcacgacaggcctgtgttgccccctcccatgatcatcctgtctcacatttacatcattattatgagactctctggacggtgtcgtaaaaaaagggagggcgatcaggaggagcgtgacaggggactgaaactatttctgtcagacgaggaattaaagcgtctccacgaatttgaggagcagtgtgtacaagagcactttcgtgagaaagaagatgaacagcagagctcttccgacgagcggatccgagtgacttcagaacgtgtggaaaatatgagtatgcgcctggaggagataaacgagagggagacgttcatgaaaacatctctgcagaccgtggatctgaggttagcccaattagaggagttgtctaataggatggtcaacgctctcgagaatctggcgggaatagatcggagtgatctgatccaggcccgttctcgcgcatcatcagaatgtgaagcaacatacctgctccgccaatccagcattaactcagccgatggctatagcctgtatcggtaccatttcaacggggaggaactgttgttcgaggatacctctctctcaaccagtcctgggacaggggttagaaaaaagacctgttcatttagaataaaagaggaaaaggatgtgaagacgcacttggtaccggagtgccaaaactccttacacctttctcttgggacctcaacttcagcaacaccagatggcagccaccttgcagtggacgatctgaagaacgccgaagaatctaagttgggacccgatatcggcatttcaaaagaagacgatgaaaggcaaaccgattccaagaaggaggagacaatcagtccctccctgaataagacagacgtcatccatggccaggacaagagtgatgtccaaaatacgcagctgacggtggagaccacaaatattgaaggtaccatatcctatcccctcgaagaaacgaagattacacggtactttcctgacgagaccattaacgcttgcaagacaatgaaatcaaggtccttcgtgtactcacgcggtagaaagctggtcggcggagtaaatcaggatgtagagtactcaagtatcacagaccagcagctgacgacggagtggcagtgtcaagtccagaagatcactagaagccacagtacagacatcccatacattgtgtctgaggccgcagtccaggctgagcacaaagaacagttcgccgacatgcaagacgagcaccatgtggcagaggcaattcccaggatcccacgcctcagcctgactatcaccgacaggaatgggatggagaatttgctttccgtgaaaccagaccaaaccctgggttttccttccctgcgctccaagtcattacacggacaccccagaaacgtgaagtcaattcagggtaaactcgaccggtctggtcacgccagtagcgtgtcttcattggtgattgttagtggtatgactgccgaagaaaagaaagttaaaaaggagaaggcaagcaccgaaaccgagtgctag

SEQ ID NO: 31259 - DNA, 4812 bp, Artificial Sequence
  Description of Artificial Sequence: Synthetic coding sequence
attaagacttctaagcggtgctgctgtggccagttcaccaaccaacacatcccaccacttccttccgccactccgtcaaagaacgaggaagagtcaaagcaggtcgagacacagcccgaaaaatggagtgtggcaaagcacacacaatcctacccaacggattcctatggagtgctggaattccaaggcggaggctactccaataaagccatgtacatcagagtgtcatacgataccaaaccagattccctgctgcatttaatggtgaaagattggcaactggaactgcccaaattactcattagtgttcacggcggtctccagaactttgagatgcagccgaagcttaagcaagtcttcggtaaaggcctgatcaaagctgctatgaccactggcgcttggatatttacgggaggtgtgtccaccggggtcatctcacacgtaggagacgcattaaaagaccactcaagtaaatctcgaggaagagtgtgcgccattggcattgccccatgggggatcgttgaaaacaaagaagacctcgtgggcaaggacgtgaccagggtgtaccaaacaatgtctaatcccctcagcaagctctccgtgctcaacaacagtcatacccatttcatactcgctgacaatggaacattggggaaatatggagcagaggtgaaattgcggagactcttagagaaacacatctctctgcagaagatcaatacgcgccttggacagggggtgcctctggtgggcctggtggtggagggtggacctaatgtagtttccattgttttggagtacctgcaagaggaaccaccaattccagtcgtaatctgtgacggcagcggtcgggcatccgacattctgtcatttgctcacaaatactgcgaagagggaggcatcataaatgagagtttgcgtgaacaactgctggttacaatccagaagacttttaattacaacaaagctcagtcccaccaattgtttgccattatcatggagtgtatgaaaaagaaagaacttgttaccgtattcaggatgggctctgagggacagcaggatattgagatggcaatattaaccgcgctcttaaaagggacaaatgttagcgctcctgatcagttgtctctggccctggcctggaacagagtggatatagccagatctcaaattttcgtgttcgggccacactggccacccctgggttcactggctccgcctaccgatagcaaagcaaccgagaaggagaagaaaccacccatggccacgactaagggtggacggggaaaaggtaaaggtaaaaagaaggggaaagtcaaagaggaagtggaggaggaaaccgatccacggaagattgagttgctgaactgggtcaatgccctggaacaggcaatgcttgacgctctggttctggatcgcgtggattttgtcaaactgctcattgaaaatggtgtgaacatgcagcattttctgactatacctagactagaagaattgtacaacacacggttggggcctcccaatacactccaccttctggtacgcgacgtcaaaaagtccaacctaccgcctgactatcacatatctctgatcgacatcggccttgttctggagtacctgatgggaggcgcatatcgatgcaactacacacggaaaaacttccgcaccctctataacaatctgttcggaccaaagagacccaaagctttaaagctcctcggcatggaggacgatgagccacccgcaaaagggaaaaaaaaaaagaagaaaaagaaagaagaggagatcgatatagacgtcgatgaccctgccgtgtctcgctttcagtaccccttccacgagctgatggtctgggccgtcctgatgaagaggcagaagatggcggtgttcctctggcaaagaggggaagaatctatggctaaggcactggtggcctgcaaactgtacaaagccatggcccacgagtcaagcgaatcggatctcgtcgacgacatcagccaggacctggacaataactctaaagattttggacagctggcactcgaactgttggaccagagctacaagcacgacgagcaaatcgcaatgaaactcctcacctatgagctgaagaactggagtaacagcacctgtctgaaactagcggtcgcggcaaagcatagagactttatcgctcatacctgttcacagatgttgttgaccgacatgtggatgggacgcctccgtatgcggaagaaccccggtctgaaggtgataatgggtatccttctgccacctactatcctgtttctagaattcaggacttacgacgatttttcctatcaaacttcaaaagagaacgaagacggcaaggagaaagaagaagaaaatacagacgccaacgccgacgctgggagccgtaaaggggacgaagaaaatgagcataaaaaacaaagatcaattcctatcggcacaaaaatttgtgaattttacaacgcgcctatcgtaaagttctggttttacacaatttcctacctgggttacctgctgctgttcaattacgtgattctagtgcgcatggatggttggcccagcctccaggaatggatagtgatttcatacatagtcagcctggccctcgagaaaatcagggaaattctgatgagcgagcccggaaagctgagtcagaagatcaaagtgtggctccaggagtattggaacattactgacctggttgccatcagcacattcatgattggcgcaatcctccggctacagaaccagccttacatgggatacggcagggtgatctattgcgtggacatcatcttttggtacataagggttctggatattttcggggtcaataaatatcttggaccttatgtcatgatgataggtaaaatgatgatcgacatgctgtatttcgtggtgattatgctcgtggtattgatgagcttcggggtcgctcgacaggctattctgcaccctgaagagaagccttcttggaaattagcccgtaacattttttatatgccgtactggatgatatatggcgaagtgttcgccgaccagatcgacctttacgctatggagattaaccctccgtgtggcgaaaatctgtatgacgaggaaggcaaacggctccctccatgtatccccggtgcctggctcactccagctctgatggcgtgctacctgctggttgccaacatattgctagtcaacctgttgattgctgttttcaacaacactttctttgaagttaagagtatctccaatcaggtgtggaaatttcagcgctaccagctgattatgacctttcatgaccggcctgtgctgcccccacccatgatcatcctgtctcatatttatattattattatgagactctcgggacgctgccgcaagaagcgcgagggtgaccaggaagaaagagaccggggactgaagttgtttctttctgacgaagaattaaaacgactccacgagtttgaagaacagtgtgtacaagaacatttccgagagaaggaggatgagcagcaatcttcctctgatgagagaatccgagtgacttctgaacgcgtggagaatatgtccatgaggctagaggagatcaatgaaagagagacattcatgaagacatctctccaaacagtcgatctaagattggcacagctcgaggaactgagcaaccggatggtgaacgccttggagaacttagcaggaattgatagatctgacttgattcaagctcgatcccgagccagttctgagtgcgaggccacttacctgcttcgccagtcctccattaattccgctgacggctattccttgtatcgataccacttcaacggggaggaacttcttttcgaggatacaagcctgtctacatcgccaggcacgggagtacggaagaaaacttgttccttcaggatcaaggaggagaaggatgtcaaaacccaccttgtcccggaatgccaaaatagtctgcacctgtccttgggtactagtacctctgcaactcccgacgggtctcacctcgccgttgacgacttgaaaaatgctgaggagagcaaactggggcctgatatcggcatctcaaaagaagatgatgagaggcaaacagacagtaaaaaggaggaaactatctcccccagtctgaacaaaaccgatgtgatccatggccaggataagagcgacgtccagaacacccagctcaccgtggaaacaacaaacatagaggggacaatctcgtacccacttgaagaaacaaagatcaccaggtacttcccagacgaaactatcaatgcatgcaagactatgaaatcaagatcgtttgtctactcaagggggaggaaactcgttggaggcgtgaaccaagatgtcgagtactcaagtataaccgatcagcagctcacaacagaatggcagtgtcaggtgcaaaaaatcactcgaagccacagcaccgatattccctacatcgtttccgaagcggcagtccaggcagagcataaggagcaattcgccgacatgcaagatgaacaccatgttgcggaagctatcccaaggataccgaggttatccttgacaataaccgatcggaatggcatggagaacctgctctccgttaagccagaccagacacttggttttccctctttgcgctcaaagtctttgcatggtcaccctaggaatgttaaaagcatccaaggaaagctcgaccgtagtggccacgcttcaagcgttagctctctcgtgatcgtctcaggaatgacagcggaggagaagaaagttaaaaaagaaaaggcatcgactgagactgagtgctag

SEQ ID NO: 31260 - DNA, 4812 bp, Artificial Sequence
  Description of Artificial Sequence: Synthetic coding sequence
atgaaagactccaacaggtgttgctgtggacagttcaccaatcagcatatccctcctcttccttccgccaccccttctaagaacgaggaggagtccaaacaggtggagacacagccggaaaagtggagcgtggccaagcacacccagagttaccctacagactcctacggggtcttagagttccagggtggaggctactctaataaagccatgtatatccgcgtgtcatacgacactaagcccgacagcctgctgcacctcatggttaaagattggcagcttgagctacctaagctgctcatcagcgtccatggagggttgcagaatttcgagatgcagccaaagcttaagcaggtcttcggaaagggcttgataaaggccgctatgaccactggggcatggatctttaccgggggtgtcagcacgggtgtgatctcacacgttggtgatgccctgaaggatcacagctccaaaagtagggggcgtgtttgtgccatcggcatcgccccatggggtatcgtcgaaaacaaggaggacctggtaggtaaagatgtcacacgagtctaccagacgatgtctaacccactgtccaaactgagcgtgctcaacaactcccacacccactttattttagcggataatggtacgctcggtaagtatggagccgaggtaaaactgcggagacttctggagaagcacattagtctacaaaagatcaatacccgtctggggcagggggtgccattggtggggcttgtggtcgaaggcggtcccaacgtagtgtctatcgtcctggagtatttgcaggaagagcccccaatccctgtcgtaatctgtgatggttcgggtcgcgctagtgatattctgtccttcgctcacaagtactgcgaggagggcggtataatcaatgagtctctgcgtgaacaactgttggtgacaatacagaagacattcaattataacaaggcacagagccatcagctgttcgcaatcataatggaatgcatgaagaaaaaggagctcgtcactgtttttaggatgggctccgagggacagcaagacatcgagatggctatactgacagcacttttaaaagggaccaatgtgagtgctcccgaccagctgagtctggctctggcctggaatagagtcgacatcgctagatctcagatctttgtttttggacctcattggccccctctagggagcctggcccctccaacagactctaaggcaacggagaaggagaagaagcctcccatggcaaccacaaaaggcggacggggtaaaggtaaggggaagaagaaggggaaagttaaagaagaggtggaagaggagacagaccctcggaagatcgagctcttaaattgggtgaacgcccttgaacaggccatgctggacgccctggtgcttgatcgcgtggatttcgtcaagttgctcattgaaaacggagttaacatgcagcactttcttacaattcccagactcgaagagctgtataatacacgcctcgggccaccaaatacccttcacctcctagtccgcgatgtcaaaaaatcaaatctgcctcctgactatcatatttctctgatcgacatcggcctggtgctagaatatctgatgggcggagcctatcggtgcaactacacccggaaaaatttcagaacgctctacaataacctgtttgggccaaaacgcccaaaagccctaaagttgctcggcatggaggacgacgaacctcctgcgaagggaaagaagaaaaagaaaaaaaagaaggaggaggagattgatatagatgtggacgatccagccgtgagccggtttcagtacccttttcacgaactgatggtctgggccgtcctgatgaagcgtcagaagatggctgtgttcctgtggcagcggggagaggagtctatggccaaggctcttgtggcgtgtaagttgtacaaagcgatggcccacgaaagtagcgagtccgacttagtggacgacatctcccaggatctggataataattcaaaagattttggccaactcgcgttagaacttctggaccagtcgtataagcatgatgaacaaatagctatgaagctgctgacctacgaactgaagaattggtctaacagtacatgcctgaagctagcggttgccgctaaacatcgtgatttcattgctcatacatgtagccagatgttattaacggacatgtggatgggccgacttcggatgcgtaagaaccctggtctgaaagtgattatgggcatcctactcccccctacaattcttttcctagaattcaggacctacgacgatttctcataccagacaagtaaagagaacgaggacggcaaagagaaggaagaggagaacacggatgccaacgccgatgccggtagccgcaaaggggatgaggaaaatgaacataaaaagcagaggtccatcccgatcgggaccaagatttgtgaattctacaacgcacctatcgtgaagttttggttctacacaatttcctacttaggctatcttctcctatttaactacgtaatactcgtcaggatggacggctggcctagcctgcaggaatggatcgttatctcatatatcgtgtcactggctctcgagaagatacgcgagattctgatgagcgaacccggaaagttgtcccagaagatcaaggtgtggctgcaggagtattggaatataacagatctcgtggctatcagcaccttcatgattggcgctattctgaggctacaaaaccagccatacatgggctatggacgggtgatttactgcgtggatatcatcttctggtatataagagtcttagacattttcggtgtgaacaaatatttgggcccttacgtgatgatgatcggcaaaatgatgatcgacatgctctacttcgtggtcataatgttagttgttctaatgtcgttcggggtggctcgccaggctatactacaccctgaggagaaaccctcttggaaactagcgcgaaatatcttctacatgccttactggatgatttatggggaggtcttcgccgaccagattgatctgtacgctatggaaattaaccccccttgtggggagaacctgtatgatgaagaggggaaaaggctcccaccatgcattccgggagcctggctgacacctgcactgatggcgtgttatcttctggtggctaatattctgttggtgaatttgctcatcgcagtgttcaataacacattcttcgaggtgaagagcatctccaaccaggtgtggaagttccagagataccaattgattatgacgtttcacgaccgaccagtgctgcccccaccgatgattatcctgtctcacatctatattattatcatgcggctgtctggcaggtgccggaaaaagcgcgagggtgatcaggaagagcgcgaccggggactcaagttgttcctgtccgatgaggaactgaaaaggctgcacgagtttgaggagcagtgcgtccaggaacactttagagagaaggaggatgaacagcagtcatcctccgatgaaaggattcgtgtgacgtcagagcgggtggagaatatgtccatgagacttgaggagattaatgaacgggaaacctttatgaaaacttccctgcagactgtggaccttcgcctggcccagctggaagaattatccaatagaatggtgaatgctctggagaatctggccggtattgacagaagtgatttgatacaagctagatctagggctagttcagagtgcgaggcgacatacctgctccggcagtcaagcatcaattccgcagacggatactccctgtaccggtaccacttcaacggagaagagttgctgtttgaagatacttcgctgtccacgagtcccggaactggtgttagaaagaaaacttgctcatttaggatcaaggaggagaaagacgtcaaaacacatcttgtaccggaatgtcagaattcactgcacttaagtctggggacttccacatccgccacacctgacgggagccatttagcagtcgatgatttgaaaaacgcagaagaaagcaaactcggtcccgacatcggcatctctaaggaagacgatgagagacagactgattctaagaaggaggaaactatctctccttctctcaacaaaacagacgtgatccacggccaagataagtccgacgtgcagaacacacagttgacggtcgagactaccaacatcgagggaacaatcagctacccactcgaagaaacaaagataactcgttactttccagatgaaacgataaatgcatgcaagaccatgaagtccagatctttcgtctactcaagaggccgaaagctggtaggtggagtgaaccaagacgtggaatacagctcaattaccgaccagcagctgacgactgaatggcagtgtcaggttcagaagataactaggtcgcacagcactgacattccatacattgtttccgaggccgcagtgcaggccgaacacaaggagcaattcgccgatatgcaggacgagcatcacgtggctgaagctatcccaaggatccctcgactgagcctgacaataaccgaccggaacggtatggagaaccttttgtctgtgaaaccagaccaaacccttggattcccgagtcttcgcagtaaatcactccacgggcacccacgaaatgttaaatccatccaagggaaactggaccggtccggccacgccagcagtgtcagttcactagtaatcgtctctggtatgacggccgaggagaagaaggtaaaaaaggaaaaggcctctactgagaccgagtgttag

SEQ ID NO: 31261 - DNA, 4929 bp, Artificial Sequence
  Description of Artificial Sequence: Synthetic coding sequence
atgagctcctttaagcgcggtagtcttaagagcagtacctccggcagccagaagggtcaaaaatcatggatcgagaagaccttctgcaaacgggaatgcatcttcgttattccctccatgaaggactctaacaggtgctgttgcggtcagttcactaaccagcacattccccctttacccagcgcaacaccttcaaaaaatgaggaagagagcaaacaggtcgaaacgcagcctgaaaaatggtctgtagctaagcacacccaaagctaccctacggattcctacggcgtgctggagttccagggcggtggatacagtaacaaggccatgtatatccgtgtgagttacgatactaaacctgattctctgttgcatctgatggttaaggactggcaacttgaactcccgaagctgctcatttcagtgcatggagggctgcagaattttgaaatgcagcctaaactgaagcaggtattcggcaagggcttgatcaaggccgcaatgactaccggggcatggatatttacaggcggagtcagcactggggtgatatcccatgtgggcgacgctctgaaggaccattcttccaagagtcgtggacgggtttgcgcgattggtattgcgccatggggaatcgtcgaaaataaagaggacctggtgggtaaagatgtgactagagtgtatcagacaatgtccaaccccctgtccaagctgtccgttttgaataattctcacactcattttatcctggcggataatggcacgctgggcaagtatggcgctgaagtaaagctgaggagacttttggaaaaacacatttcgcttcagaaaattaacactcggttaggccagggcgtccccctggtgggcctggtggtggaagggggacctaatgtcgtcagtatcgtgctggagtatttgcaggaggaaccacctattccagtggtgatctgcgatggctcaggtcgggcatcagatatcctgtcatttgcccataaatattgtgaggaaggagggattatcaatgagagtctcagggagcaactcttggtgacaattcaaaagaccttcaattataacaaggcccaatctcaccagctgttcgcaatcatcatggaatgtatgaaaaagaaagagcttgttactgtgttccggatgggttctgaaggtcagcaggatatcgagatggctatactcacagctctccttaaaggcaccaatgtgagtgccccagatcagctttcactggcgttagcctggaatcgcgtcgacatagctcgttcccaaatctttgtgttcggccctcattggcctccactagggtccctggctcctcctactgacagcaaagctacagaaaaagaaaagaagccacccatggccacaactaaggggggtcgaggcaaggggaagggaaagaagaagggtaaggtgaaagaagaggtcgaagaagagactgatcctcgaaagatcgaacttctcaattgggtcaacgccctcgagcaagctatgctcgatgctcttgtgctggaccgtgtggatttcgtgaagctcctgattgagaatggcgtgaacatgcaacactttcttactattccgagactcgaggagctttataacacgcggttgggcccaccgaacacactccatctgctcgttagggacgtgaagaaatcaaacctacctcctgactaccatatttctctcatcgacatcggcctcgtattagagtaccttatgggcggagcctataggtgcaattatacccgcaagaattttaggactctctacaacaacctgttcggccctaagcgtccaaaagccctgaagcttcttggcatggaggacgacgagcccccagctaaaggtaagaagaaaaaaaaaaagaaaaaggaagaagaaatcgatatagatgtggacgacccagctgtgtctagattccagtacccctttcacgagttaatggtctgggctgtgctgatgaagcggcagaagatggccgtgttcctctggcaacggggtgaagagagcatggcgaaggcacttgttgcgtgcaagctatacaaggccatggcgcacgagagcagcgagtccgacctggtggatgatatttcacaggaccttgacaacaattcaaaagatttcgggcagttggcgctggagctacttgatcagtcgtataaacacgatgaacaaatagctatgaagctgctgacctatgagctgaaaaactggtctaattctacttgtctgaagttggccgttgctgccaagcaccgcgatttcatcgctcatacatgcagccaaatgctccttaccgacatgtggatgggtcggttgcggatgagaaagaacccaggactgaaggttattatgggaatcttgcttccacccaccatactgttcctggagttccgcacatacgatgatttctcctatcagacctctaaggaaaacgaggatggcaaggagaaagaggaggaaaatacggacgctaatgcagacgcagggtcccggaagggtgatgaggaaaacgaacacaagaaacagcgttcgatccccattgggactaagatttgtgaattctataatgcaccgatagtcaaattctggttttacacaatctcttatctgggataccttctcctgtttaactacgttattctggtcaggatggacggatggcctagccttcaggagtggattgttatctcatacatcgtcagcttggctctggagaagatccgggagattctgatgtccgagcctggaaaactgagccagaagatcaaagtctggttgcaggaatattggaatatcacagatctggtggcaatcagtacctttatgattggcgctatcttacgtcttcagaatcagccctatatggggtacggaagggtgatttactgtgtggatattatcttttggtacatacgcgtgctggatatcttcggcgtgaacaaatacctgggcccttacgtgatgatgattggcaaaatgatgatagacatgctctactttgtcgttataatgttagttgtcctgatgtcttttggtgtcgccagacaagctatattgcatcctgaagaaaagccttcatggaaactggcacgaaacatcttttacatgccatattggatgatttacggtgaagtatttgctgatcagattgatctctacgcgatggagattaacccgccttgcggtgagaatctctacgatgaggaaggcaaacggctcccaccttgcatccctggggcttggctgaccccagccttaatggcatgctacttgttggtggccaatattctgctggtgaacctcctcatcgcggtgtttaataacaccttttttgaagttaaaagcatttccaatcaggtctggaaattccaaagataccagctgattatgaccttccatgacagacccgtgctcccaccaccaatgataatcctgtctcacatctatattatcattatgcgtttgagcgggaggtgtcgaaaaaagcgcgagggtgatcaggaggagcgggatcgcggactgaagctgttcttgtcggatgaagagttaaagagactccacgagttcgaggagcagtgtgtgcaggagcattttagggaaaaggaggacgaacagcaatcgagctccgatgagcgaattcgcgtgacgagtgagagggttgaaaacatgagtatgcgcttggaggagattaatgagcgcgaaacttttatgaagacatcactgcagacagtagacctcagactcgctcagctggaagaactgagcaaccgcatggtaaacgctcttgagaatctggctgggattgatcggtcagacctcatacaggcccgatcacgagcctcaagtgaatgtgaggccacctatctccttaggcagagttctatcaattccgccgatggctatagcctttacaggtatcacttcaacggcgaggagctcctgttcgaagacacctcacttagtacgagccctgggaccggtgtacgcaagaagacttgtagcttccgcatcaaggaagagaaggatgtcaagacacacctggtccccgaatgccagaacagcttgcacctgtccctgggtacctcaacctccgcgacccctgatgggagtcacctggccgtggacgacctgaaaaatgctgaagaaagcaagcttggaccagacatcggtatctcgaaagaggacgacgaacggcagacagactctaagaaggaggagaccatctctccgtcccttaacaaaacagacgtcattcacgggcaggataaatcagatgtccaaaatactcagctgactgtcgaaactactaatatcgagggtaccatttcataccccttggaggagaccaagattaccaggtattttccagatgaaacaatcaacgcgtgtaaaacaatgaagtccaggtcttttgtatactcgcgcggaagaaagctggtgggcggagtaaaccaggacgtagagtatagctctatcacagaccagcagctgacaaccgaatggcagtgtcaggtccaaaaaattaccaggagccatagcactgacattccttacatcgtgtctgaggcagcggtgcaggccgaacataaggagcagtttgcggacatgcaagatgagcatcacgtggccgaagcaattccacggattccaagactgtccttaacaattactgacagaaatgggatggaaaacctcctatcagtgaaaccggaccagacactaggcttcccctccctgcggtcaaagtctcttcacgggcatccacgcaacgtgaagtccatccagggtaagctggatagatctggccacgcaagctccgtcagcagcttggtgatcgtgagcggcatgaccgctgaggagaagaaagtgaaaaaagaaaaggcttcaacagaaacagagtgttag

SEQ ID NO: 31262 - DNA, 4173 bp, Artificial Sequence
  Description of Artificial Sequence: Synthetic coding sequence
atgaaagactcaaaccgctgttgttgtgggcagtttacgaatcaacacatcccgcctttgccttccgccacaccatctaagaatgaagaagagtccaagcaagtggagacgcagcctgagaagtggagcgtggcgaagcatacacagtcctatcccactgactcgtacggtgtactggagtttcaggggggaggctacagcaataaagcaatgtacatcagagtcagctatgacacgaaacccgactctctgcttcatctgatggtcaaagattggcagcttgagctcccgaaattgcttatttctgtgcatgggggtctgcagaactttgagatgcagcccaaactgaagcaggtgttcggcaagggactcatcaaagctgcaatgactactggcgcttggatattcacagggggagtgagcacaggagtcatcagccatgtgggagacgcactcaaggatcacagttccaaatcgcggggaagagtgtgcgcaattggcatcgccccatggggtatcgtggagaacaaggaagatctggttggtaaggacgtcacaagggtttatcagaccatgagtaacccgctgtcgaagctcagcgtgctcaacaatagccacacgcattttatcttggccgacaacggaacattgggtaaatacggtgctgaggtgaagcttaggcgtctccttgagaagcacatctccctgcaaaagatcaacacacgcttaggccaaggcgttcctttggttggcctggtggtcgaaggagggccaaacgtggttagcatagtactggagtaccttcaggaagaaccacccatcccagtcgtgatttgtgatggaagcgggagagcttctgatatcttgtccttcgcacataagtattgtgaggaagggggtattatcaatgaatcactgcgagaacagcttctcgtcaccatccaaaagacatttaactataataaagcgcaaagccatcagctcttcgccataatcatggagtgtatgaagaagaaggagctggtgacggtgttcagaatggggtctgaaggacagcaggatatcgaaatggcaatattaaccgccttactcaaggggacaaatgtctcggctcctgatcaactgagtctggccttagcctggaaccgggtggacatagcaagatcccagattttcgtgtttgggccacactggcctccactaggttccctcgccccacctacggacagcaaagctaccgagaaggagaagaaaccgccaatggcgaccactaaggggggtcgaggcaaggggaagggaaagaagaagggaaaagtgaaggaagaagttgaagaagagactgatcccaggaagatcgaactcctgaactgggtgaacgcactggagcaggctatgcttgatgctctagtcctggacagagtcgatttcgtaaagctcctaatagaaaatggagtgaacatgcaacactttctgacgattcccaggctcgaggaactttataatacaaggctgggaccaccaaatacgctgcatcttctcgtgcgagacgtgaaaaagagcaacttgcccccagattaccacatcagtctgattgacattggcctcgtgttagaatacctgatggggggtgcgtataggtgcaattacactcgtaaaaacttcaggacactttataataacctgttcgggcctaagaggcccaaggctctgaaactgctgggcatggaggatgacgagcccccagcaaagggcaagaagaaaaaaaagaagaagaaagaggaggagattgatattgatgtcgatgaccctgccgttagcaggtttcagtacccgtttcatgaactaatggtgtgggcagtccttatgaaaagacagaagatggcggtctttctgtggcagaggggagaggagagcatggccaaggctctcgtggcttgcaaactatataaggccatggcacacgaatcctctgaatccgatctggtcgacgatatcagccaggatttagataacaatagtaaagatttcgggcagctcgctctcgagctgttggatcagtcgtacaagcacgacgaacagatagctatgaagcttctcacctatgagcttaagaattggagcaactccacgtgcttaaagcttgctgttgccgctaagcaccgggactttattgcccatacatgctcccagatgctgctaaccgacatgtggatgggcagattacggatgagaaagaatcctggcctgaaagtgatcatgggcattctactgccccctacaattctgttccttgagtttcggacgtatgatgatttttcttatcagacctccaaagagaatgaggatggtaaagaaaaggaagaggaaaataccgacgcgaacgcggatgccggaagcaggaagggtgacgaagaaaacgagcataagaaacagaggtctattcctatcggaaccaagatttgtgaattctacaacgcacccatcgtgaaattttggttttataccatttcttaccttggttaccttctgcttttcaattacgtgattctggttcgaatggatggttggccatcgctgcaggaatggatcgtcatctcttatatcgtgagtctagccctcgaaaaaatccgggagatcctcatgtccgagcccggaaagctgtctcagaaaatcaaagtgtggctccaggagtactggaacataactgatcttgtcgccatatctaccttcatgattggcgcaattcttaggttgcagaaccagccctatatgggctacggcagggtgatatactgtgtagacatcatcttttggtatattcgcgtcttagatattttcggagttaacaagtatctggggccatacgtaatgatgattgggaagatgatgatagacatgttatatttcgtggtcatcatgttggtggtgctcatgagtttcggggtggcacgccaggccatcctccatccggaggagaagcccagttggaagctggctagaaacatcttttacatgccctattggatgatttacggtgaggtattcgcggaccagattgacctgtacgccatggagatcaatcctccttgcggcgagaacttatacgatgaagaaggtaagcgtcttcccccatgcattccgggagcctggctaactccagcactgatggcatgttatttactggtcgccaatattcttctggtgaacctcctgattgcagtttttaacaacacgttctttgaagtgaaaagcatttcaaaccaggtgtggaagttccagcgttatcagctgattatgactttccatgacagacccgtgttgcctcctcccatgatcattctctctcacatctacattataatcatgcgtttaagcggcaggtgccgcaaaaaaagggagggcgaccaggaagaaagagatcggggacttaaacttttcctctctgacgaggagctaaagagattacacgagttcgaggaacagtgcgtccaggaacactttagggaaaaagaggatgaacagcaatctagtagcgatgagcgaattcgggttacatccgagcgggttgaaaatatgagcatgagacttgaggaaattaacgagagagagacatttatgaagacctctctgcagaccgtggatctgcgcctggctcagctcgaagagctcagcaatagaatggtgaacgctctggagaacctcgctgggatcgataggagtgatctaattcaggcgcgatcacgggcttcaagcgagtgtgaggcaacctatctgcttcgccagtctagtataaattcggcagacggctattcattgtatcggtatcatttcaatggagaggagctgctgtttgaagacacctcgctctccactagtccgggaactggcgtaaggaagaagacatgcagttttaggattaaagaagagaaagacgtgaagacccatcttgtgcctgagtgtcagaactccctacacctctcactaggcacaagcacctctgcaacgccagacggctcccacctggccgtagatgacctgaagaatgccgaggaatctaaactgggacccgatatcggcatcagtaaggaagacgacgagcgacaaacagacagcaagaaagaggaaactatctcgcctagcctgaataaaaccgatgtcattcacgggcagtag

SEQ ID NO: 31263 - DNA, 4584 bp, Artificial Sequence
  Description of Artificial Sequence: Synthetic coding sequence
atgtacattagggttagctacgacaccaagcctgatagtttgttacacctgatggtaaaagattggcagttagaactgcctaaactgctaatctctgttcacggcggacttcagaattttgagatgcaacctaaactgaagcaggtcttcggcaaggggctgattaaagccgctatgaccacgggagcgtggatcttcaccggtggagtctccaccggcgttatcagccacgtgggcgatgcactaaaggaccactcttccaagagccgcggaagagtctgtgctatcgggattgccccttgggggatcgtggagaataaggaggatctcgtgggcaaggacgttacccgagtttatcagactatgagcaatcccctctcaaagctctccgtgctcaacaacagccacacgcacttcattctggccgataatggtactcttggcaagtatggagccgaggtaaagctgcgccgtttattagaaaaacacatctcactgcagaaaatcaataccagactgggccagggtgtgcctctggtgggattggtggtcgaggggggtcccaacgtggtgtctattgtgctagaatacctgcaggaggaaccacctattccagtagttatatgcgacggatccgggagggcctccgatatcctgtcattcgcacataagattattaacgaaagcctgcgtgaacagctgctcgtgacaatccagaaaacctttaattacaacaaagcccagagccaccagctgtttgccattatcatggagtgtatgaagaagaaagagctggtcacagtattcaggatgggaagcgaaggccagcaggatatcgagatggccatactgaccgccctgctcaaaggcacaaatgtctctgcaccagaccagctgtcgctcgcgctcgcctggaatcgcgtggacatcgcccgatcccaaatctttgtgttcgggccacactggcctcccctgggctcacttgcgccaccaaccgacagtaaagcgaccgagaaagaaaaaaagcccccaatggcaaccacaaagggagggcgtgggaaaggtaagggcaagaaaaaagggaaggtcaaggaagaagtggaagaagaaacagacccccgtaagattgagctcctaaactgggttaacgctttggaacaggcaatgctggacgcccttgttcttgatcgcgtggattttgtgaaacttcttatcgagaatggcgtcaatatgcagcatttcctaacaattcctcgcctagaagagctgtataacaccaggctcgggccacccaataccttgcatctcctcgtccgggatgtgaagaagagtaatcttccccctgattaccatatcagtctgatagatataggattagttttggaataccttatggggggagcataccggtgcaactacacacggaagaattttaggacgttatacaataatttgttcggtcccaagagaccaaaagccttaaaacttctaggaatggaggatgacgagccaccagccaaaggcaagaagaagaaaaagaaaaaaaaggaagaagagatcgatattgacgtcgatgaccccgctgtgtcgagatttcagtatccctttcacgagcttatggtctgggccgtgctgatgaagcggcaaaagatggctgtgttcctgtggcagagaggggaagaatcgatggccaaagctctggtggcttgcaaattatataaggccatggctcatgaaagctctgagtcagacctggtcgacgacatttcccaggacctcgacaataattcaaaagattttggacagttggcactggagctgctagaccagagttacaagcacgacgaacagatcgccatgaagctgctgacgtacgaactgaaaaactggagtaactccacttgccttaaattagccgtggctgccaagcaccgggacttcattgcccatacctgctctcaaatgctgctgaccgacatgtggatgggccgattaagaatgcgtaagaaccccggattgaaggtgatcatgggaatcttacttcctcctacaattctgtttctcgagttcagaacctacgacgatttcagctaccagacatccaaagagaatgaagatggtaaagagaaggaggaagagaacaccgacgccaacgccgacgccggtagtcggaagggcgatgaggagaatgagcataagaaacaacggagcatcccaataggaacaaaaatctgcgagttctacaatgccccaatcgtaaaattttggttttacaccataagctacctgggttatttgctactttttaattacgtcatactcgttaggatggatggatggcccagcctccaggaatggatcgtaatctcttacattgtgagcctggcgttagagaagataagggagattcttatgtcagaacctggtaaactgagtcagaagattaaagtgtggcttcaggagtattggaatatcaccgatctcgttgcgataagcacgttcatgattggggctatcctcaggcttcagaatcagccttatatggggtacggccgagttatctactgtgttgacattatcttctggtacattcgtgtgcttgacatctttggagtgaataagtatctgggaccctatgttatgatgatcggaaagatgatgatcgatatgctttactttgtggtgatcatgctggtcgtattgatgtcctttggagtcgcccgacaagcgattctgcatccagaggaaaagccgtcatggaagctggctcgaaacatcttttacatgccttactggatgatttacggggaggttttcgctgatcagatagacctatatgcaatggagatcaatcctccgtgtggcgaaaatctctacgacgaggaggggaaaagacttccaccctgtatccccggagcttggttgacccccgcactcatggcttgctacctcctcgtcgctaacattttgctggttaatcttttgatcgccgtcttcaataacacgttcttcgaggttaaaagtatcagtaatcaggtctggaagttccaacgttatcagctgatcatgacatttcacgatcgacccgttctcccgcctcctatgattattctttctcacatatacattatcattatgcgcttaagcggcaggtgtcggaaaaagcgtgaaggcgaccaggaggagagggacagagggttaaagttatttctctctgatgaggagctcaaaagactgcacgaattcgaagagcagtgcgtgcaagagcactttagagagaaggaggacgaacagcagagcagttcagatgaaaggatccgagtgacttcagaaagggtggagaatatgagcatgagactcgaagagatcaacgaaagggaaacgtttatgaagacatctctgcagacggtggacctccggctggctcagctcgaggagctgtccaaccggatggttaatgccctagagaatctggctggaattgaccgctcagatcttatacaggcccgatcacgtgctagctccgagtgcgaggcgacctacctgctgcgtcaatcctccattaactccgcagatggctactcactctacagataccactttaatggggaggagttgctgttcgaagataccagtttaagcaccagcccaggcacgggagtgaggaagaagacctgttcttttcggattaaggaggagaaagatgtaaagacacacttagtaccagaatgccaaaacagcctgcatctaagtctaggtacaagcaccagcgcaaccccagacgggtctcacctggccgtcgacgatctgaagaacgcagaggaatcgaaactgggacctgacataggtatttctaaggaggatgacgagcggcagacagattccaagaaagaggagactatctctcccagcctgaataagacggacgttatccacggacaagacaagagcgacgtgcagaacacacagctgaccgtggagacgaccaatatcgaagggacgatctcctatcctctcgaggagacaaagataacgagatacttcccagatgagactattaacgcttgcaaaaccatgaagagcagatcattcgtctactcacgtggaagaaagctggtagggggagtaaaccaggatgtcgaatattcgtctatcaccgatcagcagttgaccaccgagtggcaatgtcaggtacagaagataacccggagccactccacagacatcccctatattgtgtcagaagctgccgttcaggctgagcataaggaacaattcgctgacatgcaggatgagcaccatgtggcagaggctatcccgaggatccctcgcctctccctgacgataactgatcggaatggtatggagaatcttttatccgtgaaacctgatcagactctcggctttccatccttgaggtcaaaaagcctgcacgggcaccctcgaaatgtcaaaagcatccaggggaaactggatcgttctggacacgcttcatcagtaagtagcctggtgatcgtgtctgggatgactgccgaggagaaaaaagttaagaaagagaaagcgtccaccgaaacagagtgctag

SEQ ID NO: 31264 - DNA, 1479 bp, Artificial Sequence
  Description of Artificial Sequence: Synthetic coding sequence
atggccttgaatagtggtagtcctcccgctatagggccttattacgaaaaccatggataccagccagaaaatccctatcctgcccagccaacagtggtgcccaccgtgtatgaggtacatcccgcacaatattaccccagccctgttcctcagtacgccccaagggtgctcacacaagcctctaacccagtcgtgtgcacccaaccaaaatccccatcaggaacagtgtgtacgagtaagacgaaaaaggccctgtgtatcacattaaccctcgggacttttctcgtcggtgcagccctggctgctgggctgctgtggaagtttatgggatctaaatgtagcaattccggcatagaatgtgattcctcgggcacttgcatcaacccctcaaactggtgtgacggggtgagccactgtccgggaggcgaagatgaaaatagatgtgtgaggttgtacgggcctaactttatcttgcaggtgtactcctcccagagaaagagctggcaccccgtgtgccaggacgattggaacgagaactatggccgagccgcatgtcgcgacatgggttataagaataacttctactcttctcaaggcattgtcgacgattccggcagcacctcctttatgaagctgaacacctctgcgggtaacgtagacatttacaagaaactgtaccattccgacgcatgttcctctaaagctgtagtatccttgcggtgtatagcctgtggcgtgaacctgaatagcagccgacagtcccgcattgttggaggcgaaagcgctcttcccggtgcgtggccatggcaggtgtctcttcacgtgcagaacgttcacgtctgcgggggtagcatcattacacccgagtggattgttaccgcagcacattgcgttgaaaagccactaaataacccttggcactggacagccttcgcaggaatcctaagacaaagtttcatgttctacggagctggataccaggtagaaaaggtgatcagtcaccctaactacgactccaaaacaaagaataatgatattgctctgatgaaactgcagaaaccattaaccttcaacgatcttgtgaagcccgtgtgccttcctaatcctggaatgatgctccaacctgagcaactttgttggatttccggctggggtgccaccgaagagaaaggcaaaacaagcgaagttctgaacgcggcaaaagtgttgctaatcgagacacaaagatgcaattcaagatacgtctacgacaatctgattaccccggctatgatttgcgctgggtttttacagggtaatgtcgactcttgtcagggtgatagcggcggacctctggttacttccaagaacaatatctggtggttgatcggcgatacatcgtgggggagcggttgcgctaaagcctatagaccaggcgtgtacggcaatgtgatggtttttaccgattggatttacaggcagatgcgggctgatggttag

SEQ ID NO: 31265 - DNA, 1590 bp, Artificial Sequence
  Description of Artificial Sequence: Synthetic coding sequence
atgcctcctgcaccccctggaggggagtccggctgtgaagaaagaggtgccgctgggcatatcgaacacagtcggtatctttccttattggacgccgtagataattctaaaatggctctgaacagcggcagtcctcctgccatcggtccttactacgagaatcatgggtaccagcctgaaaacccttacccagcccaaccaacggtcgtacctacggtgtacgaggtgcaccccgcacagtactatcctagtcctgtcccgcaatacgctccaagagtccttacgcaggcttctaatcccgttgtgtgtacccagccaaagtcaccatcgggaaccgtctgcactagcaaaaccaaaaaggccctgtgcatcacactaacactgggtacatttctcgtgggggcagcgctggccgcaggcttactgtggaagtttatgggtagcaagtgcagcaattctggcatagagtgcgattcatcaggtacatgtattaacccttcaaattggtgtgacggagtcagtcactgccccggaggagaagatgagaatcggtgcgtacgcctctacggcccaaatttcattctccaggtgtacagcagccagaggaagagttggcatcctgtctgccaagatgattggaacgaaaattatggaagggcagcttgccgtgacatggggtacaagaataacttttacagcagtcaaggcatagtagacgactcagggtcaacctccttcatgaaactgaacaccagcgccggaaatgttgatatctataagaaattgtatcattccgacgcgtgttccagcaaggcagttgtgtccctccgctgtatagcctgcggggtgaatctgaactcctcgcggcagtcccgcatcgtgggtggagagagcgctctccctggtgcttggccttggcaagttagtctgcatgtgcagaatgtgcacgtctgtggaggaagcatcatcacgccagaatggatcgttactgcagctcactgcgtggaaaagcccctgaataatccttggcattggacggcttttgctggtatcttgagacagagttttatgttctacggggcaggctatcaagtggagaaagtcatttcccaccccaactacgactcaaaaacaaaaaataacgacattgctttgatgaagctgcagaaaccgctgactttcaacgatcttgtcaaaccagtgtgcttgccgaatcccggaatgatgctgcagccggaacagctgtgctggatcagtgggtggggggcaacggaggagaagggcaaaacctcggaggtgctgaatgcagccaaggtcctcctcattgagacacagagatgtaacagtcgatatgtttacgataacctaattacgccagccatgatctgcgccggatttctccaggggaatgtcgactcatgccaaggtgacagcgggggacctctggtgacaagcaagaataacatctggtggctgataggcgatacatcctgggggtcaggctgtgcaaaagcgtatcggccaggggtttatggcaacgtaatggtgttcacggactggatctataggcagatgcgggctgatggctag

SEQ ID NO: 31266 - DNA, 1470 bp, Artificial Sequence
  Description of Artificial Sequence: Synthetic coding sequence
atggccttgaattctggaagtccccctgctattgggccatactacgaaaatcacggttaccaaccggagaacccctacccagcacagcccacggttgtccctacagtgtacgaggtgcacccagcccaatactatccttctcccgttccacagtacgcgccacgggtgctgacgcaggctagcaatccagtagtgtgtacgcagccaaagagcccaagcgggaccgtttgtacgagtaaaacaaaaaaagccctgtgtatcacactgactctggggaccttcctggtgggcgcagccctggctgcgggattgttatggaaattcatgggctccaagtgcagtaactccggaattgaatgtgactccagcggaacctgtataaatccctccaactggtgtgatggtgttagccactgccccggaggagaggatgagaaccgctgcgtgaggctgtatggacctaatttcatattacaggtttatagtagtcagcggaagtcttggcatcctgtatgccaggatgattggaacgagaattatggaagggcagcgtgccgagatatgggatataaaaataatttttattcctcccagggcattgttgacgattccggctcgactagcttcatgaaactcaacacttcagctggaaacgtggatatctataagaagttataccatagtgatgcttgctcctccaaagcagtggtttccctgagatgtatcgcttgtggtgttaacctgaattcctcacgccagagccgcatcgtcggcggagagtctgcactgccaggcgcatggccatggcaggtctctcttcacgtgcaaaacgtacacgtatgtggaggctcaataatcaccccggagtggatcgtgacagcagcccactgcgttgagaaacccctcaataatccctggcactggactgccttcgctggaattctgagacaatctttcatgttttacggagctgggtatcaggtggaaaaagtcatttcacatcctaactatgacagcaagacaaagaacaatgatatcgccctcatgaagctgcagaaaccattaacctttaatgacctggtgaagcccgtgtgcctaccaaaccctgggatgatgctacagcccgaacagctgtgctggattagtggctggggtgcaaccgaggagaagggcaagaccagcgaagtccttaatgccgcaaaggtgttgcttattgagactcaaaggtgcaattccaggtacgtgtacgataatctgattactcccgctatgatttgtgcaggttttctccagggcaacgtggatagttgccagggagacagtggcggacccctcgtaacttcaaaaaataacatctggtggctcataggagacacctcctgggggagcgggtgcgccaaagcttacagaccaggagtatacggaaatgttatggtgtttacagattggatttatagacaaatgaggtag

SEQ ID NO: 31267 - DNA, 240 bp, Artificial Sequence
  Description of Artificial Sequence: Synthetic coding sequence
atggccctgaacagcgggtcgcctcctgcaatcggcccttattatgaaaaccacgggtatcagcctgagaacccatatcccgctcagcccactgttgtgcctaccgtgtacgaggtccaccctgctcagtattacccttcacccgtgcctcagtacgccccaagggtgctgactcaagcctccaatcctgtggtgtgtacacagccaaagagcccctccggtacggtctgtacctcctag

SEQ ID NO: 31268 - DNA, 1479 bp, Artificial Sequence
  Description of Artificial Sequence: Synthetic coding sequence
atggcgctgaactctggctctccaccggctatcggcccatattacgaaaaccacggctatcagccagaaaatccttacccagcccagccgacggttgtcccaacggtgtatgaagtccatcctgctcaatattacccctccccagtgccccagtatgctccaagggtgttaacgcaggctagtaaccccgtcgtctgcacccagcccaaatccccctccggtacggtctgcacaagcaagacaaagaaggccctgtgtatcacactgaccctcggcaccttccttgtgggggcagccttagccgctggcctgctgtggaaattcatgggaagcaagtgttccaattcaggaatcgaatgtgattccagcggcacgtgtatcaacccaagtaactggtgtgatggggtcagccactgtccaggaggcgaggacgagaaccgatgcgtccggctgtacggacctaattttatcctgcaggtgtactcttcccagcgaaagtcctggcacccagtctgccaggatgattggaatgagaattacggccgtgctgcgtgccgtgacatggggtataaaaacaatttctactcctctcagggcattgtggacgactcgggcagcacatcgttcatgaagttgaacacttccgctggcaacgtcgacatctataagaagctgtatcattccgatgcttgctccagcaaggctgtcgtgtccctgagatgcattgcgtgtggggtgaacctaaacagctcccgtcaatctcggattgttggaggggagagcgctttaccaggggcttggccctggcaagtgtccctccatgtgcagaatgtgcatgtctgcggaggatccataattacccccgagtggatcgtaactgccgctcactgcgttgaaaagcctctgaacaacccgtggcattggaccgccttcgctgggatcctgaggcagagcttcatgttttatggcgcaggctatcaggtggagaaggtcattagtcacccaaactatgacagtaaaactaagaataacgatatagccctgatgaagttgcagaaacccctgacgtttaatgacctcgtgaaacccgtttgtctccccaaccccggtatgatgttgcagcccgaacagctctgctggatatccggatggggtgcaacagaggaaaaaggtaaaacctctgaggtgctgaacgctgctaaagtcctgctgattgaaactcagaggtgcaactctaggtacgtgtacgataatctgattactcctgcgatgatttgtgcaggttttctccaggggaacgttgatagctgtcagggggatagcgggggtccactggtaacctccaagaacaacatctggtggttgataggggacacctcttggggcagcggctgtgcaaaggcttatcgacctggcgtttacggcaacgtgatggtttttacagactggatttaccgtcagatgagggcagacgggtag

SEQ ID NO: 31269 - DNA, 717 bp, Artificial Sequence
  Description of Artificial Sequence: Synthetic coding sequence
atgtacgcgccagggggtgcagggctacccggagggagaaggcgcaggtctcctgggggatccgcactgcctaagcagcccgagagatctctcgcctccgccctgcctggcgcactgtccattactgccctctgtaccgctctggctgaacctgcttggctgcatattcatgggggaacttgctccagacaggaactgggagtcagcgatgtgttgggatacgtgcatcccgacctgctgaaggacttctgtatgaacccgcaaactgtgttgcttttgcgggtgatcgcagccttctgctttctgggcatcctttgttcgctctccgcttttttgttagacgttttcggtccgaagcacccagcgcttaagatcacacgcagatatgcgttcgcgcacattctgacagtactgcagtgcgcgacagtgatcggtttttcttattgggcctccgaactaattctggctcaacagcagcagcataaaaagtatcatgggagccaggtctatgtaacattcgcagtgtccttctacctcgttgccggtgccggtggagcatcaattctggccactgcagctaacctgctgcggcattatccgacagaagaagaggaacaggcactggaactcctgagcgagatggaagagaacgagccataccccgcagagtatgaggttattaaccagtttcagccccctcccgcatacacaccatag

SEQ ID NO: 31270 - DNA, 717 bp, Artificial Sequence
  Description of Artificial Sequence: Synthetic coding sequence
atgtacgcgccaggcggagctggcctgccaggaggcaggaggaggcggtcacctggaggaagcgccctcccaaagcagcctgagagatcactggcatctgctctgccaggcgctctgtcaattaccgctctgtgcactgctctggcagagccggcttggctgcacatccatgggggaacttgctctaggcaggagctgggcgtgtcagacgtgctgggttatgtgcaccctgatctgctgaaagacttctgcatgaaccctcagaccgttcttctcctgcgcgtgattgctgctttctgttttctggggatcctctgctctctttctgcctttctcctcgacgtgtttggtccaaaacatcctgccctgaagataacacgcaggtatgctttcgctcacatcttgacggtcttacagtgcgccacagttataggattttcctattgggcctctgaactcattttagctcagcagcagcagcacaaaaaataccacggttcgcaagtctacgtgacatttgctgtgagcttctacttggtcgccggtgcaggtggtgcatccattctggcaaccgcagcaaacctgttgcggcattaccccacagaggaggaagaacaggcactggaactgctctcagaaatggaggagaatgagccctacccagctgagtatgaggtgataaaccaatttcagcccccaccagcctacactccgtag

SEQ ID NO: 31271 - DNA, 3075 bp, Artificial Sequence
  Description of Artificial Sequence: Synthetic coding sequence
atgtgtgctcgcatggcaggtagaacaactgctgcccctcgtggaccctatggcccttggttgtgcctgctggtcgccctcgcactggacgtggtgcgggtggattgcgggcaggcccctctcgaccctgtgtatttacctgcagcactcgagctgctggacgccccagaacatttcagggttcagcaggtgggccattatccccctgctaactctagcctcagttctaggagtgaaaccttcctgctgctccagccgtggccacgagcacagcccctgctcagagccagttatcctcctttcgcaacccaacaagtggtacctcctcgcgtgactgaaccgcaccaaaggcctgtcccctgggatgtacgggctgtgtctgttgaggcagctgtgaccccggctgaaccatacgctcgggtgctgtttcacctcaaaggacaggattggcctcccggtagcggttcattgccgtgtgcacgactccatgcaacacaccctgctggcactgcccatcaggcatgtaggtttcagccatcactcggcgcttgcgtggtggagttggagcttccctctcattggttctctcaagcttcaaccacgagggcggagctcgcttacactctggaacccgcagctgaggggcctggaggatgcggctcaggagaagagaatgaccccggtgaacaagccctcccagttgggggagtggaattgaggcctgccgatcctccgcagtatcaggaagtccccctcgatgaagcggtgaccctccgcgtcccagacatgccagtgaggcctggccagctttttagcgccaccctcctgctccgtcacaactttaccgcttctcttttgaccttgcgtattaaggtgaaaaagggactgcacgtgactgcagccaggcccgctcagccaaccttgtggaccgcgaagctcgacaggtttaaaggttctcgacaccacactaccctcataacttgccatagggccggactaacagaaccagactcctcaagtcctctggagttgagtgaattcctctgggtggatttcgtggtggagaatagtacagggggaggtgtcgccgtgacacgccctgtgacgtggcaattagaatatcctgggcaggctcccgaagctgaaaaggacaaaatggtctgggaaattctcgtgagtgagagagatatccgggcactgatccctcttgccaaagctgaggagcttgtaaataccgcgcctctgacaggggtaccccagcacgtccccgttagactggtcaccgtggatggtggtggggcactggtcgaagtgaccgagcacgtaggctgcgagagcgctaacacacaagtgctgcaggtgagcgaagcgtgtgacgctgtttttgtcgcgggtaaggagtctcgaggcgctcgcggagtgagggttgatttctggtggcgtaggctccgggcaagcctgcgcctgactgtgtgggcgcctctgcttccattgagaattgagctcaccgacacaactcttgaacaagtgagaggttggagggtgccgggtccagccgagggaccagccgagcccgcagctgaggccagtgacgaagctgagaggcgtgcccgaggctgtcatctccagtaccaaagggcaggcgttcggttcctggccccttttgccgcacatcccctcgacgggggaaggcgactgacccacctgctcggcccagactggctccttgatgtatcccacctagtcgctccccatgcccgagtgcttgactcccgcgtggctagcttggagggaggcagagtcgtggtcggacgtgagcctggagtcacctctatcgaggtgcgcagcccactgagcgatagcattctcggcgagcaagcgctggccgtcaccgacgataaagtatcagttctggagctgagggtgcagccagtgatgggtatcagtctgacactctctcgcggtaccgcccatccgggagaagtaactgctacttgctgggctcagtcagcactgcctgctcctaagcaagaggtggccttgtctctctggctgtccttcagcgatcacaccgtagccccagctgagctctacgatcgccgagacctgggactgtcggttagcgccgaagagcccggtgcaattttaccagccgaggagcaaggcgcacagctaggagttgtggttagtggggctggggctgaaggccttccgctacatgtcgctttacatcctccggagccatgcagacgaggccgtcatcgggtcccactggcatccggaactgcctggctgggcctgcctcctgcttcaacaccagccccagcattaccgagtagtccagcctggtctccgcctgctaccgaggcaaccatgggtgggaagaggcaagtggctggaagcgtcggtggcaacacgggcgtccggggaaaatttgaacgggcagaggaggaggccagaaaggaggagacggaggctcgggaagaggaagaggaggaggaagaagagatggtacccgcacctcaacatgtcaccgagcttgagctcgggatgtatgcgcttcttggagtcttttgtgtcgctatttttatatttctagtgaacggcgtggttttcgttctgaggtaccagcggaaggagccacccgactccgccactgatccaacctccccacagccccacaattgggtctggctgggcactgatcaggaagagttgagcaggcaacttgaccgccaaagcccaggcccacccaaaggcgagggcagctgtccttgcgaatctggcggaggcggagaggctcccaccctggcacccggtccgccaggaggcactacttcttccagcagtacgttggctcgaaaggaggctgggggacgaagaaagcgagtggagttcgtgaccttcgctcctgcccctccagcccaatcacctgaagagccagtgggggcaccagctgtccagagtatcctcgtggccggtgaggaggatattcgttgggtctgtgaggatatgggattgaaagaccctgaagagttgcgcaactacatggagaggatccgaggctccagttag

SEQ ID NO: 31272 - DNA, 3072 bp, Artificial Sequence
  Description of Artificial Sequence: Synthetic coding sequence
atgtgcgcacgaatggcagggagaactactgcagctccgagaggcccatatggaccctggctgtgtctactggtagccctggccttggatgttgtgagggtagactgcggacaggccccattagatccagtgtacctacccgctgcactggaactgctggacgcccctgagcattttagagtgcaacaggttggccactaccccccagctaattcttccctgtcaagcagatctgaaaccttccttttgctgcagccttggccaagagcccagcccttgctgagggcatcttatccaccttttgcaacgcaacaggtggtcccaccccgtgttacagagccccaccagagacccgttccatgggacgtccgggctgtttccgtagaagccgctgtcactcctgccgaaccttacgccagggtgctcttccatttgaagggccaggattggccacctggttctgggagccttccctgtgctcgactccacgccacacatccggctggcacagcacatcaggcatgccggttccagccatctctcggcgcatgtgtggtagaactggaacttcccagccactggttctcccaggcttccacgactcgggcagagctggcctatacgctggaacctgccgcagaaggaccaggaggatgtggttcaggagaagaaaatgatcccggtgaacaggcattgccggtgggaggtgtggaactgcggcctgccgacccccctcagtaccaagaggtgccactggacgaggcagtgaccttgagagtgccagatatgcccgtccggccaggccagctgttcagcgctacactgctcttaaggcacaactttaccgcctctttgctgactctgcgcatcaaggttaaaaagggtctccatgtgacagctgcgagaccagcacagccaacgctatggacggcgaaactcgacagattcaaagggtcacggcaccacacaacactgattacatgccaccgcgcaggtctaacagaacctgatagcagccccctggagctgtcagaattcctttgggtcgactttgtcgtcgagaactcaacgggaggaggcgtggctgtgactaggcctgtcacttggcagctggagtacccagggcaggcaccagaggctgagaaagataagatggtatgggagatcctcgtgtccgaaagagacatcagagctctgatcccactagcaaaagctgaagagctggtgaacaccgccccactgacgggcgtacctcagcatgtgccagtccggttagtgactgttgatggtgggggtgctttggtcgaggtcacggagcacgttggttgtgagtctgccaacacccaggtactgcaagtgtctgaggcctgtgacgccgtgttcgtcgcaggaaaggagagccgcggagcaagaggagtgagggtcgatttctggtggcgccgactgcgcgctagcctcagactcactgtctgggccccattactgcctctgcgtattgagctgacagacacaactctggagcaggtcagagggtggcgggttcccggacccgctgaaggtcccgcagagcctgccgcagaagctagtgatgaggcagagcggcgtgcccgtggctgccacctgcagtaccaacgggctggtgttcgcttcttggccccttttgctgcacatccgttggatgggggacgacgtctgacccatctgctgggcccagattggttgctggacgtctcacacctggtcgcaccccacgctagagtactggactccagagtggcctctctggaagggggtcgtgtggttgtggggagagagccgggtgtcacttccatagaagtgcgctctcctctgtccgatagcatcttaggagagcaggccctggccgtcaccgatgacaaggtaagcgttttagagttgagagtacagccagttatgggtatctccctgaccctgtctcgaggtacagcccaccccggagaggtgacagctacatgctgggcccaatccgccttaccagcacctaagcaagaggtagccctttcactgtggctgtcattcagtgaccatacagtggctccagccgagctctacgaccggagagatttgggcctgagcgttagcgccgaggagcccggagctattctccccgctgaagagcagggcgcacagttgggggtcgtggtcagtggggctggagcagaaggccttccgctccatgtcgccctgcaccccccagagccctgccgaaggggcaggcacagagtgccgctcgccagcggaaccgcctggctggggctccctcccgcttctacgcccgcacccgctctgccttcatcacccgcttggagccctccggcaacagaggccaccatgggaggaaagaggcaagtggcgggtagcgtgggtgggaacaccggagtcagaggtaagttcgagcgagcagaagaggaggctcgcaaggaagagacggaggctagagaggaggaagaagaggaggaagaggaaatggtaccggctcctcagcacgtgactgaattagaactcggtatgtacgcattgctgggagttttctgcgtcgctatcttcatcttcctcgtgaacggagtggtcttcgtgctccgatatcagcgcaaagaacccccagacagtgccaccgatccaacctccccacagccacacaattgggtatggttagggaccgatcaggaggaactatctagacagctcgacagacagagtcccggacctcccaagggagaaggctcctgtccttgtgaaagtggagggggaggtgaggcccctacgctggccccagggcctcccggtgggacaacttcttctagttcgacactagctaggaaagaggcaggcggacgtcgcaagcgcgttgaatttgtaacatttgccccagcacctcccgctcagagtccagaagaaccagttggagctcccgctgttcagagtatcctggtggcgggagaggaggatatccgttgggtgtgcgaggacatgggtctgaaagatcctgaagaactgcgcaattacatggagaggatccggggtagctcttag

SEQ ID NO: 31273 - DNA, 1026 bp, Artificial Sequence
  Description of Artificial Sequence: Synthetic coding sequence
atgctccctgagcagctctactttttacagtctccccctgaggaagagcctgagtaccacccagatgccagcgcacaggagctaaatgtacgggagtccgatgtgcgagtttgtgacgaatcgtcttgtaagtatggcggtgtgtgtaaggaggatggagatggactcaaatgcgcttgccagttccagtgccacactaattatattcccgtgtgcggttccaacggagatacataccaaaacgagtgcttcttacggagagccgcttgtaaacatcagaaagaaatcactgttatcgctcgcggtccgtgttactccgataatggctctggaagtggcgaaggcgaggaggaaggttcaggcgcagaggtgcatcgcaaacacagtaaatgtggcccttgcaaatacaaagcggagtgtgacgaagatgccgagaatgtgggctgcgtatgcaatatcgattgttccggatactcattcaaccctgtctgcgcttcggacggctcctcttataataatccctgcttcgttagggaggcctcgtgcattaaacaggaacaaatagacatccgtcatcttggacattgcactgacaccgatgatacctctttactgggaaaaaaggatgatggacttcagtatcgacctgacgtcaaagacgcatcagatcagagagaagatgtctacataggcaatcatatgccttgcccagagaacctgaatggttattgcattcatgggaaatgtgagttcatctacagtactcaaaaggcatcttgcagatgcgagagcggttataccggccagcattgtgagaaaaccgatttttccatcctctatgtcgtgcccagccgacagaaactgacccacgttcttattgccgcaatcatcggcgcagttcaaattgccatcatcgtcgcgatcgttatgtgtattactcggaagtgccccaaaaacaacagagggcgtaggcaaaaacagaacctcggtcatttcacttctgacacatcttctcgaatggtgtag

SEQ ID NO: 31274 - DNA, 1143 bp, Artificial Sequence
  Description of Artificial Sequence: Synthetic coding sequence
atgggggctgcagctgcagaggcgccactccgactgcccgctgctccccctcttgcattctgttgctacacttctgtgttacttttgttcgcctttagccttcccggtagcagggcgtcaaaccaaccacctgggggagggggtggtagcgggggagattgcccagggggtaaaggcaagtctattaactgttccgagcttaacgttagggaaagcgacgtcagagtttgcgacgaatcatcatgtaagtatggcggagtctgcaaagaggacggtgacggtttgaaatgtgcctgccagtttcaatgccacacaaattacattcccgtctgcggcagcaatggagacacctaccagaatgaatgcttcctccgcagggcagcatgcaagcatcagaaagaaatcaccgtcatcgcgagagggccatgctactctgataacgggtctgggtctggcgaaggggaggaagagggatctggggctgaagtccataggaagcatagtaagtgcgggccatgtaagtataaagctgaatgtgatgaggacgcggagaatgttggttgcgtgtgtaacattgactgctccggctattcctttaatcctgtatgtgctagtgacggctctagctacaataacccatgttttgttcgtgaagcttcgtgcatcaaacaggaacagattgacatcagacacctcgggcactgtactgatacagacgataccagcctgctcggcaagaaggacgatggtcttcagtaccgcccagacgtgaaagacgcgtcagatcagcgtgaagacgtgtacattggcaatcacatgccttgccccgaaaaccttaatgggtactgtattcatggtaagtgtgaattcatctacagcacacagaaagcctcatgtagatgcgagagtggctacacaggccagcactgtgaaaagaccgatttctcaatcctgtacgtggtgccatcccggcaaaagctcacccacgtcctaattgctgctatcattggtgcagtgcaaatagccattattgtggcaatcgtcatgtgtattactagaaagtgtcccaagaataacagaggacgtcggcagaaacagaacctcggccattttacgagcgacacatctagtagaatggtctag

SEQ ID NO: 31275 - DNA, 393 bp, Artificial Sequence
  Description of Artificial Sequence: Synthetic coding sequence
atgcaggagcgaaccggggcagccacagcccgtcgagagagcctaccccaggcgaacaacccagagcaactgtgtaaacagcgatgcataaatgaggcctcatggacaatgaagagagtcctaagctgcgtacctgagcccaccgtggttatggcagcccgagcattatgtatgctcgggctcgtgctggcgctgttatctagttccagtgccgaggagtatgtgggactgagcgccaatcagtgcgctgtaccagctaaagatagggtggactgcggctatccccatgtcacaccgaaagagtgcaataacagggggtgttgtttcgattcaaggatcccaggagtgccctggtgcttcaagccccttcaggaagcagaatgtacattctag

SEQ ID NO: 31276 - DNA, 285 bp, Artificial Sequence
  Description of Artificial Sequence: Synthetic coding sequence
atgaaaagagtgttatcttgtgtgccggaaccaacggtggttatggctgccagggccttatgcatgctcggactagtcttggccctgctcagctcatcatccgctgaggagtacgtgggactgtcagcaaaccaatgtgccgtgccagcaaaagaccgagtggattgtggctaccctcatgtcacccctaaggaatgcaataatcgcggttgttgctttgactcgagaatcccaggtgtgccgtggtgcttcaaaccactccaagaggcggagtgtactttttag

SEQ ID NO: 31277 - DNA, 1497 bp, Artificial Sequence
  Description of Artificial Sequence: Synthetic coding sequence
atggctctccctactctccccagctactggtgttcacagcaacgactgaaccagcagctggcccgtcagcgggagcaagaggcaaggctgcgtcagcagtgggagcagaattcacggtattttcgcatgagtgatatatgcagcagcaagcaggcagaatggagcagtaagacaagttatcagcggtccatgcacgcataccagcgagagaagatgaaggaagagaagcgacgatcactggaggccaggcgcgagaagctccgtcaactcatgcaggaagagcaggatctgttggccagggagctagaggaacttcgcttgtctatgaatttacaagagcgacgaatacgggagcagcacggaaagttgaagtccgccaaggaagaacagcggaagctgatcgccgaacagttactgtacgagcattggaagaagaacaaccctaagctaagggaaatggaacttgacctccaccagaaacacgtggtcaatagctgggagatgcagaaggaagagaagaagcagcaagaggccacagcggagcaggaaaataaacgatacgaaaacgaatatgagcgggctaggagagaggctctggagcgcatgaaagccgaggaggaaaggcgacagctggaagacaaattgcaggcggaggctctgctgcagcagatggaggagctaaagcttaaagaagtagaagctacgaaactcaagaaagagcaggagaacttgctcaaacagcgctgggagctcgaaagactggaggaggagcggaaacagatggaggcattccgccaaaaggctgagcttggacgattcctccggcaccaatataacgcccaactgtcccgaagaacccagcagatccaggaggagcttgaagccgaccggaggattctacaagcactgctcgagaaagaggatgaatcacagcgattacatctggccaggagggagcaggtaatggcagacgtcgcgtggatgaagcaggcaatagaagagcagttgcaacttgagagggccagagaagccgaactgcagatgctgctcagggaagaggccaaggagatgtgggaaaaacgagaggcagaatgggctagagaaaggtccgcacgagaccgcctgatgtcagaggtcttaaccgggcgacagcagcagatacaggagaagatagagcagaaccggagggcacaggaggagagcttgaagcaccgcgagcaactcatcagaaatttagaagaagtacgggagttggcccgtcgagagaaagaggagtctgaaaagctgaagtccgcaagaaaacaagagttagaggcacaggtggctgaaagaaggctacaagcctgggaggcagaccaacaggaagaagaagaggaagaggaagccagacgcgtcgaacagctgtctgatgccctgctgcagcaggaagcagaaacaatggcagaacagggctacagaccgaaaccctacggccaccccaagatcgcttggaattag

SEQ ID NO: 31278 - DNA, 1497 bp, Artificial Sequence
  Description of Artificial Sequence: Synthetic coding sequence
atggcactcccaacactccctagctactggtgtagtcagcagaggcttaaccagcagttggctcgacagcgggagcaggaggccagactgcgtcagcagtgggagcagaacagcaggtacttccgaatgagtgacatttgctccagcaagcaggccgagtggtcaagtaagacatcgtaccagcgatcaatgcacgcatatcagcgggagaaaatgaaggaggagaaacggagatctttggaagctcgacgcgagaaactgcgacaactgatgcaagaggagcaggacttgctcgccagggagttggaagagttacggctgagtatgaacctacaagagcggagaataagggagcaacacggaaagttgaaatccgccaaagaggagcagagaaaactgatcgctgagcagcttctgtatgaacattggaaaaaaaataacccaaaactacgcgaaatggaactggacctgcatcaaaagcatgttgttaattcatgggaaatgcaaaaggaagagaagaaacagcaggaagctacagcagagcaggaaaataagaggtatgaaaatgaatatgagcgcgcacggagagaggcacttgaaaggatgaaagccgaggaggaaaggcggcagctcgaggacaagctgcaagccgaagccctcctccagcaaatggaggaactgaagctcaaagaggtggaagccaccaagctcaagaaggaacaggagaatctcttaaagcagagatgggaactggaacgcctcgaggaagagcgtaagcaaatggaggcattccggcagaaagctgagttaggaagattccttcggcatcaatataatgcacagctgtcccgaaggacacagcaaattcaggaggaactggaagcggaccgccgtatcctgcaggctctgctggagaaagaggacgagtctcagcggctgcatctggcgcgtcgagagcaggtgatggccgatgtagcctggatgaagcaggctattgaagaacagttgcagctggagagagcacgggaggcagaacttcagatgcttctccgcgaagaagccaaggagatgtgggaaaagcgggaagctgaatgggccagagaaaggagcgcgagggataggttgatgagtgaggttctgactgggaggcagcagcagatacaggaaaagatcgagcagaacagacgcgcacaggaggaaagcttgaagcacagagagcagttgatccgaaacctcgaggaggtgcgggaacttgctcgcagggagaaggaggaatcagagaagctaaagagtgcacggaagcaggaattagaggcacaggtcgccgagagaagactccaggcgtgggaggccgatcagcaggaggaggaggaagaggaagaagcacgaagggttgaacagctgtccgatgcactgctgcaacaggaggccgagacgatggccgagcagggctacagacctaagccttacggccacccaaaaatcgcctggaactag

SEQ ID NO: 31279 - DNA, 525 bp, Artificial Sequence
  Description of Artificial Sequence: Synthetic coding sequence
atggccctgccaacgctaccgagttactggtgttcccaacagcggttaaatcagcagctggccaggcaacgcgagcaggaggccagactccgacaacagtgggagcagaattcacgctatttcagaatgtctgacatatgcagctctaaacaagctgaatggagcagcaagacaagttaccagaggtctatgcatgcttaccagcgagagaagatgaaggaagaaaaaagacgaagcttggaggcccgacgggaaaagctcaggcagctgatgcaggaggagcaggacctacttgccagggaactcgaggagcttcgtctctcgatgaaccttcaagagagacggatccgtgaacaacatgggaagttaaagagcgctaaggaggagcagagaaagttgattgctgagcagctgctctacgaacattggaagaagaataaccctaaacttcgggaaatggagctggacttgcaccagaaacacgtcgtgaatagttgggagatgcagaaagaagagaagaagtag

SEQ ID NO: 31280 - DNA, 663 bp, Artificial Sequence
  Description of Artificial Sequence: Synthetic coding sequence
atggccctgcctaccctaccttcctattggtgtagtcagcagagactgaatcagcagctcgcaagacagcgggaacaggaggccaggcttaggcagcagtgggagcagaattctagatactttaggatgagcgacatatgttcctcaaagcaggctgagtggagctcaaagacttcctatcaaagaagtatgcacgcctaccaacgggagaaaatgaaggaggagaagcgcaggtcgctggaggccagaagagagaaattgcggcagctcatgcaggaagaacaagaccttctggcaagggaactcgaggagctcagactgtctatgaatcttcaggaacgcaggattagagagcagcacgggaagctaaaaagcgcaaaagaagaacaacggaagctgattgccgaacagctgctgtacgaacattggaagaagaacaatcccaagttgcgggagatggagcttgatctccaccaaaaacatgtcgtgaatagctgggaaatgcagaaggaggaaaagaagcagcaggaagctacagccgaacaagagaacaagcggtatgaaaacgaatacgagcgagcaagaagagaggctctagagcggatgaaggctgaagaggaacgcagactgagtcggacagatggtcacaaacgcaatccatag

SEQ ID NO: 31281 - DNA, 1497 bp, Artificial Sequence
  Description of Artificial Sequence: Synthetic coding sequence
atggcattgcctaccctgccaagctattggtgttctcagcaacggctcaaccagcagcttgctcgtcaacgggagcaggaggccagactgcgccagcagtgggagcagaatagcagatactttaggatgagcgacatttgcagcagcaaacaggcagagtggtcctctaagacgagttaccagaggtccatgcatgcatatcagcgcgagaagatgaaagaggaaaagcgacggagtctcgaagccaggagggagaaacttagacagcttatgcaggaggagcaagacctgctcgcgagggaactcgaggaattacgtctttcgatgaatctgcaggagcgaagaatcagggagcagcatggtaagcttaagagcgccaaggaggaacaacgtaaattgattgctgagcagctgctctatgagcactggaaaaagaataatccgaagctgcgcgaaatggagctggatttacatcagaagcacgtggtcaactcttgggagatgcaaaaggaagagaagaagcagcaggaggcaacagcagagcaggagaataaaaggtacgaaaatgagtacgaacgcgctcgaagagaagcgctggaacgcatgaaggcagaagaggagcgcagacaactggaagataaactgcaagctgaagccttgctccagcagatggaagaacttaagcttaaagaggtagaagctactaaacttaaaaaggagcaggagaacctcctgaaacaaaggtgggaacttgagcgactggaagaggaaagaaaacagatggaggcattccggcagaaggctgaactggggcgatttctgcgccaccagtataatgcgcagctgagcaggcgcacccagcaaattcaggaggaactagaagccgatcgcagaattctgcaggccctgttggaaaaggaagatgagagtcagaggctgcatcttgctcgacgggagcaggtcatggccgatgtggcttggatgaagcaagcaattgaggagcaactacaactggaacgcgcacgggaagcagagcttcagatgctcttgcgcgaagaggctaaggaaatgtgggagaagagagaggccgaatgggctagagagaggagcgcgcgagacaggcttatgagtgaagttctgacgggaagacagcagcagatacaggagaaaatcgagcagaatcggagagctcaggaggagtccctgaaacaccgcgagcagctgatacggaatttagaagaggtgcgggagctggcaagacgtgaaaaagaagaatcagagaagctaaaatctgctcggaagcaagagctggaggcccaggtcgccgaacgaagactgcaggcctgggaagccgaccaacaagaggaggaagaagaagaggaggcacgcagggttgagcagctgtcagatgcactcttgcaacaggaggccgagacgatggcagagcaagggtaccggcctaaaccctacggtcaccccaagatcgcttggaattag

SEQ ID NO: 31282 - DNA, 3090 bp, Artificial Sequence
  Description of Artificial Sequence: Synthetic coding sequence
atgcagactaatgaaggcgaggtctccgaggagagcagttccaaagttgaacaggaggactttgtgatggagggacatgggaagactccgccaccgggagaggagtccaaacaggagaaggaacaggaacgggaagagcaactcatggaggacaaaaaacggaagaaggaagataaaaagaagaaagaggcgacccagaaagtcacagaacaaaagacaaaagtgcctgaagtgacaaaaccttcactaagccagccaaccgcggcatctcctataggcagcagcccttccccgccagtaaacgggggaaataacgctaagagagtggccgtccctaatggacaacccccatccgccgctcgctacatgcctagagaagtcccacctaggttccgctgtcagcaggatcacaaggtgctcctgaaaaggggtcagcctcctccaccttcctgtatgctccttgggggtggagcgggacccccaccatgcaccgcaccaggggcaaaccccaataatgcgcaggtcactggggctttgctacagagtgagtcaggaaccgctcctgtgtggtcgaagagtactcctcccgctccagacaatgggacgtccgcatggggcgaacctaatgaatcctcccccggatggggcgaaatggatgacacaggtgcctctacgacagggtggggtaacacaccagctaacgcccctaacgcaatgaagccgaactcgaagagcatgcaagacggctggggggagagtgatggtccagtaaccggagcccgacatccctcctgggaggaagaggaggacggtggagtgtggaacaccactggatcacaagggtctgcctctagccacaatagcgcttcatggggacaggggggtaagaagcagatgaaatgttcactcaaaggcggaaataatgactcgtggatgaatcccctggcgaagcagttctccaatatgggtttactgtcacagactgaagacaacccatcctctaagatggacttatcagtggggtcactgtccgacaagaagttcgatgtggacaaaagggcgatgaacctgggagattttaatgacattatgcgaaaggacaggtctggtttcaggcccccaaattctaaagacatggggacgactgacagcggcccttacttcgaaaaaggaggaagccatggcctttttggcaactccaccgctcaatcaagaggcctgcatactcccgttcagcccttaaactcttctcctagcctacgggcacaggttccaccacaatttatcagtccacaggtttccgctagcatgctcaagcaatttccaaatagcggcctctctcctggcctatttaatgtcgggccacagctcagtccccagcagatcgctatgctgtctcagctgccgcagataccccagtttcagttggcctgtcaattgctcctccagcagcaacagcaacagcagttgctgcagaaccagaggaagattagccaagcagtgcggcagcagcaggagcagcagctggccagaatggtatctgcccttcagcaacagcagcagcagcagcagcgccagcctggtatgaaacacagtcctagccaccccgtagggcctaagccgcatctggacaacatggtgcccaacgccttaaacgtgggcctgccagatctccaaacgaaaggccctatacccggttacggcagtgggtttagttcaggtgggatggattacgggatggtcggagggaaagaagcaggaactgagagcagattcaagcagtggacatcaatgatggaagggctcccttccgttgcaactcaggaggcaaatatgcataagaacggggcaatcgtggcccctggtaagacgcgcggaggttctccctacaaccagtttgacatcatccccggagatacgctcggcggtcacacaggaccagcaggggattcctggctcccagcgaagtctccaccaacaaataagatcggctcgaagtcttccaacgcctcttggccccctgagttccagcccggagttccttggaaggggatccagaacatcgaccccgagagtgacccatacgtgactcccggttccgtcctggggggaactgccacctcaccaattgtggacactgaccatcagttgctgagagacaacaccactggtagcaacagttctctgaataccagcctgcctagtccgggagcctggccctacagtgccagtgacaattccttcacaaacgtgcattctacctcagccaaattccctgactacaaatctacttggagtcctgatccaattggacacaatcccacacatctgagtaacaagatgtggaagaaccacatctcgtcacggaacacaacgcctcttccaaggccaccccctgggctgacaaatcctaaaccttcctctccttggagttccaccgcacccagaagtgtccgtggatggggtacacaggactctcggctggcctccgcttccacttggagcgacggagggtccgttagaccttcttactggcttgtgttacacaacctgacccctcaaatagacggcagtactctgcggacaatttgcatgcagcatggccctctgctcacattccacttaaatctcactcagggaaccgccctgataagatacagtaccaagcaggaggcagccaaggcacagaccgccttgcatatgtgtgttctgggcaacaccacgatcctagcagagttcgcaacagatgacgaggttagccggttcttggcgcaggctcaacctcctacccccgcagccaccccttccgcaccagccgctggctggcagtccctggagaccggacagaaccagagcgaccctgttgggcctgcattaaacctttttggtgggagcacaggactgggtcagtggagtagctccgctgggggatcatcaggcgctgatctggctggagcctccctatggggcccaccaaattattctagctctctttggggagtgccaaccgtggaggatccccaccgcatgggcagcccagcacccctcctgcccggagaccttctgggcggtggtagcgactctatttag

SEQ ID NO: 31283 - DNA, 5171 bp, Artificial Sequence
  Description of Artificial Sequence: Synthetic coding sequence
atgagggagaaagagcaggagagagaagagcagctcatggaggacaagaagcgcaagaaggaagataaaaagaaaaaagaggcaacacagaaagtgacagaacagaaaaccaaggtgccagaggtgactaaacctagcttgtctcagcccaccgcagcaagtcctatcgggagcagcccttctccccctgtgaatggaggcaataatgccaagcgcgtggccgttcctaatggtcaacccccatcggcggctagatacatgcccagggaggtaccaccacgctttcgttgccagcaggaccataaagtacttctcaaacgcggtcagccccctccaccatcttgtatgcttctaggtggcggtgcaggcccacccccttgcacagccccaggggcaaatcctaataacgcccaggtgaccggcgctcttctgcagagcgagagtggaaccgcgcctgactccaccctgggaggggcagccgctagtaattacgcaaattcgacatggggcagcggggcatcttccaacaacggtacatccccaaacccaatccacatttgggacaaggtcattgtcgacggatctgacatggaggaatggccctgcatagccagtaaagatacagaaagctcctcagagaatacaacagacaacaattccgcctctaaccctggcagcgagaagtctaccctgccaggttctaccactagcaacaaaggtaagggaagtcagtgccagagcgccagttctgggaatgaatgcaatcttggagtctggaaaagcgatcctaaagccaagagcgtgcagtcctctaatagcactacggagaacaacaacgggcttggaaattggcggaatgtgagcggccaagataggatcggacccggatcgggattctcaaacttcaacccaaactctaacccatctgcctggcctgccctggtccaggaaggtactagcaggaagggcgcactggagaccgacaatagcaacagttctgctcaagtctcaaccgtcggccaaaccagtcgggagcaacagagtaaaatggaaaacgccggagtgaatttcgtagtgagcggccgagagcaggctcagattcacaatacggacgggccaaaaaatggcaataccaattcactgaacctgtcctccccaaaccctatggagaacaaaggaatgccctttggaatgggactgggcaacacatccaggtccaccgatgcaccaagtcagtctactggcgatcgcaagaccggaagcgtgggatcatggggcgctgctcgcggtcccagcggcacagacaccgtgagcggccaatccaatagtgggaacaacggcaacaatggcaaagagcgagaggatagctggaaaggggcttcagtgcaaaaatccaccggatcaaaaaatgattcttgggataacaacaatcgaagcactggcggatcttggaacttcgggcctcaggactcaaatgacaacaagtggggcgaggggaataagatgacttccggcgtctcccagggcgagtggaaacaaccgactgggagcgacgaactaaagattggtgaatggtcaggcccaaaccaacccaactcatcaactggcgcttgggacaaccaaaaggggcaccccctccctgagaaccagggcaacgctcaagctccgtgctggggccgatcctcttctagcaccggttcggaagtaggtggtcaatccactggcagtaaccataaagccggatcctccgactctcacaattcgggcagaagatcttatcgaccaactcaccctgactgccaggctgtgctccaaactctattaagcaggacagacctggatccaagagtgttgtctaataccggttggggtcagacacagattaaacaagataccgtgtgggacattgaagaggtgcccaggcccgaaggcaagtccgacaaagggaccgagggatgggagtcagctgcaactcagaccaaaaactccggaggttggggcgatgccccatcccagtccaatcagatgaaaagcgggtggggcgagctgagtgctagcaccgaatggaaagatcctaaaaataccggcggatggaacgattacaagaataacaacagtagtaattggggcggagggaggccggatgaaaagaccccatcaagttggaacgaaaacccttccaaagatcagggctggggagggggacggcaacccaaccaggggtggagcagtggaaagaacgggtggggcgaggaggttgatcagaccaaaaattccaactgggaatcctctgcgagcaagccggtatccggttggggagaaggcggacagaatgagatcggaacctgggggaacgggggaaacgcttcactggcatcgaagggtgggtgggaggactgtaagcggtcacccgcttggaacgaaacaggcagacagcccaattcctggaacaaacaacatcaacagcagcagccccctcagcagccacctcccccacagcccgaggcaagtggcagttggggaggaccgccaccaccaccacctggaaatgtgagacctagcaattcttcctggtcgagcgggcctcaacctgccaccccaaaagacgaggaaccctccgggtgggaggagccttcccctcagagcatctcaaggaaaatggatatcgatgatgggactagcgcatggggggacccgaactcttacaattacaagaacgtgaatctatgggataaaaatagccaggggggaccagcccctagggaacccaatctgccaactccaatgacatccaaatctgcaagtgactccaaatcaatgcaggatggttggggtgaatcagacggtccagtgaccggggctcgccacccttcgtgggaggaggaagaggacggaggagtgtggaacacaacgggtagccagggatcagcctctagccacaactccgccagctggggccaggggggtaagaagcagatgaagtgctcgctcaagggaggaaacaacgactcatggatgaaccctctagccaagcagttctctaacatgggactcctttcacagaccgaggacaaccctagcagtaagatggatcttagtgtgggatcgctgtccgacaaaaagtttgatgtagataagagggcaatgaaccttggcgactttaatgacatcatgcgaaaagacaggtccggatttcgccctcctaatagcaaagatatgggcaccacagactcggggccttacttcgagaaaggcggtagccatggactgttcggtaattcaactgcacagtccagagggcttcacactcccgtacagccactgaattcctctccatccctgcgggcacaggttccccctcagttcatatctccccaggtctctgcaagtatgctcaagcagtttccaaactctggcctctcccctggactcttcaatgtgggtccacagctgtctccccagcagattgccatgctttcacagttacctcaaattcctcagttccagctcgcctgccagttactgctccagcagcagcaacagcaacagctgcttcagaatcaacgaaaaatctctcaagccgttcgccagcagcaggagcagcagttagcacgtatggtaagtgctctgcaacagcagcagcagcaacagcagcgacagcccggtatgaagcactctccaagccatcccgtgggtcctaagccccacctagacaatatggtcccgaacgcacttaatgttggcttacctgatttgcaaacaaaaggtcccatccccggatacggaagcgggttcagttctgggggtatggactatggtatggtcgggggaaaggaagcaggaactgagagtcggtttaagcagtggacaagtatgatggagggtctgccctctgtcgccacccaggaggctaacatgcataaaaatggggcaattgtcgccccaggtaagacaagggggggatctccttacaaccaattcgatattattccgggtgacacgctggggggacatacaggacccgctggggactcatggttaccagccaaatccccacccaccaataagattggatcaaagtccagtaatgcttcgtggccgcctgaattccaacctggcgtgccatggaaagggatccagaacattgaccctgaatccgatccatacgtgactccaggctctgtgctggggggaaccgccacaagccctatcgtggacactgaccatcagcttctgcgtgataatactacaggtagcaatagctcactcaatacaagcttgccatcgccaggcgcttggccttactcagcctccgacaacagttttactaacgtccactctacctcggccaaattcccggactataagagtacctggtcccctgaccccatcgggcacaatcctactcatctgtcaaataaaatgtggaaaaaccacatttcgtcccgcaacactactcctttgccccgtccgccaccgggactgacaaacccaaagcccagctcaccttggtcatctaccgctcctagatcagtgcgaggatgggggacccaggacagccgcctggcaagtgcctccacttggtccgacggaggttcagttagaccctcttattggctagtgttgcacaatttgaccccacaaatcgacggttccacgttgagaaccatttgtatgcagcatggtccactgcttacatttcatctgaacctgacccagggcacagcgttgatccgctatagtaccaaacaggaggctgcaaaggcccagaccgcactgcatatgtgtgtattaggcaatacaaccatcctggccgagttcgctaccgacgatgaggtatctagatttttggctcaagcccaaccccctaccccagcagccacaccctctgcacctgcagccggttggcaaagcctcgagactggccaaaatcagtccgatcccgtcggcccagcccttaatcttttcgggggatcaactggcctgggacagtggagctccagtgccggtggatccagcggtgcggatttggccggtgcgtccttgtggggtcccccaaattactcctcttccctgtggggcgtccccacagttgaggacccccaccgcatgggttcacctgcccctcttttaccaggtgacctgctggggggaggcagcgactcaatcta

SEQ ID NO: 31284 - DNA, 5171 bp, Artificial Sequence
  Description of Artificial Sequence: Synthetic coding sequence
atgcgtgagaaggaacaagaacgcgaagagcaactgatggaagataaaaagagaaaaaaagaagacaaaaaaaagaaagaggcgacacaaaagcatagtaaccagaaaaccgccatgcccgaggttaccaagccctctctgtctcaaccaaccgccgcaagtccaattggaagctcaccgtccccgcctgttaacgggggtaacaacgcaaagcgagtggcagtgcccaacgggcagcccccatccgccgcacgctacatgcctagggaagtgccccctcggtttaggtgtcagcaggatcacaaggtgctcctgaagcgcggtcagcctcctcccccatcatgcatgctgttgggcggaggcgctggtcctcctccctgcacggcacctggtgcaaaccccaataacgcgcaggtcaccggggctctgcttcagtcggaaagtgggaccgctcccgacagtacgctaggtggcgctgcggcttcaaattacgccaactctacctgggggagtggagcaagctcaaacaatggcaccagccccaaccctatccacatttgggacaaggtcatcgtcgacggttccgacatggaggagtggccatgcatcgcaagtaaggatactgagtccagttccgaaaacacgactgataacaatagcgcctccaatcccggttctgaaaagagcaccttacccggaagcactacctcaaataaaggtaagggctctcaatgccagtcagcctctagcgggaatgaatgtaatcttggtgtgtggaagagcgacccaaaggccaaaagtgtccagagctccaactctactacagaaaacaataacggtctgggtaattggcggaacgtctctggccaagatagaattggccctggctccggattttctaactttaaccccaactctaacccatctgcttggcctgcactcgtacaagaagggacctctcgaaaaggagcattggaaaccgataactcaaattctagtgcccaagtgtctacagttggccaaacttccagggaacagcaatcaaagatggagaatgctggagtgaacttcgttgtgtctggccgtgagcaagctcagatacataacacggacggccctaaaaacggcaataccaatagtctgaacctgagcagccccaaccccatggagaataaaggaatgcccttcgggatgggcctcggtaacacaagcaggtcgacagacgccccttctcagagcaccggtgatcggaagactggaagtgtcggcagctggggggcagcccgagggcctagcggtactgataccgtaagcggccagtccaactccggcaacaatggaaataacggaaaggagagggaggatagctggaagggcgcatccgtgcagaaaagtaccggctctaaaaacgatagttgggacaacaacaacaggagtacagggggttcctggaattttggaccacaagactcaaacgataataagtggggcgagggtaacaagatgacctctggcgtgagccagggcgagtggaagcagcctacaggatccgacgagttgaaaatcggggagtggtcaggacccaaccaacccaatagctccactggtgcctgggataatcagaagggtcacccactgcccgaaaatcagggaaatgctcaagccccttgttgggggcgatcatcctcctctacgggcagcgaggtggggggtcagtcaaccggatccaaccataaggcaggcagcagcgacagtcataattctggacggagatcatacagaccaacacaccctgactgtcaagccgtgctgcagactttgctgtccagaactgacttagacccacgcgtgctgagcaacaccggatggggccaaacccagatcaagcaggataccgtgtgggacattgaggaagttcccaggccagagggcaagagtgacaaagggactgagggctgggagtctgccgctacgcaaacaaaaaattctggcggttggggtgacgccccttcacaatctaaccagatgaaaagtggatggggagagctctcagccagtacagaatggaaggacccaaagaacactggcggttggaatgactacaagaataacaacagttccaactggggaggaggcagacctgatgaaaaaaccccctcctcatggaatgagaatccgtctaaggatcagggctggggaggcggaagacagccaaaccaaggctggagcagcgggaagaacggctggggagaagaagtggaccagacgaagaacagcaattgggagtcttctgcatccaagccagtctccgggtggggcgagggtggccagaatgagatcgggacatggggcaacggcggaaacgctagcctggcctccaagggtggttgggaagactgcaagcggtctcctgcctggaacgaaacaggacgccagccaaattcttggaacaagcaacaccagcagcagcagccacctcagcagccgcctccccctcaacctgaggcctccggctcatggggaggcccaccaccccctccccctggcaatgttaggccatcaaactcctcctggtcgtccgggcctcagccggcaacgccgaaagacgaggagccttcagggtgggaggagcccagcccccagagtatatccaggaagatggacatagatgatgggacgagcgcctggggggatcctaattcatataactataagaatgtgaacttgtgggataagaattctcaaggtgggccagcccctagagagcctaaccttccaacccctatgacatccaagtccgcatccgatagtaagagcatgcaggatggctggggggaatcagatggtcccgtaacaggcgctaggcatccttcttgggaggaagaagaggacggaggagtgtggaatacaaccggcagtcagggttccgctagctctcataattctgcttcgtggggtcaaggaggtaaaaaacagatgaagtgttctctgaaagggggaaacaacgatagctggatgaatccactcgccaaacagttctctaatatgggactcctttctcaaacagaggacaacccctcctcgaagatggacctgtcggtggggtccttatctgacaaaaaattcgacgtggacaaacgggcaatgaacctgggcgatttcaatgatattatgcggaaggaccggtccggcttccgcccaccaaacagtaaggatatgggaaccacggattcaggcccttactttgaaaaaggtgggtcacacgggctctttggcaactcaacagctcagtccaggggactacatactccggtacaacccctgaacagtagcccatccctccgggcacaggttccaccccagtttatttcaccacaggtttcagcctccatgctgaagcagttcccgaacagcggtctctctcctggcctgtttaatgtggggccacaactgtccccccaacagattgccatgctgagtcaattgccccagatcccccagtttcaattggcttgtcagctcctgctgcagcagcagcagcagcagcaattactgcagaatcagaggaaaatatcgcaggctgtgcgccaacagcaagagcagcagctggcccgaatggtgtcggctctgcagcagcagcagcagcagcagcagaggcaacccggaatgaagcacagtccttcacatcccgtgggtccaaagcctcacttggataacatggttccgaacgccctaaatgtgggtctgcctgacttacagacgaagggccctatcccaggttatgggtctggtttttctagcggaggtatggattatggcatggtcggcggtaaggaggctgggactgaaagcaggttcaagcagtggacatcaatgatggagggacttcccagcgtggcaacccaagaagcaaacatgcacaagaacggagcaattgtggctcctggtaaaaccaggggcggaagcccctacaaccagtttgatatcattcctggcgacacattgggtggccataccgggccagccggagactcttggctccctgctaagtcgcctcctacaaataagataggatctaagagtagcaatgcttcttggccacccgaattccagcccggagttccctggaagggcatccagaacattgatccggagtcggatccctacgtgacgcccggaagcgtgctcgggggaacagctacgagccccattgtcgacactgatcaccagctgttgcgcgacaacactacagggtccaactccagtctgaacacgagcctcccaagtcctggggcttggccttattcagcctccgacaacagctttacaaatgtacactccactagcgcaaagttccctgactataaatcgacgtggagtccagacccgattggacataaccccacgcacctctcaaacaagatgtggaagaaccacattagctctagaaatactaccccactgcccaggccaccgccaggattgacaaatccaaaaccttcttctccatggtcctccaccgcacccagatcagtgcgagggtggggtacacaggactcccggttggcttctgcgagcacgtggagcgatggcggaagcgttcgtcccagttattggctggttctccataatctcacgccccaaatcgacgggtcaaccctaagaacaatttgcatgcaacatgggcctttgttgacgttccacctgaatctgacacaggggacggcgttgattaggtattccacaaagcaggaggcagccaaggcccagacggctctccacatgtgcgtgctaggaaacacaacaatacttgccgaatttgctaccgacgacgaggtgtcacggtttttggctcaggcccaaccaccaactcctgccgcaacgcccagcgcccctgccgctggttggcagtctctggagacaggacagaaccaatcggatccagttggtccggcactgaatctctttggcggatccacaggacttggccaatggtcttcttcagcaggcggatcttcaggcgctgacctcgccggagcttccctgtggggtcctcctaactatagttcctcgctttggggcgtgccaacagttgaggaccctcaccgcatgggatcacccgctccattactccccggtgacctgttgggcggtggcagtgactctatcta

SEQ ID NO: 31285 - DNA, 3090 bp, Artificial Sequence
  Description of Artificial Sequence: Synthetic coding sequence
atgcaaaccaatgagggagaagtgtccgaggagagcagtagcaaggtggaacaggaggacttcgtgatggagggacacgggaagactcccccaccaggggaagagtctaagcaggagaaggagcaggagagagaagaacaactgatggaggacaaaaagcgaaaaaaagaggacaaaaagaaaaaggaggccacccagaaagtgaccgaacagaagaccaaagtgcctgaggtgaccaaaccgagcctgtctcagccaactgccgcttcacctattgggtccagcccctcaccaccagtgaacggtgggaacaacgcaaaacgcgtagccgtgccaaacgggcaaccaccctcagccgcacgctatatgcctcgggaggtcccgccaagattccggtgccagcaggaccacaaggttctgttgaaaaggggccaacctcctccaccctcttgcatgttgctcggtggaggtgcaggcccaccaccctgtaccgcccctggggctaacccaaacaacgcacaggtaaccggcgcattactgcagtctgagtccggtactgctcccgtctggtctaagtctacacctccagcgccagacaatgggacttccgcttggggagaacctaatgagagctcccctggttggggcgaaatggatgacaccggcgctagtaccactggttggggaaatactccagccaatgcccctaatgcaatgaagcccaattctaaatccatgcaggacggttggggcgagagcgacggccctgttaccggggctaggcacccctcttgggaggaggaggaggacggcggtgtttggaataccacaggatcacaggggtctgccagctctcataacagcgcatcttggggacagggagggaaaaaacagatgaaatgttcactaaagggagggaacaatgatagttggatgaaccccctcgctaagcagtttagcaatatgggtttactgtctcaaacagaggataatccttcttccaagatggatctgagtgtaggatcgctctccgacaagaagttcgatgtggacaaacgggctatgaacctgggggactttaatgatattatgagaaaggatagaagcggctttaggccaccaaactcaaaggacatggggaccacagactcagggccttactttgagaaaggcggatcacatggtttgttcggaaactccacagcacagagtcgtggactgcatacccctgtacaacccttaaactctagcccaagcctcagagctcaggtgccccctcaatttatctcgccacaggtatcagcttcaatgctgaaacagtttcccaattctgggctgtcacccggtctattcaacgtgggccctcagttgtctccgcagcagatcgctatgctttcacagttgccccagattcctcagttccagttggcatgccagctattgttgcaacagcagcagcagcagcagctgctccagaatcagaggaaaatctcgcaggctgtgcgccaacagcaggaacagcagctggccaggatggtgtccgccctgcagcagcagcaacaacagcagcagagacagcccggaatgaagcatagccctagccacccagttggccctaaaccccatctagacaatatggttcctaatgcattaaatgttgggcttcctgatctgcaaaccaaaggtcctattccaggttacggcagcgggtttagcagcggtggcatggattacggcatggtgggtggcaaggaggccggtaccgaatcaaggttcaagcagtggacatcaatgatggaagggcttccatctgtggcaacgcaggaggcgaatatgcataagaacggggctatcgtagctcccggaaagactagaggcggttcaccctacaaccagttcgatattatccccggagatactcttgggggtcacacaggcccagccggagactcttggctgcccgctaagtcccctccaactaataagattggcagcaaaagctctaacgcctcttggcccccagagtttcaacccggagtgccatggaaaggaatccaaaacatcgatccagagtctgacccatatgttacccctggcagcgtcctgggcggtactgcaaccagccccatcgtggatacagaccatcagctgttgcgggacaataccaccggttccaattcttcgttgaataccagcctccctagccccggagcttggccttactccgccagcgataattcgttcactaacgtgcacagcacttcagccaagttccctgattacaaatctacttggagccccgacccaattgggcataaccccacacatctgagcaacaagatgtggaaaaatcatattagctcaagaaataccaccccactacctaggccgcctcctggcctgactaaccccaaaccttccagtccatggtcttccaccgcaccaaggtcagtgagaggttggggcactcaagacagtaggctggcctccgctagtacctggagcgacgggggtagcgtgagaccctcatactggttggtgctgcataatctcacacctcaaatcgatgggagtaccctgcgaacaatctgtatgcaacacggtcccctgctcactttccacctgaatctcacccagggaaccgcgttgatccggtattccacaaagcaggaggccgcaaaagcacagacggctctgcacatgtgcgtgctcggcaacacgactatccttgctgagtttgccaccgatgacgaagtgtcccggttcctcgcacaggcccaacctccaacccctgcagccacgccaagtgcccctgctgccggttggcagagtctcgagacaggccagaatcagtcagatccagtaggtccagcactgaatttattcgggggatcgactggcttgggtcagtggtccagttcagccggaggctcctccggagctgatctggccggtgctagtctttgggggccacctaattacagtagcagtctctggggcgtgcccactgtcgaggatccccaccgtatgggctccccagctcctttactgcccggagacctcctcggaggcggttctgactctatctag

SEQ ID NO: 31286 - DNA, 114 bp, Artificial Sequence
  Description of Artificial Sequence: Synthetic coding sequence
atgcagaccaatgagggggaggtgtcagaggaatcttcctctaaagtggaacaggaagactttgtaatggaaggccacggcaagacacccccaccaggagaggagtccaaatag

SEQ ID NO: 31287 - DNA, 5501 bp, Artificial Sequence
  Description of Artificial Sequence: Synthetic coding sequence
atgagggaaaaagagcaggagcgtgaggagcagctcatggaagataaaaagcgaaaaaaggaagataagaaaaagaaggaggctacccagaaggtgacagagcagaagaccaaggtacccgaggtgaccaagccgagtctttctcagccaacagccgcatctccgattggaagcagcccatctcctcccgtgaatggcggaaataatgcaaaacgagtagcagttccaaatggacagcctcccagcgcagcacgttacatgccacgtgaggttcctcctcgattccggtgccagcaagatcataaggtcctgctgaagcgcggacaaccacccccaccatcctgcatgctattgggtggaggtgcaggacccccaccgtgcacagctcccggagctaacccaaacaacgctcaggtgaccggcgcattactccaatccgaatcaggaacggcacctgattccacactgggtggtgccgcagcttccaattatgcaaactcgacatggggaagcggcgcttcttcaaataatggcaccagcccaaacccgattcatatctgggacaaggtgatagtggatggctctgatatggaggaatggccttgtattgcctccaaagatactgagtcctcctccgaaaataccacggacaacaatagtgcaagtaatccaggctccgagaaaagcaccctgccaggctcaactaccagcaataaaggaaagggctctcagtgccagtccgcctcttccggtaacgagtgtaacttgggtgtctggaaaagcgaccccaaagccaaaagcgtgcagagttcgaactcgactaccgagaataacaatggcttggggaattggcgcaacgttagtggccaggatagaatagggccagggagcggctttagcaattttaaccctaactccaacccttccgcctggcctgcactcgtacaggaaggaacaagtagaaaaggagctctcgaaaccgataacagtaactcttccgctcaggtgtcaaccgtcggccagacctcacgggagcagcaatccaaaatggagaatgccggagttaatttcgtcgtgagcggcagggaacaggcgcagattcacaacaccgacggcccaaaaaacgggaacactaattccctcaatctgtcgtctcctaaccccatggaaaacaagggtatgccatttggcatgggtctgggcaatacatctcggtctaccgacgccccttcccagtccactggtgaccgcaagactgggtccgtgggctcttggggagctgcccgtggcccttccggtaccgataccgtcagtggccagtcaaattcaggcaacaatggaaacaacggaaaggagcgtgaggattcctggaagggggctagcgtccagaaaagtaccggatctaaaaatgattcctgggataataacaataggagtaccggtggatcatggaactttgggccacaggactctaacgacaataagtggggggaagggaacaaaatgacgagtggcgtatcccagggcgagtggaagcagcccacgggttcagacgagctgaaaattggtgagtggagcggaccaaaccagcctaactcatctacgggagcttgggacaaccagaagggtcaccctcttcccgagaatcaggggaatgcgcaggccccttgctggggccgttcttcttcatccactgggtcagaagttgggggtcaatccaccggaagcaatcacaaggcgggaagcagcgatagtcacaactcaggccgtcggagctacagaccaactcatcctgactgccaggctgttctgcagaccctgctctcccggactgacctggatcctcgagtgctctccaacaccggttggggccagacccagattaaacaggacaccgtatgggacatcgaggaagtgccgaggcctgagggaaaatcggataagggcacagagggttgggagtctgccgcaacccagaccaagaacagtgggggatggggtgacgcgccttctcagtctaaccagatgaagtcaggttggggagagttaagtgccagcacagagtggaaggatcccaagaacacaggtggttggaacgattataagaataataattctagtaattggggtgggggacgccctgatgaaaagactccaagttcctggaacgagaatcctagcaaggatcaaggctggggcggaggacggcaaccaaaccaggggtggagctcaggcaagaacgggtggggcgaggaggtggatcaaacaaaaaactcaaattgggaaagtagcgcaagcaagcccgtaagtgggtggggagaaggaggccagaacgaaatcggtacctggggaaatggaggaaacgcttccctggcttcgaagggaggttgggaggactgcaaaaggagccccgcatggaacgaaacaggtaggcagcccaattcgtggaacaaacagcaccaacagcaacagccaccgcaacagcctccaccccctcagcccgaagccagcgggtcatggggaggtccgcctccgccacctcccggaaacgtgcggccatcaaattcctcatggtcctccggcccacagccagccacaccgaaggacgaagagccatcgggttgggaggaaccctcacctcagagcatctcgcggaagatggatattgacgacggcaccagcgcatggggcgatccaaatagctacaattacaaaaatgttaatctgtgggacaaaaatagccaaggtggccctgctcctagagagccgaacctgccaacaccaatgacctcaaagtccgcttccgtctggagtaagtccaccccacccgcaccagacaacggtacctccgcatggggcgagccgaacgagtcttcccctggttggggcgagatggatgacacaggcgcttccaccactggatggggcaacacccctgcaaacgcgcctaacgcaatgaagccaaatagcaagtcaatgcaggacggatggggcgagtccgacggccctgtgacaggagcaagacacccctcttgggaggaagaagaagacggcggagtatggaatacgactgggtcccagggctccgcatctagccacaactctgcgagctgggggcagggcggtaagaagcagatgaagtgcagcttgaagggtggtaataatgactcatggatgaacccactggcaaagcaattcagtaacatgggacttctgtcacagacggaagacaatccatcctcgaaaatggacctgagcgtgggttccctctccgataagaaatttgatgtcgacaagcgggcaatgaatctcggggacttcaacgacattatgaggaaggataggagcggatttaggcctccaaactctaaggacatgggaactaccgattcaggaccatatttcgaaaaactgaccctgcccttctccaatcaggacggatgcctcggtgacgaggctccctgttccccattttcacccagcccctcctacaagttgtcaccctccgggtccactcttccaaatgtgagcctgggcgcaatcggaaccggattaaacccccaaaatttcgctgctcggcagggaggcagccatgggctgttcggcaattccactgcccagagtcgaggcttgcataccccggttcagcccctgaacagcagtccaagtctccgggcacaggtgcctccgcagttcattagcccccaggtctcggcatctatgctcaaacagttccccaattcaggactcagcccaggcttgttcaacgtcggaccacaactctcacctcagcagatagcaatgcttagccagttaccacaaatcccgcagttccaactggcctgccaacttctcctgcaacagcagcagcaacagcaattactacagaaccaaagaaaaatttcacaggcagtacgccagcaacaagagcagcaacttgccaggatggtgtccgcattgcaacagcagcaacagcaacagcagcggcagcctggaatgaagcactcacccagtcatccagtgggcccaaagcctcatctggacaacatggtgccgaacgctctaaatgtgggtctgcccgacctgcagacgaaaggcccaattcctggatatgggtccggcttcagtagcggcggtatggattacggcatggtgggcggaaaggaggctggtaccgaatctcgctttaaacagtggacatcaatgatggaggggctcccaagcgtagcaacccaggaggcgaatatgcacaagaatggcgctatagtcgcgccaggcaagacccgcggaggcagcccttacaaccagtttgacatcatacccggtgacaccttggggggtcacacaggacctgcgggagacagctggttacctgcaaaatctcctccgacaaacaaaatcggttcaaagtctagcaatgcatcttggccccctgagttccagcccggagtaccctggaagggcattcaaaacatagatccagagagcgacccctatgttaccccaggatccgtactggggggaaccgcaactagcccgatcgtcgacacagatcaccagctgctcagagataatacgaccggcagcaatagttccttgaatacttctctcccatcacctggcgcatggccttatagcgcttcggataactcttttacaaatgttcactctactagtgccaaattcccagattacaagtccacttggagccccgatccaatcggacacaaccctacccacttgtctaacaagatgtggaagaaccacatctctagtcggaacacgacccctctgcctcgcccacctcccggattgacaaatccaaagccgagttcaccgtggtctagcactgcccctaggagtgtgcgaggctgggggacccaggacagccgcctcgccagtgccagtacatggagtgatggtggttctgttcgccctagctattggctggtgttgcacaacctgaccccccagattgatggcagcaccctgcggacaatatgcatgcagcacgggcctctcctgaccttccatctgaacctcacacaaggcactgccctgatccggtacagtacaaagcaagaagcagccaaagcacaaaccgcccttcatatgtgcgtcctaggtaacacaactatcctcgcagagtttgctacagacgatgaggtatctcgatttctcgcccaggctcagcccccaacccccgcagccaccccatcggccccagctgcaggttggcagtcacttgagaccggccagaaccagtctgaccccgtcgggccagccctcaatctatttgggggatcaaccggactcgggcagtggtctagcagcgcaggaggcagctctggggcagatctggccggagcctcgctctgggggcctcccaactactcaagctctctctggggggtgccaacagtggaagatccacatagaatggggagtcctgcaccactcctgccaggggatctcctgggagggggtagtgattccatcta

SEQ ID NO: 31288 - DNA, 3153 bp, Artificial Sequence
  Description of Artificial Sequence: Synthetic coding sequence
atggaggtggctgtggagaaggcggtggccgcagccgctgctgcttccgccgctgctagcgggggtccaagcgccgctccaagtggagagaacgaagcggaatcccggcaaggtcctgacagcgaaagaggcggagaagccgctcggctaaatctcctggatacttgtgcagtttgtcaccagaacattcagtcccgagccccaaagctgctcccttgcctgcattccttttgccagcggtgcctgcccgctccccagaggtaccttatgctaccggctcctatgctaggaagtgctgagactcctccgccagtgccggctccgggttcgcctgtgagcggttccagcccgttcgcaacacaagttggtgtgatccgctgtcccgtttgcagccaggaatgcgcggaaagacacatcattgataacttcttcgtgaaggacacgacggaggtgccttcaagcaccgtggaaaagtcgaaccaagtctgtacctcctgtgaggacaatgctgaggcgaacggcttttgcgtggaatgtgtggagtggctctgcaaaacctgcatacgggctcatcaacgggtgaaattcacaaaggatcatactgtgaggcaaaaggaagaggtttctcccgaggcagtgggcgtgacaagccaacggcctgtcttttgcccatttcataaaaaagaacaactgaagctctactgcgagacatgtgataaactgacctgccgggattgccagcttttagaacataaagaacataggtaccagttcattgaggaagcctttcagaaccagaaggtgattatcgacaccctcatcacaaaactgatggagaagacaaaatatatcaaattcactggtaaccagatccagaatcgcattatagaggtgaatcagaaccagaagcaagtggagcaagatattaaagtcgcaatattcactttgatggtcgagataaataagaaaggtaaggccctcttacatcagctggaatccctcgccaaggaccaccgcatgaagctgatgcagcaacaacaggaggttgccggactttctaagcagctcgagcacgtgatgcatttctctaagtgggctgtaagctcaggtagttccaccgcccttctctactcaaaacgcctgattacctataggctgcgacacctgctacgtgcccgttgcgacgcgtctccagtgacaaataatacaatacagtttcactgtgacccatccttctgggctcaaaatatcattaacctgggcagcctggtgattgaagacaaagaaagccagccacagatgccaaaacagaatccggtcgtagaacagaattctcagcctccttccggcctgtcaagcaaccagctgtcaaagtttcccacccaaatcagcctcgcccaattgaggttgcagcacatgcaacagcaagtcatggctcagaggcagcaggtgcagcgtcggcctgccccagtgggattgccaaaccccagaatgcagggacccatccagcagccatccataagccaccagcagcctccacctaggttaattaattttcagaaccattctcctaagcccaacggcccagttctcccaccccaccctcagcaacttcggtatcctcccaaccagaacatcccaagacaagcaatcaagcctaaccctctgcagatggctttccttgcccagcaggctattaagcaatggcaaatcagttctggccagggaacaccgagtacaactaactctacatctagcacaccttcgagtcctaccattacaagcgcagccggttatgacggcaaggccttcggttctcccatgattgacctgagctccccagtaggaggttcgtataatctgccatctttgccagacatcgattgctcgagcaccattatgctcgataacatagtcagaaaagatacaaatattgatcacgggcagcctaggcccccttcaaacagaacggtgcagtctccaaattccagcgtccctagcccaggcttggcaggacctgttaccatgacatccgttcacccaccaatcagaagtccctccgcatctagcgtgggttcaaggggttcaagcggctccagctcaaaacccgctggtgcagacagcactcacaaggtgccagtcgtgatgcttgagcccataaggatcaaacaagaaaactctggccctccggaaaattatgatttcccagtcgtgatcgtgaagcaggagagcgacgaggagtcccgccctcaaaacgcgaattatcctcggagcattttgaccagcctgctgctcaatagttcccagtcttccactagcgaagagacagtcttgagaagcgacgctcctgacagcacgggggaccagcctggtcttcaccaagacaactcatctaacggcaagtccgagtggctagaccctagccaaaagagccctctccacgtgggggaaacccggaaagaggatgatccaaacgaagattggtgcgcagtctgtcagaacgggggagagctcctgtgctgtgagaaatgccctaaggtcttccacctgagctgccatgtacctacgctcacgaactttccgagcggagagtggatatgcaccttctgcagggacctgtccaaacccgaagtcgaatacgactgcgatgccccttcacataattctgagaagaagaagacagagggcctggtgaaacttactcccatcgataagcgcaaatgcgagcggttgcttctcttcctgtattgtcacgagatgagcctcgccttccaggatcccgttccacttaccgtgccggactattataagataatcaaaaaccccatggacctgtccactatcaaaaagagactgcaggaggactatagtatgtactccaagccagaagatttcgtggcggatttccgattgatctttcagaattgtgccgagttcaatgagccagattccgaggtcgccaacgcaggaataaagttagagaactatttcgaagagctcctgaagaacctttatccagagaagagatttcctaagcctgagtttcgaaatgaatcggaagacaacaagttcagcgacgatagcgacgacgatttcgtacagcccaggaagaaaagactgaaatccatcgaagagcgacaactgctcaagtag

SEQ ID NO: 31289 - DNA, 1650 bp, Artificial Sequence
  Description of Artificial Sequence: Synthetic coding sequence
atggaaggccctcgcagcgctgcttgcagagcaagacctgctacaagtccgggagcggtggatctgacggctccccctcctcctcccctcctgcgcatactgaacagccgtgccgctcccgcaaccagaaccttcgcagacctctgtcgctcccttctgcaacccgaatcgagagttctgtgtcgactgcagcccgtaaattgctaccctcccgctgcgtcgacaaaactgtgccccgttggcgtgattagatgtcccgtgtgtagtcaggagtgcgcagaaaggcacataatcgataacttctttgtaaaagacaccacagaagtgccctcgtctacagtggaaaaatctaaccaggtctgcacatcctgtgaggacaatgcggaagctaacggtttctgtgtggagtgtgtagagtggttgtgcaagacatgtattagagctcaccaacgggtgaaattcacgaaggatcatactgtccgccagaaagaagaagtttcacctgaagcagtcggtgtgacttcacaaaggcccgtattttgtccatttcacaagaaggagcagcttaagctgtattgcgaaacatgtgacaagctgacctgccgggattgtcagctacttgagcacaaggagcataggtatcaattcatcgaggaggcctttcagaaccaaaaggtcatcattgacaccctgatcactaagctgatggagaaaaccaaatacatcaagtttacaggcaatcagatacagaatcggatcatcgaggtgaatcagaaccaaaagcaggtggaacaggatatcaaggtcgcgatattcactctgatggtcgagattaacaaaaagggtaaggccctactgcaccagctcgaatctctagcgaaagaccacagaatgaaactcatgcagcagcaacaggaggttgccggactgtcgaagcagctagaacatgtgatgcattttagcaaatgggctgtatcgtcaggatcctccaccgctttactgtatagtaagcgtttaataacatatcgcttacggcatcttctgcgcgcacgctgtgacgcgagtcctgtcaccaataacaccattcagtttcactgcgatcccagcttttgggcccaaaatatcatcaaccttggcagtttggtcatcgaggataaggaaagccagccacaaatgcctaagcaaaatcctgtggtggagcaaaattctcaacctccctccgggctgtcttctaatcagttatctaaattccccacacagatcagtctggcccagttgcgcctgcagcacatgcagcaacaacaaccccctcccaggcttattaatttccagaatcacagccccaaacctaatgggccagtcctgcctccacatcctcagcagttgagatatccccctaaccagaacatacctcgacaggcgattaagccaaacccactgcagatggccttcctggcacagcaagcaataaaacagtggcagattagttctggacagggcactccctcgacgactcagaatatcaacacagccgcatgcaccgtgttcgacgtccgcgtactgcatcacataccatactgggcactcaacatttctagcagtgagcgcgactcatttctgtggttttcaagtgtatacaaccttgaatag

SEQ ID NO: 31290 - DNA, 3051 bp, Artificial Sequence
  Description of Artificial Sequence: Synthetic coding sequence
atggaggtagcagtagagaaggcggtagccgctgccgcagctgcctctgccgcagccagcggcggaccttcagccgctcccagtggcgagaatgaagcggagagccgccaaggccctgactccgagcgcggaggtgaagccgctcgactcaacctactggatacatgtgctgtgtgccaccagaatattcagtcccgcgctcccaaactgctgccttgtctccactccttctgccagagatgtctgccagcccctcagcgctatctcatgctaccagccccaatgctggggtccgcagaaaccccaccacccgtgcctgcacctgggtcacctgtctccggatcatcaccctttgccacgcaggtgggagtcattcgctgccctgtttgctcacaggagtgtgccgagcggcatatcatcgacaacttcttcgtgaaggacaccacggaggtaccaagttctaccgtggaaaaatctaatcaggtgtgcacgtcttgtgaggacaacgcagaagccaatgggttctgcgtagagtgtgtggaatggctttgtaaaacatgcatcagggcgcaccagagagttaaattcaccaaagaccatactgtgcgacagaaggaggaggtctctcctgaggcagttggggtgacctcccagaggccagtcttttgtcccttccacaagaaagagcagttgaagctgtactgtgaaacctgtgacaaactgacctgccgtgattgtcagcttttggagcacaaggagcatagataccagtttatcgaagaggcctttcagaaccagaaggtgataattgacacactgataacaaaattaatggaaaagaccaagtacatcaagttcacggggaatcagattcagaaccggatcattgaagtcaaccagaatcaaaagcaggtggagcaggacattaaagtggcaatcttcacgctgatggtggagataaataagaagggcaaagcactgctgcatcagcttgaaagtttagcaaaagaccatagaatgaaactgatgcagcagcagcaggaggttgccggactaagcaagcagcttgagcatgttatgcactttagcaaatgggccgtttcctcgggctcatccaccgcgctgttgtattccaagcggctgattacctaccgccttaggcaccttctgagggctaggtgcgatgcctctccagtgaccaataacacgattcagtttcactgcgacccttcattttgggcccagaacatcatcaacctaggttcccttgtgattgaagataaggaaagtcagcctcagatgcccaagcagaatccagtcgtagagcagaattctcaacccccatccggattgtcatctaatcaactgtcaaagtttccaacacagatcagcctggctcagctgcgactgcagcacatgcaacagcagcagcctcctcctcgcctgattaacttccagaaccattcacccaagccaaacggccctgtgctccccccacacccgcagcagctgcgctacccaccaaaccagaacatccctaggcaggccattaaaccaaatcctttacaaatggcctttcttgcccagcaagctatcaaacagtggcagatctcatccggtcagggtactccatcaaccacaaacagtactagttctacaccatcgagccccaccattacctcagccgcaggctatgatggtaaagcatttggctctccaatgatcgacctttccagcccggtcggcggatcttacaatctgcccagtcttccagatattgactgcagctcaaccatcatgttggataacattgtgcgcaaggatacaaatatcgaccacggacagccccgtcccccatcgaaccggacagtccagtcaccaaactcctcggttccctcccctggtttggccggacccgtgacaatgaccagcgtgcacccacctatcagatctcctagtgcatcgagcgtcggatcaaggggaagtagtgggtcttctagcaagcccgctggtgcagacagcacgcacaaggtccccgtcgtgatgcttgaaccgataagaatcaagcaggaaaacagtggccctcctgaaaattatgatttccctgtggtgattgtgaagcaggagagtgacgaagagtcccggcctcagaacgcgaattatcccagaagcatcctcacttctctgcttctcaatagctcccagagcagcacaagcgaagagaccgtgctgcggtccgacgcacctgatagcaccggagatcaacccggactgcatcaagacaatagttcgaatggcaaaagcgagtggctggatccctcccagaagtctccactccacgtgggtgagactaggaaagaggatgaccccaatgaggactggtgtgcggtttgccaaaacgggggtgaactcctgtgctgcgaaaagtgtccaaaggtgttccacctatcttgtcacgtcccaacattgacaaatttcccctctggagagtggatctgtaccttttgtagggacctttcgaagcctgaggtggagtatgattgcgacgcccctagtcacaacagcgagaagaagaagaccgaagggcttgtcaagctgacacccatagacaaacgcaagtgcgaacgccttcttctgtttctttattgtcatgagatgagcctcgcattccaggaccccgtcccactgaccgtccctgattactataaaatcatcaaaaacccaatggacttatctacgattaaaaaacggttgcaggaggactattccatgtactccaagcccgaagacttcgtcgcagacttccggctaatcttccagaattgcgccgagttcaatgaaccagactctgaagtagctaatgctggcataaagctcgaaaactatttcgaggaactgctgaaaaacctttatcctgagaaaagattcccgaagccagaattccgtaacgagagtgaagataataagttcagcgacgatagcgatgacgacttcgttcagcctcggaaaaaaaggttgaagagcatcgaagagaggcagttattgaagtag

SEQ ID NO: 31291 - DNA, 2886 bp, Artificial Sequence
  Description of Artificial Sequence: Synthetic coding sequence
atgctacccgcaccaatgctgggcagtgctgaaaccccaccaccagtacccgctcccggttcccccgtctctggaagtagtcctttcgctactcaggtcggcgttatccgctgtccagtgtgttcccaggagtgcgcagagcggcatatcatcgataatttttttgtgaaagatacaactgaagtgcccagctcaacagtggaaaaaagcaaccaggtctgcacatcctgcgaggataatgccgaagctaatggtttctgtgtggagtgcgtcgaatggctttgtaaaacctgcatcagagctcatcagcgggtcaaatttacaaaggaccacaccgtcaggcaaaaggaggaggtaagccccgaagctgtaggagtgacctcgcagcggccagtgttctgcccgttccacaaaaaagaacaactcaagctctactgcgagacatgcgataagttgacatgccgcgattgtcagttgctggagcacaaggagcatagatatcagttcatagaggaggccttccagaaccagaaggttataatagacaccctgattaccaagctgatggagaagacgaaatatatcaagttcacaggcaatcagatccagaatcgcataattgaggttaatcagaaccaaaaacaggtggaacaggacattaaggttgccatattcactcttatggttgagattaacaaaaaaggcaaggctctgttgcatcagctggagtctctagcgaaagaccatagaatgaagctgatgcagcagcaacaggaagtggctgggctctcgaagcaactcgagcacgtgatgcacttttccaaatgggctgtgagctcaggctcctccacagccttgctgtatagcaagcgcttaataacctatcgcttacggcacctgctgagggcaaggtgtgacgcctcacctgtgactaataacacaattcagttccattgcgatcccagtttttgggcacagaacatcatcaatctcggaagcctggtcatagaggataaagaatctcagccccagatgccaaaacaaaatccagtggtggagcagaattcgcagcctccctcagggctatcatccaatcagttgtcaaagtttcccacccagatttctcttgcccaattaaggctgcaacacatgcagcaacaggtaatggcccaacgccaacaggtgcagcggaggcccgctccagtaggactgcccaaccccaggatgcaaggcccaattcagcagccatcaattagtcaccagcaaccccctccacgcctgatcaacttccagaaccatagcccaaaaccgaacggacctgttcttccaccccacccccaacaactacgctaccctcccaatcagaatatccccagacaggcaattaagcctaaccccctgcaaatggcgttcttggcacaacaggctattaagcagtggcagataagcagtgggcaggggactccaagcacaaccaactcaacttcttccacaccgagctctcctacaattacaagcgcagccggttatgatggcaaagcgtttgggtccccaatgatcgatctgtccagtcccgtagggggaagctataacctccccagcttaccggacatcgattgtagtagcaccatcatgctggacaatatcgttcgtaaggataccaatatcgatcatggccaacctagaccccctagcaacaggacggttcagtccccaaatagcagtgtgccatcccccggactcgcaggcccagtgactatgacgtcggtccacccccctatcaggtccccaagcgcctcatccgtcggcagcagagggtcctcaggctcaagttcgaagccggctggtgccgactccactcataaagttcccgtggtaatgctggaacccattaggatcaagcaggaaaatagcgggcctccagaaaactatgattttccggtggttatcgttaaacaagagagtgacgaagaaagcaggcctcagaacgccaattatcctcgttctattctgactagcctgctgctaaattcaagccagtctagcacgagtgaggaaacagtgctccgctcagatgcgcctgattcgaccggcgatcagcctggcctccaccaggataatagcagcaacgggaaaagtgagtggctcgatccaagccagaaatctcccctccacgtcggagaaactcggaaggaggatgaccctaatgaggattggtgcgccgtgtgccagaacggtggagagctgctatgttgcgagaaatgcccaaaggtttttcacctcagttgccatgtacctacacttacgaatttcccttccggggagtggatttgcacattttgtcgggatttaagtaagcctgaagtggagtacgactgcgatgccccatcacataattccgaaaagaagaagaccgaggggctggtaaagctcactcccatcgacaaaagaaaatgcgaaagacttctgctatttctgtactgtcatgaaatgtcattggccttccaggaccctgtgcccctcactgtgcctgattattataagataataaaaaatccaatggatctgtcgacaattaagaaacgcctccaggaggactattcgatgtatagtaagcctgaggactttgttgcagatttccgcctcatctttcaaaactgcgctgagttcaacgagccagactccgaagtggcaaatgccggaatcaaactggaaaattacttcgaggagttgcttaaaaacctgtatcctgagaagaggttccccaaacctgagttccgtaacgagtccgaggacaacaaatttagtgacgattctgatgatgactttgtgcagcccaggaaaaaaagactcaaaagtattgaggagcgccaattgctcaagtag

SEQ ID NO: 31292 - DNA, 1692 bp, Artificial Sequence
  Description of Artificial Sequence: Synthetic coding sequence
atgggacttcaggcttgtttgctcggactttttgcactaattctgtccggaaagtgctcttactctcccgaaccagaccaacggcgtaccctgccacctggctgggtgtcactcggccgagccgaccctgaggaagagctgtctctgacattcgccctacgccaacagaatgttgagaggctcagtgaattggtccaggccgtaagcgacccaagctccccgcagtacggcaagtatcttactctggaaaatgtggccgacctggtgcgaccctccccgctgactctccacactgttcaaaagtggctgctcgccgcaggggcacagaaatgccactccgtcattacccaggattttctgacttgttggcttagcattcggcaggcggaactgttgttacccggtgctgaattccaccattacgtcggcggacctactgaaactcacgtggtccggagtcctcatccctatcagctcccccaggcactcgcaccacacgtcgactttgtggggggactacacaggtttccccctaccagctctctgcgccaaaggcccgagcctcaggtgacaggtactgtcggcctccatttgggcgtaactccatctgtcatccggaagcgatacaaccttactagccaggatgttggcagcggcacttctaacaactcccaggcctgcgcccagttcctggagcagtacttccacgacagcgatctggctcagtttatgcgcctgttcggcggaaactttgcgcaccaagcctctgtagcacgcgtggtcggccaacagggaagaggcagggcaggaatcgaggccagtctggatgtccaatatcttatgagcgccggtgccaacatctcaacatgggtctactccagccctgggaggcacgagggccaggaaccgttcctgcagtggctgatgctgctgtccaatgagagcgccctgccgcacgtgcacacagtgtcttacggggacgacgaagattcactctcttccgcatatatacagagggtcaacactgagctgatgaaagcagccgcacgcggactcactctgctttttgctagcggtgattccggcgctggctgttggagcgttagtggacgccatcagttccgtcccaccttccctgcttcttcgccctatgtgaccaccgtcggaggcacatcatttcaagagccatttctgatcacaaatgaaatcgtggattatatatcaggcggtggattttccaacgtttttccgagaccttcctatcaagaggaggccgtgaccaaattcttatcctcctctccacatcttcctccctcatcttacttcaacgcaagtggacgcgcttaccctgacgtagctgccctgtccgacggctattgggttgtgtcaaatcgggtccctatcccgtgggttagtgggactagtgcctcaacgccagtgttcgggggaatcttatccttaataaacgagcacaggatcctgagtggtcggcctcctctggggtttttgaatccacgtctatatcaacagcacggggctggcctcttcgacgttactcggggttgccacgaatcatgcctcgacgaggaggtagagggccagggattctgttccggcccaggatgggatcctgtcactgggtggggaacccccaatttcccagccctacttaagactctgctgaatccctag

SEQ ID NO: 31293 - DNA, 1041 bp, Artificial Sequence
  Description of Artificial Sequence: Synthetic coding sequence
atgggcctccaggcatgcctgctgggccttttcgcactcattctgagcggcaaatgttcatacagccctgaaccagatcagcgcaggaccctgcctccaggatgggtgagcctgggcagggcagatccagaggaggaactgagtttgactttcgctctgcgccagcagaatgtggagcgactgtccgagttggtccaggcagtgtccgatccctcctccccacaatatgggaagtatctcaccctagagaacgttgctgacttagttagaccctctcccctgacactgcacaccgtccaaaaatggctcctggcagcaggcgcacagaagtgtcatagcgtaattacccaggattttctgacctgctggctttcaatccgacaggccgagttactgctgcccggtgctgagttccaccactatgttggtggccctaccgaaacacacgtcgttagaagccctcacccttaccagctcccccatatcctcgaagttccttatgtgaccacggttgggggtacttcattccaagaaccattcctgataaccaatgagatagtggattacatttccggcggaggcttctctaacgtgttcccaagacctagttaccaagaagaggcggtaacaaagttccttagctcttccccgcatcttcctccatcttcttattttaacgcctcaggacgcgcttaccccgatgttgcggcactgagtgacggctattgggtggtgtctaaccgagtgcctattccctgggtttccggcacttctgcctcaacgcctgtgttcgggggtatattaagtttgataaatgagcaccgtatcctgagtggcaggcctcctctggggtttctcaacccgaggctctaccagcagcatggggctgggttattcgatgtgactcgtggatgtcatgagagctgcctcgacgaggaagtggaagggcaaggtttctgtagtgggcctggttgggaccccgtaaccggctggggaacaccaaacttccctgctcttcttaaaacccttctcaatccttag

SEQ ID NO: 31294 - DNA, 3495 bp, Artificial Sequence
  Description of Artificial Sequence: Synthetic coding sequence
atggcgcaacaggcaaatgtgggtgagctgctggccatgttggatagccccatgctgggcgtgcgagacgacgtgacggccgtctttaaggaaaatctgaatagcgaccgcggacctatgttggtaaataccctggtcgactactacctggagaccagcagccagcctgcgctccacattctcactacgctgcaagaacctcatgataagcatttactcgatcgcattaatgagtacgtggggaaggcagctactcgcttgtcgatcctgtcactcctgggccacgtcatccggctgcagccttcctggaagcataagttgtcccaggctcccttgcttccgtctctgctgaagtgcctgaaaatggatacggatgtggtcgtcctcactacaggcgtcctggtactaatcaccatgctgcctatgatcccgcagagcggcaagcagcaccttttggacttctttgatatattcggacggttgtcttcctggtgtctgaagaagcctggacatgtcgcagaggtttatcttgtccatctgcatgcaagcgtgtatgccctgttccatagattatacggaatgtatccttgtaatttcgtcagcttcctgagatctcactactcaatgaaagaaaacctggaaaccttcgaggaggtagtgaagccaatgatggaacacgtaaggatccatcctgagttagtgaccggctcaaaagatcatgagctggacccccgacgctggaagcgactggaaactcatgacgttgtgatcgagtgcgctaagatctcactggaccctacggaggcgagctacgaggatggttactccgtaagtcaccagatctctgcccgattcccccacagatcagctgatgtcactactagcccttacgccgacacacagaacagctatgggtgtgcaacttctacaccttatagcacatcccgtctcatgctgttaaatatgccgggacagctgccgcagacgctgtccagcccatctacgaggttgattactgaacccccacaggccaccttatggtcacccagtatggtctgtgggatgaccacacccccaaccagtcccggaaatgtgcccccagatttgagccacccatactccaaggtcttcggaacgaccgctggaggaaaagggaccccactgggcaccccggcaacttcccccccacccgctcccctttgtcattccgacgactatgtgcacattagtctgccacaagccactgtgacacctcccaggaaggaggagcggatggactcagcacgaccctgtctgcaccgccaacaccatctactgaacgaccggggttctgaggagccgccaggcagtaagggatcagtaaccctgtccgaccttccgggttttttgggcgatctcgcatcagaagaagacagcatcgaaaaagataaagaagaggcagctatctcccgcgagctgtctgagattaccaccgccgaggcagagccagtcgtcccacggggtgggtttgatagtcccttctatcgggattcactgccaggatctcaacggaagacccactctgccgcatcaagcagccagggggcatccgtcaatcccgagcctttacattcctctctcgacaaattgggcccagacacgcctaagcaagcatttacgccaatagaccttccctgtggaagcgccgacgaatcccccgctggggacagagagtgtcagacatcactggagacttcaattttcaccccatctccttgtaagattcctccgcctacacgggtgggcttcggatccggtcaacccccaccctacgaccacttgttcgaggtggccctcccgaagacagcacatcattttgtcattcgaaagaccgaagaactattgaagaaggctaagggtaatacagaagaggacggggtgcccagtacaagtcccatggaggttctggaccgtttaattcagcaaggggcagacgcacatagcaaagaattgaataaactgcccctgccttcaaagtccgtggattggactcactttggcggttctcctcccagcgatgaaattcgcacccttagagatcagcttttgctgctgcataaccagctcctgtacgagaggttcaagaggcagcagcatgccctgcggaacaggagattgcttcgaaaagtgatcaaagccgctgctctcgaggaacacaacgccgctatgaaagaccaattaaaactccaagagaaggacatccagatgtggaaggtgagcctccagaaagagcaagccagatacaatcagctgcaggagcagcgggatactatggtaaccaagctacatagccaaattcgccagctccagcacgatagggaggaattctacaaccagagtcaggaactgcagacaaaactcgaggattgtcgaaatatgattgctgaactgcgaattgaattgaaaaaggccaacaataaggtatgccacaccgaactgctgctgtcacaagtatcacagaaactcagtaattcggaaagtgtgcagcagcagatggagtttttgaataggcaactcctagtcctgggcgaagtgaacgagttgtaccttgagcagctccagaataaacacagcgataccactaaggaagtggaaatgatgaaggccgcttaccggaaggagctggaaaagaacaggtctcacgtccttcagcagactcagcgcctagacacttcccaaaagcgcatccttgagcttgagagccacctggccaagaaagatcacctgctgctggagcagaagaagtatctggaagacgtcaagctccaggccagagggcagctgcaggctgctgaatcgagatatgaagcacagaagcggattacgcaggtctttgagctggagattttggatttgtacggcagattagaaaaggacggactgctaaaaaagttagaggaggagaaagctgaagcagcggaggccgctgaggaaaggctcgattgctgcaatgatggctgcagcgattcgatggtgggccataacgaagaagcgagtggccacaacggggagacgaagactccacgcccttccagtgcgcgaggatccagcgggtctaggggaggcggagggagctccagttcaagcagcgagttgtccacaccggagaagccccctcaccagcgggcaggcccattcagcagccgctgggaaactaccatgggtgaagctagtgcatccattcctacgactgttgggtcacttcctagttctaagtcattcctgggtatgaaagctagggagttgtttcgcaacaagagtgagtcccagtgtgacgaagatgggatgacttcttccctcagcgagagcctgaaaaccgagctaggaaaggatctgggggtagaggccaaaatacccctcaacctggacggaccccacccaagccccccaacccccgattccgttggacagctccacataatggactacaatgagactcatcacgagcactcttag

SEQ ID NO: 31295 - DNA, 1101 bp, Artificial Sequence
  Description of Artificial Sequence: Synthetic coding sequence
atggctcagcaagcaaatgtcggagagttattagccatgctcgacagccccatgctgggagtgcgagacgatgtgacggccgtattcaaagagaacctgaacagcgacagaggtcccatgctagtgaacactctcgtggattattacctggaaacgagttcccaacccgctctgcatatcctgacaactctccaagagcctcacgacaagcatctgcttgacaggatcaacgaatacgtggggaaggctgccacccgcctgagcattctgagccttctgggtcacgttataagactccaaccttcctggaaacataagctgtctcaggctccccttctgcccagtctcctcaagtgtctcaagatggatacggatgtggtggttctgacaaccggagtgctcgtgctcattacaatgctccccatgatcccacagagtggcaaacagcacctgctggacttcttcgatatcttcgggcgattatcctcctggtgcctcaaaaagcccggacacgtggctgaagtgtacctggttcacctgcatgcttccgtgtatgccctctttcacagactctacggtatgtatccctgcaacttcgtctcattcttgagatcacattactccatgaaggagaacctggagacttttgaagaagtggtcaagccaatgatggaacatgtgcggattcatccggagttagttaccggctctaaggaccacgagctggaccctaggagatggaagcggttagaaacccacgacgttgtgattgaatgtgccaagattagccttgatcccacagaggcgtcttatgaggacggctacagcgtaagccatcagattagtgcgagatttccacatcggagcgctgatgtgactactagcccttatgccgatacacagaactcctacgggtgtgcgacgtctactccatatagcacaagcaggctaatgctcctgaacatgcccggacagttaccccagactctgtctagcccctcaacccggctgattactgagccccctcaggtgtggtgccagttagtgtgtctactttcccccctgttgtctggcgaagctgaccccctaggccaaatttag

SEQ ID NO: 31296 - DNA, 954 bp, Artificial Sequence
  Description of Artificial Sequence: Synthetic coding sequence
atggatacagatgtagttgttttaacaacgggggtgctggtgttgatcaccatgctgccaatgattccgcaatccgggaaacagcatctgctagacttttttgacatctttgggagattgtcctcgtggtgtcttaaaaaacctggccatgttgcggaagtctatctggttcatctgcatgcttccgtatacgctctgttccatcgattatacggcatgtacccatgtaattttgtgagtttccttcgctcgcactacagtatgaaggagaatctagagacatttgaggaggtggtgaagcccatgatggagcacgtgcgaatacatccagaactggttaccggcagcaaagaccacgaactggaccctaggaggtggaaaagactggagacacacgacgtggtgattgagtgcgccaagatctccctggaccccaccgaagcctcctacgaagatgggtatagcgtctctcaccagatatctgctcgcttcccacatcgatcagcagacgttacgacatctccttacgctgacacccaaaatagctatggatgtgctacttccaccccttactctacttcccgactcatgctcctgaatatgcctggtcagcttccccagacactatcctctccgagcactcggctaataacagaacctccccaagcaaccctgtggtccccaagcatggtgtgtggcatgactaccccaccaacaagcccgggaaatgtgccgcctgatctgtcgcacccctattccaaggtgtttgggaccacagctggagggaaaggcacgccattgggcacccccgctacatctcctcccccagccccaagcgtgatacgcatgacaacttgcaccttccactcaccgcgaccccagtcccaccctccaggccgaaaacgcgaatggatattgcaagaccatgtgtataccgacaatacaatattttag

SEQ ID NO: 31297 - DNA, 3495 bp, Artificial Sequence
  Description of Artificial Sequence: Synthetic coding sequence
atggcccagcaggccaatgtcggagaactgctggccatgctcgatagtccgatgttgggtgtgcgggacgacgtcactgctgtgtttaaagagaacctgaacagtgatcgagggccaatgctggtgaataccctggtggattactaccttgagacttcatctcagcccgcactccatatcctcacaacgcttcaagagccccacgataaacatctacttgatagaataaacgagtatgttgggaaggctgctacacgcctgtcgatcctctcccttctgggacacgtcataaggctacaaccctcatggaagcataagctgtcacaggcccctctgcttccgagtctgttgaaatgcttaaagatggacactgatgtagtggttctgacaaccggggtgttggtcctgatcaccatgcttccgatgattcctcagagcggaaagcagcatctccttgactttttcgatatttttgggcgtctgtcgtcatggtgtctcaagaagccagggcacgtggctgaagtctatttggtccatctgcacgcctctgtctacgccctgttccataggctttatggaatgtatccctgcaactttgtgtccttcttgagatcgcattactcgatgaaagaaaacctggaaacctttgaggaagtggtgaagccaatgatggaacacgttagaattcaccctgaactcgttactggctccaaagatcacgagctcgatcccaggagatggaaacgcctagagacacatgacgtcgtcattgagtgcgccaagatttctctggatccaacagaggcctcatacgaagacgggtatagcgtgtctcaccagattagcgccaggttcccgcatcgtagcgcggacgtgacaacctcgccgtacgcagacacacagaattcatacgggtgtgcaacctccactccctattcaacgtcaaggctcatgttattaaatatgcccggtcaacttcctcagacacttagctccccaagcacgcgtctcatcaccgagccacctcaagcaacactgtggagcccatcaatggtctgtggcatgactacgcccccaacaagtcccggaaacgtacctccagatctgagccacccatatagcaaggtcttcgggacaaccgccggtggcaagggcacgcctctgggaacccctgcaacctcccccccacctgctccactttgtcattccgatgattacgttcacatcagcctgccacaggccaccgtcaccccaccaagaaaggaagagcggatggattccgctcgtccttgcttgcaccgccagcaccatctgctcaatgatagaggctccgaagaaccgcctgggagtaaaggaagcgtcacgttgagtgacttacctggcttcctcggagatttagcctccgaggaagattccattgagaaggacaaagaagaagcagcaatctcacgggaacttagcgagatcaccacagccgaagcggagcctgttgtgcccagaggcggattcgatagccccttttatcgagactcactgccaggctcacagcggaaaacacactctgctgccagtagttcccaaggagccagcgtaaatccagagccattgcattctagccttgataaactgggcccagacacccccaagcaggcgttcaccccgattgacctcccatgcggcagcgccgacgaaagccccgctggggaccgagaatgtcaaacctccctggagacctctatcttcacaccgtcaccgtgcaagataccgccacccactcgcgtcggcttcgggtcaggccagcccccaccctatgatcatctgttcgaggtggccttaccgaagacggcccaccacttcgtcatacgaaaaacagaggaactgctcaaaaaagccaagggtaacaccgaagaggatggcgtgccttctacttctcccatggaggtactggaccgattgatccaacagggtgccgatgctcattccaaggagctcaataagctccctttgccttccaaatccgttgactggactcatttcggaggttccccccctagtgacgagatcagaactctgcgtgatcagctcctccttttacacaaccagttgttgtatgaacgctttaaaagacagcagcacgccttgcggaaccgccgtctactgcgtaaggttatcaaagcggctgccctggaggagcacaacgccgcaatgaaagaccaacttaagctgcaggaaaaggacatccagatgtggaaagtctcactccaaaaggagcaggcacgttacaatcagttacaagagcagcgcgacacaatggttacaaagctacactcacagattcgccagttgcaacatgaccgcgaggaattctacaatcagagtcaggagctacagaccaagctggaggactgtcgaaacatgatagctgagctcagaatcgaacttaagaaggctaataacaaagtatgtcatacggaactgttactaagtcaggtttcccagaagcttagcaactccgaatccgtgcagcagcaaatggagttcctcaataggcaacttctggtcttaggcgaggtcaatgagctgtacttagagcagctgcagaataaacactctgatactactaaagaagttgaaatgatgaaagcagcctatcggaaggagctcgaaaaaaatagatctcatgtcctgcagcaaactcagcgtctcgacaccagccagaagcggatcctggaacttgagtctcacttagcgaagaaggatcatctactgctcgagcagaaaaaatacctcgaggacgtaaagctgcaggcaagagggcagctgcaggcagcagagtccaggtacgaagcccagaagagaatcactcaggttttcgagctcgagattcttgacctgtatggccgactcgagaaggacgggctcttaaagaagcttgaagaagaaaaggccgaggcagccgaggcagcagaggaacggctcgattgctgcaacgatgggtgttccgattcgatggttggtcataacgaggaggcaagcgggcataacggcgagacaaaaactccaagaccttcttccgcgagggggagttccggctcccgcggtggcggtggcagctcttcttcctcatcagagctgagcacccctgagaagccgcctcaccagagagccggtccctttagtagccgctgggaaacaacaatgggagaggcttcggccagcatcccaaccactgtgggaagtctccccagcagcaaaagctttctcggtatgaaggcaagggaactgttcagaaataaatccgagtctcagtgtgatgaagacgggatgacaagctcattatctgaatcattgaagacagaactaggcaaggatcttggggtcgaggctaaaatcccactgaacctggacggccctcaccccagcccaccgacgcccgactcggtggggcagttacacataatggactacaacgaaacacaccatgagcactcctag

SEQ ID NO: 31298 - DNA, 849 bp, Artificial Sequence
  Description of Artificial Sequence: Synthetic coding sequence
atggacaccgacgtcgtggtcctcacaacaggtgttcttgtattaattactatgctgcctatgattcctcagagcggcaaacagcatctcctggacttttttgatatctttgggcgtctgagcagctggtgtctgaaaaagccagggcacgtagccgaggtctacctggttcatttacatgctagcgtgtacgccttattccatcgcctgtacgggatgtatccatgcaatttcgtgtccttcctccgcagtcattacagtatgaaagaaaacctggaaacattcgaggaagtggttaagcctatgatggaacacgtccggatacatccagagctcgtgacaggctctaaagatcacgagcttgacccacggcgttggaagaggctggagacacacgatgtcgtcatagagtgcgctaagatctctttagatcccacggaggcgtcctatgaggacggctattccgtgagccaccagatctctgcgagattcccccaccggtcagcagatgtgacaacgtctccatacgctgacacgcagaactcctacggttgtgccacctcaacaccgtactcaacgagtcgactgatgctgttaaatatgcccggtcacctcgcgacgaccgtccgaccacgcccaccagggcctgccgctcctggtgccgtggttgaagcggaagtggtggaggcggcagctgccgctgcagcgagctttctgccacaaaggaatccccacaccagggggcaggcacactcagccgtgggcggtaggcgactctgggagaagcgtctgcctgctagcccgccactgtgggcccattttcccgtccaaaaggctagctgggtgtag

SEQ ID NO: 31299 - DNA, 3342 bp, Artificial Sequence
  Description of Artificial Sequence: Synthetic coding sequence
atggctcaacaggctaatgttggggagctgctcgcaatgctcgattcgcctatgctaggcgtgagggacgacgtgacggctgtgttcaaggagaacctcaattctgaccggggacctatgctcgtcaataccttagttgactattacttggagacatcaagtcagccagctctgcacattctgaccacacttcaggaaccccacgacaaaatggacacagacgtcgtagttcttactaccggggtgctcgtgctaattaccatgctgcctatgatcccacagtctggcaaacagcacctcttggactttttcgatatcttcggacggttgtcgtcttggtgcctaaagaagccaggccacgttgcagaggtttatttagttcatctgcacgcttccgtttacgccctgttccaccggctgtacggcatgtatccatgtaattttgtgtcgtttttaagaagtcactactcaatgaaagaaaatctggaaacattcgaggaggtggttaaaccaatgatggagcatgtccggatccacccggaattggtcacagggtctaaagaccatgaattggacccaaggaggtggaagcgtctcgaaacccacgacgtggtgatcgaatgtgccaaaatcagtttggatcccacggaagcaagttatgaggacgggtactccgtgtcccaccagattagcgccaggttcccccatcgcagcgccgatgtgaccaccagcccgtacgcagatacccaaaacagctacgggtgcgccacatcgactccctatagtactagccggctgatgctgctgaatatgcccggtcagctcccccaaaccctcagctccccatcaactaggctcatcacagaaccccctcaggccaccctttggagtccaagcatggtgtgtggaatgaccacaccccctacctcacctgggaacgtccctcccgatctgtcacacccttatagcaaggtcttcgggaccactgcaggcggaaaggggacacccctcggaacccccgcaacctccccgcctccagccccactgtgccacagcgacgactatgtgcatatctccctcccccaggccaccgtgacacctcccagaaaagaggaaagaatggattccgcgcgaccctgcctacatagacagcaccacttactaaacgatcggggaagcgaggaacctcctggcagcaaaggctcagttaccttatcggaccttccgggttttctcggtgatctggcctcagaggaagattctatcgagaaagataaggaagaggctgctatctcgcgcgaactgagtgagattacaacagcagaagccgaacccgtagtcccaaggggaggattcgactccccattctaccgcgattccctgccaggcagccagagaaaaacgcattccgctgcatcctccagtcagggggcatccgtgaatccggagccgctgcattcttcccttgacaaattgggccctgatacacctaagcaagcctttacccccatcgacctgccttgtggcagcgcagatgagagccccgctggggatcgggaatgccagacttccttagaaacttcgatttttacgccgagcccctgtaagattcctcctccaacacgggtcggatttggatccgggcagcccccaccttacgatcacctttttgaagtggctttgcccaaaactgctcatcattttgttattcggaaaaccgaagaactgctgaagaaggctaaaggaaataccgaagaggatggcgtgccaagcacatctccaatggaggttctggaccggttaatacagcagggcgctgacgcccactccaaagaactaaataaactgccattacccagcaagtctgtggactggacccacttcggcggaagtcccccatcagatgagattcgcacacttcgagaccagttgctgctgttacacaaccagctgctctacgaaagatttaaacgtcagcagcacgctttaaggaatcgcaggctactccgcaaggtcataaaggccgctgcgttagaggaacacaatgctgccatgaaagatcagcttaaacttcaggaaaaggacatccaaatgtggaaagtctcgcttcagaaagagcaagctcggtacaatcagcttcaagagcagcgagatacaatggtcaccaaacttcatagccaaattcgccagctacaacatgatcgagaagagttttacaatcagtctcaggagctgcagaccaagctcgaggactgtagaaatatgattgccgagctgcggatagaactcaaaaaggccaacaacaaagtctgccacaccgagctgctgcttagtcaagtcagccaaaagctgagtaattcagagtccgtacagcaacagatggagtttctgaaccggcagctactcgtgctgggagaagtgaatgaactgtatctggagcaactgcagaacaagcacagcgatactacaaaggaggtggagatgatgaaggccgcttatagaaaggagttggaaaaaaacaggtctcatgttctgcagcaaacccagagactcgatacttcccagaaaagaattctagaactcgagtcacatctagctaagaaggatcacctcctattggaacaaaagaagtatcttgaggatgtcaagttgcaagctcggggtcaacttcaagctgctgaatcgaggtatgaggctcagaaacgtataacccaagtctttgaactggaaatactcgatctttacggtcgtcttgaaaaggatggcctgctgaaaaaattagaggaagagaaagcagaggccgcagaggccgcagaggagcgacttgactgttgtaacgacggttgctctgacagtatggtaggccataatgaagaagcaagtgggcacaacggcgagacaaagactccacgaccatccagcgccagaggcagttctggttctaggggtggaggcggtagttcgtctagcagcagtgaactgagcacccctgagaagcctccgcatcagcgggctggacccttctcgagccgctgggaaaccacgatgggcgaagcctcagcttctatccccaccacggtgggctcactcccttcctctaagtccttcctgggtatgaaggccagagagctattccgcaacaagagcgaaagtcagtgcgatgaggatggcatgacaagctcactgagcgagagcctaaagacagagctcggaaaggatctcggcgtggaagcgaaaatccctcttaacctagacggaccacatccgtcgccacctacgccagactcggtcggccagctgcacatcatggactacaacgaaacgcaccatgagcactcatag

SEQ ID NO: 31300 - DNA, 2397 bp, Artificial Sequence
  Description of Artificial Sequence: Synthetic coding sequence
atggctctgcattctcctcagtatatctttggagatttctcccccgatgagttcaaccaattttttgtcactccccgaagctcggtggagcttccaccctattccggtacagtcctgtgcgggactcaggcagtcgacaagctgcccgacggacaagagtatcagagaatagagtttggagtggacgaggtgatcgaaccttcagacaccctgcccaggactccttcctattccatcagctccacacttaatccacaggctccggagtttattctgggctgcacagcttctaagatcacaccagacggtatcacaaaggaagcatcatacggcagcatcgattgccagtatcctgggagcgccctggccctcgacggctcctcaaacgtggaggccgaggttttggagaatgacggcgttagtggcggtctcggccagcgagaaagaaagaagaagaagaagcgaccgcctggttattactcatacttgaaagacggcggtgatgattccatatccacggaagccttggtaaacggtcatgctaactctgctgtgccgaactctgtctccgcagaagacgcggagttcatgggcgacatgcctccatctgtgactcctaggacttgcaatagccctcaaaacagcaccgatagcgtcagtgacatcgtaccggacagccctttcccaggtgcattggggtctgatacccgtactgcaggccaacccgaaggcggtcccggagccgatttcggacagtcctgtttccctgccgaggcgggacgcgacacattgagccgtaccgctggggcacagccttgtgtagggacagatacgaccgaaaaccttggtgtcgcgaacggacaaattctggagtcttccggcgaagggactgctactaatggtgtggaactgcacaccaccgagtcaatcgaccttgatccaacaaaaccggaatcggctagccctccagccgacggcaccgggtcagcttctgggacactgccagtgtcgcagcccaagagttgggctagtctgttccatgatagtaagccaagctccagttctcctgttgcctacgtggaaactaagtatagccctccggcaataagcccactggtcagcgaaaagcaggtggaagtcaaggaaggactggtgccagtgagcgaagatcctgtggcaatcaagatcgccgagctgctggagaatgtcaccttgatccataagccggtgagcttgcagcctcggggactgattaacaagggaaattggtgttatatcaacgcgacattgcaagcgttggttgcttgtccacccatgtatcacttaatgaaatttatcccactgtactccaaggtgcagcgcccatgcacgtcgacaccgatgatcgactcctttgttcgtttaatgaatgagttcacaaatatgcccgtccctcctaagccccgacaggccctcggggataagatagtgcgggatattcgtccaggggcagccttcgaacctacgtatatttacaggctactgacggtgaacaaatcaagtctcagtgagaaaggaaggcaagaggatgcggaagaatacttgggattcatccttaacgggctgcacgaggaaatgctcaacctcaagaaactgctgagtccatccaacgaaaaactgaccatctccaacggtcctaagaatcactccgtgaatgaagaggaacaggaggaacaaggagaaggaagcgaagacgagtgggagcaggttggtccaaggaacaagacctcggtcaccaggcaggctgactttgtgcagacccctatcacgggtatttttgggggtcacattcggagtgtggtctaccagcagtcttcaaaggagagcgcgacgctgcaaccattcttcactctgcagcttgacattcaaagtgataaaattcggacagtgcaggatgctctggaatctctggtggctcgcgaaagcgttcaaggctacaccacgaagacgaaacaagaagtggaaatttccagacgagtgaccctggagaagcttcccccagtcttagtgcttcacctgaagagatttgtgtacgaaaagacaggtggttgccagaaactaattaagaacatcgaataccccgtggacctggagatcagcaaggagctgctaagccctggagtgaaaaataagaatttcaagtgtcacagaacatacagactgtttgctgtcgtgtaccatcatggcaactccgcaaccgggggtcactacactactgatgtcttccagattggattgaatggttggttgaggattgacgaccaaaccgtgaaggtcattaatcagtatcaggtcgtcaagcctaccgccgaaagaaccgcctaccttctctattaccggcgagttgatctgctgtag

SEQ ID NO: 31301 - DNA, 5354 bp, Artificial Sequence
  Description of Artificial Sequence: Synthetic coding sequence
atggcaaagcctacctccaaagactccggactgaaagagaagttcaaaatactgctgggcttaggaacccccaggccaaaccccaggagcgccgaggggaaacaaacagaatttatcattactgcggagatcctgcgagagctgagcatggagtgcggactcaataatcgcatccggatgatagggcaaatttgcgaggtggccaagactaaaaaatttgaagagcacgccgtcgaggccttgtggaaggccgttgctgacctgcttcagcccgaacgaccccttgaggctcggcatgccgttttggctcttttaaaggcaatcgtgcagggccagggagagagattgggtgtgttgcgcgctctgttcttcaaggtgatcaaagactaccctagcaacgaggacttgcacgagcgattggaggttttcaaagcactgacagacaatggaagacatattacctacctcgaggaggaacttgcggactttgtgctccagtggatggatgtgggcctttctagcgagtttcttctggtcctagtgaacctggttaagtttaactcctgctacctcgacgaatacatcgccagaatggtccaaatgatatgcctgctgtgtgtgcggaccgctagtagcgtggatatcgaagtttcactgcaagtcctggatgcagttgtttgttataactgtctgcccgctgaaagtttgccactgtttatagttactctgtgccgtacaatcaatgtcaaggaactgtgcgagccttgttggaaactgatgcggaacctcctcggcacccacctcgggcactctgccatctacaacatgtgtcacctgatggaggatagggcgtacatggaagacgccccactgctcaggggggctgtcttcttcgtgggcatggccctttggggtgctcaccgcctctattctctccgcaatagcccaaccagtgtgctcccaagcttctaccaagccatggcatgtcccaatgaggtggtgtcatacgagatagtgctaagcattactagattaattaagaagtaccgaaaagagctgcaggtagttgcatgggatatcctgctgaacataattgaaagacttctccagcagctgcaaacattggattcaccagagcttcgcacgatcgtgcatgacctgttaacgacagtagaggaattatgtgaccaaaacgagtttcacgggtcacaggagcggtattttgaactggtagagcgctgcgctgaccagcggcctgagagcagccttctgaacctgatcagctatcgtgcccaatccattcacccggcaaaggacgggtggatccagaatcttcaggctttaatggagcgcttctttagatccgaaagccggggtgctgtaagaattaaggttctcgacgtgttgtcatttgtgcttctgattaataggcagttctatgaagaggagctgataaatagtgtcgtaatatcccagcttagccacatacctgaggacaaggaccatcaggttcgtaaattggctacacagctactcgtggacctcgccgaagggtgtcatacccatcacttcaattctctactcgatatcattgaaaaggtgatggcacgctctctctcaccgccacccgaacttgaggagagagacgtcgccgcttactcagcatccctggaggacgtcaaaaccgcagtgctgggactgcttgtcatcttacagacaaaattgtacacactgcctgcttcacacgccacaagggtgtacgaaatgctcgtgagccacattcagctgcactacaagcactcatacacattgcctattgctagcagcatccgcctacaagcattcgactttttgttgctgctgcgcgcagacagcctccataggctgggtttaccaaacaaagacggagtagtgcggtttagcccatactgtgtgtgtgattatatggagcccgagcgtgggtctgagaaaaaaacttccgggccactgagcccccctacaggacctcctggacccgcacctgccggacctgcggttaggctcggcagcgtgccttacagtcttctgttcagggtgttactacagtgcctgaagcaggaaagcgattggaaagtgctgaaacttgtactaggtcggctgccggaatccctgcggtataaggtcctcatcttcacatccccctgttccgtggaccagctttgctccgctttatgttcaatgttaagcggtccgaagacgctggagcgcctacgcggagctcccgagggcttctcccggaccgacttgcacctcgcagtcgtccccgtgctgacagctctgatctcataccataactatttggataagacaaagcagcgggaaatggtttattgtctggagcagggattgatacacaggtgcgcctcccagtgtgtcgttgccttgtcaatttgtagcgtggaaatgccagacatcattatcaaagccctgccggtgttagttgttaagctgacgcacatttctgctaccgctagcatggccgtacctctgcttgagtttctctcaaccttagcccgtctgccccacctgtaccgtaatttcgccgctgagcaatacgcatccgtcttcgccatttccctgccctatactaatccttccaaatttaaccagtatattgtctgcctcgcccaccatgtcattgcgatgtggttcattaggtgccgcctcccctttcgaaaggactttgtaccatttataacaaagggcctgcggtccaacgtcttgttgtctttcgacgatactccagagaaagatagttttagggcacgcagcacttccctcaatgagcgtccaaagtcactgaggatagctcggcctcctaagcaaggtctgaacaattcaccacctgtcaaggaattcaaggagtcaagcgccgctgaggcattcaggtgtcgctctatcagcgtgtctgaacacgttgttaggtcccgcatccaaacatctctgacaagcgctagtttaggatccgctgatgaaaattcggtggcccaagcagacgattcacttaagaacctgcaccttgaactcacagagacatgcctggatatgatggctcgctatgttttttcaaactttactgcagtgccaaaacggagcccagtgggagaattcctcttggccggaggcagaaccaagacctggttggttggtaataaactggtcaccgtcacaactagcgttggtactggcacccgctctctacttggcctggactcgggtgagcttcagtccggcccagagagcagctcgagccctggggttcatgttaggcagacaaaggaggccccagccaaattggagtcacaggccggtcaacaggtttcacgtggagcccgagaccgggttcgcagtatgtctggcggtcatggccttcgggtcggcgcactagatgttcccgcatcacagtttttggggagcgcaacaagtcccggtcctcgtacagcacctgccgctaaacctgagaaggccagcgcgggaacaagagtgcccgtccaagaaaagaccaacctggctgcctacgtgccactactcacccagggatgggccgaaatactggtgcgtaggcccaccggcaacacctcctggctaatgtctctcgagaatcctctttcacccttcagttcggacattaataatatgccccttcaggagctgagtaacgctctgatggccgcagagaggtttaaagaacacagggatactgcactgtacaaaagtctgtctgtccccgctgcgagtactgccaagccgcctcctttgccgaggtcgaacactgacagtgctgtagttatggaagaaggttccccgggtgaggtacccgtccttgtggagccaccgggactggaagatgtagaggctgccctcgggatggatcggaggactgatgcttatagccgttcttcctcggtgtccagccaggaggagaaaagcctgcatgctgaggagctggtgggacgcggtattcctatcgaacgagttgtatccagcgaaggcggtcggccttccgtagaccttagctttcaaccatctcagccactgtcaaagagctcgtctagccctgaactgcaaactctccaggacatcctgggcgatccgggagataaggctgacgtggggaggctgtcccccgaggtcaaagccaggagtcagtcaggcacactggacggagagtctgccgcatggagtgcctccggggaagacagtaggggacagccagaaggcccacttccatcttccagccccagatcaccaagcgggctgaggcctaggggctataccatttcggacagtgcacctagcaggcgaggcaagagagtagagcgggacgccctgaagtccagagcaactgcatctaacgctgagaaagtgcccggaataaatccatctttcgtgtttttacaactttatcattccccgtttttcggtgacgagtccaacaagcccatcttgctgcctaacgaatctcagagcttcgaaaggagcgtacagctcctggaccagataccgagctacgacacccataagattgcagtgctgtatgttggagaaggtcagtcaaacagtgagctggcaatattgtcgaatgagcacggctcataccgatacacagaattcctcacaggcctagggagacttattgaactgaaagactgtcagcctgataaagtgtacttgggcggactcgacgtgtgcggcgaggacggccagttcacgtattgttggcatgacgacattatgcaggccgtgtttcacatcgcaacactcatgcccaccaaagatgtcgacaagcaccgatgtgacaagaaacgacacctcggaaatgactttgtatctatcgtgtacaacgattcgggcgaagacttcaagttggggaccattaaggggcagtttaacttcgtgcatgttatcgtcacacctttggattacgaatgcaatttggtcagcctgcagtgcagaaaggatatggaagggcttgtggacacatcggtggcaaagatcgttagcgatagaaacctgcctttcgtcgcgaggcagatggctcttcacgcaaatatggccagtcaggtacaccactctagatccaatccgactgacatttacccgagcaaatggattgctcggttacgacacattaagcggcttaggcagagaatttgcgaggaagcagcttattccaatccctctctacctctcgtccacccccctagtcatagcaaggcgccagcccagacaccggctgagccaactccgggttacgaagtggggcagagaaaaaggcttatctcgtcagtggaggatttcacagagttcgtgta

SEQ ID NO: 31302 - DNA, 5294 bp, Artificial Sequence
  Description of Artificial Sequence: Synthetic coding sequence
atggctaagcccacctccaaggacagcggacttaaggagaaattcaaaattctcctgggactggggacacccaggcccaaccccagaagtgccgagggcaaacagacagagttcatcattaccgctgagatcctgagggagctgtcaatggaatgcggactcaataatagaattcgcatgattgggcagatctgtgaagtggcaaaaacgaaaaaatttgaggagcatgccgtagaggctctgtggaaagcagtggcagacctgctgcagcccgagaggcctctggaagctaggcatgcggtcctggcactcctcaaggcaattgtacaggggcagggggagcggctcggcgtgctacgtgcactatttttcaaggtcatcaaggactatccaagtaacgaagaccttcatgagagactggaagtttttaaggcgctcacagataacggtagacacataacttatctcgaagaagagctggctgactttgtgctccagtggatggatgtcggactgtccagcgaatttttactcgtattggtcaacttggtgaagtttaacagctgctacctggacgaatacatagcccgtatggtgcaaatgatttgtctgctctgtgttcggacagcctcctcggtggatatcgaagtgtctcttcaagttctggatgcggtagtttgctacaattgtctccctgcagaatccctccctctattcatcgtcaccttgtgccgtaccatcaacgttaaagaattgtgcgagccctgctggaagctgatgcgcaatctcctagggacccatttaggtcactcagccatatataacatgtgtcacctcatggaagaccgagcctatatggaggatgctccgctgctacgaggagcagtgtttttcgtagggatggcattgtggggggctcaccgcctgtattctcttcgtaatagccccacctccgtgcttcctagtttctaccaagccatggcgtgcccaaatgaagtcgttagctatgaaattgtcctgagtattaccagattgatcaaaaagtacagaaaggaactacaggtcgtggcttgggacatcctcttaaatatcatcgaacgcttgctgcagcagctccagaccctagactcacctgaacttaggacgattgtgcatgatctcctaacaactgttgaagagctgtgcgaccaaaacgagttccacgggtctcaagagcggtattttgagttagtcgaacgatgcgccgaccagcggcctgagtcttccctgttgaaccttatttcctatcgcgctcagtctatccaccctgcaaaggatgggtggatccagaacctgcaagcgttgatggagcgcttcttccggtcagaatcaaggggagcggtaaggattaaagttctcgacgttctttctttcgtcctgctcatcaacaggcagttttatgaagaggaattaattaattccgtagtcattagtcaactgtcccacattcccgaggataaagaccaccaggtgagaaaactggccacacagctgctggtcgatttggcagagggttgtcacacccaccacttcaacagtctgctcgatatcatcgaaaaagtgatggccagatcgctgagtccaccacccgagctcgaagagcgggatgtcgcggcttactccgcttcacttgaggatgttaaaactgcggtgcttgggttgttggtcattctccaaacaaaactttatactctgcccgcatcccacgccacacgcgtgtacgaaatgctggtgagccatatccagctacattataaacatagctacactctgccgattgccagctcgatacggctacaggccttcgactttctgctcctgctgagggccgacagcctgcacaggttgggactgcctaataaggacggtgttgtgaggttctccccatattgtgtgtgcgattacatggagcctgagagaggatctgagaaaaaaacgagcggccctctctcccccccaactggccctcccggaccagcacctgccggaccagctgtccgactgggaagtgttccctactccctgctgtttagagtgttattgcagtgtctcaagcaagagtccgattggaaggtgcttaagcttgtgctgggaaggcttcccgaaagtctacgttataaggtccttatcttcaccagtccctgctctgtggaccagctgtgcagcgctctatgtagcatgttatctggcccaaaaaccctggaacgcttgcgcggtgccccagaggggtttagtcgaaccgatcttcacttggccgtcgtgcccgtgctcaccgccctcatttcttaccacaattatttagataagacaaaacaaagagagatggtgtattgcctggagcaaggattaattcatcggtgtgccagccaatgtgtggtcgctttgagcatctgtagcgttgaaatgccagatatcatcataaaggcactccccgtcctggtggtgaagctgactcatatctccgccactgcatccatggccgttccactgctggagttcttgtcaaccctggcgagactcccacatttgtacagaaattttgccgctgagcagtatgcttccgttttcgctattagcctgccgtacaccaatccttccaaattcaatcagtatatcgtctgcctcgcccaccacgtcatagcgatgtggtttattagatgccgactgccatttaggaaggatttcgttcccttcatcaccaaaggcctgaggagcaatgtactgctctcattcgacgatactcctgagaaggattctttccgcgctcgatccacttctctgaacgagcgccctaaaagccgcatccaaacaagtctgacaagcgcaagcttgggaagtgcggacgagaatagcgtggcacaggctgatgactccctgaaaaacttgcatctagagctgacagaaacctgtctggacatgatggcgagatatgtcttctctaacttcacagcggtacccaagcggtctcccgtgggtgagttcctgctggccggagggcgaaccaagacatggctcgtgggaaacaaacttgtcacagtcaccaccagcgttggaacgggtaccagatcgctgctcgggctggatagtggtgaactccagagcgggccagaatccagtagctctcctggcgtccatgtgcgtcagactaaggaagcacccgctaagttggaaagccaggctggccagcaggtctcccgcggagctcgagatcgggtgaggagtatgagtggaggccacggcctgcgagtgggcgctcttgacgtgcccgcttctcagtttctaggctctgctacttctccaggaccacgtacagccccagcggcaaaaccagagaaggcctcggccggtacccgagtgccagttcaggaaaagactaacctagccgcttacgtgccactcctgacacaggggtgggcggaaatcctggtgcgaaggcccactggcaacacatcttggttgatgagcctcgagaatcctttgtcccccttctcgtcagatatcaataacatgcctctgcaggagctgtccaatgccctgatggccgctgagcgcttcaaggaacacagagatactgctctgtataagagcctcagtgtacccgcagccagtacggcaaagccccctccccttcccagaagtaacacagtcgcttccttcagttcactgtaccagtcaagctgtcagggtcaactgcacagaagcgttagttgggctgacagtgcggtcgtgatggaggaaggcagtccaggggaggtgcctgtcttagtggagcccccaggactggaggatgtagaggctgccctcggaatggataggcggactgatgcttatagccggtcctcctcggtgtcgagccaggaggagaaatctctgcacgcggaagagctggtgggtagagggatccccattgagcgggtcgtgtcctccgaaggagggcgtccttccgtcgatcttagttttcagcccagtcagcctttgagcaaaagtagctctagccctgagctgcaaacgctacaagatatcctgggtgatccaggggacaaagccgatgtgggtcggctgagtcctgaggtcaaagcacgctcgcagagcggcactctagatggcgagagcgcggcttggtctgcctcaggggaagattcgagaggccagcccgagggccctctcccaagtagcagcccccgatctcccagcgggctgaggccacgcggatacaccatttccgactccgccccttcccggagaggcaaacgggtggagcgggatgcacttaagtctcgcgctactgcatcaaatgccgaaaaggtgcctggaataaacccttccttcgtcttcctacagctgtaccattctcctttcttcggggacgagtccaacaaacccattctactcccaaacgaaagccaatcttttgaaaggagcgtgcaactactggatcagatcccctcttacgatactcataagatcgccgtgctgtatgtcggagaggggcaaagcaatagtgaacttgcaatcctctcaaacgagcatggaagttacaggtatactgagttccttactggccttggcaggcttatcgagctgaaagactgtcagcccgataaagtttatctgggaggtctggatgtctgcggcgaagacggacagtttacctattgttggcatgatgatatcatgcaggctgtcttccacatcgccacgttgatgcccacaaaggatgtggacaaacatcgatgtgacaagaaaagacatctggggaatgatttcgtctctatcgtatataacgattcgggcgaggatttcaagctgggcactatcaaagggcagttcaatttcgttcacgtgatcgtgaccccactggattatgaatgcaaccttgtcagtctgcagtgtcggaaagatatggagggcttggtcgatacttcagtggcgaagatagtctccgatcgaaatctgccattcgtcgccagacagatggctctgcatgccaacatggccagccaggtgcaccacagtagaagcaatcctacggatatctacccttctaaatggatcgctaggctccggcatataaaaagactgcggcagaggatttgtgaggaggccgcatatagtaatccttcactccctttggttcatcctccatcacacagtaaggcacccgcacagacccccgctgagcctacgcccggttatgaggtcggacagcgcaaacgacttatatcttctgtcgaggactttacggagttcgtcta

SEQ ID NO: 31303 - DNA, 5079 bp, Artificial Sequence
  Description of Artificial Sequence: Synthetic coding sequence
atggagtgtggtctgaataaccggattagaatgattggccagatttgtgaagttgccaaaactaaaaaattcgaagagcatgccgtggaagcactgtggaaggctgttgccgacctcctccagccagagcggccattggaagccagacacgctgtgctagctctgctcaaagccattgtacaaggacaaggagagcggttgggtgtccttcgggctttgttcttcaaagttattaaagactatccaagcaacgaagacctccacgagcgcctggaggtgttcaaagctctcacagacaacgggaggcacataacatatttggaagaggaacttgctgactttgtgcttcagtggatggatgtggggctgtcgtcagagtttctcctggttcttgtgaatttagtgaagtttaacagctgttaccttgacgagtacatcgccaggatggtgcagatgatctgtctgctgtgtgtgcgcactgcaagttccgttgatattgaagtctcactacaagtcctggacgcagtcgtgtgctacaactgccttcccgctgagtcgctgccactttttatcgtcacattatgtcgaaccataaatgttaaggagctgtgcgagccgtgctggaagttgatgcgaaacctcctcggtactcatcttggacatagcgccatctacaatatgtgccatttgatggaagacagggcctacatggaagacgctcccctcctgagaggcgctgttttctttgtgggtatggctctgtggggagcccatcgcctctacagtctcagaaattcccccacgagcgtgctcccctcattttaccaggccatggcttgcccaaatgaggtggtatcatatgagatcgtactctccattaccagattaataaagaagtaccggaaggagctccaagtcgtcgcctgggacatcctgctgaatatcattgaacgcttgttacaacagttgcaaactttggattcacctgagctgagaaccatagtacacgatttgttaactaccgtggaagaactttgcgaccaaaacgagtttcatggttcgcaggagagatatttcgaactggtagagcgatgtgccgaccaaagacccgaatcctctctcttgaacttgatttcctacagagctcaaagcattcacccagctaaagacgggtggatccaaaatctgcaggcgcttatggaacgtttctttaggtccgaaagcaggggcgctgttaggattaaggtgttggacgtcttaagctttgttctgctgattaaccggcaattttacgaggaagagttaattaatagcgtggtcatatcacagctttctcacattccagaagataaagatcaccaggtcagaaagctggctacccagctgcttgttgacctcgccgaaggatgccacactcatcattttaacagcttgctggatatcatcgagaaggtcatggcacggagcctaagcccacctcctgaactggaagaaagggatgtggccgcttactcagcatcgctggaggacgtcaaaaccgcagtactggggctcctggtcatcctccagaccaaactttatacactgcccgcatcgcacgccacacgggtgtacgagatgctggtttcccacattcaacttcactataaacactcgtacacactgccaatcgcaagttccattcgtctacaggccttcgattttctgctgctgctgcgcgctgactcacttcaccgtctgggtttacctaacaaagatggcgttgtaaggttcagcccctactgcgtgtgtgattacatggaacccgagcggggatctgagaagaaaacatctgggccattatcgccacccacgggcccaccgggaccagcacctgctggcccagctgttcggctgggttccgtgccatatagcctgttgtttagagtactattgcagtgcctgaagcaggagagcgattggaaggtgctcaagctggtcctaggtaggctgccggagtctttgagatacaaagttttgattttcaccagcccatgctctgtcgaccagctatgttcggccttgtgtagcatgctttccggccctaagacactggaaaggcttcggggagctcctgagggtttctctcggaccgaccttcacctcgcggttgtcccagtcctgaccgccttaattagctaccataattacctggataaaaccaaacaaagggagatggtttactgcctggagcagggcctgatccatcggtgcgcgtctcaatgtgtggtcgccctttccatctgtagcgtggagatgccagacattattatcaaggcgctaccagtgcttgttgtgaagctaacccacatcagtgccacggctagtatggcagtccccctgctagagttcctctcaacactggcccgtctaccacacttgtaccggaactttgccgcagagcagtatgcttctgtctttgccatctctctcccatacactaatccatccaagttcaaccagtacatagtgtgtttagcgcatcatgttattgctatgtggtttatacggtgcaggttgccattccgcaaagactttgttcccttcatcaccaaaggattgaggagcaacgttctgttgtccttcgacgatacaccggagaaggattcctttcgggctagatcgaccagcttgaatgaacgacctaaaagccggatccagaccagtcttacctccgcttcactcgggtccgctgatgagaacagtgtagcccaggccgacgactccttaaaaaacttacaccttgagctgactgagacatgcctagatatgatggccaggtatgtcttcagcaacttcacggccgtccctaagagaagtcctgtcggagagttcctgctggcaggcggaaggacgaaaacttggttggtgggcaacaaattagtgactgtcaccaccagcgtgggtactggcacgcggtcactccttggtttggattctggtgagttacagagtgggccagaatcatcgtcttccccaggcgtgcacgtgagacaaacaaaggaagcgccagccaaactggaaagtcaggctggccagcaagtgagcaggggcgcacgggatcgcgtgcggtccatgtctggcggacacgggctgcgcgtgggagctttagatgtgccagccagccagttcctgggctcagccacctctccgggacccaggactgcacccgctgccaagcccgaaaaagcaagtgcagggacgagagtgcccgtgcaggaaaagaccaacctggccgcttatgtcccactgctgactcagggctgggcggaaatcctcgtacgcaggcctacaggcaatacctcttggttgatgtctctcgaaaacccactaagcccctttagcagcgatatcaacaatatgccgctccaggaactgtcaaatgctctgatggctgccgaacggtttaaagagcatcgcgacacagcactgtataaaagcctgagcgtgccggcagccagtacggctaagcccccacccttacctcggtccaacacagactccgccgtggtgatggaggagggcagtcccggtgaagtgccagtcttggtcgagcccccaggtctagaggacgtagaagctgcactaggcatggatcgaaggacagatgcatacagtcggtcatcatccgtatcgtctcaggaagaaaagtcgttgcatgccgaggaactggttggccgaggaatccccattgaaagggtggtgtcttcagaggggggtcgcccaagcgtcgacctgagcttccagccttcccagcccttgagcaagtcttcctcatcgcccgaacttcaaaccctccaagatatcctgggcgaccccggtgataaggccgatgtagggaggctgagtccggaagtgaaagccaggagccagtctggcactctggatggagagagtgctgcctggtccgcgagtggagaggactctagaggacaacctgaggggccactgccaagctccagtccaaggtcaccatccggactgcgccctagaggctatactatttcggacagtgctcctagccgaagaggaaaacgggttgaaagggatgcactgaagtctcgcgcaaccgcgtccaatgctgaaaaagtgcccggtatcaacccctccttcgttttcctgcagctgtaccacagccctttctttggggacgaaagcaacaaacccatccttctgccaaatgaatcccaatcattcgagcggtcagttcaattgctcgaccagatcccaagttatgacacccataagatcgctgtgctttatgttggggagggacagtctaactccgagctggccatcttgtccaacgaacatggatcctacagatatacagagtttctcactggtctgggccgattaatagagctgaaggactgtcagccggataaggtgtaccttggtggactggacgtgtgtggggaagatggtcagttcacctattgctggcacgacgacataatgcaggctgtattccatattgccaccctgatgcctacaaaggatgtagacaagcaccgctgcgacaaaaaacgccatctggggaatgactttgtgtccattgtctacaatgactcaggcgaggatttcaagctgggaactatcaaggggcagttcaattttgtgcacgtgattgttacccccctggattacgaatgcaaccttgtgtcacttcagtgccgcaaggatatggaaggtttagtggacacgagcgtagccaagattgtgtccgataggaaccttccctttgtcgcgcgacaaatggccttgcacgctaacatggcgtctcaggtgcatcactctaggtcgaaccctaccgacatttacccctccaagtggattgccaggctgagacatatcaagagattacggcagcgaatttgcgaggaggctgcgtattccaatccttcgctgcccttggtccatcccccttctcattccaaggccccagcacagacacccgctgaacccacccccggatacgaggtgggtcagcgaaagaggctgatctcttctgtggaagatttcaccgagttcgtctag

SEQ ID NO: 31304 - DNA, 5225 bp, Artificial Sequence
  Description of Artificial Sequence: Synthetic coding sequence
atggcaaaacccaccagtaaagacagtgggctcaaggagaagtttaagatactgctcggcttaggtactccaaggcctaaccctcgctccgcagagggaaagcagacggaatttatcattacagcagaaatccttagagagcttagtatggagtgcggccttaataaccgcatacgcatgataggacagatctgtgaagtcgccaagacaaaaaagtttgaggagcatgcagtcgaggctttgtggaaggcagtggccgatctgctccagccagaaagaccacttgaggctcgccatgccgtgttagctctgctgaaggccattgttcaaggtcaaggcgaacgcctgggggtgctgagagccctcttttttaaagtcatcaaggactacccctctaatgaggacctgcacgagagattggaggtgtttaaagcattgaccgataacggcagacacataacttatctggaggaggagctagctgatttcgtacttcaatggatggacgtcggcctttcatccgagttccttctagtcctcgttaaccttgtgaagttcaactcgtgttatctcgatgaatatattgcacggatggtccaaatgatctgcctgctttgcgttagaactgccagctcagtagatatcgaggtgagtctacaggtactggacgccgtggtgtgctacaactgtctgcctgcagagtcactgcccttgttcattgtcactctgtgtagaaccattaatgtcaaggagctgtgtgagccatgctggaagcttatgcgtaatctgttgggcacacatcttggacactctgctatttacaatatgtgccatctgatggaggacagagcctacatggaggacgccccactgctgcgcggtgccgtattcttcgttgggatggccctctggggcgctcataggttgtattccctacgcaatagtccaactagtgtcctgcctagtttctatcaagctatggcctgccctaacgaagtcgtaagttacgagatcgtgcttagtataactaggcttataaagaaataccgaaaggagctccaggtcgtggcctgggacatactgcttaatattatcgaacgactcctacagcagctgcaaaccttggatagtcccgagttgcgcaccatcgtacacgacctgctgaccacagtcgaagagctgtgtgatcagaacgaatttcacggcagtcaggaaaggtacttcgaactcgtggaaaggtgtgctgatcagcgacccgagtcatcgctcctgaaccttatcagctacagggcccagagcatccacccggcaaaggacggttggatccaaaatctccaagcactgatggagcgatttttcagaagcgagtcaagaggcgcagtgaggatcaaggtgttagatgtcttgtccttcgtgctcttgatcaatcgacaattttacgaagaggaactgattaactccgtagtgatcagccaactgagtcatattccagaagacaaagaccaccaagtgcgtaagttagctacacaactcctcgtggatctggcagaaggctgtcatacacaccacttcaacagcctccttgatatcattgagaaggtgatggccagaagccttagtccccctccagagttggaggaaagagacgttgccgcttattccgcctcgctggaggatgtgaagaccgccgttctgggtctgctggtgatcctgcagacaaagctgtatacactccccgctagccatgccacacgagtttacgagatgcttgtatctcatatacagctccactataaacatagttatacattgccaatagcatccagtatccgactgcaggcatttgacttcctgctcttgctcagggcagattccctgcataggctcggcttgccaaataaagacggcgtcgtgcgattttctccttactgcgtatgtgattatatggaacccgaaagaggatctgaaaagaagaccagcggacctttatccccgccaaccggtccccctggtcccgcacctgccggaccagctgttcggctgggatctgttccctactcactgctatttagagtgctcttacagtgtctaaaacaggagagcgactggaaagtgctcaagctcgtgctgggacgcctgcccgaaagtctgcgctataaagttctcatttttacttccccgtgcagcgtggatcaattgtgtagtgccctgtgtagcatgctttcaggcccaaagacgctggaaagactgaggggagccccagaagggttctcacggacggatcttcacttggccgtggttcctgtgctgacggccctaatctcttaccataactatctcgataaaacaaaacaacgcgagatggtgtactgtcttgaacagggacttatccacagatgcgcttcgcagtgtgtcgtggcgctatctatctgcagcgtggaaatgcctgatattattatcaaagcactaccagtgctcgttgtcaagcttactcacatctctgcaacagcctccatggccgtgccactgctagagttcctaagcaccctggcacggctgccccacctgtataggaacttcgccgcagaacaatatgcatccgtttttgcaatctctttaccttacactaacccatcgaaatttaaccagtacattgtatgtttggctcatcatgtgatcgcaatgtggttcatacgctgccgcctgccttttcgcaaagactttgtcccctttatcaccaaaggccttcggtcaaacgttctgctctccttcgacgatactccagagaaagactcttttagggcccgttcaaccagcctgaacgagcgaccgaagtcccggatccagacgagtctcacctctgcatctctggggtccgcagacgaaaatagtgtcgcgcaagcagacgattcactgaagaacctgcaccttgaacttacagaaacctgtctggacatgatggcaagatacgtattcagcaattttacggccgtccctaaacggtcaccagtgggggagttcctcctggcgggaggtcgcaccaagacctggcttgttgggaataagctcgtgaccgtgaccacttccgtgggaacaggaacaaggtcactgctgggattggattccggggagctccagtcaggacctgaatctagctcatcacctggcgtgcacgttcgacagactaaggaggctcccgcaaagctggaatcccaggccggtcaacaggtctctcgtggagcaagggacagggtgagatctatgtccggagggcatgggctgagagtgggggctctggacgtccccgctagccaatttcttgggtctgctacatcccctggcccaaggaccgcacccgcagcaaaacccgaaaaagcctctgccggaaccagggtgcccgtgcaggaaaaaactaatcttgccgcatacgtgccactgctcactcagggctgggccgaaatacttgtgcggcgacctacaggtaataccagttggttgatgagtctcgagaatccgctatctccattcagcagtgatattaacaacatgcccctccaggagctgtccaatgcactaatggccgctgagaggttcaaagagcacagggataccgcgctgtacaagtcactctccgtgccagccgcttcaaccgcaaagcctccgcctcttcctagaagtaacactgatagcgccgtagtgatggaggagggcagtcctggggaggtgccagttctggttgaaccgcctggcctggaagacgttgaggccgctcttggcatggacagacggaccgacgcttactctagaagttcctcagtgtcgtcgcaggaggagaagagtctgcatgcagaggagctcgtcgggaggggcatcccaatcgaacgggtcgtttcgtcggagggaggcagaccgagcgtagacctctcgtttcagccatctcagcctctttcaaagtcttctagcagtcctgagctgcagacactccaggatattttaggagatcccggtgacaaggccgatgtgggcagacttagccctgaagtgaaagcacgcagccagagcggcactctagatggagagtcggccgcttggagcgccagcggcgaggactccagagggcaaccagaggggccactccccagctcaagtccccgttccccctcagggctgaggccacgtggatacacaatcagtgatagcgccccttcacgacgcggaaaacgcgtcgagagagacgcgttgaagagcagagcgactgccagcaacgcagagaaagtcccaggaattaacccatcctttgtcttcctgcagctgtaccattcaccctttttcggtgacgaatctaacaagcccatccttctaccgaatgaaagccagtctttcgagaggtctgtacagctgctggatcagatcccctcctatgatacacacaaaatcgccgtactctatgtgggtgaagggcagagtaacagcgaactggctattcttagtaatgagcacggaagctaccgctataccgagtttctgacaggcctgggacgactcatagagctgaaagactgtcaaccagacaaggtttacctcggcggactcgacgtgtgtggggaagacggccagtttacctattgctggcacgacgacatcatgcaggccgtctttcacattgcaacgttaatgcctaccaaggatgttgataagcaccgctgcgataagaagcggcacctaggtaatgacttcgtatccatcgtgtacaacgatagtggagaggacttcaagcttggtactataaaaggccagttcaattttgttcacgtgatcgtgacaccactggactatgagtgtaatctggtgtcactgcaatgtcgaaaagatatggaaggactggttgacactagcgtagctaagatcgtgtccgacaggaatctgccctttgtagccagacagatggctctccacgcaaacatggcttcccaggtgcaccatagcagaagcaaccccaccgacatatacccaagtaaatggatcgctaggctccggcacattaagagactgcgacaaaggatatgcgaggaggcggcttacagtaacccttcgctacctctggtgcaccccccatcccactctaaggcccctgcacagacccctgccgaacctactcccggttatgaagtggggcagcgcaagagactgatctccagtgtggaggattttaccgaatttgttta

SEQ ID NO: 31305 - DNA, 5115 bp, Artificial Sequence
  Description of Artificial Sequence: Synthetic coding sequence
atggccaaacccacgtcaaaagactccgggctaaaagagaagttcaaaatcctgctgggcctcggcaccccaaggcccaaccctagatctgctgagggcaaacagactgaattcattattaccgccgagatcctcagagaactgtcgatggagtgtggtttaaacaatcgcataagaatgatcggacagatctgtgaggtggccaagactaagaaatttgaggagggtgaacggctgggagtcctgcgagcactgtttttcaaagtcatcaaagactatccttcgaatgaagacctgcacgaacgacttgaggtgttcaaggcactgaccgataacgggcgacacattacttatttggaggaagagttggctgactttgtgctgcagtggatggacgttgggctgtcaagcgaattcttgttagtactggttaacttggtcaaattcaatagctgttatcttgacgaatatattgcccgaatggtgcagatgatctgtctactgtgcgtgcgaaccgcttcttctgtggacatcgaagtctctctccaggttcttgatgctgtcgtatgttataactgtctgcccgcagagtccctccctttgttcatcgtcaccctctgccgtacaatcaatgtcaaagagttgtgtgagccatgttggaaattgatgcgaaacttactgggaacccacctgggacacagcgcgatctacaatatgtgccatctgatggaagacagggcctacatggaggacgctcctcttctgcgcggagccgtcttctttgtcgggatggctctgtggggggctcaccgtctctattctcttcgtaactcccctactagcgtgctcccttctttctatcaggcgatggcttgtccgaacgaagtcgtgtcttacgaaatcgtgttgtccatcactcgattgatcaagaagtaccgcaaagaactgcaggttgtggcctgggacatcctgttgaacattatcgagagactgctgcagcaactgcagacgctcgactctcccgagttgaggactattgtacacgatctgctgacaactgtggaggagctgtgtgatcagaatgaatttcatgggagccaagagaggtacttcgaactggtggagagatgtgcagatcagagacccgaatcttcgctgctgaacctcatttcgtaccgggctcagtctatacatcccgctaaagatggttggattcagaatctgcaggccctgatggagagatttttcagaagcgaatctagaggcgctgtgaggataaaggtgctggacgtattgtcgtttgtcttgctaatcaaccgccagttctacgaggaggagctaattaactcagtggtgatctcccagctgtcccacatcccagaggataaagaccaccaggtccgaaagctggccactcagctgctcgtggaccttgcggaaggatgccatacccatcactttaacagtttgttggatatcattgagaaagtcatggccaggagtctgtctccacctccggaacttgaggagagggacgtggccgcatattctgccagtttagaggatgtgaagacagcagtgctgggactgctggtgatcttgcagactaaactttacaccctgccagccagtcacgctaccagagtgtacgagatgctggtgtcacacatccaactgcactataaacacagttacactctgcctatcgcctcttctatcagactgcaggcttttgatttcctgctcttactgcgggctgattccctgcatcgcctcgggctgcccaataaagacggggtcgtgagattttctccttattgtgtgtgtgactacatggagccggagcggggatcagaaaagaaaacaagtgggccactgtcccccccaacaggcccacctgggccagcccctgccggacccgcagtcagacttggatccgttccttactcactgttgttccgcgtcctcttgcagtgcctaaagcaggaatcagattggaaggttcttaaactggtgctgggcagactgccagaaagtctgcgatacaaagttctgatttttacaagcccttgctctgtcgaccaactttgcagcgctctgtgctctatgctttcaggccctaaaacactggaaaggcttcgaggagcacctgagggcttctctaggactgacctgcaccttgctgtagtacctgtgttgactgccctgatttcataccacaactacctggataaaacgaaacagcgggagatggtttattgtcttgagcagggcctcatccataggtgtgcatctcagtgtgtggttgccctatccatttgcagcgtggagatgcctgacataatcatcaaagctttgcctgtgctcgtggtcaaattgacgcacattagtgccaccgctagtatggctgtaccactcttagagttcttatctaccctcgctcgattgccacatttatatcgcaattttgctgctgaacagtacgcgagcgtattcgctatttcccttccttataccaacccgtctaagttcaaccagtatatcgtgtgcctggcccaccatgtgatagcaatgtggttcatacggtgccgactcccctttagaaaggacttcgtgccttttattactaaaggccttaggagcaacgtgctgctgtcctttgatgacactcccgaaaaggactcttttagggccagatccacatccttgaacgaacggcctaagtcccgcattcagacttcgctgacctctgcctcacttggttcggctgacgagaattctgtagctcaagccgacgattctctgaagaacctgcacctggaattgactgaaacatgcctcgatatgatggcaaggtacgtgttctctaattttacggccgtgcccaagagatcccccgtcggcgaattcttactggctggcggacgcactaagacttggctcgtgggaaataaattggtgactgtaaccacgagtgtgggtacaggaacgagatcattgcttgggctcgacagcggagagctccagtctggaccagagagctccagcagtcccggagtacacgttcgtcagactaaggaagctcccgcaaagctggaatcacaggccggacagcaggtctcccggggtgcccgagatagagtgcggtcaatgtccgggggtcatggcctgagagtgggagcattagatgttcccgctagtcagttccttggcagtgcaacttctcctggcccacgaaccgccccagcagcaaagccagaaaaggccagtgctgggactagggtgcccgtgcaagagaagacgaaccttgcagcctatgtgcccttgttgactcagggctgggccgagattttggttcgcaggccgaccggtaacacctcgtggctgatgtcactggaaaatcctctgagccccttcagcagtgatataaataacatgccactgcaagaactatctaatgcccttatggctgctgagcgattcaaggaacaccgtgacaccgcactgtacaagtctttaagcgtacctgcggcatcaaccgccaagccaccacctctccctcggtccaacacagattctgctgttgttatggaggaaggctcacctggtgaggttcccgtcttagttgagccacctgggctggaagacgtagaggctgcacttggcatggacaggaggactgatgcttacagccgttctagctcggtatcttcccaggaggaaaaatcacttcacgctgaagaacttgttggtaggggcattcccattgagagggtggttagctctgaaggcggacggccaagtgttgacttgagcttccagcccagccagcccctgtctaagtcttccagctcccctgaattgcagactctgcaggacattctgggcgaccctggtgacaaggcagatgtaggaaggctctctcccgaagtgaaggccagaagtcaatcaggaacgttagacggagaatctgctgcttggagtgcatctggggaagactctagaggacaacccgagggaccgctcccatcgtcgagtcctcgaagtcccagcgggctgaggcctcgcggttacactatttcagacagtgccccaagccgaagggggaagcgggtggaaagggacgcactaaagtcccgggctactgccagtaacgcagaaaaagttccagggatcaacccctccttcgttttcctgcagttgtatcatagccccttcttcggggatgagtctaataagcctattctgctccctaatgaaagtcagtcttttgagcgctccgtgcagctgctagatcagatcccttcctatgacacgcataaaatcgccgtgctgtatgttggtgaaggacaatctaactctgagctggcgatcctcagcaacgaacatggctcctatcgctatacagaatttctgactgggcttgggagactgatagagctgaaagactgccagcccgacaaggtgtatctgggaggcctcgatgtgtgcggtgaggacgggcagtttacttactgctggcatgatgatatcatgcaggctgtctttcatatcgctacccttatgcccactaaagacgtggataagcatcggtgtgataaaaaacgccacctgggtaatgacttcgtgtccatagtctacaacgattcaggagaagattttaagctgggaactattaagggccagtttaacttcgtgcatgtcatcgtgacccctttagattacgagtgcaatctggtttccctccaatgcagaaaggatatggaaggtcttgttgacaccagcgttgccaagatcgtctctgatagaaacttaccctttgtggccagacagatggccttacacgcaaacatggcgagccaagttcaccacagccgctccaaccctaccgacatttatccttccaaatggatagctcgccttcggcacattaaacgcctcaggcaacggatatgcgaagaagccgcttatagtaacccctcgctgccactcgtgcaccccccaagccacagcaaggcacctgcgcaaacacccgcagaacccacccccggatacgaggtggggcagagaaagaggctcatatcaagcgtggaggattttacggaattcgtgtag

SEQ ID NO: 31306 - DNA, 516 bp, Artificial Sequence
  Description of Artificial Sequence: Synthetic coding sequence
ttcccaagggatctcagccttatcagtcccttggcccaggccgtcaggtcctctagtcgcacaccctcagataaaccagttgcccatgtggtggccaatccccaggccgaggggcaactgcagtggctcaataggcgggcaaatgccctgctcgctaacggggttgaattgcgggataatcaactcgttgtgcctagcgaaggtctctacctgatatactctcaagtgctgtttaaaggtcaagggtgtccatctacacacgtgctcctcacccacactatttctcgaatcgccgtgagctatcaaactaaggtcaaccttctgagtgccattaaaagtccatgtcagcgggaaacccccgaaggtgcagaggcgaaaccgtggtatgagccaatttacctgggcggtgtgtttcagttggagaaaggagaccgactatccgccgagataaacaggcccgattacctagactttgccgaatctggccaggtgtacttcggtattatcgccctgtag

SEQ ID NO: 31307 - DNA, 306 bp, Artificial Sequence
  Description of Artificial Sequence: Synthetic coding sequence
atggcaatgatggaggtgcagggtgggccaagtcttggccaaacctgcgtgcttatcgtcatttttactgtcctgttacagagcctgtgtgtggctgtgacatacgtttactttacgaatgagctgaagcagatgcaggacaagtactctaagagtgggattgcatgcttcctgaaggaagacgacagctactgggatcctaatgacgaggagagtatgaattctccctgctggcaggtgaagtggcaactgcgccagttagtgcgcaaaaccccccgaatgaagcgcctctgggcagccaagtag

SEQ ID NO: 31308 - DNA, 846 bp, Artificial Sequence
  Description of Artificial Sequence: Synthetic coding sequence
atggccatgatggaggtacagggcggaccctcactggggcagacctgtgtactcattgtgatctttacggtgctgctccagagcctgtgcgttgcagttacttacgtgtatttcactaacgaattgaagcagatgcaagacaagtattccaaaagtggaatcgcctgcttccttaaagaggatgattcttactgggaccccaatgatgaagagtccatgaacagcccttgctggcaagtgaagtggcagttgcggcaactggtgcgaaagatgattttacgaacctccgaagagacgataagcaccgtccaggagaaacagcagaatattagtccactggtaagggaacgaggcccacagcgggtggctgctcatatcaccggaacaagaggaagaagcaacacactgtctagtcccaattctaagaacgagaaggcgctaggtaggaaaataaacagttgggagtcttcgagaagcggccactccttcctgagcaatttgcatctcaggaacggagagttagttatccatgagaaaggattttactacatttattcacaaacatattttcgcttccaggaggaaatcaaggaaaatacaaaaaatgacaagcaaatggtgcaatatatttacaaatatacctcctatcccgatcccatccttcttatgaagagcgcacgcaacagctgctggtccaaggatgctgagtacggcctctatagcatttatcagggtggaatctttgagctcaaagaaaatgatagaatctttgtgtccgtgacgaatgagcacctaattgatatggatcacgaggcatctttcttcggagctttcctggtcggctag

SEQ ID NO: 31309 - DNA, 858 bp, Artificial Sequence
  Description of Artificial Sequence: Synthetic coding sequence
atggatgatagcactgaaagagagcagtctcggttgacatcttgcctgaagaagagagaagaaatgaagcttaaagagtgtgtgagtattctgccccgtaaggaatcaccatctgtcaggtctagtaaagatggcaaactccttgcagctactctgctgctcgctctgctgtcatgctgcctgaccgtcgtgagtttctatcaggtcgcagcactgcaaggcgatctggcatcattacgagccgaactgcaggggcatcacgcagaaaagcttccggcaggagccggagctccgaaagccggattggaagaagcccctgcagtcactgccggtctcaagatctttgagcctccggcaccgggtgaggggaatagctcccaaaactccaggaacaaacgtgccgtacagggtccggaagagaccgtaacccaagattgtttacagctaatcgcggactccgagacccccactattcagaaaggctcttatacgtttgtaccgtggctcctcagctttaagcgcggttctgcattagaagagaaagaaaacaagattctcgttaaagagacaggctatttctttatatacggtcaggtactgtatacagacaaaacctacgcaatggggcacctaatacagagaaagaaagtgcacgtcttcggggatgaactaagcctcgtgaccttattcaggtgtattcaaaacatgccagagacactacctaataacagctgctactccgctggcatcgccaagcttgaagaaggggacgaactccagcttgccataccgcgtgaaaatgcacaaatttccctggacggcgacgtcacatttttcggagcgctgaaactgctatag

SEQ ID NO: 31310 - DNA, 801 bp, Artificial Sequence
  Description of Artificial Sequence: Synthetic coding sequence
atggatgactccacggaacgggaacaatctcgcctaaccagctgcctcaaaaagagagaggagatgaaactgaaagagtgcgtcagtatcctgccacggaaggagtcacctagtgtgcggagtagtaaggacggcaagcttctcgcagccacgctattgcttgcactcctgtcttgctgcttaactgtggtctcattctatcaagttgctgcgcttcagggtgacctagcctcgctgcgcgcagagctacaaggccaccatgcagaaaagctgcccgcaggcgcaggggcacccaaggcaggactggaggaggctcccgctgtcactgccggattaaagatctttgaaccacccgctcctggtgaagggaactcaagccaaaactcacgcaacaagcgcgctgtacagggccctgaagagaccgggtcatacaccttcgtgccttggcttttgagtttcaagagagggtccgccctggaggagaaggaaaacaagatcctcgtgaaagagaccggctactttttcatttatgggcaggtgctgtataccgacaaaacatatgcgatgggacatctgatacaacgcaaaaaagtacatgtgtttggcgacgagctatctctggtgacccttttccggtgtatacagaacatgccagagaccctgccgaataatagctgctacagtgccggtattgccaaattggaggagggggacgagctgcagcttgctattcctcgcgagaacgcgcaaatcagtctcgatggggatgtgaccttttttggtgccctcaaactcctctag

SEQ ID NO: 31311 - DNA, 495 bp, Artificial Sequence
  Description of Artificial Sequence: Synthetic coding sequence
atggatgactctaccgagagggaacagagtaggctgactagctgcctcaaaaagcgagaagaaatgaagcttaaagagtgtgtgtctatcttacctagaaaggagtctccttcggtgcggtccagtaaagatggaaaattgctggctgctacactcctgttggctctgctttcatgttgtctgacagtggtgagtttttaccaggtggccgcactgcagggggatctcgccagcctgagagcagagttacagggacaccacgccgagaaactcccagctggggctggcgcacccaaggccggtttagaagaggccccagctgtcactgcaggcttgaagatatttgagccccctgcccctggagagggcaactccagccagaacagcaggaataaaagagcagtccaagggccagaggaaacggtgacacaggactgcttacaactgattgccgattctgagactcctaccatccagaaagggttcatttattag

SEQ ID NO: 31312 - DNA, 2700 bp, Artificial Sequence
  Description of Artificial Sequence: Synthetic coding sequence
atgcctacgctaggttggctccccgagaaccgtgatatctcagaggatcaaagcagtgctgagcagacccaggctctggcatcccaggccagccagtttctagctaaagtggagagctttgagcgtcttattcaagctggacgtctgatgccgcaggaccaggttaaggggtttcagcgtctgaaggcagcccacgccgctttggaggaagagtatttaaaagcgtgccgcgagcagcaccccgcacaacctctggccggttctaagggaacacctggcagatttgacccccgacgagaacttgaggctgaaatctacagattaggctcctgcttggaggaactcaaggagcacatagatcagactcagcaggaacccgagcctccaggttccgattccgctctggactcaacgcccgctctaccttgtctccaccagcctacacatctgccagcacccagcgggcaagcccctatgcctgcaataaaaactagctgtcctgaacctgccactacaacagccgcagcttctacaggtccctgccctctccacgtgaatgtggaggtatcctcagggaacagtgaggttgaggatcggccacaggatcccctcgccaggctgcgacacaaagaactgcaaatggagcaggtgtaccacgggctgatggaacggtacctgagcgtaaagtctctgccagaggctatgagaatggaggaggaggaagagggcgaagaggaggaggaagaagaggggggaggagacagcctagaggtggatggagttgctgcaacgcctggcaaggctgaggctacccgtgtcctgcccagacagtgccccgtccaggcggaaaagtcacacggcgctcctctagaagaggccacagagaaaatggtaagcatgaaaccaccagggttccaggcctctttggcgcgagacggacatatgagcggcctcgggaaagctgaagctgccccaccaggccctggtgtcccccctcacccccctgggaccaaaagtgccgcttcccatcagtcttcaatgacctctctcgaaggtagcgggatatcggagcgtttgccccaaaaaccattgcatcgtggtggcggaccacacctggaggagacctggatggcttctcctgagactgactcaggattcgtgggaagtgaaaccagccgcgtctccccactgacccagacccctgagcaccgtctatcccatatttccacagccggtacccttgcccagccgtttgccgcatctgtccccagggacggcgctagttatcctaaagccagaggcagcctcataccacgtagggccactgaaccatctactcccaggtctcaggctcagaggtatctcagttctccatccggtccgttacggcagcgcgctccaaacttctcccttgaacgcacattagccgcagaaatggctgtgcccggttcagaatttgagggtcataagaggatttccgagcaacctctccctaacaagaccatctcccccccacctgcacctgcccctgctgccgctcctcttccctgtggaccaaccgagaccataccctcattcctccttactcgcgctggacgagatcaggccatttgcgagctacaagaagaagtgtcgcgactccgacttaggctggaagactcactccaccaacccttacaaggcagccctactcggcctgctagcgcttttgatcggcctgctcgaacaagaggccgtcccgcagacagccccgctacctgggggtctcactatgggagcaaaagcacagagcgacttccgggagaaccacggggagaggaacaaatcgtgccacccggacgtcagcgcgctagatcatctagcgtgcctcgggaggtgttgcggttatctctgtcctcagaatcagaactccccagcctccccttgttctcagaaaagtccaagactaccaaggattctccacaggccgctcgggatggaaaacgcggagttgggtcggccggttggcctgacagagtgaccttcaggggccagtatacggggcacgagtaccacgtcctgagccctaaagctgtgccaaaaggcaatggaactgtgagctgtcctcattgtcgcccaatcagaacccaagatgccggaggtgccgtgacaggtgacccactgggtcctcctccggctgacaccctgcagtgtccactttgcggccaagtggggtcccccccagaggctgatggacctggcagcgcaaccagcggcgcagagaaggcgaccactcgccgtaaggcttcaagcacaccctcaccaaaacagcggagcaaacaggctggctccagcccacgccctccccctgggctttggtatctagccacagcccctcctgcacctgctccacccgcttttgcctatatcagttctgttcctatcatgccttatccccctgctgccgtctattacgcccctgccggtccaacctctgctcagccagcagccaagtggcccccaactgcttctccacctccggcacgaaggcaccgccacagtatccagttggacctaggtgatctggaggaactgaataaggctctttcaagagccgtgcaggccgctgagtcggtgcggtccaccacacgacagatgcgatcaagtctttccgcagacctgcgccaggcccattccttgcggggaagctgtttgttttag

SEQ ID NO: 31313 - DNA, 1569 bp, Artificial Sequence
  Description of Artificial Sequence: Synthetic coding sequence
atggcgcttctgccacgtgcgctgtcagcaggggctgggccatcctggagacgcgcagcacgcgctttccggggattcctcttactcctacctgaacccgctgccctcaccagggctctgtccagggctatggcgtgcagacaggagccccagccacagggaccccctccagccgcaggggcagtcgccagctatgactatctggtgataggaggcggttcgggagggctggccagtgccagacgggcagctgaattgggagccagggccgctgtcgtggagagtcataaactaggaggtacgtgtgtgaatgtaggatgtgtgccaaaaaaagttatgtggaacactgctgtgcattctgaattcatgcacgaccatgcagattacggctttcccagctgcgagggtaagtttaactggcgcgtgatcaaggagaagcgagacgcttacgtgtctaggctgaatgcaatctatcagaataaccttaccaagtcacatatcgaaataatccgcggacacgcagcctttacctctgaccccaaacctaccattgaagtgtccggcaaaaagtacacggctccccacattctgatcgctacagggggaatgccttctactccccatgaatcacagatacccggtgcctcgctcggcatcacctccgatgggttctttcagctggaggagctccctgggaggtccgttatagtgggcgcaggctatatcgccgttgaaatggcagggatactgtctgccttaggcagcaaaacctctctgatgatccgacatgataaagtgctaagatctttcgatagcatgatctccaccaattgtacagaagagctggagaacgcaggcgttgaggttttgaagttcagccaggtcaaagaggtgaaaaaaacattgtctggcttggaggtgtcaatggtcaccgcggtccctggccgactgccagttatgacaatgattccagacgttgattgcctgctgtgggccatcggacgagttcctaacaccaaagatctgtcgctaaataagctcgggattcagactgacgataagggacacatcatcgtggacgaatttcagaacacaaacgtgaaaggaatctatgcagttggagacgtgtgcggcaaggcactccttacaccagtcgccattgctgcagggcgtaagttggctcaccgcttgttcgaatacaaagaagactctaaactcgattacaataacatccctactgtcgtgttctcccatcctcctatcggaactgtcggtctcactgaggacgaggcgatacacaaatacgggatcgagaacgtgaagacttactctacgagcttcacccccatgtatcacgcggtgacaaagagaaagacgaagtgtgtcatgaagatggtgtgcgccaataaggaggagaaggttgtcgggatccacatgcaggggttgggctgtgatgagatgctccaggggtttgcggttgcggtcaagatgggagccaccaaggcagattttgataacactgtcgcgatccatcccacaagttctgaagagctggtgactcttcggtag

SEQ ID NO: 31314 - DNA, 1323 bp, Artificial Sequence
  Description of Artificial Sequence: Synthetic coding sequence
atggagcagcgagggcagaatgctcctgccgcttccggtgccaggaaaagacatgggccagggcctagagaagctaggggtgccaggccgggtccccgagtgccgaaaaccctggtgctcgtcgtggcggcagtgctcctgctggttagcgccgagtcagctttaattacacaacaggacctggcccctcagcagagagctgcccctcagcagaaacggtctagtccctctgaaggtctttgcccgcctgggcaccacatcagcgaagatggtcgggactgcatctcttgtaaatatggacaggactactctacccattggaacgacctccttttttgtctgcgttgtacccggtgtgactcgggtgaggtcgaactgtccccttgtacgacgacccggaatacagtctgccagtgtgaggaaggaacatttagagaagaggacagcccagaaatgtgtcgcaagtgcagaactgggtgcccaagaggaatggttaaggtcggggactgcacaccgtggagcgatattgaatgcgtgcataaagagtcaggaaccaaacatagcggagaggtccccgctgtagaggaaactgtaacttcctccccaggtactcctgcatcaccgtgttccctgtcaggaattatcatcggcgttacggtggccgctgtggtccttattgtggccgtttttgtgtgcaaatccctcctttggaagaaggtgctaccctaccttaaggggatctgtagtggtgggggtggagatcccgagcgggtggataggtctagccagcgccctggggctgaagataacgtgctaaatgagattgtgtccatcttgcagccaacccaggtgccagagcaagaaatggaggtgcaggagccggcagagcctactggcgtcaatatgctgagtcccggtgagtccgaacacttactagaaccagccgaagccgaaaggagccagcgtagaagattgcttgtgcccgcaaacgaaggcgaccctacagagaccctccggcaatgttttgacgatttcgcggacctggtgccattcgactcgtgggagcctctgatgcggaaactgggattaatggataacgaaataaaggtagcgaaagcagaggccgctggtcaccgtgatacactgtacacaatgttgatcaaatgggtcaataagactgggagggacgcctccgtacataccctgcttgatgctcttgaaactctgggagaaagactggcaaaacagaaaattgaagaccacctcctcagctccgggaaattcatgtacctagagggcaatgcggatagtgctatgagctag

SEQ ID NO: 31315 - DNA, 1236 bp, Artificial Sequence
  Description of Artificial Sequence: Synthetic coding sequence
atggagcagagggggcagaatgcccctgcggcttcaggcgcacgcaagagacacggcccaggcccacgagaagccagaggggcacgccctggccctcgggtgcccaagacactagtgctagtcgtcgccgctgtactgctgttggtgtcagcggagagtgcactcattactcaacaagatctggcacctcagcagagggcagcccctcagcagaagaggtcatcaccaagcgagggactctgcccacccggacaccacatttccgaagacggtcgcgattgtataagctgtaagtacggccaggattattctactcattggaacgatctgttgttctgtctccgatgtacaagatgtgactccggcgaggtcgaactgtcgccttgtaccaccaccagaaacactgtatgtcagtgcgaggagggcactttcagggaagaagactcccctgaaatgtgtcggaagtgtagaaccggatgccctcggggaatggtgaaggtgggggactgcacgccatggtcagacatcgagtgtgtgcataaggagagcggaatcatcatcggagtgacagtcgcagccgttgtgctgatcgtcgcggtcttcgtctgcaaaagcctgttatggaaaaaggtattaccctatctaaaaggcatttgctccggagggggaggcgatccagaaagggtcgaccgaagcagccagcgcccaggcgctgaggacaatgtcttgaacgaaatcgtatcgatactccaacctacacaggtgcccgagcaagagatggaggtacaggaacccgcagaacctacaggggtgaatatgctttcccctggcgaaagcgaacatcttctggaaccggctgaagctgagcgtagccagcgacggcgacttctggtgcccgctaacgagggagatcccacagaaactctccgacagtgttttgacgatttcgctgatctggtgccgtttgatagctgggagcccctgatgcggaaactcgggctgatggataatgaaataaaggtggccaaggctgaggccgcaggacatagggatacgctatataccatgcttatcaagtgggtcaataaaacagggcgtgacgccagtgttcacacactcctggacgcactggagactttgggcgagcgcctggccaagcagaagatagaggatcacctcctctcatcagggaaatttatgtaccttgaaggtaatgccgatagcgctatgagttag

SEQ ID NO: 31316 - DNA, 783 bp, Artificial Sequence
  Description of Artificial Sequence: Synthetic coding sequence
atgtgcaggaaatgcagaactggatgccctagggggatggttaaggtgggcgactgcacgccatggagcgacattgaatgcgtgcacaaggaaagcggcatcattatcggtgtgaccgttgcagccgtggtgctcatcgtggccgttttcgtgtgtaaatctctgctttggaaaaaggtcctgccttatctgaagggaatttgcagcggcggtggcggagatccggagcgagttgatcggtcatcccagcgccctggcgctgaggacaacgtgttaaatgaaattgtctccatcctgcaaccgactcaggtgcccgaacaggagatggaggtccaggaacccgcagagcctaccggggtaaacatgctcagtcctggagaaagtgaacacttgttggagcctgccgaagccgaacgctcccagagaagacgcctattggtgccggcaaatgaaggcgaccccaccgagaccctccggcagtgctttgacgacttcgctgacctggtgccctttgactcatgggaaccactaatgaggaagttgggcctgatggataacgaaattaaggttgcaaaagccgaagcagctggtcacagggatacgttgtacaccatgctcataaagtgggtgaataaaaccggaagagacgcgtccgtccacacactcctggacgcgctggagaccctcggtgagagactggccaaacaaaagatcgaggaccatctgctatcaagcgggaaattcatgtatctggaaggcaatgcagatagtgctatgagctag

SEQ ID NO: 31317 - DNA, 1161 bp, Artificial Sequence
  Description of Artificial Sequence: Synthetic coding sequence
atgggcctctggggacagagcgtaccaaccgcctctagtgccagagcagggagataccctggtgccagaacagcatccggaactaggccctggctgctggatcctaagattcttaaatttgtggtattcatagtcgcagtgctgctccctgtccgggtagattctgcaacaatccctcgccaagacgaggtgccccagcagactgttgccccacagcaacagagacgatccctcaaggaggaggagtgtcctgctggctcgcaccggagcgaatacaccggagcctgcaacccatgcacagagggcgtggattacaccatagcatccaacaacttaccctcctgcctgctgtgcaccgtgtgcaagtcgggacaaacaaacaaatcctcttgcacaaccactagggacacggtgtgtcagtgcgagaagggctcttttcaggacaagaactctccggagatgtgtcggacctgcaggactggatgcccaaggggaatggtgaaggtctctaattgcacgccacggtccgacatcaaatgtaagaatgaatccgcggctagctcaaccggcaagacgccagcagctgaggaaaccgttaccacaatcctgggtatgttagcaagtccgtaccattacttaattattatagtcgtcctggtgataatcttggccgtcgtagtcgtggggttttcatgcagaaaaaagttcatttcctacctcaagggtatctgctccggaggcggtggtggcccagagagggttcacagggtgttgtttcgcagacggagttgcccttcccgtgtgccaggggcagaggacaatgctcggaacgagacactgtccaacaggtatctccagcccacccaagtctcagaacaggaaatccagggacaggagctggccgagctgactggagtgaccgtcgaactgccagaagagccccagagattgcttgagcaagccgaggccgaggggtgccaacgcagacggctgctcgttcctgtgaatgacgccgatagcgccgacataagcacccttttggatgcgtccgccactcttgaggaggggcatgccaaggaaaccatccaggatcagcttgtgggttcggagaagcttttctacgaagaagacgaagccggttccgccacatcctgcctctag

SEQ ID NO: 31318 - DNA, 1368 bp, Artificial Sequence
  Description of Artificial Sequence: Synthetic coding sequence
atgggcctgagtaccgtccctgatttgttgctgccccttgtgcttctagaactgctcgtgggtatttacccttcgggagtgataggcctcgtgccccacttaggagacagagagaagcgcgactctgtgtgtccacagggaaagtatattcaccctcagaataactccatttgttgtactaagtgtcataagggaacgtatttatataacgattgccctggtcctgggcaagatacagactgtagagaatgtgaatctggatcattcactgcttctgagaaccatctgcgacactgtctgtcctgcagcaaatgccggaaagagatggggcaagtggaaatctcgtcctgcactgtcgacagggacacagtgtgtggttgccgcaagaaccagtatcgtcattattggagcgaaaatctgtttcagtgcttcaattgctcactctgtctgaacggcaccgtccatctctcttgtcaggagaaacaaaatacagtctgtacatgtcacgctggtttcttccttcgcgagaacgagtgtgtgtcttgtagcaattgcaagaagagccttgaatgcaccaaattgtgccttccgcagattgagaacgttaaaggcactgaggatagcggtaccaccgtactcctgccccttgtcatcttcttcggcctgtgcctactgagtctcctattcataggcctgatgtatagataccagcgctggaagtcaaagctttattctattgtctgcgggaagtccacccccgaaaaggaaggggaacttgagggcaccacaaccaagccactcgctcctaacccgtcattctcgccaacacccggattcacaccgacgctaggtttcagccctgtgcctagttccacatttacgtccagcagtacgtatacgcccggtgactgccctaacttcgcagcccctagacgggaggtcgcacccccatatcagggagcagatcctattcttgccaccgccctggcatctgatccaatacccaatcctctgcaaaaatgggaggactctgctcataaacctcagtctctggacactgatgatccagcgaccttgtacgccgtggtggagaacgtgcctcccctccggtggaaagaattcgtcaggaggcttggactcagcgatcatgagatagacagactggagctgcagaacggtaggtgtttgagggaagctcagtatagcatgttggctacgtggaggcggcgtacccctcgccgagaagcaacactcgagctcctcggcagggtcttgagagacatggatctcctgggttgtctggaagatatcgaagaggcactgtgcggccctgctgcgctccccccagcgccttccctcctgagatag

SEQ ID NO: 31319 - DNA, 657 bp, Artificial Sequence
  Description of Artificial Sequence: Synthetic coding sequence
atgggactttccaccgtccccgaccttttgttgccccttgttctgctggaactgctagttgggatctatccctctggcgtcattgggctagtgccccacctgggagaccgcgaaaagagggacagcgtgtgccctcaagggaagtatattcacccccagaacaactccatttgctgcacaaagtgtcacaaaggtacatatctatacaatgactgcccaggcccaggacaggacaccgactgtcgggagtgcgagtccgggagtttcactgctagcgaaaaccatctgagacactgcctcagctgcagtaaatgccggaaagagatgggccaggtggagatctcgtcctgtacagtggaccgggacacagtctgtggctgtagaaagaaccagtaccgtcattattggtcagagaacctgtttcaatgttttaattgttccctgtgtctcaacgggacggtgcacctctcatgtcaggaaaaacaaaacaccgtctgcacgtgtcatgcaggattcttcctgagggagaatgaatgtgtcagttgttcaaaggtactgctgtgcagaccaggctggaacgccgtggcccgaagcagattgactgccacttctgcctcccaaatccaggctattctgttgctgcaacctcccaagtag

SEQ ID NO: 31320 - DNA, 1386 bp, Artificial Sequence
  Description of Artificial Sequence: Synthetic coding sequence
atggcccctgttgcagtttgggctgccttggctgtgggtctagagctgtgggctgctgcccatgccctgccagcacaggtggctttcaccccctatgcgccagaacccggaagcacctgtcgcctgagagagtactacgaccagaccgctcaaatgtgctgctctaaatgttcaccagggcagcacgcaaaggtcttttgtactaagacgagtgatactgtgtgcgactcttgcgaggatagtacctacacccagctctggaactgggtgcccgagtgcctttcatgcgggagccggtgctcaagcgatcaggtggagacacaggcatgcactagagagcagaaccgaatctgtacatgtcggccaggctggtattgcgcactcagtaaacaggagggatgtaggttatgtgcaccgctgcgcaagtgcaggcccggattcggagtcgcaagaccaggaactgaaacatcagacgtggtctgcaagccttgcgcccctgggaccttcagcaatactactagcagcacagacatctgtcgtcctcatcagatttgcaacgtggtagccatccctggaaatgctagcatggacgccgtgtgtactagcacatcacccactcggagcatggcccctggggcagttcatctcccacagcctgtctccacacgatcccagcatacccagcctactcccgaacccagcaccgctccctccacgagttttctgctccccatggggccatccccgcctgccgagggttcaacaggcgactttgctctgcccgtgggcctcatcgtgggggtgaccgctctgggtctgcttattatcggtgtagtgaattgcgtcattatgacacaggttaagaaaaagcctctgtgcctccagcgggaagccaaggtgccacatctgcccgctgacaaagcgaggggaacccagggcccagagcagcaacacctgctaatcacggcgcctagctccagctcttcgtccttagagtctagcgcgtccgcccttgacagaagagcgccaaccagaaatcaaccacaagcgcctggcgttgaagcttccggtgcgggagaggcgagagcctccaccggctcttccgattctagccccggtggccacggaactcaggttaacgtgacctgtattgtgaatgtttgttcttcatccgaccatagctcccagtgcagctcccaggcatcatccactatgggagacacggattccagtccatctgaatcaccgaaagatgagcaggtgcccttctcaaaggaggagtgcgcgtttcgctcccagctggagactccggagaccttattagggagtaccgaggagaagccattgcctcttggtgtaccagacgctggcatgaagccttcctag

SEQ ID NO: 31321 - DNA, 807 bp, Artificial Sequence
  Description of Artificial Sequence: Synthetic coding sequence
atggctccagtggctgtctgggcggctctcgctgttgggctcgaattgtgggctgcagctcatgcgctccctgcccaagtggcctttaccccctacgcgcctgaacccggtagcacatgtaggctacgcgaatactatgaccaaacagcacaaatgtgctgcagtaaatgtagccctggtcagcatgccaaggtgttttgcaccaagacctcagataccgtctgcgactcctgcgaggattccacatatacacagctgtggaattgggtgccagaatgtttgagttgtggctcacggtgttcttctgatcaggtagagacccaggcctgcacccgcgaacaaaaccggatctgcacctgccggcctgggtggtattgtgctctgagcaagcaggagggttgcaggctttgtgcccctctccggaaatgccgcccaggctttggagtggccagacccggaacagagacgtccgatgttgtgtgtaagccctgcgcacctggaactttcagtaatactacttccagcaccgacatttgtcgaccccatcagatttgcaatgtggtcgcaatcccagggaatgcctcgatggatgcagtgtgtaccagcacttcgcccacccgaagcatggccccaggagctgtacatctgccccagccggttagtactagaagtcagcatacccagcccactcccgagccttcgactgccccatccactagctttcttctacccatgggaccctcccctcctgcagaggggagtacaggagatttcgccctccccgtggtgtcactgtcttcgagttag

SEQ ID NO: 31322 - DNA, 468 bp, Artificial Sequence
  Description of Artificial Sequence: Synthetic coding sequence
atggcccctgtcgctgtgtgggctgcgctggctgtggggctcgaactgtgggcagcagcccatgctctgccagctcaggtggccttcacaccttacgcacccgagcccggtagcacatgtcggctccgagaatactacgatcagacggcacaaatgtgttgctcaaagtgtagccccggtcaacatgctaaggtgttctgtaccaagacgtcagacaccgtctgcgatagttgcgaggattcaacctacacccagctgtggaattgggtgccggagtgcctgagctgcggcagccgttgctcgtccgatcaggttgagacccaggcctgtacacgcgagcagaacagaatatgcacgtgtaggccgggatggtattgtgccctctctaagcaggaaggatgcaggctttgtgcaccattgcgaaagtgccgccctggctttggagtggctcgccctgacctgagctag

SEQ ID NO: 31323 - DNA, 114 bp, Artificial Sequence
  Description of Artificial Sequence: Synthetic coding sequence
atggctcctgtggccgtctgggcggctctggccgtgggtctggagttatgggctgccgctcacgcactaccagcacaggtcgatcccggtccattatttccccatccaggctag

SEQ ID NO: 31324 - DNA, 1968 bp, Artificial Sequence
  Description of Artificial Sequence: Synthetic coding sequence
atggggacgtcaccttcaagcagcaccgccctagcctcctgttccagaatcgcccgaagagccacagccactatgattgccggttctctgctgctgcttggattcctatcaacaactacagctcaacccgagcaaaaggctagtaacctcataggcacgtaccggcacgtcgatagagctaccggccaggtcctgacctgcgacaaatgtccagctggcacctacgtatctgagcactgcacgaatacgtccctgagagtctgctcatcctgccccgtgggaacttttactagacatgagaatggaatagagaagtgccatgactgctctcaaccatgtccctggcccatgatagaaaagctcccttgcgctgcgcttacagaccgcgaatgcacctgcccaccaggaatgttccagtctaacgctacttgcgcccctcatacagtatgtcctgtgggatggggcgtgcgaaagaaaggcactgaaactgaggacgtgcgttgtaaacagtgtgctcgcggtacatttagtgatgtcccatcaagcgtaatgaagtgcaaggcatacacggattgtctctcccagaatcttgtggtgatcaagcccggtacaaaggaaaccgacaatgtttgcgggacactgccatccttctcttcttcaacctccccatccccagggaccgcaatcttcccacggcctgagcacatggaaacacacgaggtgcccagctccacctatgtacccaagggcatgaacagcacggaaagcaatagctctgcatcggtgcggcctaaggtgttatcatccatccaagaggggaccgtgcccgataatacttcctcggctcggggtaaggaagacgttaataagacattgcccaatctgcaggtcgtaaatcaccagcaaggtccgcatcacaggcacatcctgaaactgctcccatctatggaagccacaggtggggaaaagtcttcaaccccgatcaagggccctaagcgaggacaccccagacagaacctgcacaagcactttgacatcaacgagcaccttccttggatgatcgtgctcttcctgctgctggtcctggtggtaattgtcgtatgtagtatccgcaaatccagccgcaccctgaagaaggggccaagacaggatccatctgctatcgttgaaaaagctgggctcaagaaatccatgacccctacccaaaaccgggaaaagtggatatattattgcaatggccatggtattgacattctgaagctcgtagccgctcaagtgggcagccaatggaaagacatctaccagtttctttgcaatgcttccgaacgcgaggtggctgccttttctaacgggtacacagctgatcacgagagagcctatgcagccctgcagcattggacaattcgcggacctgaggcaagtctggcgcagttgatctcagctctaagacaacaccggagaaacgacgtggtagaaaaaatcaggggtttgatggaggacactacccagttggagacagataagctggcactgcccatgtccccatctccgctgagtccatcgccaatacctagccctaacgccaagctcgagaatagtgccttgttgacggtggaaccctccccccaagataaaaacaaagggttttttgtggatgagagcgaacccttgcttcgatgtgattcaactagcagcggtagctctgccctcagtcgcaacggttcatttatcacaaaagaaaaaaaagacaccgtccttcgtcaagtcagactggacccatgcgatcttcaacccatctttgacgacatgctgcattttctgaatcccgaagagttgcgtgtgatcgaggaaatccctcaagcagaggacaaactggacagactgttcgaaattattggcgttaaatctcaagaggcttcccagactttgctggacagcgtttactcccacttacctgatctgctctag

SEQ ID NO: 31325 - DNA, 1035 bp, Artificial Sequence
  Description of Artificial Sequence: Synthetic coding sequence
tcttgctgtcgcccttggagacctctgggtgcacgatctcctgcccgtcctagtcgccctaagcgcggtcatccgaggcagaacctccacaagcatttcgacatcaatgagcacctcccctggatgattgtgttattcctgctgctcgtccttgtggttattgtcgtgtgctctataagaaaatcatctaggacactcaaaaagggtccaaggcaggacccgtcagccatcgtagaaaaggccggactgaaaaagagcatgactccaacccagaatagggaaaagtggatctattactgtaatggtcacggaatagatatcttgaaactggtggccgctcaggtcggctctcagtggaaggatatatatcagttcctctgcaatgcttctgagagggaagtcgcagcgtttagcaatggctatactgcggatcacgagcgggcatacgcggcactgcagcactggactattcgtgggccagaggcttcccttgcgcagctgatcagtgctctgcgccagcaccggcgtaacgacgtagttgaaaaaatccggggtctgatggaggacacgacacagctggaaactgataagctggccctgccaatgtcacccagccctctgtctccaagcccgatccccagcccgaatgctaagctagaaaacagtgcactcctcactgtggagcctagccctcaggacaagaataaagggttcttcgtggacgagtccgagccactactcaggtgcgattcgaccagcagcggttctagcgccctgtctcggaatggctccttcatcactaaggaaaagaaagacaccgtgctgcgccaggtgcggctggacccttgtgatcttcaacccatcttcgacgacatgttgcactttttgaatccagaggagctccgcgtgatagaggagataccgcaggctgaagacaagctcgatcgcctgttcgagatcattggggttaagtcccaagaggcttcccaaactcttctcgatagcgtttattcacacctgcccgacttgctatag

SEQ ID NO: 31326 - DNA, 1119 bp, Artificial Sequence
  Description of Artificial Sequence: Synthetic coding sequence
atggaacagaggcctaggggctgtgctgctgtggcggctgccctgttgttggtcttacttggcgctagagctcaaggcggaacccggtccccacggtgcgattgtgcaggtgacttccacaagaaaatcggcttattctgttgtcggggttgccctgccgcttcccaagtcgctctggagaattgcagcgccgtggctgacacccgatgcgggtgtaaacccggttggttcgtagaatgtcaggtgtctcagtgcgtttcctcctctccattctattgccagccgtgccttgactgcggtgcgctccatcggcacaccaggttgttgtgctcaaggcgggacactgactgcggcacttgtttaccagggttctacgagcatggcgacggctgcgtgagttgtccaacgagtacactggggtcttgcccagaaaggtgtgccgctgtgtgcgggtggcggcagatgttttgggtccaggtgctgcttgcgggactggtggtgcccctcctgctcggggctacacttacctacacatataggcactgttggccacacaagcctcttgtcaccgcggacgaggctggaatggaggccttgacaccgcctccggcaactcacttaagcccattggacagcgctcacaccctgctagccccaccggattcctcggaaaaaatttgtaccgtgcaattggtcgggaacagctggactcctggctatccggaaacccaagaagctttatgtccccaggtaacatggtcctgggatcaactgccaagcagagcactggggccagcagcggctcctaccctctccccagagagccccgctgggagtcccgcaatgatgctgcagcccggaccacagctgtacgatgtgatggacgccgttcccgcaaggcggtggaaggaatttgtcagaacgctgggacttcgcgaagccgagattgaagccgttgaggtcgagattgggaggttcagagatcaacagtatgaaatgctgaagcgatggcgacagcaacagcccgcagggctcggggcagtgtatgccgctctggagcgcatgggcttggatggttgcgtcgaagacctgcgctctagactacagagaggcccatag

SEQ ID NO: 31327 - DNA, 705 bp, Artificial Sequence
  Description of Artificial Sequence: Synthetic coding sequence
atggaacagcggcctagaggctgtgccgcagttgcagccgctctgctccttgtgctgctgggcgcacgcgcacaaggcggaacgaggtcaccacggtgtgattgtgcaggagacttccacaagaaaatcgggctcttctgttgcagggggtgtcccgctgatgaggctggcatggaggcgcttacacccccaccggctacccacttatccccattggattcggcccataccctcttagctccacccgatagttctgaaaagatctgcaccgtgcagctcgtgggcaactcgtggacacctggataccctgagactcaagaggctctctgtccacaggtaacatggagttgggaccagctaccgtcaagagctctgggcccagctgctgcaccaacattaagtcctgaaagtcccgcaggcagccccgctatgatgttgcagccaggcccacaactgtatgacgtgatggatgcggtgcccgctcggcgatggaaagagtttgtaagaacacttggtctcagagaagcagagatcgaggcagttgaggtggagattggtcgctttcgcgaccagcagtacgagatgctgaaaagatggaggcagcaacagcctgccggattgggtgccgtatatgccgctcttgagcggatgggcctggacggttgcgtagaggatttgaggtctcgcctacagagaggcccttag

SEQ ID NO: 31328 - DNA, 1143 bp, Artificial Sequence
  Description of Artificial Sequence: Synthetic coding sequence
atggaacagaggccgagaggatgcgctgccgtggctgcagctctcctcctggtgctcttaggcgcacgggctcaagggggaaccaggtctccacgctgcgactgtgccggtgattttcacaaaaaaatcgggctgttttgctgtagggggtgtcctgcagggcattatctcaaagctccctgtacagaaccgtgtggaaatagcacatgcctggtttgcccacaagacacattccttgcatgggagaatcatcataactctgagtgtgcgagatgccaggcctgcgatgagcaggcaagccaggtcgcactggagaattgctccgccgtggctgacacacggtgtgggtgcaagccagggtggtttgtggagtgccaggtgtctcagtgcgtgtcctcctctcctttctattgccagccatgcctcgattgtggagccctgcaccgacacacaagactgctctgttctagaagagataccgattgcggaacttgcctgcccggattttacgagcatggagacggctgcgttagctgcccgacgagtaccctgggaagttgcccagagagatgcgcagccgtgtgtggctggcgacagaatgaggcaggcatggaggccctaacccccccacccgcaacacacttgagtcctctggacagcgcccatacactcctggcacccccagacagctcagaaaagatctgcacagtgcaactggtgggcaattcttggacgccaggttatcccgaaactcaggaggcgctctgccctcaggtgacttggagttgggatcagctcccttccagagcactggggcctgcggctgcccctaccctttcaccagaaagccccgcaggctctcctgctatgatgctccagccagggcctcaactctacgatgtcatggatgccgtaccagccagacgatggaaggagtttgttcggactctcggactgcgcgaagctgagattgaggctgtggaggtggaaatagggaggttccgggaccaacagtatgagatgctgaagcgctggaggcaacagcagcccgcaggcctaggcgcagtgtacgccgctctcgagcggatgggcctggatggctgtgtcgaggacctgagatctcggctgcaacggggtccctag

SEQ ID NO: 31329 - DNA, 1254 bp, Artificial Sequence
  Description of Artificial Sequence: Synthetic coding sequence
atggagcagcggccacgcggatgcgctgctgttgccgctgctctcctgctcgttctgctgggagccagggctcaaggcggaactaggtcacctcgctgcgattgcgctggagactttcataagaaaatcggcttattctgttgcagaggctgtccggcaggtcactatctgaaggctccttgcactgaaccatgtggtaatagcacgtgcctagtctgcccacaggatacttttctcgcctgggaaaatcatcataactccgagtgtgcacgttgtcaggcatgcgacgagcaggctagtcaagtcgccttggagaattgctcagccgtcgcagacactaggtgcgggtgcaagcccggatggttcgttgaatgtcaagtctctcagtgtgtgtctagttccccattctactgtcagccatgcctggattgcggcgctttgcacagacacaccagattgctgtgctcaagaagggacactgactgtggcacctgtctgcccggattttacgaacatggagatggttgtgtaagttgtcccactagtactctggggtcatgtcccgaacgctgcgctgccgtgtgcggttggcgacagatgttctgggtgcaagtgctgcttgcagggttggtagtgccactgctcctgggtgcaacacttacatacacatacaggcactgttggcctcataaacctctcgtgacagcggacgaggcgggaatggaggccctgactcctcccccagccacccatctgtcgccgctggatagtgcccatacattgctggcaccgccagattcatcggagaaaatatgtactgtgcagcttgtgggcaattcctggaccccaggctaccctgagactcaggaagccctgtgtcctcaggtcacatggtcttgggaccagttaccatcacgcgcacttggccctgcggcagcaccaacactctccccagaaagcccagccggtagcccggcaatgatgctgcagccaggccctcagctctatgacgttatggatgcagtgcctgccagacggtggaaggaatttgtacgcacattgggactcagagaggcagaaatagaagcggttgaggtggagattggacggtttcgtgaccagcagtatgaaatgctgaagcggtggcggcagcaacaacccgcaggattaggggctgtctacgctgccctggagcgtatggggctcgacggttgcgtggaagacctgaggagtagactacaaaggggaccctag

SEQ ID NO: 31330 - DNA, 1281 bp, Artificial Sequence
  Description of Artificial Sequence: Synthetic coding sequence
atggaacagcgccctcgcggatgcgccgctgttgcagcggctctgctcctggtgctgcttggagcacgggctcaggggggaactcggtcacctcgctgtgattgcgctggcgattttcacaaaaaaatcggtctgttttgttgcagggggtgccccgctgggcattacttaaaggccccatgcacagagccctgcggcaattccacgtgccttgtttgcccccaggatactttcctggcatgggagaatcatcacaacagtgagtgtgcacgctgtcaggcttgcgatgaacaggcctcccaagtcgccttagaaaactgtagcgctgtcgcagacactaggtgtggttgtaaaccgggatggtttgtggagtgccaggttagccagtgtgttagctctagcccgttttactgccagccctgcctagattgcggggcactacatcgacacacacggctgctgtgttcccgcagggacacagattgtggaacctgtctgcctggtttttacgagcacggcgacggttgtgtcagctgtccaactcctcccccttctcttgcgggtgcaccatggggggcagtgcagagcgctgtccccctgtctgtagcgggtggccgtgtcggggtgttttgggtccaggtgctgctcgcagggttggtcgtgcccttgctgctgggcgcaaccctcacctatacttacagacactgttggcctcataaaccactcgtaactgcagacgaggcgggaatggaagctcttacccccccacccgcaacccacctgtccccgctcgattccgctcacacgctgctggcaccccctgacagtagtgaaaaaatttgtacagtacagctggtaggcaactcgtggactcctgggtaccctgagacacaggaagcattatgccctcaggtgacatggtcttgggatcagctgccttcccgcgcacttggacccgctgccgcacccaccctgtccccggagtccccagccggttcccccgctatgatgctgcagccagggcctcaattgtacgatgtcatggacgccgtgcctgcacgccgttggaaggaatttgtccgtactctcggactgagggaggcagagatcgaggctgttgaggtggaaatcggacgttttcgggaccagcagtatgagatgttgaagaggtggagacagcagcaaccagccggtctgggggcagtgtacgcagccctcgaaaggatggggctggacggctgtgtagaggatctgcgctctcgccttcaacggggaccttag

SEQ ID NO: 31331 - DNA, 768 bp, Artificial Sequence
  Description of Artificial Sequence: Synthetic coding sequence
atggggaatagttgctacaacattgtagcaacactgcttttggtcctcaactttgagaggacccgatctctgcaagatccgtgcagcaactgtccggcagggactttctgtgataataacaggaatcagatctgctccccgtgtcctccaaactcttttagctctgctggcggacagagaacatgcgacatatgcaggcagtgtaaaggggtgttcaggactcggaaggagtgttcaagtacgagcaatgcagagtgtgattgcacccccggattccactgtctgggggcaggatgttcaatgtgcgaacaggattgtaagcaaggacaagagctgaccaaaaagggttgcaaggactgctgctttggcaccttcaatgatcagaaaagaggaatctgtaggccatggacaaactgttctctggacggaaagagcgtcttagtgaatgggaccaaagagcgtgatgttgtgtgcggcccaagtccagcagatctttccccaggggcatcctcagtcaccccgcctgccccagctcgggagccaggccactccccccaaatcatctccttctttcttgctctgacaagcaccgctttgctttttttgttgttcttcctaacgttaaggttttcggtcgtgaaacgcggtcgtaaaaagctcttgtatatctttaagcagccctttatgcgaccagtgcaaacgacgcaggaagaggatggctgttcatgtaggttccccgaggaagaagaagggggatgcgaactgtag

SEQ ID NO: 31332 - DNA, 5919 bp, Artificial Sequence
  Description of Artificial Sequence: Synthetic coding sequence
atggatccaactggatctcagctggattctgacttctcacaacaagacaccccatgccttattattgaggattctcaaccagagagccaggtcctggaagacgactccgggagtcatttttccatgttatcccgtcacctgcctaacctacagacacacaaagagaacccagtgctcgacgtggtgagcaatccagagcagactgccggagaagaaaggggagacgggaactctggatttaatgaacacctgaaagaaaacaaggtcgccgaccccgttgacagctcaaatctggatacttgtggctctatctctcaggtcatcgagcagctgcctcagcccaataggaccagttctgttttgggcatgtctgtggagagcgcaccagccgtcgaggaagagaaaggcgaggagcttgagcaaaaagagaaagaaaaggaagaagacacatccggcaacaccacccactccctcggcgcagaagacaccgcttcatcccaattgggatttggggtgctggaattgagtcaaagccaagatgtggaggaaaacaccgtgccgtacgaagtcgataaggaacagttgcagtccgttacaacaaattcagggtacactcggttgtctgatgtggacgcgaacacagccatcaaacatgaggagcaaagcaacgaagacatccctatcgcagagcagtccagtaaagatatccccgtgacagcccagccttctaaggacgtgcacgtagtcaaggagcagaacccccctcccgcaaggagcgaagatatgcctttctcgccaaaggcatctgtagcggctatggaagccaaagagcaactctccgcgcaagagctgatggagtccggtctgcagattcagaagagtcccgagccagaggttttgtccacccaggaggacctgttcgatcagtctaacaaaactgtgtccagtgacggctgcagcacccctagccgggaagagggtggatgttcactcgcctcaacacctgctacaacccttcacctgctgcagctgagtggtcaaaggtctctcgtgcaggactctctgagcaccaacagctccgatctggtcgccccaagcccagatgcgttccgaagcacacccttcattgtgccaagttccccaacagaacaggaaggcaggcaggacaagccgatggacaccagtgtgctgtccgaagaaggcggtgaaccgtttcagaagaagttacaaagcggagagcccgtggagctcgagaatccaccgttgctcccagagtctacagtttcaccacaagccagcaccccaatctctcagagcaccccagtgtttcccccaggtagtctacccatcccctctcagccccagttttctcatgatatctttatccctagcccgagtttagaagaacagagcaacgatggtaaaaaggacggtgatatgcatagcagctcactaaccgtggaatgttctaaaacaagcgagatcgagcctaagaattccccagaagatctgggactctctttaacgggcgattcctgcaagctgatgctctccaccagcgaatatagccagtcaccgaagatggagtcccttagctctcacagaatcgacgaggatggcgagaatacccagatcgaggatacggaacctatgtcacccgtcctcaatagtaagtttgtccctgctgagaacgattctatcctcatgaatccagctcaggacggagaggtccagcttagtcagaacgatgataaaacaaagggtgacgacacggacactcgtgatgatatttccattctggcaacaggctgcaaaggcagggaggagaccgtagctgaagacgtctgtatagacttgacttgcgacagcggtagccaggcggtgccatcccccgctactcggtctgaggctctgagctctgtgctggaccaggaggaggctatggaaatcaaggagcatcaccctgaggagggaagttccggctcagaagtggaagaaattcccgagaccccctgcgaaagccagggggaggaactgaaggaggagaatatggagtcagtgcccctgcatctatcactaacagaaactcagtcacaggggctgtgcctccaaaaagagatgccaaagaaggagtgctcagaggctatggaagttgagacctcagttattagtatagattctccccagaaattagctattctggaccaggagctggagcataaagagcaggaggcttgggaggaagctacttctgaggactctagcgtggtcattgttgatgtgaaggagccctccccacgcgttgacgtgtcatgcgagccacttgagggagtggagaagtgctccgatagtcagtcgtgggaagacatagcaccggagattgagccgtgtgcagagaatagactggacaccaaagaagaaaagtcagtggaatacgagggcgatctgaagtccggcactgccgagacagagccagtggaacaagactcctcccagccatcgttgcctcttgtccgggctgacgacccgctgaggcttgatcaggagttgcagcagccccaaacccaagaaaaaaccagcaattctcttaccgaggatagtaaaatggctaacgcaaagcagctgtcttccgacgcagaggcacagaagctaggcaagcccagcgcccatgcctcccagtcgttttgtgaatcatccagcgaaaccccctttcattttacactgcccaaagagggcgacatcattccccctctcaccggcgctactccacccctgatcggccacctgaaattagagccaaagcggcattcaacaccgatcggcattagtaactatcctgagtcaaccattgcgacttccgatgtgatgagcgagtccatggtggagacccatgaccctatccttgggagcggcaagggtgactcaggcgctgccccagatgtagacgacaagctctgccttagaatgaagcttgtgagccccgaaaccgaagcctccgaggagtctctccagttcaacctggagaaacctgctacaggcgagcggaaaaacggttccacagctgtagctgaatctgtggcgtctccgcagaaaaccatgtctgtcttaagttgcatttgtgaggcccgtcaggaaaacgaagccaggtcggaggatccgccaaccacccccatccggggtaaccttcttcattttccgtcctcccagggggaggaggagaaagagaagctcgagggtgatcacacgattcgacagtcccagcaacctatgaagcctatctccccagttaaggaccctgtttcgcccgctagccagaagatggtgatccaggggccatcctcccctcagggcgaggcaatggtgacggatgtcctggaggaccagaaggaaggcaggtctaccaataaagaaaacccatcgaaagcattgattgaaagaccctcccagaacaatattggcatccagaccatggaatgcagcctgcgggttcctgagacagtgtccgccgcaactcagaccatcaagaatgtatgcgaacaggggacatctaccgttgatcagaattttggaaagcaggacgctactgtgcagactgaacggggaagcggcgaaaagcctgtgtctgcccctggggatgatactgagagcctgcacagccagggcgaagaggagttcgacatgccgcagccccctcacggccacgtcctccaccgtcatatgcggacaattcgcgaagtgcgtacactggtgacccgcgtaataacagatgtgtactatgtggatggcactgaggtagaaaggaaggtgacagaggagaccgaggaacctatcgtggagtgtcaagagtgcgaaaccgaagtaagccccagccagacaggtgggagttccggggatctgggcgacattagctcttttagctccaaagccagttcccttcatcggacaagttcaggaaccagcctttcggccatgcattctagcggttcaagtggtaagggggctgggccactcagggggaagaccagtgggacggaacctgccgatttcgctctgcctagttcacgcggaggaccaggcaagctgagcccaagaaagggcgtgagccagaccgggactcctgtgtgtgaggaagacggagatgccggtctggggattaggcagggcggaaaggcacccgttactccacgaggacgcggaagaagaggtcgtccccctagcaggaccaccggaactagggaaaccgctgtgcctggaccactcggaattgaggatatttcccccaatctgagcccagatgacaagtccttctcgagggtcgtgccaagggtgccagacagtactaggaggactgacgtgggagctggcgcactccggagaagcgactccccggaaatacccttccaggccgctgctggacctagcgacgggctcgacgcaagttctccaggcaattcctttgtgggactcagggtcgttgctaagtggtcatctaatggctatttctacagcggcaaaattaccagagacgtaggcgctggaaaatataaactgctgttcgatgacggttacgaatgtgacgttctcgggaaagatattctgctctgtgatcctatccccctggatacagaggtgacagcactgtcagaggacgaatacttttccgctggcgtcgttaaaggccaccgtaaggagagcggggagctatattacagtattgagaaagagggccagagaaaatggtacaagagaatggcagtaatcctatccctggaacagggcaatcgcctgcgcgagcagtacggcctcggaccctatgaagccgtcactcctctcacaaaagctgcggatatctcattagacaacctggtcgagggaaagaggaagaggaggagtaatgtttccagccctgcaactccgaccgcctcctcaagtagttccactactccgacccgtaagattacagaaagccctcgcgcttctatgggcgtcctgagcgggaagcgcaagctcattacatcggaggaagagagatcgccagccaagcggggtcgtaaatcggccacagttaaacccggagctgttggtgccggagagttcgtttccccatgtgagtcgggtgacaataccggtgaacctagtgctctggaggaacagcgcggtcccctgccgctgaataaaaccctgttcttaggctacgcctttcttctgactatggccacgacctccgataaactggcaagccgttcaaagctgcctgatggcccaacgggcagttccgaggaggaggaggagttcctggaaattcctcctttcaataaacagtacacggagtcccagcttagagcaggcgctggatacatcctggaagattttaatgaggcacaatgtaataccgcctaccagtgcctgctgatagccgatcagcattgcagaacccggaagtactttttatgcctggccagcgggattccttgcgtgtctcatgtctgggtacatgacagttgtcatgccaaccagctccaaaactaccgcaactacttgttgcccgctggatactccctggaagagcaacgcatcctggattggcagccacgggagaaccccttccagaatttgaaggtcttgctggtttctgatcaacagcaaaacttccttgaattgtggtccgaaattctgatgaccggaggtgctgccagcgtgaaacagcaccactcaagcgcccataataaggacatagccctcggagttttcgatgtcgtggtcacagatcccagctgccccgctagtgtcctcaagtgcgcagaggcccttcagctgcccgtcgtcagtcaggagtgggtcattcagtgcttgattgtcggggagcgcatcggcttcaagcagcacccgaaatacaagcatgattatgtgagccactaa

SEQ ID NO: 31333 - DNA, 5784 bp, Artificial Sequence
  Description of Artificial Sequence: Synthetic coding sequence
atgccgggtgagcagatggaccccaccggcagccaattggactccgacttcagtcagcaggacacaccatgcttgatcattgaagacagccagcccgagtcccaggtgctcgaggacgattccggtagtcatttcagtatgctctctcggcatctgccaaatctgcagacacataaggagaaccccgttcttgatgtggtctccaacccagaacagactgctggcgaggagaggggagacggaaacagcgggtttaacgaacacttaaaagaaaataaggtggcagatcccgtcgacagtagcaaccttgacacttgtgggtccatttcgcaggtgattgagcagttaccacaacctaataggacttcctcagtgctgggaatgtccgtggagagtgcccctgctgtggaggaagagaaaggcgaggaactcgaacagaaggaaaaagagaaagaagaggacactagcggcaacacaacacatagcttgggcgcagaagacacagcaagcagtcagctggggttcggggttctggaactatctcagtctcaggacgtggaagaaaataccgtgccatatgaagttgataaggagcagctgcagtctgtcaccacaaactcagggtacactcgcctgtccgacgtcgatgccaacaccgcgattaagcatgaagaacagtctaatgaggatatccccatcgccgagcagtcttcaaaagatataccagtgactgcacagccttccaaagatgtacatgtggtgaaggaacaaaatccgcctcctgctcggagtgaggatatgccattttctccgaaagctagtgtagcggctatggaagccaaagagcagttgtctgcacaagagctgatggaatcagggctgcagatccagaagagccccgagccagaggtgctatcaactcaggaagatctgttcgaccaaagcaacaaaactgtgtcttccgacgggtgctccacaccgagccgggaagaaggcggatgctcgctcgcgagcacaccagccactacactccacctgctgcagctgtccggtcaacggtccctcgtgcaagactccctaagcaccaattcatctgatttggtagccccttctccagacgctttcaggtcaactccattcattgtgcctagttcccctactgaacaagaaggacgccaggacaaacctatggatacttcagtgctgtcagaggagggaggcgagccttttcagaagaaattacagagcggcgagccggtcgagctggaaaacccaccacttctgccagagtccactgtgtccccccaggcaagcacaccaatctcacagagcacaccggtttttcctcctgggagtcttcccatcccatcacagccccagttttcgcatgatatcttcatccccagtccaagcctggaggagcaatcgaatgacggaaaaaaagacggggacatgcattccagctcattgaccgtggaatgctccaagactagcgagattgaacctaagaactctccagaagacctcgggctttccctcactggcgatagctgcaaactgatgctgagtactagcgagtattcacaatccccaaagatggaaagcctttcctctcacaggatagacgaagacggtgagaatacacagatcgaagatacagagcctatgtcaccagtgctcaacagtaagttcgtcccagccgagaacgactctatcctgatgaatcctgctcaggatggcgaggttcagttgagccagaatgatgacaagaccaagggcgatgacactgacaccagagacgacatatcaattctggccacgggttgcaagggcagagaagagacagtggccgaagatgtgtgcatcgatctcacgtgcgattctgggtctcaggcagtgccaagccctgctactcgcagcgaggccctgtctagcgtgctggaccaggaagaggcaatggaaatcaaagagcaccatcccgaggaagggtcttcagggagtgaggttgaggaaataccagagaccccctgcgagagtcagggagaggagttgaaggaagagaacatggagtcggtacctctgcatctcagcctgaccgaaactcagtcccagggcctgtgtctgcagaaggagatgcccaagaaagaatgtagcgaggcgatggaggtggagacctccgtgatttccatcgattccccccagaaactggctattctcgatcaggagctggagcacaaggagcaagaagcttgggaggaggctacctctgaagacagcagcgtggtgatcgtcgatgttaaagaacctagccctagggtggacgtttcctgcgagcccttagagggcgtagagaagtgttccgactcccagagctgggaagacattgccccagagatagaaccatgcgcagaaaaccggttggataccaaggaggaaaaaagcgtggagtatgaaggagatcttaaatctggcactgccgagaccgagcctgtggagcaagactctagtcaacctagtctgcctctcgtccgagccgacgatcctctccggctggaccaggagctgcagcagccgcaaacacaagagaagacctccaattctctgaccgaggattcgaaaatggctaatgctaaacagctgagttccgacgcagaagcccaaaaattgggaaaaccctcagctcatgcgtctcagagtttttgcgagagctcaagtgagacccctttccatttcactctgcccaaggagggagatattatccctccccttacaggtgcaactcctccgctcatcggtcatctcaagctggagcctaagcgccattccactcctatcggaatctctaattatccagagtcaacaattgccacctccgatgttatgtctgaatcaatggtggagacgcatgacccgatactggggtctgggaagggcgacagcggtgcagcacccgatgtggatgacaagctctgtctgcggatgaagctggtgtccccggagacggaagcctcagaggagagcctgcagtttaatctggagaaaccggctaccggcgagcgcaagaacggctctaccgctgtcgctgaaagcgtagcatctccccagaaaacgatgtccgtattgtcttgtatctgtgaggctcgacaggaaaacgaggccagatcggaggaccctcctactacacctatccgaggaaacctcttacatttccccagctctcaaggggaggaagagaaagagaaacttgagggtgatcatacaatccggcagtcccagcaaccaatgaaaccaatcagtccggtcaaggaccccgtttcacctgccagtcagaaaatggtgattcaggggcctagcagcccccagggagaagccatggtgacagacgttcttgaggatcagaaggagggccgttcaacaaacaaagagaatccaagtaaggcgctgatcgagaggccaagccagaacaatatcggcattcagactatggagtgtagtctgcgcgtaccagaaacagtttctgccgctactcaaaccatcaagaatgtgtgcgagcagggcacctctactgttgaccagaacttcggcaagcaggacgctaccgtccaaacggaacgtggctctggggagaaacccgtcagcgccccaggagacgacacagagtcgttgcattctcagggggaggaggaattcgatatgcctcaacctccccatggccatgtgctgcatagacatatgaggaccatcagagaagtgcgaactttggtgacaagagtcataacggatgtttactatgtcgatggaactgaagtggagcgaaaggtcacagaggagacggaggagccaattgttgagtgccaggaatgtgagactgaagtgagcccatcccaaaccggcggatcaagcggggacctgggcgacatttcttcgttctcttctaaagcctcctcactccaccggacatctagtggcacgtcactgtcagcaatgcacagcagcggctccagcggtaaaggggcaggaccactgagaggtaagacctctggaaccgagcccgctgatttcgccttaccttcttctcgcggagggcctggcaaactcagggaaacagcggtgccgggtccactcggcatcgaggatatctccccaaatttaagcccagatgataaaagcttcagtagagtggtcccacgggtgcccgactctacgcgcaggacagacgtgggagcaggggcactacgaagatccgacagtcctgaaatccccttccaagcagccgctggtccctccgacggcctcgacgccagctcgcctgggaattcattcgtgggattaagagtggtcgccaaatggtctagtaatggatatttttatagtggaaagatcacccgcgacgtgggtgcaggtaagtacaagctgctgtttgatgacggctacgagtgcgatgtccttgggaaggacatcctcctgtgtgaccccattccattagacactgaagttaccgccttatccgaggatgaatattttagcgcgggagtcgtgaaaggacatagaaaggaatcaggcgaactctactattctatcgagaaggaaggacagagaaagtggtacaaacgaatggcggtaattctctctctggagcagggcaatcgcctgcgggagcagtacggtctgggtccctatgaagccgtgacaccccttactaaggcagctgatatctccttggataatctggtggaaggcaagcggaagcgcagatcaaacgtgtcatcaccagctactcccaccgcttcctctagctcatctacgacaccaactaggaaaattaccgaatccccccgagcatccatgggggtgctgagtgggaaacgcaagctaataaccagcgaagaggagagatcacccgctaagcggggtcgcaaatccgcaaccgtcaaaccaggagctgtgggcgcaggtgagtttgtaagtccttgcgaatccggggataataccggagagccatcggccctggaagaacagagaggcccattgcccctcaataagactttatttttgggctacgcctttcttctgacaatggccaccacatccgataagttagcaagcaggtctaagctaccggatggccctacgggtagtagtgaggaggaagaggaatttctggaaattccacctttcaacaaacagtataccgagtcacagctgcgggcaggagccggatacatcctcgaggacttcaacgaggcacagtgcaataccgcgtatcagtgcctgctgatcgccgaccagcactgcagaacgcgaaagtacttcctgtgcctcgcaagcggtattccatgcgtatcacatgtttgggtccatgatagttgtcacgcaaaccagctacaaaactaccgtaactacctgctacccgcaggctactcgctcgaagaacaacgtatcctcgactggcagccgagggagaatcccttccaaaacctgaaagttcttctggttagcgaccagcaacagaactttctagaactttggtccgaaatcctaatgactggaggcgcagccagtgtaaaacaacatcactcttcagcccataacaaggatattgctttaggagtctttgacgtggtggtgaccgatccaagctgtccagccagcgtactgaagtgtgcagaggccttgcagttgccggtggtgtcccaggaatgggtgatccaatgcctgattgtcggcgaacggatcgggtttaagcagcaccccaaatacaagcacgattacgtgtctcactag

SEQ ID NO: 31334 - DNA, 5933 bp, Artificial Sequence
  Description of Artificial Sequence: Synthetic coding sequence
atgccgggtgagcaaatggatccaacaggatcacagctagatagcgatttcagccagcaggacacaccatgcctgatcattgaagacagtcaacctgaatcccaggtattagaggacgatagtggctcccacttctctatgttgtcccggcatctgcccaacctgcagacacacaaggagaacccggtactcgatgtcgtctccaatccagagcagaccgcaggcgaagagcgaggagacggtaactccggcttcaatgagcaccttaaggagaacaaggtggcagatcccgtggattcctcaaacctggatacctgcggcagtatcagtcaagtgattgagcagctccctcagcccaaccgcacaagctccgtgcttggcatgtcagttgagtctgccccagctgtggaagaggaaaaaggcgaagagctcgaacagaaagagaaggagaaggaagaggatacctccgggaacaccacccactctttaggagccgaagacacagcatcaagtcaactcggattcggagtgctagaactttcccagagccaggacgtcgaggaaaataccgttccttacgaagttgacaaggaacagctgcagagtgttaccaccaacagtggctatacgaggctgtccgatgtagatgccaataccgcaattaaacacgaagaacagagcaacgaagatatccctattgccgaacagagctccaaagacattccggtcactgcgcaaccatctaaggacgtgcacgtggtcaaagaacagaacccgccaccggcacggagtgaggacatgccattttctcctaaggcaagcgtggccgcaatggaagccaaggaacaactgtccgctcaagaactgatggaatccggtctgcaaatacagaagtcacctgaaccagaggtgctgtccacccaggaagacctctttgaccagtccaacaagacagtgagttccgatggttgtagcacaccttccagagaggaggggggttgtagcttagcttcaacccccgcaacaacactacacctgctgcagctatctggccagagaagcctcgtccaggatagccttagcacgaatagtagcgaccttgttgctccgagtcctgatgcgtttagatcaacacctttcattgtgccatcttcccccaccgagcaggagggccgacaggataagccaatggacacgtcagttctgtctgaggagggcggagaaccttttcaaaaaaaactgcagtcgggagagccagtggagctggagaatcctcccctgttgcctgaaagcaccgtgagtccacaggctagtacaccaatttcgcagtcaacaccagtgtttccacctggtagtctccctatcccctctcaaccacagttttcccatgatatttttatcccctcccctagcttggaggagcaaagcaatgacggcaagaaggacggcgacatgcactcctcaagcctgactgttgagtgttctaagacctctgaaattgagccaaagaactctcctgaggatttagggctcagcctcacaggggattcctgcaagttgatgctaagcacatcggagtattctcagagtcccaaaatggaaagtcttagctcacatcgcattgacgaagatggcgagaatacccagattgaagatacagagccaatgtccccggtcctcaatagcaaatttgtgccggcagagaatgatagtatcttaatgaatccagcacaggacggcgaagtgcagctgtcccagaacgacgacaagaccaaaggagacgacactgatactcgcgacgatatctcaatcctggctacaggatgtaaagggagagaggagaccgtagccgaggatgtgtgcattgacctgacttgtgacagtggttcacaggccgtcccatcacctgccacccggagcgaagccctcagctccgttttagatcaggaggaagccatggaaatcaaggagcaccaccctgaggaagggagttcgggttcagaagtagaagaaatccccgagacaccttgtgagtctcaaggcgaagaacttaaggaggagaatatggaaagcgtcccgctacacctgtccctcaccgagactcagtcacaggggctgtgcctgcaaaaagaaatgcccaagaaggagtgcagcgaagcaatggaggtggaaacatctgtgatctctatagattcccctcagaaactcgcaattcttgatcaagagctggaacacaaggagcaagaggcatgggaggaggcaactagcgaggacagctcagttgtgattgtggatgtcaaggagccttctccacgagtggatgtgagctgcgaacctctcgaaggcgtggagaagtgctcagatagccagagttgggaggatatagctccggaaatcgagccttgcgccgaaaatcgactcgacactaaagaagagaaatctgtggaatatgagggtgatctcaagtctggtacggctgagaccgagcccgtcgagcaggatagcagccagccaagcctccctttggttagagccgatgaccccctgaggttggatcaggaactccagcagccacagacccaagaaaaaacttccaattccctgacagaagactctaaaatggctaacgccaagcagctgtcttctgatgccgaagcacaaaaattggggaagccctcggcacatgcaagccaatccttctgtgaaagcagcagcgagacaccattccactttactctgccaaaggagggtgacattatccctcctctcactggcgcaacacctcctctcattgggcacctaaagttagaacctaagcgccatagtactccgattggcattagcaattacccggagtctaccattgcaaccagcgatgttatgagcgagtccatggtggagactcacgaccctatccttggctccgggaagggcgattccggggctgctcctgacgtggacgataagctgtgtctccggatgaaactggtctctcctgagacggaggcgagtgaagaatcgctgcagttcaatttggagaaaccggctaccggggaacgaaagaacggttctaccgccgtggccgagtcagtggccagtcctcagaagaccatgtcggtgctcagctgcatatgtgaagcaaggcaggagaatgaggcgagaagtgaagacccgcctaccacccccattcgcggtaaccttttacacttcccttcctcccagggcgaggaggagaaagagaagttggagggggaccatactatcagacaaagccagcagcctatgaaacctatctcccctgtcaaagaccctgtaagccccgctagtcaaaagatggtaatacagggcccaagctcacctcagggcgaagccatggtcactgatgtactggaagaccagaaagaagggagatccaccaacaaagaaaacccaagcaaggcattgatagagcgcccttcacagaacaacattggcattcagacaatggagtgcagcctccgcgtgcccgaaactgtatcggctgccacacagaccattaaaaacgtgtgcgaacagggcacttccactgtagatcagaacttcggcaagcaggatgcaacggtccagaccgagagagggagcggcgaaaagcctgtctcagcccctggagacgacacagaaagccttcactcgcaaggggaagaggaattcgatatgccgcaacccccacacggccacgtactgcaccggcacatgcgaactatacgcgaggtgcgcactctggttactagagtaattactgacgtgtattatgtggacggcacagaggtcgagaggaaggtgacagaagagacagaggagccaatcgtcgaatgtcaggagtgcgaaaccgaggtctcaccctcacaaacgggcggatccagcggggacctaggggatatcagctctttcagcagcaaagcgtccagccttcacagaacatccagcgggacctccctttccgccatgcatagctctgggtcatcggggaagggggctggccctctaaggggtaagacaagcggaaccgagcccgctgattttgcgctgcccagcagtaggggaggtccaggaaagttgtctccacgcaaaggcgtttctcagactggtacaccagtctgcgaagaggacggcgacgctggcctgggaattcgtcaggggggaaaggctccagtaaccccacggggtcggggacgtcgcggacgaccaccaagtagaacaaccggtacacgagaaacagctgtgcccggacccttgggcatcgaggatattagccccaacctttcacctgatgataagagtttcagccgggtggtccctcgtgtaccagactctacaagaaggacagatgttggtgctggagccttgcgcaggtcagatagccccgaaatcccatttcaggcggctgcagggccttcggatggtctcgatgcctccagccccggaaactcattcgtcggcctaagagtagtcgcgaaatggtccagtaatggctatttctacagcggcaagatcactcgcgacgtgggcgctggcaagtacaagctgctgttcgacgacggttacgagtgtgatgtgctgggtaaagacattcttctctgtgaccccatcccgcttgatactgaggtgaccgctctaagcgaagatgagtattttagcgcaggggttgtgaagggccacagaaaggagtccggcgagctatattactctatagagaaagaggggcagcgaaagtggtacaagcgaatggcggtaattttatctctggagcaaggtaaccgcttgagagagcagtatggcctcggaccctacgaagctgtcactccactaactaaggccgcagatatctccctggacaacctcgttgaggggaaaagaaaaaggagatctaatgtgtcctctcctgctacccctacagcgtccagttccagttctacaactcctacaaggaagattaccgagtctcctcgagcatccatgggagtcctaagcggaaaacggaaactcatcaccagtgaggaggagaggagtccagcaaagcgcggacgcaaaagtgctacagtcaagcccggagcggttggtgcaggcgaatttgtatccccatgcgaaagcggcgataacactggggaaccatccgccctggaggagcaaagaggacctctcccactgaacaagacattattcctgggctacgcctttttattgactatggcgacgacttctgataaactggccagcagatcaaaactgcccgacggacccactggatcttccgaggaggaggaggagtttcttgaaattcccccatttaacaagcaatacaccgagagccaattgagggccggtgctggatacatcctcgaagatttcaatgaggctcagtgtaatacggcctatcagtgtctgcttattgcggaccaacactgcagaacccgtaagtactttttatgtttggccagtggcataccttgtgtgtcacacgtctgggttcacgacagctgtcatgccaaccagctgcagaactacaggaactacttacttccagccggttactccctggaggaacagaggatcctagactggcaaccacgcgaaaaccccttccaaaacctcaaagttctccttgtgtctgatcaacagcagaactttctcgaactgtggtccgagatcctaatgacagggggagccgcttccgtgaagcaacaccatagctccgcgcataataaagatatcgccctaggcgtgtttgacgtggtggtgacggatccaagctgccccgcaagtgtcttgaaatgcgctgaggcccttcaactgcccgtggtgtctcaggaatgggtgatccagtgtctcatcgtaggcgagcggattggctttaagcagcacccgaagtacaagcatgattacgtgagccacta

SEQ ID NO: 31335 - DNA, 5927 bp, Artificial Sequence
  Description of Artificial Sequence: Synthetic coding sequence
atgccgggagaacagatggatccaactggtagccagctcgatagcgacttcagtcagcaagatactccctgcctgattatagaggatagtcagcctgaaagccaagtccttgaggatgactcgggctcccatttctcaatgctgtctcgacatttaccaaatctgcaaacacacaaggagaatcctgtgctggatgtggtgtcgaaccccgaacagaccgccggtgaagagcggggtgacggaaacagcggcttcaacgaacatctcaaagagaataaagttgccgaccctgtcgattcaagcaatctggacacatgcggatctatctcacaggtgattgagcagttaccccagccaaatagaacctccagtgtgttggggatgtccgtcgagagtgctcctgccgtagaagaagaaaagggcgaagaattggagcagaaggagaaagaaaaggaggaggacacttccggtaacaccacacactctctaggcgctgaggacaccgcctcatcacagctgggcttcggcgttttagaacttagccagtcacaggatgtggaggagaatacagtgccttacgaagtggataaggaacagctgcaatccgtgactacaaatagcggatacactcgcctgtctgacgtggatgcgaacacagccattaagcatgaggagcagagcaacgaggatattccaatcgctgaacagtcttcaaaagacatccccgtgacagcccagccatctaaggacgtccatgtggttaaagaacagaatcccccacccgctagaagtgaggacatgccttttagtcctaaggccagcgtagcagcaatggaagcaaaggagcaactgagcgcacaggagttaatggagtccggattgcaaatacagaagtctccggaacctgaagtgttgtccacacaggaagatctttttgaccagtctaataagaccgtctcaagcgacggctgttcaaccccttcccgggaggaaggaggttgttccctcgccagcactccagccaccaccctccacctgctacagctgtccggtcagcggtccttagttcaggacagtctcagcaccaactccagtgacctcgtggcccctagccccgatgccttccgctccacaccatttatcgtgccctcctctccgactgagcaggagggaagacaggataagcccatggacacctccgtactcagcgaggaagggggagaaccctttcagaagaaattgcagtcaggcgagccagtggaactggaaaatccacccttactaccagagagcaccgtgtcaccccaggcgagcacccccatatcgcagagtactcctgtcttccctcccggatccctcccaatacctagccaaccccagttttcgcacgatatattcatcccgagccccagtctcgaggagcaatcaaatgatggcaagaaagacggggacatgcactcttccagtttaacagtcgagtgttcaaagacctcagaaatcgagccaaaaaattctcccgaggacctggggctgagccttactggcgactcttgcaagcttatgctctccaccagcgagtactctcaatctccgaaaatggagtctctgagctcacatagaattgatgaagacggcgaaaatacccagatcgaggacaccgaaccaatgtctccagtgctgaactcgaaattcgttcccgcagagaatgattccatcctcatgaaccccgctcaggatggggaagtgcagttgtctcaaaacgacgacaaaacaaagggagacgataccgacacaagagatgatatctccatcctcgcaaccgggtgcaagggcagagaggagactgtggccgaggacgtgtgcatcgatcttacatgtgacagcggatcacaggcagtgcctagtccagcaacccggagcgaggctttgtcttcggtattagatcaggaggaggcaatggaaatcaaggagcatcaccccgaggaagggtccagcgggagcgaagtagaggagattcccgagactccctgtgaaagccaaggggaagagctcaaggaggagaacatggagtcagtgccactgcatctctctttgaccgaaacccagagccaaggactgtgcctccagaaggaaatgcctaagaaggagtgctcagaggccatggaagtagagactagtgtgatctctatagactcgcctcaaaagctggcaattctcgatcaggaactggagcataaagagcaggaggcatgggaagaagctacaagcgaagacagtagtgttgttatcgtggacgtcaaagaaccatcccccagggtcgatgtaagctgtgaaccccttgaaggagtcgaaaagtgctccgacagccagagctgggaggacatcgccccagaaattgagccgtgcgcagaaaatcgcctggacacaaaagaggagaagtctgttgaatacgaaggggatctgaagtctggcaccgccgaaacagaaccagtggagcaggactcatcccagccttccttgccacttgtgagagcagatgatccacttcgtctagaccaggaactccagcagccccagactcaggagaagacaagtaattctttaaccgaggactccaagatggcaaacgcaaaacagttaagctcagacgcagaggctcagaaactcgggaaaccctccgcacacgcctcccagagtttctgtgaatcctcctcagagaccccctttcattttactctgcctaaggaaggggacattatccctccgctcactggagcaacgccgccacttattggtcaccttaaactggagccaaaacgccatagcaccccaattggcatctcaaattatccagaatctaccatagctacctcagatgtcatgagcgagtccatggttgagacacacgatcctattctgggatcaggcaaaggagattccggcgctgcccctgatgtcgatgacaagttgtgcttgcgaatgaagttggtgagtcccgaaacggaggcatcagaagagtccctgcagtttaatttggagaagccagcaactggagaaagaaaaaatgggagcaccgcagtggcggagagtgtggcatccccccagaaaacgatgagcgttctctcgtgtatttgtgaggccaggcaggagaatgaggccaggtccgaggatcccccaactacgccgatcagaggaaacctgctgcacttcccttcaagccagggcgaggaagagaaagaaaagctggaaggggatcacacgattcgacagagtcagcagcctatgaaaccaatcagtcctgtcaaagacccggtgagccccgctagccagaagatggtaattcaaggcccttcttccccccagggcgaggccatggttactgacgtgctagaggaccagaaggagggcagatccactaacaaagagaacccctccaaagccttgatcgaacgcccatcacagaacaatattggaatacagacaatggagtgttctttacgagttcctgaaacggtgtcagccgcaacccagaccatcaaaaacgtgtgcgaacaggggacctctacagttgaccaaaacttcggcaagcaggatgccacagtgcagaccgaaagagggagcggagaaaaacccgtgagcgcccctggcgacgataccgagtccttacactctcagggggaggaagaatttgacatgcctcaacccccacacggtcatgttctgcacagacacatgcggactatcagagaggtccgcacactcgtgacacgtgttatcaccgacgtctactacgtcgacggtaccgaagtcgaaagaaaggtcaccgaagaaacagaggagcccatcgtggagtgtcaggaatgcgagacagaagtgtcccctagccagactggcggtagctccggggacctaggggatatctcgtccttcagtagcaaagcttccagtctccatcgtacttctagcggtacctcactcagcgcgatgcatagctccgggagctcaggaaaaggcgcaggccctttgagaggtaagacatccgggaccgagccggctgatttcgctctgccaagtagtcgagggggaccgggtaagctcagcccacgcaagggtgtgtcccaaactgggacgcctgtgtgcgaagaagatggtgacgctggactggggattcgccagggcggaaaggccccagtgaccccccgagggcgtggccgaagaggcagacccccaagccgaaccactggcactcgagaaactgctgtgccaggtcctttaggcatagaagacatctcccctaacctctcccccgatgacaagtctttctctcgggtcgttcccagagtgcccgattcaactagacgaacagatgtgggagctggggctctccgccgttccgattcaccagagattccgttccaggctgctgctggccctagcgatgggctggacgcgagcagccccggaaattcttttgttggcctgcgcgtcgtggcaaagtggagcagcaatggctacttctattccggcaagatcacacgcgacgtcggcgctggcaagtacaaattactcttcgacgatggttacgagtgcgacgtcctcggtaaagacatcttactgtgtgatcctatccccctggacactgaagttacagcactttccgaggatgagtatttttccgccggtgtggtaaagggacaccggaaggaaagcggggagctttactactcgattgaaaaggaggggcaacgtaaatggtacaagagaatggccgtgatcctctccctcgagcagggcaataggcttagggagcagtatggcctcggcccatatgaggcagtgacacccctgacaaaggccgctgatatttctcttgataacctggtcgagggtaagaggaagaggcgttctaacgtgtcatctcctgctaccccaactgcgtcctcctcatccagcaccacccctacccgaaaaataaccgagagcccgcgagcgagtatgggtgtgctttctggcaagagaaagctgatcacatcagaggaagagcgcagcccagctaagcgcggtcgaaagtctgctacagtcaagcctgtcggcgctggggaatttgtatcgccctgcgagagtggtgacaatactggcgagccgagcgcattggaagaacaacggggacctctgccgctgaacaagacactatttctgggttacgctttccttcttacaatggcgaccacaagtgataagctagcctctcggagtaaattgcctgacgggcctactggctcctctgaggaggaagaagagtttctggagattccaccctttaacaagcagtacaccgagagccagttgcgggctggagccggttacattctggaagactttaatgaggcgcagtgcaacaccgcttatcagtgcttgcttattgctgaccagcattgccgcactcgcaaatacttcctgtgtctggcgtcgggcattccttgcgtgtcccacgtgtgggtgcacgactcctgccatgctaaccagctgcaaaactatcggaactatcttttgccagctgggtacagtctggaggagcagcggatcctggactggcagcccagggaaaacccctttcagaacctgaaggtgctcctggttagcgaccaacaacagaatttccttgaactgtggtctgagatcctcatgactggcggagccgcatcagtcaagcaacaccactcgagcgctcacaacaaggatatcgccttaggtgtgtttgatgtggtcgtcaccgatccctcttgcccagcaagtgtgctgaaatgtgccgaagcactccaactcccggtcgtctcgcaggagtgggtgatccagtgcctgatcgtgggagaacgcatcggctttaaacagcatccaaagtataagcacgattacgtctcccacta

SEQ ID NO: 31336 - DNA, 1623 bp, Artificial Sequence
  Description of Artificial Sequence: Synthetic coding sequence
atggctcagagtactgctaccagtcccgatggagggaccacattcgagcacttatggtcctccctcgaaccagatagcacgtactttgacctgccgcagtctagccgtggcaataatgaagtagtcggtggcaccgactcttccatggacgtgttccaccttgaaggtatgacaacatcggtgatggcccagttcaacctgttgagcagcaccatggatcagatgtctagtcgggctgcctctgcaagcccttacacgcctgagcatgcggcttccgtgccaacacattccccatacgcccagccgagctcaaccttcgacaccatgagccccgcacccgtgatcccctcaaatactgattacccaggccctcatcattttgaggttacatttcagcagagtagtaccgccaaatccgctacctggacatattcgcccctattgaagaaactgtactgccagatcgctaaaacatgtccaatccagatcaaagttagtactcctccaccacctggcaccgctattcgagccatgcccgtgtataagaaagcagagcacgtcactgatgttgtaaagcggtgtccgaaccatgaactgggtcgagacttcaatgagggtcagtccgctcccgcttcccatcttattcgggtagaggggaacaatctgagccagtatgtggacgaccctgtgactggaagacagagcgtggtggtcccttatgagccgcctcaggtcggcactgagtttacaactatactgtataatttcatgtgtaactctagctgcgtcgggggtatgaatcggcgacccatcctgataattatcaccttggagatgagagacggtcaggtcctgggaagacgaagttttgagggtcgcatctgcgcctgcccaggccgagatcgaaaggccgacgaggatcactaccgggagcaacaagccctcaatgagagcagtgctaaaaatggcgcagcctccaagcgagcattcaagcagtcacctcccgctgtgcctgctctgggggctggggtaaaaaagcggagacatggggacgaagatacatattacctgcaggtgcggggacgtgaaaacttcgaaatcttgatgaaattgaaagaaagtctggagcttatggaactggtacctcagccactcgtggactcatatagacaacagcagcagctgctgcagaggccattcttgaccgggcttgggtgccctaattgcatagaatacttcaccagccagggcctgcagagcatctaccatctccagaatctgaccattgaagatttgggcgcacttaaaattcccgagcagtaccggatgacgatatggcgtggccttcaggacctaaagcaaggccacgattactcgacagcccagcagctgttgagatcaagtaatgccgctaccatctctatcggcggtagcggagaactgcaacggcagagagtgatggaggcggtacacttccgggtacgccacaccattaccatccctaacaggggcggtccgggaggtggccctgacgagtgggccgactttggtttcgacctccccgactgcaaggctcggaagcagccgattaaggaggagtttacagaggccgagatccactag

SEQ ID NO: 31337 - DNA, 1500 bp, Artificial Sequence
  Description of Artificial Sequence: Synthetic coding sequence
atggctcaaagcaccgccacgtcaccagacggcggtacaacttttgagcacttatggagctcacttgagcctgactcgacctacttcgacttgccacagagttcccggggtaacaatgaagtcgttggcggaacggacagtagtatggatgtgtttcacttggagggcatgaccacatctgtaatggcccagtttaacctgctgtcgtctaccatggaccagatgagctcacgtgcagcctccgcatcgccatatactccagagcacgctgcgtctgtcccaacccacagcccctacgctcagccatcgtcaacattcgataccatgtctccagcccctgtgattccatccaacacggactatcccggacctcaccatttcgaagtcactttccagcaaagctccactgccaagagcgccacatggacctacagcccacttctgaaaaagctgtactgccagatagccaagacatgccccattcaaatcaaagttagtacacccccacccccaggcaccgccattcgcgctatgcctgtttataaaaaagctgaacatgtgacagacgtggtgaaaagatgccctaatcacgagttgggtagagattttaacgaagggcaaagtgcacctgcatcgcatctgatacgcgtggaagggaataacctctcccagtatgtggatgatccggtgacaggccgacaatccgtagtagtaccatatgaaccgccacaagtcggaaccgagtttaccactatactgtacaactttatgtgtaacagctcttgcgttgggggtatgaacagacggccaatccttatcatcattactcttgagatgcgagatggccaggtgctgggccgaagatcctttgaaggacgcatctgcgcctgccctggtcgcgatcgcaaggctgatgaggaccactacagagaacagcaggccttgaacgaatccagtgcaaaaaacggcgcagccagcaagcgtgcctttaagcagtctccacctgccgtgccagctctgggtgcgggtgtcaagaaacgcaggcacggcgatgaggacacatactacctccaggtgcgtggacgcgaaaattttgaaattcttatgaagctcaaggagtccttggagctgatggagctggtccctcagcccttggtcgattcatatcggcagcagcagcagttgctgcaacgtccatcccacctacagccaccctcctatggaccagtactatcccccatgaataaagtccacggaggaatgaataaacttccctccgtcaaccagctggtcgggcagccacctcctcactcctctgctgccacccctaacctcggaccagtgggtccaggcatgcttaacaaccacggacacgctgtacccgctaacggagaaatgagcagcagccatagcgcccaatccatggtttcgggtagccactgcactccaccccctccataccacgcagacccatcccttgtccgaacttggggaccctag

SEQ ID NO: 31338 - DNA, 1668 bp, Artificial Sequence
  Description of Artificial Sequence: Synthetic coding sequence
atggcccaatccacagccacatcacccgatggcggaactactttcgagcacttgtggagttctctggagcccgatagtacctatttcgacctgccccaatcttccaggggcaataacgaagtcgtcgggggaacggattccagcatggacgtgttccacctggaaggtatgacaacctctgtgatggcccaattcaatctcctgtccagtactatggaccaaatgtccagcagggccgcaagcgcctcaccttacactcccgaacatgcagcgtcagtgccaacccattctccttacgcccagccatctagcacttttgatacaatgtcaccagctcccgtcataccatcaaatacggattaccctggtccccatcacttcgaggtcactttccagcaatcttctaccgccaagagcgccacctggacctactctcctctgctgaagaagttatattgccagattgctaaaacctgtcctatccaaattaaggtatccacccctcccccaccagggacggctattcgcgcaatgccagtctacaagaaggctgagcacgtgaccgatgtagtgaaaagatgccctaaccacgaactgggcagggactttaacgagggccagagtgccccagccagtcatctgatcagggtggaagggaataacttgagccagtatgtggacgaccccgtgaccggcaggcagtcagtggtcgtcccatacgagcctcctcaggtcgggactgagtttacaaccatcctgtataatttcatgtgcaattcttcttgtgtcggcggaatgaacagacgtccaattctcattattattacactcgagatgagggatgggcaggtactgggaaggcgttcatttgagggtagaatctgcgcgtgccccggtcgagacagaaaggctgatgaagaccattatagggagcagcaggcactgaacgagtcctcggcaaaaaatggggcagcctcgaagagggcttttaagcaaagcccccctgccgtgccagccctgggggctggcgtcaagaagagaagacacggagacgaggatacctactacctccaggtgcgcggaagggaaaatttcgagatccttatgaagttaaaggagtcactggagttgatggagctcgtcccccaaccgctggtggacagctacaggcagcagcagcagctactccaacggccaccaagagatgctcagcagccctggccacgctccgcatctcagcgacgggacgagcagcaacctcagcgcccagtacacggacttggcgtgccccttcacagtgccactcctcttccacggagaccacagccccgtcaggatctgggcgcactgaaaatccctgagcagtacaggatgactatctggagaggacttcaggatctcaagcaggggcatgactattcaacagcccagcagctgttgaggtcttctaatgcagctactatttccattgggggaagcggtgaacttcagcgccagcgcgttatggaagctgtacactttagagttagacacaccattaccattcctaatcgcggtggccctgggggtggtccagatgaatgggccgactttggatttgatttacctgattgcaaagcaagaaagcaacctattaaagaggagttcacagaagccgaaatccattag

SEQ ID NO: 31339 - DNA, 1281 bp, Artificial Sequence
  Description of Artificial Sequence: Synthetic coding sequence
atgctttacgtgggcgaccctgcaaggcacctagccacggcacagttcaatttgctctcctcgactatggatcagatgtcatctagagccgcaagtgcatccccatacaccccagagcacgcagcctctgtcccaactcatagcccctatgcccagccgagctccacgtttgataccatgtctccagcaccagtgattccttcaaatactgactatccgggtccccaccactttgaggtgactttccagcagtcttctacggccaagagtgccacatggacatactccccattgctcaagaaactgtactgtcagatcgcaaaaacctgccctattcagattaaggttagcactccaccaccccctgggactgctatccgggcaatgcccgtttataaaaaggccgagcatgttacagacgtggtcaaacgctgtcctaatcacgaattaggacgcgacttcaacgaagggcagtctgcacctgcatctcaccttattagggtcgagggtaataacctgtcccagtacgtggacgatcccgtaaccggtaggcagtcagtggttgtcccttatgagcctcctcaggtcggcacggaatttactacaatcttgtacaatttcatgtgcaacagctcctgtgtgggagggatgaaccgtaggccaatcttgattatcatcaccctggagatgcgggatggccaggtactcggcaggcggagctttgagggccgaatatgtgcttgcccgggaagagacaggaaggccgatgaggaccactatcgcgagcagcaagctctcaacgagtcttcggcaaagaacggggctgcttcaaaacgtgccttcaagcagtctcctcccgctgttcccgctctgggagctggagttaagaaacgtcgtcatggtgacgaagacacatattacctacaggtccgcggtagagagaatttcgagattctgatgaagctgaaagaatcactggaattgatggaactggtgccgcaaccactagttgatagctatcgtcagcagcaacagctccttcaaagaccaccgcgtgatgctcaacagccatggcccaggagcgcgtcacagcggagggatgaacagcagccacagcgcccagtacatgggctgggggtcccactgcactcagcgaccccactgccgagacgccctcagccacgccagtttttcaacaggattggagtttcgaaactgcatcgggtctttcatctgccacgggtcacagaacacctccctcctgctgaaccagaccattag

SEQ ID NO: 31340 - DNA, 1353 bp, Artificial Sequence
  Description of Artificial Sequence: Synthetic coding sequence
atgctgtacgtaggagacccagctcgtcatttagcaaccgcccaatttaatctcctgtcttctacaatggatcagatgtcttcaagggccgcttcagccagcccgtatacgcctgagcacgcagcctctgtgcccacacattccccatacgcgcagcctagctccacctttgacaccatgagccccgcacctgtgatcccttcaaatactgactacccaggccctcatcattttgaggttacctttcagcaatctagcaccgcaaaaagcgctacatggacttattctccacttcttaaaaagttgtactgccagatagccaaaacctgccctattcaaataaaggtgtctacccctccaccacccggaaccgctataagagcgatgcctgtttacaaaaaggcagaacacgtgaccgacgtggtgaaacgctgccctaaccatgaactgggcagggatttcaacgagggccagtcagcaccagcaagtcatctgattcgcgtcgagggtaacaacctgtctcagtacgtcgacgaccccgtgacaggacgccagtcagtagttgtgccctatgagccccctcaggtcggcaccgagttcaccacgatactatataacttcatgtgtaacagttcatgcgtgggcggaatgaatcggcgtcctattctgattatcatcactctggagatgcgggatgggcaggtgctcggaaggaggagttttgaagggagaatctgtgcatgtcctgggagagacagaaaggctgacgaggatcactaccgagagcagcaagctcttaatgaaagctccgccaagaatggcgcagcatccaaacgcgcattcaagcaaagtcctcctgccgtaccagccctgggagctggcgtgaaaaaaagaagacacggggacgaagacacctattacctccaggtgagaggtcgagagaacttcgagatcctcatgaaactgaaagagtccttggagctgatggagctggtgccccagccactcgtggatagctacagacagcagcaacaacttttacagcgaccaagccatttacagccacccagttacggtcctgtcctatccccaatgaacaaagtgcacggtggtatgaacaagctgccgtccgtgaaccagctagtgggccagcccccaccacactcctctgcagcaacacccaatcttggccctgtggggccaggaatgctaaataaccatggccacgccgtgccagctaatggtgaaatgtcgagttctcattccgctcagtctatggtgtctggctctcattgcactccaccccctccttatcacgctgatccaagtttggtccgaacatgggggccttag

SEQ ID NO: 31341 - DNA, 1764 bp, Artificial Sequence
  Description of Artificial Sequence: Synthetic coding sequence
atgctctacgtcggtgaccccgcacgtcacctggcaacagcgcaattcaacctgttgagctccacaatggaccagatgagctctcgtgcagcatcggcatccccgtacactcctgaacacgcagctagtgtgccaacccactccccctacgctcagccaagttctactttcgacacaatgtcccctgctcctgtgatcccttctaatacagactatcctggacctcatcacttcgaggtgacgttccaacaatctagtaccgccaaatcagcaacctggacttattctcccttactgaaaaaactttactgccagatcgccaagacatgcccaattcagattaaagtctccacaccaccacccccagggactgcaatccgagccatgccagtttacaaaaaagctgaacatgtcactgacgttgttaaacgctgccctaatcacgagctcgggagggactttaatgagggacagagtgcccctgcctcccacctgattagggtggaggggaacaatctctcccagtacgtggatgacccagtgacaggcaggcagagcgttgtagtgccttatgaacccccacaggtcggtaccgagtttaccaccatcctctacaacttcatgtgtaactctagttgcgtggggggaatgaacaggagacccatccttatcattattacacttgaaatgagagatggacaggtgcttggacgcaggtcctttgagggaagaatctgtgcatgtccaggtagagataggaaagctgatgaagaccactaccgggagcaacaagctctgaacgagtccagtgcgaaaaacggtgctgcttccaagagggcctttaaacagtcgccacccgcagttccggctctgggagcaggcgtgaaaaaaagacgacacggtgacgaagacacatattacctgcaggtgagaggcagggagaacttcgagatcctaatgaagctgaaggagagcctggaactgatggaactggtgccgcagccccttgtagattcgtacagacaacagcagcaactgttacaacgcccaagccatctgcaacccccatcttacggtccagtgctatctcctatgaacaaggtccatggaggcatgaataagcttccctcagtgaatcagcttgttggacagccaccccctcattcgtctgccgctaccccaaatctcggcccagtggggccaggtatgctcaacaaccacgggcatgcagtgcctgcaaacggagaaatgtctagtagccactccgcccagtctatggtgtccggttctcattgtacccccccacctccataccatgctgatccatccttagtctcctttctcacaggcctaggctgccccaattgcatcgagtattttacaagccaaggtctacaatcaatttatcacctccagaatttaactattgaggacctgggggcactgaaaatacctgagcagtatcgcatgaccatctggcgtggtttgcaggacctgaaacagggccatgactattccaccgcacagcagcttttgaggtcaagcaatgcagccaccatttccattgggggaagtggtgagctgcagcgacaaagagtcatggaggccgttcactttcgtgtccggcatactatcacaattccaaaccgcggtggccctgggggagggccagatgagtgggccgattttgggtttgatctgccagattgtaaagctcggaaacagcccatcaaggaagagtttaccgaagcagagattcactag

SEQ ID NO: 31342 - DNA, 1698 bp, Artificial Sequence
  Description of Artificial Sequence: Synthetic coding sequence
atggaccagatgagcagccgagccgcttcagcatctccttacaccccagagcacgccgcttctgttccgactcatagcccttacgcccaaccgtcttccacctttgataccatgtctccagccccagtgatcccatctaataccgattacccaggtcctcatcacttcgaagttacattccagcagtccagtaccgccaaatcagccacctggacttacagccctttgctcaagaagttatactgtcagattgcgaagacttgtcctatccagatcaaggtctcaacaccaccgccacctgggaccgccatccgggcaatgccagtgtacaagaaagcagagcacgtcactgatgtggtcaaaaggtgccctaaccacgagctgggcagggacttcaacgagggtcagtccgctcccgcatcacaccttatcagggttgagggaaacaatctttcgcaatacgtggacgacccagtcacaggccgacaatctgttgtcgtcccctacgaacccccacaggtgggcactgaattcactaccattttgtacaatttcatgtgtaactcctcctgcgtggggggtatgaatcgccgtcccatccttattattatcacattggaaatgcgggatggccaggttcttggaaggcgtagctttgagggacgcatctgcgcgtgtcctggacgcgatcgcaaagctgatgaggatcactaccgggaacaacaagctctgaacgagtcctcagccaaaaatggtgccgcatctaagagggcttttaaacaatctcccccagcagtgcccgctctaggagcgggagtgaagaagcgacggcacggggatgaggacacttattatctgcaggtcagaggtagagaaaattttgagatactcatgaagctgaaagaaagtctggagctgatggagcttgtcccacagccattggttgactcctacagacagcagcagcagctgcttcagcgtcctagtcatttgcaaccgcctagctatggacccgttttatccccaatgaacaaagtgcacggtggcatgaacaagctgccatctgtgaaccaactggtgggccagccgcctcctcattctagtgctgcaactcccaatttgggacctgtgggtcctggcatgctgaataatcatggacatgccgttccagctaatggagagatgtcctcatcacactccgctcagtctatggtttcaggttcgcactgcacacccccacctccctaccacgccgacccctcgctcgtgtcatttcttaccggcctaggctgtcctaattgtatcgagtacttcacaagtcagggcctccagtcaatttatcatctccagaatctgacaatagaggacttgggagctttaaagataccagagcagtaccgcatgaccatttggcggggactccaagatttgaaacaggggcatgattactcaacagcccagcagctcctccgctcgagtaatgctgctactattagcataggcggttcaggcgaactccagaggcagcgcgtcatggaagcggttcatttccgagtgcgccatacgataaccatcccgaatcgcggaggtcccggtggcggacctgacgagtgggcggattttggctttgatctgcccgattgtaaggcccgtaaacaaccaatcaaagaggagttcaccgaagctgaaatccactag

SEQ ID NO: 31343 - DNA, 1911 bp, Artificial Sequence
  Description of Artificial Sequence: Synthetic coding sequence
atggcccaaagcactgcaaccagccccgacggcggaacaacttttgaacacctgtggagctcactcgaaccagactctacctatttcgatctgcctcagagttctaggggaaacaacgaggttgtcggcggaaccgattcatccatggatgtgtttcacctggaaggtatgacaacaagcgttatggcacaattcaatttactcagcagcactatggatcagatgtcttcacgggcagctagtgcctctccatacacaccagaacacgctgcaagtgtccctacccattccccttacgctcagccgtctagcaccttcgacacaatgtcccccgctcctgttattcccagcaacaccgattaccctggaccccatcattttgaagtgacatttcagcagtcgtccaccgccaagtcagcgacctggacgtacagccctctactgaagaagctctattgtcagatcgcgaagacctgccctatccaaattaaagtaagcacacctcccccaccaggcactgccatccgcgcaatgcccgtgtataaaaaagcagagcacgtcaccgacgtggtcaagcggtgtcctaatcatgaactgggcagagattttaatgaggggcagagtgcacctgccagccatctgatcagagtggagggaaacaatttgagtcagtatgtggatgatcccgtgaccgggaggcagtcagtcgtggtcccctacgaaccaccgcaggtgggaaccgagtttactacaatattgtacaacttcatgtgtaatagctcatgtgtgggcggaatgaaccggaggccgatcctgataattattactttggagatgcgggacggacaggtcctggggagaaggtctttcgaaggtcggatttgtgcctgtcctggcagagaccgtaaggcagacgaggaccactatcgcgagcaacaagcactcaacgaatccagtgccaagaacggagcagcctccaaacgggcattcaagcagtccccacccgcagtgcccgctttaggtgccggagtaaagaagcgacgccatggcgacgaggatacatattacctacaggtgcggggacgtgagaattttgagatactcatgaagctgaaggagtctctggaactgatggagttggtgccccaacctctggtggactcttaccgccagcaacagcaattgttacagcgcccttcccatctgcagccaccatcctatggcccagtgctatcaccaatgaacaaagttcatggcggaatgaacaagctgccttcagtgaatcagctcgtgggacaacctcccccacactcttcagctgccactccaaatcttggcccagtcggcccaggcatgttgaacaatcatggacacgcggttcccgctaacggtgagatgagttccagccattctgcgcaaagtatggtgagtggttcccattgcacaccccctcctccgtatcatgcagatccttccctggtgtcatttctcacgggattgggatgtcccaattgcattgagtattttactagccagggcctccaatccatttaccacctgcagaacttgaccatagaggacttgggagctctgaaaataccagaacagtatcgcatgactatatggagggggttacaggacctaaagcagggccacgactatagcacagcccaacagctgctccggtctagtaacgccgcaaccatatcaattggcggatccggggagctgcagaggcagcgggtcatggaagccgtccactttcgcgtccggcacaccatcaccattccaaatagaggcggacccggtggtggcccagacgagtgggccgatttcgggttcgacttgccagattgtaaagccaggaaacagcccattaaagaggaattcacagaggccgagatacattag

SEQ ID NO: 31344 - DNA, 1053 bp, Artificial Sequence
  Description of Artificial Sequence: Synthetic coding sequence
atgggggctggtgcttcggctgaggaaaaacattctcgtgagcttgagaagaagctcaaagaggatgcagaaaaggacgctcggaccgtgaagctgctgctgcttggcgcaggcgaaagtggcaaatcaacaatcgtgaagcagatgaagattattcaccaggacggctacagcttggaggaatgtttggaatttatagcaataatctacgggaatactctccaaagcatcctggctatcgtgagggccatgactaccctaaatatccagtacggggactccgctagacaggatgacgcaagaaaattaatgcatatggcagatacgattgaggagggtactatgcctaaggagatgagcgacattattcagaggctgtggaaggattctgggattcaagcatgctttgagcgcgcaagtgaataccaactgaatgatagcgccggttactatctgtccgaccttgaaagactcgtcacaccgggatatgtgcccactgagcaagacgtcttgaggtcccgggtgaagaccaccggtatcattgaaacccagttttcctttaaagacctcaacttcagaatgtttgacgtgggcggtcagcgcagcgagaggaaaaagtggatccactgcttcgagggcgtgacatgcatcatcttcattgccgcactgagtgcctacgatatggttcttgtggaggacgatgaggtaaatcgcatgcatgaatctctgcacctgttcaattcaatttgtaatcacagatatttcgctacaacttcaatagtacttttcttaaacaaaaaagatgttttttttgagaagataaagaaagcacacctgagcatctgcttccctgactacgacgggcctaatacatacgaagatgccggaaactacatcaaggtgcaatttctagagcttaatatgcgccgagacgtaaaagaaatttactcacatatgacctgtgccacagacacgcagaatgtcaagtttgtgttcgacgctgtgacggacatcatcatcaaagagaatctcaaagactgcgggcttttctag

SEQ ID NO: 31345 - DNA, 609 bp, Artificial Sequence
  Description of Artificial Sequence: Synthetic coding sequence
atgatgcaggacgtgtcctcatcaccagtatctcccgcagatgatagtttgagcaatagcgaggaggaaccagatagacagcagccaccctccgggaagcgtgggggtaggaaacgccgttcttcgcgtcgatcagctggcggaggggctggccctggcggagctgcgggtggtggggtgggtggcggagatgaacctggatcccccgctcagggaaagcgcggtaaaaaatccgcgggttgtggcggtggagggggagcgggaggaggcggtggatcttctagtggaggtggcagtcctcagtcctacgaggagttgcaaacccagcgtgttatggccaacgtgagggaacgtcagcgcacacagtctctgaacgaggccttcgcagctttgagaaagattatcccgaccttgcctagtgataagctgtcaaagatccaaaccctgaagctcgccgctaggtatattgattttctgtaccaggtcctccagtccgacgagctggatagcaaaatggcttcttgtagttacgtggcgcacgagcggctgagctatgcattttccgtttggcgcatggagggagcctggtctatgtccgctagccactag

SEQ ID NO: 31346 - DNA, 741 bp, Artificial Sequence
  Description of Artificial Sequence: Synthetic coding sequence
atgggcgatagggaacagttgcttcagagggctcggctcgctgagcaagcggaacgatatgacgacatggccagcgcaatgaaggctgtgacggaactgaacgagcccctatccaacgaggacagaaacttactttccgttgcttataaaaatgtcgtcggtgcacggagaagtagttggagggttatcagcagcatcgagcaaaagaccatggcagatggcaatgaaaagaaactcgagaaagtgaaagcatacagggaaaagatcgaaaaggagctggagaccgtttgcaacgatgtcctgagccttctggataagtttctgatcaagaactgtaatgactttcagtatgaaagcaaagtgttttacctgaaaatgaagggggattattaccgctatcttgcagaggttgctagcggtgaaaagaaaaactcagtggtagaagcctccgaagccgcatacaaagaggcctttgaaattagtaaggagcaaatgcagcctacacatcctatcaggctgggactggcactgaacttttccgtgttttattacgaaatacagaatgcccctgagcaggcctgtttgctggccaagcaggcatttgacgacgcgatcgctgaattagacaccctgaacgaagattcctacaaggattcgacattgatcatgcagctgctaagagacaacttgaccctctggacttctgaccagcaagatgaagaggccggagaagggaattag

SEQ ID NO: 31347 - DNA, 1626 bp, Artificial Sequence
  Description of Artificial Sequence: Synthetic coding sequence
atggtctggagggttcctccgttcctcctgccgatcctgtttctaggcacccattatcaactggatgtgcaattgtaccattgcactctactgggtcctgcctcgcccccagcccatgtgctccttcccccatcagggcctccggctccgaggcacctgcacgctcaggccctgtcagactctgagatccagcttacatggaagcacccagaagcactgcctggccctatcagtaagtatgtggtggaggtacaagtggctggcggagcaggggatccattatggattgatgtggatcgtcctgaggaaactagtaccatcataagaggtcttaatgcttctacaaggtatcttttcaggatgagagcctccatacagggcctcggggattggtcaaacaccgttgaagagagcacactgggtaatggcctgcaagccgagggcccagtgcaggagtcccgggctgccgaggaggggctagatcagcagctgattctggccgtcgtaggctcagtgtctgctacatgcctgacaattctcgcggctttgctcaccctcgtatgtattagaagaagttgtttgcacaggaggcgcacctttacataccagtccggttccggcgaagagaccatcctgcaattcagctcggggacccttacccttacgaggagacctaagttacaacccgaaccactttcctacccagtgctggagtgggaagatatcacctttgaagatctgatcggcgaaggcaacttcggacaagtaatcagagctatgattaaaaaggacggccttaagatgaacgctgctataaagatgctgaaggaatacgcctcagaaaacgaccatcgggatttcgctggtgagctcgaagtgctctgcaaactcgggcatcaccctaacatcataaatctcctaggtgcttgtaagaaccggggttatctatatatagccatagagtatgccccttatggaaaccttctagatttcctcaggaagtctcgcgtgctggaaacagatcctgccttcgcgagagagcatggcactgcttccacgttgtcaagcaggcagctcctgcggttcgccagcgatgccgctaatggcatgcaatacctgagcgaaaagcaattcatccacagggacttggccgcacggaatgttctcgtgggcgaaaatctggcctctaagatcgctgatttcggattgtcccggggtgaggaggtgtacgtcaaaaagaccatgggccgattaccagtcagatggatggcaatcgagtccttgaattattctgtgtacacaactaaaagcgacgtgtggtcctttggtgttcttctatgggaaatcgtcagtctggggggaacaccctactgcggaatgacttgcgccgagctgtatgagaaattacctcaaggataccgcatggagcaacccaggaattgtgatgacgaggtgtatgaactgatgcgacagtgttggcgcgacaggccatatgagaggcccccatttgcccagattgcccttcagttaggacggatgttggaggctcgtaaagcctatgtgaacatgtctttgttcgagaatttcacctatgccggaattgatgccaccgctgaggaggcatag

SEQ ID NO: 31348 - DNA, 3417 bp, Artificial Sequence
  Description of Artificial Sequence: Synthetic coding sequence
atggtgtggcgagtccctccattccttttaccaatccttttcttggcaagtcacgtcggcgctgccgtggacttgactttgctggccaatctgcggttgaccgatccccagcgcttcttccttacttgtgtttccggtgaggctggcgcaggaagaggatctgacgcatggggcccacccctcctgctggagaaggatgaccgcatcgtgcgaactcccccaggacctccgctgcgactggccaggaacgggagtcaccaggtcaccttgcgcggtttcagtaagcctagtgacctcgttggagtattctcttgcgttggtggagcgggagctagaaggacccgggtgatctatgttcataacagcccaggcgctcacctgctccccgacaaggtcactcatactgtcaacaagggagataccgcagtgctgtcggcccgagttcacaaagaaaagcagacagatgtaatttggaagtccaacgggtcttacttctacactctggactggcacgaagcccaggacgggcgattccttctgcaactgccaaatgtacagcccccatcctcagggatctattcagcaacttacttagaggccagcccactgggctccgcattcttccgtttgattgttcgcggttgcggagcagggaggtggggccctggttgtacaaaggaatgccctggctgtctgcatggcggagtatgccatgaccacgatggcgagtgcgtctgcccgcctgggttcactgggactagatgtgaacaagcatgccgagagggacggttcggccagtcctgtcaggaacagtgccctggaatatctgggtgcagaggactgaccttctgcctgccagatccctatggttgctcatgtggatcaggctggcgtggatcccagtgtcaggaggcttgcgctccaggacacttcggagccgattgtagactgcagtgccagtgccagaacgggggaacctgtgatcgattttctggctgcgtgtgtcctagcggctggcatggtgtccactgcgagaagtccgaccggatcccccagatcttgaatatggcctctgagctggagtttaatctagaaaccatgcctcgcattaactgtgccgcagcaggaaacccctttcccgtacgcggttcaatcgaattgagaaaacctgatggtacagtactcctgtcaacaaaggcaattgtcgagcccgagaagacaaccgcggagtttgaggtccctcgtctcgtgttggcagactccggtttctgggagtgtagagtgagtacctcgggaggacaggactcccgtaggttcaaggtgaacgtaaaagtccctcccgtccccctggctgcaccccgtctgctcaccaagcaaagcagacagcttgtggtgagccccctggtgtcattttccggagatggccctatctccactgttagactgcattaccggcctcaagactccacaatggattggagcacgattgttgtggacccttctgagaacgtgacgctaatgaatcttagaccaaagaccggttattccgtccgagtccagctgtccaggccaggtgaggggggagaaggggcatggggcccacctacacttatgactactgactgtcctgaaccactgcttcaaccatggctcgaagggtggcatgttgaaggtacggacagacttcgggtctcctggagcttacccttagttcccggacctctggttggtgacggctttttgctgaggctgtgggatggaacacggggacaggaacggagagagaacgtgagctctcctcaggccaggactgctctgctgacaggattgactcctggaacccactatcaattggacgtccagttataccattgtacgcttttgggtcctgcctccccgcctgcccacgtactgcttcctccatctggtccaccagctccaaggcacttgcatgcacaggcactttcagacagcgagatccaactgacttggaagcatcccgaagccttgcctggaccgatctccaagtacgttgtcgaagtccaggttgccggtggggctggagaccccctctggatagacgtggaccgtcccgaagaaacatcaaccatcatcagaggcctgaatgcctctactcgctacttgttccggatgcgtgctagcatccagggactaggtgactggtctaatactgtcgaggaatccaccctagggaacgggctgcaggctgaaggacctgtgcaggagtctagggctgcagaggaagggctcgaccagcagttgatactcgcggttgttggcagcgtgtctgcaacttgcctgaccatccttgcagcacttctgactctggtgtgtataagacggagctgcctccataggcgaaggacctttacatatcaaagtggctctggagaggaaacaatcctgcagttctcctcaggaactttaacactaactagaaggcctaaattgcagcccgaaccacttagttatcccgtactggaatgggaggacataacctttgaggacttgattggagagggaaatttcggacaagtcattagggcaatgatcaaaaaagatggccttaagatgaacgcggcaattaagatgcttaaggaatacgcaagcgagaatgaccatagagacttcgccggtgagcttgaagtgctgtgtaagttggggcatcatcccaatattatcaacctgcttggggcttgcaagaaccggggttatctgtatatcgcaatagaatatgcaccttacgggaaccttcttgatttcttacgtaaatcaagagtgctcgaaacagacccagccttcgcacgtgagcacggcacagcttctactctgtcttcccgacagttgctacgtttcgcttcagatgcggcaaacggtatgcagtacctgagcgagaaacaatttatacaccgtgacctcgccgcaagaaacgtcctggtcggtgaaaacttggcgtcaaaaatcgccgatttcgggctgagccgtggagaggaagtgtatgtgaagaaaacaatgggtcgtcttccagtcagatggatggccatcgagtctctcaattattccgtgtataccacaaagtcagatgtctggagcttcggcgtgctgctctgggagatcgtcagcttgggaggcaccccatactgtggcatgacttgtgcagaactctacgagaagctaccccagggctaccggatggagcagccacgaaattgtgatgatgaggtgtacgaattgatgaggcagtgttggagggacagaccatacgaaagacctccctttgcacagatcgcactgcagctgggcagaatgctggaggctagaaaggcctatgtgaatatgagccttttcgagaattttacctacgcgggtatagacgccaccgcagaggaggcctag

SEQ ID NO: 31349 - DNA, 2352 bp, Artificial Sequence
  Description of Artificial Sequence: Synthetic coding sequence
atggccagcgagttagaattcaacctggagaccatgcccagaataaattgcgctgcagctggaaaccccttccctgtcaggggttccatcgagctgcgaaagcccgacggaactgttcttctaagcaccaaggccatcgtcgagccagagaagaccacagcagaattcgaagtgcccagattagttttagccgactcaggcttttgggaatgtcgggtgagcacatctgggggtcaggatagccgcagatttaaagtcaacgtcaaagtcccccctgtgccattggccgctcctcgccttctgacaaagcagtcgcggcagcttgtagtgtcaccactcgtatccttcagtggagacgggcctatttcgacagttcggctccactacagaccccaagacagcaccatggattggtctactatcgtggtggaccccagcgagaacgtcaccctcatgaacctgcggcctaaaactggctacagcgttcgggtccagctgtctcgtcctggcgagggaggtgaaggagcctgggggccacccactctgatgaccactgactgcccggaaccactactacagccttggctggagggctggcacgtagagggcaccgaccgcctgcgcgtgtcatggtctttgcccctggtgccaggtccactggtgggagatggttttttgctgagactctgggacggaactcgcggacaggagcgcagagaaaatgtgtctagtccacaggcaaggaccgctctcctgaccggccttactccgggtacgcattatcagttggacgtgcagctgtatcattgtacattattggggcctgcctcccctcctgcccatgtgctgcttccacctagtggtcccccagcacctaggcacctgcacgctcaagcactcagtgattctgagatccaactgacctggaaacacccagaagccctgccgggtcccatctctaaatacgtagtcgaagtgcaagtggccggtggcgctggcgaccccctgtggatcgatgtagacagacccgaagagacgtcaaccatcatccggggactaaacgcgtcaacgagatacctttttcgcatgcgggctagcatccagggcctcggagactggtcaaatacggtagaagaaagcactctgggtaacggtctccaggctgagggccctgtacaggagtcccgcgcagcggaagaaggtctcgaccaacagctgattcttgctgtggttggctccgtgtccgcaacctgtctcacgattctggctgctctactaaccttagtttgcatccgcagaagttgtctgcatcgcagaaggacattcacataccagagcggatcaggtgaggagaccatccttcaattttcctccggcacacttactctaactcggaggccgaaactgcaaccggagcccctcagctaccctgtcttggaatgggaagatatcacatttgaagatctgataggagagggcaattttggccaggtgatcagagcaatgattaaaaaagacggcttgaagatgaacgccgcaattaaaatgttgaaggaatatgcctctgaaaacgaccaccgggactttgcaggagaattggaggtgttatgtaagctcggccatcaccctaatataattaacttgctgggtgcctgtaagaacaggggttacttgtacatcgctattgagtatgccccatacgggaacctgctggatttcttgcgcaagagccgtgtgctcgagaccgacccagcttttgccagagagcatggaacggccagcaccctctcctctcgtcagcttctgagattcgcttctgatgccgctaacggtatgcagtacctttcagagaaacagtttattcatagagatcttgctgctcgtaacgtgctggtgggcgagaatctagcaagcaaaatagccgacttcggtttgagtcgcggagaggaggtctacgtcaagaaaacgatgggccgacttccagttagatggatggccatcgagtcacttaactattcagtgtacactaccaagtccgatgtgtggagctttggcgtcttactttgggaaatcgtctcactgggcggaacgccctactgcgggatgacctgcgccgagctgtatgaaaagctgccccaggggtaccgcatggagcagcccagaaattgcgacgatgaggtctatgaactgatgcggcagtgttggcgggacagaccttatgagcggccaccctttgcacagattgccctgcagcttggcagaatgcttgaggctaggaaagcatacgtgaatatgagcttgtttgagaactttacctacgccggaatcgacgcgaccgctgaagaagcctag

SEQ ID NO: 31350 - DNA, 954 bp, Artificial Sequence
  Description of Artificial Sequence: Synthetic coding sequence
atggtgtggcgggtgcccccatttttgctgccgatcttgtttcttgcgagccatgtcggggcagccgtggatctgaccttattggccaatctgaggctcacagacccccaacgcttctttttaacttgtgtgtcaggcgaggcaggtgctggccgtggaagcgatgcctgggggccaccactgctcctggaaaaggacgaccggatagtgaggaccccccctggtcctcccctccgtctggctaggaacggtagtcaccaggtgaccctgagggggttctccaagccttctgatttggttggcgtgtttagttgcgttggaggggctggtgctcgccgtacccgtgtgatatatgttcataactcccctggcgctcatctcctccctgataaggtcacccacaccgtcaacaagggagacactgcagttctgagcgctagggtgcataaagaaaagcagaccgatgtgatttggaagtccaacggctcatatttctatacactagattggcatgaggctcaggatgggcgattccttctacaactgcctaatgttcagccacctagttccggtatatatagcgctacctacctggaggcctcgcccctggggtcagcctttttcaggctgatagtgcggggatgcggggctggccgatggggacctggctgtaccaaggagtgtcctgggtgcctgcatggcggagtttgtcacgatcacgatggagagtgcgtctgtcctcccggatttaccggaacacgctgcgagcaagcttgtcgtgagggacggttcggccagtcttgtcaggaacaatgtccaggcatttccggctgccgaggacttaccttctgcctaccagatccttacggatgcagctgcggctccggttggcgtggaagtcagtgccaagaggtgcaccaagggcactgtggcgcacgagaagatcactcatag

SEQ ID NO: 31351 - DNA, 1266 bp, Artificial Sequence
  Description of Artificial Sequence: Synthetic coding sequence
atgagagctagcattcagggcctcggcgactggagtaatacagtcgaagagagtactctgggaaacggactgcaggcggaaggccctgtacaggaaagccgcgctgccgaggagggactggatcagcagctaattttggctgtggttggcagcgtgtccgccacctgcttgaccattttggcggcattgttgactttggtatgtatacggagaagttgcctacacaggcgccgaacatttacttaccagtccgggtccggcgaagagacaatccttcagttttccagcggtaccctgacccttacaagacgtccaaaactgcagccagagcctttgtcataccctgtcctggagtgggaagatatcacctttgaagacttgatcggcgagggcaactttggccaggtaataagggctatgatcaagaaagatggcctgaagatgaatgctgcaattaaaatgttaaaagaatatgccagtgagaatgatcacagagattttgcgggagagctagaggtcctgtgcaaactcggccaccaccctaacatcattaacctcctgggtgcatgtaaaaaccggggatacctatacatcgcaatcgagtacgcaccttacggaaacctcttggacttcctcagaaagtcaagggtgctggagaccgatcccgctttcgcccgagaacacgggactgccagtaccctgtccagcaggcagttactgagattcgcatctgatgccgcaaacggaatgcagtacctgtcagagaagcaattcatccatcgcgatttagcggctcgtaatgtcttagtgggtgaaaatttagcttccaaaattgcagattttggcctttcccgcggtgaggaagtctatgtcaaaaaaactatgggccgtctgccagtccgatggatggcaattgaaagcctaaattatagtgtctacacaacgaaatccgacgtttggtcattcggcgtcttactctgggaaatcgtgtccctggggggaaccccttactgcggcatgacatgcgctgagctttatgagaaactgccacagggctataggatggagcagccacggaattgcgacgatgaagtgtatgagttgatgagacaatgttggcgggacaggccatacgagcgacctccctttgcccagatagcactccagctcggccgaatgctggaggctcggaaggcatacgttaatatgtctctgtttgaaaatttcacatacgcaggtatagatgccacagcagaggaagcctag

SEQ ID NO: 31352 - DNA, 1140 bp, Artificial Sequence
  Description of Artificial Sequence: Synthetic coding sequence
atggtgtggcgagtgcctccatttctcctcccaatcctgtttttggccagccacgtcggtgccgcagtggaccttactctcctcgccaacctacgcctaactgatcctcagaggttttttctgacgtgtgtgagcggcgaggccggtgcgggacggggaagcgacgcttggggtcccccacttctgctggaaaaagacgaccgcatcgtccggacacctcccggaccacccctgaggctggcccgtaacggctcgcatcaagtgacgctgagagggtttagcaagccatcggatctggtgggcgttttctcctgcgtgggaggcgcaggggctcgtcgaactagggtgatctatgtacacaatagtcctggcgctcacctgcttcctgacaaagtcacacacaccgtgaacaaaggtgacaccgccgtcctgtccgccagggtccacaaagaaaaacagacagatgtcatctggaaaagcaacgggtcttacttctatacgctagactggcacgaagcccaagatgggcgatttctgctgcagctgcctaatgtccagcctccatctagcggcatttattcagccacgtatctagaagcaagtccattaggatcagcttttttccggcttatcgttcgcggatgcggagcaggcagatggggccctggctgtacaaaggagtgcccaggctgcctccatgggggtgtatgccatgatcacgatggcgaatgcgtgtgtcctccaggattcaccggcactcgctgcgagcaggcctgtagagaaggacgctttggccagagttgtcaggagcaatgcccgggaatttcaggttgcagaggcctcactttttgcctcccagacccttatgggtgctcatgtggcagtgggtggcgcggaagtcagtgccaggaagcatgtgcaccaggccactttggggctgattgcagacttcagtgccagtgccagaacggaggaacttgtgatcgctttagtggatgcgtctgcccttcaggctggcacggggtgcactgcgagaagtctgggtggagagattgggtggatacctctacggagaagcagaacacagatgaaggacgattcggcggacacgtgtcagcacccgtgggtgcaccaggctag

SEQ ID NO: 31353 - DNA, 819 bp, Artificial Sequence
  Description of Artificial Sequence: Synthetic coding sequence
atggctttgctggtccgcgtgcttcgaaatcagacttctatcagtcagtgggtccctgtgtgctccagactgatccccgtgagccccactcagggccagggcgaccgcgctctgtcccggacttcccagtggccacaaatgagccaaagtcgcgcatgcggaggcagtgaacaaatcccaggcatcgatattcagttgaaccgcaagtaccatactactaggaaactgtctacgactaaagattccccccagccggtggaggagaaagtgggagcctttactaagatcatagaggctatgggctttaccgggccattgaagtacagatgccagatgcctgatacgtttaactcatggttcctcataaccctcctccatgtgtggatgtgcctcgttaggatgaagcaggagggtagaagtggtaaatatatgtgccgaatcattgtacattttatgtgggaagacgtgcagcaaagaggacgagtgatgggcgtcaacccttatatcctaaagaagaatatgattctgatgaccaaccatttctatgccgcaattctcggctatgacgaaggcatcctctcggacgatcacgggctcgccgctgccctgtggagaactttttttaacagaaaatgtgaagaccccagacacctagaactgctggttgagtatgtccgaaaacagatccaatatttggacagcatgaatggggaggacctcctgctaactggcgaggtgagttggagacctctcgtggagaaaaacccgcagtccattctgaaaccccatagcccaacctacaacgacgaagggctctag

SEQ ID NO: 31354 - DNA, 564 bp, Artificial Sequence
  Description of Artificial Sequence: Synthetic coding sequence
atgcagcctatcgatacctgcgtcagttaccctagaacgggaggtcaagggtctgtcagtcatttccctggctgccaaatgcccgacacctttaattcatggtttctgattaccctgctccacgtgtggatgtgcctggtaagaatgaaacaggagggaaggtccggtaagtatatgtgtcgcattatcgtgcacttcatgtgggaagatgtgcaacaacgaggacgggtcatgggggtcaacccctacattctaaagaaaaatatgatcctaatgacaaaccacttctatgcagctattcttggttatgatgaaggcatcttatcggatgaccacgggttggctgctgctctgtggcgcaccttctttaaccgaaaatgtgaagaccctagacacctcgaactgctagtggaatatgttagaaaacagatacagtacctcgactcaatgaacggcgaggatctcttgttaaccggggaggtctcatggcgccctctcgtagagaaaaaccctcagagtattctaaagcctcactctccaacttacaacgacgaaggtctgtag

SEQ ID NO: 31355 - DNA, 696 bp, Artificial Sequence
  Description of Artificial Sequence: Synthetic coding sequence
atggctcttctcgtccgggtgctccgcaatcagacatccattagtcagtgggtacccgtgtgcagccgtctcattccagtgagtcctacacaagggcaaggggatcgcgctctgtcccggacctcccagaaaatcaaaatagccgctttacgaatgtacacttcttgcgtggaaaaaacagatttcgaggaattttttctacggtgtcaaatgccagacactttcaattcctggttcctgatcacactgctccatgtctggatgtgcctggtccgcatgaaacaggaaggcagatccggcaagtacatgtgccggattatagtgcatttcatgtgggaggacgtgcagcagcgaggcagggtcatgggggtgaatccctatatcttgaaaaaaaacatgatactgatgaccaatcacttttatgcagccatactgggttatgatgaaggcatcctgtcagacgaccacgggctggcagccgcactctggcggactttttttaataggaaatgcgaagaccctcgacatcttgagctgcttgttgaatatgtgaggaagcagatccagtatctggattctatgaacggggaggatttattgctcaccggcgaggtgtcatggcggccactggtcgaaaagaatccccagagcattcttaaaccacactcccccacctacaatgacgaggggctctag

SEQ ID NO: 31356 - DNA, 822 bp, Artificial Sequence
  Description of Artificial Sequence: Synthetic coding sequence
atggctttgttggtgagggtacttcgtaatcagaccagtatcagccagtgggttcctgtgtgcagcagactgattccagtgagtcccacacagggtcagggtgacagggccctgtcacggaccagccagtggccccagatgagccaatctcgcgcatgcggcggtagcgagcaaatccccggaatagacattcagctgaatcggaaataccacacaacccggaagctcagcactactaaggactctccacagcctgtggaagaaaaggtgggggcattcaccaaaatcatcgaagctatgggttttaccggccctctgaaatattcgaaatggaagatcaagatcgccgcattaagaatgtacacatcctgcgtggagaaaacggacttcgaggagttcttcctgagatgccaaatgccagatacctttaattcctggttcctcattacgcttcttcatgtctggatgtgcctcgtaaggatgaagcaggagggccgatctggaaagtacatgtgccggatcattgtacatttcatgtgggaggatgtgcaacaacgcggtagggtgatgggaggaattctctcggacgaccacggactggcggcagcgctttggaggacattcttcaaccggaaatgtgaggaccccagacatctcgagctcctcgtggaatacgttaggaagcaaattcagtatttggatagcatgaatggggaagatttactactcacgggagaagtcagttggaggcccttagtggagaagaatccccagtctatcctaaagcctcactcgccaacgtataatgacgaaggtctctag

SEQ ID NO: 31357 - DNA, 900 bp, Artificial Sequence
  Description of Artificial Sequence: Synthetic coding sequence
atggcactgttggtcagggtccttcgcaaccagacatccatctctcaatgggtcccggtctgcagtaggctcattcccgtgagtcctacccaggggcagggggatcgcgcactctctcgcacaagccagtggcctcaaatgtcacagtccagagcctgtgggggttcagagcagatacctggcattgatattcagttgaaccgcaagtaccacacaaccaggaagctatccaccactaaggacagccctcagcctgtggaggagaaggtgggggcattcaccaagataatagaagccatgggtttcaccggtcctcttaaatactcaaagtggaaaattaagattgctgcactgcgaatgtacaccagctgcgttgagaagaccgattttgaggagtttttcctccgatgtcagatgccagacacatttaatagctggtttttaatcacccttctgcatgtttggatgtgtctggttcgaatgaaacaggaaggaagaagtggaaaatacatgtgcaggatcattgtgcactttatgtgggaggatgtgcaacaacggggacgcgtgatgggggtgaacccttacatcctgaagaaaaatatgattcttatgactaatcatttctacgccgcaatcttgggctacgatgagggaatcttgagcgatgaccatgggctcgctgccgctctttggagaacttttttcaatcgcaaatgcgaggacccgcgtcaccttgaactcctggtggagtatgtacgcaaacagatacagtatcttgactccatgaatggggaggacctgcttctgaccggtgaggtcagctggcgccctctcgtggagaaaaacccacagagcattctaaaaccccactctcctacctataatgatgagggactctag

SEQ ID NO: 31358 - DNA, 603 bp, Artificial Sequence
  Description of Artificial Sequence: Synthetic coding sequence
atgggctttactggccctctgaagtacagcaagtggaagattaagatcgcggcactgcgaatgtacacttcatgcgtcgagaagaccgattttgaggagttcttcttacggtgccagatgcccgatacattcaatagttggtttctgattacactgcttcatgtctggatgtgtctggtcagaatgaagcaggaaggtaggtcgggcaaatatatgtgccggattattgtacacttcatgtgggaagacgtgcagcagcgtggacgcgtgatgggagtgaacccctacattcttaagaaaaacatgattctgatgactaatcatttctatgccgcaatcttgggatacgatgagggaatactgagtgatgatcacggacttgccgctgctctgtggcgcacattcttcaaccggaagtgcgaagaccccagacaccttgagttgctggtggaatacgtgaggaagcaaattcagtacctcgactccatgaatggagaagatctgcttcttactggagaagtatcttggaggcccctagtggagaagaatccccagagcatccttaagcctcattctcctacctataacgacgaaggtctttag

SEQ ID NO: 31359 - DNA, 489 bp, Artificial Sequence
  Description of Artificial Sequence: Synthetic coding sequence
atggcactgctcgtgcgagtgctccgcaatcagaccagtatcagtcaatgggtgcctgtctgttcaaggttgatcccggtatcccctacgcagggtcaaggggaccgggctttatccagaaccagccaatggcctcagatgagccagtcgcgggcttgcggcggatcggaacaaattcctggcatcgacatacagctcaacaggaagtatcacacaacgcccatactcgggtatgacgaaggaatcttgtctgacgaccatgggctggctgccgctttgtggcgcactttttttaacaggaaatgcgaagatcctcgtcacctggaactgctggtggaatatgtgcggaagcagatccagtatctggatagcatgaacggggaagatctgctattgaccggagaggtctcttggcgaccactggtggaaaaaaatccccaatcaattctaaaaccacattcccctacctataatgatgaggggctttag

SEQ ID NO: 31360 - DNA, 435 bp, Artificial Sequence
  Description of Artificial Sequence: Synthetic coding sequence
atgtgcttagtgagaatgaaacaagagggacggagcggtaagtacatgtgccggatcatcgtgcatttcatgtgggaagacgtccagcagagaggcagggtcatgggcgttaacccatacatactgaagaagaatatgatcctaatgaccaatcatttttacgctgccatcctgggctacgatgaggggatcctgagcgacgatcacgggctcgccgctgccttatggcgaacattctttaacaggaaatgtgaggaccctcggcacctggagctcctcgttgagtacgtaagaaagcagatccagtacttagattccatgaacggcgaagatcttctgctcaccggcgaggtgtcctggagacctttagtggagaagaacccacaatctatcttaaagccccactcacccacatataacgacgagggactctag

SEQ ID NO: 31361 - DNA, 447 bp, Artificial Sequence
  Description of Artificial Sequence: Synthetic coding sequence
atggccctgctcgtcagagtgctccgaaatcagaccagcatcagccagtgggtgcccgtgtgcagtcgtttaattcccgttagtccaacacaggggcagggtgatcgggctctgagccggacaagtcaatggcctcagatgtcgcagtctcgcgcttgtgggggttccgagcagatcccaggcattgacatccagctgaaccgaaaataccacacaacaagaaagctctcgactactaaggacagtcctcagcccgttgaggagaaggtgggtgccttcactaaaatcatagaggccatgggctttaccggacccctaaagtatagtaagtgggacgtgagtagtcctaacgaggcaggtagacccgagtgggaagtgcacgtgagttaccacagtagtttctacgtcgggggttgttccgctgccagacagagccatggaggctag

SEQ ID NO: 31362 - DNA, 825 bp, Artificial Sequence
  Description of Artificial Sequence: Synthetic coding sequence
atgttgagcgtcgcttcaagatctgggccattcgccccagtgctgagcgcaacgagccggggtgtggccggagcccttagacctttagtacaagccacagtgcctgcaactcccgagcaaccagtcctggacctgaagcggcctttcttgagccgcgagtccttgtctggtcaagcggtacgtagacccttagtcgcatctgtgggtttgaacgtacccgcaagcgtgtgctatagtcataccgacatcaaggttcccgatttctccgagtacaggcggctggaggtccttgactccaccaagagttctcgagagtcaagtgaagcccgtaagggattcagttacttggtgactggagtgaccactgtcggagttgcctacgccgcaaaaaacgccgtgactcagttcgtgtccagcatgtcagctagcgccgatgtcttggcgttggccaaaatcgagattaagttgtctgatatccctgaaggcaagaacatggcattcaaatggcgaggcaaacctctgttcgtccggcacagaactcagaaggaaatcgaacaggaggccgctgtggagttgagtcagttaagagacccgcagcatgatctcgacagagtgaagaagcccgaatgggttatactcattggtgtctgtacccatttaggctgcgtccccatagctaatgccggagatttcgggggttattactgcccttgccacggctctcactatgacgcaagtggcaggatccggttggggcctgcacctctgaacctggaggtaccaacctacgaatttacctctgacgatatggtaatcgtgggctag

SEQ ID NO: 31363 - DNA, 1221 bp, Artificial Sequence
  Description of Artificial Sequence: Synthetic coding sequence
atggccgctggggctggtgcaggcagcgcacccaggtggctgcgggcactgagcgaacccctctctgctgcccagctgcggaggctggaggaacatagatactccgccgctggtgtctcgctattggagcctcctctgcagctgtactggacatggctgctccagtggatccctctttggatggccccaaactctattaccctgttgggcctcgccgtgaacgttgtcacaactctggtcctcatcagctactgcccaaccgccactgaggaggctccctactggacctaccttctctgcgccctcggactgtttatttaccaaagcctggatgcaatcgatggcaaacaggctaggcggaccaactcttgttccccacttggcgagcttttcgatcacggctgcgatagtctctctaccgtgttcatggccgtcggtgcctccattgctgcccgtctgggcacataccccgattggttctttttttgctcatttattggaatgtttgttttttactgcgcccactggcagacctacgtgagtggtatgctaagattcggaaaagttgatgtaactgaaatacagattgccttggtcatagtgttcgtgttgtcagcttttgggggagcaacaatgtgggactacactatacccatcttggagattaaactcaaaatcctgccagtgcttgggtttctggggggagtgattttcagttgcagcaattactttcacgtgatactccacggaggcgtgggtaaaaacggatcgaccatagctggtacctcagtgctcagtcctgggctacatataggattgattatcatcctggctatcatgatatataagaaaagcgccactgacgtcttcgagaagcatccatgtttgtatattctgatgtttggatgtgtgtttgcaaaggtaagccaaaagttggtggtcgcacacatgactaagtcagagctgtacctgcaggacacagttttcctcggccctggcttactgtttctcgatcagtactttaacaactttatcgatgaatacgtggtgctgtggatggcaatggttatatcctcgttcgatatggtcatttactttagcgctttgtgcctccagatatccagacacttgcatctaaatatttttaagaccgcctgtcaccaggcccctgagcaagttcaggtactttccagcaagtcacatcagaacaatatggactag

SEQ ID NO: 31364 - DNA, 2508 bp, Artificial Sequence
  Description of Artificial Sequence: Synthetic coding sequence
atggcagaactgtccgaggaggccctcctgagtgttctgcccacgattcgagtccctaaagccggtgaccgggtgcataaggatgaatgtgcattttcatttgacactcccgagtccgagggcggtctgtacatctgtatgaacacattcctgggatttgggaaacagtacgtggaaaggcacttcaacaagactggccaacgcgtttacctccacctgcgcagaacccggcgacccaaagaggaggacccagctactgggaccggggatccccctagaaaaaagccaacaaggctggccattggggtggagggcggttttgatctcagcgaagagaaattcgagctcgatgaggacgtgaagatagtgatcctccctgattatctcgagattgccagagacggcctggggggtctgcctgatattgtaagagatcgggttacttccgctgtggaagcactactctccgccgattccgcatcacgcaagcaagaggtgcaggcatgggacggtgaggtacgccaagtctctaagcatgctttttccctcaagcagctggataatcctgctagaatccccccatgcgggtggaaatgttctaaatgcgacatgagagagaacctatggctgaacttgactgacggctctattttgtgtgggaggcgctatttcgacggttcgggtggaaataaccacgccgtcgagcactacagggagacgggttatcccttggcagtgaagctgggcacgattacacctgatggcgctgacgtttattcatacgacgaagacgacatggtcctggatccctctttagcagaacacttgtcacatttcggaatcgacatgctgaagatgcaaaagacagataagacgatgacagaactggagatagacatgaaccagcgtatcggcgagtgggagctgatccaggaaagtggtgtgcccctcaagcccctcttcggacccggatataccggaataaggaacctggggaattcttgctacctaaacagtgtggtgcaagtgctgttttcaatacccgattttcagcgaaaatatgtagacaagctggagaagatttttcagaatgcccctacagatcctacccaggatttctccacacaggtcgccaaactgggccatggactacttagcggcgaatattccaaacccgtgccagaaagtggggacggggaaagggtcccggaacagaaagaggttcaggacgggatagctcccaggatgtttaaggcattgataggcaaggggcaccccgagttctccacgaaccggcagcaggacgctcaggagtttttcctgcacttgataaatatggtcgaaagaaattgcagaagctctgaaaaccctaacgaagtgttccggtttttagtcgaggagaagatcaaatgtttagccaccgagaaggtcaagtacacgcagagggtcgactacatcatgcagctcccggtgcctatggacgctgctctcaacaaagaggagctcctggagtacgaagagaagaagaggcaagcagaagaggaaaaaatggccttaccagaactggtgcgagcacaagtgccattcagctcatgccttgaagcgtatggagcacccgagcaggtggatgacttctggtccacagctctgcaagcaaaaagcgtggccgttaagacaacccgttttgccagttttcccgactatttggtaattcaaattaagaaattcactttcggactcgactgggtgcctaagaaactggatgtcagcatcgagatgcccgaggaactcgacatctcccagctccgcggaaccggcctgcaacctggggaagaggaattgcccgatatagcacctccattggtcacacctgacgaaccaaaagcgccaatgctcgatgagtccgttatcatacagctggtggaaatgggcttccccatggacgcctgtcggaaggctgtgtattataccgggaattcaggcgcagaagccgctatgaattgggttatgagtcacatggatgatccagacttcgccaatccgttgattctacctggcagttcaggccctggcagtaccagtgccgctgctgaccctccgccagaagactgtgtaactaccatcgtctctatgggtttttccagagatcaggctctcaaggccctgcgcgctaccaacaacagccttgaacgtgctgtggattggatcttctcgcacatcgacgacctggacgccgaagctgcaatggacatctcagagggacgatcagcagccgactctatttccgaatctgtgccagtgggacctaaggttcgggacggccctggtaaatatcagcttttcgcctttatcagccacatgggcactagtacgatgtgtggccattacgtgtgtcatattaagaaagagggcagatgggttatatacaatgatcagaaagtgtgcgccagtgagaagccgcctaaagacctaggatacatctatttctaccagcgcgtggcaagctag

SEQ ID NO: 31365 - DNA, 2385 bp, Artificial Sequence
  Description of Artificial Sequence: Synthetic coding sequence
atggctgacgcctgggaagagatcaggcgtctcgccgctgattttcagagagcccagttcgctgaggccacacagcggctaagcgaaaggaactgtattgagatcgtcaacaaattgatcgctcagaagcagctggaggtcgtccatacactggacggaaaggaatacattacccctgctcagatcagtaaggaaatgagagacgaactgcacgttcgcggaggcagagtgaatatcgtggacctgcaacaggtgatcaatgtagacttaatccatattgagaatcgcattggtgatataattaagagcgagaagcatgtacaactcgtgctgggacaattaattgacgagaattatctggatcgtcttgcagaggaagttaacgacaaactccaggagtccggacaggtgaccatttcagagctgtgtaaaacttacgatctgcctggaaatttcttgacccaggcccttacccagagactagggaggatcatcagcggacacattgacctggacaaccgcggagttatattcactgaagccttcgtagcgaggcacaaagcacgtatccgtggactgttttccgcaatcactagaccaaccgcagttaatagcttgatttccaaatacgggttccaggaacagttgctgtatagtgttttagaggaactggtgaactccgggagactccgtggtactgtggtggggggacggcaagataaagcagtctttgtgccagatatatattctcggacccagtccacctgggtggactcctttttcagacagaacggctacctggaatttgatgcgctgagccgcctcggtattccagacgctgtgagttatatcaagaagagatacaagacaacccagctgctatttcttaaggccgcatgcgtcggccaagggcttgtggaccaggtcgaggcgtccgtggaagaagctatttcttcagggacatgggttgacatcgccccactgctccccaccagcctgtccgtcgaggatgccgcaatacttttgcagcaggtgatgagggccttttccaaacaggcttcaactgttgtgttctcagatactgttgttgtgtcggagaagtttatcaacgactgcacggagctctttcgtgagctgatgcaccagaaggccgagaaggagatgaaaaacaaccccgtgcatctgataacggaggaggatctgaagcagattagcacactggagagcgtcagcactagtaaaaaggataagaaagacgagaggagaaggaaggccactgagggctccgggagcatgcgcggaggagggggaggtaatgccagagagtacaaaattaaaaaggtgaaaaaaaagggtcgaaaggatgacgattcagacgacgagtcacagagctcacacacaggcaaaaaaaagccagaaatttcatttatgttccaagatgaaatcgaggacttcttgcggaaacatatacaagatgctccggaggaattcatctcagagctagcagaatacctgatcaaaccgctgaacaagacgtacctggaagtcgtgcggtctgtgttcatgagcagtacaacctctgccagcgggaccgggagaaagaggacaattaaagacctgcaggaagaagtgtcaaacctttataataatatccgcctcttcgagaaaggcatgaagtttttcgccgatgacacacaggccgctctgacgaagcaccttctgaaatccgtgtgcacagacatcaccaacttgattttcaatttccttgccagtgatctgatgatggccgtcgatgatccagccgctattacatcagagattcgcaaaaagatattgtctaaactttccgaagagaccaaggtggccctgactaaactgcacaactctctcaacgagaagtctattgaggactttataagctgcctggattccgccgcagaggcatgcgatatcatggtgaagcgcggagacaaaaagagggaaaggcagattttgtttcaacacagacaggctctagctgaacagcttaaggtgactgaagacccggcactgattttacatcttacgtccgtgttgctatttcagttcagtacgcattctatgctccatgcccctgggaggtgtgtcccacagatcatcgcattcctgaactccaagataccagaagaccaacacgccctgctggtgaaataccagggcctcgtggttaaacagctagtgagccagtccaagaaaacgggccagggagactaccccttgaacaatgagctggataaggagcaggaggacgtagcttccaccaccagaaaagagctgcaggagttatcatcaagcatcaaagaccttgtcttaaagtcccggaagtcaagcgtcaccgaggagtag

SEQ ID NO: 31366 - DNA, 942 bp, Artificial Sequence
  Description of Artificial Sequence: Synthetic coding sequence
atgatcgggcagaagactttgtatagctttttcagtccaagcccggcaagaaaaagacacgccccatcacccgagccggcagtgcaggggactggtgtagcaggagtgcccgaggagtccggagatgccgcagcaatcccagcgaagaaagcgccagcgggtcaggaagagcctggaactcctccctcctcacctttatccgccgaacaattggataggatccaacggaacaaggcagccgctctgctgaggctggctgcgaggaacgtccctgtgggttttggcgaatcttggaaaaaacacctgagcggtgagtttggaaagccgtattttattaaacttatgggttttgttgccgaggagcgtaagcattacacagtgtacccaccgcctcatcaggtgttcacgtggacacaaatgtgtgatattaaagacgtcaaagtggtgattctcggccaagacccatatcatgggccaaatcaggctcacggactgtgcttctcggtccagcgaccggtgcctcctcctcccagcctggagaacatatacaaggaactgtcaacagatatcgaagacttcgtacatcctggtcatggagacctgagcgggtgggcgaaacaaggtgtccttctgttaaacgccgtacttacagtgcgagcccatcaggccaactcacacaaagagcgcggatgggaacagttcaccgatgcggtggttagctggctgaaccagaacagcaatggccttgtgtttctgttatggggctcctacgcacagaagaagggatccgctattgatagaaagcgacaccacgtgttgcagaccgcccacccttccccgctgtctgtttataggggcttctttggatgccggcacttcagcaagactaatgaattgctgcaaaagagcggcaaaaagcctattgactggaaggaactctag

SEQ ID NO: 31367 - DNA, 915 bp, Artificial Sequence
  Description of Artificial Sequence: Synthetic coding sequence
atgggggtcttttgtctgggtccatgggggctcggcagaaagctcaggacaccaggaaagggcccactgcaactactgagcaggctctgcggggaccacctccaagcgatcccagccaaaaaagcccctgccggacaggaggagccaggcactccgccatcctctcctctgtcagcagaacagcttgacagaatccagcggaacaaggctgctgctcttctgcgactggccgctcgcaatgtacccgtaggtttcggagagtcctggaaaaaacatttgtcgggagaattcgggaagccctattttattaaattgatgggttttgtggctgaagaaagaaagcactataccgtttatcctcccccacatcaagtattcacgtggacccagatgtgtgatatcaaagatgtgaaagttgtaatcttggggcaagacccctaccacgggcctaaccaggcccacggcctatgcttttccgtccaaagacccgttccaccccctccctccctggagaacatctataaggaactgtctactgacatagaagattttgtccatcccggacatggcgatctatccgggtgggcgaaacagggcgttttgcttctcaatgcagtgctgacagttcgggctcatcaagccaactctcacaaggagcgaggctgggagcagttcaccgatgcggtggtcagttggctgaatcagaactctaatggcctggtctttctgctgtggggctcctacgcgcaaaagaaaggctctgcaattgacagaaaaaggcatcatgtgctccaaaccgcacacccctctcctctgagcgtatacaggggcttcttcggctgccgccacttttccaagaccaatgaattgctccagaaaagcggaaaaaaacccattgattggaaggagctctag

SEQ ID NO: 31368 - DNA, 813 bp, Artificial Sequence
  Description of Artificial Sequence: Synthetic coding sequence
atgggggtgttctgtctgggtccctggggccttggcagaaagcttagaacacccggaaaaggaccactcagcgccgagcagctggacaggatacagaggaacaaggctgcggcactactgaggcttgcagccagaaatgttcccgtggggtttggggaaagttggaaaaaacatctgtccggagagtttggcaagccttattttataaaactgatggggttcgtcgccgaagaaaggaaacattataccgtgtacccaccacctcatcaagtgttcacctggacgcagatgtgcgacatcaaagatgtcaaggtcgtcatcttaggccaagatccctatcacggcccaaaccaggctcacggactttgcttctccgtgcagaggccagtgcccccaccacccagccttgaaaacatctacaaggagctcagcactgacatcgaagatttcgttcacccaggtcacggagatctttcaggctgggccaaacagggggtccttctgctcaacgccgtccttacagtgcgtgcccaccaagctaactcacataaggagaggggttgggaacagttcacggatgctgtggtgtcttggcttaaccagaactccaatgggctagtgttccttctctgggggagttacgctcaaaagaagggcagtgctattgacaggaaaaggcatcacgtgttgcaaaccgcccatccatctcccctctctgtgtacaggggattcttcggctgcagacacttcagtaaaacaaacgaactcttacagaagagcggaaagaagcccattgattggaaggaactatag

SEQ ID NO: 31369 - DNA, 9287 bp, Artificial Sequence
  Description of Artificial Sequence: Synthetic coding sequence
atggttttcgagtctgtggtggtagacgtgctgaacagattcctgggggattacgtggtcgatctggacacctctcagttaagcctcggcatctggaaaggggctgttgcccttaagaatctgcagatcaaagaaaatgcgttaagtcagctggatgtccccttcaaggtgaaagtgggacacatcggtaatcttaagctcatcatcccctggaagaatctctacactcagcccgtggaagctgtgctggaggaaatatacctgctgatcgtcccatcctcccgcatcaaatacgatccactaaaggaggagaaacaactcatggaagcaaagcagcaggaactcaagcggatagaggaagccaagcaaaaggtagtggaccaagagcagcacctccccgaaaagcaggatacgttcgccgaaaagttagtcactcagatcatcaagaatctccaggtgaaaatcagctctatccacatcagatatgaggacgatatcacgaatcgcgataaacctctcagcttcggcatttctctccagaatctttccatgcagacgactgatcagtactgggtgccttgcctccacgatgaaacggaaaaattggtgcggaaacttattcgacttgataatctgtttgcatactggaacgtcaagagccagatgttttacctttcagactacgataactcgctggacgacttgaagaatggcatcgtgaatgagaatatcgtgccagagggatatgattttgtgttccgacccatttccgcaaatgccaagctcgtcatgaatagacgatccgattttgatttctcggcacccaagatcaacctggaaatcgagctccataacatcgcgatcgaatttaataagccgcagtactttagcattatggaacttctggagtccgtggatatgatggcacagaatctgccatataggaaattcaagcctgatgtacccttacatcatcatgcgagggagtggtgggcctacgcaattcatggggttctggaggttaatgtgtgtcctagactctggatgtggtcctggaagcatatccgtaagcatcgccagaaggttaaacagtacaaggagctctacaagaaaaaactcacctccaagaaaccgccaggggaacttctcgtcagcttagaggagctcgagaagacattagatgttttcaatatcacgatcgccaggcagaccgccgaagtggaggtgaagaaagctggatacaaaatctacaaagagggtgtaaaagacccagaggacaacaagggatggttctcctggttgtggtcttggagcgaacagaatactaatgagcagcagcctgatgtccaacccgagaccctcgaggagatgctcacaccagaagagaaggctcttctgtacgaggccatcggatactcggaaaccgccgtggatcctactctcctaaagactttcgaggctttaaaattctttgttcacctcaaatctatgagcattgtgctccgcgagaaccaccagaaacccgagctggtagacatagtaatcgaggagttttcaactctcatcgtgcagcggccaggagcccaggcgatcaagttcgagacaaaaatcgactcatttcacatcacagggctgcctgacaacagcgagaaaccgagactcttatcgtcattggatgatgcgatgtccctattccaaattacctttgaaataaatccactggatgagacggtgtcgcagcgttgcattatcgaagcggagccccttgagattatttatgatgcacgaactgtaaactccattgtcgagttctttaggccgccaaaggaggtgcaccttgcgcagcttacggcggctactctcactaagctggaggaatttcgtagtaagacagccaccgggctcctttatataatcgaaacacagaaggtgctggatcttaaaatcaatctgaaagcgagctacatcatagtcccacaggacggaattttttcgcccacaagcaatcttttactccttgacttaggacacttaaaggttacgtccaaaagtaggtcagagctcccagacgtaaaacagggagaagccaacttgaaagaaattatggacagagcctatgatagttttgatatccagctcacaagcgtgcaactgctctacagccgtgtgggcgataattggagagaagccagaaaactgtcggtgtcgacccaacatatcttggttccaatgcattttaacctagaactctcaaaggctatggtctttatggatgtcaggatgcccaaatttaagatttacggaaaactgccattgatctctctgcggattagcgataagaaactgcaggggattatggaactgatcgagagtattcccaagccggaacctgtgacagaagtctccgcccctgtcaaaagcttccaaatacagacctctacttctttaggcacctcacaaatctcccaaaagatcatacctctgctggagctgcctagcgttagtgaggatgacagcgaggaggagttcttcgatgcaccttgtagcccgctggaggaacctctccagtttcctactggtgtcaaatccattcggactagaaaactccagaagcaggactgctctgtcaacatgactacttttaaaattcgattcgaggttcccaaggtgttaatagaattttaccaccttgttggcgattgtgagctgtcagttgtcgaaatcctggtcctcgggttaggcgcagagattgaaatccgcacctatgatctgaaggccaacgcattcttaaaagaattttgcctgaaatgccctgagtaccttgatgagaacaagaaacctgtttacttagttaccacgctggacaacaccatggaagatctgctgacccttgagtatgtcaaagctgaaaaaaatgtccccgacctcaaatcaacatataacaacgtgctgcagctaattaaagttaacttcagttctctagatattcacttacataccgaggccctcttaaatactatcaattacctacataacatcttgccacagagcgaggagaaatcggcacctgtcagtaccaccgagaccgaggataaaggtgacgtgattaagaaacttgccttgaaacttagtacgaatgaggatatcatcacgctgcagatccttgccgaactgtcctgcctacaaatattcatacaagaccaaaagtgcaatatttctgagatcaaaatcgaaggtcttgacagcgaaatgatcatgaggccgtccgaaaccgagattaatgcaaagctcagaaatattatagtactggactctgatataaccgccatctataagaaggccgtgtatatcaccggcaaggaagtcttttcgttcaagatggtctcgtatatggacgctactgcgggtagtgcatatactgatatgaacgttgtcgacatccaggttaatttgatcgtgggatgcatcgaggtggtatttgtgacaaagttcctgtattccattctggcctttattgataactttcaggctgccaagcaggcgttagccgaggccaccgtgcaggctgcaggaatggcagccactggagttaaagagctggctcaacgctcatccagaatggccctcgacatcaatattaaagctccggttgtggtcattccccagtctcctgtaagtgaaaacgttttcgttgcagacttcgggctcatcacgatgacaaacacatttcacatgatcactgagtcccagagcagccctccacccgtcatcgacctgattaccataaaactctctgaaatgcgactgtaccgcagtcgatttattaacgacgcgtaccaggaggttctggacctgttgttgcccctcaacctggaggtggtcgtggagaggaacctgtgctgggagtggtatcaggaggtgccttgttttaacgtgaacgcacaactgaagcctatggagtttatactctcacaggaggatattactaccatatttaaaacactgcatggtaatatctggtacgagaaagacggtagcgcctcacccgcagtgactaaggatcagtactctgccaccagcggggtgacaacgaatgccagtcatcacagcggaggtgcaactgttgtgacagccgctgtcgtcgaggtccattcacgagccctactagtgaaaaccacgctgaatatttccttcaaaactgacgacctcacaatggtgctatacagcccaggcccaaagcaagccagttttacagacgttagggatccttcactgaaactcgccgaatttaaactcgaaaacattatctctacgctcaaaatgtacactgacggcagtaccttctcatcattctccctgaagaattgcatcttggacgataagagaccacacgtgaaaaaagccacacccagaatgattggtttgaccgtggggttcgataagaaggatatgatggacataaagtaccgcaaggtgcgcgatggctgtgtcactgatgccgtctttcaagagatgtacatctgtgcatccgtggaatttctccaaacagtggctaatgtctttttggaggcatacactaccggcaccgccgtggagaccagtgttcaaacctggactgccaaagaggaggtccctacccaggagtctgttaagtgggagatcaacgtcatcatcaagaacccagaaattgtcttcgtggcagatatgactaagaatgacgctccggcactcgtgatcacaacacagtgcgagatttgctataaaggaaacctagagaactctactatgacagcagccatcaaggacctgcaagtgagagcctgcccctttctcccagtgaaacgtaaaggcaagatcaccaccgttctccaaccctgtgatctgttttaccaaaccacacagaagggtacagacccccaggtgatagacatgtctgtgaaatcgctcactttaaaggtgagccccgtcataataaatacaatgattacaatcacttccgccttgtatacaaccaaagagacaatccctgaggaaacagcctcttccacagcacacctatgggagaagaaggacaccaagacactgaagatgtggtttctggaagaatcgaatgagacagagaaaattgctcctacgaccgaactggttcctaaaggcgaaatgatcaagatgaacatcgacagtatctttatcgtccttgaagcaggtatcggacatcggacagtgcccatgctactggcgaaatcccgtttttccggagagggaaagaactggagttcactgatcaatcttcactgccagctggagctagaggttcactactataacgaaatgttcggcgtttgggagcccttgctggagccactcgagatcgatcaaacagaggatttccgcccttggaacttgggcattaaaatgaagaagaaagctaagatggccatagtggagagcgatcctgaggaggaaaattataaggtacctgagtataaaacagttatatccttccactccaaggatcagttaaatattaccctttcaaagtgcggtcttgtgatgctgaataacctggtgaaggcttttacggaggccgcaacgggaagctccgccgatttcgtgaaggacctcgctcctttcatgatcctcaattccctcggcttgactatatccgtgtcgccctcagacagcttctctgtcctcaatataccaatggctaagagctacgttctcaagaacggggagtcactgtccatggactatatcagaacaaaggataatgatcactttaatgccatgaccagtcttagcagcaagctgtttttcatcctgcttacaccggttaatcactcaacagcggacaagattccactgacgaaagtgggcaggcgactatatacagtcaggcatagggagagcggcgtggagagaagtatcgtttgccagatcgatacagtcgaaggctctaaaaaagtcaccatacggagccccgttcagatcagaaatcatttctctgtgccgctctccgtttatgagggagataccctccttggtacggcttcccctgagaacgaattcaatatccctctgggtagctaccgaagcttcattttcctgaagccagaggacgaaaattaccaaatgtgtgaaggtatcgactttgaagaaattatcaagaacgatggcgctctcctgaagaagaaatgccgctcaaaaaatccaagcaaagagagctttctgatcaacatcgtgcctgagaaagacaatctgacgtccctttccgtttactccgaagatggatgggatctgccctacatcatgcatctgtggccgccaattctgctgcggaaccttcttccctacaaaatcgcctactatattgaaggcatcgagaatagcgtatttacattatcggagggccacagcgcacaaatctgcaccgctcagcttggaaaggcgagactgcacctgaaactgctggattatctcaatcatgactggaaatcagaataccacatcaaacctaaccaacaggatatctccttcgtttcatttacttgcgtgaccgagatggagaaaactgatttggacattgccgttcacatgacttacaataccggacaaactgtcgtcgcctttcattctccatactggatggtcaacaaaaccgggaggatgctgcagtataaagccgacgggatccaccgcaagcacccccctaactataagaaaccagttctgtttagttttcaacccaatcattttttcaataacaataaggtgcaactgatggtgactgactccgagctgtcaaatcagtttagcatcgacaccgtgggctcacatggtgcggttaagtgcaagggcctgaagatggattatcaggtcggggtcaccatcgatctctcatctttcaacattaccagaatcgttactttcaccccattttatatgatcaagaacaagtctaaataccatatcagcgtcgctgaggagggaaacgataagtggctgtccctggacctggagcagtgtatcccgttctggcctgagtacgcatcgtctaagctgttgattcaagtagaacgcagcgaagacccccctaagcggatttatttcaataaacaggaaaactgtattcttctgcgcctcgataacgagcttgggggtatcatcgctgaggtaaatctggctgagcattcaaccgtcataacctttttggattaccatgatggcgctgccaccttcctgcttatcaaccacacgaagaatgagctggtgcaatataaccagagtagcctctccgaaatcgaagactcactgccaccgggtaaagcagtgttttatacttgggccgacccagtgggatcacgtcgcctgaaatggagatgccgaaaaagccacggagaggtaactcagaaagacgacatgatgatgccgatcgatctgggcgaaaaaaccatttatctggtatccttcttcgaaggcctgcaacgcattattctgttcacagaggaccccagagtctttaaggtaacgtacgagtctgagaaggctgaactggccgaacaggagatcgcggtggctctccaggacgtgggaatcagccttgtcaacaattacacaaagcaagaggtggcatatatcgggatcactagcagcgatgtcgtttgggagactaagcccaaaaaaaaggccagatggaaacctatgtccgtaaagcatacggaaaaattagagcgtgagtttaaggaatataccgagagttcaccatccgaagacaaagtcatccaacttgacaccaatgtgcctgtgagactgacccccactgggcacaacatgaaaatattgcagccccacgtaattgccttgcgcagaaactatctgcctgctctaaaagtagagtacaacacctcggcacatcagtcaagctttagaattcagatttaccggattcagatacagaaccagatccacggcgctgtgtttccgttcgtcttttacccagtgaaaccacccaaatccgtgaccatggactccgcacctaagccctttaccgacgtgtcaattgtcatgcggtccgctgggcactcgcaaatctctaggatcaaatattttaaagttttgatccaggaaatggacctgcgacttgacctgggctttatttacgctcttaccgatttgatgactgaagctgaggttacggagaacaccgaggtagagctgtttcataaagatatcgaggctttcaaggaggagtataaaaccgcctctttggttgatcaatcccaggtgtcactttatgagtactttcacatatctccaatcaagctccacttgtccgtgtctctcagctctggacgggaggaagccaaagactccaagcagaatggagggctgataccagtgcactcactgaatcttctgctgaagagcataggtgccacactgacagacgtacaggacgttgttttcaagttggctttttttgaattgaattatcagtttcatacaaccagcgatctgcagtccgaagttatcaggcactactcaaagcaagccatcaaacagatgtatgtgctcatactcgggctcgacgtgctgggaaaccctttcggcctgatcagagagttttctgaaggcgtggaggctttcttttatgaaccttaccaaggggctatccaggggccagaggagtttgtcgaggggatggccctggggctcaaagcattggtgggcggtgcagtgggcggtttggccggagcagcatcaaaaatcacaggcgctatggcaaagggtgtggcagccatgaccatggatgaggattatcaacagaagcgcagggaagctatgaataaacagcccgctggtttcagagaagggattacccgaggcggaaagggattggtttccggctttgtcagtgggattaccggcattgtcactaagccaattaagggagcacagaagggcggagctgccggattttttaagggcgtcggcaaaggcttggttggagccgtcgctaggccaaccggaggaattattgatatggccagctccaccttccaaggtattaagagggcaacagaaacctcagaagtggaatctctacgcccacccagattttttaatgaagacggagtaatacgcccataccgcctgagggacggcaccggcaaccagatgctacagaagattcagttttacagagaatggataatgacccactccagtagtagtgatgacgacgatgacgacgatgacgacgatgaatcagacctcaatcacta

SEQ ID NO: 31370 - DNA, 9525 bp, Artificial Sequence
  Description of Artificial Sequence: Synthetic coding sequence
atggtctttgaatccgtggtggtggacgtgctcaatcgatttcttggtgactacgtagtagatctcgacactagccagctatctctggggatttggaagggagcagtcgccttgaagaacttgcagattaaggagaatgcgctctcccagctcgacgtcccatttaaggtgaaggtgggacatattgggaacctaaagttgattatcccttggaagaatttatacactcaaccggtcgaagctgtgctggaggaaatctaccttctgattgttccaagctcacggatcaagtacgaccctctcaaggaagagaagcagctaatggaggcaaaacaacaggaactgaaacgcatcgaggaggctaagcagaaggtggttgatcaagaacagcacttgcccgagaagcaagacaccttcgcggagaaactagtcacccaaatcattaagaacttacaggttaaaatctctagtatccacatcaggtacgaagatgatatcaccaaccgggacaaaccactctccttcggcatttctctccagaacctgtcgatgcagacaaccgatcaatattgggtaccttgtctgcatgatgagacagagaagctagtacggaaattaatccgcttagacaatcttttcgcctattggaatgtgaaaagccagatgttttacctgtctgactatgacaattcactggacgacctgaaaaatggcatagtcaatgaaaatattgtgccggaagggtatgacttcgtcttcaggcctattagtgctaacgctaaactggtcatgaaccgtagatcggactttgacttctctgccccaaaaattaaccttgagatcgagctccacaacatcgccatagagtttaataagcctcagtatttctccatcatggagctgctggaatcagtcgacatgatggctcaaaatctaccttaccgaaagtttaagcccgacgtgcccctgcaccaccacgctcgagagtggtgggcatacgcaattcacggggtgttggaagtaaatgtgtgccccagattgtggatgtggagctggaagcacatcaggaagcaccgccagaaagtcaaacagtataaggagttgtacaaaaaaaaactgacttccaaaaaacctccaggcgaactcttggtgagtctagaggaattggaaaagactctggacgtattcaacattaccatagctagacaaaccgccgaggtggaggtgaagaaggcaggctataaaatttacaaggagggcgtgaaggatcccgaagacaacaagggttggttttcctggctttggtcttggtccgaacaaaataccaatgaacagcagcccgacgtgcaacctgaaaccctggaagaaatgctgacaccggaggaaaaagctttactctatgaggccattggctactctgaaacagcagtggatcccacactgctgaaaaccttcgaggccttgaaattcttcgtgcatctaaagagcatgtccattgtcctgcgggaaaaccaccaaaaaccagagctcgtcgacattgtcatcgaagagttctctactctcatcgtgcaaagaccaggcgcacaggccattaaattcgagacaaagatcgacagcttccacatcaccggtcttcctgataacagcgagaagcccaggctactgtccagcttggacgatgcaatgtcactgttccagatcacttttgagataaaccctcttgacgaaaccgtttcccagaggtgtatcatcgaggccgaacccttggagattatttacgatgctagaaccgtgaatagcatcgtcgagttcttccgaccaccaaaagaggtgcacctcgcacagctgactgcagcaacattgactaagcttgaggaatttcggtccaagaccgcaaccggattactgtatatcatcgaaacccagaaagtgttagacctcaaaatcaatttgaaggccagctacattattgtcccacaggacggcattttctcacctaccagcaatctgctgctcctggatctggggcacttaaaggtgacttctaaatcaaggagcgagttgcctgatgtaaaacaaggagaggctaacctcaaggagattatggacagagcctacgactcattcgatattcaactcaccagtgtgcagctactttactcgcgggtaggggacaactggagagaagcgcgaaagcttagcgtatcgacacagcacattttggttcccatgcattttaatttggagttgagcaaggctatggtgtttatggacgtcaggatgccaaaatttaaaatctacggaaaactgcccttgatttcactgaggatcagcgacaagaaattgcagggaattatggagctcattgaatctattccaaaacctgaacctgtgactgaagtgtcagctcctgtgaaatctttccagatccagacttccacttccctgggtactagccaaattagccagaaaattataccacttctggagctcccctctgtcagtgaggacgatagcgaagaggagttttttgacgccccatgttcaccattggaagagcccttgcaattcccgactggtgtcaagtctatcaggacaagaaaattgcagaaacaggactgctctgtgaacatgaccacttttaagattcgcttcgaggttcctaaagtgctgattgaattttaccacttagtcggtgactgcgagttatcggtagtggaaatcctggtgcttggccttggcgctgagattgagatccgaacctacgatctcaaggcaaatgctttcctcaaggagttctgtctcaagtgtcctgagtacctggacgaaaacaagaaacccgtttatttagtcactacacttgataacacgatggaggatctcctcaccttagaatacgtcaaagctgaaaaaaatgtgcccgatctgaagagcacctacaataacgtgttacagctgatcaaggtcaactttagcagcctggacatccacctccataccgaagccctcctaaacacgatcaattacctccacaacatcctcccacagagcgaagagaagtctgcacccgtctccaccaccgagacagaggacaagggcgacgtcatcaagaagctggcactcaaactcagcactaatgaagacatcatcaccctgcaaattctcgccgagctctcctgcctccaaatattcattcaggatcagaaatgtaatattagcgaaattaagattgagggcctggactcagagatgatcatgagaccttccgagacagagatcaacgccaaactgcgaaacatcatcgtactcgactctgatatcacagccatctacaagaaggcagtgtacataaccggaaaggaagtattttcctttaagatggtgagctacatggatgcgaccgccggaagtgcctacactgacatgaatgtggtggacatccaagtgaacttgatcgtgggatgcattgaagtagtgttcgtgaccaaattcttgtactccattttagcgtttatagataacttccaggctgctaagcaggccctggcagaagccaccgtgcaggcagctggaatggcagctacaggtgtgaaagagcttgcacaacgaagttcacgtatggccctggacattaacattaaggccccagttgtagtaatccctcagtcacccgtctccgagaacgtgtttgtggcagacttcggactcataaccatgactaatactttccacatgatcacagagagtcaatcttcccctccgcctgttattgatctaattacaatcaagttatctgaaatgcgactctacaggtccaggttcattaacgacgcataccaggaggtgttggatttgctcctcccgctgaacctggaggttgtggtggaacgcaatttgtgttgggagtggtatcaggaagtaccctgcttcaatgttaacgcacaactcaagccaatggaatttatcctgtcccaggaggatatcactactatatttaagaccctgcatggtaacatctggtatgaaaaagatggaagtgcaagcccagccgtgactaaagaccagtatagcgctacctctggggtgacaacaaatgcgtctcatcacagcggtggcgcaactgtggtcaccgccgcagtggtggaagtccactcccgcgctcttctggtgaagactactttaaacatctccttcaagaccgatgacctgactatggtattgtactccccagggcctaaacaggcgtcgttcacagatgtccgagacccgtcccttaaactggccgagttcaaactggagaatatcatttcaactttgaagatgtacaccgatggaagcactttctcaagcttctcactgaagaattgtatcctggacgacaagcgacctcatgtcaagaaagccacacctcgtatgattgggttgacagttggcttcgataagaaagatatgatggatatcaagtacaggaaggttcgggatggatgcgtgactgatgctgtttttcaagagatgtatatatgcgcaagtgtggagtttctccagacagtggcaaatgtttttttggaggcatacacaaccgggaccgccgttgaaacatccgtacaaacatggacagcaaaggaggaggttccgacacaggaaagcgtaaagtgggagattaatgttatcataaagaatccagaaattgtgttcgtcgctgatatgaccaaaaacgacgcgccagccttggttatcaccacccagtgcgagatttgctacaaggggaacctggagaactcgactatgacggcagccattaaggatttgcaagttagagcctgcccttttctgcccgtcaagagaaagggtaaaattaccaccgtgttgcagccctgcgacttgttttatcagactacacagaagggtacagacccacaggtgatagacatgtccgtgaagtccctcacactgaaagttagcccggtcatcatcaacactatgatcacaattacctcggcgctgtacacaaccaaagagaccatccctgaagagaccgcgagctccactgcgcatctgtgggaaaagaaggacactaaaactttgaaaatgtggtttctggaggagtctaacgagacagaaaagatcgcccctactactgagctggtgccaaagggtgagatgattaagatgaatatcgatagtatctttattgtactggaggccggtatcggacacagaacagtcccaatgttactcgctaagagccggttttcaggagaggggaagaattggtcaagcctgattaatttgcactgccagctggagctcgaggtgcattactacaacgagatgtttggcgtttgggagccccttttggagcccttagaaattgaccagaccgaagacttcagaccatggaacctcgggattaagatgaagaaaaaagctaagatggcaatcgtggaaagcgatcctgaggaggagaattataaagtacccgagtataaaaccgtgattagcttccattctaaggaccagttgaatataactctgtcaaagtgcgggctggtcatgctgaacaatttagtgaaggcctttacggaggcagccactggcagctccgctgattttgtcaaggatctggccccttttatgatcctgaatagcctggggctcaccatatccgtttctccaagtgatagttttagtgtcctaaatatacccatggcaaagagttacgtgcttaagaacggggaatcactgagcatggattacatccgcactaaagacaacgaccatttcaatgccatgacgtccctctcctctaaactcttcttcattttactgacaccagttaaccactccacagccgataagataccactgaccaaggtcggcaggagattatacaccgtgcgccaccgcgagtctggcgtcgaaaggtctattgtctgtcagatcgacaccgtcgagggaagtaagaaggtcacaatccgctcacctgttcagatacggaatcatttctcggtgcctttgagcgtatatgaaggagacacgctgctgggcacggctagccccgagaatgagttcaacataccattgggctcctacagatcctttatcttcctgaagcccgaggacgaaaactatcaaatgtgcgagggcatcgattttgaggagataattaaaaatgatggagccctcctgaagaagaaatgtcgttctaaaaatccatccaaagagtcattcctcattaacatcgttcccgagaaggataatctgacctcgctatcagtgtactctgaggacggttgggacctgccctacatcatgcatctgtggccccctattctgcttagaaatctgctgccctacaagatagcctattatatagaggggatagagaactcagtgtttactttgtccgaggggcattcggcacagatatgcaccgcacaactaggaaaagccaggctccatctcaagctgctagattaccttaatcatgactggaaaagtgagtaccacataaagcctaaccaacaggatatcagcttcgtgagcttcacctgcgtgacagaaatggaaaagactgaccttgatatagcagtgcatatgacatacaacacgggtcagacagtggtagctttccattccccttactggatggttaataagaccggtcgcatgctccagtacaaagccgatgggattcacaggaagcatcctcctaattacaaaaaaccagtgctctttagcttccagccaaatcacttcttcaacaacaacaaagtccaactaatggtgactgacagcgagctctctaaccagttttcaatagatacagtcggctcgcatggcgcagtaaaatgtaaggggctcaagatggattaccaggtgggagtgaccatcgatttgtcatcgtttaacataacacgaatagtcactttcaccccattctatatgatcaagaataaaagtaagtaccacatttcagtcgcagaggaaggcaatgataaatggctgtcgttagacttggaacagtgtatccccttttggcccgagtacgcttcaagcaagctactgattcaagtcgaaagaagcgaagacccaccgaaacgcatctattttaataaacaggagaattgcattctgttgaggctggacaacgaactcggaggtattatcgctgaagtcaatctcgctgagcattctacagtcattactttcttagactaccacgatggcgctgcgactttccttcttattaaccatactaaaaatgagctggtccaatataaccagtcatctctgtctgagattgaagactccctcccgccaggcaaagccgtgttctacacttgggccgaccccgttgggagcaggcggctcaagtggcgctgtagaaagtcacacggggaggtgacacagaaagacgacatgatgatgccaatagatctgggggaaaaaacaatttacctggtctctttcttcgaagggcttcaaagaattatccttttcaccgaggatcctagagtcttcaaggtaacttatgaatcggagaaagcggagttggccgagcaggagatcgccgtcgcgctccaagatgtaggtatctctctggtgaacaattatacgaagcaagaggtggcctacataggaattacttccagcgacgtcgtgtgggagacaaagccaaaaaaaaaagcacggtggaagcccatgtccgtaaagcacacggagaaactggaaagggagttcaaagaatatactgagagctctccatccgaggacaaggtgatccagttggatacaaacgtgcccgtgaggctcacccctacagggcacaacatgaaaattctacagccacatgtgatcgctttacgcagaaattaccttccggctctaaaggttgagtataatacctcagcgcatcaatcttcatttcgaatccagatctacagaatccaaattcagaaccagatccacggagccgtgttcccttttgtcttttaccccgtgaagccccctaaatctgtgacgatggacagtgcacctaagccctttactgacgtctctattgttatgcgatccgccggacactcccagatcagcaggattaaatattttaaagtgctgatacaggaaatggacctgcgcctagatctgggatttatatatgctttgaccgaccttatgactgaggcagaggtcacggaaaacaccgaggtggagttgtttcacaaggatatcgaggctttcaaagaggagtataagacagcttctcttgtggatcagagccaagtctccctgtatgagtacttccacatatctcccattaagcttcaccttagcgtcagcctctcttcaggtcgcgaagaagccaaagattccaagcaaaatgggggattaatccccgtccattccctgaatctactactgaagtcgattggtgcaactttaaccgacgtccaggacgtcgttttcaaactcgccttctttgaactaaattaccaatttcatacaacttcagacctgcaatccgaggttatccggcactactcaaagcaggccattaaacagatgtatgtgttgattcttggtctcgacgttctcgggaatcccttcgggttgattcgcgagttctccgaaggggtcgaggcgttcttttacgagccataccaaggtgccatccagggcccagaggaatttgtagaaggaatggctctggggctcaaagccctcgtgggcggagccgtggggggattggccggagctgcaagcaagataactggcgcaatggcaaaaggggttgctgccatgacaatggatgaggactatcagcagaaacggagagaggcaatgaacaagcagccggctggctttcgggaaggaatcactcgaggtggcaagggactcgtgtctggctttgttagtgggatcacgggcatagtcacgaaaccaattaaaggagcccaaaagggaggggctgcgggattcttcaagggcgtcgggaagggcttggtcggggcagtagcacggccaaccggtggaatcatcgatatggctagctctacattccagggcataaagcgggcaaccgagaccagtgaggtggagagtttacgcccacctaggttctttaatgaagacggagtcatccgcccttacagactgcgcgatggtaccgggaaccagatgctgcaggtgatggaaaatgggaggttcgccaagtacaagtattttacccacgtgatgatcaacaaaacggacatgctgatgatcacacgcaggggagtcctcttcgttaccaagggaacgtttggacagctgacatgtgagtggcagtactcattcgacgagtttacaaaggagccattcattgtccacgggcgaaggttgcggatcgaagccaaagaacgggtgaaatctgtgttccacgctagagaattcggcaaaatcattaatttcaaaactcccgaggatgcaagatggatacttaccaagctgcaggaggcacgtgaaccatctccttcactgtat

SEQ ID NO: 31371 - DNA, 9209 bp, Artificial Sequence
  Description of Artificial Sequence: Synthetic coding sequence
atggtttttgagtctgtggtggttgatgtgttgaacaggttcctgggagactacgtggtggacctggacacgagtcagctttccttgggcatatggaagggcgctgttgctctgaagaacctgcagatcaaggagaatgctctgtctcagcttgatgtgccattcaaggtgaaggtgggccacatcggcaacctgaagctgattatcccttggaaaaatctgtacacccagcccgttgaagctgtcctcgaggagatatatctgctaatcgtgccatcaagccgcatcaagtatgatcctctcaaagaggagaagcagttgatggaagccaaacagcaggagctgaaaagaatagaggaggctaagcagaaggtagtggatcaggagcagcatctgcccgaaaagcaagatactttcgccgagaagctggtgacgcaaatcatcaagaacctacaggttaaaatatcctcaattcacatacgctacgaggacgacattaccaatcgagacaaaccgttgagctttggtattagcctgcagaaccttagcatgcagactaccgatcagtactgggtcccctgccttcatgacgagactgaaaagctcgtcagaaaactcataaggctagataacttgttcgcatactggaacgtgaagtcacagatgttctacctctctgattacgataattccctcgacgatctcaaaaatggcatcgtgaacgagaatatcgtccccgagggttatgactttgtgtttaggcctatctcggccaatgctaagctggtcatgaaccgtcgtagcgacttcgatttctcggcccctaaaatcaatttagagattgaactgcataacattgccatcgaattcaataagcctcagtacttttccattatggaattgctggagagcgttgacatgatggcccagaatctcccctacagaaagttcaaaccggatgtgcctttacatcaccatgccagagagtggtgggcttacgcgattcatggggtcttggaggtcaatgtgtgcccacggctctggatgtggagctggaagcatattaggaagcatcggcagaaggtgaaacagtataaggaactatataagaagaagctaaccagtaaaaaaccacccggtgaattattggtttcactggaagaattagagaaaacccttgacgtatttaacattaccatcgccaggcagactgccgaggtcgaggtgaagaaagcaggttataaaatctacaaagaaggggtcaaggatcccgaggacaacaaggggtggttctcttggctgtggagctggtcagagcaaaatactaacgagcagcagccggacgtgcagcccgaaactctcgaggaaatgctaacaccagaggaaaaggcgctactgtatgaggccattgggtattcagagacagccgtggaccctacactgctcaaaaccttcgaagcactaaaattctttgtgcacctcaagagtatgtcgatcgtgctgagagaaaatcatcagaaacccgaattagtggacatcgtaatcgaagagttcagcacactgatcgtgcagaggccaggcgcacaagcaattaagttcgagacgaagattgattcctttcatatcactggcctgccagataactccgagaagccccgactgttgagttccctggacgacgccatgagtctgttccagatcacatttgaaatcaatcccctggacgagacagtaagccagcgctgtattatcgaagccgagccattagagattatctacgacgcgcgaacagttaactcgatcgtagaattctttagaccaccaaaagaagtgcatttagcacaactaaccgcggctaccttgacaaagctcgaagagttccgcagcaagactgctacaggcctactgtacatcatcgagactcaaaaagtactcgatctgaaaatcaacttgaaagcctcatatatcattgtgcctcaagatggcatcttctcgcccacgagcaatctgttgctgctggacttgggccacctcaaggttacttctaaaagcaggagcgaactgcccgatgtcaagcaaggggaggcgaatttgaaggaaatcatggacagggcatacgattccttcgacatccagctgacctctgtacagttgttatatagtagggtcggggataactggagggaggctcgcaaactctccgtcagtacacagcatatcctggtccccatgcactttaacttggagctgtccaaagccatggtgtttatggacgtgcgcatgcctaagtttaaaatctacggaaaattgcctctgatcagtttacgcatctctgacaagaaactccaaggtataatggagctgatcgagtccattccgaagccggagcccgtcactgaggtctccgcccctgtcaagagcttccaaatccagacctccactagcttgggaacatcgcaaatctcacagaagatcatccccctgctggaactgccatccgtgtcagaagacgactctgaagaagaatttttcgacgccccatgctcaccattagaggagccgcttcagtttcccaccggcgtgaagtctatcagaacaagaaaactgcagaagcaagactgctcagtgaacatgactacttttaagattaggttcgaggtccccaaagttcttatcgaattctatcatctggtgggtgattgtgagctcagtgtggtcgagattctcgtgctgggcctgggcgcagagatagaaattcggacctacgatctcaaggctaatgccttcctgaaggagttctgtctgaagtgcccggagtacctggacgagaacaagaaacccgtctaccttgtcaccacattagataacacaatggaggacctgcttacacttgagtatgtaaaggccgaaaaaaatgtacccgatctcaagtcgacatacaataacgtactgcagttgatcaaagttaacttcagttccctggacatacacctccataccgaagcgctgctgaatactatcaattacttgcacaacattttaccccagtccgaagaaaagtcagccccagtgagtactaccgagacagaggacaaaggggatgtgataaagaagctggccttaaagctgtcgacaaatgaggatatcatcacactgcagatcctcgccgaactctcgtgtttacagatttttatccaggatcagaaatgcaatatctcggaaatcaagatagagggcttagattcggagatgatcatgaggcctagcgagaccgagatcaacgcgaagctgaggaacattattgttctggatagcgacattacggccatctataaaaaagcagtgtacatcaccgggaaggaggtctttagctttaaaatggtttcttatatggacgcaaccgctgggagcgcatacaccgacatgaacgtcgtggacatccaagtcaacctgattgtggggtgcattgaggtagttttcgtgaccaagttcctctattccatcctggcctttattgataacttccaagctgcaaagcaagccctcgcagaagccaccgttcaggctgctggtatggctgctaccggagtaaaagaactggcacagaggtcctctaggatggccctggatatcaacataaaggcaccagtcgtcgtaatcccacaatctccggtgtcagagaacgtgttcgtggccgattttggcttaataactatgacgaatacctttcatatgatcacggagtctcagtcaagcccacctccagtgattgatctcatcacaataaagctttctgagatgcgtctttatcgaagccgcttcattaacgacgcgtaccaggaggtcttagacctgctcctgcccctgaaccttgaggtggtggtggagcgaaacctgtgctgggaatggtaccaagaggtgccttgcttcaatgttaatgcgcaactcaaacccatggaatttatcctgtctcaagaggatatcactaccatattcaagacactgcatggaaacatttggtatgagaaggatggaagcgccagccccgctgtgactaaggaccagtacagcgccacttccggcgtaaccacgaatgctagtcatcacagcggtggtgccacagtagtgaccgcagccgtggttgaggttcattctagggcactgcttgttaagactacactgaatatttcctttaagaccgacgacctcacaatggtgctttactctccagggcctaaacaggcctcctttaccgatgtgagagacccctctctgaagttagctgaatttaaactggaaaacatcatcagcacattgaaaatgtacacagacggctccacattttcctcttttagcctcaagaattgcatcctggatgataagaggccacacgttaaaaaagccacccccagaatgatcgggctgaccgtgggttttgacaaaaaagatatgatggacatcaaataccgcaaagttcgagatgggtgcgtcaccgatgcagtctttcaggaaatgtatatttgcgcgagcgtggagtttcttcagaccgtcgcgaacgtgttcctggaggcttatacaacaggaactgcagtggaaacaagcgtgcagacctggacagcaaaagaggaggttcctactcaagagtccgtgaaatgggaaatcaatgtaattattaagaaccccgagatcgtttttgtcgccgatatgactaagaatgacgctcccgctctggtgattactacacagtgcgagatctgctacaaggggaaccttgaaaacagcacaatgactgccgcaattaaggacctgcaggtgcgtgcctgtccattcctgccagtaaagaggaagggcaagataactactgttttgcagccttgtgacctgttttatcagacaacccagaaggggaccgatccgcaggtgattgatatgagtgtgaagtcactgacactgaaggtctcaccagtcatcattaacacaatgataaccataacctcagccctttacacaacaaaagaaacaatccctgaggagacagcgagctcaaccgcccacctctgggagaagaaagacacgaaaaccctgaagatgtggttcctcgaggagagcaacgaaacagagaaaatagccccaactaccgagctcgtaccgaaaggagagatgatcaagatgaacattgattccatcttcatcgttctggaagccggaattggtcatcggaccgtgccgatgttactcgcgaagagcaggttttcaggtgaaggcaagaactggagctcgctcatcaatctccactgtcagctggaactggaagtccactattataacgagatgtttggtgtgtgggagcctctcctggaacctcttgaaatagatcaaaccgaggattttaggccctggaatctaggtattaaaatgaagaaaaaagctaagatggccatcgtagaaagcgacccagaagaggagaactataaggtgcctgaatacaagaccgtaatttccttccattcaaaggaccaactgaatatcacactcagtaagtgtgggctggtaatgctgaataatcttgttaaggcgttcaccgaggccgctactgggagctccgcagatttcgttaaggacctcgcaccttttatgattcttaactctttgggactcaccatctctgtcagtccctcggattcattctcggtgctcaacatcccaatggccaagtcttatgtattaaaaaacggcgagagcctgagtatggactatataagaactaaagacaacgaccacttcaacgcgatgacctcactcagttcaaaactttttttcatactcctcactcccgttaatcactcaactgctgataaaatccccctgacgaaggttgggagacgcctctacacagtccggcaccgcgaatcaggtgtggaacggagcatcgtgtgtcagattgatacagtggagggcagtaagaaggtgaccatccgctccccggtgcagataagaaaccacttttcagtgcccctttcagtgtacgagggggacacactacttggcacagcctctccagagaacgagtttaacatcccgttagggtcctaccgctcatttattttccttaaacctgaagatgaaaactatcagatgtgcgaaggaatcgacttcgaggagatcatcaagaatgacggcgcactgttgaagaagaaatgtcgctctaagaacccctctaaggaaagcttcttgatcaatattgtgccagagaaggacaacctgaccagcctgtcagtatattcagaagacgggtgggacttaccatacattatgcatctgtggcccccaatcttgctacgcaacctactcccctacaagatcgcatactatatcgagggaattgagaatagtgtttttaccttatcagagggacactccgcccagatatgtacggcacagttgggaaaggccagactgcacctcaagcttctggattatctgaaccatgactggaaatcagaatatcacattaagcccaatcagcaagatattagcttcgtgagttttacatgcgtgacagagatggagaagaccgacctcgatattgccgtgcacatgacatacaataccggccaaaccgtagtggcattccattccccatattggatggtgaataaaaccggcaggatgctgcagtataaggccgacggcattcaccgcaaacacccaccaaactacaaaaaaccagttctgtttagttttcaaccaaatcatttctttaataataacaaggtacagctaatggtcacagattcagaactttccaatcagttcagcatcgacaccgtggggtcacacggggcagtcaagtgcaaaggattgaaaatggactaccaagtgggtgtgacaattgacctcagctcattcaacatcacgcgcatcgttacttttactccattctacatgatcaagaataagtccaagtatcatatctccgtcgccgaggagggtaacgataagtggctgagtctagacctggaacaatgtatccccttttggcctgagtatgcctcaagtaagctactaattcaggttgaaaggtctgaggatccccctaaacggatttattttaacaaacaagagaactgtattttgctccgcctggataatgagctaggaggcataattgctgaggtgaacttggcagagcactctacggtgattactttcctggattatcatgatggagcagccacgttcttactgatcaaccacacaaagaacgaactcgtacaatacaaccaatcatctctgtctgagatcgaagattcactcccccctggtaaggcggtgttctacacatgggccgaccccgttggctctagaaggctgaagtggaggtgtagaaagagccacggcgaagtgactcagaaagatgacatgatgatgcccattgatctcggcgagaagactatctatctggtttctttttttgaagggctccagaggattatcctgtttacagaagatcctagagtgttcaaggttacttacgaaagcgagaaggctgagttggctgagcaagaaattgctgtagccctccaagatgtcgggatttccctcgtgaataattatactaaacaagaggttgcctacattgggatcacttcatccgatgttgtgtgggaaacaaaacccaaaaagaaggcaaggtggaagcctatgagcgtcaagcacacggagaagttggagagggagttcaaggaatacacagaatccagcccatcagaagacaaggtgatacagctggataccaacgtgccggtgaggctgacgcctactgggcacaacatgaaaatactccagccacacgtgatagcactgaggcggaactacctcccagccctcaaagtcgagtacaatacctcagcacatcagtccagctttcggatccagatctatcggattcagattcaaaaccaaattcatggagccgttttccccttcgtgttttacccagtgaagcctcctaagagcgtgacaatggactcggcaccaaaaccatttaccgacgtatctatagtgatgcggagtgccggacatagccaaataagccgcatcaagtactttaaggtgctcatacaggagatggatctgaggctggaccttggattcatctacgcccttacagatttgatgacagaagcagaagtgactgaaaacacagaggtagagctgtttcataaggacattgaagcttttaaggaggagtacaagactgcgtccttggtggaccagagccaggtgtctctctacgagtatttccacatcagtcccattaagttgcacctatccgtgtctcttagcagtggcagagaagaggctaaggactccaaacagaacggtggactcattccagttcatagcttaaatttgcttctgaagtcaatcggagctaccctcaccgatgttcaggatgtcgtcttcaaactggcattctttgaattgaattatcagttccacaccacgtccgatctccaatctgaagtgattcggcactatagtaagcaggcaattaagcagatgtatgtcctcattttgggtctggatgtactggggaatccttttgggctgatcagggaattctccgagggggttgaggcattcttttacgagccataccagggggctatccagggtccagaagaattcgtggagggcatggcactgggcttgaaggctcttgttggaggcgcagtcgggggactggcaggcgcagctagtaagattaccggggctatggccaagggagttgctgcgatgaccatggatgaagactatcagcagaagcgcagagaagccatgaataagcagcctgccggatttagggaggggatcacgcgaggtgggaagggcctggtatctggcttcgtctctggaatcaccggcattgtcacgaagccaataaagggtgcccagaagggaggagccgcaggttttttcaagggtgtgggcaaaggtctggttggggctgttgctagacctacaggcggaatcattgacatggcctcctcaacatttcaggggatcaagagggccaccgagacctcagaggtcgagagcctccgcccacctagattcttcaacgaggatggagttattagaccatacaggctcagagacggaactggaaaccaaatgctgcaggccagcaaatccttgatata

SEQ ID NO: 31372 - DNA, 9407 bp, Artificial Sequence
  Description of Artificial Sequence: Synthetic coding sequence
atggtattcgagtccgtggtggtggatgtcctaaataggttcctgggtgactacgtcgttgacttagacacatcacagctttccctggggatttggaagggggcagtcgccctgaagaatctgcagattaaagagaacgccctgagtcagctcgatgtcccatttaaggtgaaggtggggcacattggaaacctcaaactgataataccatggaagaatctttacacccaacccgttgaggctgttcttgaagaaatatacctgctgatagtgccgtcgtcgaggatcaagtacgatccactgaaagaagagaagcagctgatggaagccaagcagcaggaactgaagcgaatcgaggaggccaaacaaaaggtggtggaccaggagcaacatcttccggaaaagcaagatacttttgccgaaaaactggtgacccagatcatcaagaatctccaggtcaaaatctcaagtatccacatcagatatgaggacgatattacaaaccgcgataaacctctttccttcggaatcagcttacaaaacctttcaatgcagacgacagatcagtactgggtgccatgtctgcacgacgaaacagaaaagttggtccggaagctgatccggctggataacttgtttgcatactggaacgtcaagtctcaaatgttctacctgtccgactatgacaactcactcgacgacctgaagaatgggatcgtaaatgagaacatagtcccagagggatatgactttgtgtttaggccaatatccgctaatgccaagttggttatgaatcggcgtagtgacttcgatttctcggccccaaagattaaccttgagatcgaactgcataacatcgccattgaattcaataagccccagtacttttctatcatggaattgctggaatccgtagatatgatggctcagaatcttccatatagaaagtttaaaccagacgtgccactgcaccatcatgcaagagagtggtgggcctatgctattcacggcgtgctggaagtgaatgtgtgcccgagactgtggatgtggagttggaaacacattagaaagcacaggcaaaaagtaaagcagtataaagagctttacaagaaaaaattaacctccaaaaaacctcctggcgagttactggtttccctggaggagttagagaaaacattggatgtcttcaatatcaccattgccaggcagacagccgaagtcgaggttaaaaaagccggatacaagatatacaaggagggagttaaggaccccgaggacaataagggatggttttcatggctgtggtcttggagcgaacaaaacaccaatgaacagcagccagatgttcagcccgagaccctggaggagatgctaacgccggaggaaaaagccttattgtatgaggccatcggttatagcgaaacggcggttgacccaacactgctgaagacattcgaggctctgaaattttttgttcacttgaagagcatgagcatcgtgttgcgggagaaccatcagaaacccgaactggtcgacatcgtgattgaagagttcagcaccttgatcgttcaaaggcctggggcacaggccattaagtttgaaactaagatcgatagcttccacataacaggcctgccggataactctgaaaagccccgacttttgagctcactggatgacgcgatgtcgcttttccagataaccttcgagattaaccctctggatgagaccgtgtcccagcgctgcattatcgaggccgagccattggagataatttacgatgcacgtaccgtaaacagcattgttgaattcttcagaccacccaaggaggtccacttggcgcagcttacagcggcaacactgacgaaacttgaagagttcaggagcaagaccgcaactggccttctgtatatcatagagacacagaaggtgctggacctgaagatcaatctcaaagcatcttacattatcgtgccacaggatggcattttttcccctacaagcaatctactgctgctcgatctgggccacttaaaagtcacaagcaagagtcgcagcgagctccccgatgtgaagcagggcgaggctaatttgaaggaaattatggatagagcctacgattcattcgacatccagctaacgtccgtgcagctgctttactcccgggtcggggacaattggagggaggcacggaaacttagcgtgtcaacccagcatatactcgttcctatgcattttaacctcgagctgagtaaagctatggtgtttatggatgtccggatgcccaagtttaaaatctacggtaaactaccacttatctctcttaggatctccgacaaaaaacttcagggtattatggaattgatagagagtattccgaaacctgaacctgttactgaagttagtgccccagtgaagagttttcagatccaaactagcacgtctttggggacctctcagatcagccagaagatcataccactgttggaactgccctcggtttctgaagatgacagcgaggaggagttctttgatgctccctgctcccccttggaggaacccctgcagttcccaacaggtgtcaaatcaattaggacccgaaagctgcaaaaacaagactgctctgttaacatgaccacttttaaaatccggttcgaggtgcctaaggtcctcatcgaattttatcacctcgttggcgactgcgaactctcagtggttgaaatcctcgtcctggggctgggggctgagattgaaatacgcacctatgacctcaaggccaatgccttcttgaaggagttttgcctgaagtgtcccgaatatcttgatgaaaataaaaaacccgtatacctcgtgacaacattagataacaccatggaagacctgctgactctggagtatgtgaaggccgaaaaaaatgtacccgacttgaaaagcacttacaataatgtgctgcagttgatcaaagtaaacttttcatctttggacatccaccttcatacagaagcactgctgaacacgataaactacctacataacatccttccccagtctgaagagaagtcggcccctgtaagcaccaccgagaccgaagacaaaggcgatgtgattaaaaagctcggcctagatagcgaaatgattatgagaccttcagaaactgagataaacgccaaattacgcaatattatcgtacttgattccgatatcaccgctatctataaaaaagcagtctacatcactgggaaggaggtgttttcatttaagatggttagctacatggatgctacagctgggtcagcatatacggacatgaacgtagtggacatccaggtcaatctcattgtaggctgcatcgaggtggtcttcgtaacaaaattcctatattcaatactggcgtttattgataatttccaggccgctaagcaggcattagcagaggcaacggtgcaagccgctggcatggccgctaccggggtcaaggaacttgctcagagatcttcccgtatggcccttgacatcaacattaaggcaccagttgtggtgatcccccagagccccgtgtcagaaaacgtattcgtggccgatttcggccttattaccatgaccaatacattccacatgataacagaaagtcagtctagcccccctcctgtgatcgatttgatcacaatcaagctttcagaaatgagactctatcgatccagattcattaacgatgcatatcaagaagtactcgacctgctactccccctaaacctggaagtggttgtcgagcgcaacctgtgctgggagtggtatcaggaagttccttgtttcaatgtgaatgcccagcttaagccgatggaattcattctgtcacaggaagacatcaccaccatatttaagactctccatggaaatatatggtacgaaaaagatggtagcgcatccccagccgtgactaaggaccagtacagcgcgaccagcggcgtaaccaccaacgcgtctcaccactccggaggagctactgtggttaccgcagctgtagtggaggttcactctagggccttattagttaagactacccttaacatcagcttcaaaacggatgacttaaccatggttctgtactccccaggcccaaagcaggcgtcctttacagatgttcgtgatccatctctgaagctggccgaatttaaattggaaaacattatctcaacattgaaaatgtacacggatggatccactttctccagtttttctttaaagaattgcattctggacgacaagcgacctcatgtgaaaaaagccaccccaaggatgataggattgaccgttggctttgataagaaggatatgatggatattaagtatagaaaagtgcgcgacggttgtgtcacggacgcggtattccaggagatgtatatctgcgcttctgtagagttccttcagacagtggccaatgtctttctggaagcctataccacaggaacagcagtcgaaacttccgtccaaacctggacagccaaggaagaagtgccaacccaggagagcgttaagtgggagattaatgtgatcattaagaaccctgagatagtgttcgtggcagatatgaccaaaaacgacgcaccggctttggtgatcacaactcaatgcgaaatatgttataaagggaatttagagaatagtactatgaccgccgctataaaggacctgcaggtgagggcgtgtccctttcttcccgtcaagcggaaaggcaagatcacgaccgttctgcagccatgtgacctgttctatcagaccacgcagaagggaactgatccgcaagtgatcgacatgagcgtcaaaagcctaacactcaaagttagcccagtaattattaacacgatgatcacaattacctcggccttgtacacaaccaaggaaacaatcccagaggaaaccgcaagcagcactgcccacttgtgggagaagaaagacacgaaaaccctgaaaatgtggtttcttgaggaaagtaatgagacagagaaaattgcgccaaccacagaactggttcccaagggcgaaatgatcaaaatgaatatagactccatcttcattgttctggaggccggtattggtcataggaccgtccccatgttgctggccaagagccggttcagcggggagggaaagaactggagtagcctgatcaacctgcattgtcagttagagctggaggtgcactactacaacgaaatgttcggagtctgggaaccgctgctggagccacttgaaatcgatcagactgaggattttagaccttggaacctaggcattaaaatgaaaaaaaaggccaaaatggccatcgtggaaagtgacccagaggaagagaactataaagttcccgagtacaaaacagtcattagtttccactctaaggaccaactcaatatcactctctctaaatgcggactagtgatgctgaataatttggttaaagccttcacagaagccgctaccggctcctctgcagatttcgtgaaggatctagcccctttcatgatcctgaatagtctcgggctaaccatcagcgtgtcgccatcagattcattttcggtcttgaacatccccatggctaagtcatatgtcctgaaaaatggggaaagtctgtccatggactatattaggaccaaggataacgatcactttaacgcgatgacctccctttcgagcaaattattcttcatactccttacccctgttaatcattcaaccgctgataaaatccctttgacaaaggtgggtaggagattatataccgtcaggcatagagaatctggcgtcgagagaagcattgtgtgtcagatagacactgtggagggttcaaaaaaagtgacgattcggagtccagttcagataagaaatcacttctcagtgcctttaagcgtatacgagggggataccctgctgggaacggccagccccgaaaatgaattcaacattccactcggctcgtatcgtagttttatcttcctgaaacctgaggatgaaaattaccagatgtgcgagggtatagactttgaggagattataaagaacgatggggcactgttgaagaaaaaatgccgcagtaaaaatccttctaaagagtcctttctcatcaatatagtcccagaaaaggacaacttgacaagcctatcagtgtactccgaggacggatgggatttaccatatatcatgcatctgtggccaccaatcttgctccgaaacctcctgccctataagatcgcttactacatcgaagggatcgagaattccgtatttactctttctgagggacatagcgcacaaatttgcactgcccagctggggaaggctcgccttcacctgaagcttctggactatctgaatcacgattggaagtctgagtaccacattaagcctaatcagcaggatatcagcttcgttagcttcacctgtgtgacagaaatggagaagaccgacctagatattgcagtgcatatgacctataacaccggccaaaccgtagtggcgtttcatagtccctattggatggttaataaaacaggcaggatgctgcagtacaaggccgacggtattcataggaaacacccccctaattataaaaagcccgtgctcttctccttccaaccgaatcatttttttaacaataacaaagtccagcttatggtgacagactcggagctgtccaatcagttttctatcgatacagtcggcagccatggggctgtgaagtgcaagggcctcaaaatggactaccaggtgggggtgacaatcgatctgagctcgtttaacattacaagaatagtcacattcaccccattttatatgatcaagaataagagtaagtatcatataagtgtggcggaggaggggaacgataagtggttgagtctggatctggagcagtgcatccccttctggcctgagtacgcttccagcaagctgctgatacaggttgaacgctctgaggatccaccaaaacgcatttacttcaacaagcaggagaattgcatcttactgaggctagacaatgagctgggcggtatcatagctgaagttaacctggcagagcattctaccgtgattacatttctggactaccacgacggtgctgccacctttcttctgatcaatcatacaaaaaatgagttggttcagtacaatcagagcagcttatcagaaatcgaagacagcctgcccccaggaaaggccgtcttctatacctgggccgacccagtgggcagtagacggctaaagtggaggtgtcgtaagtcccacggcgaagttacgcagaaggatgacatgatgatgcctattgaccttggcgagaagactatttacctggtcagttttttcgagggattacagcggatcatactgtttacagaggatccgagagtttttaaggtgacttatgaaagcgaaaaggctgagctggctgagcaggaaattgctgtcgctctgcaagacgtcggaatctctctggtgaataattatactaagcaggaggtagcctacatcggtatcacgtcttccgatgtcgtctgggaaaccaaacctaaaaaaaaagcccgatggaaaccgatgtccgttaaacacactgagaagctggagcgcgaattcaaagagtacacagagtcatcccctagtgaggataaggtgattcaactcgacaccaatgtccccgtgagactaacgcccaccgggcacaacatgaaaattctgcagccccacgtgattgcactgcgaagaaactatttacccgcactaaaggtagagtacaacacgagcgcacaccaatcgagttttagaatccagatctataggattcagattcagaaccagatccacggcgctgtctttcccttcgtcttttaccccgtgaagcccccaaaatccgtgaccatggactctgcccctaaaccatttaccgacgtcagtatcgtgatgcgatcggctggacactcacagatttctcgcatcaaatattttaaggtcttgatccaggaaatggacttgagactggatctcggattcatctatgccttaactgatctgatgactgaagcagaggtcacagaaaacactgaagtggaactttttcacaaagatattgaagctttcaaagaagagtacaaaactgcttctcttgtcgatcagagccaagtgtctctttacgagtactttcacatttccccaattaaactgcacctgagcgtgtccttgtcgtctggacgcgaggaggccaaagactctaaacagaatgggggattaatccccgtccacagtcttaacctgcttcttaaatccattggagctaccttgacagacgtgcaggatgtggtctttaaactggccttcttcgaactgaattatcagtttcacaccacaagcgatctgcaaagtgaggtaatccggcattatagtaaacaggcaattaaacaaatgtacgtcctgatcctgggcctagacgtcttaggcaacccattcgggctgattagagagtttagcgaaggggtggaggcttttttttatgagccgtatcagggggctatccagggcccagaagaattcgtggagggtatggcgctgggcctcaaggcactcgtgggaggcgctgtaggcggacttgcaggggctgccagtaaaatcacaggcgcaatggccaagggcgtggccgctatgacaatggacgaggattaccaacaaaagcgaagagaggccatgaataagcaacccgcaggcttcagagagggcattaccaggggaggtaagggactcgtgagcggttttgtctcaggaatcacaggtatcgttactaaaccgataaagggggcacagaaagggggagctgctggctttttcaagggcgtgggaaaagggttggtcggggctgtcgcaagaccgacgggcggtataatagacatggccagcagcaccttccaggggatcaagagagccaccgagaccagcgaagtcgagtccttacgcccacctaggttctttaacgaggacggcgttatacgaccgtacaggctccgcgatggtaccggcaatcaaatgcttcaggtgatggagaacgggaggtttgccaagtataaatacttcacacacgttatgatcaataagactgatatgctcatgatcacgaggaggggcgtgctttttgttaccaaaggaacattcggccagttaacgtgtgaatggcagtactctttcgacgagttcacaaaagagccttttatcgttcacggcagaagactgagaatagaagccaaagagagagttaagtcagtctttcacgccagagagttcgggaaaattattaacttcaagacccccgaagatgccagatggattttgacaaagctgcaggaagcccgagagccatcgccctccctgta

SEQ ID NO: 31373 - DNA, 1317 bp, Artificial Sequence
  Description of Artificial Sequence: Synthetic coding sequence
atgaacgaggtatcagttattaaagaaggctggttgcataaacgcggagaatatataaagacctggaggcctaggtacttcctattgaagtcagatggcagctttatcggttacaaagagcggcctgaggccccagaccaaaccctgccccctctcaacaacttttcagtggctgagtgccagctcatgaaaactgagcgacccagacctaatacattcgtgattcggtgcctgcaatggactacagtgatcgaacgcacttttcacgtggactcccctgacgagcgggaggaatggatgcgggcaatccagatggtcgctaactctctaaaacagagggcccctggagaggaccccatggattacaagtgcggcagtccttctgactccagcactactgaagaaatggaggttgcagtttccaaagcccgtgctaaggtgactatgaatgatttcgattatctgaaattgctcggcaaaggcacgttcggcaaggtaatcctcgtgcgcgagaaggccaccggacgctactatgcgatgaagattctgagaaaagaggtcattattgcgaaggatgaggtggcccacaccgtcaccgagtctagagtcctgcagaacacgcgacaccccttcctcacggcactgaagtatgccttccaaacacacgacagattatgtttcgttatggaatacgctaatggtggggagctcttttttcatcttagtagagagcgcgtgttcacagaggaaagagcgaggttttacggggctgaaatagtgagtgctttagagtatttacactcgagggatgtggtctacagggatataaaggttctagaagataatgactacggcagggccgttgactggtggggcttgggagtcgtgatgtacgagatgatgtgcggacggctacctttctataaccaagaccatgagcgcctgttcgagcttatcctgatggaagagatacgttttcctcgcacgctatcccctgaggctaaaagtctgctcgcaggactcctgaagaaggatcccaaacagcggctgggaggagggccatccgacgcgaaggaggtaatggagcacagattttttttgagcataaactggcaggatgtggtccaaaagaaactgctgccacctttcaagccgcaagttacatcagaggtggatactagatacttcgacgacgaattcactgcgcagagcattaccatcactccccctgatcgctatgactcactgggtttgctggaattagatcagaggacacatttcccccaattctcgtattccgcaagcatccgcgaatag

SEQ ID NO: 31374 - DNA, 444 bp, Artificial Sequence
  Description of Artificial Sequence: Synthetic coding sequence
atgcgttgcctatcctccaaaaaagccggatctacttctgttgttaagtatattaagacgtggcgaccgagatactttttactgaagtcagatgggtcgttcatcggatacaaagagcggcctgaggcgcctgaccagactctgccacctctcaacaacttctccgtggctgagtgccagcttatgaagactgaaagaccaagaccgaatacctttgtgattaggtgtttacagtggaccaccgtgatagaacgaaccttccatgtggactcgcccgacgagagagaggaatggatgagggctatacagatggtggcaaactccttacagccccatttgtgtgcccaaacaagaatctggaaaaccccgcctcccgctcaagcttgggctgttggacgcctggagatacaggtgcttatccacaccagtccatcagagggctag

SEQ ID NO: 31375 - DNA, 1149 bp, Artificial Sequence
  Description of Artificial Sequence: Synthetic coding sequence
atgagggcgatccagatggtggccaacagcctaaagcagagggctcccggtgaggatccaatggattataaatgcggatcaccttcggactccagcacaacggaggaaatggaagtggccgtgtcaaaggccagagcaaaggtgaccatgaacgactttgactacctgaagctgctgggtaaaggaacatttggcaaagtgatactcgtgcgcgagaaggcgacagggcgatactatgctatgaaaattctgagaaaggaggttatcattgccaaggatgaggtggcgcacacagtgacagagagtcgtgtcctgcaaaatacacgccaccctttcctgacagccctgaagtacgcattccaaacgcacgatcgcctgtgtttcgtcatggaatacgccaacgggggagaactgttcttccacctgagccgcgagcgggtctttaccgaggagagagctagattttatggggctgagatcgtttctgccctagagtacttgcacagccgcgatgtcgtgtaccgtgatattaagctcgagaaccttatgctcgataaagacggtcatattaagataaccgactttggtctctgcaaggagggcatttcagacggcgcaacgatgaagaccttctgcggtacccccgaatacttggcccctgaagtgttagaggataatgactacgggagagccgtggattggtgggggctgggagtcgtcatgtacgagatgatgtgcgggaggctgccattctacaatcaagatcacgagcggctcttcgagctgatcctgatggaggagatcagattcccaaggactctgagtcctgaggccaaatctctcctggccggactgctgaagaaggatcccaaacagaggctggggggaggtccttccgacgctaaggaggtgatggaacacaggttctttctcagtatcaattggcaggatgtagtacagaaaaaactgctgccaccattcaaacctcaggttacctcagaggtggacaccagatactttgatgacgagttcaccgctcagtcaattacgataacccctcccgaccgttatgacagtctgggcctgctcgagctggatcagaggacacattttccacagttctcctatagtgcttccatcagggagtag

SEQ ID NO: 31376 - DNA, 402 bp, Artificial Sequence
  Description of Artificial Sequence: Synthetic coding sequence
atgaatgaagtgagcgtgattaaggagggctggttgcacaaaagaggcgagtacattaaaacgtggcggcctcgctacttcctgctgaagtcagacggctctttcatcgggtacaaggaacgccctgaggccccagatcaaacgctgcccccactgaataacttttctgtagcagaatgccagctgatgaaaactgaacgtcccagaccaaacacattcgttatccgttgcctgcagtggactaccgttatagaacgcacgttccatgtggattcaccagacgagcgggaagagtggatgcgggcaattcagatggtagcaaattccttaaaacaaagagcacctggagaagatccaatggactataagtgtggctcaccgtcggactcgagcactacctag

SEQ ID NO: 31377 - DNA, 1446 bp, Artificial Sequence
  Description of Artificial Sequence: Synthetic coding sequence
atgaacgaggtttccgtgatcaaagagggatggttgcataagaggggggagtacattaagacctggagacctcggtactttctcctgaagtccgacgggtcttttattggatacaaggaaaggccagaagctccagatcagactctacctccgctgaataacttttccgttgctgagtgtcaactgatgaagacagaacgtcccaggccaaacacctttgtaattcgatgcctccaatggaccactgtcatcgagcgcaccttccacgttgatagtcccgatgagcgggaggagtggatgcgggcaatccaaatggtggctaactccttgaaacagagagccccaggcgaggacccaatggactacaagtgtggtagcccttccgacagcagcactacggaggagatggaagtggctgtttccaaggcccgagcaaaagttacaatgaacgatttcgactatctgaaacttctgggaaagggcaccttcggcaaagtgatcttagttcgcgaaaaagctacggggaggtattacgctatgaaaatattgcgaaaggaagtcatcattgcaaaagatgaggtggcacataccgtgacagagtcgagggtgctgcagaataccagacacccatttctgaccgcattgaaatatgcctttcagacccacgatcgcttgtgctttgtgatggaatatgccaatggaggcgagttgttttttcatttgtctcgtgagcgggtttttaccgaagaacgcgctaggttctacggtgctgagatcgtctcagctcttgaatatcttcattccagagacgtcgtttacagggatatcaagctggaaaacttgatgctcgacaaggacggtcatatcaagatcactgactttgggttgtgcaaggaagggatcagtgacggcgctactatgaagacattttgtggaactcccgagtacctggctcctgaagttcttgaagataatgactatggcagagcagtggattggtggggccttggcgttgttatgtacgagatgatgtgcggcagactgcccttttataatcaggaccacgagagactttttgaactgattctcatggaggagatcagatttccacgaacactcagtccagaagccaagtccctgttagctggcctgctgaagaaagaccccaagcagcgtttgggcggagggccaagcgacgcgaaagaagtgatggagcaccgcttcttcttgtcaattaattggcaggacgtggttcagaaaaagttgctaccaccatttaaaccacaggtgacatctgaagtggacaccagatattttgatgatgagtttaccgctcaatcaatcaccatcactccccctgatagatatgattccctggggctgctggagctggatcagagaacccactttccccagttttcatattccgcttctatccgggagtag

SEQ ID NO: 31378 - DNA, 402 bp, Artificial Sequence
  Description of Artificial Sequence: Synthetic coding sequence
atgaacgaagtgtctgttatcaaggaagggtggctgcacaagcgtggagagtatataaagacctggcgcccaagatatttcctgctcaagtcagacgggagtttcatcggctacaaggagcgaccagaagcccctgaccagaccctgcctccacttaataacttttccgtcgcagaatgccagttaatgaagacggagagacctaggccaaacaccttcgtgattagatgcttgcaatggactacagtgattgagcgcacgtttcacgtggactcaccagacgagcgcgaggagtggatgagagctatccagatggtcgccaactctctgaagcaaagagcccctggcgaggaccccatggattataagtgcgggagtcccagtgattcttctaccacttag

SEQ ID NO: 31379 - DNA, 291 bp, Artificial Sequence
  Description of Artificial Sequence: Synthetic coding sequence
atgaatgaagtttccgtcattaaagaaggatggttacacaaaaggggagagtacatcaagacttggcgcccacgctattttctcctgaaaagcgacgggtcttttattgggtataaagagcggccagaagcaccggaccagacgctaccgcctcttaacaatttctcagtggccgaatgtcagctgatgaagaccgagcggccacgccctaataccttcgtgataagatgcctgcagtggaccaccgtcattgagagaacttttcatgttgattctcctgatgagcgatag

SEQ ID NO: 31380 - DNA, 360 bp, Artificial Sequence
  Description of Artificial Sequence: Synthetic coding sequence
atgaatgaagtgagtgtgataaaagagggttggctgcataaacggggagagtatataaaaacttggaggccgcgatattttctcctcaagagtgacgggagctttataggctacaaagagagacccgaagccccagaccagactctgcctccgttaaataactttagcgttgccgaatgccagctcatgaaaactgagcggccaaggcccaatacattcgtgattaggtgcctgcagtggaccactgttattgagcgcaccttccacgtggacagccctgacgagagagaggagtggatgcgtgccattcagatggttgctaacagcctcaagcaacgcgctcctggcgaggacccttag

SEQ ID NO: 31381 - DNA, 1446 bp, Artificial Sequence
  Description of Artificial Sequence: Synthetic coding sequence
atgaatgaagtgtcagttatcaaagaaggctggctgcacaagcgaggcgagtatatcaagacgtggagaccacgctatttcctgctcaagtccgatggctcattcattgggtataaagagcggccagaggcccctgatcagacactgccacccctgaacaacttcagcgtcgctgagtgtcagctcatgaaaactgagaggcccaggcctaacacgtttgtgatcaggtgcctccaatggaccaccgtcattgaaaggacctttcatgtggatagtccagacgaacgagaagagtggatgcgcgctatacagatggtggctaactccctgaaacagcgtgcgccaggtgaagaccccatggattataagtgcggtagtccatcagatagctcgacaactgaggagatggaggtggcagtgtccaaggcaagagcgaaggtaacaatgaacgacttcgattaccttaagttgttgggaaagggtacgtttggtaaggtgattctggtgcgggaaaaggcaactgggagatactacgcaatgaagattcttcgtaaagaggtgatcatagccaaagacgaggttgcccatactgtcacagagtctagggtgctccagaatacccggcatcccttcctcactgcactcaagtatgcctttcagacgcatgacaggctgtgttttgtgatggagtacgctaacggaggagagctcttctttcacctgtctcgagagcgagtttttaccgaggaaagggccagattttacggtgcagagatcgtctctgcgttggaatacctgcactcccgggatgttgtctatcgcgatatcaagttggagaatttgatgttagataaagatggacatatcaaaattacagatttcgggctttgcaaggaagggatctccgacggtgctaccatgaagacattttgtggcaccccggaatacctcgcccctgaggtccttgaggataatgactatggaagggccgtcgactggtggggccttggtgtcgtcatgtacgagatgatgtgcggaagactacctttctacaaccaggatcacgaaaggctgttcgagctcattctgatggaagaaatccgctttccacggacgctcagccccgaagcaaagagtttgctggcaggactcctgaaaaaagatccaaaacagaggctggggggagggccatcagatgctaaggaggtgatggaacataggttctttctctcgattaattggcaggatgttgtgcagaaaaagctactgccccctttcaagccacaggtgacgtcagaagttgacaccaggtattttgatgacgagttcacggcccaatccattaccattacacctccagacaggtacgatagtctgggtttactggaactcgatcagaggacgcactttccccagttttcctattctgcctccatccgagagtag

SEQ ID NO: 31382 - DNA, 204 bp, Artificial Sequence
  Description of Artificial Sequence: Synthetic coding sequence
atgaacgaggtaagcgtgattaaagaagggtggctgcacaaaaggggagagtacataaaaacctggcggcctcgctatttcctgctgaaatcagacggcagtttcatcggctataaagagaggcccgaggcccctgaccagaccttgccaccactgaacaactttagcgtggcagagtgccagctgatgaaaaccgaaagatag

SEQ ID NO: 31383 - DNA, 144 bp, Artificial Sequence
  Description of Artificial Sequence: Synthetic coding sequence
atgaatgaggtctccgttatcaaggagggctggctccacaagcgcggagaatacatcaaaacatggcgcccacgttattttctcctgaaatctgatggaagtttcatcggatataaagagcgacccgaggccccagatcagtag

SEQ ID NO: 31384 - DNA, 405 bp, Artificial Sequence
  Description of Artificial Sequence: Synthetic coding sequence
atgaacgaagtcagcgtgatcaaggagggttggctgcataagcgaggggaatacatcaagacctggaggcctagatattttctgttaaagtcagacggcagctttatagggtataaagagcgaccagaggctcctgaccagacgctgccaccgctaaataacttttcagtggctgagtgccagctgatgaaaaccgaacgcccacgtcccaacactttcgttatccgatgcttgcagtggaccaccgtgattgagaggacatttcatgtggattccccagacgagcgcgaagaatggatgagagcgattcagatggtggcgaactcccttaagcaaagagcccctggagaggatcccatggattacaagtgcgggtcaccctccgactcctctacaacagaatag

SEQ ID NO: 31385 - DNA, 324 bp, Artificial Sequence
  Description of Artificial Sequence: Synthetic coding sequence
atgaatgaggtctctgtgatcaaggagggctggctgcacaagcgaggcgagtacataaagacgtggagaccacgttactttctgttaaagagcgatggctcattcattggatacaaagagagacctgaagctcctgaccagacgttgcctcctcttaataacttctcagtggccgaatgtcagctgatgaaaaccgagcgcccaaggcccaacacattcgtcattcgatgccttcagtggacaactgtcatcgaacggacatttcacgtggatagccccgatgaaagggaagagtggatgagggcaatccagatggtcgcctag

SEQ ID NO: 31386 - DNA, 867 bp, Artificial Sequence
  Description of Artificial Sequence: Synthetic coding sequence
atgaatgaagtttctgtgatcaaagagggatggctgcataagcgcggtgagtatattaagacgtggcggccacgttatttcctcctgaagagcgatgggtccttcattggctacaaggagcgtcctgaagcccctgaccagacgcttccaccactgaataacttctctgtggccgagtgtcagttgatgaagacagagcgcccacggcctaatacatttgtgataagatgtctgcagtggaccacagttattgagagaacctttcacgtggacagcccagacgagagggaagaatggatgagagcaattcagatggtagctaattcactcaagcagcgggctcccggtgaggacccaatggactataagtgtggaagcccgagcgactctagcacaaccgaggaaatggaagtggctgtttccaaggctcgcgcaaaagtcaccatgaatgattttgactatctaaagcttctgggaaaaggtacctttggcaaggtgatacttgtgcgagaaaaagccacggggaggtactatgccatgaagatcctacgaaaggaggttatcatcgccaaggacgaagtagcccacactgtcacagagagccgggttctgcagaacacgcggcatccttttctgacagtgagttgcccacctttgccaaggcagtgcgaagcctccctgtggacagagcttagggagcgtgcacttatattctggtataaagcccagagttgggggaggcctggagggcaggggaaggtgctgcttagacctgcaaagtcctcagaaccaagacatgtggtgggagtgtcacggttgggcgaatgggaaggggactctttttttattgatgggggtttcatgtag

SEQ ID NO: 31387 - DNA, 1440 bp, Artificial Sequence
  Description of Artificial Sequence: Synthetic coding sequence
atgagtgatgtcacaattgtgaaagaaggatgggtccaaaagcggggagagtatatcaaaaactggagaccccgatactttctcctgaaaacagacggatccttcattggatataaagagaaaccacaggatgtggaccttccatatccccttaacaacttcagtgtggcaaagtgtcagctcatgaagaccgagcgacccaaacccaacacattcattatcagatgtttacagtggacaacagtcatcgaacggacatttcatgtcgacacgccggaggaaagagaggaatggactgaagctatacaggccgtcgccgaccggctccagcggcaagaggaggagagaatgaactgtagccccacaagccagatcgacaacatcggtgaagaagaaatggacgcctccaccacacaccacaaaaggaagactatgaacgacttcgactatctgaaactgctcggcaaaggcacattcggtaaggttatccttgttcgagaaaaagccagcggcaaatactatgctatgaagatactcaaaaaagaagtgataatagcaaaggatgaggtggcccataccctcactgaaagcagagttctgaagaacactcggcatcctttcttgacaagtcttaagtactcattccaaacaaaggatcgactctgcttcgttatggaatacgtgaatgggggtgagctattctttcatcttagcagagaaagagtgtttagcgaagacaggacccggttctacggcgctgagattgtcagcgcgctggattatctccattcaggcaagattgtgtaccgcgatttgaagctggagaatttgatgttagacaaggacggacatatcaaaatcactgatttcggactgtgtaaggaaggcatcactgatgccgctactatgaaaactttttgtggaacccctgagtacttggcccctgaggttctggaagataacgattatggcagagcagtagactggtggggcctgggtgtggtcatgtacgagatgatgtgtgggaggctgccattctacaaccaggatcacgaaaagctttttgagttaatcttgatggaggatatcaaatttccacgaacacttagtagcgacgccaaatcgcttctgtctggactgctgattaaggatcccaataagcgcctcgggggaggcccagatgatgcaaaggaaatcatgcgccactccttcttctccggagtaaactggcaggatgtttatgacaaaaaactcgtgcccccatttaagccccaggtcacctctgagaccgataccaggtactttgatgaagagtttaccgctcagacaatcacaattactccacccgagaaatacgatgaggacggcatggattgtatggataatgagcgacggccacacttccctcagttctcctattctgcaagtggaagagagtag

SEQ ID NO: 31388 - DNA, 1398 bp, Artificial Sequence
  Description of Artificial Sequence: Synthetic coding sequence
atgtccgacgtgaccatagtgaaagaagggtgggtgcagaaaagaggtgaatacattaaaaactggcggccaagatactttcttttgaagacggacgggtcgtttattggatacaaagagaagccccaggatgtggatttgccttatccgctaaacaatttcagcgtagctaaatgtcagcttatgaaaactgagagaccaaagcccaatactttcattattcgctgtcttcagtggacaacagtcatagagcgtacgttccacgttgatacgcccgaggagagagaggagtggacggaagccatccaggctgttgcagacagactacagcggcaagaggaggaacgaatgaattgtagcccaacctcccaaattgacaacataggcgaggaagaaatggacgcctcaaccactcaccacaaaagaaagacaatgaatgacttcgactacctgaaactgctggggaaaggcactttcggaaaagtcatactggttcgcgagaaggcttctgggaaatattacgccatgaaaatcctgaaaaaggaagtcattatcgccaaggacgaagtggcccatacactgaccgagtccagagtgctcaagaatacccgtcatcccttcttaacttcattgaagtactcctttcaaaccaaggaccgcctctgttttgttatggagtacgtgaatggcggagaactgttttttcacttatctcgggagcgggtgttttctgaagaccggacccgtttctatggcgcagaaatcgtcagtgctttagactacctgcattcaggcaagatcgtttaccgggatctgaagctggaaaacctgatgctggacaaagacggccacatcaagataacagattttggcctttgtaaagaaggtataactgacgcagctactatgaaaacgttctgtggcacccccgaatatcttgccccagaagtgctcgaggacaacgattatggccgagctgtggactggtggggattgggagtggtgatgtatgagatgatgtgtgggaggctccccttttataatcaagaccatgagaaactgtttgagctgatactcatggaggatatcaaattccctaggaccctatccagtgacgccaagtcactcttgagcggtctgctgataaaagatcccaacaaacgtctgggagggggaccagatgatgccaaggagattatgcggcactcctttttctctggcgtgaactggcaagacgtttacgacaaaaaattggtgcctcccttcaaaccgcaggtgacctcagagactgacacgaggtacttcgatgaagaatttacagcgcagaccatcactatcacacccccagagaaatgtcagcagtctgactgtggcatgctgggcaattggaagaagtag

SEQ ID NO: 31389 - DNA, 1440 bp, Artificial Sequence
  Description of Artificial Sequence: Synthetic coding sequence
atgagtgatgtgaccattgtgaaggaaggatgggtccagaagaggggtgaatacatcaagaactggcgcccaaggtactttctgctgaagaccgacgggtctttcatcggttacaaagagaaaccccaggacgtggacctgccataccccctgaacaacttctcggtggccaagtgccaactgatgaaaaccgaaagacctaagcctaacacattcatcatccggtgcctacagtggacaaccgtgattgaacggacattccacgtcgatacccccgaggagagggaggaatggacagaagccattcaggctgttgcggaccgcctgcagcggcaggaggaggagcgcatgaactgttcccccacaagccagattgataacattggggaagaggaaatggacgccagcacaacccaccacaagcgcaaaaccatgaatgatttcgattacctgaaactcctgggcaagggtacattcggtaaagtcatccttgtcagagaaaaagcatccggcaagtattacgccatgaaaattctgaagaaagaagtcataatcgccaaggacgaggtggcccacaccctgactgaaagcagggtgctgaaaaacacacggcacccctttctgacctctctaaagtacagcttccagaccaaggaccgcctctgtttcgtgatggaatacgttaacggaggcgagctgttctttcacttgtcaagggagagggtcttttctgaggatagaacacgattctacggggctgaaatcgtgtccgccctggactacctgcacagcggcaaaatcgtgtatcgggacctgaagctcgagaatctgatgctggacaaagatgggcacattaagattactgattttggtctgtgtaaggaggggataactgacgctgctaccatgaaaacattttgcgggacgccagaatacctcgctcccgaggttttggaggacaacgactacggccgtgcggttgattggtggggtctaggcgtggtaatgtacgagatgatgtgcggacgcctccccttttacaaccaagatcacgaaaaactctttgagttaatcctcatggaagacatcaaattcccaagaacgctctctagtgatgccaagtctcttctgtccggtctgctcattaaagaccctaacaagagactgggaggagggccagacgacgccaaagagataatgcggcatagtttcttcagcggcgtgaactggcaggacgtgtacgacaaaaagctcgtaccaccattcaagccacaggtgacttccgagacggatacaagatacttcgacgaggaatttacagcccagacaatcaccatcactcctccggagaaatacgacgaggatggaatggactgtatggacaacgaacgcaggccacactttccacagttttcttatagtgcctccggcagggaatag

SEQ ID NO: 31390 - DNA, 1398 bp, Artificial Sequence
  Description of Artificial Sequence: Synthetic coding sequence
atgagtgacgtaacaattgtgaaggaggggtgggtgcagaagcggggtgagtacatcaagaattggcggcctcggtattttctgctgaaaactgatgggagctttatagggtataaggagaagccacaggacgtggacctaccatatccactgaacaactttagcgtggctaagtgccagcttatgaaaaccgaacgcccaaaaccaaatacatttatcataagatgcctgcagtggaccactgtcatcgagcgcacctttcacgtcgacacacctgaagaaagggaagagtggactgaggccatccaggcagtcgcagataggctccagcggcaggaagaagagcgcatgaattgttctccaacttcgcagatagataacattggggaggaggagatggatgccagcaccacccatcacaaaaggaaaaccatgaacgacttcgactacctgaagctgctgggtaagggcacattcggcaaggtgattctggttcgggagaaagcatctgggaaatactatgcaatgaaaatcctgaaaaaggaggtaatcatagctaaggacgaggtggcccacaccctgaccgaaagccgtgttctgaagaacacccgccatccgttcctgacctcattgaaatattcgtttcagactaaggaccggttgtgctttgtgatggagtatgttaacggtggtgaactgttttttcatctgagtcgcgaacgggtgttctccgaggacagaacgcgattctacggcgcagagattgtgtctgcactggactacctgcatagcggcaagattgtctaccgtgacctgaaactcgagaatcttatgctcgacaaggatggacatatcaagattacagacttcggactttgcaaggagggaatcacagacgctgcgacaatgaaaacattctgtgggacaccggaatatctagccccagaggttttagaagacaatgattatggccgagcggtggactggtggggactgggtgtggtcatgtacgagatgatgtgtggacgactccctttctacaaccaggaccatgaaaaactctttgaattaatcctaatggaggacattaaatttcccagaacactgagcagtgatgcaaagagcttactgagcggcctgctgatcaaggacccaaacaagagactgggtggcggacccgacgacgcgaaggaaatcatgcggcactcttttttcagcggcgtcaactggcaggacgtgtatgacaagaagctggttccgccattcaaaccacaagtgacttctgaaacagatacacgctacttcgatgaggaattcaccgcccagaccatcacaattacaccaccggagaagtgtcaacaatccgattgcggaatgctcggcaattggaagaagtag

SEQ ID NO: 31391 - DNA, 420 bp, Artificial Sequence
  Description of Artificial Sequence: Synthetic coding sequence
atgtctgatgtaacaatcgtcaaagaaggctgggtccaaaaacggggagaatatattaagaactggcggccacggtactttctgctgaaaaccgatggttctttcatagggtataaagaaaaacctcaggacgtggatctgccttacccattgaataacttctctgtggctaagtgtcaacttatgaagaccgagaggccaaagccaaatacatttataatccgatgcttgcagtggacaacagttatagagcggacattccatgtggacacaccagaagagagggaagaatggacagaggctattcaggctgtcgccgatagactgcaaaggcaggaggaggagcggatgaattgctcgcctacatctcagatcgataacataggtgaggaagagatggatgcctcgacaacacattag

SEQ ID NO: 31392 - DNA, 624 bp, Artificial Sequence
  Description of Artificial Sequence: Synthetic coding sequence
atgagcccactccttcgtcggcttcttcttgccgctctgctacagttggccccagcacaggcacctgtaagccagcctgacgctccaggccatcagagaaaggtggtcagttggattgacgtgtatacccgggctacctgtcagccgagggaggtggtagttccactaacagtcgagctgatggggacggttgccaaacagttggttccaagctgcgtcacagtgcaacgctgcggagggtgttgcccagatgacggactggaatgtgtgccaacaggccagcaccaggtccggatgcagattctaatgatccgctatccaagctcacaacttggagaaatgagcttggaagagcactcacaatgcgaatgtcgtcctaagaagaaagactctgcggttaagcccgatcgggcagccactcctcaccatcggcctcagccgaggagcgtgccagggtgggactcagcaccgggtgcccctagccctgccgatattacccaccccactccagcgccaggcccttcagctcacgccgctcctagcactacctcagcactcacaccagggcctgctgctgccgcagcagacgctgctgcttcatccgtagccaagggaggcgcttag

SEQ ID NO: 31393 - DNA, 567 bp, Artificial Sequence
  Description of Artificial Sequence: Synthetic coding sequence
atgtcacctctgcttcgcagattgctgctggctgctctgctgcaactggccccagcacaagcccctgtctcccagcccgacgcgccagggcatcaaagaaaggtggtgagctggattgacgtgtataccagggccacttgtcagcccagggaagtggtggttcccctgacagtcgagctcatgggaaccgttgcaaagcagctcgtgccttcttgtgtgacagttcagcgatgcggtggatgctgtcctgacgatggactagagtgcgtccccacaggacaacatcaggtgaggatgcagatcctgatgatccgttatccttcatcccagctcggcgagatgagcctggaagaacactcccaatgcgaatgtcggcctaagaagaaagattcagctgtaaagcctgatagcccaagacctctgtgtcccaggtgtacacagcaccaccagaggcccgatccccgtacctgtcgttgccggtgtagaaggcggtcatttctgaggtgtcaggggagagggctcgaactcaaccccgatacctgcagatgcaggaagcttcggaggtag

SEQ ID NO: 31394 - DNA, 1143 bp, Artificial Sequence
  Description of Artificial Sequence: Synthetic coding sequence
atgagcgagactgtgatctgttctagccgcgctacggtcatgctgtacgacgacgggaataagcgctggctgcctgcaggaaccgggccacaggcattcagccgagtccagatatatcataatcccacagccaacagtttcagggtcgtcggccgtaagatgcagcccgaccagcaggtcgtcatcaactgcgccatagtgcgtggggtgaaatataatcaggccactccaaactttcaccagtggagggacgctcggcaggtgtggggactgaatttcggcagcaaggaagatgctgctcaatttgcagctggtatggcgtccgccctcgaagctctagaggggggaggaccccctccaccccctgccctccccacgtggtcagtcccaaacggaccatcgcctgaagaagttgagcagcaaaagagacagcagcccggaccctcggaacatatcgagagacgcgtgtcgaatgctggaggaccccctgcgccacctgcaggcggtccacccccacctccagggccacctccgccacctggccctccgccaccacccggactaccgccatcaggtgtccctgctgccgcacacggggctggcggagggcctccacctgcacctcctctgcctgctgcacagggccctggcggagggggagcaggtgcaccagggctggcagcggctatagctggcgctaaattgaggaaggtcagtaaacaggaagaggcaagcggtggacccactgcgcctaaggccgaaagtgggaggtctgggggaggcggtttgatggaggaaatgaatgccatgctggcccgaaggcggaaggccactcaagtaggtgagaaaactccaaaagacgagtccgccaatcaagaggagcccgaggcaagagtcccagcccaaagtgaatccgttaggcggccttgggagaagaactccaccactctgccgaggatgaaatctagtagctcagtaacaactagtgagacacaaccctgtacacctagcagcagtgactattctgatctccagcgggttaaacaggaactcttagaagaagttaaaaaggaattgcaaaaggtgaaggaggagatcatcgaggccttcgtccaggaactgcggaagcgcggatctccatag

SEQ ID NO: 31395 - DNA, 915 bp, Artificial Sequence
  Description of Artificial Sequence: Synthetic coding sequence
atggctggtaactttgactctgaggagcgttcctcctggtactggggaagactgtctaggcaggaagctgttgctctgctccaagggcaacggcatggagtgttcctggtgagagatagtagtaccagccccggagattatgttctgagcgtctcagaaaacagtcgggtatcccactatataattaattccagcggaccacggccacctgtccctccctccccagcccaacctccgccaggcgtgtctccatctaggctccggattggcgatcaggagttcgattcgctgccagctctgctggagttctataagatccattatctcgacactacgaccttaattgagcccgtctcccgcagtagacaaggctcaggagtcattttacgccaggaggaggctgagtatgttcgggctctgttcgattttaacggaaacgacgaggaagatctgccattcaagaagggtgatattttgcgcatcagggataaaccggaggagcagtggtggaatgccgaagactctgaaggaaagagaggcatgatccctgttccctatgtggagaaatatcgccctgcctccgcttctgtgtcagcgctgatcggcggaaatcaagagggttctcatccccagccactggggggacctgagccgggaccctacgctcagccttccgttaatacccctctacctaatcttcagaacggacctatctatgcaagagtgatccagaaaagagttcccaatgcgtacgataagacagcccttgcactagaggtgggcgaactggtgaaggttaccaaaataaatgtttctggccagtgggaaggtgagtgcaacggcaaaagagggcacttccccttcacccatgtgaggctgttggaccagcagaaccctgatgaagattttagctag

SEQ ID NO: 31396 - DNA, 615 bp, Artificial Sequence
  Description of Artificial Sequence: Synthetic coding sequence
atggcgggaaacttcgacagcgaagagagaagcagttggtattgggggaggctcagccgccaagaggcagtcgcgctgctgcagggccagcgccatggtgtgttcctggtgcgggacagctctacatcccccggagactatgtcctctcagtgtcagagaactcacgggtttcacactacatcatcaatagctccggcccaagacccccagtccctcctagtcccgcacagccaccacccggtgtgtcccccagccgccttaggattggggaccaggagttcgactctttacccgctctgctggagttttataagatccactacctggacaccactacgctgatagaaccagtctcacggtctcggcagggaagcggggtcatcctgcgccaggaggaggcagagtatgtccgtgccttatttgacttcaatggaaatgatgaggaagaccttccatttaaaaagggagacattctgaggattcgtgacaaacctgaagaacagtggtggaacgctgaggactcagagggcaagagaggtatgatacccgttccctatgtggagaaataccggccagcgtctgcctcggtgagcgctttaattgggggtcgctag

SEQ ID NO: 31397 - DNA, 2196 bp, Artificial Sequence
  Description of Artificial Sequence: Synthetic coding sequence
tgaaaacctgccaccggcctatgggtgtgggtcagcctactcgtggccgctgggacagtacagccctccgacagccaatccgtatgcgcaggcaccgaaaataagctgagctccctctcagacttggagcagcagtatcgggcactccgcaaatactacgaaaactgtgaggtggtcatgggtaacctcgagattacaagcatagaacacaatagagatttgtctttcctccgctcggtaagagaggtcactggatacgtcctggtggcccttaatcagtttaggtacctgccactggagaacctgcgaatcattagggggactaagttatacgaggacaggtacgccttggcgatctttctgaattaccgaaaagatgggaatttcggcctacaggaactgggcctaaagaaccttacagagattctgaatgggggagtgtacgttgatcaaaacaagtttctttgttacgcggatacgatccactggcaagacatagtgcggaatccatggccttctaatttgacgctagtgagcacgaacggtagttccggctgtgggaggtgtcacaagagctgcaccggacggtgttggggacctactgagaatcattgccagacattaacaagaacggtgtgtgccgaacaatgcgatggtaggtgctacggtccctacgtcagtgactgttgccatcgggagtgcgccggaggttgtagcggtcccaaagatacggactgcttcgcctgcatgaacttcaatgactcaggcgcttgcgtcacgcagtgccctcaaacctttgtctacaacccaaccaccttccagttggagcataactttaacgcaaagtacacctatggagccttctgtgttaagaagtgcccacacaactttgtggtggattcatcatcatgtgtacgcgcatgtccgagcagcaaaatggaagtcgaggagaacggcatcaagatgtgcaagccatgtaccgacatctgtccaaaagcctgcgatggtatagggacaggctccctgatgagtgcccaaacagtggattcaagcaacatagacaaatttataaactgcacgaagatcaacgggaatctgatcttcctggtaaccggtattcacggcgacccatacaatgcgatcgaagctattgaccctgaaaaactgaatgtcttccgcaccgtgagagaaatcacaggctttctcaatatccagagttggcctccaaatatgaccgattttagcgtgttctcaaacctggtcaccataggtggacgtgtcctgtatagtggactgagccttctgatattgaagcaacagggcataacgagcctgcaatttcagtccctgaaagagatcagtgctgggaatatttacatcactgataactccaatttgtgttattaccacactattaactggaccacactcttttcaacaatcaatcagcgcatagtgatacgggacaaccgcaaagctgaaaattgtaccgctgaagggatggtatgcaaccacctgtgttccagcgacggttgctgggggccaggcccagaccagtgcctgtcctgccgtaggttctcacgaggacggatatgtattgaatcgtgcaacctgtatgatggagagtttagagaatttgaaaatggcagcatttgcgtcgaatgcgacccgcaatgcgagaagatggaggacggactgcttacctgccatgggccaggcccagacaattgtacgaagtgtagccattttaaggatgggccaaattgcgttgagaagtgccccgacggtctgcagggcgctaattctttcatttttaagtatgcagatcccgaccgagaatgccacccctgtcacccgaattgtacccaaggctgcatcggtagtagtattgaagattgcatcggcttgatggacagaacgcctcttatcgccgcaggggtcattggcggtctgtttatcctcgttattgtcgggttgaccttcgcagtttacgtgagacgtaagagcattaagaagaagagagccctgcgtcggtttctggaaacagagctggtggaaccactgacccccagcgggacggccccaaaccaagcacagctgaggatcctgaaggagacagaactcaagagagttaaagtgcttgggtccggcgcattcggcactgtgtacaagggtatctgggtccctgaagggtag

SEQ ID NO: 31398 - DNA, 3927 bp, Artificial Sequence
  Description of Artificial Sequence: Synthetic coding sequence
atgaagcctgctactggtctctgggtgtgggtctccctgctcgtcgcagccggaactgttcagccgtcagattctcagtcagtatgtgcaggtaccgagaacaaactctccagcctgtcagacctcgagcagcagtacagggctctgcggaaatattacgaaaattgcgaagtggtaatgggcaatcttgagatcacctctatcgagcataaccgcgatctgtccttcttgcgctctgtgcgggaggttaccggctacgtgctcgtggccttaaatcagtttagatacctgcccttggagaacttacggattatccgcggtaccaaactctacgaagaccgttacgccctggccatcttcttgaactacaggaaggacggaaatttcgggctccaggagttaggcctgaagaatctgacagagattctgaatgggggagtgtatgtggatcagaacaagtttctctgttatgctgacacaatccactggcaggacatcgttcgtaacccatggccctctaacctcacgcttgttagtactaatggaagctccggctgcggtaggtgccataaatcatgtacaggacggtgttgggggcctactgaaaatcattgtcagaccctgacccggaccgtatgtgcagaacaatgtgatggccgatgctacggaccatacgtgtcagactgctgccatagagagtgtgcaggaggctgttccggcccaaaggatacagactgtttcgcctgtatgaatttcaacgactccggggcttgcgtgacacagtgcccacaaacttttgtctataatcccactaccttccagctggagcacaatttcaacgctaaatatacttacggggcattttgcgtgaaaaaatgcccgcataacttcgtggtcgatagcagctcttgtgtccgggcttgtccgagcagtaagatggaggttgaagaaaacgggattaaaatgtgcaaaccctgtactgatatctgtccgaaggcatgcgatggcattggcaccgggtcactgatgagcgcacagacggtggacagctcaaacatcgataaatttatcaactgcacaaaaattaatgggaacttgatttttctggtgaccgggatacatggggacccctataacgccattgaagctatcgatccagaaaaacttaatgtgtttagaacagttcgcgagatcaccgggttcttgaacattcagtcttggcccccaaacatgaccgacttttcagtgttttctaatcttgttaccataggcggacgcgtgctctactctggcctgagcctactgatcctgaaacaacagggcataacatcattacaatttcagtcactgaaagagattagcgctgggaacatttacatcacggacaactctaacttgtgctattatcataccataaactggacaacccttttctccaccattaaccagaggatagtgatccgcgataataggaaagccgaaaattgcactgccgagggtatggtctgcaaccacttgtgtagtagcgacggatgctgggggccaggtccagaccagtgtctctcttgccgaaggttctccagaggcaggatctgcatcgagtcttgcaatctctacgacggtgagtttagggaattcgaaaacggatctatttgtgtggaatgtgatccacaatgcgagaaaatggaggacgggttgcttacttgtcatggccctgggcctgataattgcacaaaatgttcccattttaaggatggacctaattgtgtggaaaaatgccccgatgggttacagggggctaatagtttcatcttcaaatacgccgatccagaccgcgagtgtcatccgtgtcatcccaactgtacccaaggatgtaatggccctaccagtcacgattgtatatattatccttggacaggacattccactctaccgcagcacgctcgaactcccctcatcgctgctggtgtgattggtggcctgttcatcctggtgattgtcggtctgacttttgcagtctatgttcgccgaaagtccattaagaaaaaaagagcactgaggcggtttctggaaactgaattggtggaaccgctcaccccctccgggactgccccaaatcaggcccagctgcgcatccttaaggaaaccgagctgaagcgagtgaaggtcctgggctccggagcgtttggtacagtgtataaaggcatctgggtgccggagggcgagactgtcaaaatcccagtggcaatcaaaattctcaatgagacgacaggtcccaaggcgaacgtggaatttatggatgaagcacttatcatggcttcaatggaccacccacatctggtgagactactgggcgtctgtctgtcccctaccatccaactcgtcacacaactcatgcctcatggctgtctgctggagtacgtccacgaacacaaggacaacattgggagccagttacttctaaattggtgcgttcaaatcgctaagggtatgatgtacctggaagagagaaggctcgtacacagagacctcgccgcacgcaatgtcctagtgaaaagccctaaccacgtgaagattactgactttggtctggccagactactggagggagatgaaaaagagtacaatgccgatggcggaaagatgcctattaagtggatggcactcgaatgcatccactatcgcaaattcacacatcagagtgatgtgtggagctacggagtcacaatttgggaactcatgactttcggcggaaagccttacgatggtataccaactagagaaattccagacttgctagagaaaggcgaaaggctgcctcagccccctatctgtactatagacgtttatatggtgatggtgaagtgttggatgattgatgctgattcccgcccaaaattcaaagaattagccgctgagttcagccgcatggccagagaccctcagagatacctggtaattcagggcgatgataggatgaagctgcctagccccaacgatagtaagttttttcagaatcttctggacgaggaggacttggaggacatgatggatgctgaggagtatttggtcccacaagctttcaatattccccctccaatctacacatcaagggccaggattgacagcaatcgatctgaaattggacactctccccctcccgcttacactccaatgagcggcaatcagttcgtatacagagatgggggattcgccgcagagcaaggcgtgtcagtcccctaccgagccccaacctccacaattcctgaagcacctgtggcacaaggcgcaacggcggagatcttcgatgatagttgctgtaatggtacattgcgtaaacctgtggctccccatgtgcaggaagactcttccacacagcgctattctgccgaccccactgtgtttgcacccgaacggagcccaagaggagagcttgacgaggagggatacatgactcccatgcgcgacaagcccaagcaggagtacctgaatcctgtcgaagaaaatccgttcgtgtctcgtaggaagaacggggacttgcaggcacttgataaccctgaatatcacaacgctagtaatggcccacctaaggctgaagacgaatacgtgaatgagcccctgtacctgaatacattcgctaataccttgggcaaagcagaataccttaagaacaacatcctctcaatgccagagaaagccaaaaaagcctttgataatcccgactactggaatcactctctgccgccacggtcaaccttgcagcatccagattatctccaggagtattccacaaaatacttttacaagcagaacggtcgtatcaggccgatcgttgccgagaacccagaatacctgtccgagtttagtctcaaaccaggtacagttcttcccccacccccttaccggcatcgtaatacggtggtctag

SEQ ID NO: 31399 - DNA, 3897 bp, Artificial Sequence
  Description of Artificial Sequence: Synthetic coding sequence
atgaagcctgctaccggcctgtgggtttgggtgtccttactggttgctgctggaacggtgcagccatcagattcccagagcgtctgcgcaggcacggagaataagcttagcagtctctccgatctggagcagcagtatcgggcactgcgcaaatactacgaaaactgtgaggtggtgatggggaacctcgaaataacatcaattgaacacaatcgggacttgtctttcctacggagcgtcagagaggtgactggctatgtgctggtagcactgaatcagttccgctatctgccattagaaaatctgcggattatcagggggaccaaactctacgaggaccgctatgcactggctattttcctgaattatcggaaggatggtaactttgggctgcaggagctcggactgaagaatctaacagagattctgaatggcggagtctatgtggaccaaaacaagttcttgtgctacgccgataccatccattggcaggacatcgtgaggaacccttggccaagcaaccttacactcgtgtcgacgaatgggtcttcaggctgcggtcgctgtcacaagagctgcactggacggtgctgggggcctaccgagaatcactgccagacactcacgaggacagtttgtgccgagcagtgcgacgggaggtgttatggaccatatgtctctgactgttgtcaccgtgaatgtgccggaggctgttcaggtcccaaagacacagactgctttgcctgtatgaatttcaacgattccggggcatgcgtgacccaatgcccacagacgtttgtgtacaatcccacgacattccagttggagcacaacttcaatgccaaatatacctacggcgcattctgcgttaagaagtgcccacataatttcgtggtggactccagctcctgcgttagggcgtgcccttccagtaagatggaagtggaggaaaatgggatcaagatgtgcaagccgtgtacagatatctgtcctaaggcatgcgatggcatcggtacgggttctctgatgtccgctcagaccgtcgacagttctaacatcgacaagtttattaactgcactaagatcaatggcaatcttatattcttagtgactggcatccacggggacccatacaatgcaattgaggctattgatcccgagaagttgaacgtattccgcactgttcgagaaattacaggcttccttaacattcaatcatggccccctaacatgaccgacttctccgtgttctctaatcttgtgacaatcggcggtcgggtcctatattcgggcctgtctctgttaatcttgaaacaacagggcatcacatctcttcagtttcagtctttaaaggagatcagcgcaggcaatatttatattaccgacaactcaaatttatgctattatcataccatcaattggactactctattttctaccattaaccagcggattgtgatccgtgataataggaaggccgagaattgcacagccgaaggcatggtctgtaatcatttgtgctcgtcagatggctgttggggacctgggcctgaccagtgtctgtcgtgccgaaggtttagtcgcggaagaatctgcattgagtcatgcaatctgtacgatggagagttccgcgagtttgagaatggcagcatttgtgtggagtgtgatccccagtgtgaaaaaatggaggatggactgctcacttgtcatgggcctggccctgataattgcaccaaatgctcccacttcaaggatggcccaaactgtgtcgaaaaatgtcctgacgggttgcagggcgcaaactccttcatcttcaagtacgctgacccggaccgcgagtgccacccgtgccaccctaactgtacccagggatgtatcggctcttctatcgaggactgtatcgggttaatggatagaacacccctgattgcagccggagtgattggaggtttgtttatccttgtcatcgtggggctgaccttcgccgtctatgtccgcaggaaaagtatcaagaagaaacgagccctgcgaagatttctggaaactgaactagtcgagcccctgacaccatcaggtaccgcccctaatcaggcgcaactccgaatcttgaaagaaacagaactgaagcgcgtgaaagtactgggtagcggagcatttggtactgtgtataagggaatatgggtgcccgagggggaaaccgtgaagattcctgtagcaataaagatccttaacgagaccactggaccgaaggccaacgtcgaattcatggacgaggccctcatcatggcctccatggaccacccacatctggtgcggcttctcggcgtctgtctctcaccgaccattcagctcgtcacgcagctgatgccacatggatgccttttagaatacgtgcatgagcacaaagacaatatcgggtcccagttgctgctgaactggtgcgtccagattgccaaaggaatgatgtatctagaagagaggagattggtccatcgagaccttgcagcacggaacgtcctggtcaagtccccaaaccacgttaaaataacagattttgggctggcacggcttctcgagggcgatgagaaggagtacaacgcagatggaggtaaaatgcctatcaagtggatggcgttggagtgcatacattacagaaaattcactcatcagtcagatgtatggagttacggcgtgaccatctgggaactgatgaccttcggcggtaagccctacgacgggataccaacaagagaaatacccgacctgctggaaaagggcgagagactccctcagccccctatctgcaccatcgacgtctacatggtgatggtgaaatgttggatgatcgacgccgactcacgaccaaagtttaaagagctcgccgctgaattttcgaggatggccagagacccacaaaggtacctggtcattcaaggtgacgatcgcatgaaactgccatcccctaatgactctaaattcttccaaaatctgcttgacgaggaagacctggaggacatgatggacgcagaagaatatctcgtcccccaggcattcaacattccgccacccatctataccagccgcgcaagaatcgattccaacaggagcgagatcggccacagccccccaccagcctatactcctatgtcgggcaaccaattcgtgtacagagacggaggctttgctgctgaacagggggtcagtgtgccgtaccgagcacccaccagcaccattcctgaggccccagtggctcagggcgcaacagccgaaatattcgatgattcttgttgtaacggaaccctccgtaagcctgtcgcgccacatgtgcaagaggactcttctacccagcggtattctgcagatcccactgtgttcgccccagagagaagtcctagaggcgagctggacgaagaaggatatatgacccccatgcgcgacaagcccaaacaagagtacctgaatcccgtcgaagaaaatcctttcgtatcccggagaaagaatggagatctgcaggccctcgacaacccagagtaccacaacgcatccaacgggcctcccaaggccgaagacgaatatgttaacgagcctttatatctgaatacgttcgctaacacactgggcaaagccgaatatttaaagaataacatattaagcatgcccgagaaagccaaaaaagcatttgacaatcctgactattggaaccatagcctcccccctagaagcacgctccagcatcccgactacctgcaggagtatagtactaagtacttctataaacagaatgggaggattcgacccatagtggcggagaacccagagtacctgtctgaatttagccttaagcccggtactgttttgcccccacccccatacaggcataggaacactgtggtctag

SEQ ID NO: 31400 - DNA, 387 bp, Artificial Sequence
  Description of Artificial Sequence: Synthetic coding sequence
atggggaacctagaaataacaagcattgaacataatcgggacttatccttcctgcggagcgtgagagaggtcactgggtatgttctcgtggctctcaaccagtttcggtatcttccactggagaacttacggattattcgcggaacaaagctgtatgaggatcgttacgctctcgccatctttctaaattacagaaaggacggcaatttcggcctccaggaactgggtttgaaaaatttgactgagatcctcaacggaggtgtgtacgtcgaccagaataaatttttgtgctacgccgacaccatacactggcaggatattgtgcgcaacccctggccttccaatctgactcttgtgtctactaatggatcaagtggctgcggttag

SEQ ID NO: 31401 - DNA, 3878 bp, Artificial Sequence
  Description of Artificial Sequence: Synthetic coding sequence
atgaagcctgcaacgggattatgggtctgggtgagcttgctggtggccgcaggcacagttcaaccatctgacagccaatccgtatgtgctggcacagaaaataaactcagctcactttcagacctggagcaacagtatagagctctcagaaaatattatgagaactgtgaggtcgtcatgggtaacctcgaaattacgtctattgagcacaatcgtgatctaagtttcctcagaagcgttcgggaggttaccggttacgtgctggtcgccctcaaccagtttcgctacctgcctttggaaaacctccgcattatcaggggcactaagctgtacgaggatcgctacgcactggccattttcctcaactataggaaggacggcaatttcgggctgcaggagttagggctgaagaaccttactgaaatcttgaatggcggagtctatgtcgatcaaaataaattcctgtgctacgccgacaccattcactggcaggacattgtcaggaacccatggccatcaaacctcacactggtctcaactaacggatcctcaggctgtggacggtgccataagtcatgtacgggcagatgctggggccctaccgagaatcactgccagaccctaacgcggaccgtctgtgcggagcagtgtgatggaaggtgctacggcccttacgtctctgattgttgtcaccgggagtgtgctggtggctgctctggtccgaaggatacagactgctttgcttgtatgaattttaacgatagcggtgcctgcgttactcaatgcccacaaacgttcgtgtataaccctacaacatttcaactggagcacaattttaacgccaaatacacatacggagccttttgcgtaaaaaagtgtcctcacaattttgtggtagactctagttcctgcgtacgggcttgcccctcttcaaagatggaggtcgaagaaaatggtatcaagatgtgtaagccttgcaccgacatttgccctaaggcgtgtgatggcatcggtacagggagcctcatgtccgcgcagacggtggacagttctaacattgacaaatttattaattgtaccaagattaatggcaacctcatatttctggtgacaggaatccatggcgatccctataatgcaattgaagctatagatccagagaagctaaacgtgttcaggacagtgcgtgagataaccggattcttaaatattcaatcttggccccctaacatgacggacttttcagtatttagtaacctggtcacaatcggtggccgagtgctatacagcggcctgtctctgctgatcctgaaacagcagggaatcacatccctgcagtttcagtctcttaaggaaatctcggctggcaacatttacatcacagataactctaatctgtgctactaccacacaatcaactggaccaccctgtttagtactattaatcagaggatcgtgattcgagataatcgcaaagcagagaattgtactgcagagggtatggtctgtaaccatttatgcagctctgacggctgttggggcccaggtcccgatcaatgcctctcatgtaggcggtttagtcgcggtaggatctgcatcgagtcttgcaacctgtacgatggggagttccgggaattcgagaacggctctatctgtgtagaatgcgacccgcagtgcgaaaagatggaggacggcttgctgacctgccatggccctggccctgataactgcacgaaatgctcccattttaaggacgggccaaattgcgtcgagaagtgcccagacggactccagggagccaattcctttatctttaagtacgccgatccagaccgggagtgccatccttgtcacccaaactgcacgcaggggtgtaatggcccaacaagtcacgattgtatctattacccctggaccggtcatagcactctcccgcaacatgctaggaccccactgattgctgcgggagtgattgggggtctttttatcctcgtcatagttggactaacctttgcagtgtatgtaaggcgcaagtctatcaagaagaagcgagccttgcgcagatttttagaaactgaactcgtggagccactcaccccgagcggtaccgctcccaaccaggcccagctgcgcatcctgaaggagacggagctcaaacgggtgaaagtgctcgggtccggggcatttggcacggtgtataaaggcatttgggtgcccgaaggagagaccgtcaagatacccgtggcaatcaaaatactcaacgaaacaaccggaccaaaggccaacgttgaattcatggatgaagccctgataatggcatctatggatcatccccacttggtccgcctgctgggagtctgcctctcaccaaccattcagctggtaactcagttgatgccccatggttgtttgctggaatatgttcatgagcataaagacaatatcgggtcacagctgctcctaaactggtgcgtgcagatcgcgaagggcatgatgtacctggaagagaggcggttggtccatcgcgacctcgccgcacggaatgtgctcgtgaagtcccccaaccacgtcaagatcacagactttggcctcgccaggctcttggagggagatgagaaggagtacaacgccgacggtggtaaaatgcctatcaaatggatggctcttgaatgcattcactaccgcaagtttactcatcagagcgacgtgtggtcatacggagtgactatctgggaacttatgacattcggcggaaagccttacgatgggattccaaccagggagatccccgacctgctcgagaaaggcgaaaggctgccacagccgccaatctgtaccattgacgtgtatatggtgatggttaagtgctggatgatcgacgctgacagtcggcctaaatttaaagagcttgctgccgaattctccaggatggcgcgtgacccccagcggtatctcgttatccagggggatgaccgcatgaaacttccctctccgaatgatagcaagttttttcagaatctgctcgacgaagaggacttggaagacatgatggacgcagaggaatacctggttccacaggcctttaatatccctcccccaatttacacctccagggcaagaattgactctaatcgtaaccagttcgtgtaccgtgacggaggattcgctgcagagcagggcgtgagcgtgccttatcgcgctccgacaagcactattcctgaagccccagtggcccagggcgcaactgctgaaatcttcgatgattcctgctgtaatggcacactgcggaaacccgtcgcccctcacgtccaagaggactcttccacgcagagatactcagccgatccaactgtctttgccccagaacgcagccccaggggcgaactcgatgaggaaggatacatgacacccatgcgtgataaacccaaacaggaatacctgaacccagttgaggagaatccattcgtatccaggcggaaaaatggagatctccaggcactagataaccccgagtatcataatgcaagcaatggccctcccaaggccgaggacgagtacgtcaacgagcctttgtatctgaacacctttgctaataccttgggaaaagctgaatatttgaagaacaacatcctatcaatgccagaaaaagctaaaaaggccttcgacaatcctgattactggaatcactccctaccacccagaagcaccctacaacatccagactatctgcaggagtactctaccaagtacttctataaacagaatgggcgaatcaggcccattgtcgctgagaacccagagtatctgtcagagtttagcttgaaaccgggaactgttctaccccctcccccttacaggcacaggaacactgtggtcta

SEQ ID NO: 31402 - DNA, 4029 bp, Artificial Sequence
  Description of Artificial Sequence: Synthetic coding sequence
atgcgggctaacgatgctctccaggtgttgggcctcttgtttagtctggccagagggtctgaagtgggaaactcccaggccgtgtgccccggtacgcttaacgggttgagtgtcaccggtgacgccgagaaccagtaccagaccctatacaagctttatgagaggtgcgaggtcgtcatgggcaacttggagatcgtgctcactgggcataacgctgacctgagcttcctgcagtggattcgagaagtcactggttatgttctggtggccatgaacgagttctccaccctgccgctcccaaatctgcgggtggttagaggtactcaagtgtacgatgggaaattcgctattttcgttatgcttaactataacaccaacagtagccacgctcttcgtcagctcagactcacccagctcacagagatcctcagcggaggagtctacattgagaaaaacgataagctatgccacatggatacaatcgattggagagatatcgtgcgcgacagagacgccgaaatcgtggtgaaagacaatggcaggtcctgtccaccttgccatgaagtctgtaagggccgttgttggggtccaggatctgaggactgtcagacgctgaccaagacaatttgtgcaccacagtgtaatgggcattgcttcggaccaaacccaaaccagtgctgtcacgatgagtgcgcaggagggtgcagcggaccccaggatacggactgctttgcctgcagacattttaatgattcaggagcctgtgtgccacgttgtcctcagccattagtttacaacaaacttaccttccagctggagccaaacccccacaccaaataccagtacgggggtgtgtgcgttgctagctgccctcataactttgttgtagaccagacatcatgcgtgagagcttgtcctcctgacaagatggaggttgacaaaaatggattaaagatgtgtgagccttgtggtggtctctgtccaaaggcctgtgaaggaacagggtctggaagtcgctttcagaccgttgactctagcaatatcgacgggttcgtgaattgcacgaagatcctcggaaacctggactttcttataactgggctcaatggggatccttggcacaagatcccagccctagaccccgaaaaactgaatgtgtttagaacggttcgggagatcacaggctacctgaacattcaatcctggccacctcacatgcacaacttcagcgtgttttcaaacttgactaccatcggcggacgctcgttatataataggggattcagcctgctcattatgaagaatcttaacgtgacgagtctgggatttcgcagtctgaaggaaatatctgcaggtagaatttatatcagtgccaatcggcagctttgttaccatcattctctaaactggactaaggtcctgcgcggacccactgaggaacgacttgacattaaacacaatcgcccacgtcgcgattgcgtggcagaaggtaaggtgtgtgatccactgtgctctagcggaggctgctgggggccaggtcccggacagtgcctgagttgtcggaactatagtcgtggcggtgtgtgtgtgacccattgcaatttcctgaacggggagcctcgggagttcgcacatgaagctgagtgtttttcgtgtcaccctgaatgccagccgatggaggggacagctacctgtaacggttcaggcagcgacacatgcgctcagtgcgcccattttcgcgatggccctcactgtgtgtcctcatgtccccacggcgtgctgggggcaaagggcccaatttataagtacccagatgtgcagaacgaatgccgtccttgccacgaaaattgtacccaagggtgcaaaggacctgagcttcaggactgcctcggacagacactggtcttgattggaaagactcacttgacaatggccctcaccgtcatcgctggccttgttgtaattttcatgatgctgggaggaacctttctctattggcggggacgtcgaatccagaataaacgcgcaatgcggagatacctggaacgcggtgaatcaattgagcctttggaccctagcgaaaaagccaataaagtactggcaaggatttttaaggagaccgaactccggaagctgaaggtcctggggtccggcgtgttcggtacggtgcacaagggtgtttggattcctgaaggcgagtcgatcaaaatccccgtttgcataaaagtaattgaggataagtccggacggcaatcctttcaggccgtaacggaccacatgcttgccattggctcactagatcacgctcacatcgtacggttgctgggattgtgtccaggatcatccctccagttagtgacacagtatctgccactgggcagtttgctcgatcacgtgagacagcaccggggagccctggggcctcaactgctccttaactggggagtccagatagccaaaggtatgtactacttagaagaacatggaatggtgcaccgcaacttggcggctaggaacgtcctcctcaagagcccgagccaggtgcaggtggctgacttcggggtcgcagatctgctacctccggatgacaaacagcttctctactccgaggccaagactcccattaagtggatggcactggagtcaatccacttcggcaaatacacacatcagtctgacgtatggagttatggcgtgactgtttgggagctaatgactttcggagctgagccgtatgccggtctcaggctggctgaggtaccggatctgctggaaaagggagagcgtctcgcccagccgcaaatttgtactatcgatgtgtacatggtcatggtgaaatgttggatgatagatgaaaacatcaggccaacctttaaggaactggcaaatgagttcacccgtatggccagagatccgcctcgttatctggtgataaaacgtgagtctggaccaggtatagcgcctggtcctgaaccgcacggactgaccaataaaaaattagaggaggtcgagttagaaccggaattggaccttgatctcgacctggaggccgaggaagataatctcgctaccaccacacttggttcagcactatccctaccagtgggaacgctgaatcgcccacgaggtagccagtccctgctgtcccccagtagcggctatatgccgatgaatcaaggaaacctgggcgagagctgccaggagtcagccgtgagcggatcaagcgaaagatgcccaaggccagtgagtctgcaccctatgccacgcggatgtcttgcgagcgagagctcagagggccatgtgacaggatcagaagccgagttacaagaaaaggtcagtatgtgtcgcagtcggtccagatcccggagcccacggccacgcggtgattctgcctatcactctcagagacattcactgctaacaccagtgactcccctcagcccgcctggcctcgaggaagaggatgtgaatggctacgtgatgccggatacacaccttaaagggaccccgtcctctagggaaggaacactgtcgagcgttggtctcagctccgtgctgggtactgaagaggaggacgaagacgaggagtatgaatacatgaatcgtcgacgcaggcactcccccccacatccacccagaccttcgagcttagaagagctcggatatgaatacatggatgtgggttcagacctgagcgcctcgctggggtctacgcaaagttgccccctgcatcccgtcccgatcatgccaactgcaggcaccactcctgacgaagactatgaatacatgaatcgccaacgggacggagggggtccaggcggagactatgctgcgatgggcgcatgccctgcaagcgaacagggttacgaggagatgcgcgcatttcaaggaccgggtcaccaggccccacacgtgcattatgcaagattaaagaccctcaggagtctggaagcaacagactcggcatttgacaacccagactactggcattcgcgcctgttcccgaaggctaacgcccagcggacttag

SEQ ID NO: 31403 - DNA, 996 bp, Artificial Sequence
  Description of Artificial Sequence: Synthetic coding sequence
atgcgtgcaaacgatgcgctgcaggtattggggttactttttagcttagctaggggcagcgaagtgggcaattcccaggcagtctgtcctggcactctcaatggtctgtcagttactggcgatgccgagaaccaataccaaacactatacaagctatacgagagatgcgaagtcgtgatgggaaatctggagatcgtcctcaccggacataacgcggacctcagctttttgcagtggatcagagaagtaaccggttatgtcctggtggctatgaatgagttttctacattacccctgcccaacctgcgggtggtacggggaactcaggtgtatgatgggaaatttgccatctttgttatgcttaactacaacaccaacagtagccacgcactgcgccagctgcgcctgacacagctgactgaaattctctcggggggagtgtatattgagaaaaatgacaagctttgtcacatggacactattgactggcgggacatagtaagagatagagacgccgaaatcgttgtgaaggacaatggccgttcctgtcccccatgccatgaagtgtgtaaggggaggtgttggggccctggctccgaggattgtcagacactgaccaaaacaatatgtgcccctcagtgtaacggtcactgctttggcccaaatccgaaccagtgttgccatgatgaatgcgcaggcggatgctccggccctcaagacaccgattgcttcgcttgcaggcacttcaacgattcgggggcatgcgttcctcgctgcccacaaccccttgtgtataataagctaacttttcaactcgagcccaacccccatacaaaatatcagtatggtggagtgtgtgtggcctcttgcccacataactttgtagttgaccagaccagttgtgtaagggcctgcccgcctgacaaaatggaagttgacaaaaacgggctaaaaatgtgcgagccctgtggtggcctgtgcccaaaagttttctag

SEQ ID NO: 31404 - DNA, 552 bp, Artificial Sequence
  Description of Artificial Sequence: Synthetic coding sequence
atgagagcaaatgatgccctgcaggtcttgggattgttattcagcctggccagggggagcgaggtcggaaatagccaggctgtatgtcctggaaccctgaacggtctttccgttaccggagacgccgaaaatcagtaccaaactctgtacaaactgtatgaaagatgcgaggtagtcatgggcaacctcgagattgtgctaactggccacaacgcggatctatcgtttctccagtggattagggaggtcactggctatgttcttgtggccatgaacgagttctcaacacttcccctgcccaacctccgcgtcgtcaggggcacccaggtctatgacggcaaattcgcgatcttcgtcatgctcaattataacaccaactcctcccacgccttgcgccagctccgccttacacagttgacgggacagttcccaatggtgcctagtggtctgacacctcagcctgcacaagactggtatctgcttgacgacgacccccgtctgctgacacttagtgccagcagcaaggtgccagtaactcttgctgcagtttag

SEQ ID NO: 31405 - DNA, 3852 bp, Artificial Sequence
  Description of Artificial Sequence: Synthetic coding sequence
atgggaaaccttgaaattgttctcactgggcataatgcagatctttcattcttgcagtggatcagggaggtgacggggtacgtgctggtggctatgaacgagtttagtaccctgccattgcccaacctgcgcgtcgtacggggtacccaggtgtatgacgggaagttcgccatctttgtgatgctgaactataacacaaactcctcgcacgctctacggcaactgcgtctgactcagctgactgaaatcctgagcggtggggtgtacattgagaagaatgacaaactgtgtcacatggacacaatcgattggcgcgacatagtgcgagaccgcgatgcagagattgtggtgaaggacaatggacgaagctgccctccatgtcacgaagtctgtaaagggaggtgctggggtcctggctctgaagattgtcaaactctcactaaaacaatttgtgccccacaatgcaatgggcactgttttggccctaaccctaatcagtgttgccatgatgagtgcgccggaggatgttcaggcccacaggacaccgattgtttcgcatgcaggcactttaatgactccggcgcttgcgtcccaaggtgtcctcaaccgctggtctacaacaaactgaccttccagctggaaccaaatccacatacaaagtatcagtacggtggtgtctgcgtggcctcctgcccccacaattttgtcgtggaccaaacctcatgtgttagagcctgtcccccagacaaaatggaagtggacaaaaacgggctgaagatgtgcgaaccttgtggaggcttgtgtcctaaggcctgcgaaggcacaggaagtgggtcacggtttcagactgtggactccagtaacatcgacggattcgttaactgtactaagattctgggcaacctggattttctgatcaccggactgaacggcgacccctggcacaaaatcccagcgctggacccggagaagctgaacgtgttcaggacggtccgcgagatcactgggtatctaaacattcaatcctggcctccgcacatgcataactttagcgttttttcaaacttgactaccataggtggccgtagcttgtataatagggggttcagtctactgattatgaaaaaccttaatgttacgagccttggcttccggagcctgaaggagatcagcgctggcagaatctatatctcagcaaatcgacagctgtgttaccaccactccctcaattggaccaaggttctcaggggacccacggaggaacgcctagacatcaaacataacaggcctcgccgagattgtgtcgctgagggcaaggtctgcgaccccctgtgctctagcggcggatgctggggcccaggaccagggcagtgtctctcatgcagaaactactcccggggtggtgtctgtgtcacgcattgcaatttcctgaacggcgaacccagagaattcgcccacgaagcagagtgcttcagttgccacccagagtgccagccaatggaggggactgcaacttgtaacgggagcggcagtgacacatgcgcacaatgtgcacacttccgcgatggaccacactgtgtctccagctgtcctcatggcgttcttggcgctaaaggtccaatatataaatatccagacgtacagaacgaatgccggccatgccacgagaattgtactcagggctgcaaaggaccggagctccaggactgtctaggtcagacccttgtattgatcggtaagacacacctcacaatggcgttgaccgtgattgcgggtctagtggttattttcatgatgttagggggtactttcctctactggagagggaggcgaatccagaataaaagagcaatgagaaggtatcttgaacgcggtgagtccattgaaccactcgacccctctgaaaaggcaaacaaggtattggcccgaattttcaaggaaactgagctaaggaagctgaaagttctggggtctggtgtttttggcacagttcacaaaggtgtgtggatacccgaaggggaaagtattaagatcccggtgtgtatcaaggttattgaggacaaaagcggcaggcagtctttccaggcagtgacagatcacatgcttgcaattggcagcctagaccacgctcacattgtgagattactgggcttatgcccaggatcttcactgcagcttgttactcagtatctgccactgggaagcctattggatcacgtaagacaacatagaggggctttggggcctcagctcctactgaactggggtgtgcagatagcgaaggggatgtactacttagaggaacacggaatggtccataggaatctggccgctaggaacgtgctgctgaagtcacctagccaagttcaggtggccgacttcggcgtagccgacctgctaccaccagacgacaaacagttgttatactccgaggccaagacccccattaagtggatggccttggagagcatacacttcggcaagtacacccatcagagcgatgtttggtcgtatggtgtgacagtgtgggagctgatgacttttggcgctgagccatatgcaggattaaggcttgcagaagtgccagatctgttagaaaaaggcgaacggctggcgcagccccagatttgtaccattgacgtgtacatggtaatggtgaagtgctggatgatcgacgaaaacatccgccctacatttaaggagctggccaatgaattcactcgcatggccagagaccctccgagatatctagttattaaaagagagtccggtcccggtatcgcccctggccctgaaccccatggattaaccaataagaaactggaggaggtggagcttgaaccagaactcgacttagacctggatctcgaggcggaggaggacaatcttgcaactaccacactgggtagcgctttgtcgctgccagtcggaaccctcaaccgaccaagggggtcccaatcacttttaagccccagctctggctacatgcccatgaatcaaggaaacctgggcgaaagctgtcaggagtcggccgtgtcaggctctagcgagaggtgcccaagacccgttagcttacacccgatgcctcgcggttgccttgcaagcgagtcaagtgagggacatgtgacagggtctgaagccgaattacaggaaaaggtatccatgtgtcgctcccggtcccggtctagatcccccagacctagaggcgactctgcataccactcccaacggcatagcttactcactccagtcactcccctgagccctcccggtctagaggaagaagatgtaaatgggtatgtgatgccagatactcacctgaaaggcacgccctcgtctcgcgagggtacactctcatccgttggcctatcctcggtgctgggaacagaagaagaggatgaggacgaggaatacgaatatatgaacagaagacgcagacatagtccgccacacccacctagaccctctagtctggaggagttggggtatgaatacatggacgtgggatcagacttgagcgcatctctggggtcaacccagagctgtcctctccatccggtccccattatgccaaccgccggaacaactcctgatgaggattacgagtatatgaaccggcaacgggatggagggggaccagggggtgactatgctgctatgggcgcttgtccggctagtgaacagggctacgaggagatgcgcgcttttcagggacccggacaccaggctccacacgtgcattatgccaggctgaagacactgaggagtctggaagccacagacagcgcttttgacaaccccgattattggcacagcagactgtttcctaaagccaacgcgcaacggacctag

SEQ ID NO: 31406 - DNA, 2100 bp, Artificial Sequence
  Description of Artificial Sequence: Synthetic coding sequence
atggcactgaccgtgatcgctggcctcgtggttatttttatgatgctgggtggcaccttcctctattggcggggtagacggatccagaacaaacgtgcaatgcgcaggtacctggaaagaggtgagagcattgaacctttggacccatcggagaaggcgaataaagtgttagccagaatctttaaggagactgagctcagaaaacttaaggtgttgggatccggagtattcggaactgtccataagggcgtatggatacctgagggagaatcgattaagatcccggtgtgcataaaagtgatagaggacaagagtggacggcagagctttcaggcagttacagaccacatgctggcaattggaagcctggaccacgcccatatcgtgaggctgttgggactttgcccagggagctcgctgcagttggttacccagtacctcccactcggatcattgttagaccacgtgaggcaacatagaggggctttgggaccgcaattgctgttaaactggggcgttcagatagcaaaggggatgtactacttagaggagcacgggatggttcacagaaaccttgctgcccgaaacgtgttgctcaaatcaccgtcccaagtgcaagtggctgactttggcgtagccgacctgctgcccccagatgataagcaacttctatatagtgaggccaagacccccattaaatggatggcgctggagtcaatacacttcggcaagtatacccaccaaagtgacgtctggtcctatggtgttacggtctgggaactgatgacatttggcgcagaaccctatgcagggcttaggttggcagaggtcccagacctgctggagaagggcgagagactcgctcagcctcagatttgcacaatagacgtttatatggtcatggtgaagtgttggatgattgacgaaaatataagaccaacttttaaagaactggcaaatgaattcacaagaatggctcgcgaccctccacggtacctggtaatcaaacgagagagcgggccaggcatcgcccctggtccggaaccacatggcctgaccaacaagaagctggaagaagttgagctcgagcctgagttagacttggacctggacctggaggcagaagaggataatctggctacgaccaccctgggttccgctctttcccttccagtcgggaccttaaaccggcctagaggctcgcagagcctgctgtctccttcatccggctacatgcccatgaaccagggcaacctgggggaatcgtgtcaggagtctgcggttagcgggtccagtgagcgctgtccaaggccagtatctctccatccaatgcctcgagggtgtctcgctagcgaaagcagcgagggtcacgtgaccggaagcgaagccgagctgcaagagaaggtctctatgtgcagatccagaagcagatccagatcccctaggcccaggggcgattcggcttaccactcccagaggcattctctgctgacgcccgttacccccctttctccacctgggctcgaagaagaagatgtaaacgggtacgtcatgccagatactcaccttaaggggaccccctcgtccagagaagggaccctgagcagtgttgggctaagcagcgttttagggactgaagaggaagacgaagacgaggagtacgagtatatgaaccgacggcgacggcattccccccctcatcccccaagaccttcttccctggaggagctaggctatgaatatatggatgtggggagtgacttgagcgcctccctgggaagcacacagagttgccccctccacccagtacccattatgccaacggctggtactacgccagatgaagattatgaatacatgaacaggcagcgtgacggaggagggcctgggggagattatgctgccatgggcgcttgccccgcttccgagcagggctatgaggagatgagagcctttcaagggcctggccatcaggctccccacgtgcattacgccaggttaaagacacttcgctcacttgaggctacggactcagcttttgataatccggattattggcattctcgcctgttcccaaaggcaaacgctcaaaggacctag

SEQ ID NO: 31407 - DNA, 381 bp, Artificial Sequence
  Description of Artificial Sequence: Synthetic coding sequence
atgcgggctaatgacgctctgcaggtactgggcctgctgttctcattggcaagaggatcagaggtcggtaatagccaggctgtgtgccccggtaccctgaacggactgagcgttactggagacgctgagaatcaataccagactctgtacaagttatacgaaaggtgcgaggtcgtgatgggcaacctagagattgtcttgaccggccataacgccgatctgtcattccttcaatggattcgggaggtgacaggctatgtactcgttgccatgaatgaattctcaacgctcccattaccgaatctgagagtggtgcgaggaacccaggtgtatgacggcaaattcgccatcttcgtgatgcttaactacaataccaattag

SEQ ID NO: 31408 - DNA, 2766 bp, Artificial Sequence
  Description of Artificial Sequence: Synthetic coding sequence
atgcgggcaaacgacgcccttcaggtgctaggactgctgttctccctggccagagggtctgaggtcggcaattcccaagccgtttgcccaggtaccttaaacggacttagcgtcaccggggatgctgaaaaccagtatcagacattatataagttgtacgagcggtgcgaagttgttatgggaaaccttgaaatcgtgttgaccggccataatgccgacctctccttcttgcaatggattagggaggtgactggttacgtgctggtagccatgaatgagttcagcactctacccctccccaatttgagagttgtgcggggaacgcaggtgtacgatggtaagttcgccatcttcgtgatgctcaattataatacaaactccagtcatgctttgcgacagctgcgcctgacacaactcacagagatactgagtggtggcgtttacatcgagaaaaatgataagctctgtcacatggacacaatcgattggagggacatagtcagggacagggatgctgagattgttgttaaggataatggacgcagctgccctccttgtcatgaagtctgtaagggtcggtgttgggggccaggaagcgaggactgtcagactttgactaaaaccatttgtgcccctcagtgcaacggacactgctttgggcctaatcctaatcagtgctgccacgatgagtgtgccggagggtgttcaggcccacaagatacagactgcttcgcttgtcgacattttaacgactcaggagcgtgtgtgccccgatgcccacagcccctggtctacaataagctcacattccagctagaaccaaatcctcatacaaaatatcaatacggcggagtgtgcgtagcaagctgcccacataactttgtggtggaccagacatcttgtgttcgggcatgtccacccgataagatggaagtggacaaaaatggactgaaaatgtgcgaaccctgcggaggcctctgtcccaaagcgtgcgagggcacaggatctgggagccggtttcaaacagttgactcctccaacatcgacggctttgttaattgcactaagatattaggcaatctggactttcttatcactggtctcaacggcgacccttggcataagattccagcactggaccctgagaaactcaacgtgtttcggacagtcagggaaattaccggttacctcaatatccagtcttggcctcctcacatgcacaacttctctgtgttcagtaacctgaccacaattggcggacggagcctgtataatagggggttctcactcctgatcatgaaaaacctaaatgtcacatctctcggattcaggtccctgaaagaaattagcgccggaagaatttatataagcgcgaaccggcagctgtgttaccatcatagtctgaattggactaaagtgctaagaggccctaccgaagagcggctagacattaaacataatagacctagacgggattgcgtagcggaggggaaggtgtgcgacccattatgcagcagcggcggatgttggggacccggtcctggacagtgtctttcatgtcggaactattccagagggggtgtgtgtgtgacacattgcaattttttgaacggcgaacctcgagagtttgcacacgaagccgagtgtttttcctgccaccctgagtgccagccaatggaaggtaccgccacatgcaacgggagcggaagtgacacatgcgctcagtgcgcccactttcgtgacggtcctcactgcgttagcagctgcccccatggcgtgctgggcgctaaagggccaatatacaaataccccgacgtgcagaatgagtgtaggccatgccatgagaactgtacccaaggatgcaagggccctgagctgcaggattgcttgggccagaccctagttctgatcggcaagacacatctgacgatggctctcacggttatcgcgggactcgttgtcatcttcatgatgttaggaggcaccttcttatattggaggggtcggagaatccagaacaaacgtgcaatgcgtcggtacctggaacgtggggagtcaatagaacctctggatcccagtgagaaagctaataaggtgctagccaggatattcaaagagactgagttacgaaaactcaaagtcctcggtagcggggtatttggaacagttcataagggggtgtggatccccgagggagagtcaataaagatacccgtgtgtataaaagtcattgaagacaagtccggaaggcagtcatttcaagccgtgaccgaccacatgttagccattgggagtcttgaccacgcgcatatcgtgcgcttactcggtctttgccccggtagcagtcttcagttggtcacacagtatctgcctctcgggtctttgctggatcatgtgcggcagcatagaggcgctctgggacctcagcttctactgaattggggggtgcagatcgcgaagggaatgtattacctggaggagcacggcatggtccaccggaaccttgcagccaggaatgtgctgctcaagagtccttctcaggttcaggttgccgatttcggcgttgccgatttgcttccccctgatgataagcaactcctctactccgaggcaaagacgcccatcaaatggatggcccttgaatcaattcactttggtaagtatacgcaccaatccgatgtctggtcctacggtcaatgtatatggatgccatcgttacctagtcttgccccagtatcaaacctgccatttgagactccttcgtag

SEQ ID NO: 31409 - DNA, 10191 bp, Artificial Sequence
  Description of Artificial Sequence: Synthetic coding sequence
atgttcattaatatcaagagcatcttgtggatgtgctccacactgatagtgacccatgcactgcataaagtgaaggtcggaaagtccccaccggtgagaggctcgttgtccggtaaagtgtcattgccctgccatttctcaacaatgccaaccctgccaccatcatacaatacctccgagttcctccgcattaagtggagtaaaatcgaggtggataagaacggcaaagatttgaaggagacaaccgtcctcgtggcgcagaacggtaatattaaaattggtcaggattacaagggtcgtgtcagcgtgcccactcaccctgaagcggtgggagacgcgtcactaaccgtggtgaaactgctggctagcgacgcaggtctttatagatgcgatgtgatgtacggtatagaggatacccaggacacggttagcttgactgtggatggagtcgtctttcactacagagcagcgacaagcaggtacacgctcaactttgaggcagcacagaaggcctgcctagacgtcggtgctgtcatcgcaaccccggagcagctctttgcggcatacgaggacggattcgaacagtgcgatgccggttggctcgccgatcagactgtgcgatatcccattagagcccctcgcgtcggctgttatggggataagatgggtaaagcaggcgtgcgcacatacggctttcggagcccccaggagacttacgatgtgtactgttacgtcgatcacctggatggcgatgtgttccatctgaccgtaccctccaagtttacttttgaagaggccgcaaaggagtgtgaaaatcaggatgctcgcctggccactgtgggggaactgcaggctgcctggagaaatgggttcgaccaatgcgactatgggtggctcagcgacgcctcagttaggcacccagtgactgtagccagggctcagtgcggcggaggcttactgggcgtgcgaaccctctatagattcgaaaaccagaccggctttccacccccagattcccggtttgacgcctactgtttcaaacccaaggaagcgacaactattgatctgagtatattggccgagactgctagcccgagcctaagcaaagaaccccaaatggtgagcgatcgaacaacacccatcattccacttgtcgatgagttgccagtcatccccacagaatttccaccagtgggaaacatcgtttcttttgagcaaaaagccactgtacagccacaggcaatcactgattccctggcaacgaaactgccaacacccaccggcagcactaaaaagccgtgggacatggatgactactcccccagtgcatctggcccactgggcaaactggacatcagcgaaattaaggaggaggtcctgcagtccacgacaggcgtttctcactacgccaccgactcatgggacggggtagtggaagataagcaaacccaggagagcgttacccaaattgagcagatagaggtgggcccactagtgacctccatggaaattcttaagcatattccatctaaggagttccctgtgacagagacccctctggttactgctcggatgatacttgagtctaagacagagaagaaaatggtgagcaccgtatctgaactggtgacaactggacactacggatttacactcggcgaggaagacgacgaggaccggaccctaaccgtcggctctgacgagagcacactgatcttcgatcagataccggaggtgatcacagtgagcaaaaccagcgaggacaccatccacacccaccttgaggatctcgagtctgtgagcgcatctactacagtctcaccactgatcatgcccgacaacaatggctctagcatggacgactgggaagaaaggcaaacatccggacggattactgaagaatttctgggtaagtacctttctaccaccccgtttccaagccagcatcggaccgagattgaattgttcccatacagtggagacaagattctcgtcgagggtatcagcacggtgatctacccctcgcttcagacggaaatgacacatcgtagagaacgcaccgagaccctcattcccgagatgcgaaccgatacctacaccgacgaaatacaggaagagattaccaagagccccttcatggggaagacggaagaagaggtattctccgggatgaagctttccacctctctgtctgagcctatccacgtcacggaatcatcagtcgagatgaccaaaagttttgattttccgacactcataacaaaattgagcgctgaaccaactgaagtcagggatatggaagaagatttcacggcgacaccaggaaccacgaaatatgacgagaacataacaaccgtgctgttagcgcacggaacccttagcgtggaggccgcaactgtgtccaaatggtcttgggacgaggacaatactactagcaaacctcttgagagcaccgagccctcggcctcgtccaagctgccgcctgctttgctgacaacagtgggaatgaacggtaaagataaggacatcccttcatttaccgaggacggggcagatgaatttactctgataccggatagtacacagaaacagctggaggaggtcactgatgaggacatagcagcccacgggaagtttaccatcagattccagcctaccacaagtacaggcattgcggaaaagtcaactttgcgagattctactaccgaggagaaggtgccccctattacaagcacagaggggcaggtgtacgccacaatggagggcagcgccctgggtgaagttgaagatgtggacctgagcaagcccgtaagtactgtcccccagtttgcacatacatcagaagtggaggggctggctttcgtgtcatactcgtctacccaagagcccaccacctatgtcgattcctctcatacgatcccactcagcgtgattcccaagaccgattggggggtgctagtgccctcagtgcccagcgaagacgaagtgcttggcgaacccagccaggacatactggttatcgatcagacaagactggaggccaccatcagccctgagaccatgaggacaaccaaaataaccgaaggtactacccaggaagagtttccgtggaaggagcaaacagccgagaagcctgtgccagccctgtcttctacagcttggacgccaaaggaagcggtcacacctcttgacgagcaggaaggggatggatctgcatacaccgtgagcgaggatgagttactgacaggttctgagagggtccctgtactcgagaccacccctgtgggcaagatagatcacagcgtaagttaccctccaggcgctgtaacagagcacaaagtaaagactgacgaagttgtcacattaacaccgcgaatcggccctaaggtgtctctgtcccccggaccagagcagaaatacgaaacggagggatcctcaaccaccgggtttacctccagcctgtccccttttagcacccacataactcagctgatggaggaaacaaccactgaaaagacgtctctggaggacattgacttgggctctgggctgtttgaaaagcccaaggccaccgaactgatagagttttccaccattaaagtgactgtgccatctgacatcactaccgcattctcttcagtggataggctgcatactacttccgcatttaagcccagttccgcaatcacaaaaaaaccgccactaatcgacagagagcctggcgaggagactacttccgacatggtgattattggtgagagcactagtcacgttcccccaactactttggaggatatagtggcaaaggagactgagacagacattgatcgggaatatttcacaacatcttccccccctgctacccagcccactcggccaccaactgtcgaagataaggaggctttcggccctcaggccctctcaacgcctcagccaccagcctccactaagtttcatccagatatcaacgtgtacattattgaagtcagagagaacaaaaccggtaggatgtctgatctgtctgttattggacacccaatcgattctgagtccaaagaggatgaaccttgcagcgaagaaactgaccccgtccatgatctgatggcagaaatcctgcccgaatttcccgacataatagagatagacctctaccactctgaggagaatgaggaggaagaagaggagtgcgcaaacgccacagacgtgaccaccacaccctccgttcagtacattaatggaaaacacttggtcacaacagtcccgaaagatcctgaagcagccgaggcaagacgcggtcaattcgaaagcgtggctccttctcagaacttcagtgactcatctgaaagcgacactcacccatttgtcatagcaaagaccgagctgtccaccgccgtacagccgaacgaatctaccgagaccaccgagtccctggaggtgacctggaagcccgagacctaccctgaaacctccgaacacttttcagggggtgaacccgatgtcttcccgacagtgcccttccacgaggagtttgagtcggggacagctaagaagggggctgagtcagtaaccgaacgtgacactgaggtgggacatcaggctcacgagcacaccgagcccgtaagcctttttcccgaggagagtagtggagaaatcgcaatagaccaggaatcccagaagattgcattcgctagagccactgaggtgacattcggtgaggaggtggaaaaatctactagtgtcacctatacacctacaatcgtgccctccagcgcgagcgcatacgtgagtgaggaagaagccgtaacactgatcggaaacccctggcccgacgacctgctctccactaaggagagttgggtggaggctacacccaggcaagtagtcgagctgagcggaagcagttccattcccatcaccgaggggtctggagaagctgaggaggacgaggataccatgtttacgatggtgaccgatctgtctcagaggaataccactgacaccctcatcacacttgacacctcaaggattatcacagagtcattcttcgaagtcccagccacgacaatctacccagtatccgagcagccatcagccaaagtggtcccaactaagtttgtgtccgagactgataccagcgagtggatctcatcaaccaccgtggaggaaaaaaaacgtaaggaggaagaaggaactactggtaccgcatccacttttgaggtctattccagtacacaaagatcggaccaattgatcttgccatttgagctggagagccccaatgtggcgacgtcatcagactccggcacccgcaagagtttcatgagcctgactactcctacgcagagcgagagggagatgactgattccacgcctgtgtttaccgagactaacacgctggagaatctgggagctcaaacgactgaacatagctccatacaccagcccggagttcaagaggggctcacgacattgcctcgctctccagcctctgtgtttatggaacaggggtctggtgaggctgctgctgatcctgaaaccactacagtctcatctttctccctcaacgttgagtacgccattcaagccgagaaagaggtggctggaactctgtcacctcatgtggagactacttttagtacagagcccactggcctggtcctcagcactgtcatggacagggtggtcgctgaaaatatcacacagacatcacgcgagatcgttattagtgaaaggctcggagagcccaattacggtgctgagatcagaggcttttccacggggtttccactagaagaagatttctccggtgatttcagagaatattccaccgtgtctcaccccattgccaaagaggaaaccgtcatgatggagggaagtggggacgcagcctttagggacacgcaaacatcaccatctaccgtccctacctccgtgcacatatctcacattagtgacagcgaaggaccaagcagcacaatggtctctacaagtgccttcccctgggaggaatttacgagttccgcagaggggtcaggcgagcagctcgtgacagtctcttcaagcgtagtgcccgtgttgcctagcgctgttcagaagttctctggtacagcatcaagcattatcgacgagggcctgggtgaggtgggaactgtaaatgagatcgatcgacgttctacaattctcccgacagcagaagtggagggtacaaaagcccctgtagaaaaagaggaggtcaaagtgagtggaacagtgagcaccaactttcctcagaccattgagccagctaaattgtggtctaggcaggaggtaaaccctgtgcggcaggagatcgagagtgagaccaccagcgaagaacaaatccaggaagaaaaatctttcgaaagcccacaaaacagcccagcgaccgagcagaccatcttcgatagccagacctttacagagaccgagttaaaaacaactgactattccgttctgacgacaaaaaaaacatatagtgacgacaaggaaatgaaagaggaggatacaagtctcgtgaatatgtctactcccgatcccgacgccaacgggttggagagttacactactctgcccgaggctacagaaaaatcccatttcttcttagccaccgcactcgtcacagaaagtattcctgctgagcacgtggtgaccgacagccccattaagaaagaggaatctactaaacacttccccaaggggatgcgccctaccatccaggagtcagataccgagctcctgtttagcggtctgggcagcggtgaggaagtgctgcccaccctacctactgaatctgtcaatttcacagaggtggaacagataaacaataccctgtaccctcatacctcccaggtcgaatcgacctcctcagataaaatcgaagactttaatcgtatggaaaatgtcgcaaaagaggttgggcctctcgttagccagaccgacatattcgagggctcaggctcagttacttcaacaactttgattgagatactttcggacaccggcgcagaaggccctaccgttgccccactgccattctcaaccgatattgggcatcctcagaaccaaaccgtacgctgggcagaagaaatccagacgtcgcgccctcagactataacagagcaagacagcaacaagaatagctcaacggcagagatcaacgagactaccaccagtagtacagattttctcgcaagggcctacggttttgagatggccaaagaatttgttactagtgcacccaaacctagcgacctctattacgaaccctctggcgaagggtccggtgaggtggacatcgtggacagcttccacacttccgctaccacccaggccacgcgccaagaatctagcactacattcgtgtctgacgggtcactggaaaagcacccagaggtaccatcagcaaaggccgtgaccgcagacggattccctacagtatccgttatgctcccacttcactccgaacagaacaagtcctcacccgaccctaccagcaccttgtccaatacagtgtcctacgagcgcagcactgatggatcctttcaagataggttccgggagtttgaggattctaccctgaagcctaatcgaaaaaaacccaccgagaacataattatagacctggacaaggaagacaaagatctgattctgacaattacggagtccactatcctggagattctccccgaactgaccagtgataaaaatactatcatcgatatagaccataccaagcctgtttacgaggacattctcggaatgcagacagacatcgacaccgaggtccccagtgaaccacacgattctaatgatgagtccaatgacgatagcacccaagtccaggaaatctatgaggcagctgtcaacctcagcctcacagaagagacctttgagggctctgctgatgtactggcaagttacacccaggccacacacgacgagtcaatgacctatgaggatagaagccaactggaccacatgggcttccacttcaccacagggattcctgccccatctacagaaaccgagttggacgttctgctgccaaccgcgactagcttgcctattcctagaaagtccgccaccgtcatccctgaaatcgaaggaattaaagccgaggccaaggcactcgatgatatgtttgaaagctcgactctctctgacgggcaggctatagccgaccaatctgagatcatccctaccttgggccagttcgagcggactcaggaggagtacgaggacaagaagcacgccggaccgtcttttcagcccgaatttagctccggcgctgaggaagctctggtcgatcacaccccttatctcagtatcgccactactcacctgatggatcagagcgtcaccgaggtgcccgacgtgatggaaggctctaaccccccttactacaccgacaccaccctagctgtctctacttttgccaagctttcgagccaaacgccttcctctcctctgactatctattcggggtctgaagcatctggtcacacagagattcctcagccttccgcactgcccggaatcgacgtgggatcgagtgttatgtcacctcaggacagtttcaaagagatccatgttaatatcgaagctacttttaagccatcctccgaggagtatctgcatattacagagcccccatcacttagccctgacacaaagctcgaaccaagcgaggatgacggaaagcctgagctgctcgaggaaatggaggccagtcccaccgaactcatcgccgtggaaggcacagaaatactgcaggatttccagaataaaacagacggccaggtttccggtgaggctataaagatgttccccacaatcaaaacgcccgaagcaggcacggtcattacgacagccgacgaaatcgaactagagggagcaacgcagtggccccactctacatcagcctccgccacctatggagtagaggccggagtggtgccatggctgagccctcagacctctgaacgccctactttatcttcatctcctgagattaatcctgagactcaggccgctctgattcgcggtcaggatagcacgattgctgccagcgagcaacaggtggccgcaaggattctggatagcaatgaccaggccacagtgaatccggtcgagttcaacacagaagtggctacacctccattctcacttctggaaacatctaatgaaacagactttctgatcggaattaacgaggaaagtgtggaagggactgctatttacctccctggccctgatagatgtaagatgaatccctgtctcaacgggggaacatgctatcccacagaaacctcctacgtgtgtacctgcgtgccgggatattcgggtgaccagtgtgagttggacttcgatgaatgtcactcgaacccctgtaggaatggtgccacatgtgtggatggctttaacaccttcaggtgcctttgcctgccttcctacgtaggggcactttgcgaacaggacaccgaaacgtgcgactacggatggcataagttccaaggccagtgctacaagtacttcgcgcaccgacgcacctgggacgcggcagaaagggaatgtcgactacagggggcacacttgacaagcatattgtcccatgaagagcaaatgttcgttaaccgtgtaggacacgactaccagtggatcggacttaacgacaaaatgttcgaacatgatttccgttggactgacggcagcactctccagtacgagaattggcgacctaaccagccggattccttcttctccgctggtgaggactgtgtcgtcataatttggcacgaaaacggtcaatggaacgatgtgccttgcaattaccacttgacctacacatgcaagaaagggacagttgcgtgcgggcagccccctgtggtggagaacgctaaaacctttggcaagatgaaacctagatacgaaataaacagcctcattcgctaccactgcaaggacggttttatccaacggcacttgccaaccattaggtgcctagggaacgggagatgggccatacccaaaattacatgcatgaatccttcagcctatcagcgaacctattctatgaagtatttcaagaattccagctcggccaaggataatagcattaacacatctaaacatgaccacaggtggtcccgccgatggcaagagtccaggcgctaa

SEQ ID NO: 31410 - DNA, 4928 bp, Artificial Sequence
  Description of Artificial Sequence: Synthetic coding sequence
atgtttataaacatcaaatctatcctgtggatgtgctcaacccttatagttacgcacgcactacataaagtgaaggtgggtaagtcaccccctgtgagggggagtctctcggggaaagtatccttgccttgccatttctctaccatgccaaccctcccacccagctacaacacgtccgaattcctgcggatcaaatggtccaagatcgaagtagataagaatgggaaagatttgaaggaaacaacagtcttggtggcccagaacggtaacattaagatcggccaggactacaagggacgtgtgtccgtgcctacacaccctgaggcggtgggcgacgcctctttgaccgttgttaagttgctggcctctgatgctggtctttatagatgtgacgtgatgtacgggatcgaagatacacaggataccgtaagcctcactgtagacggcgtggtgtttcactatagggctgctactagcaggtatactctgaacttcgaggccgcacaaaaagcatgcctcgatgtgggagccgtgatcgctactcccgagcaacttttcgccgcttacgaggacgggttcgagcagtgcgacgccggttggctggccgatcaaactgttcggtatccaattcgggctcctagagtgggttgctatggtgacaaaatgggaaaagccggagtgcgcacctacggattcaggagcccacaagaaacctatgacgtttattgttacgtggaccatttagatggcgatgtgtttcacctcaccgtcccctcaaaattcacgttcgaggaggctgccaaggaatgtgagaatcaggatgcccgactggccacagttggggaattgcaggcagcctggcgcaacggcttcgaccagtgcgattatggttggctgagtgatgcaagcgtgagacaccccgtgactgtggcccgtgcccagtgtgggggaggcctcctgggtgttcggactctataccgttttgagaaccagaccggttttcctccgccagattctcgctttgacgcgtattgttttaaaccaaaagaagccacaactattgatctgagcatactcgcggagacagcttcaccttccctcagtaaagagcctcaaatggtgtctgaccggactacccccatcattccactggttgatgaactgcccgtaattcctacagagttccccccagtgggaaacatcgtctcattcgagcagaaagccacggtgcagccccaggcaattaccgattcccttgcgactaagctaccaacgcctaccggatccactaagaagccatgggatatggatgactacagcccatctgcctcaggccctctgggaaagttagatatcagcgagataaaagaggaagtcctgcaaagcaccacaggagtgtcccactatgcaaccgactcttgggatggcgtcgtggaggataaacagacccaggagagtgtcactcagatagagcaaattgaggttggcccactggtcaccagcatggagatcctgaaacatatcccctccaaggaatttcctgttacggagacacctcttgtcaccgccagaatgatcctggaaagtaagacggaaaagaagatggtaagtacggtgtctgaactggtgacgaccggccattacgggtttacccttggagaggaggatgacgaggataggaccctgacagttggttccgacgaatccaccctgatctttgaccagattcccgaggtgatcactgtgtccaagacttccgaggacaccatccatacacaccttgaagatttagaaagtgtttccgcctcaaccactgtcagtcccctcattatgcccgacaacaacgggagctctatggacgattgggaagagcggcaaaccagtggcaggattacagaggagttcctgggtaaatacctgagcacaaccccattcccgagtcaacaccgcacagaaatcgaactcttcccctactccggcgacaagattttggttgagggcatctcaaccgtgatctatccttcgctccagaccgaaatgacacatcgccgtgaacggacagagactctgataccggagatgagaactgatacctacaccgacgaaattcaggaagaaatcacaaagagtcccttcatgggtaaaaccgaagaagaagtgtttagcgggatgaagctctctacttcgctgtctgagccaatccatgtgactgaaagctctgttgaaatgacaaagagttttgatttccccaccctgataaccaaactgtccgcggagccaaccgaggtgcgggatatggaagaagactttacagcaactccaggaacaacaaagtacgatgagaatattacaacagttttactggcacacggcacgttgtccgttgaggctgcgacggtttccaaatggtcatgggacgaagacaacaccacttccaagcccttggagtctacggaaccttccgcctcctcgaagcttcccccagccctactaacaacagtgggaatgaacggtaaggataaagacataccttctttcacagaagacggggcagatgagtttactctaatcccggacagcacgcagaagcagctggaagaggtcacagacgaggacattgccgctcacggcaagttcacaatccgatttcaaccaactacatccactggcatagcggaaaagagtacattgcgagacagtacaactgaggaaaaggtccccccaattacatccacggagggacaagtttacgccacaatggaaggatccgccttgggcgaggtggaagatgttgacctgtctaaacccgtgtccacagtcccccagttcgctcatacgagcgaagtcgaaggccttgcattcgtaagctactcgagtacacaggaacctacaacatatgtcgatagcagccacacgatccccttgagtgttattcctaaaacagactggggagtcctggttccgtcagtcccctctgaagacgaggtccttggcgaaccttcccaggacatcctcgtgatcgaccagacccggttggaagccacaataagccctgagacaatgagaacaactaaaataacagagggtacaacccaggaagagtttccttggaaggaacagaccgcagaaaaacctgtacccgctctgagttctacggcgtggactcctaaggaagcagtgacacctctcgacgagcaggaaggggacggtagcgcttacacggtcagcgaggatgaactgctgaccggatccgagagggttcccgtcctcgagacgacacccgtcggcaaaattgatcacagcgtctcttatccaccgggagcagtaactgaacacaaagtcaagacagacgaagttgtgactttgactccaagaattgggcctaaagtgagcctttcgccaggcccagaacaaaaatatgaaactgaaggctcctcaacaaccggctttacctccagcctttctccattctcgactcatattacccagcttatggaagaaaccaccacagagaaaacttctctggaagacatcgacttgggctccggcctctttgagaaacccaaagcaacagaactgattgaattcagcacgataaaggtcacagtacctagcgatataacaacagcattcagctctgtggataggctccacaccacctccgctttcaaaccttcctccgccattactaaaaaaccccctctaattgaccgtgagccgggagaagaaacaacatcagatatggtgatcattggtgaatctacctcgcacgtccccccaacgactctcgaggatattgttgcaaaagagaccgagactgatatagatcgcgagtatttcacaacaagcagtccacctgccactcagcccacgcggcctcccacggttgaggacaaggaggcgtttggaccacaggccctgtccacgcctcagcctccagcctcaacaaaattccaccctgacatcaacgtatacattattgaagtgcgagagaataagaccggcccagacagatgcaagatgaacccatgtctgaacggtggaacatgctacccgacggagacgagttacgtttgcacctgtgttccaggatactctggagaccagtgcgagctggacttcgacgagtgccattccaatccatgtcgcaatggagctacatgcgtagatggttttaatacttttaggtgcctttgcttgccctcatacgtgggcgcattgtgtgagcaggatacagagacctgtgattatggatggcacaagtttcaaggacagtgctataagtattttgctcataggcgaacgtgggacgctgctgagcgtgagtgccggctgcagggagcccacctgactagcatcctgagccacgaagagcagatgtttgtgaatcgagtagggcacgattatcagtggatcggcctgaatgacaagatgttcgaacacgacttcaggtggacagatggttctaccctccagtacgaaaactggcgtccaaaccagcccgacagcttctttagtgccggagaggactgtgtagtcatcatttggcacgagaacggacagtggaacgacgtcccatgtaactatcacctgacatatacatgtaaaaaggggactgtggcctgtggtcaaccccctgtggtggagaatgcaaaaacctttggcaagatgaagccaagatatgaaatcaattcactgatcagataccattgtaaggacggattcattcagcgtcatctacctaccattaggtgtctggggaacgggaggtgggccattccaaagattacatgcatgaacccctccgcttatcaacgtacctattctatgaaatattttaagaactcaagctcagccaaagataatagcattaacacctccaagcacgatcaccggtggagtcggagatggcaagaaagcagaaggta

SEQ ID NO: 31411 - DNA, 7229 bp, Artificial Sequence
  Description of Artificial Sequence: Synthetic coding sequence
atgttcataaacattaaatctattctgtggatgtgcagcacactaatcgtgacccatgctctgcacaaggttaaggtaggtaagtcccctcctgtccgcggatcactgagcgggaaggtgagcttaccctgtcatttttccaccatgccgacgttgcctcccagttacaacacgagcgaattcttgaggatcaaatggtctaagattgaggttgataaaaatgggaaagatcttaaggaaaccacagtgctcgttgcccagaacgggaacattaagataggccaagactacaagggaagagtcagcgtgccgacccaccccgaggcagtaggcgatgcctctctgactgtggtcaagttgctcgctagcgatgctggtctatacaggtgcgacgtcatgtacggcatcgaggacactcaggataccgtgtctctcacagttgacggagtggtattccactatagggcagctacctcacgctataccctgaactttgaggccgctcaaaaggcatgcctggacgtgggggcagttattgcaactcccgagcaactgtttgcggcttatgaggatggcttcgagcagtgcgatgccggttggcttgccgatcagaccgtaagatacccaatccgggcacctcgcgtcggttgttacggagataagatgggtaaggcaggggttagaacttatggtttcagatcccctcaggagacatatgatgtctactgttatgtcgaccatctggacggggatgtgttccacctcacagtcccttctaaattcacctttgaggaagctgccaaagagtgtgagaatcaggatgcgagactggctactgtgggagagttgcaggcggcttggagaaacgggttcgaccagtgcgactacggttggctctctgacgcctctgtgaggcatccggtgactgttgctcgggctcaatgcggcggagggctgttgggtgtccgaaccctctatagattcgagaatcagacaggattcccacctcctgattcaagatttgacgcttactgttttaagcgaaggatgtctgacctgtctgtgattggacaccctatagactcagagtcaaaggaagacgaaccctgcagcgaggaaactgacccagtccatgacctcatggctgagattctgcccgagtttcccgacatcatagaaattgatctctatcactctgaagaaaacgaagaagaggaggaggagtgcgctaacgcaacagacgtgaccacgacaccgagcgttcaatatattaatggcaaacaccttgtgaccaccgtgcccaaagatcctgaagcggcagaggcccgacggggacagttcgagagtgtggcaccaagccagaatttttctgattcctccgagtctgatacgcatccattcgttattgctaaaacagaactctctacagccgtccagcctaatgagagcacggagacgaccgaaagcctggaggtgacatggaagcccgaaacctaccctgagactagcgaacacttctctggcggagagccagacgtgttcccaactgtcccctttcacgaagagttcgagtctggaacagccaagaagggagccgaaagcgtgactgaacgggatacagaagtcggacaccaggcccacgaacatactgagccagtgagcctgttccccgaggagtctagcggggagatcgcaatagaccaggaatcacagaagattgcctttgccagggccacagaggttacgtttggcgaggaagtggagaaatctaccagcgtcacttacacgcccacaatcgtgccctcctccgcctcggcgtatgtttcagaggaagaggctgtgacactaatcgggaacccatggcccgacgacttactctccactaaggagtcgtgggtagaggctaccccgagacaggtcgtggagctttcggggtctagttctatccccataacggagggatcaggcgaggcagaagaagatgaggacacaatgtttaccatggtgaccgacctgtcccaacgcaataccacggatactctgatcacgctagacacttcacgcatcatcacggagtctttctttgaagtacccgctaccacgatttatcccgtgtccgaacagccctcagcgaaggtggtgcctaccaagtttgttagcgagaccgatacaagcgagtggatcagctctactactgtggaggaaaagaaacgaaaagaggaagaaggtacgacagggacagcctcaacctttgaggtctatagtagtactcagcgcagcgaccagttgatacttccatttgaactggagagtccaaatgtcgctacatccagtgattccggaacacggaagagcttcatgagtcttactactcctacacagtcagaacgcgaaatgacggattctactccggtgttcactgagacaaacacactggagaatctgggcgctcaaaccaccgagcacagctccattcaccaacctggggtccaggaaggcctgactacccttcctcgctcccccgcatcggtatttatggagcaggggagcggcgaagcagcagctgaccccgaaacaacaacagtgtcctccttctcccttaatgtcgagtatgccatccaagccgaaaaagaagtagccggtactctgagcccccatgtggaaaccacattttccactgaacccacgggcctagttctttccactgtaatggacagggtggtggctgagaacattacccaaaccagtcgtgaaatcgtgatttccgagcggctgggggagcccaattacggcgctgagatcaggggcttttcaaccggctttccactggaggaggacttttcaggtgacttcagggagtacagtaccgtatcgcaccccatagccaaggaggagacagtgatgatggaaggctcaggggatgccgctttccgggacacccaaacctccccttctacagtcccaaccagtgtccacatctcgcacatttcagattctgagggcccaagtagcaccatggttagtacatctgctttcccatgggaagaattcacttctagtgccgaaggtagcggggagcaactggtgactgtgagcagttccgtagtccccgtgctgccttctgccgtgcagaaattcagtggaactgctagctcgatcatagacgagggactgggcgaagtgggtacggttaacgaaatcgacaggcggtcaaccatactcccgaccgccgaagttgaaggcaccaaagcacccgtcgaaaaggaggaggtgaaggtcagcgggactgtgagcactaactttccgcagaccatcgaacccgctaagctctggtcgcggcaggaggttaacccagtgagacaagagatcgagtctgagacaacatccgaagagcagattcaggaagaaaagtcgttcgagtcacctcaaaactcacctgcaaccgagcagactatcttcgattcccagaccttcactgagactgagctgaaaacaacagattatagcgtgcttacgaccaaaaagacatattcagacgacaaagaaatgaaggaagaggatacaagcctggtgaacatgagtacacccgaccccgacgctaacggactggagtcatatacaactctgcccgaggcgactgaaaaatctcatttctttctggccactgccctggtcaccgaaagcattcctgctgaacacgtggtcaccgattctccaatcaagaaggaagaatcaactaagcacttccctaagggaatgagacccactatacaggaaagcgacacagaacttctgttttccggactgggaagcggcgaagaagtgcttcccactctacccaccgagagcgtcaacttcaccgaagtggagcagattaacaacacactgtacccacatacatctcaggtggagtctacaagttcagacaagatcgaagactttaatcgcatggaaaacgtggccaaagaggtgggacccctagtgagccaaactgatatctttgaaggttcaggctctgtgacgtcaactaccctgattgagatcctgtcggacactggcgctgagggccctactgtggcacccttaccgttttctactgatattggtcatccccaaaaccaaactgtccgctgggctgaagaaatacagacatccagacctcagactatcacagaacaggactcaaacaaaaattctagcaccgcagaaatcaatgaaactacaacctcctcgactgattttctcgccagggcctatggatttgaaatggccaaggaattcgtcacctctgcccctaagccctctgatttatattatgagcctagcggtgaggggtccggcgaggtggatatagtcgactcattccatacttctgccaccacccaagccacccgccaggaaagctctacaacttttgtgtctgacggaagcctggaaaagcatcccgaggtcccttccgctaaggcagttaccgccgacggctttcctactgttagcgtgatgctgcccctgcacagcgagcagaacaagagttctcctgaccctacgagcaccctttcgaatacggtctcctacgaacgctctactgacggttcctttcaggacaggtttagagagttcgaggactctaccttgaagcccaatcgtaagaagccaactgaaaacatcatcatcgacttagacaaggaggacaaggacctgatcctcaccatcacagagtccacaatcctcgagatcttacctgagctgaccagcgacaaaaataccattatcgatattgatcacacaaagcctgtctatgaggatatcctcggtatgcagaccgatattgacacagaagtgccctctgaaccccacgattcgaatgatgagtccaacgatgatagcacccaggtgcaggagatttacgaagccgcagtcaatttatccctgacggaggagaccttcgaggggtctgcagatgttctcgcttcttacacccaggctactcatgatgagtctatgacgtacgaagacagatctcagctggaccacatgggcttccactttaccaccggaattcctgcaccatccacagaaactgaactggatgtcctattaccaacagccacatccttacccatccccagaaaatctgctaccgtgatccccgaaatagaagggatcaaagccgaagccaaggctctggacgacatgttcgaatcctctacactgagtgatggtcaggctatcgccgaccagtcagagatcatccctactctggggcagttcgaacggacccaggaggaatacgaggataagaagcatgccggaccgtccttccagcccgaattttcatccggagccgaggaggctttggtagaccacaccccctatttgtcaatcgctacaactcacctgatggatcagtccgtgacagaggtgccagatgtcatggaggggtccaatcctccatactacactgacaccacgctggctgtcagtacgttcgctaaattgtccagccagacaccttcctctcctctgacgatctactcaggttctgaagccagtggccacacagaaataccacaaccgagtgccctgcccggtattgacgttggcagtagcgtgatgagcccccaggacagttttaaggaaattcatgttaatattgaggctacctttaagccgtcctccgaggagtatcttcacatcaccgaacctcccagtctcagtcccgatacaaaactggagccatctgaagatgatgggaagcccgaactgctcgaagagatggaggcctcccccaccgagctcatcgctgtggagggcaccgagattctgcaagacttccaaaacaagacggacgggcaggtctctggcgaggccatcaaaatgttccccacaatcaaaacaccagaagcagggactgtgatcacaaccgcagatgaaatcgagttagagggcgctacccagtggcctcactcaacatccgcttctgcaacatatggggttgaagctggggttgttccatggctgagtccgcagacatctgaaaggcccaccctcagctcttcacctgagataaacccggagacccaggcagctctgatccgcggacaggatagcactattgccgcaagcgagcagcaagtggcagcacgcatccttgatagcaacgatcaggccacggtcaatcctgtagaatttaacactgaagtggccaccccaccattctctctgctcgagacaagcaacgagacggatttcttaattggcatcaacgaggagagcgttgaaggtacagccatctacttgcctgggccagacagatgtaaaatgaatccgtgcctcaacggcggtacttgctaccctaccgaaaccagctatgtgtgcacctgcgtccccggatattcaggagatcagtgcgagttagacttcgacgagtgccactccaatccttgccgcaacggagcaacttgcgtggatggttttaacacgtttagatgcttatgtttaccctcctacgtgggagcattatgcgagcaggacactgagacttgtgactacggctggcacaagtttcaaggtcagtgctataaatatttcgcgcacagacgcacttgggatgcggctgagagggagtgccggttacagggagcccatctgacaagtatcctgagccatgaggagcagatgtttgtgaacagagtcgggcacgactaccagtggataggactgaacgacaaaatgttcgaacatgattttcggtggaccgacggcagcacattgcagtacgagaactggcggccaaatcagccagattcgttcttttccgctggcgaggactgtgttgtgatcatctggcatgagaatgggcaatggaatgacgttccctgcaattatcacctgacatacacgtgcaaaaaaggcacagtggcttgcggacagccaccagtcgtggagaatgccaaaaccttcggcaagatgaaacctcggtacgagattaattctctcatccgctaccattgtaaggacggattcatacagcgacacctcccgaccattagatgtctaggaaatggcaggtgggcaattccaaagatcacatgtatgaacccatccgcttatcagcggacttatagcatgaaatacttcaaaaattctagctccgctaaagacaatagcatcaatacatccaagcacgaccacagatggtcccggagatggcaagaatctaggcgcta

SEQ ID NO: 31412 - DNA, 4785 bp, Artificial Sequence
  Description of Artificial Sequence: Synthetic coding sequence
atgccaaccctccctcccagttacaacaccagcgaattccttaggatcaagtggtctaagattgaagtcgataagaatggcaaagacctgaaggagaccactgtattagtcgctcagaatggtaatatcaagattggtcaagactacaagggcagggtgagcgtaccaacgcatcccgaagctgtgggtgacgccagtctaactgtggtaaaattgttagctagcgatgccggactgtaccggtgtgatgttatgtacggaatcgaggacacacaggatacagtctctctaaccgtcgacggagtggttttccattaccgcgctgcaacgtcccgctatacgcttaatttcgaggcagcacaaaaggcttgtctcgacgtgggagccgtgatcgcaacgccagagcagctcttcgcagcctatgaggatggcttcgagcaatgcgatgcaggatggctagccgaccaaacagtgcgttatcccatcagagctcccagggtcggttgctacggggacaaaatggggaaagccggtgttagaacctacggattccggagccctcaagagacctacgacgtgtattgctacgtagatcaccttgatggagacgtgtttcatttaactgtgccatcaaaattcacattcgaggaggctgccaaagagtgcgaaaatcaagatgcaagattggccaccgtgggtgagctgcaggccgcttggcgcaacggcttcgaccagtgtgactacggttggctgagtgatgcctccgtgcggcatcccgtaaccgtggcgcgtgctcagtgtggcggtggcttgctgggggtcagaaccttgtaccgtttcgaaaatcagaccggtttccctccccctgacagccgattcgacgcttactgtttcaagcccaaagaagctaccacaatcgatttaagcatcctggcagagacagctagtccaagcttgtccaaagaacctcagatggtgtccgatcggaccacacccatcatcccattagtcgatgaattgcccgtgatccctaccgagttccctcctgtagggaatatcgttagttttgaacagaaggcaaccgtgcagccccaagccattacagactccctcgcaactaaattgcctacaccaaccggctctactaagaagccgtgggacatggatgactactccccttctgcctccggaccactaggtaagttggacatcagcgaaattaaagaagaagtcctgcagagcacgacaggggtctcccactacgctacggactcctgggacggtgtcgtggaggataaacagactcaggagtccgtgacccagatcgagcagattgaggtgggccctctggtgacatcgatggagattctgaaacacatcccttccaaagaattccccgtcaccgagaccccactcgttacggccagaatgatcttggaaagcaagacggaaaagaaaatggtttccacggtatccgagctcgtcactacagggcattatggattcaccctaggtgaagaggacgatgaggaccgaacgctgaccgtgggctcagacgagagcacgttgattttcgaccaaattccggaggtgattacagtgtctaaaaccagtgaggatactatccacacgcatctggaggatctcgaatctgtaagcgcaagtactactgtgagcccactcataatgccggataacaatggcagcagcatggacgactgggaggaacgacaaacgtccggacgcatcaccgaagaattcctcggtaagtatctgtccacaactccgtttcccagtcagcatagaacagaaatagagctgtttccctacagcggtgataaaatcctagtggaaggcatctcgaccgtgatctatccttctcttcagaccgagatgacacaccgaagagagaggaccgagaccttaattccagagatgcgcactgatacttacacagacgagatccaggaagagatcactaaaagccctttcatgggcaagactgaagaggaagtgttctctggaatgaagttatccacctctttatccgagccgatacatgtgaccgagtcatcggttgaaatgactaagagttttgacttccccaccctgattactaagctgtcggcagagcccaccgaggtccgggatatggaggaggatttcacagctactcccggtaccacaaagtacgatgaaaacattacgaccgtgctactggctcatgggactctatccgtcgaagcagcaacagtgagtaagtggtcttgggacgaggataatacaacatctaagccattagaatctacggaaccgagcgcttcttctaaactgccacccgctctgttaactactgtaggcatgaatggcaaggacaaggatatcccttccttcactgaagacggagctgatgagttcacgctaatccccgactctactcagaagcagctcgaagaagtcacagacgaagacattgcggcacacggtaagtttacaatcaggtttcagcccactacaagcactgggatcgccgaaaaatctacgcttcgagacagcaccactgaagaaaaagtcccgccaatcacctctaccgagggacaggtctatgccaccatggaagggtccgctttaggtgaagtggaggatgttgatttatccaagcccgtgagcactgtgccccaatttgcccacacctccgaagtggagggtctggctttcgtgagctatagctcaacacaggagcctactacatacgtcgacagctctcacacaatccctttgtctgtcatccccaaaacagattggggcgtcctggtcccctctgtcccatcagaggatgaggtactgggagagccgtcgcaggatatcctagttatcgatcaaaccaggctcgaggccacgatatcccctgagacaatgcgcacaaccaaaatcacagagggcactacccaggaagaattcccctggaaagaacagactgccgaaaagcccgtgccagccctctcatccactgcgtggacacctaaagaagctgtcaccccacttgatgagcaggagggagatggtagtgcatacacggtcagtgaggacgaactgttgaccggatctgagcgggtgccggttcttgaaacaacccctgtcggcaaaatagaccattcagtctcttacccccctggggctgtcacagaacataaggtcaagactgatgaggtggtcaccctgactcctaggataggtcctaaggtctctttatccccaggaccggaacagaaatatgagactgaaggatcaagtaccaccgggtttaccagcagcctcagccctttcagtacccatattacccagctcatggaggagactaccaccgagaagacaagcctcgaagacattgaccttgggtcaggcctgtttgagaagcccaaggctaccgaacttattgagtttagtactatcaaggtgacagtacccagcgacattaccaccgctttttcctcagttgaccggttacacacgacatccgcgttcaagccatcaagcgccatcacaaagaaaccaccgctcatcgacagggagcctggggaggagaccactagcgacatggtgatcataggggagagcacttcccatgttcccccaaccacgctggaggacatcgtggccaaagaaacagaaaccgacattgaccgcgaatatttcacaactagcagcccacccgctacccagcccacccgccctcccactgtggaagataaagaagctttcgggcctcaagctctgtcaactccccaaccgcctgccagcaccaaattccatcccgatataaatgtttatatcatagaagtgagggaaaacaagaccggaccagaccgctgtaagatgaacccgtgtctgaatggagggacatgttatcctacagagacgtcgtatgtctgtacctgcgtgcccggatactcaggggatcagtgcgagttggattttgacgagtgccactcgaacccttgtcgaaatggcgcaacctgcgtggacgggttcaatacctttcggtgtttgtgtctgccatcctacgtgggggcactctgtgagcaggacaccgaaacatgtgactacggttggcacaaatttcaagggcagtgctataagtacttcgctcacaggagaacttgggatgccgcagaaagggagtgtcgcctccagggtgcgcacctgacatcaatcttgtcccacgaagagcaaatgtttgtcaaccgtgtggggcacgactatcagtggattggactcaatgacaaaatgtttgaacacgattttcggtggacggacggatctactctgcaatatgagaactggcggccaaatcagccagatagtttcttttctgccggagaggactgcgtagtcattatctggcacgagaatggccaatggaacgatgtgccatgcaactaccacctgacctacacgtgtaagaaggggacagtggcctgtggccaaccgccagtggtagagaatgccaaaaccttcggcaaaatgaagcctagatacgagattaatagccttatcaggtatcattgcaaggatggctttatccagcggcatctgcctacgatcaggtgtttgggtaatggccgatgggccattcctaagatcacttgtatgaaccctagtgcctatcagcggacatactcaatgaaatactttaaaaattcatcttctgctaaggacaactcaattaacaccagtaaacacgatcaccgttggagccgccgttggcaagagagccgacgttag

SEQ ID NO: 31413 - DNA, 1968 bp, Artificial Sequence
  Description of Artificial Sequence: Synthetic coding sequence
atgttcataaacatcaaatctattctgtggatgtgtagtacactcatagtgacgcacgctctgcacaaagttaaggtgggaaaaagtccacctgtgcggggatctcttagcgggaaagtttcattgccatgtcatttcagcacaatgcccacgttaccaccatcttataacacatcagaattcctacgaattaagtggtcaaagatcgaggtcgataaaaacggcaaggatctaaaagaaactactgtgctagtggcacagaatgggaacattaaaatcggccaggattacaagggaagggtgtctgtgccaacgcacccagaggcagtaggagatgcttctctgacagtggtaaagctgctggccagcgacgccggactttatcgttgcgatgtcatgtatgggattgaagatacgcaggatactgtgagcctgacggtggacggagtggtgttccactacagagctgccacctcccgatacactttgaactttgaggctgcccaaaaagcctgcctggatgtgggagccgtgatcgctaccccagagcagttgtttgcagcctatgaggatggctttgagcagtgcgacgcgggttggctcgcagaccagactgtccgatacccgattagggctccgagggtggggtgctatggcgataagatgggaaaagcgggagtgagaacctacggctttaggtcaccccaagagacttacgatgtgtactgttacgtggatcatcttgacggtgacgtcttccacctgaccgtgccaagcaaattcacattcgaggaagccgctaaggagtgtgagaatcaagatgcgaggttggccactgtgggggagttgcaggctgcatggaggaatgggtttgaccagtgtgactatggatggttatcagacgcctccgtcagacatcccgtcactgtagccagagcccaatgtggtggtggtctgctgggagtccgcaccttgtacagatttgaaaaccagactggcttcccacctcccgatagtcgctttgatgcttattgttttaagcgcccagacaggtgcaagatgaacccctgtcttaatggcggtacctgttatccaacggagacaagttacgtgtgcacatgtgttccaggctattcgggtgaccagtgcgagctcgactttgacgagtgtcactcaaatccttgcaggaatggtgccacctgcgtagacggatttaacacgttccggtgtctgtgcctgccttcctacgtcggagctctgtgtgagcaagacacggaaacctgcgattacggatggcacaaatttcaaggccagtgctacaaatactttgcgcacagacggacatgggacgccgctgaaagagagtgccgactgcaaggcgcacacctgacttctatcctcagccacgaggagcagatgttcgttaatagggtgggccatgactatcaatggatagggctgaacgacaaaatgttcgagcacgacttcagatggaccgatggtagtacactgcagtacgagaactggaggcccaatcagcctgatagttttttcagcgcgggagaagactgtgtggtaatcatctggcacgaaaatggccaatggaatgacgtgccttgcaactatcacctcacatatacgtgcaaaaaaggcactgttgcttgcggacagcctcctgtggtggaaaacgcaaaaaccttcggcaagatgaagcccaggtacgaaattaattcactcatccggtaccactgcaaggatggttttatccagcgccatctgcccactatacggtgtctgggcaacggaaggtgggcaatcccgaagatcacatgtatgaatccgtccgcttaccagagaacctattcaatgaagtacttcaagaattcatcttccgccaaggataactccatcaatacctccaaacacgatcaccggtggagtaggaggtggcaggaatccaggcgatag

SEQ ID NO: 31414 - DNA, 1440 bp, Artificial Sequence
  Description of Artificial Sequence: Synthetic coding sequence
atggcttcaaccatcaaggaggctctctcagtcgttagcgaggatcagtctctctttgagtgtgcctatggaactcctcacctggccaaaaccgaaatgacagcttccagctcatctgactatggccaaacctccaaaatgagtccccgagtgccccaacaggattggctgtcacagcctccagccagggtaacaatcaaaatggagtgcaatcctagccaggtcaacggttccagaaacagccctgatgagtgttcagtagccaaggggggaaagatggtgggaagtccagacactgtgggcatgaattatggctcttacatggaagagaaacatatgcctccccctaatatgacgactaatgaaagaagggtcatcgtgcctgctgatcctaccctctggtcaaccgatcacgtacgccagtggcttgagtgggccgtaaaagaatacggtttgcccgacgtgaacattttactatttcagaatatcgatggcaaagagttgtgtaagatgactaaggacgacttccagcggctcactccttcatacaacgccgacatcctgctatcacacctgcactacctcagggaaacgccactgcctcaccttacctctgacgatgtcgataaagccctgcaaaacagccctcggctgatgcacgcaaggaacacaggcggagccgcttttatcttccccaacacttctgtgtatcccgaggctacacagcgtatcactactaggcctgacctcccttatgaacctccgagaaggagtgcctggactggccatggccatcctacgccacagagtaaggcggctcaaccctctccctccactgtgccaaaaaccgaggaccagcggcctcagctggacccctatcaaatcttaggcccaacctccagcaggctggcaaatccagggtcgggacagatccagctgtggcagttcttacttgaactcctgtccgattccagcaacagctcttgcattacatgggagggcacaaatggcgagtttaaaatgacagaccccgacgaagtcgctcggcgatggggtgaaagaaagtccaagcccaatatgaattatgataagttgtcccgcgctctgagatactactacgacaagaacattatgacaaaggtgcatggaaaacggtatgcatataaattcgatttccacggcattgcccaagctcttcagccacatccaccggaaagctctctctataaatacccgagcgaccttccctacatgggctcataccatgcccatccacagaaaatgaacttcgtcgctcctcatcccccagccctgccagtcacctcttcctcatttttcgccgctcccaacccgtactggaactcccctactggcggtatctatcccaataccaggttacctacttctcacatgcctagtcatctcggcacttattactag

SEQ ID NO: 31415 - DNA, 1092 bp, Artificial Sequence
  Description of Artificial Sequence: Synthetic coding sequence
atggttggttccccagatacagtaggaatgaattatggatcatacatggaagagaaacacatgcctccaccaaacatgacaactaatgaacgtcgtgttatcgtccccgctgatcccacgctttggtccacggaccatgtgaggcagtggctggagtgggctgttaaggaatatggcttgccagacgtaaacatactgcttttccagaacatagacggtaaagaactgtgtaaaatgaccaaggatgacttccagcggcttacccccagttacaatgcagatattctgctgtcacatctacattacttgagagaaacacccttacctcatctcacctctgatgacgtcgacaaggcactccagaactcaccccgtctcatgcacgctagaaatacagatttgccgtacgaacccccacggagatccgcgtggacgggccacgggcatcctacacctcagagcaaggcggcacagccaagtcctagtacagtcccgaagacggaggatcagagaccccaattagatccttaccagattctgggtcctactagttcccgccttgcaaaccccggatcaggccagatccaactgtggcagttcttgctagaactcctgagtgactccagcaatagttcatgcatcacgtgggaggggacaaacggagaatttaagatgacagacccagacgaggtggccaggcggtggggcgaaagaaagtccaaaccgaacatgaactatgacaagttgtctcgagccctcagatattattatgataagaacatcatgaccaaggtgcatggcaaacggtacgcctacaaattcgattttcatggtatagctcaggctctgcagccacatcccccagagagtagcctgtataagtacccatcagatctcccgtatatgggcagttatcacgcccacccacagaaaatgaacttcgttgcaccacatccgccagccctccccgtgacaagtagcagtttcttcgccgcaccgaacccatattggaattcccctacagggggtatctatcccaacaccagactacccaccagccacatgccctctcacctgggaacctattactag

SEQ ID NO: 31416 - DNA, 1389 bp, Artificial Sequence
  Description of Artificial Sequence: Synthetic coding sequence
atgattcagaccgtccccgaccctgctgctcacataaaagaggcattgagcgtagtctcagaagaccagtctttgtttgagtgcgcatatggaacccctcatctggccaagaccgagatgacggcgtcatcttcttctgattatggccaaacttcaaaaatgtctcccagggtaccccagcaggactggttgtcacagccacctgcaagggtcacaatcaagatggagtgcaatcctagtcaggtcaacggctcacgaaacagccctgacgagtgttcagtcgcaaaaggcggaaagatggtcggttcccctgatactgtaggcatgaactatggcagctacatggaggagaaacacatgcctccacctaacatgacgaccaatgagaggagggtgatcgtacctgctgaccctactctgtggagcaccgatcacgtgcggcaatggcttgagtgggccgtcaaggagtacggcctgccagatgttaacatcctgctgtttcagaatatcgatggcaaagagctctgtaaaatgacaaaagatgacttccagcggctgaccccgtcctataatgccgatatcttgctgtcacatctgcattacttacgtgaaaccccattgccccacctgaccagcgatgatgttgacaaggccctgcaaaactctcctcggttaatgcacgcccgtaatactgacctgccttacgagcccccacgcagaagcgcctggacaggtcacggtcatccgaccccccagtcaaaggctgcgcagccatcaccaagcactgttcccaaaacagaagaccaaagaccgcagctcgacccctaccagattcttgggcctacttctagtagactggccaaccccggttctggccaaatacagctgtggcagtttcttcttgagctgctcagcgatagctcaaacagctcatgtataacctgggaagggacaaatggggagttcaaaatgaccgaccccgacgaagtggcaagacggtggggagaacgaaagtccaaacccaatatgaactacgataaactgtcccgtgccctgcgttattactatgataagaatatcatgacaaaggtacatggcaaaaggtatgcctacaagttcgatttccatggtatcgctcaagctctgcaaccacatccccctgaaagctcgctgtacaaatacccgagcgatttgccttatatgggctcgtaccacgcccatccacagaagatgaattttgttgctcctcatccacctgcactcccagtgacttcttcttccttttttgccgcacccaatccttactggaatagccccacaggtggtatttaccccaacaccagactccccacctctcatatgccgagtcatctggggacttattactag

SEQ ID NO: 31417 - DNA, 1461 bp, Artificial Sequence
  Description of Artificial Sequence: Synthetic coding sequence
atgattcaaactgtcccagaccctgcagcgcatattaaagaagccctgtccgtggtaagtgaagaccagagcctttttgaatgcgcttacggaacccctcatctagccaaaactgaaatgactgcctccagctcctccgattacggtcagacatccaagatgtcccctcgggtgcctcagcaggactggttgtcgcagcccccagcacgagtgacaatcaagatggaatgcaacccgtctcaggtaaacgggtcacggaacagcccggatgagtgctccgtggctaaaggcggtaaaatggtcggcagccccgacactgttgggatgaactatggcagctatatggaagagaaacatatgcccccaccaaacatgaccacgaatgaaagacgtgtgatcgtgccagcagatcctacactgtggtcaactgaccatgtgaggcaatggttggagtgggctgtgaaagaatatgggttgcccgacgtcaatatactcctctttcagaacattgatggaaaagagctgtgcaagatgacgaaggacgacttccagcgcttaactccttcttataacgccgacatactgctgtctcacctgcactacctccgggagacccccctgccacatctcacatccgatgatgtggataaagccctgcagaattcgccaaggctgatgcatgcaagaaatacaggcggagctgcattcatctttcccaatacatccgtctatcccgaagctacacagcggatcactacccgaccagacctgccctacgagccaccccgaagaagtgcctggacaggccatggacaccccacgcctcagtctaaggcggctcagcccagcccatcaacagtgcccaagaccgaagatcagcggcctcagctggacccttaccagattttaggacccacgtcgtcacgcttggcaaacccgggaagtggccagattcagttgtggcaattcctgcttgagctcctctctgattcttccaatagcagttgtatcacttgggaggggactaacggggagttcaaaatgaccgacccagatgaggttgccaggagatggggtgagcggaagtcaaagcccaacatgaattacgataaactgagcagagccctgagatactactatgacaagaatattatgacgaaagtgcacggcaagaggtacgcctataaattcgacttccatggtatcgcacaggctcttcagcctcatccaccagagtcatccctttacaaataccccagcgatctgccctacatggggtcataccatgcacatccccagaaaatgaactttgtcgcccctcatccaccagctctgcccgttaccagctcctcgttcttcgcagctccaaatccttattggaactcaccaacaggcggaatctaccccaataccaggctgccaacctctcacatgccttctcacctcgggacatattattag

SEQ ID NO: 31418 - DNA, 1461 bp, Artificial Sequence
  Description of Artificial Sequence: Synthetic coding sequence
atgattcagacagtgcccgatcctgccgctcacataaaagaagccctaagtgtcgtgagtgaggaccaatccctctttgaatgcgcttatggcacgccacacctggcaaagaccgagatgaccgctagtagttcctctgactacggacagacctctaagatgtccccaagggtgcctcagcaagattggttgagtcagcctcccgctcgggtgaccatcaagatggagtgtaacccgagtcaggttaacggttcccgcaactcccccgatgagtgttccgtcgctaaaggaggaaagatggtaggcagccctgatacagtgggcatgaactacggatcctatatggaagaaaagcatatgccccctcctaatatgactactaacgagcgaagagttatcgtgcctgcagatcctactctgtggtccactgaccatgtgcggcaatggctggagtgggctgttaaagaatacggcttacccgatgtgaatatcctactgttccaaaatatcgacgggaaggaactgtgtaagatgactaaggacgactttcaacgtctcaccccatcttataacgcagatatcctcttgagtcatcttcattatttgcgcgagacaccccttccccacctcacctccgacgatgtggataaagcactacaaaatagtcccagactgatgcacgcccgaaacacagggggagcagcctttatctttccaaacacctctgtgtacccggaggccacacagagaatcacgacgagacctgacctgccctacgaacctcctcgccgatcagcatggacggggcacggccaccctacaccacaatcaaaagccgctcagccttccccaagtacagtgcctaagactgaggatcagagacctcaactcgatccatatcagattttgggtccaacatctagtcggctggccaaccccggtagtggccaaatccagctgtggcagttcctgcttgagctgcttagcgacagttctaactcctcttgcattacgtgggaggggacgaacggggagtttaaaatgactgaccctgacgaagttgctcgacgctggggcgagaggaagagcaagcccaatatgaactatgacaagctgtcacgcgcactgaggtactactacgataagaatatcatgacaaaggttcatggcaaacgctacgcctataagtttgacttccacggaattgctcaggccctccagccacaccctccggaatcctccttgtacaaatatccgtcagaccttccatatatgggctcctaccacgctcaccctcaaaaaatgaactttgtcgcaccacacccgccagccctacctgtgaccagttccagcttctttgcggcacccaacccatactggaactctccaaccgggggaatttaccccaatacgaggttgcccacatcacacatgccaagccacctcgggacatactactag

SEQ ID NO: 31419 - DNA, 516 bp, Artificial Sequence
  Description of Artificial Sequence: Synthetic coding sequence
atggcatctaccattaaggaggcactaagtgttgtctccgaagaccagagtttgtttgagtgcgcctacggcaccccccacttggctaaaacagagatgaccgcttctagttctagcgactatggccagacctccaagatgagtcctcgggtgccacagcaggactggctttctcagcctcccgcaagagtcacaatcaagatggagtgtaatccaagtcaagttaatgggtcccgtaactcccctgacgaatgctctgtagccaaaggaggcaagatggtggggtcaccagataccgtggggatgaactatggatcctacatggaagagaagcatatgccccctcctaatatgacgactaacgaaaggagagttatagtaccagccgatttgccctacgaaccccctcgaagatcagcctggaccggccacgggcaccctacaccgcagtcgaagggaacggtgctcgctccgatgaccctgtcatttatgagtcaggctgtcgacgactgctag

SEQ ID NO: 31420 - DNA, 1389 bp, Artificial Sequence
  Description of Artificial Sequence: Synthetic coding sequence
atgattcaaacagttcccgatcccgcagctcacataaaagaagccctgtcagtcgtgagtgaggaccaatcgttattcgaatgcgcctacggcacacctcacctggcaaaaacagagatgacagcctcctcatctagcgactacggtcaaacaagtaaaatgtcaccccgtgtgccccagcaggactggttgagccagcctccagccagagtcaccatcaagatggagtgcaacccttcgcaggtgaatggttcccgcaatagccccgacgaatgcagtgtggccaaggggggtaagatggtaggatctcccgacaccgtggggatgaattacggcagctatatggaagagaaacatatgcctccccctaatatgacaacaaatgagcgtcgggtcattgttcccgcagatccaactctctggtctaccgaccatgtccgccagtggctggaatgggccgtcaaggagtatggcttgccggacgttaatatcctgttatttcagaacattgacggaaaggagctgtgtaaaatgactaaggatgactttcagagattaactccatcttacaatgccgatatactgctcagccacctgcattaccttcgcgagacccctctgccccatcttaccagcgatgatgtggacaaggcattgcaaaattcacctcgcctgatgcatgccagaaataccgatctgccctatgagcccccacgaagatctgcttggaccggccatggccatcccacccctcagtccaaagcggcacagcctagcccttccaccgttcccaaaaccgaagaccagcggcctcagctcgacccctatcagatcctggggcctacttcttctcgtctcgccaaccccggatccggccaaattcagctatggcagtttttgctcgagctgctcagtgattcctctaattcctcttgtattacttgggaaggtaccaacggcgaatttaagatgactgatcccgacgaggttgcgcgaaggtggggggagagaaagagcaagccaaacatgaactatgacaagcttagtagggctctgagatactattacgacaagaacattatgacaaaggtgcacggtaaacgctacgcttataaattcgattttcatggaatcgcccaggccctgcagccccaccccccagagagctcactctacaaataccccagcgacctgccttatatgggctcatatcacgcacaccctcagaagatgaattttgtggcccctcaccctcccgctttaccagtcacctcgagttcttttttcgcagccccaaatccatattggaattcgcccacaggtggtatttaccccaataccaggctgcccacaagccatatgccatcacatctgggaacctattactag

SEQ ID NO: 31421 - DNA, 1164 bp, Artificial Sequence
  Description of Artificial Sequence: Synthetic coding sequence
atggtaggctctccagatacggttggcatgaattatggctcctatatggaagagaagcacatgcctccaccaaacatgacgaccaacgagcgaagggtaatcgtgccagcagaccctacgctctggtcaacagaccacgttaggcagtggctggagtgggccgtcaaagagtatggtctcccggatgtcaacattctgctcttccagaatattgacggcaaggagctatgcaagatgactaaagacgactttcagcggctgactccttcgtataacgccgacatcttactctctcatttgcattacctgagggaaacccctttgccccacctcaccagcgatgacgtcgataaagctctgcagaactcaccaagattaatgcacgccagaaacacaggaggagctgcttttatcttccctaacacctcggtttatccggaggccacacaaagaattaccaccaggcctgatctgccatatgagcccccaaggagatccgcttggacagggcacggacaccccacaccgcagtcgaaagcagcccaaccttccccctctaccgtgcccaagactgaggaccagagaccacagctggacccttatcagatcctgggacccacaagctccaggctggccaatcctggatccggtcaaatccagctctggcagttcctgctggaattactgtcggattcttccaacagctcttgtattacttgggaaggcacgaacggcgaattcaaaatgaccgacccagatgaggtggccagacgatggggcgaaagaaaatcgaagccaaacatgaattatgataagttgagtagggctctgagatactactacgacaagaacattatgactaaggtgcatggtaaaaggtatgcctacaaatttgacttccatggaatcgcgcaggcactacagccacacccacccgagagctccctgtataagtaccctagcgatcttccgtacatgggtagttaccacgctcacccccagaagatgaacttcgtggccccacaccccccagcactgccggtgacctcctcctccttctttgctgcccctaacccgtactggaacagcccaaccgggggaatctaccctaacacccgactgccaacaagccacatgccttctcacttgggcacatactactag

SEQ ID NO: 31422 - DNA, 1410 bp, Artificial Sequence
  Description of Artificial Sequence: Synthetic coding sequence
atgaatgactttggtattaagaatatggatcaggttgcaccagtcgccaactcatacagaggaacattgaagcgccagcctgctttcgacaccttcgatggctcactctttgccgtatttccttcattgaatgaagagcaaactctccaagaagttcctaccggattggatagtatctcccatgatagcgccaactgcgagctgccactcctgactccttgttctaaagccgtgatgtcccaggctctgaaggctacctttagtggattcaagaaagaacaacggagactcggcatcccgaaaaacccatggctgtggagcgaacagcaggtgtgtcagtggctcctatgggcgacaaacgaattttccctcgttaatgttaaccttcaaaggtttggcatgaacggacagatgttatgcaacctgggtaaggagcgatttctggagctcgcaccagacttcgtcggggacatcctctgggagcacctcgagcaaatgataaaggagaaccaagagaaaaccgaggaccagtacgaagaaaattctcacttgacaagcgtgccccactggatcaactctaatactctcgggttcgggaccgagcaagccccttatgggatgcagacacagaactaccccaagggtggtctccttgacagcatgtgtcctgccagcactccatctgtcttgtccagcgaacaggaatttcagatgttccccaagagtcgcctaagttccgttagtgtaacttattgcagcgtctcacaggatttcccgggaagcaacctaaacttgttgaccaataacagcggtacaccgaaggaccatgattcgccggagaatggggcagacagttttgagtcctcagattctctcctccaaagctggaattcacagagttcattattggatgtgcagagggtgccatcattcgaatctttcgaggatgactgttctcagtcactctgcctcaataagccaacaatgtcttttaaagattatatccaggagcggtccgacccggtggagcaagggaagcccgtgatccccgcagccgttctagcaggatttacaggatccggaccaattcaactgtggcagtttttgttggagctactcagtgacaaatcctgccagtcttttatctcctggactggcgatggctgggaattcaaactagctgatcccgacgaagtcgctagaagatggggtaagcgtaagaataagccaaaaatgaactacgagaagctgagcagaggactcagatactattatgataagaacatcatacataagacatctggcaagcggtatgtgtaccgattcgtgtgtgatttacaaaatctgctgggatttacaccagaggagcttcacgccatcctgggggtccagccggatacagaagactag

SEQ ID NO: 31423 - DNA, 1410 bp, Artificial Sequence
  Description of Artificial Sequence: Synthetic coding sequence
atgaacgattttggaattaagaatatggatcaggtggctccagtggcgaattcataccgcggtactctgaaaaggcagccagcatttgacacgttcgacggcagcctcttcgccgtgttccccagcctgaacgaagaacagactctccaggaggtgcctacaggtcttgatagtatctcacatgactccgccaactgcgaactccccttgttaaccccctgctccaaggctgtcatgagccaggctctgaaagcgaccttctcagggttcaaaaaggagcagaggcgactgggtatccccaaaaacccctggctgtggtccgagcagcaggtgtgccaatggctgttgtgggccactaatgagttttccctggtcaacgttaacttgcagagatttggaatgaatggccagatgctctgcaacctcggaaaagagaggtttctggagctggcacccgattttgtcggggacattctgtgggagcatcttgaacagatgataaaagaaaatcaggagaagacggaggaccaatatgaggagaatagccacttgacaagcgtaccacactggattaacagcaacacgctcgggttcggcacagagcaagcaccatatggtatgcaaacgcaaaattatcccaagggtggattgttagattccatgtgtcccgcatctacaccaagtgtgttgagctcggagcaggagtttcaaatgttccctaagagcagactgagttcagtgtcggtgacttattgcagtgttagccaggatttccctggaagcaatcttaaccttttgacaaataactcaggcacacctaaggaccacgactcccctgaaaacggggctgattcctttgaaagcagtgactctctgctccagtcttggaatagccaatccagcctcctcgacgtccagagagtcccttcgtttgaatccttcgaagacgattgcagccaatcactgtgcttgaacaagccaacaatgtcctttaaggactatattcaggagagatcggatcccgtcgagcaggggaaaccagttatccccgcagccgtgctggcgggatttacaggctccggcccaatccagctgtggcaattcctcttggagctgttgtccgataagagttgccagtcctttatatcatggactggtgatggctgggaatttaagctggctgaccctgatgaggtggctaggcgctggggaaaaagaaagaacaaacccaaaatgaattacgagaaattatccagaggtcttaggtactattacgacaaaaatataatccacaaaacgagcggcaagcgatatgtgtacagatttgtgtgcgatctgcaaaatctgctcgggtttaccccagaagaacttcacgccatcctgggtgtgcagcctgatacagaggattag

SEQ ID NO: 31424 - DNA, 507 bp, Artificial Sequence
  Description of Artificial Sequence: Synthetic coding sequence
atgaatgacttcggaatcaagaacatggaccaggtggctcctgtggctaacagttatagaggaacactcaaacggcagcctgcattcgatacgttcgacggctctcttttcgctgtgttcccaagtctgaatgaagagcagacactgcaggaagttcctacaggactggactcaatcagccacgattctgccaattgcgaactgcctctcctcaccccatgtagtaaagcagtcatgtctcaagctcttaaagccacgttttctggatttaagaaggaacagcggcgactgggtattccaaaaaatccttggctctggtctgagcagcaggtttgccagtggctgttatgggccacaaatgagttttccctagtgaatgtaaatctgcagagattcggcatgaacggacaaatgctttgcaatctcggaaaagaacgtttcctcgagcttgccccagatttcgtgggagatattttgtgggagcacctcgaacagatgattaagtag

SEQ ID NO: 31425 - DNA, 813 bp, Artificial Sequence
  Description of Artificial Sequence: Synthetic coding sequence
atgaacgacttcggcattaagaatatggaccaggtggctccagtggcaaacagttatcgcggtactctgaaacgacagccggctttcgacaccttcgatggatctctgtttgcggtctttccctcactcaatgaggagcagaccctgcaggaggtgccgaccgggttggactcaatcagccacgatagcgccaattgtgaactgccgctgctgacaccttgttccaaagccgtgatgtctcaagcccttaaagcaaccttttctggttttaagaaggaacagaggcgcctgggcatccccaaaaatccctggctgtggtctgagcagcaagtctgtcagtggttgctctgggccaccaatgagttttccctggtgaatgtgaacctgcaacggtttgggatgaacgggcagatgctgtgtaacttgggcaaggaaagatttctagaattagctcccgacttcgtgggagatatcctgtgggagcatctggaacagatgatcaaagagaaccaggagaagaccgaagaccagtacgaggagaactcccacctgacatcagtgcctcactggattaactcaaatactctcggtttcggaacagagcaggccccatacggcatgcagacccagaattatcccaagggaggtctgctagactccatgtgccccgcatcgactcctagcgtgttgagctccgaacaggagttccagatgtttcctaaaagccgactctccagtgtgtctgtgacctactgcagtgtctcacaggatttcccaggtagtaacctaaatttgttgactaacaatagttag

SEQ ID NO: 31426 - DNA, 570 bp, Artificial Sequence
  Description of Artificial Sequence: Synthetic coding sequence
atgacagagtataagctggttgtggttggggctgggggtgtaggcaagagcgccctgactattcagctgattcagaaccactttgtcgacgaatacgaccctactattgaggacagttatcgcaaacaggtggtgatcgacggtgagacctgcctcctggatatcctggataccgcaggacaagaggaatacagcgcaatgagggatcagtatatgcgtacaggcgaagggttcctgtgcgtcttcgccatcaataatactaagagcttcgaagatatacaccagtacagagaacagatcaagagggtcaaagattcggacgacgtgcccatggttctcgtcggcaacaagtgcgacttggctgcacggaccgtagagagccgccaggctcaggacttggcacgctcgtatggcattccctacattgaaacttccgccaagacacgtcagggcgtagaggacgcattctacacactggtgcgggagataaggcagcacaagctccgcaagcttaacccccctgatgaaagtgggcctggctgtatgagctgtaagtgcgtgctgtcctag

SEQ ID NO: 31427 - DNA, 513 bp, Artificial Sequence
  Description of Artificial Sequence: Synthetic coding sequence
atgaccgagtataaattggtagtggtaggtgccggtggcgtcggtaagtctgcgctcaccatacagcttatccagaaccacttcgtagatgaatatgaccccactatagaagacagttatcggaagcaagttgtcattgatggggaaacttgcttgttggatatcctcgacaccgccggtcaggaggagtatagcgccatgcgcgatcagtacatgaggactggggaaggtttcctttgcgtgttcgctattaataacacaaagtcattcgaggatattcaccagtacagagagcagatcaagagagtgaaagactctgacgacgttcccatggtgcttgtcgggaataagtgtgacttggcggctcggactgtagagagcaggcaagctcaagatttagcacggtcctatggcatcccctacattgagacttccgccaaaactaggcagggttcaaggtccgggagcagttcgagctctggaaccctctgggatccacctgggccaatgtag

SEQ ID NO: 31428 - DNA, 570 bp, Artificial Sequence
  Description of Artificial Sequence: Synthetic coding sequence
atgactgagtacaagttggtagtcgtcggcgcagggggagttggtaagtcagcactcacgattcagttgatccagaatcacttcgtagatgagtatgatccgacaatagaggacagctaccggaagcaggtggtgattgacggagagacatgccttctggatatcctggatactgccggacaggaagaatacagcgcgatgagagatcagtacatgaggacgggtgaaggctttctttgcgtttttgcaataaacaatacgaaaagtttcgaagatatccaccaataccgcgagcaaatcaaaagggtgaaagattcagacgacgtgcccatggttctcgtggggaataaatgtgaccttgccgcaagaactgttgagtctcggcaggcacaggatctggcaaggtcttatggtatcccctatattgaaacaagcgccaagacacggcagggagtcgaggacgcattttatacactggtgcgggaaatcagacagcataaattgcgcaagcttaaccccccagatgaatccggcccagggtgtatgtcgtgcaagtgtgtgctgtcttag

SEQ ID NO: 31429 - DNA, 513 bp, Artificial Sequence
  Description of Artificial Sequence: Synthetic coding sequence
atgacagaatataaactcgtcgtggtaggtgccggtggggtgggcaaaagtgcacttaccatacagctgatacagaaccatttcgtcgacgagtacgatcccactatcgaggactcctacaggaagcaggtggtgatcgatggggagacctgcttactggacatcctcgataccgccggacaggaggaatactccgccatgcgggatcagtacatgagaaccggcgaaggctttctatgtgtgttcgccattaataataccaagtccttcgaggacattcatcaatacagggagcagattaagagggttaaggactcagacgatgtgccgatggtgcttgtgggaaataaatgtgatctggctgcccgaacagtggagtcaagacaagcccaggacctcgccaggtcgtatggcatcccatacatcgagacgagcgccaaaacccggcagggaagcagatccggtagcagctctagcagtggaactctctgggatccccctgggcctatgtag

SEQ ID NO: 31430 - DNA, 570 bp, Artificial Sequence
  Description of Artificial Sequence: Synthetic coding sequence
atgacagagtacaaattggttgtcgtaggtgccggaggagtcggtaagtctgctttgaccatacagttaatacaaaaccacttcgtggacgaatatgatcctaccattgaggacagctaccggaagcaggtagtaatcgacggggagacatgcctcctggatatcctcgatactgctgggcaggaggagtactccgccatgagagaccagtacatgaggacaggcgaggggtttctatgtgtcttcgctatcaacaatacgaagtcttttgaagatatccaccagtaccgcgaacagataaaacgcgtcaaggattcggatgacgtaccaatggtcttggtgggtaataagtgtgaccttgccgcacggacagtcgagtccaggcaggcacaggatttggccagaagctatggcatcccctatattgaaaccagtgctaagacgcggcagggggtcgaagacgccttttataccttagtgagagagatacgtcaacataaactgcgcaaactgaatcctccagacgaatctggcccagggtgcatgtcttgcaagtgtgtcctctcctag

SEQ ID NO: 31431 - DNA, 513 bp, Artificial Sequence
  Description of Artificial Sequence: Synthetic coding sequence
atgactgagtacaagctggtcgtggtgggagctggaggcgtgggaaaaagcgcactgaccatacagcttatacaaaaccattttgtagacgaatacgaccctaccattgaggactcctaccggaagcaagtggtaatcgacggggagacctgcctgcttgatattttggacacagctggccaggaagagtattctgctatgcgcgaccagtatatgcgaaccggagaaggattcctctgcgtctttgctataaataacactaagtctttcgaggatattcatcagtatagggaacagattaagagagtaaaggattcggatgatgtacccatggtcctggtaggcaacaagtgcgatctggcagcacgcacagtggagagcaggcaggctcaggatctggcccgtagctatgggattccatacatagagacaagcgctaaaactcgccagggctcccgctcagggtcatccagttcctccggaaccttatgggatcctcctggcccaatgtag

SEQ ID NO: 31432 - DNA, 609 bp, Artificial Sequence
  Description of Artificial Sequence: Synthetic coding sequence
atgctgcccccagggaccgccactctgctcacactattgttagccgctgggagtctcggccaaaagccacaaaggcctagacgcccagcctcacccatctcgacaattcagccaaaggccaacttcgacgcgcaacaattcgccggaacctggctgctcgtcgctgttggatccgcctgtaggtttctgcaggagcaggggcaccgagccgaagcgaccacgctccacgtggcgcctcaaggtactgccatggccgtatctacgttccgaaagcttgacgggatctgttggcaagtccgccaactctacggagacacaggcgttttggggaggtttctgctgcaggccagagatgccaggggggcagtgcatgtggtcgtggcagagaccgattatcagagctttgcggtgctctacctggagcgtgccggtcagctgagtgtgaagctctacgccaggtcgctgccagtgagcgactcagtccttagtgggttcgagcagagagtgcaagaggctcacctcactgaagaccagattttttacttcccaaaatacggcttttgtgaagctgccgaccaatttcatgtcctcgacgaggtccgcaggtag

SEQ ID NO: 31433 - DNA, 522 bp, Artificial Sequence
  Description of Artificial Sequence: Synthetic coding sequence
ggcttccttgtgcccctctggctgatgcggaactgcttccgtttgcaagaagagatgctccagcgagaggaggctgagaatacccttcagagcttccggcaggacgtggacaatgcttcactcgctcgcctagaccttgagcgcaaggttgaatctttacaagaggagatcgcctttctcaagaaattacatgaggaagagattcaggaacttcaggcgcaaatccaggaacagcacgtgcagattgacgtagatgtctcgaaacctgatctgaccgccgctttgcgagatgtgaggcagcagtacgagtcagtcgctgcaaaaaacctccaagaagccgaagaatggtacaagtccaaattcgccgacctgtcagaagccgctaataggaacaacgacgctctacgccaggccaagcaggaaagcacggaatacaggaggcaagttcaatcgttgacatgcgaagtagatgctcttaaagggaccgtcagcaccaacccggcagtcaaggagggtaaatag

SEQ ID NO: 31434 - DNA, 687 bp, Artificial Sequence
  Description of Artificial Sequence: Synthetic coding sequence
atgaggaactgctttaggttgcaggaagagatgctccagagggaagaggctgaaaatacactgcagagttttagacaggacgttgacaacgccagcttagcgagattggacctcgagaggaaggtcgaaagcctccaggaagaaatcgcttttctcaaaaaactccacgaagaagaaatccaagaactgcaagcacagatacaggagcagcatgttcaaatcgacgtcgatgtgtccaagccggacctcaccgccgcacttagagacgtgcggcagcagtacgagagcgttgctgccaaaaacctgcaagaggctgaggagtggtacaagagcaagtttgccgacctgagtgaagccgcaaatcggaataacgatgctctacggcaggccaagcaggagagcaccgaataccggagacaagtgcagtctctgacatgcgaggtcgacgctctgaaaggcactaacgagtcactagaacggcaaatgagagaaatggaggaaaacttcgcagtcgaggccgctaattaccaggacactatcggccgactgcaagacgagatccagaacatgaaggaggagatggctagacatctccgcgaataccaggatttgctcaacgtgaaaatggcacttgatatcgaaatcgccacttatcgtaagctgctggagggcgaggaatccaggtag

SEQ ID NO: 31435 - DNA, 1296 bp, Artificial Sequence
  Description of Artificial Sequence: Synthetic coding sequence
atgtccacccggagtgtgtcaagctcctcttatcgacgcatgtttgggggaccgggaacagctagccgtccaagtagttctcgcagctacgtgactacatctacaaggacctactcactgggttccgccctgcgaccctctacctcccggtcactgtacgccagctccccgggtggcgtctacgccacgagatcctctgctgtccggttgagatcttccgtacctggagtcagactgctgcaggattccgtcgacttcagcctggccgacgccatcaatacagaatttaagaatacccgtaccaacgaaaaggtggagctgcaagagttgaatgacaggtttgctaactacattgataaagttcgattcctggagcaacagaataaaatcctgttagcagagttggagcagctcaaaggacaaggcaagtcacggctcggagatttatacgaagaagaaatgcgagaactccggagacaggttgaccagcttacaaatgacaaggcccgagtggaagttgagcgggacaatttggctgaagacatcatgcggcttcgggaaaaactgcaggaagagatgttacaacgcgaggaggctgaaaatacactgcagtctttcaggcaggatgtggacaacgcatccttggcaagattggacctggaaaggaaggtcgaatcgctgcaggaagaaatcgcctttctgaaaaagcttcatgaggaagaaattcaggagttacaagctcagatacaggagcagcatgttcaaatcgatgtggacgtatctaagccagacctcactgccgctctgagagacgttaggcagcagtatgagtcagtggcagctaagaacctccaggaggccgaggaatggtacaagtctaaattcgctgacctgagtgaggcagctaaccgtaataacgatgcgcttcgtcaggcgaagcaagaaagtacggaataccgtcgtcaggtgcaatccctcacttgcgaggtcgatgccctcaagggcaccaacgagagtcttgagagacagatgcgtgagatggaggagaacttcgcagtcgaggccgctaactaccaagatacaatcggtcgcttacaagatgaaattcaaaacatgaaagaggaaatggcccgacacctgcgggaatatcaggatcttcttaacgtaaagatggccctcgacattgagatcgcgacctaccggaaactgctcgagggcgaggagtctcggatctctctaccgttgcctaatttctcttcgttaaatttgcgtggcaagcattttatttccttgtag

SEQ ID NO: 31436 - DNA, 1401 bp, Artificial Sequence
  Description of Artificial Sequence: Synthetic coding sequence
atgtctacaagaagcgtatcctcttcatcttacagacggatgttcggcggacctggcacagcttcgcgtccctcatccagtaggtcatacgttacgacatcaactaggacatactccctggggtccgcactgcgcccatccacctcacggtcactgtacgcttcctcccccggaggtgtgtatgcaacacgttcttcggccgtccggctgagatcgtccgtccccggagttaggctcttgcaggacagcgtcgatttctcccttgctgatgctatcaacaccgagttcaaaaatacccggacaaatgaaaaagtcgagctccaggaactgaacgataggttcgccaattatattgacaaagtaaggtttctcgagcagcagaataaaatcctactggctgagcttgaacaattaaagggccaggggaagtcccgactcggcgacctgtacgaagaggagatgagggagctgaggcggcaagttgatcagcttaccaacgataaggcaagggtggaggtggaacgagacaacttggctgaggatattatgaggctgcgagaaaagctgcaagaagaaatgcttcaaagggaggaggctgagaacacacttcagagctttagacaggacgtcgacaatgcctccttggctcgactggatctggaacgcaaggtcgaatccctgcaggaggagatcgcattcctcaagaagctacatgaggaggaaattcaggagctccaggcgcagattcaagaacagcacgttcaaatcgacgtcgacgtcagcaagccagacctgaccgcagccctccgtgatgtacgtcagcagtacgagtctgtagcagctaagaatttgcaggaggctgaggagtggtacaagtcaaaattcgccgacctgtcagaggccgctaatcgcaacaatgacgcgttgcgacaagcgaaacaggaatccactgagtatcggagacaggttcagagtcttacttgtgaggtggacgcgctgaaaggaactaacgaaagtctcgagcgccagatgcgggagatggaggaaaactttgccgtggaggccgctaactaccaagacacaataggcaggctccaggacgaaattcagaacatgaaagaggagatggcgcgtcacctgcgcgaatatcaggatctgttgaacgtcaagatggccctcgacatcgagattgcgacatatcgcaaactgctcgaaggcgaggagtcacgaatctctcttcctctgccaaatttctcttccctgaacctcagagagaccaacctagattctctgccacttgttgatactcacagtaagcgcacactgctgatcaaaactgtggagacccgagatggccaagttataaacgaaacttcacaacatcatgatgatctggagtag

SEQ ID NO: 31437 - DNA, 1224 bp, Artificial Sequence
  Description of Artificial Sequence: Synthetic coding sequence
atgtttggaggcccaggcaccgcctcaagacccagtagttcccgctcttatgtcaccacaagcacacgaacctattctttgggttcagcacttaggcccagcacttctcggtctctctacgcgtcctctccaggcggtgtatatgctacaaggtcctccgcagttagactccgctcaagtgtccccggtgtgagactgctccaggattcagtggacttttccctcgccgatgcgatcaatactgagttcaagaacacacgcactaatgaaaaagtggagctgcaggaattaaatgatcgctttgctaattacatcgacaaggtgcgtttccttgagcagcagaacaaaattctcctggctgaattagagcagctgaagggccaaggtaaatcaagactgggtgacttgtatgaggaggaaatgcgggaactgcggaggcaagtagaccaacttacaaacgacaaagcaagagtcgaggtggagcgagacaaccttgcggaggacatcatgcggctgcgcgagaaactacaggaggagatgctgcagcgggaggaggccgagaatacgcttcagtctttccggcaggacgtggataatgccagccttgcacggcttgaccttgaaagaaaggtggaaagcctccaggaagagattgcatttctgaaaaaactccatgaagaagagattcaggaactccaagctcagatccaggaacaacacgtgcagatcgatgtggacgtctcaaagccagacctcactgctgctttaagggatgtgcgacagcagtatgagagtgtagccgctaaaaacctgcaagaggccgaagaatggtataaatcgaagtttgctgatttatccgaagctgcaaatagaaataatgacgctctgcgccaggccaagcaggagagtaccgagtacaggagacaagtgcagtccctaacgtgcgaagtagacgctctgaagggtactaacgagagcctggaacgtcagatgagagaaatggaggagaactttgcggtcgaggccgctaactaccaagataccatcggcaggttacaggacgagattcaaaacatgaaagaggaaatggcccgtcacctgcgggagtaccaggatctgctcaatgtgaaaatggccttagatatcgaaatagccacatatcggaaactccttgagggtgaggagtcacgcatattgtgtctgtttcagacattccccccatag

SEQ ID NO: 31438 - DNA, 2256 bp, Artificial Sequence
  Description of Artificial Sequence: Synthetic coding sequence
atggaagatctgtcatccccggactcaacactcttgcaggggggacacaatctgttatcttcggcctcattccaagaggctgtgacatttaaggacgtgatcgtggatttcacacaggaagagtggaaacagctggacccaggccagagagacctctttcgtgatgtcacactggagaactatacacacttagttagcatcgggttacaagtctccaaacccgatgtaatctctcaactggagcagggaacagagccttggataatggaaccatcgattcccgtgggaacatgtgctgactgggagacacgccttgaaaatagcgtgtccgcccctgagcccgacattagcgaagaagaactcagcccagaagtcatcgtggagaaacacaagcgtgacgacagttggagctccaatctgctggagtcctgggaatatgaaggcagtttggaacgccaacaggccaaccaacagactctccctaaggaaatcaaggtcaccgagaagaccattccatcctgggaaaagggcccagtgaataacgaatttggcaagtctgttaacgtgtcttcaaatctcgttacccaggagccatcacccgaggagacatctacaaagaggtcgataaaacagaactccaatccagtcaaaaaagagaagagctgtaaatgtaatgaatgtgggaaggccttcagctactgcagcgccctgattaggcaccaaaggacccataccggggaaaagccttataaatgtaacgaatgcgaaaaagcgtttagccgctctgagaacttaattaaccaccagcgaatccacacaggcgacaagccttataagtgtgaccaatgtggcaagggctttattgaaggaccgagccttacccagcatcagaggattcacaccggcgagaaaccatataaatgtgatgaatgcggaaaggcattctctcagagaactcatctggtgcagcatcagcggattcacacaggcgaaaagccctatacttgcaacgaatgcggaaaggctttttcacagcggggtcactttatggagcaccagaagatccataccggggagaaaccctttaagtgtgatgagtgtgacaagacttttactaggtccacccatctgacacagcaccaaaagattcacacaggagagaagacatataagtgtaacgagtgtgggaaggccttcaatggcccatctaccttcatccgccaccatatgatccacactggagaaaagccctacgagtgcaacgagtgcggaaaggctttctcgcagcactccaacctaacgcagcaccagaagacgcatacgggggaaaagccatatgactgcgcggagtgcggaaagtccttcagttattggagttccctcgctcagcatctgaagattcatactggtgagaagccctacaaatgtaacgagtgcgggaaagctttttcatactgttcaagcctgacccagcaccggaggatacatactcgcgagaaacctttcgagtgttctgagtgtggcaaagctttctcctacctgagcaatctgaaccagcaccagaagacacacactcaggagaaggcctatgagtgcaaggagtgtggtaaggcgttcattaggagtagtagtttggcaaaacatgaacgcatccacactggcgaaaaaccttaccagtgtcatgaatgtgggaaaacattcagttatggttcctctcttattcagcaccggaagattcacaccggggagcgcccttacaaatgcaacgagtgcggccgagcctttaatcagaacatccatttgacccagcataagcggattcataccggcgctaaaccttacgagtgcgccgaatgtggtaaggcttttaggcattgttccagccttgcccagcatcagaagacacacaccgaggagaagccatatcaatgcaacaagtgcgaaaaaacattttcgcagtcatcacacctaacgcagcaccagcggattcacactggtgagaaaccttataagtgcaatgaatgcgataaggccttctctagatcgacccatctaaccgaacatcaaaacacccacaccggtgagaaaccctataattgtaacgaatgcagaaagacttttagccagtccacttatttgattcagcaccagcgcattcactccggggagaagccttttggctgtaacgattgtggtaagagttttaggtatcgctctgccctgaacaaacaccaacggctgcatccgggaatttag

SEQ ID NO: 31439 - DNA, 3201 bp, Artificial Sequence
  Description of Artificial Sequence: Synthetic coding sequence
atgcccgtgttccatactagaaccattgagtccatcttagaacccgtggctcaacaaatttcccatctggttataatgcacgaagaaggggaagttgatggcaaagccatacctgatttaacagcacccgttgccgctgttcaggccgctgtttctaatttggtccgtgtgggaaaagaaaccgtgcagaccaccgaggatcagatcctgaaacgcgatatgcctcccgcttttataaaagtggagaacgcctgtaccaaattggtccaagccgctcagatgctgcaatcagatccctacagtgtgccagcgagagattatctgatcgacggcagccgaggtattctctccggaactagtgacctgttgttgacatttgatgaggccgaagtgaggaagataataagagtgtgcaagggcattctggaatacctgacagtggccgaagtggttgagaccatggaagacttagtgacttataccaagaatctcggcccagggatgacgaagatggctaagatgattgatgaacgccagcaggaacttactcatcaagagcatagagtgatgcttgtcaacagcatgaatactgtcaaagagctcctgcccgtactcatcagcgcaatgaagattttcgtaaccaccaagaactccaagaatcagggcattgaagaggccttaaagaacagaaactttacggtcgaaaaaatgtctgcagagattaatgagatcataagagtcctccagctgacctcttgggacgaggacgcatgggcttctaaagatacggaggctatgaaacgcgcattggcttcaattgattccaaacttaatcaggcaaaaggatggctcagagatccgagtgcctccccgggagatgctggcgagcaggctatcaggcagattcttgacgaagccggtaaggtgggagagctgtgtgcaggcaaggaaagaagggagatcctgggaacatgcaaaatgctgggacagatgacggatcaggtagccgacctcagggctaggggtcagggtagttctcccgtggccatgcagaaggcccagcaggttagccaggggctggatgtgctgactgctaaggtcgagaacgccgcacgaaagctcgaggcaatgaccaacagcaagcagtccattgccaagaaaatcgacgccgcacagaattggttggcagacccgaacggcggaccggagggagaggagcaaatacggggtgccttagctgaagcccgtaaaatagcagagctgtgtgacgatccaaaggaacgggacgatatcctccggtccctcggcgagatcagcgccctcacctctaagctggccgatctgaggcggcagggaaagggagacagcccggaggcccgagcactcgcaaagcaggtggccactgccctgcagaacctccaaaccaagacaaaccgtgccgtggcgaactccaggcccgcaaaggcagccgtgcacctcgagggcaaaatagagcaggcacagagatggattgacaatcctacagtcgatgaccggggtgttggccaggcagccattagagggctcgtggcggaaggccataggcttgctaacgtgatgatgggaccatacaggcaagatctgctggctaaatgcgaccgcgttgaccagctcactgctcagctcgctgacctagccgctcggggagaaggcgagagccctcaggccagagcacttgccagtcaactccaggatagtctgaaggacttaaaagcgaggatgcaggaagctatgactcaggaagtttccgatgtgttttctgatacaactactccaatcaagctgctcgccgtggccgctaccgcaccccctgacgcccctaatcgcgaggaagtattcgatgaaagggctgctaactttgaaaaccacagcgggaaactcggtgcgaccgcggagaaggccgctgctgtgggtacagcaaataaatctacagtcgagggtatccaagcaagtgtcaagactgccagggagttgacaccccaggtggtgtccgctgctaggatactgctgaggaacccagggaaccaagctgcctacgagcactttgaaaccatgaagaatcagtggatcgataacgtggagaagatgactggactcgttgatgaagcaatcgatacaaagagtctgctggatgcttccgaagaagccatcaaaaaagatctggataagtgcaaagtcgcgatggcaaatatacagccacagatgctggtcgccggtgccacctcaatcgcgaggcgagctaatcgaatccttcttgtagccaaaagggaggtggagaattccgaggatcctaagttccgggaggctgttaaggcagccagcgatgagctgagcaagacaattagccccatggttatggacgccaaggcagtggccggaaacatctctgatcctggactccagaagtcctttctggattccgggtataggatattgggagcagttgccaaagtcagagaagccttccaaccacaagagcctgattttcctcccccacctcccgatctcgagcaacttcggttaacagacgagcttgctccaccaaaaccccctctcccggaaggtgaggtgcctccgcctcgacctccaccccctgaagagaaggacgaagaatttccagagcagaaagccggagaagtcataaaccaacccatgatgatggctgcaaggcagttgcatgatgaggccaggaagtggtcgagcaaaggtaacgatatcatcgctgccgcaaagcggatggccttgctgatggcagaaatgagtaggctggttcggggaggcagcgggaccaagcgcgcactgatccagtgcgcaaaggacatcgctaaggccagtgatgaggtaacacggctcgctaaggaggtagcaaagcagtgtacagacaagagaattaggactaatttactccaagtttgcgagcggatacccaccatctccacacaattgaagatcctgtctaccgttaaggctaccatgctgggtcgaactaatatcagtgatgaagagtccgaacaggccaccgagatgttggtccacaacgcgcagaatctcatgcaaagcgtaaaggagactgtacgtgaggctgaagccgcatctataaaaattcgaaccgacgccggttttaccctgcgctgggtgcgaaagaccccttggtatcagtag

SEQ ID NO: 31440 - DNA, 2784 bp, Artificial Sequence
  Description of Artificial Sequence: Synthetic coding sequence
atgctccaaagcgacccgtacagcgtgccggctagagactatctgatagacggcagccgcggaattctctcaggcacaagtgacttacttctgaccttcgatgaagctgaagttcgcaagataatcagggtgtgtaaggggatcttggagtacttaactgtggcagaggtggtcgagacgatggaagaccttgtaacgtacacaaagaacctaggacccggaatgactaagatggcgaagatgatcgatgagcggcagcaagaattaacccatcaggagcaccgcgtgatgcttgtgaatagtatgaacaccgttaaggaactgcttccagttctgatcagtgccatgaaaatcttcgtcaccacaaagaactctaaaaatcagggcattgaggaggccttgaaaaaccgaaattttactgtagaaaaaatgagcgctgagattaacgagatcattagagtactgcagcttacctcctgggacgaggatgcttgggcatcaaaagacactgaagccatgaaacgtgccctggcttccatcgatagtaaacttaaccaggccaagggctggttgagagatccatccgcctctcctggagacgctggggaacaggccatcagacagatcctggacgaggccggtaaagtaggcgaattgtgtgccggaaaagagaggcgcgaaatactgggcacatgcaaaatgctcggccagatgactgaccaagttgctgatcttagggcccgtggacagggcagcagtcctgtggccatgcagaaggctcagcaagtttctcagggtcttgacgtgcttacagccaaggtggagaatgctgccagaaagctggaggctatgacaaattccaagcagagcatagcaaagaaaattgatgcagcacaaaattggctggcagaccccaacggaggcccagagggtgaggaacagataagaggcgcactagctgaggcgagaaaaatcgcggaactgtgtgatgatcccaaggagcgggacgatattcttagatcactgggtgagatctcagctctcacttctaagcttgcagacttgaggcgccagggtaagggagattctcctgaggctcgcgcactggcaaaacaggttgcgaccgccctgcagaatctgcagaccaaaacaaaccgagcagttgccaacagtaggccagcgaaagcagctgtccatctcgaagggaaaattgaacaggcccaaagatggatcgacaaccccacggtggatgaccggggtgtcggacaagcggcaatcaggggcttggttgccgagggacatcggctggcaaatgtgatgatgggaccttatcggcaggacttactggccaaatgtgatcgggttgaccagttaactgcacagctcgcagacctggcagcgcgtggcgaaggagaatccccgcaggcacgggctctggccagtcagttgcaggactctctcaaagacctcaaagcccgtatgcaggaagcgatgacccaggaggtttccgatgtgttctcagatacaacaaccccaataaagctactggccgtcgctgccaccgcgccaccagacgcacctaaccgggaagaagtattcgatgaacgcgcagcaaactttgagaaccatagtggcaagcttggagccacggctgagaaagcagccgcagtcggcacagccaacaagagcacggtggagggcattcaggcttccgtgaaaacagctcgcgaactaacgccccaggtggtgtcagctgccagaatactgcttcggaacccaggaaaccaggctgcctacgaacacttcgaaaccatgaagaatcagtggattgacaacgtcgaaaaaatgacaggcctggtggatgaagctatagatacgaaaagtctactcgacgctagtgaagaggcgattaaaaaggatctggataaatgtaaggtggctatggctaacatccagccccagatgctggttgcaggcgctactagtatagccagacgagcaaacagaattctcctggttgctaaaagggaggtcgagaactccgaagacccgaaattccgagaggccgttaaagcggcaagtgacgaactgtctaaaactatctccccgatggttatggatgctaaggctgtggccggtaatatctccgacccaggtctgcagaaatccttcttggattcggggtataggatccttggggctgttgctaaggtccgagaagccttccaaccccaggaacccgattttccgcctcctccacccgacctcgaacagctcagactgacggatgaattagctccccctaagccaccgctcccggagggggaggtgccaccccctagaccaccgccaccagaggagaaagacgaggagtttcctgaacagaaggctggtgaggtgattaaccagcctatgatgatggcagcacgacagctgcatgacgaggcaaggaagtggagttcaaaacccggaatacccgcagcggaagtgggcattggtgtggtcgccgaagccgacgccgctgacgcggctgggtttcccgtaccacccgatatggaggacgattacgagcccgaattgcttctaatgcctagcaaccagcctgtgaaccaaccgatcctcgccgcagcccaatccctccaccgtgaagctaccaaatggtccagcaaagggaacgatatcattgccgcagcgaagcgtatggcccttctgatggccgagatgtcccgcctggtgcgcggaggctccgtcccaaggacctctcctcgtccccagatgagatag

SEQ ID NO: 31441 - DNA, 984 bp, Artificial Sequence
  Description of Artificial Sequence: Synthetic coding sequence
atgcctgtgttccacacgagaaccatcgagtcgattctggagcccgttgcccagcagatctcacatctggtaattatgcacgaggaaggtgaagtagacggtaaagctattcccgatcttaccgcacccgtggctgccgtccaggccgctgtgtcgaatctcgtccgggttggaaaggagaccgtgcagactaccgaagaccagatcctcaagagggatatgcctccagcatttataaaagtggaaaacgcctgcacaaaactcgtgcaagcagcccagatgctgcaatccgatccatattcagttccggctcgcgattacctgattgatggctcacgcggtatcctatccggcacatcagatctgctgttaacttttgatgaagccgaggtcccacccccacggcctccgccacccgaagagaaggacgaggagttccccgagcaaaaggccggtgaggtgataaatcagcccatgatgatggcagcacgccagctgcacgatgaagctcgcaaatggagtagcaaggggaacgatatcatcgcggctgcaaaacggatggcccttctcatggctgagatgtctagactggtccgcggaggatcaggtaccaagcgggctttaatacagtgtgccaaggatatcgctaaggcttcagatgaggttacaaggctagccaaagaagtggccaagcagtgcacagacaagagaattcgcacgaatctgttacaagtctgcgagaggatccctacaatttccacacagctcaaaattctgtctacagtaaaggccacaatgttaggtcggacaaacatcagcgacgaggagagtgagcaggccactgaaatgctggtgcacaatgcccagaacttgatgcagagtgttaaagaaacagttcgggaggcagaagcagcttcaatcaagatcagaaccgacgccggatttaccctgagatgggttcgcaagacaccttggtaccagtag

SEQ ID NO: 31442 - DNA, 2421 bp, Artificial Sequence
  Description of Artificial Sequence: Synthetic coding sequence
ggccaaatgactgaccaggtcgctgatctgcgagctcgcggacagggatcttccccggtcgctatgcaaaaggcccagcaggtgtcccaaggcctggacgtgcttacagcaaaagtcgagaacgccgcacgcaagctggaggccatgaccaactcgaagcagagcattgctaagaaaattgatgccgctcagaattggctggccgatccgaatgggggtcccgaaggcgaggagcaaatacggggagcactggcggaggctaggaaaatcgcagagctgtgcgatgaccctaaggaaagagatgatatactaagatctcttggcgaaatcagcgcccttacctccaagctggcagatctccgaagacagggcaaaggagattcaccagaggccagggccctggctaaacaggtcgcgactgcacttcagaatctgcagactaaaaccaatcgcgctgtggcaaacagccggccagccaaagctgccgtccatctggaaggcaaaattgaacaagcacagcgttggatagacaatccaactgtggacgaccgaggcgtcggccaagccgctatcaggggcttagttgctgagggacatagactggccaatgtgatgatgggcccttacagacaggacttactggcaaagtgtgacagagtcgatcaactgacagcacagctggccgacctggcagcccgaggtgagggggagagccctcaggcccgtgctcttgcttcccagcttcaggacagcctcaaagatcttaaagcccgtatgcaggaggcaatgactcaggaggtgtcagatgtctttagtgacactaccacacccatcaagctgctggcggtagctgccaccgccccacccgacgcccctaacagggaggaggtgttcgacgaacgggctgcgaacttcgaaaaccatagcggcaaactgggtgccacggccgagaaagccgctgcagtggggactgctaataaatccactgtagagggtattcaggcatccgtgaagacagcacgcgaactgacaccacaagtcgttagtgccgcacgtattttgctgcgaaaccctggcaaccaggcggcatatgagcacttcgagaccatgaagaaccagtggatagacaacgtcgaaaaaatgacgggcttagttgacgaggctatcgataccaaatctctgttagacgcctccgaggaggctatcaagaaggacctggacaaatgcaaggtagctatggccaatatacagccccagatgctggttgcgggagccacttccattgcacgaagagctaatcgcatcctgcttgtagctaagagggaggttgagaattcggaggatcctaaattcagagaagcagtcaaagctgcttccgacgagttaagtaaaacaatctctccaatggttatggacgccaaggccgtggctggcaacatcagtgaccccggtttgcaaaaaagtttcttagactcgggctaccgcatcttgggggcagtcgctaaagtccgggaagcctttcagcctcaggaacctgactttccgcctcctcccccagacctcgagcagctgcgcctgacagatgagctggcaccacccaagcctcctctgccagaaggcgaagtgcctccacccaggccaccccctccggaggaaaaggatgaagagtttcctgagcagaaagcaggtgaagtcatcaatcagccgatgatgatggccgctagacagctgcacgatgaggcacgcaagtggagttcaaagcctgggattcccgctgcggaagtgggcattggagtcgtggcagaagcagacgcggctgatgctgccggttttccagtgccccctgacatggaagatgactatgagcctgagctgctgctgatgccgtcaaaccaaccagtgaaccagccaatactcgccgcagctcaatccctgcatcgcgaggctacaaaatggagtagcaaggggaacgacattattgccgcagctaaacggatggcattgctgatggctgaaatgtccaggctggtccgagggggaagcgggactaagagagcacttatccagtgcgcaaaagatatcgctaaagcatccgacgaggtgaccaggctggctaaggaggtggctaagcagtgcacggacaagcgcattcgcaccaacctgctccaagtgtgtgagaggatcccaacaattagcactcagctgaagatactgtctaccgtgaaagcgacaatgctgggacgaactaatatatccgatgaagagtctgaacaggccactgagatgctagtacataatgcacagaacctcatgcaatcagtgaaggaaaccgttcgcgaagccgaggcggcaagcattaagattagaacggatgctgggttcaccctgaggtgggtgagaaaaacaccttggtaccaatag

SEQ ID NO: 31443 - DNA, 3021 bp, Artificial Sequence
  Description of Artificial Sequence: Synthetic coding sequence
atgccccctgcctttatcaaggtcgaaaatgcatgcactaagctggtgcaggctgcccagatgctgcaatccgatccatacagcgtgcccgctagagattacctcatcgacgggtcacggggtatattgagcggtactagtgacctcctgctcacctttgacgaagctgaggtgaggaagattattagggtgtgcaaggggattttggaatatctaactgtggcagaagtggtagagacaatggaggatctggtcacttacaccaagaaccttggaccaggtatgactaagatggccaagatgatcgacgagaggcagcaggagctgacccatcaggagcatcgagttatgctcgttaactcgatgaacacggttaaagagctcttaccagtgctaatctctgccatgaaaatctttgtgactactaaaaactctaaaaaccaaggtatcgaagaggccctcaagaacagaaatttcactgtcgaaaaaatgtcagcagaaattaacgaaatcattcgtgtgctgcagctcacctcctgggatgaggacgcatgggccagcaaggacaccgaggccatgaaacgcgcactcgcctctatcgattcgaagctcaatcaagccaagggctggctgcgggacccctccgctagcccaggcgatgctggggagcaggcaatccgtcaaatcctcgacgaggcaggaaaggttggcgaactgtgcgcgggtaaggagagacgggaaatcttaggtacttgtaagatgctcgggcaaatgaccgaccaggtggctgatctcagggctcggggtcagggctctagtccagtcgcaatgcagaaggctcaacaggtatcccaaggactagatgtgttaacggccaaagtggagaacgccgcacgtaaactggaggccatgaccaattctaaacagtcaattgccaagaagatagacgccgctcaaaactggctggcggatcctaacggtggccctgaaggagaagagcagatcagaggcgcactcgcggaggctaggaaaatcgccgagctctgcgacgatccgaaagagcgcgatgatattttgcggtctctgggagaaattagcgccctcacgagtaagcttgccgacctgcgccgtcagggcaaaggggatagcccagaagcccgtgctttagcaaagcaggtagccaccgccctccagaacctgcaaacaaaaacaaatcgggcagtggctaacagtaggcccgctaaagcagctgtgcacctggaaggaaagattgaacaggcccagcgctggattgacaatcctacggttgatgaccggggagtgggacaggctgctatccgcggattggtggctgagggacatcgactggcgaatgtcatgatggggccttatagacaggacttgctggcaaagtgcgacagagtagatcagttaaccgctcaactggctgatctggccgctcgaggtgaaggagagagccctcaggcccgagcactggcatcacagctgcaggattcactcaaggacttgaaggcacgaatgcaggaggccatgacccaggaggtctcggatgtattcagcgacactacaactcccataaagctcctggccgtagccgctaccgccccaccagatgccccaaaccgagaagaagtattcgacgagcgggctgccaacttcgagaatcactctggcaaactgggcgctacagccgagaaagccgctgccgtgggcaccgcgaacaaaagcacagtcgaagggatccaggcctctgtaaagactgccagagagttaactccacaagttgtgtcggccgcacgcatcttacttcgcaacccaggcaaccaggccgcatatgaacatttcgagacaatgaagaatcagtggattgataatgtagagaagatgactggcctcgtggatgaagccattgacactaagtctctcctggacgctagcgaagaggccattaagaaggacctggataaatgtaaggtggcaatggccaatatacaaccacagatgttagttgccggagcgacatcgattgcaagacgagccaatcggattctgctggtggccaagagggaagtcgagaactcagaggacccaaagttccgggaagctgtgaaggctgcctccgatgagctctccaagacgatttctcctatggttatggacgccaaagccgtggccggaaacatttcagatccagggcttcaaaagagctttctagacagcgggtaccgaattttgggtgccgtggccaaagtgagggaggcatttcagccccaggaaccagattttcccccacctcctccagatttggagcaattaaggcttaccgacgaacttgcccctccaaaacccccattgcctgaaggggaagtgcctcctcccaggccccctccacctgaggagaaagacgaggagttccccgaacagaaagcaggagaagtgataaaccagcccatgatgatggccgctagacagctccatgacgaggccagaaagtggtcttccaaggggaatgatatcatcgccgctgccaagcgaatggctctgctcatggcagaaatgtccagactagtgagaggagggagcggtaccaagcgggctctgatccaatgcgcgaaagacatcgcaaaagctagtgacgaggtcaccaggctggctaaagaggtggctaagcagtgcacagataaacgaatccgcaccaacctgctacaagtatgtgaacgcattcccacaatatccactcaattaaagatcctgtccaccgttaaggcaacaatgttgggccgaacaaacatcagcgacgaggagagcgagcaggcaacagaaatgctcgttcataatgcgcagaacctgatgcagtctgtcaaagagaccgttagggagctaaaactgctgcagagtaaatttgaacaaatgctagacctgcactgtgctggcctcgaacggctgccaggcacatccagacaccttgcagagcctggatggcatcgaaacttgtattag

SEQ ID NO: 31444 - DNA, 570 bp, Artificial Sequence
  Description of Artificial Sequence: Synthetic coding sequence
atgactgagtacaagctggtcgtggttggagccggaggagtaggaaagtctgccctgacaatccagttaatccagaatcacttcgtcgatgaatacgatcctacaattgaggactcttataggaagcaggtcgttattgacggagaaacctgcttactggatattttggatacagcaggccaggaagaatatagtgcgatgcgtgaccaatacatgcgcacaggagaaggattcctctgtgtgttcgcgattaacaataccaagagtttcgaagatattcatcactaccgggaacagattaagagagtcaaggactccgaggacgtgcccatggtactcgttggcaacaagtgcgacctcccgagccgtacagtagacacaaagcaggcccaggacctggccaggtcttatggaataccttttatagagactagtgcaaagactcgtcagcgcgtagaagacgcgttttacacactggtgcgggaaatcagacagtaccggctaaaaaaaatttctaaggaagaaaagacacctggatgtgtgaagattaaaaaatgtatcataatgtag

SEQ ID NO: 31445 - DNA, 567 bp, Artificial Sequence
  Description of Artificial Sequence: Synthetic coding sequence
atgaccgaatacaaactggtcgtggtgggtgcaggtggtgtgggcaagtcagccctgaccatacagttgattcagaaccattttgtggacgagtatgatccgacaatcgaggacagttatcgcaaacaggtggtgatcgatggggaaacatgtctcctggatatactcgacactgccggtcaggaagagtatagcgctatgcgcgaccagtacatgaggacaggggaaggctttttgtgtgtcttcgcaatcaacaacaccaaatctttcgaagacatccaccactacagggagcaaataaaaagggtgaaagactcggaagacgtccccatggtgttggtgggcaataaatgtgatctgccctctcggacagtggacacaaaacaggcccaggatctggccagatcctacggcattcctttcattgaaacatcagccaagacccggcagggggtggatgatgccttctacacgctcgtcagggaaataaggaagcataaagagaaaatgtctaaagatggtaagaaaaagaagaagaagtccaaaaccaagtgtgtgattatgtag

SEQ ID NO: 31446 - DNA, 228 bp, Artificial Sequence
  Description of Artificial Sequence: Synthetic coding sequence
atgactgaatacaagttggtcgtggtaggcgctggcggagtaggcaagtctgctctaactatccagctgattcagaaccactttgtcgatgaatacgatcccacaattgagggcgttgacgacgctttttatactctcgtgagagagattcgaaaacataaagaaaagatgtcaaaggatggaaaaaagaagaagaagaaaagcaagaccaaatgtgtgatcatgtag

SEQ ID NO: 31447 - DNA, 2931 bp, Artificial Sequence
  Description of Artificial Sequence: Synthetic coding sequence
atgagaggagctagaggtgcctgggattttctttgtgtgctcttacttttactgcgcgtccagaccggatcctcccagcctagcgtgtctcccggtgagcctagtccccctagcattcaccctggaaaatccgatctgatagtgcgggtgggtgacgaaattaggctcctttgtactgaccccggatttgtgaagtggacgtttgagatcctggacgaaaccaacgaaaataaacagaatgagtggattactgagaaagctgaggcgactaataccggaaagtacacgtgcaccaataagcatggactgagtaactcaatatacgtcttcgtgagagacccagctaaattgtttcttgttgatcggagcctgtacgggaaagaggacaacgatactctagtacggtgtccgctgaccgatcctgaggtgacaaactactccctgaaaggatgccagggtaaacccctgccaaaagaccttcggttcattccagatcccaaagccggtatcatgatcaaatcggtgaagcgagcctaccatcggctttgcttgcactgcagtgtggaccaggaaggaaagagcgtgttatccgagaagttcatactcaaagttcgtcctgcgttcaaggctgtgcccgtagtcagtgtctcaaaagctagctatctcctgcgagagggagaggaatttacggtcacttgcacgatcaaagacgtgagctccagtgtatattcaacctggaaacgggaaaactctcagaccaagttgcaagagaagtataacagctggcaccacggggacttcaattacgagagacaggctaccctgaccatcagctccgcacgcgtgaatgattcaggtgtcttcatgtgttatgccaataacacgtttggcagcgcaaacgtgaccacaacactggaagtggtggacaaggggttcatcaacattttcccaatgatcaacactacggttttcgtgaatgatggagagaacgtggatttgatcgtagagtacgaggcgttccctaaaccggaacaccagcaatggatttacatgaatcgtacatttactgacaagtgggaagactaccctaagtctgaaaacgaaagcaacatacggtacgtgagtgaactccatctcacaagactcaaaggcacagagggaggtacatatacgttcctggtgtccaacagcgatgtgaacgctgctattgcattcaatgtgtacgtgaatactaaacccgagatcctgacctacgaccggttagtgaacggcatgttacagtgtgttgcagctggttttcccgagcccacaatcgattggtacttttgtcctggtactgaacagcgctgtagcgcctcggtgcttccagtggatgtgcagaccctgaacagctctggcccacccttcggtaagctggtggtgcagtcttctatagacagcagtgcctttaagcataatgggaccgtcgaatgtaaggcttataacgatgtgggaaaaacttctgcttacttcaatttcgccttcaaaggcaataacaaggaacagattcatccccacaccctgttcacccccctgttgatagggtttgtgattgttgctggtatgatgtgcatcattgtgatgatcctcacatataaatacctgcaaaaacccatgtacgaggtgcaatggaaggtggtggaggaaatcaatggcaataattatgtgtacattgatccgacacaattgccctacgatcacaagtgggagtttcccagaaatcgactgtcttttggcaagactctaggcgctggcgctttcggcaaggtcgtggaggctaccgcctatgggttgatcaagagtgatgctgcaatgactgtcgctgtgaaaatgttgaagccctctgcccatctaactgaacgggaggcattgatgtctgagcttaaggtgctgtcttatctcggaaaccacatgaacatcgtgaacctgctgggtgcatgtactattggtggccctaccctggtgatcaccgagtattgctgctatggcgatctgttgaatttcttgagacggaagagggatagtttcatctgctctaagcaggaggaccatgccgaggcagccctttataagaacctgctgcacagcaaagagtcatcctgctctgattctaccaatgaatacatggatatgaagcctggcgtcagttatgttgtccctacaaaagcggataaaagaagatcagtgagaattggtagctatatcgaacgcgatgttacacccgcaatcatggaagacgatgaactggcactggacctggaggatctgttgtcattctcctaccaggtggctaagggaatggcctttctggcatcaaaaaactgtatccaccgagacctggcggcaaggaatattctcttgacccatggtcggatcacgaagatatgtgactttggcctggctagggacattaaaaatgactcaaattacgtggttaaaggtaacgctcggctaccggtgaagtggatggcgccagaaagcatcttcaactgtgtgtacacgtttgagagcgacgtatggagctatggaattttcctttgggagctcttttcccttggatcatccccctaccccggaatgccggtcgactctaagttttacaaaatgatcaaggagggattccggatgctttccccagaacacgcgcctgccgaaatgtatgacattatgaagacctgttgggacgccgacccccttaagaggcctacattcaaacagattgtacagctgatcgaaaaacagatcagtgagtccactaatcatatctacagcaatctggccaactgctcccccaatcggcaaaaacctgtcgtggaccacagcgtgaggattaactccgtgggatccactgcaagctcctcccagcccctgttagtccacgacgatgtttag

SEQ ID NO: 31448 - DNA, 2919 bp, Artificial Sequence
  Description of Artificial Sequence: Synthetic coding sequence
atgcgcggtgcccgtggcgcttgggatttcctgtgtgtgctgctgctgctgttacgtgtgcagaccgggtcttctcagccctccgtgagccctggcgaacctagtccgccttccattcacccaggcaaatctgacctgattgtgagggtaggcgatgagattaggctgctgtgcactgaccctggttttgtgaaatggacatttgagattctggatgagacgaatgagaacaagcaaaatgaatggattactgagaaagcggaggccacaaatactggaaaatatacttgtaccaataagcatggcctgtccaacagcatatatgtcttcgtcagggatccagctaagctctttctcgttgaccgatctctgtatgggaaagaagataacgatacgttagtccgctgtccgctgaccgacccggaggtcacaaactatagtctgaagggttgccaggggaagcccctccctaaagacttacggttcatccctgatccaaaggctggcatcatgataaagagtgtgaagcgggcttaccatcgcctgtgcctccattgtagcgttgatcaggagggaaagtcagtactcagcgagaagtttatcctaaaagtaagacccgctttcaaagcagtgcccgtagtttccgtgtcgaaagcctcctaccttttacgcgaaggggaagagtttaccgttacatgcactattaaggatgtaagttcaagcgtttactcaacgtggaaacgggaaaactcccagacaaagctgcaagaaaagtataatagttggcaccacggagacttcaattatgagagacaagccactttgactatcagctcggctcgggtcaatgactccggcgtgtttatgtgttatgcaaacaacaccttcggaagtgccaacgttacaaccacactggaggtcgttgacaaagggtttattaacattttccctatgattaatacgacagtgttcgtgaacgacggcgaaaacgtagatttaatcgtcgagtacgaggctttcccaaagcccgagcaccagcagtggatctacatgaaccgcacgttcaccgataagtgggaagactacccaaaatctgagaatgagagtaacattcgatacgtatccgaattgcacctgacaagactgaagggtaccgagggcggtacatacacctttctggtttctaatagtgacgtgaacgccgctatcgctttcaacgtctatgtaaatactaagccggagatcttgacttatgaccgattggtgaatgggatgttgcagtgcgtggctgccggattccctgagcctacgattgactggtatttctgtcctggcaccgagcagaggtgctccgctagcgtccttcctgttgacgtgcaaactctgaacagctccgggcctccattcggaaagctggtggtgcagtcttccattgacagctcagccttcaagcataatggcacggtggagtgcaaggcatataacgatgtgggaaagacaagcgcctacttcaatttcgcttttaaggaacaaatacaccctcacactcttttcaccccgttgctgataggtttcgtgatcgtggctggcatgatgtgtatcattgtcatgatccttacctataagtatcttcaaaagcccatgtacgaggttcaatggaaggtggtagaggagattaacggcaataactacgtgtacatcgaccccacacagctcccttatgaccacaaatgggagttccctcggaatcgtctctcgtttgggaaaacacttggggcaggtgccttcggtaaggttgtcgaggcaaccgcgtacgggctcatcaagtcggatgccgcaatgacagtggccgttaagatgctgaagccatctgctcacctgacagagagagaggctctgatgtccgagctaaaggtgctgtcctacctgggcaaccacatgaatattgttaacctgctcggggcttgtacaatcgggggtccgacactcgtcattactgagtattgttgctatggtgacctgctaaactttctgcggcgtaagcgcgactcctttatttgtagcaagcaagaggaccacgcggaggctgcactatacaaaaatctgcttcacagtaaggaaagttcatgctcggactccaccaatgagtacatggacatgaaaccaggcgtgagttatgtcgtgcccacaaaggctgacaaacgaagatctgttcgcatcggcagctatatcgaaagagacgttactccggctataatggaggacgatgaactcgccctggatctcgaagacctgctttccttcagctatcaggtggccaaaggaatggcattcctggcatcgaagaattgcatccatcgagatctcgccgcacggaacatactcctgacccatggccgtatcacaaagatatgtgacttcggcctcgcccgtgacatcaaaaacgactctaattacgttgttaaagggaacgctcgcctccctgttaagtggatggcccctgaatccatcttcaattgcgtctacacatttgagtctgatgtttggtcttatgggatattcctttgggagcttttctctcttggctcatcaccatatcctggcatgcccgtggacagcaagttctataaaatgatcaaggagggctttagaatgctgtctcccgaacacgcgcctgcagagatgtacgacatcatgaagacctgctgggatgctgacccattgaagaggcctacctttaagcagatcgtgcagctcattgaaaagcagattagcgaaagtaccaatcacatctattccaacctggctaactgctcccctaataggcagaagcccgttgtcgaccacagtgtgaggattaattctgtgggctccactgctagcagcagccagccacttctggtgcacgatgatgtgtag

SEQ ID NO: 31449 - DNA, 1242 bp, Artificial Sequence
  Description of Artificial Sequence: Synthetic coding sequence
atgcgcggagcaagaggggcttgggactttctgtgcgtgctccttttgcttctgagggtgcagaccggcagctcacagcccagtgtgagccccggagaacctagccctccatctattcaccctggcaagtccgatctgatcgtgcgcgtcggtgatgagatcaggctgctgtgtacagatccaggcttcgttaaatggacgtttgagattcttgacgaaactaacgagaacaaacagaatgaatggatcaccgaaaaggctgaggccactaatacaggaaagtacacttgcaccaacaagcacggcctgagcaatagcatttacgtatttgtacgggaccccgcaaagctcttcctggtggacagatctctctacgggaaagaggacaatgacaccctcgtgagatgcccactgactgatcctgaggtaacgaattactctttgaaagggtgccaggggaaacccctgcccaaggacttgcgcttcattcccgacccaaaagccggaatcatgatcaagagcgtcaaaagagcttatcaccggctgtgcctccactgttctgtggatcaggaggggaagtcggtgctgtcagagaaatttattctgaaggtgcggcctgctttcaaggcagtgccggtcgttagcgtttctaaagctagctaccttctgcgggaaggggaagagttcactgtcacatgcaccattaaggatgtctctagctcggtctacagcacctggaaacgggagaacagtcagactaagctccaagaaaaatacaactcatggcatcacggggacttcaattacgagcgtcaagctactctcacaatctcgagcgcccgagtgaacgattcaggcgtgttcatgtgctacgccaacaatacattcgggagcgccaacgtcacaactactctcgaagtagttgataaagggtttataaacatttttcccatgataaatactacggttttcgtgaatgacggggagaatgtcgacctgattgtcgaatatgaagcgtttccaaagccagaacatcaacagtggatctatatgaataggacttttactgacaagtgggaagactacccaaaaagcgagaacgagtctaatatcaggtacgtgtctgaactccatctcactcggttgaaaggtacggagggcggaacttatactttcctggtgtcaaacagtgacgttaacgctgcaattgccttcaatgtgtacgtcaatagcaaactctag

SEQ ID NO: 31450 - DNA, 1212 bp, Artificial Sequence
  Description of Artificial Sequence: Synthetic coding sequence
atggcctcagagttggccatgtccaattccgaccttcccacgagcccactcgccatggagtacgtcaatgatttcgatctgatgaaatttgaggtgaagaaagagccagtggaaacagataggatcatttcccagtgcgggaggctgattgccggaggctccttgtctagcacaccaatgagtactccatgtagctcagtgccaccctcaccttccttctcagctccctcaccaggttccggaagtgaacagaaagctcacctggaagattactattggatgactgggtacccacagcagctgaatcccgaggctctcggctttagtcctgaggatgcagtcgaggcactgatcagtaactcacaccagctccagggtggattcgacggatacgcccgtggagctcagcagctggctgcagcagctggtgctggagcaggagcttccctaggaggaagcggcgaggagatgggacccgctgctgccgtcgtctccgccgtgatcgcggcagccgcagcccagagtggtgccggaccgcattatcatcatcatcaccatcatgccgcaggacatcatcaccaccctaccgccggtgctccaggtgccgctggctcagctgcggcatccgctggaggtgcaggcggagctggaggtggtggacctgcctctgcaggcggaggagggggtggcggtggcggaggtggaggcggaggggctgctggtgctgggggagcgctccatcctcatcatgctgccggtggactccacttcgatgatcgcttcagtgacgaacagcttgtgactatgtcggtgagggagttgaacaggcagctgaggggcgtaagcaaagaggaagtgatcaggctcaaacagaaacggaggacactgaaaaaccggggatacgctcagagctgtcgcttcaagagagtgcaacaaaggcacgttttggagagcgaaaagaatcagctcctgcagcaagtggatcatctgaaacaggaaattagccgtctcgtgagggaaagagacgcctacaaggaaaaatacgaaaagctggtctccagcggtttccgggaaaacggctcctcctctgataatcctagtagtccggaattcttcatcacggagcccactagaaaactggagccttcagttggctacgccaccttctggaagccccaacacagggttctgacatctgtgttcacaaagtag

SEQ ID NO: 31451 - DNA, 1122 bp, Artificial Sequence
  Description of Artificial Sequence: Synthetic coding sequence
atggcctccgaactggctatgagcaattctgacctccccaccagccctctggctatggagtatgtcaatgacttcgacctgatgaaattcgaagtgaagaaggaaccagtcgaaacagaccgcattatcagtcagtgcggtagattgatcgcaggtgggtccctcagctcaacacctatgtccactccttgttcttcagtgcctccctccccttcttttagcgctccaagcccgggttctgggagtgagcaaaaggcacacctcgaggactactattggatgactgggtacccacagcagcttaaccctgaggctttggggttcagcccggaggacgccgtggaagcgctcatttcaaattcacatcaactgcaaggtggatttgatgggtatgccaggggcgcacagcagctcgcagctgccgcaggagcgggtgctggagcatctctcggcggtagtggcgaggagatggggccagctgcagccgtagtcagtgcagttatagctgcggctgcagcccaatctggcgctgggccacattaccaccatcaccaccatcacgcagcgggtcaccatcaccaccctactgccggagccccaggcgcagccggatcagctgccgcttctgccggtggtgcagggggtgccggagggggaggacccgcaagcgcaggaggcggaggaggcggaggcggtgggggtggcggaggaggcgctgccggtgcagggggtgccttgcacccacatcatgccgcaggcggacttcacttcgatgatcgcttttccgatgaacaactcgtaaccatgtccgtgagagaactcaatcggcagctgagaggagtctccaaggaggaagtgatccggctcaagcagaagcgacgtaccctgaagaatcggggttacgcccagagctgtcgctttaaaagagtgcagcagaggcatgtactggagtcagagaaaaatcaacttctgcagcaggtggaccacctgaagcaggaaatctcccggttggtacgtgaacgcgacgcatataaggagaagtacgagaaactcgtgtcgtcaggcttccgtgaaaatggatctagttccgataacccatcgtcaccagagttttttatgtag

SEQ ID NO: 31452 - DNA, 1062 bp, Artificial Sequence
  Description of Artificial Sequence: Synthetic coding sequence
atggcagcggagctggcgatgggcgctgagctgccctcatcccctttggccatcgagtatgtaaacgattttgacctgatgaagtttgaagtcaagaaagagccaccggaagccgagagattctgccacaggttaccaccagggagtctttcatcaaccccgctcagcactccctgtagctcagttccatcttcaccgtccttctgtgccccatcccccggtaccggcggtggcggaggcgctggcggagggggaggctctagccaggccggtggcgcaccgggtccaccaagcggcggacctggggctgttggtggtacctctggcaagccggctctcgaggatctttattggatgagcggctatcagcaccatttaaacccggaggctttgaatctgacacccgaagatgccgttgaggcgttgatcgggagcggccaccacggggctcatcacggggctcaccacccagccgctgccgcagcctacgaggctttcagggggcctggcttcgccggagggggaggagctgacgatatgggggcagggcatcaccacggagcacatcatgcggctcaccatcaccatgccgcacaccatcaccaccaccatcaccaccatcacgggggtgctggacacgggggtggggctggccaccacgtaaggctggaggaacgtttcagcgatgatcaactggtgtctatgtcagtccgggagctaaataggcaactgcgcggtttctccaaggaagaagtcatccggctgaagcagaaaagacgtacactgaaaaatcggggatatgcacagtcctgtcggttcaagcgtgtgcagcagcgacatatcctcgaatctgagaagtgccagctgcagtcccaagttgagcagctgaagctggaggtgggcagactggctaaggagagggacctgtacaaggagaagtatgagaagctcgccggaaggggagggcctggcagcgccggaggtgcgggattcccacgagagcctagtcctccccaggccggtcctggtggcgctaaaggaacagccgatttttttctctag

SEQ ID NO: 31453 - DNA, 972 bp, Artificial Sequence
  Description of Artificial Sequence: Synthetic coding sequence
atggccgctgagctcagtatgggcccagaactgcctaccagtcctttagccatggagtatgtaaacgacttcgatctcctgaaatttgacgtgaaaaaagaaccgctgggccgagctgagaggcccggaaggccatgcaccagactgcaaccagcagggtccgtgagtagcactcctttatctacgccatgctcgtcagtgccttccagcccatcattctctcccaccgagcagaaaacgcacttggaagacctttactggatggctagcaattaccaacaaatgaacccagaagccctaaatttgacacccgaggacgctgtggaggccttgatcggcagtcatcctgtgccccaacctttgcagagttttgattctttccggggagcccaccaccaccatcaccatcaccatccacatccccatcatgcctatcctggggctggcgtagcccacgatgagctagggccacatgctcacccccatcaccaccaccaccatcaggcttcccctccaccgtccagcgcggcatcgcctgctcagcagttaccgaccagccatccaggtccagggccacacgccactgccagtgccacagctgcaggtggaaacgggtcggtggaggaccgcttcagcgacgaccagttggtctccatgagcgtgcgggaacttaacaggcatctcagaggattcactaaagacgaggtcatcagactcaagcaaaagcggcgaacactgaaaaatcgtggttacgcgcagtcctgccggtacaagcgggtccagcagaaacatcatctggaaaacgagaagacccaactgattcagcaggttgaacagcttaaacaagaagtgtcccggttggcgagagagagggatgcctacaaagtgaagtgtgagaagctggccaattcaggtttcagggaagcaggcagcacatcagactccccctcttcccccgagttttttttgtag

SEQ ID NO: 31454 - DNA, 972 bp, Artificial Sequence
  Description of Artificial Sequence: Synthetic coding sequence
atggcagctgagctctcaatgggtccagaactgccaaccagtcctctcgctatggaatacgtgaacgatttcgacctgctaaagttcgatgtgaagaaggagcccctcggacgcgctgaacggcctggacgcccttgtacacggctgcaacctgccggatcggtgagcagtaccccattgtcaacaccatgttccagtgttccatcctctccgtctttttcccccacagagcagaaaacacatctggaggacctttactggatggcttcgaactaccagcagatgaaccctgaggctctcaatctgaccccggaagacgcagttgaggccctaattggctctcacccagttccccagccacttcagtcgttcgattcatttcgcggagcgcaccatcaccaccaccaccaccatccccatccccaccatgcctatcccggagctggagttgcgcacgacgagctgggtccacatgcccacccacaccaccatcatcatcaccaggccagtccccctccatccagtgcagcttcccccgcacaacaactgcctacatcccatcctggtccgggacctcatgccacggcaagcgccactgccgcaggcggaaatggatctgtcgaagatcgattctctgacgaccaattggtaagcatgtcggtaagggagctgaatagacatctccgcggttttacgaaggatgaggtaatcaggctcaaacagaaaagaaggacattgaaaaatagggggtacgctcagtcctgcagatataaaagagttcagcagaagcaccacctcgaaaacgaaaaaactcaactcattcagcaggtggaacaactgaagcaggaggtaagcagattggcacgggaacgggacgcatataaagttaagtgtgagaagctggccaatagcggatttagagaggctgggtccaccagcgactccccttctagcccagagttcttcctctag

SEQ ID NO: 31455 - DNA, 1233 bp, Artificial Sequence
  Description of Artificial Sequence: Synthetic coding sequence
atggctaaacggagcagaagtgaggacgaggacgacgatcttcagtatgcagatcatgattacgaggtgcctcaacagaaaggccttaagaagttgtggaatagagttaaatggacccgcgatgaggacgataagcttaaaaagctggtcgagcaacacggcactgatgactggaccctgatcgcgagccatctccagaatcgatccgatttccagtgccagcatagatggcaaaaggtgctaaatccggagctgatcaaggggccttggactaaagaggaagaccagcgcgttatcgaactcgtgcaaaaatatggaaaaaagagaaagatgcgggtaggccactctcccggtagtgagctgagagatggctctctgaatgatggcggtaacatggccctcaagcatacaccgctcaagaccctgcctttcagcccctcccagttttttaatacatgccccggtaatgagcagcttaatattgaaaatccatctttcacgtccacccccatctgtgggcagaaagccctaataactacacctttacataaggagactacaccgaaggatcagaaggagaacgtcggatttcgcacccctaccatccggcgaagtatcctgggaaccacaccacgcacgcctacgccgtttaagaacgccctagctgcccaggagaagaagtacgggcctctcaagatcgtatctcagcccttggctttcttggaggaggatattagagaagtactcaaagaagagactggcactgacctgtttttaaaagaggaggacgaacccgcatacaagagctgcaagcaagagaataccgcctccgggaaaaaggtaagaaagtccctagtgctggacaattgggagaaggaagagagcggtacccagctgttgacggaggacatctccgacatgcaatctgagaaccggtttacaacctctctgcttatgattccccttctcgagatccacgataatcgatgtaatctaatcccagagaaacaggacatcaactctacaaacaagacatacaccctgacgaagaagaagcccaatccaaatacgagcaaggtggttaagctcgaaaagaatctacagtcaaattgtgagtgggagaccgtggtttatgggaaaaccgaggatcaacttataatgaccgagcaagcacgacgctatctgtccacttatactgcaacttccagcaccagcagggccttgatcctatag

SEQ ID NO: 31456 - DNA, 2259 bp, Artificial Sequence
  Description of Artificial Sequence: Synthetic coding sequence
atggctaaaaggagtcggtccgaagatgaggatgatgatctacagtacgcagatcacgactacgaagtccctcagcagaaaggcctaaaaaaactgtggaatagggttaagtggacccgcgacgaagatgataagctgaaaaaactggtggaacagcacggcactgacgattggaccttaattgcgtctcacctccagaacagatctgatttccagtgtcagcatcgctggcaaaaggtgttaaaccccgagctaataaagggaccttggactaaggaggaagaccagcgggtgatcgaattggtgcaaaagtatgggccaaaacggtggagcctgattgccaagcacctcaagggacgtatcggaaaacagtgcagggagagatggcacaatcatctcaaccccgaagttaaaaaaagcagctggacagaggaagaggaccgcatcatatatgaggcacacaagcggcttgggaaccgctgggccgagatagccaaactcctgcctggtagaaccgacaactctattaagaaccactggaatagtacgatgcggcgaaaggtcgaacaagagggctacttgcaagacggcattaaaagcgaaagatcatcctccaagctccagcataagccttgtgccgctatggatcacatgcagacccaaaaccagttttatattccagtgcagatccccggataccagtacgttagccctgaagggaactgcattgaacacgtgcagccaaccagtgccttcattcagcaaccattcatcgatgaggaccctgacaaagaaaagaaaatcaaggagttggagatgttgctcatgagcgctgagaacgaagtgagacggaaaagaataccctcccaaccgggaagcttctccagttggtccggcagcttccttatggatgataatatgtctaacacccttaattcactagatgagcatacttctgaattttactccatggatgaaaatcagccagtgtccgctcagcagaacagcccaacaaaattccttgccgtcgaggctaatgccgtgctatcgagtctgcagactattccggagttcgcagaaaccctggagctcatcgaaagcgaccctgtagcctggtcggatgttacctccttcgatattagtgatgccgcagcgagtcccattaaatctactccagtcaagcttatgaggatccagcataacgagggtgccatggagtgtcagttcaatgtgagtctggtgctcgagggcaaaaaaaatacgtgtaacgggggtaatagtgaagccgtgcctctgacatcgccgaacattgccaagttctccacccctcccgctatacttaggaagaaaagaaaaatgcgggtcggtcattctccagggtctgaacttcgagatggcagcctgaacgatgggggaaacatggcgttgaagcacacgcccttaaagaccttgcctttctctccctcacagtttttcaatacctgtccaggaaacgaacagttgaatatcgaaaatccatcattcacctcaacacccatctgtggccagaaggctctgataacaacaccactgcacaaggagacaacacccaaggaccagaaggagaatgtgggatttaggacccccacaattcgtagatctatcctgggcacaaccccaaggacccctactcctttcaaaaatgcgctcgccgctcaagagaagaagtacggtcctttaaagatcgtgtctcaaccattagccttcctggaagaggacatacgggaagttttgaaggaggagacaggaacggacctgttcctgaaagaagaagatgagcctgcttacaagagctgcaaacaagagaatacagcgtccgggaagaaagtgcgcaaatccctcgtgttagataattgggagaaagaggaaagcggcacgcagctcctgaccgaggacataagtgacatgcagtcagagaatcggtttacaaccagcctcctcatgatcccgctgctagagatccatgacaaccgctgtaatttgattccagagaagcaggacattaatagtactaataagacttatacattgaccaaaaaaaagccaaatcccaacaccagcaaagtcgtcaaactggaaaagaatctccagagtaactgcgaatgggaaaccgtggtttacggaaagacagaggaccagctcatcatgacagagcaagcacgcaggtatctctcgacatacaccgcaaccagctctacctcccgtgctctcatcctctag

SEQ ID NO: 31457 - DNA, 2079 bp, Artificial Sequence
  Description of Artificial Sequence: Synthetic coding sequence
atggctaagaggagtaggagtgaagatgaggatgacgatctacagtatgccgaccacgactatgaagtgcctcagcagaaaggactgaagaagctctggaatagagtaaagtggacaagagacgaagacgacaaactcaagaagctcgtggagcagcatggaactgatgactggacacttattgcctcccatctgcaaaatagatcagattttcagtgccagcaccggtggcagaaggtgttaaacccagagcttattaagggtccctggactaaggaagaagaccagagggtgatcgaactggtccagaagtacgggcctaagagatggagtttaattgccaagcacctcaagggaaggattggtaaacagtgtcgagaacggtggcacaatcacctgaatccagaggtgaagaaatcgtcttggactgaggaggaggatcgcatcatctacgaggcgcataagagactgggcaaccggtgggcagaaatcgccaagttgctgcctggcaggaccgacaactctattaagaaccactggaactcaacaatgcggaggaaagtagagcaagaaggctacctgcaggacgggattaaatcggagcgctctagctcaaagctccagcacaaaccgtgtgcggctatggaccatatgcagacccagaatcagttctacatacccgtgcagattccgggatatcagtacgtttcccctgagggaaattgcatcgagcacgtccagcccacctcagcttttattcaacaaccttttatcgacgaggatccagataaggagaagaaaatcaaagagctcgagatgcttctgatgtccgcagaaaacgaggtgaggcggaagaggattcctagccaacctggaagttttagttcctggtccggcagtttcctcatggatgataacatgtccaatacgttgaatagccttgatgagcacacgtcagaattctactcaatggacgagaatcagccggtctccgcccagcagaactctcctacgaagttcctggcagttgaagctaacgctgtgctgtccagcctgcaaaccatacccgagttcgccgagacactggagctgatcgaatcagaccccgtggcatggtcagatgttacctcatttgatatttccgatgccgcagccagccccatcaagtccactccggtgaagttaatgcgaatccagcacaacgagggagccatggagtgtcagtttaacgtgtctctcgtgctggagggcaaaaagaatacttgcaacgggggtaattccgaagctgtgcctcttactagccctaatatcgccaagttcagcacccctcccgcaatcctgaggaagaagagaaagatgcgggtgggacactcacccggttcagaattgcgggatggatccttgaatgacgggggtaatatggctctgaaacataccccccttaaaacattacctttttctccaagtcagttctttaacacttgtcccggaaatgaacaactcaacattgagaatccttctttcacctccacacccatctgcggccaaaaggctcttatcaccacacccctacataaagagaccactcctaaggatcagaaagaaaacgtgggcttccgcacccctaccatcagacggagtattctgggaactacaccccgaacacccacccctttcaagaacgcactcgccgctcaagaaaagaaatacggcccactcaagatcgtgtctcaacctctggccttcctggaagaggatattagggaggtattaaaagaggagacagggaccgacctgtttttgaaggaagaggatgagccggcttataagtcttgcaagcaggaaaataccgcctctgggaagaaagtccgcaagtcacttgttctggataactgggaaaaggaggaatctggcactcagctgctgactgaggacatctcggacatgcagagcaattgtgagtgggagaccgtcgtgtacggcaagactgaagaccagttgataatgactgagcaggcgaggagatacctgagcacttataccgcaacctcctcgacctcccgggctcttattctgtag

SEQ ID NO: 31458 - DNA, 711 bp, Artificial Sequence
  Description of Artificial Sequence: Synthetic coding sequence
atgtgcgtctgcgcaggctgccgtgcagctcctagccggagaggggcaggtccacttcaggttgccggaggatggtcggagggggctgatatggactacgatagctaccagcactatttctatgattatgactgtggtgaagacttctatcggtccaccgcgccttctgaggatatctggaaaaaattcgagctggtgccctcccccccaacaagcccaccatggggtctgggtcccggtgctggggaccctgcccctgggatcgggcctcccgagccctggccaggaggatgcacgggagacgaagccgagtcaagaggccactccaagggctggggcaggaattatgcgagcatcatccgcagagactgtatgtggtctgggttttccgccagagagcggctagagagagcagtatcagatcgcctcgccccaggtgcgccacgaggtaatcctcccaaagccagtgccgcacccgattgtacgccatctctcgaagcagggaatcccgcaccagctgcaccttgccccctgggagagcccaagacgcaggcctgctccgggagtgagagcccgtccgacagcggaaaggacctgcccgaaccaagcaaaaggggacctcctcatggctggcctaagctgtgcccctgtttgcggagtggtattgggagcagtcaagccctggggccttcacctcccctctttggctag

SEQ ID NO: 31459 - DNA, 1095 bp, Artificial Sequence
  Description of Artificial Sequence: Synthetic coding sequence
atggattacgacagttaccagcattacttttacgattatgattgcggggaagatttctatcgctcaacagctccctcagaggatatttggaagaagtttgagctcgtcccctccccacccaccagtcccccttggggacttgggccaggagcaggggaccccgctccagggattgggcctccagagccatggccgggtggctgcactggcgacgaggctgaatcgcggggacactctaaaggatggggccgtaattacgcttccatcatcaggagagattgcatgtggagcgggttttccgcacgcgagcgactggagcgcgctgtgagtgatcgacttgctccgggagcgcctcggggaaacccaccgaaggcgagtgcagcccctgactgcactccctcactagaggccggaaatccagcacccgcagcaccctgccctctcggcgagccgaagactcaggcatgcagtggatctgagtcacccagtgacagcgagaacgaggaaatcgacgtggttacagtggagaaacgccagtccctcggaattcggaagcctgtgacgatcaccgtccgggctgacccactcgatccgtgcatgaagcacttccatatcagcatccatcaacagcagcacaactacgctgccaggttcccacctgagtcttgcagccaagaggaggcatctgagagaggtccgcaagaagaagtacttgaacgcgacgcggcaggcgagaaggaagatgaggaggacgaagagatagtgtctcccccaccggtcgagagcgaagctgcacaaagttgtcatcccaaacccgtttcttccgacaccgaggacgtgacaaagcgcaagaaccacaatttcttggagagaaaaagacggaacgatctgcggtcaaggtttttagccctcagggatcaagtcccgacacttgcctcatgtagcaaggcgcctaaggttgtgattctctctaaggcgttagaatatttacaggccctggtgggcgcagagaaaagaatggctaccgaaaagagacaactgcggtgtagacagcagcaacttcagaagagaatagcctatctaaccggatattag

SEQ ID NO: 31460 - DNA, 1185 bp, Artificial Sequence
  Description of Artificial Sequence: Synthetic coding sequence
atgtgcgtgtgcgcaggatgtagagctgcaccgtctcggcgaggtgccggacctctccaggtcgcagggggatggagtgagggcgcagacatggattatgattcataccagcactatttctacgattacgattgtggtgaggacttttataggtccacagctccgagcgaagacatctggaagaagttcgagctggtcccctcccccccaactagccccccttggggcctcggacccggagctggcgatccggcacctggaattgggcctcccgaaccatggcctggtggatgtaccggcgacgaagcagaatccaggggccattccaagggttgggggcgaaactatgcctccattattcgtagagattgtatgtggagtggattctccgccagggaacgcctggagcgtgccgtttccgaccgattggcgcctggggcaccaagggggaatccaccgaaggcgtccgccgcacctgactgcactccgtccctggaagccggtaatccagcgcctgcagccccatgtcccttgggagaacctaagacacaggcctgctccggaagtgaaagtccaagtgactcggagaatgaagagatagacgttgttacagtcgaaaaacgccagagcctaggcatccgcaagcctgtaaccatcacagtacgcgctgacccactcgacccttgcatgaaacactttcatataagcatacaccagcaacaacacaattatgccgctcggttcccccctgaaagctgttcccaagaggaagcaagtgaaagggggcctcaagaagaggttttggagagggatgctgccggtgagaaggaggatgaggaggatgaagagattgtgagccccccacccgtagaatccgaggccgcacagtcctgtcacccaaagccagtgtcatccgacactgaggatgtgactaaaagaaagaatcataatttcctggagcgaaagcggagaaatgatttgagaagtaggttcctggctctccgcgatcaggtacccactctggcatcttgctccaaggctccaaaagtggtaatattatcgaaagctcttgagtacctgcaggcattggtgggtgccgagaagagaatggccaccgagaagaggcaactacgatgtagacagcagcagttgcagaaacggatagcctaccttacaggatactag

SEQ ID NO: 31461 - DNA, 621 bp, Artificial Sequence
  Description of Artificial Sequence: Synthetic coding sequence
atggactatgactcctaccagcactacttctatgactacgattgcggagaagacttctaccgttcgactgcaccaagcgaagatatttggaaaaaatttgaactggtaccatctccacccacatcccccccttggggtctgggtccaggagccggagatcctgctcctggaataggccctcccgagccgtggcctggcggttgtacaggtgatgaggccgaaagtcgagggcactctaagggctgggggcgaaactacgcatcgattatcaggcgggattgtatgtggtctggatttagtgccagagaaagattagagcgggcagtatccgacaggttggccccaggtgcccctcgcggaaacccccctaaagcttcagcggcacccgattgcaccccatccctggaagcaggaaacccagcacccgctgccccatgccctctgggtgagccgaaaacccaggcatgctcggggtccgagtcaccttccgactccgggaaagatctcccagaaccatccaaaaggggtcctcctcatggatggccgaagttatgtccctgtcttaggtccgggattggttcctctcaagcattggggccatcacctcctctctttggctag

SEQ ID NO: 31462 - DNA, 303 bp, Artificial Sequence
  Description of Artificial Sequence: Synthetic coding sequence
atggactacgactcatatcaacactacttctacgactatgactgcggtgaggacttctacagaagcactgccccttcagaagatatatggaagaagtttgagctggtgccttcaccaccaacgagtcccccttgggggttagggcctggcgcaggcgaccccgcacctggaattggaccacccgagccctggcccggtggctgcactggggatgaggctgagtctcgcggtcacagtaagggctggggtaggaactatgcttcaataattcggagggattgtatgtggagtggcttttcctag

SEQ ID NO: 31463 - DNA, 642 bp, Artificial Sequence
  Description of Artificial Sequence: Synthetic coding sequence
atgcctagacgggctgaaaactgggacgaagcagaagtgggggctgaggaagctggagtcgaggagtacggtccggaagaggatggaggggaagaatcaggcgctgaggaatccggcccagaagagagtggccctgaggagctgggagcagaggaggagatggaagctggcagacctcggccagtcttgaggtccgttaactcaagggaacctagccaggtaatcttttgcaaccgtagtccgagagtcgtgctacctgtgtggctaaactttgatggcgagccccagccttatcctactctgcccccaggcacaggcaggagaatccactcctacagaggacacctgtggctgtttcgtgatgctgggacacatgatggcttacttgttaaccagacagagctgtttgtcccctccctgaacgtcgatggccagcccatttttgccaatattactttgcccgtgtatactttaaaggagagatgtctgcaggttgtgcgaagtttagtgaaaccagaaaattatcgcaggctggacattgtccgaagcctgtacgaggacctcgaggaccatccaaatgtccaaaaagatctggagagactcacccaggaacgtatcgcccatcaacgaatgggggactag

SEQ ID NO: 31464 - DNA, 519 bp, Artificial Sequence
  Description of Artificial Sequence: Synthetic coding sequence
atgccacgcagggccgaaaactgggatgaagctgaagttggcgcagaggaggccggagtcgaggaatacgggcctgaagaggacggtggagaggagtcaggagcagaagaaagcggccctgaggagtccggcccagaggaattgggcgctgaagaggagatggaggccggaaggccacgacccgtcctccgcagcgtgaatagccgcgagccatcacaagttatcttttgcaacaggtccccaagagttgttctgcctgtttggctgaactttgacggggagccacagccctatccgactctgccacccggaacggggagaagaattcactcctatcgcgtttatacactaaaggaacgctgtcttcaggtggttagaagcctcgtaaagcctgaaaactacagaaggctggacatagtccggagcttatatgaggatctggaagaccatccaaacgtgcagaaggacctggagcgtctcactcaggagcggattgcccaccagagaatgggggattag

SEQ ID NO: 31465 - DNA, 396 bp, Artificial Sequence
  Description of Artificial Sequence: Synthetic coding sequence
atgccgagaagggccgagaactgggatgaagctgaggtgggagccgaggaagctggcgtggaagaatacggcccagaggaggattcttatcggggacatctctggctgttccgcgacgctggaacacacgatggacttctggttaatcaaacagagctcttcgtgccatctctgaatgtagacggccagccgatctttgcaaacatcaccctgcccgtgtataccctaaaagagcgctgccttcaggtggtgcgtagtttggtcaaaccggagaactacagacgcctggatatagtgcgctcgctgtacgaagacttagaggaccaccctaacgttcagaaagacctggagcgcctgacccaggagcgtatcgcgcaccagcgcatgggcgattag

SEQ ID NO: 31466 - DNA, 1281 bp, Artificial Sequence
  Description of Artificial Sequence: Synthetic coding sequence
atggtgcacttctgtggacttctgacactgcacagagaacccgtccctctgaaatcgatatcggtgtccgtgaatatctatgaatttgtggctggcgtgtccgccaccctcaattacgagaacgaggagaaggttccactggaggcgttttttgtgttcccaatggatgaagatagcgcagtgtattcttttgaagccctcgtggatggaaagaaaatcgtagcagagcttcaggacaagatgaaagctagaactaattatgaaaaggccatttcacagggccaccaagcgttcctcctcgaaggcgactcaagtagcagggatgtgttctcttgtaacgtcggtaacctgcagcctggttctaaggctgcagtcacactcaaatacgtgcaggaactgccacttgaagctgatggggctctcagatttgtgcttccagccgtcctgaatccaagatatcagttcagcggtagctccaaggattcctgtctgaatgtcaagacgccaattgtcccagtggaagacctgccatacaccctttccatggtcgcgaccatcgatagccagcatggcatcgagaaagtccaatccaactgtcctctttctcccactgaatatctgggggaagataaaacaagcgcccaggtgagcttggctgctgggcataaatttgatagggatgtggagttgctcatttactacaacgaagtgcacactccctcagtcgtgctggagatgggcatgccaaatatgaaaccgggacatctgatgggagacccaagcgcaatggtaagtttttatccaaatataccagaagaccaaccttccaatacctgcggtgagttcatctttctgatggatcgatccggcagcatgcaatccccaatgtcgagccaggatacgagccaattacggatacaggctgccaaagagaccctcatactcctgctcaaaagcctgccaatcgggtgttattttaacatctacgggttcgggtccagctacgaggcatgtttcccggaatccgtgaaatacactcagcagactatggaagaagcactgggacgggtcaaactgatgcaggcggatctcggtgggacagagatcctggctcccctgcaaaacatctaccgcggtccgagtatccccggtcacccgctccaggtgttcgagcgcccatacacactcacggtcctgctgctgcacctctcccctgaaggaaatctgtgtgtgattcggccaaggcattcaaggtggactataactgtgtctgtgggctag

SEQ ID NO: 31467 - DNA, 2361 bp, Artificial Sequence
  Description of Artificial Sequence: Synthetic coding sequence
atggtccacttctgtggcctcttaactctgcaccgggagccggttcctcttaagagcataagcgtctcggttaacatctacgagttcgtggccggagtaagtgcgactctcaattatgaaaatgaggaaaaagtgccacttgaagcgttctttgtgttccccatggatgaggattctgcagtgtacagcttcgaggccttggtcgatgggaaaaagatcgttgccgaattgcaggacaaaatgaaagcccgtactaattatgaaaaggccatctctcaggggcaccaggcttttcttctagaaggtgactcaagttcccgtgatgtgttttcatgcaacgtgggcaacttacagcctgggtcaaaagccgcagttacactaaagtacgtacaggagctcccactggaggctgacggcgctttgagatttgttctgcccgcagtgctcaatcctcggtaccaattcagtggaagcagtaaggattcatgcctaaacgtcaagacccccatagtgcccgtcgaagacctgccgtataccctgagtatggtggccactatcgacagtcagcacggaatcgaaaaggtacagagcaattgtccactcagtcctacagagtatttgggagaagataaaactagtgcccaggtgagccttgccgcaggccataaatttgatagagacgtggaactgcttatatactacaatgaggtccacacccccagcgtggtcctcgaaatggggatgcctaacatgaagcctggtcacctgatgggagacccttccgctatggtaagtttctatcctaacatacccgaagatcaaccttcaaacacgtgcggcgaatttatcttcttaatggaccgtagcggatctatgcaaagcccaatgtcatcccaggatacttctcagctgcgcatccaggccgctaaagaaactctgatacttctcctgaagtcgctgcctatcgggtgttacttcaacatttatggctttggatcttcgtacgaggcgtgtttcccagagtctgtcaaatatacccagcagaccatggaagaagccttaggcagagttaaactgatgcaggctgacttgggaggcacagagatactcgcacccctgcagaatatctaccgtgggcctagtatccccggtcacccactccagctgttcgtattcacggacggagaggtgactgacacttttagcgtgatcaaggaagtgcggatcaaccggcagaagcacaggtgcttctcatttggcattggcgagggaaccagcacaagcctcattaagggcatcgccagagcatctggaggaacgtccgaattcattacaggcaaggataggatgcaatccaaagcactgcggacccttaaacggagcctccagccagttgtcgaggatgtgagcttgtcttggcacctgccacctgggttatccgcaaagatgctgtccccagaacagacagtaatttttcgcggacagcggcttatcagctacgcccagctgactggaaggatgccagccgcagaaacaaccggggaggtgtgtttaaagtacactttacagggcaagacatttgaagacaaggtcaccttcccattgcagccaaaacccgacgttaatctgaccattcaccggctggccgctaaaagtttactgcaaacaaaagacatgggactcagggaaactccagccagcgacaaaaaagatgcactgaacctgagtctggagtccggcgtaatatcaagctttacggcgtttatcgctattaacaaggaactaaacaagccagtccagggaccactggcacacagggacgtccctaggcccatcctactcggggcttccgccccattgaagataaaatgccagagcgggttccgaaaagctctccactcagacaggccgccatccgcaagtcagccgcgaggagagttgatgtgttacaaggccaagacattccagatggatgactactcgctgtgcggtctcataagtcacaaagatcagcactctcctgggtttggtgagaatcacctggtgcagttgatttatcaccagaatgctaacggttcatgggatttgaacgaggacttggcaaaaatcctgggcatgtctctggaagagatcatggccgcacagcccgctgagctcgtagactcatcgggatgggctaccatcttggctgtcatttggttgcactcgaatggcaaggatttgaaatgtgaatgggaacttctggagagaaaagctgtagcctggatgagagcccatgcaggcagcaccatgccctccgttgtgaaggcagccatcactttcttaaagagcagcgtggacccagctatattcgcattctag

SEQ ID NO: 31468 - DNA, 1248 bp, Artificial Sequence
  Description of Artificial Sequence: Synthetic coding sequence
atggtccacttctgtggtctcctgactctgcacagagagcctgtgccactaaagtctatttcagtatctgttaacatctatgaatttgttgcaggcgtttccgctacacttaattacgagaatgaggagaaagttcccttggaagccttctttgtcttccctatggacgaagattcagcggtttattccttcgaggcgctcgttgacggtaagaaaatcgtcgccgaactgcaggacaagatgaaagccagaacaaactacgagaaagctattagccagggacatcaggcctttctgttagagggagactccagttcacgagacgttttttcttgtaatgtggggaacctgcagccaggtagtaaggccgcagtgactctgaagtatgtccaggaactgccattagaagccgacggcgcactccgattcgtgttgcctgccgtgttaaatcctaggtatcagttcagcggctcgagcaaggacagttgtcttaacgtgaaaacgccaatcgtgccagtagaggacctcccatacactctgagcatggtagccaccattgactctcagcatggtatcgagaaggttcaatcaaactgccctctgtcccctactgaatatcttggggaagataaaactagcgcccaggtcagcctggccgctggccataagttcgacagggacgtggagctcctcatttactacaacgaggttcatacgccctctgtcgtgcttgaaatgggtatgccaaatatgaagcctggccatctaatgggtgaccccagtgctatggtgagtttctaccctaacatccccgaggatcagccatcaaatacatgtggggaatttatcttcctgatggaccggagcgggtctatgcagagtccaatgagtagccaggataccagccagctaaggatacaggccgcaaaagaaaccctgattcttttgttgaaaagcctgccaattggctgttatttcaacatttatggtttcgggtctagctatgaagcctgctttccagagtccgttaaatacacccagcagacaatggaggaggcactcggtcgcgttaaactgatgcaggctgacttgggcggaaccgaaatcttggcccctctccagaacatatataggggcccatccattccagggcaccccctccaactcttcgtattcacagatggggaggtgactgacactttcagcgttattaaggaggtccgcatcaacagacagaagcatagatag

SEQ ID NO: 31469 - DNA, 2361 bp, Artificial Sequence
  Description of Artificial Sequence: Synthetic coding sequence
atggtgcatttctgtggcctgcttaccctacaccgtgaaccagtcccactgaagtcaatctcagttagtgtcaatatctacgaatttgtagccggagtgtcagccactctgaactacgagaacgaagagaaagttcctctggaggcctttttcgtcttccccatggatgaggactccgctgtgtactcctttgaggcactggttgatgggaaaaagattgtcgcagaactacaagacaaaatgaaagccagaaccaactatgaaaaagcaatttcacaggggcaccaggctttcctgcttgaaggggacagtagcagcagagatgttttcagctgtaatgttgggaacttgcaaccagggtccaaggccgctgtgactcttaagtacgtgcaggagttacctttggaggccgacggcgctttacgatttgtgctgcccgcagtcctgaatcccaggtatcagttctctggttcatcaaaggacagctgtttaaacgtgaaaaccccaatcgttcctgtagaggacctgccatacactctgagcatggtcgccaccatcgatagccagcacggcatcgaaaaagttcagtctaattgtcctttgagtcctacagagtacctcggtgaggacaagacgtcggcccaagtctctctggctgcgggacacaagtttgatagagatgttgaactcctcatatattataacgaggtgcacaccccttccgtcgtgctggagatgggcatgcccaatatgaaacctggacacctcatgggcgaccctagtgccatggtgtctttttatccaaacattcctgaggaccagccttctaacacatgtggggagtttatctttctgatggaccgatccgggtcgatgcagtcacctatgtcttcacaggatacttcacaacttcggatccaggctgccaaagaaaccctcatactgctcctcaagagtctgcctattgggtgttattttaatatctacggctttggcagctcatacgaggcttgttttcccgagagtgtgaaatacactcagcagactatggaggaagccctgggcagagtcaagttaatgcaagctgatctgggcggaacagaaattctggcacctttgcagaatatctacagagggcctagtattccaggtcatcctctgcagctgtttgtgttcaccgatggtgaggttacagacacattttccgtgatcaaagaagtcaggattaatagacagaagcaccgctgttttagcttcggaatcggtgaaggtacatccacctctctgataaaggggattgctcgggctagcggcggaacctctgagttcataacgggcaaagaccgcatgcagagtaaggcactgcgcacccttaagcgatctttgcagccggtagtggaggatgtctccttatcatggcatctgccacctggactgtctgccaagatgctctctcccgaacagacggtgatcttccggggtcagaggcttattagctacgctcagctgactggtaggatgccagcagcagagactacaggagaggtttgcctcaagtatacactacagggcaagacatttgaggacaaggtcacgtttccactccagccaaagcccgacgtaaatctgactatccacaggctggccgctaaatctctgctgcagaccaaagatatggggctgagggaaactcctgcgtccgacaagaaggacgccctaaacctttcccttgaaagcggggtgatttcctcttttaccgccttcatagcgatcaataaagaactgaataagcccgtgcagggacctctggctcacagggacgtgcctagacctatcctcctgggtgccagtgcacctctcaaaatcaaatgccagtccggctttcgcaaagctcttcactctgatagacctccatctgcctcccagcctagaggcgaactgatgtgctacaaggccaaaacttttcagatggatgactatagtctgtgcggactcatatctcataaggaccagcattctccgggtttcggagagaatcatctcgtacagctgatctatcaccaaaacgctaatggcagttgggaccttaatgaagacctcgccaagattctgggcatgagcctcgaggaaattatggcagcacagccggctgagctggttgacagctcagggtgggccaccattctggcagtgatctggctgcattctaacggaaaggatctgaagtgtgagtgggagctgctggagcggaaagccgtggcctggatgcgcgctcacgcaggcagcactatgccaagcgtcgtcaaagctgccatcacttttctgaagtctagcgtcgatccagccatctttgcattttag

SEQ ID NO: 31470 - DNA, 1248 bp, Artificial Sequence
  Description of Artificial Sequence: Synthetic coding sequence
atggtccatttttgcggactgctgaccctccaccgggaaccggtccccctcaagtcaatcagcgtgtctgttaacatctacgagtttgtggccggagtaagcgcaactctgaattacgagaatgaagaaaaggtcccactggaggccttcttcgttttccctatggacgaagactccgctgtctacagctttgaggccctggtggatggtaaaaagatcgtggcggaactgcaggacaagatgaaagctcgtacaaactatgagaaggctatcagtcagggccaccaggccttcttgctggagggggactcatcatctcgcgatgtcttcagctgcaacgtgggcaaccttcagccaggctccaaggcagccgtgacgctaaagtatgtgcaggagttaccccttgaggcagacggcgctctcagatttgtactgccagcagtgctgaacccccgttatcaattctccggctcttccaaagatagctgtctaaatgtgaaaactcccatcgtacctgtggaggacttgccttacacactatccatggtggccaccatagattcccagcacggcatcgagaaggtgcagtcaaactgtccattgtctcccactgaatacctcggcgaagataagactagtgcgcaagtttcactggctgccggtcataagtttgacagggatgtggagctcctcatttattacaacgaggtgcataccccctccgtcgttttggaaatgggtatgcccaatatgaaacccggacacctcatgggggacccatctgctatggttagcttctaccctaatatacctgaggaccagccttctaacacgtgtggggaattcatctttcttatggacaggtccggctccatgcaaagccccatgtcctctcaggatactagccagttacggatccaggctgcaaaagagaccctcatcctcctcctgaagagcttgcctatcggatgttattttaatatatatggattcgggagcagctatgaggcgtgtttcccagagtcggttaaatacactcagcagacaatggaggaggcactcggccgtgttaagctgatgcaggcagacctggggggtactgagattctggcccctctccaaaatatctatcggggtcctagcataccaggacatcctcttcagcttttcgtcttcactgacggggaagttacagacactttttctgtgattaaagaagtgcggatcaataggcagaagcaccgttag

SEQ ID NO: 31471 - DNA, 2301 bp, Artificial Sequence
  Description of Artificial Sequence: Synthetic coding sequence
atggccgcattgagcgggggagggggaggcggagcagaacctggccaagccttgttcaatggcgatatggaaccagaagccggtgcaggagcaggtgccgcagcatcctccgccgcagatcccgctatccctgaagaggtatggaacatcaagcagatgattaaacttacccaagaacacattgaagccctgttagacaaattcggcggagaacataaccctcccagcatctatctggaggcctacgaggaatacacctcaaagctcgacgccctgcagcagcgcgaacagcagctgctggaaagccttggcaatggaaccgacttctccgtgtcttccagcgcgtcgatggacaccgtgacaagcagttccagctcatccctgagcgttctcccatcctctttatccgtattccagaaccctacagatgtggcccgatccaatccaaagtccccccagaagccaattgtaagggtgttcctccctaacaagcagcggacagtcgtaccagctaggtgcggcgtcactgtgcgcgactccctcaagaaggccttaatgatgcgcggactgatcccagaatgttgcgctgtataccggattcaggacggcgagaaaaaacccattggctgggacactgacatcagctggctcacaggggaggagctccacgtggaggtgctagaaaatgttccgctgactacccacaactttgtacgaaaaacgtttttcaccctggccttctgcgatttctgtagaaagctgctgttccaaggcttcagatgccaaacttgtgggtacaaatttcaccaacgctgctccacagaagtgcccctgatgtgcgtcaactatgatcaactcgacctgttgtttgtgtcaaagtttttcgagcaccatcctattccccaggaagaagctagcctggctgaaaccgctctgacgtcagggtcgtccccctccgctcccgcttcggatagtattggtcctcagattctgacctccccatctcccagtaaatcaatccccatcccacagccgttcagaccggctgatgaggatcatcggaatcaatttgggcagcgagatcgctcatctagtgcccctaacgtgcacataaatacaatcgaaccagtgaatattgacgaccttatcagagaccaggggtttcgtggcgacggcggaagcaccaccggactgtctgctacccctccagcctcactgccaggttcactgacgaatgtcaaagctttgcagaagagtccaggtcctcagcgcgaaaggaagtccagcagttcctccgaggataggaatcgcatgaaaactctgggcaggcgggattcatctgatgactgggagattcccgacggacagataactgtcgggcaacgcatcggctctggaagcttcggaaccgtgtataaaggtaagtggcatggcgacgtcgcggttaaaatgctcaacgttaccgctcctacaccccaacagctgcaggcctttaagaatgaagtgggtgtgttgcggaagaccagacacgtcaatattctgttattcatgggctattcgaccaaaccacagctcgccatagtgactcaatggtgcgagggctcgtctttgtaccaccatctgcacataattgagaccaaattcgagatgattaagcttattgacatcgccaggcaaactgcgcagggaatggactacttgcatgccaagtccattatacatagggatctgaagtctaacaatattttcctgcacgaagaccttactgtcaagataggagactttggtctggcaactgttaaaagccgttggtctggttctcaccagtttgagcagctgagcgggtccattctctggatggctcccgaagttatccggatgcaggataagaacccttactcctttcaatcagacgtgtatgcgttcggtatagttctttacgaacttatgacaggacaattaccatactccaatattaacaatagggaccagatcatctttatggtggggagagggtacctgtcccccgatctatcaaaggttcggagtaactgccctaaagcaatgaaacggcttatggccgagtgtcttaaaaagaagcgcgacgaacggcctctgttccctcagatccttgccagcattgagttgctggcaaggagcttgcctaagatccatcgctcagcctctgagccatcattaaacagagccggttttcaaaccgaagacttctccctctatgcttgtgcctcacccaagacccctattcaagctggtggatatggcgctttccctgtgcactag

SEQ ID NO: 31472 - DNA, 1947 bp, Artificial Sequence
  Description of Artificial Sequence: Synthetic coding sequence
atggaacatatccagggtgcatggaagaccataagtaatggatttggattcaaggatgccgtgtttgatggatccagctgtatttctcctaccatagtgcagcagttcgggtatcagcgcagggcgagtgacgacgggaagctgacagacccttcaaagacaagcaacaccatcagagtgttccttccaaacaagcagcggacagttgttaacgttcgcaacggcatgagtttgcacgactgtctcatgaaggccctaaaggttagaggactccagccggagtgttgtgctgtattcagactgctccatgagcacaaagggaagaaggcgcgtctggactggaacaccgacgccgcttcccttataggtgaagagcttcaggttgattttctggaccatgtccccctgaccacccataattttgccaggaaaacttttcttaaactggctttttgtgatatctgccagaagttccttctgaatgggtttaggtgccaaacctgcggctacaagttccatgagcactgttctaccaaagtccctacaatgtgtgttgactggagcaatatacgacagctactgctatttccaaatagtaccattggggactcaggcgtacccgctttacccagtctgacaatgcgtcggatgagagaaagcgtctcaagaatgcctgtcagcagtcagcatcgctactctacaccacacgccttcaccttcaatacgtcctctccatcttcagaaggctcgcttagtcagcgccagcgctccacaagtactcccaacgtacatatggtttcgacaacgctgccggtagacagccgtatgatagaagatgctattaggagccattcagaatccgcgtccccatccgccctgtcaagctccccgaacaatctgagtcccaccgggtggagccagcctaaaacacctgtgcctgcacagcgggaaagagcacctgtgtccggcacccaggagaagaataagatccgtcctagaggccagagagacagctcttactattgggagattgaagcctcagaggtgatgctgtcgaccagaatcggaagtggctcctttgggacggtgtacaaaggcaagtggcatggcgatgttgctgtgaagatccttaaggtggtggaccccacaccagaacagttccaggcgtttaggaacgaggttgctgttctaaggaaaacacggcatgtcaatattctattgttcatgggctatatgaccaaagacaaccttgccatcgtgactcagtggtgtgagggaagctcgctatacaagcacctgcatgtccaggaaacaaaattccaaatgttccagctgatcgatatagcccgacaaactgcacaggggatggactacctgcatgccaaaaacattatccacagagatatgaagtctaacaacatttttctgcacgaaggtctgacagtcaagataggcgacttcgggctggccacggtaaagtctagatggtctgggtcacagcaggtagaacagcctaccggatctgtgctttggatggcccctgaagttataagaatgcaggataacaatccattctcctttcagagtgatgtgtatagctatggtatagtcctctatgagctgatgacaggagaactcccatacagtcacatcaataaccgggaccagattattttcatggttggacggggatatgcctcccccgaccttagtaaactgtacaaaaattgtcccaaggccatgaaaagactggttgctgactgtgtcaagaaagtgaaagaagaacgaccgctgttccctcagattttgtcaagtatcgagcttctgcaacacagcctgccgaagattaacagaagtgcttccgagccctcactgcatcgggctgcccataccgaagatatcaatgcctgtactttgaccacgagtcctagactgcctgtgttttag

SEQ ID NO: 31473 - DNA, 2007 bp, Artificial Sequence
  Description of Artificial Sequence: Synthetic coding sequence
atggagcacattcagggggcatggaaaacaatcagcaacggattcggtttcaaggacgctgtatttgacggctcgtcttgcatcagccctacgattgtgcaacagttcggctatcagcgcagggcaagcgatgatgggaagctgactgacccctctaagacatctaacacaataagagtctttcttcctaataagcaacgtactgtcgtgaacgtgcggaatggtatgtccttacatgattgccttatgaaggccctaaaggtcagaggacttcagcctgagtgctgtgccgtgtttcgcctgctccatgagcataaaggtaagaaggccaggctagattggaacactgacgcagcgtctcttattggcgaggaacttcaggttgattttctcgaccacgtgcctcttaccacacacaatttcgccaggaagaccttcttaaaattggcgttctgtgacatctgtcagaaatttctcctgaacggattcagatgccagacgtgcggttataagttccacgagcactgctctacaaaggtcccaaccatgtgtgtcgactggagcaacatacgccagctcctcttatttcccaattccacaataggagacagtggcgtgcccgctctgccaagtcttacaatgcgtcggatgcgggagtccgtgagccgcatgccagttagtagtcagcaccggtactccactccacatgccttcactttcaatacctcctccccgagctccgaaggctctttgagtcaacgccaacggagcacctccacaccaaacgtgcacatggtgtcgacaactctccccgttgacagcagaatgatcgagaacaacaatttaagcgcctctccaagggcatggtcccgaagattttgcctccggggacgggatgctatcagatctcactctgaaagcgccagtccttctgcattgagttcgagccctaataatttgtctcccactgggtggtctcaaccaaagacccccgttcctgcccagagggaaagagctcccgtatctggcactcaggagaaaaacaaaattcgaccgagaggacagcgtgactcatcatattattgggaaattgaagccagtgaggtgatgctctctacaaggatcggaagtggcagctttgggactgtttataagggcaagtggcacggcgacgttgccgtcaagatactcaaagttgtagaccccacacctgagcagttccaggcttttaggaatgaggtcgcagtactgaggaaaacacgtcatgtgaatatattactcttcatgggctatatgaccaaggataatcttgcaatcgtgacacaatggtgcgaggggtcctctctctataagcacctgcatgtacaggagaccaagttccaaatgttccagctgattgacatcgctcggcagacagcgcaaggaatggactacctccatgccaaaaacatcattcaccgagacatgaaaagcaacaacattttccttcacgaaggtttaacagtgaagatcggcgattttgggctggcaacagtaaagtctcgttggtctggctcgcagcaagtcgagcaaccaaccggcagcgtgctctggatggccccagaggtcataaggatgcaggacaataaccctttttcttttcagtccgatgtctattcttacggcattgtcctgtatgagctcatgactggcgagcttccctactcacacattaacaatagagaccagatcatttttatggtcggtaggggttatgccagtcccgatctgtcaaagctatacaagaactgccccaaggcaatgaagagactggtggccgactgtgttaaaaaggtcaaagaggagcggccattgttccctcagatactgtcatctattgagcttctacaacacagcctgccaaaaattaatagatccgcttcagaaccttctctacaccgcgctgctcatacggaagatataaacgcatgcaccttgacaacctctcctcggttgccggtgttctag

SEQ ID NO: 31474 - DNA, 1302 bp, Artificial Sequence
  Description of Artificial Sequence: Synthetic coding sequence
atgtgcgtggattggagtaacattagacaattattcagtcagcaccgatacagcacccctcatgcttttacgttcaacacttcctcaccaagtagcgaaggtagtttgtcacagagacaacggtcaaccagcactcctaacgtgcatatggtgtcaactacattacccgtggactcacggatgatcgaggacgcaatacgctctcattcagagagcgcatccccctctgctctgtcctcctcccctaataatctgtcccctacggggtggagtcagccaaagacccctgttccagcacagagggaacgcgctccagtgtctggcacgcaggaaaaaaataagatccgaccccgtggacagagggacagctcttattattgggagatcgaggcatctgaagtgatgctcagcacccgaattgggtctggcagttttgggactgtctataagggaaaatggcacggggacgttgccgtcaagattttaaaggtcgtggaccccactccagaacaatttcaggcctttcgaaacgaggtggccgttcttcgcaagactaggcatgtaaatatactcctgtttatgggctacatgactaaagataatctggctatcgtgactcagtggtgtgaaggatcaagtctctataagcaccttcacgtgcaggagaccaagttccagatgtttcaactgatcgatattgcacgccagactgctcaaggaatggattaccttcatgctaagaacatcattcaccgcgacatgaagagcaataatattttcctccacgagggtctgaccgtcaagatcggagacttcgggttggctacggttaaatcaagatggtctgggagtcagcaagtcgagcaaccgacaggttctgtactctggatggcccctgaggtgatacgaatgcaggataacaatcccttttcctttcagtcagacgtgtacagttatgggatcgtactgtatgagctcatgaccggcgaactcccctacagccacatcaacaaccgagaccaaatcatctttatggttggcagaggatacgcctctcctgacttgagtaaactgtacaaaaactgcccaaaagccatgaagcggctcgtggccgattgtgtcaagaaggtcaaggaagaacgccctttgtttccccaaattctttccagtattgagcttctgcagcactctctgccaaagatcaatcggagtgccagcgagccatctctacacagagccgcacacacagaagatatcaatgcctgcaccctcacgacctctcctcgactgcccgttttttag

SEQ ID NO: 31475 - DNA, 1704 bp, Artificial Sequence
  Description of Artificial Sequence: Synthetic coding sequence
atgatggccaatagtcagattctgctgcggcaggcgacgctgagcgtgttttcgtgtagaacctcaaaggagcagtgcaagaaggccagactggactggaataccgacgccgcatctcttatcggcgaagagttgcaggtggacttcttagaccacgtacctctgactacccacaatttcgcacgtaaaaccttccttaagttagccttctgtgacatctgccagaagtttctcctgaatgggtttaggtgtcagacatgcggatacaagttccatgaacattgcagtaccaaagtcccaactatgtgcgttgattggagtaacatcaggcagttgctgttgtttcctaactcaaccatcggagactcaggagttccggctctgccctccttgactatgcggcgaatgagagaaagcgtatcacggatgcccgtgagttcccaacacagatatagcaccccgcatgccttcacattcaatacatcttcaccttcttcagaagggagccttagccaacggcagcgcagcacatcgactcctaacgtgcacatggtgagtactactctgccagtcgattcccggatgatcgaagatgcgattagaagccattccgagagcgcctctccaagtgccctgtcttcatcaccgaacaatctgagccctactggatggagtcagcccaaaactcccgtgcccgcacagagggagagagcacccgtttccgggactcaggaaaaaaacaagatccggcctcgcggtcagcgcgactcctcttactattgggaaatcgaagcatctgaggtcatgctttccaccaggatcggttcaggatcctttgggaccgtctataaggggaagtggcacggagatgtcgcagtgaagatactcaaggtggtggatcccactccggagcagttccaagcgttcaggaacgaggtggccgtgctgcgcaagacccgccacgtaaacattctgctctttatgggatacatgaccaaggataacctagcaatagtgactcagtggtgcgagggctcctctctttataagcacctgcatgtgcaggaaaccaaatttcagatgtttcaattgatcgacatagccaggcaaaccgcccaaggcatggattacctgcacgccaaaaatattattcaccgggacatgaagagcaataatatctttctgcacgagggactgacggtgaaaataggcgactttggactcgccactgtgaaaagcaggtggtccggatcccagcaggtggagcaacctaccggttccgtgttatggatggcaccagaagtcattcgcatgcaggataacaaccctttttcatttcagtccgacgtgtatagttacggcatagtcctttacgaactcatgactggtgaattgccctactcccacatcaacaacagggaccaaattatctttatggtggggagaggatacgccagccccgaccttagcaaactgtataagaactgtcccaaagccatgaagaggctcgttgcagattgcgtgaaaaaagtgaaagaagagcgtcccctctttccacagatactctcatcaattgagttacttcaacactctctgccaaagataaataggtctgcttccgagccctcattacaccgtgccgctcacaccgaagacataaacgcatgtacactaactacctcaccccgtcttcctgtattttag

SEQ ID NO: 31476 - DNA, 1611 bp, Artificial Sequence
  Description of Artificial Sequence: Synthetic coding sequence
atgggatcgaataagtctaagcccaaggacgcttcacagaggcgcagaagtctggaacctgcggagaacgttcacggagctgggggaggggctttcccagcttcacaaacaccgtcgaagcctgcgagcgcagacgggcacaggggtccctccgctgctttcgcaccagcagcagcggagcctaaattgttcggcggtttcaacagctccgacactgtaacatctcctcagcgcgctggtcctctggccggaggtgtcacaaccttcgtcgcactctatgactacgaaagccgaacggagactgacctgtcgtttaagaaaggtgagagactgcagatagtcaataacacagagggggactggtggctggctcacagcctttcaaccgggcaaacaggctacatacccagtaactacgtcgcgccatccgactcaatacaggcggaggagtggtattttggaaagattacacgacgtgagagtgagagactgctgctgaacgcagagaatcctcggggaactttcctggtcagagaatcagagacaactaagggcgcatattgtttaagtgtgtctgacttcgataacgcaaagggtctcaatgtgaaacactacaagatccgcaagctcgattctggaggcttttacatcacgtcacgaactcagttcaactcgttacaacagctggtcgcttactactccaagcatgccgatggcctttgccaccgtctcacaacagtttgccccacatccaaaccccaaacccagggcctagcgaaagacgcatgggagatacccagggagagcctccgtctggaagtgaagctagggcaaggttgttttggcgaagtttggatgggcacatggaacggaacaaccagagttgcaattaagactcttaaacccggaacaatgtctccggaggccttcctgcaagaggcgcaggttatgaaaaagctgcgacacgaaaagttggtgcagctgtacgctgttgtaagcgaggagcccatttacatagtaacggagtatatgagtaagggatcattactggacttcctcaagggagagacagggaagtacctccgactgccccaacttgtagacatggctgcccagattgcaagcgggatggcatatgttgaacgcatgaactacgtgcaccgagatctgcgcgcagccaacattcttgtcggcgaaaatttagtgtgtaaggtcgcagatttcggactggccaggctaatcgaagataacgagtataccgccagacagggggctaaatttccaatcaagtggaccgcacccgaggcagctctttacggcagattcactattaaaagcgacgtctggagcttcgggatcctcttaacagagctgacaacaaagggcagggtgccttacccgggaatggtgaaccgagaggtgctggaccaggtggaaaggggttacaggatgccatgtccccctgaatgccccgagagcttgcacgatctaatgtgtcaatgttggaggaaagagccagaggagagaccaacatttgagtacctgcaggcgttcttggaggattacttcacatcaactgaaccccaatatcagcctggcgagaacttgtag

SEQ ID NO: 31477 - DNA, 1629 bp, Artificial Sequence
  Description of Artificial Sequence: Synthetic coding sequence
atggggtctaataagagtaaacctaaagacgcaagccagcgccgacgatccttagaacccgcagagaacgtgcacggggcaggagggggagcctttccagccagccagactccatcaaagcccgcatcagcggatggtcaccgcggtccttccgcagcctttgcccctgccgctgcagaaccgaaactcttcggcggtttcaactcctcagacaccgtaacaagtccacaacgggcagggcctctcgccggtggcgtcacgacgttcgtggcactctatgattatgaatcccgtaccgaaaccgatctgtcttttaaaaaaggcgaacgcctgcagattgttaataatactcggaaagtcgacgtgcgcgaaggtgactggtggcttgcccattctctgtctactggccagacaggttacataccttctaattatgtcgcgccatcggatagcatccaggccgaggagtggtacttcggcaaaatcacccgcagggagtccgaacggcttctactgaatgccgagaacccccgtggcacttttctggttcgggagagcgaaactaccaagggtgcatactgtctgtcggtgtctgatttcgataatgcaaagggtctaaatgtgaagcactataagattcgcaaactcgatagcggaggattctacataacgagccgcactcagttcaacagtctgcagcagctcgtagcctactacagcaaacatgctgatgggctgtgccacaggctgaccacagtttgcccgactagtaaaccacaaactcaaggtctggctaaggacgcctgggaaatccctcgggaaagcttgcgcctggaagtgaagcttgggcagggttgctttggggaggtatggatgggtacttggaatgggaccaccagagtggcgataaaaacactgaaaccagggaccatgtcacctgaggcgttcctgcaagaggctcaggtaatgaaaaagctgcgccacgaaaagctggtacagttgtacgccgtagttagtgaagaaccaatctatatcgttacagagtacatgagcaagggctcactgctggatttcctcaaaggcgagaccgggaagtatctgagattaccacagctggtggatatggcagcacaaatcgcaagcggcatggcatatgttgagagaatgaattatgtgcaccgggatcttcgcgctgccaatattttggttggcgagaacctggtctgcaaggtggcagattttggattggccagactgatcgaggataatgagtacacagccaggcaaggcgcaaaattccccattaagtggacagcccctgaagccgcattgtatggacgtttcacgatcaagagcgacgtatggagcttcgggatacttctgaccgagcttacgactaaggggcgagtcccataccctgggatggtcaatagagaagtcctcgaccaagttgagcgagggtacagaatgccctgccctccagagtgtccagagtccttacacgatctcatgtgccagtgctggaggaaggagcctgaggaacgccctacatttgaatatctgcaggccttccttgaagattactttacatcgaccgagccacagtatcagccaggcgaaaacctttag

SEQ ID NO: 31478 - DNA, 1611 bp, Artificial Sequence
  Description of Artificial Sequence: Synthetic coding sequence
atgggatccaataagtccaaaccaaaggacgcaagccagcgacgcaggtctcttgaacctgccgagaacgtacatggcgcaggtggaggagcttttcctgcctcacagacaccctcaaaacctgctagcgctgatggtcacagaggaccttccgcggcatttgctcctgctgccgctgagccaaaattgtttggcggattcaacagctctgacactgtgaccagtccacagcgcgctggtccactggctggcggagttacaactttcgtagccttgtatgattacgagtcaaggactgagaccgacctgagtttcaaaaaaggggagcggcttcagattgtgaacaacacggagggggactggtggctggcccatagcctgagtacaggtcagaccgggtacatcccctccaattacgtagcccctagcgatagtattcaggctgaagaatggtattttgggaaaatcacacgcagagaaagcgaaaggttgctgttaaatgctgagaatccgagggggaccttccttgtcagggaaagcgaaaccactaagggggcttattgtctgtctgtgtctgacttcgacaatgcaaagggacttaatgtgaagcattataaaatcagaaagctggacagtggcggtttttatataacttcacgaacacaattcaactctctgcagcagctcgtcgcttactattccaagcacgccgatgggctgtgccaccgtctgaccacggtgtgtcctaccagcaaaccccagacccagggcctggcgaaggatgcatgggaaatcccaagagagtcactcaggttagaagtcaagcttggtcagggctgtttcggagaggtttggatgggtacatggaacggaaccacgcgagtggcgattaaaacgctcaagcccggtactatgtccccagaagctttcctgcaagaagctcaagtgatgaaaaagctgcgccacgagaaacttgtccaactttacgcggttgtctccgaggagccaatctacatcgtgactgagtacatgtcaaagggcagcctactggattttctgaagggggaaacgggaaaatacctgcgtctgccacagcttgtggacatggcagctcagatcgcatcaggcatggcatacgtggaacggatgaactacgttcatcgagatttgcgagccgctaacatcctcgtgggcgagaacctggtttgcaaagtggctgactttggccttgccagactaattgaggataatgaatacacagctaggcagggtgccaagttccccatcaagtggaccgctcccgaggcagccttgtatgggcgatttacaatcaagagcgatgtgtggtcttttgggatactgttgaccgagcttacaaccaagggacgcgtcccctaccccggtatggtgaaccgcgaagttctggatcaggtggagcgcggttaccggatgccctgcccccctgagtgccctgaatctctgcatgacctcatgtgccagtgctggagaaaggagcctgaggagcgtccaacatttgagtaccttcaggccttcttggaggattacttcacatcgacagaacctcagtatcagcctggagaaaacctttag

SEQ ID NO: 31479 - DNA, 1611 bp, Artificial Sequence
  Description of Artificial Sequence: Synthetic coding sequence
atggggtcaaacaaaagcaaacccaaagacgcttcacagcgcagaaggtctctcgaacccgctgagaacgtccacggtgctggaggcggtgcattccctgcttcacaaaccccgagcaaacccgcatcggccgacgggcatcgaggtccgtccgcggctttcgcacccgctgccgctgagcctaaattatttggcggattcaactcgtccgacacagtgaccagccctcagagagcaggtcccctggctggaggggtcaccacattcgtggcactgtatgactatgagagcagaacggagacggatctttccttcaaaaaaggcgaacgcctgcagattgtgaacaatacagaaggagactggtggctggctcacagtctatcaaccggccagaccgggtatataccatcaaactatgtggctccgagcgattcaatccaagccgaggaatggtacttcggtaagatcacgcggcgagagagcgagcggctgctgctcaacgccgaaaatcctaggggtacatttttggtcagggaatccgagaccactaaaggggcttactgtctgtctgtaagtgattttgacaatgctaaaggcctgaatgttaaacattacaagattcggaagctggactcaggcggattctatatcaccagtcggacacagttcaatagcctgcagcaactagtcgcatactactcaaagcacgctgacgggctttgtcacagacttactactgtctgccctacatccaagccgcagacccaggggcttgctaaggatgcttgggagatcccaagagaatccctccgtcttgaggtaaagctgggtcaggggtgttttggagaagtatggatgggaacctggaacgggactacaagggttgccataaagaccctgaaacccggaaccatgtctccagaggcatttttgcaagaggcacaggtgatgaaaaaactgaggcacgagaaactagtccaattgtacgctgtggtctccgaagaaccgatctacattgtgacggaatatatgtctaagggaagccttctggactttcttaaaggagagactggcaaatatttgaggctcccacaactggtggacatggctgcccaaattgcctctggcatggcttatgtcgaacggatgaactacgttcatcgagatctgcgcgctgccaacatcctggtgggagagaacctcgtgtgcaaagtcgccgactttgggctcgcccgactgattgaggataatgagtacaccgcgcgtcagggagccaagttccctatcaaatggactgctcctgaagccgcactttatgggagattcactattaagagcgatgtctggagctttggaatacttcttactgagctcacaactaaggggagagttccgtacccaggcatggtcaaccgcgaagtgctcgaccaggtggaacgcggatacaggatgccatgcccaccggaatgtcccgaaagtctccacgatttaatgtgccagtgctggcgaaaagagccagaggagcgaccaacatttgaatatttgcaggcttttctggaagattattttacttctaccgagccccagtatcagccaggcgagaatctgtag

SEQ ID NO: 31480 - DNA, 1611 bp, Artificial Sequence
  Description of Artificial Sequence: Synthetic coding sequence
atgggcagcaataagtccaaacccaaagatgcctcccagcggcgtcggagtctggaaccagctgaaaatgtccatggcgcaggcggaggggctttcccggcttctcagacaccctcaaaacctgcctccgcagatgggcatagagggccatccgctgcgtttgccccagcagcggctgaacctaaactattcggaggcttcaatagttcagacacagtcacttctccccagcgagctggccctcttgccggaggagtgactactttcgtcgctctttacgattacgagtccagaactgagacagacctgtcttttaaaaagggtgaacgtctgcagatcgttaacaataccgaaggcgactggtggcttgctcacagcctgagcacggggcagaccggttacatcccctctaattatgtcgccccatctgactccatacaggcagaggagtggtattttgggaagattacgcggagggagtctgagcgtctgctactgaacgctgagaacccaaggggtacgttcctcgtccgtgaatcggaaactaccaagggtgcctactgtctctccgtgagtgactttgacaacgccaaggggctgaacgttaagcactacaagatcaggaaattagatagcggaggattctacattacatcaaggacgcagttcaacagtcttcaacagctggtggcctactattccaaacacgctgacggactgtgtcatagactcaccactgtgtgtcctactagtaaaccacagacacagggtctcgctaaggatgcgtgggaaatccctcgggagtctctaaggttggaggtgaaacttgggcaggggtgtttcggagaggtatggatgggcacatggaatggaaccacaagggtagcaattaagaccctcaaaccaggtacaatgtcgcctgaggccttcctccaggaagctcaagtgatgaaaaaattgcggcacgaaaagctggtgcagctgtacgccgtggtgtctgaagaaccaatttatatcgtcactgaatatatgtccaagggcagcctcctggattttctgaaaggcgaaactggcaagtatctacgcctcccccagctcgtggacatggctgctcagatcgcctcaggaatggcctacgtggagcgcatgaactatgtccatcgtgacctgcgcgctgctaacatcctcgttggcgagaatctcgtctgtaaagtcgcggattttggcctggcaaggttgatcgaagacaacgagtatacagccagacagggagccaagtttccgatcaaatggacagccccagaggccgctctatacggacggttcacaataaagagcgacgtctggtcttttggaatccttcttacagaattgacaacaaagggcagagtgccgtatcctggcatggtgaaccgcgaagtgctggatcaggtggagaggggatacaggatgccatgtccccctgagtgtcctgagtccctgcatgacctgatgtgtcagtgctggcggaaagaacctgaggaaaggcccacgtttgagtacctgcaggcctttttggaagattacttcacgtccactgagccacagtaccagcctggagagaatttgtag

SEQ ID NO: 31481 - DNA, 423 bp, Artificial Sequence
  Description of Artificial Sequence: Synthetic coding sequence
atgcccctggtgaagaggaatattgatccgagacatctgtgccataccgccctcccccgaggaatcaaaaatgaactggagtgtgtgacgaacataagcctggcaaacatcattcgacagctttcttcacttagtaaatatgcagaagatatcttcggggagttattcaacgaggcacacagcttctcatttcgcgtgaattcactgcaggagagagtggaccgcttaagcgtctctgtaactcagttagatcccaaggaggaggaattgtctttacaggacattaccatgagaaaggccttcaggtcatccaccatacaggatcagcaactctttgaccgcaaaacgctgccaattccacttcaggagacttatgacgtgtgtgagcaaccacccccacttaacattctgaccccttattag

SEQ ID NO: 31482 - DNA, 1680 bp, Artificial Sequence
  Description of Artificial Sequence: Synthetic coding sequence
atgccacttgttaaacggaacattgatcccaggcacctgtgtcatactgcccttcctcgaggcataaagaacgagctggagtgtgttactaacatcagtctagcgaacattatccgacagctgtcaagcttgtctaagtacgctgaagacattttcggggaactttttaatgaagcccactctttttcctttcgcgttaactctctccaggaaagggtggatcggctgagcgtctctgtgacccagctggaccccaaagaggaagagctgagcctccaagacatcacaatgcgtaaggcattccgatcatctaccatccaggaccagcagctgttcgatcggaagacccttcctatacccttgcaggagacttacgacgtgtgtgagcagcccccacctctgaatattttaaccccataccgagatgacggtaaagaagggcttaagttctatacgaatccatcgtactttttcgatctgtggaaagagaagatgctccaagacaccgaggacaagcgcaaagagaagcggaaacagaagcagaagaacttggatcggcctcacgaacccgaaaaagtgcccagagcccctcacgacagacgcagggagtggcaaaaactcgctcagggcccagagctcgctgaagatgacgccaacctgctacataaacacatcgaagtggcaaatgggccagcctcgcacttcgagactcgacctcagacctatgtcgatcacatggacggtagttacagtctgtcggctctaccctttagccagatgtctgagcttctgactagagcggaggagagagttttagtgcggcctcatgaacctcctcccccacccccaatgcacggtgccggagatgctaagccgatccccacgtgcatatctagcgccactggcctcattgagaatagaccacagagcccagccacgggaagaacgccagtcttcgtgtccccaactcctccaccacctcctcccccactaccgtctgccctgtctacgtccagcctgcgggctagcatgaccagcaccccaccgccaccggtcccacctcctccaccccctccggctacggctctccaagcgcctgctgttccaccaccacccgctccgctccagattgcccctggcgtgctgcaccccgctccaccacctatcgcaccaccactggtccagccctctcccccagtggcccgagccgcacccgtgtgcgagactgttccagtccatcctctgccgcagggagaagtgcagggcctccccccaccacccccacctccacccctccctccgccaggaatcagacccagctccccagtgaccgttaccgctctcgcccacccgccttccgggcttcacccaactccctccactgcccctggaccccacgtccccctgatgcctccatcacccccatcacaggtcatacctgccagcgaacccaagcgtcatccctcaacactacctgtcatcagtgacgcgagatccgtgttacttgaggccattagaaagggcatccaactccggaaggtggaggaacagagggagcaggaagctaagcacgagcggattgaaaacgatgtggcaacaatcctatcccgcaggattgcagtggagtatagtgacagcgaggatgatagcgagtttgatgaggtggattggctggaatag

SEQ ID NO: 31483 - DNA, 423 bp, Artificial Sequence
  Description of Artificial Sequence: Synthetic coding sequence
atgcccctagtcaaacggaatatcgatccacgacatctgtgccataccgcattaccgagagggataaagaacgaactcgagtgcgtaaccaacattagcctagccaatataatccgccaattgtcaagcttgagtaagtacgccgaggacatattcggtgaattgttcaacgaagctcattcgttcagcttccgcgtaaatagcctgcaagaaagagttgatcggctgtccgtgtctgtgacgcaattggacccaaaggaagaagaactcagcttgcaagatatcaccatgaggaaagcattccggagttcgacgatccaagatcaacaattgttcgaccggaaaacactgcctattccactgcaagagacatacgatgtgtgcgaacagcctccccctcttaatattctgactccatactag

SEQ ID NO: 31484 - DNA, 1680 bp, Artificial Sequence
  Description of Artificial Sequence: Synthetic coding sequence
atgccactcgtgaagcggaatatcgatcccagacacctttgccatacagccctcccgcgtgggataaagaacgaactggagtgcgtgacaaatatctcacttgccaacatcatcaggcaactcagctcgctctctaagtatgcggaagacatattcggggagttgtttaacgaggcgcattctttttcgtttagagtcaattctctacaagagagggtagatcggctgtcagtatccgtgacccagctcgacccgaaggaggaggaattgtctctgcaggacatcacgatgaggaaggctttccgcagttctaccatccaggaccagcagctgttcgacagaaagaccttgcccattccattgcaggagacctacgacgtgtgtgaacagcccccacctctgaatatcttgacaccctatcgcgacgatggcaaagagggcctgaaattttacacaaacccttcatattttttcgacttgtggaaggagaaaatgctacaggataccgaggataagcggaaggagaaaagaaaacagaaacagaaaaatctggacaggccgcacgaacccgagaaggtcccacgcgcacctcatgaccggcgaagggagtggcaaaaactggcccaggggccagagctcgctgaggatgacgcgaatctcctgcacaagcacatcgaggtggcaaacggcccagcatcccattttgagacccgtcctcaaacgtatgtcgaccacatggacggaagctatagcctgtccgccctcccattctctcagatgtctgaactcctgacacgtgctgaggaacgcgtacttgtgcgaccccacgaaccacctccgcctcccccaatgcacggggcaggggacgcaaaaccaattccgacctgtatctctagtgcaacgggcctcatcgagaatcgacctcagtctcctgcaactgggcgaacacctgtctttgtttcccccacacctcctcccccacctccaccccttccaagcgctctgagcacctcatctctcagggcttcaatgacatccaccccccctccgcctgttccccctccacctcctccacccgcaactgctttacaggccccagcagtgcccccaccaccggcaccacttcagatcgccccaggggtgttacacccagccccacctccaatcgcacccccattggtgcaaccatcgcccccagtggctcgcgcagccccagtgtgcgaaactgtgcctgtgcaccccctgcctcagggggaagtgcaggggctgcctcccccaccccctcctcctcctctgcctcctcccggaattcgccctagtagtcctgtcacagtgaccgccttggcccatcccccttccgggctgcacccaacaccttccaccgccccaggacctcatgttccacttatgccgccttctcctccaagccaggtgatccccgcaagcgaacccaaaagacacccttctacgctccctgtgattagtgatgccagaagcgtgctgctggaggcaattaggaagggaattcagctgcgcaaagtggaggagcagcgggagcaggaagctaagcacgaaaggattgaaaacgatgtggcaaccattctctcgcgtcgcatagctgtggagtatagcgattcggaagatgattcagagtttgatgaagtggactggcttgagtag

SEQ ID NO: 31485 - DNA, 1680 bp, Artificial Sequence
  Description of Artificial Sequence: Synthetic coding sequence
atgcccctcgtgaaaagaaatatcgatccgagacacctctgtcataccgctctgccgagggggattaagaacgagttagagtgcgtgactaacatatccctggccaacatcatccgacaactgtcgtcccttagtaaatacgcggaagatatattcggagaactgtttaatgaagcccacagtttctcgttccgggtgaacagcctgcaggaacgcgtcgatcgactgtcagtttctgtcactcagcttgatccaaaggaagaagagctgagtctgcaagacattaccatgagaaaggcgtttcgttcttcgacaatacaggaccagcagctgttcgacaggaaaactctgccgatccccctgcaggaaacctatgatgtatgcgagcagcctccaccattgaatattttaacaccatatagggacgacgggaaggaggggttaaagttttacacaaaccccagctacttttttgacctgtggaaggagaaaatgttgcaggacacagaagacaagcgtaaagaaaagagaaaacagaagcagaaaaatctagacagaccacacgaacctgaaaaggtacctcgggcaccccacgaccgaaggcgtgaatggcaaaagctcgcgcaggggcctgagctggccgaagatgatgcaaacttactgcataaacatatcgaggtggccaacggccctgcttcacacttcgagaccagaccacagacttacgttgaccacatggacgggtcttacagcctgagcgccttaccctttagtcaaatgtccgagctcttgacaagggccgaggaaagagtccttgtcaggccgcatgaaccacctcctcctcccccaatgcacggggctggggatgcgaagccgatcccaacctgcatttcatcagccactgggcttattgagaatagacctcaatcaccagccacgggacgaacaccagtgtttgtcagcccaactcctcccccaccccctcctcctttgccttctgcactgtcaaccagtagtctgcgggctagtatgacaagcactcctccccctcccgtgccaccacctcctcctcccccagccactgccctgcaggcgccagccgttcccccaccccctgcacccctgcagatcgcaccaggcgttttgcaccccgctcccccacccatagcaccccctttagttcagcccagcccacccgtcgcacgcgcagcccctgtctgcgaaactgtacctgtgcatccactgccacagggcgaggttcagggactgccacctccacctccaccccctccactcccgccaccaggtattcgtccatcctcccccgtaacagtgacggctttagcacatcctccgagtggcctccaccccactcccagcactgctcccggacctcacgtcccccttatgcccccaagcccgccaagtcaggtaattccagccagtgaacctaagagacatccaagtaccctgccggtgatcagtgacgcccgatcagtgctgttggaagccatcagaaaaggaatccagcttcgcaaagttgaggaacagagggaacaggaggctaaacacgagaggatcgagaacgacgttgccacaattttgagcagaagaatagccgtggagtattcagacagcgaggacgactccgaattcgacgaggtagattggctggagtag

SEQ ID NO: 31486 - DNA, 1680 bp, Artificial Sequence
  Description of Artificial Sequence: Synthetic coding sequence
atgcccctcgtgaagcggaacattgatccgcgtcacctctgccataccgcgctccccagaggcatcaaaaatgagctggagtgtgtgaccaatatatcgcttgcaaatataatcaggcaactgtccagcctgtccaagtacgccgaggatatatttggagaactcttcaatgaggcacattcatttagcttcagagttaactcccttcaagaaagggtagataggctgtcagtaagcgtaacgcagttggaccctaaagaagaggagttaagcttacaggatataaccatgaggaaggcttttcgcagttccacaatccaagatcagcagttattcgatcgtaaaacactgcctattccacttcaggaaacctacgacgtgtgtgagcagccccctcctctgaatatactcacaccctatcgggatgacggcaaagaaggtctcaagttctacacgaaccctagctatttctttgatttgtggaaagagaagatgctgcaggataccgaggataaacgaaaggagaagcgaaagcaaaaacagaaaaacctggacaggccgcacgagcctgaaaaagttccgagggcccctcacgacaggagacgggagtggcaaaagctagcacagggcccagaactcgccgaagatgacgctaatttactccacaagcatatagaagttgccaacggtccggcatcgcacttcgagacccgtccacagacctatgtcgaccacatggacggcagctactctctttcagcattgccgttcagccagatgagcgagctgctcacccgcgctgaagaacgagtgctggtgcgcccacacgagccaccccctccacccccaatgcacggcgcaggggacgctaaacccatccctacctgcattagtagtgccacaggcctaatcgagaacagaccacagtctcccgcaaccggacgcacccctgtgttcgtatcccctactccaccacccccacctccccctctcccaagcgctctctcgacatcctccctccgagctagcatgacctccacgccccctcccccagttcctccccctccaccacccccagcaacggccctgcaagccccagctgtgccccctccacccgctcctctacaaatagcgcctggagttcttcatcctgcgcctccgcctatcgcacctccccttgtccagccttccccaccagtggctagggctgccccagtctgcgagactgtgcccgtccacccactgccgcaaggagaggtgcagggtttgccccctccaccaccaccccctcctctgccacccccagggatccgcccttcctcccctgtgacagttacggccctagcccatcccccatccggtctccaccccacgccctccacggccccaggccctcatgtcccactgatgccgccttcacctccatctcaggtgatccctgctagcgaaccgaagcggcacccatcaactctgccagtcatcagcgatgcacgttccgtcctcctggaagcaattaggaagggtatccagctccggaaagtcgaagagcagcgtgaacaggaggccaagcacgagaggatcgaaaatgatgtggctacaatactgtctcgcaggatcgctgtcgaatacagcgattctgaggacgactccgagtttgacgaggtggactggctggaatag

SEQ ID NO: 31487 - DNA, 1680 bp, Artificial Sequence
  Description of Artificial Sequence: Synthetic coding sequence
atgcccctggtgaagcgcaatattgaccccaggcacctctgtcatacagctctgcctcgcggaatcaagaacgagctcgaatgcgtaacaaatatttcattagcgaatataatccgacagttgagttctctgagtaaatatgcagaggacatttttggtgagctatttaacgaggcccacagctttagcttccgtgtgaatagtctgcaggagagagtggatcgtctgtccgtcagtgttacacagctggaccccaaggaggaggagctctcattacaggatatcacgatgagaaaagcatttagatcatctacgatccaggatcagcagctgttcgaccgtaaaactttgccaatccccctgcaagagacgtacgatgtctgcgaacagccaccccctctaaacatcttaaccccctatcgcgatgatggaaaagagggcctcaagttctacacaaatcccagctatttctttgacctctggaaggaaaagatgttgcaggacaccgaagataagaggaaggagaagcggaaacagaagcagaaaaacctggacaggccgcacgagcccgagaaggtgcctcgggcaccacacgatcggaggagggaatggcagaagttggcccagggtcccgaactagcggaggacgacgccaacttgctgcacaagcatatagaggtggctaatggaccagcctcccattttgaaactaggccacaaacctacgtcgatcacatggacgggagttatagtttgagcgcgctccccttctcacaaatgagtgagttgctaacacgtgccgaggaaagagtgttggtgcgccctcacgaaccacctcccccaccacccatgcacggagccggagacgcaaaacccatcccaacttgtatcagtagcgcaacaggcctgatcgaaaaccggccacagagtcctgcgacagggaggaccccagttttcgtctcccccacaccccctcctccgcctcccccactgccttccgcactcagcacctcatcactgcgtgcaagcatgacctccacccctccacccccagtgccaccaccaccgcctccacccgcaacggctctgcaagcccctgccgtaccccctccacctgcgccattgcagatcgccccaggagtgttgcatcccgcaccccctcccattgctcccccactcgtccaacccagcccacccgtcgccagagcggctccagtgtgtgagactgtccccgtgcaccctttaccccagggcgaagtccagggtctgcctccccctcccccacccccaccattacctcctcccggtatcagacctagcagcccagtcaccgtcaccgccctagctcaccccccaagtgggctccaccctactccgtcaaccgctcccggaccccacgtccctttgatgcccccttcaccgccaagccaggtgatcccggcttccgaacccaagcggcacccctcaacattgcctgtcattagcgatgcacggagcgtactgctcgaagcaatccggaaaggaattcagctgcggaaggttgaggaacaacgggagcaggaggccaagcacgagaggattgaaaacgacgtggccactattctaagcaggagaattgctgtggagtattcagacagtgaagacgacagtgaattcgacgaagtcgactggctcgaatag

SEQ ID NO: 31488 - DNA, 270 bp, Artificial Sequence
  Description of Artificial Sequence: Synthetic coding sequence
atgcctcttgtcaagagaaacatagaccctagacatctttgtcacacggccctaccccgtggcattaagaatgagttggaatgcgtgacaaatatctcgctggctaacattatcaggcagttatcatcactctctaagtatgccgaagatatcttcggcgaattattcaacgaggcccactctttctcattcagagtcaacagcctccaagagcgggtggaccgtctgtcagtctctgtaacccaattggatcctaaagaagaagagtag

SEQ ID NO: 31489 - DNA, 543 bp, Artificial Sequence
  Description of Artificial Sequence: Synthetic coding sequence
atgcccctcgtgaagaggaacattgaccctaggcacctttgtcatacggctctgcccagaggtattaagaacgagctagaatgcgtgactaatatcagccttgctaacatcattcgacagctgtcatccctgagtaagtatgctgaggatatcttcggagaattattcaacgaggcccatagcttcagtttccgcgtgaattccctccaggagcgcgttgacagactttctgtgagcgttacccaactggacccaaaagaagaggagctgagcctccaggacattaccatgaggaaggcctttcgttcatctaccatacaggatcaacaactgttcgatcgcaagacattgcccataccccttcaggaaacctatgacgtctgcgagcaacctccgcctctgaacatcctgaccccatacagggatgacgggaaggaggggctgaaattttatacaaaccctagttacttttttgacctctggaaggaaaaaatgctgcaggataccgaagacaagcggaaggagaaacggaagcagaaatag

SEQ ID NO: 31490 - DNA, 270 bp, Artificial Sequence
  Description of Artificial Sequence: Synthetic coding sequence
atgccactagtcaagcggaacatcgatcctcgccacctgtgtcatacagccctgcctcgaggaatcaaaaacgagctggaatgcgtgaccaacataagtctggccaatatcatcagacagttgtcctctctgtctaagtatgcggaagacatcttcggtgagctgtttaatgaggcccactcattcagctttcgagtgaattcactccaggaacgcgtggacaggttgtctgtgagcgtcacacaactagatccgaaagaggaggaatag

SEQ ID NO: 31491 - DNA, 1497 bp, Artificial Sequence
  Description of Artificial Sequence: Synthetic coding sequence
atgcccttggtgactagaaatattgaaccaagacatctgtgccggcaaaccctaccgagcgtgagatctgagctagagtgtgttaccaacatcaccctcgccaacgtgattcgacagctgggcagtctgtcaaaatacgccgaggacatctttggagagctcttcacccaggccaacaccttcgcttcacgtgtttcatctctcgccgaaagagttgacagattgcaggttaaagtcactcaactggaccccaaggaagaagaggtgagtctccaggggatcaacacgcgcaaggctttccgtagctcgaccattcaggatcagaagctgttcgatagaaactctttacccgtacctgtcttagaaacctataacacttgtgacacccccccaccattgaacaacctcaccccataccgagatgacgggaaagaggccttaaaattttacactgatccctcttacttctttgacctttggaaggagaaaatgttacaagatacaaaagatatcatgaaagagaaaaggaagcaccgaaaggagaaaaaagacaatcctaacagggggaatgtgaacccccgaaagattaaaactcgcaaagaagagtgggagaaaatgaagatgggccaggagttcgtggagtcgaaggagaagttgggaactagcggctacccgcctacccttgtgtatcagaacggaagcatcggttgtgtggagaatgtcgacgcatcctcctatccacctcctccccagtccgactcggcgagcagtcctagtccttccttttccgaagataatctgccgcctccacctgcggaatttagctatcccgtcgacaatcagaggggcagtggactggctggaccaaaacggagcagtgtcgtgtcccccagccacccacccccagctccacccctgggctctcctccaggccctaagcctggtttcgcgccacctcccgctccccctccccctccgcctccaatgatcggcatcccaccaccgcctccaccagtaggattcggtagcccgggtacaccaccgcctcctagccccccaagtttcccacctcatccagacttcgctgcccctccacccccacctccacctcccgcagcagattatcccacactcccgccaccccctctgtctcagcctaccggcggagctcccccaccacccccaccaccacctccgccaggacccccaccccctccgtttacgggggctgacggacagccagctattccgccaccattgtcagacaccactaaacctaagtcatcgctgcccgctgtgtcggacgcccgatccgatcttctttccgcaattagacagggatttcagctgcgacgagtggaggagcagcgggaacaggagaagagggatgtagtcggaaacgatgttgccacaatcctgtcacggcgtattgccgtggagtactccgacagtgaggacgattcatctgagtttgatgaggacgattggagcgattag

SEQ ID NO: 31492 - DNA, 846 bp, Artificial Sequence
  Description of Artificial Sequence: Synthetic coding sequence
atgcctttggtcacaaggaatattgagccacggcacctgtgccggcaaaccctcccatcagtccgatcagaactggaatgcgtgacaaacatcacccttgctaacgtgatccggcagcttggaagcctgagcaaatatgcagaagatattttcggagaactctttacccaggctaacacatttgcatcacgcgtgagcagcttggcagaacgagtagaccggctccaagtgaaggtaactcagctggacccaaaagaagaggaggtgagtctgcagggtatcaatactcggaaagccttccgctcgtcaacgatccaggatcagaagctgtttgatagaaactcactgccggtgcctgtcttagagacctataatacgtgcgatactccgcctcctctcaacaacctgactccttacagggatgatggcaaggaggctttaaaattttataccgaccctagttatttctttgatctctggaaggagaaaatgctgcaggacacgaaagatattatgaaggagaagcgcaaacacagaaaagagaagaaggacaatccaaatagaggtaacgttaatcctagaaagattaaaacccgtaaagaagagtgggaaaagatgaaaatgggtcaggaattcgtagagtcgaaagaaaaacttggtactagcggatatccacctacactcgtataccaaaacgggtctatcggctgcgtcgagaatgtggacgcaagctcttatcctccaccgcctcagagtgactcagcatcttctcctagtccttccttcagcgaagacaatttgccgccaccccctgcagagttcagattcagcgccgctcagggttag

SEQ ID NO: 31493 - DNA, 1533 bp, Artificial Sequence
  Description of Artificial Sequence: Synthetic coding sequence
atgcccgtccccccaccccctgcccctcctccgcctccaaccttcgcactcgcaaacacggagaagccaaccctgaataaaacggagcaggcaggaagaaacgccctactgtccgacatttccaaagggaagaaactgaaaaaaactgtgaccaatgaccgtagcgcgcctatcctggataagcctaaaggtgcaggagcaggcggtggcggtggtggctttggaggtgggggaggcttcgggggagggggaggcggaggcggaggtggctctttcgggggtggcggaccacctgggctaggtggacttttccaggctggaatgcccaagcttagaagtactgcaaatcgcgacaatgatagtggaggctcaagaccaccactgttgccaccgggtggtagaagcacttctgccaaacccttcagtccaccgtccggccctggacgatttcctgtgccgtccccgggtcaccgttcaggcccacccgagcctcagcgcaatcgcatgcctcccccacggccagatgtcggaagcaaaccagacagtattcccccaccagtcccatctacccctaggcctattcagtcaagcccacacaataggggatcccctcctgtccccggaggtcccaggcaaccttcgccgggaccaactccacctcctttccctgggaaccgtggcaccgccctgggcggaggctccatccggcagagccccctcagcagcagctctcccttttcaaatcgccctcccctgcccccaacacctagtcgagctctagacgataagcctccgccaccacctccaccagtggggaaccgcccttctatccaccgagaggccgttcctccaccacctccgcagaacaataagcctccagtgccatccacaccccgtcccagcgcatcttcacaagctccaccaccgccacctcctccctcacgcccaggcccacctcctctaccaccctcgagcagcggcaacgatgaaactccaaggctgccccagagaaatctatccctctcatcctccacaccccctctccctagtccaggacgctcgggacccttacctccaccacccagcgagagacctccccctccagtccgcgacccacccggaagatctggtccccttccccctccccctccagtgagtaggaatggatcaacaagtcgcgctctgcctgcgaccccccagctgccaagtcggtctggagttgattcacctcggtccggaccgcgaccacccctcccaccagacaggccatccgcaggcgcaccgccaccgcctccgccttctacctccatcaggaacggatttcaggacagtccctgtgaagatgagtgggagtctcgcttctactttcatcccattagcgaccttccgccacctgagccttatgttcaaactacgaagtcctatcccagtaagttggcccgaaacgagtcacgttcagggtccaatcgcagggaaaggggggctcctcctcttcctccaattcctcgtcctcccaagcaagccgcagaatag

SEQ ID NO: 31494 - DNA, 1512 bp, Artificial Sequence
  Description of Artificial Sequence: Synthetic coding sequence
atgcctgtgcctccacccccagctccccctccaccccctacattcgcattggctaacaccgaaaaacctacgctcaacaagaccgaacaggctgggcgaaatgccctgctgagtgacatatccaagggaaaaaaactgaagaagactgtgacgaacgatcgatcggcccctattctggacaagcccaagggggctggagccggaggaggagggggagggttcggcggaggtggcggatttggcggaggtgggggaggaggcggaggtggtagcttcggaggaggcggaccaccaggcctgggaggcttgttccaggccggaatgcctaaactgaggtcaactgccaaccgggacaatgactcaggaggatctaggcccccattgctgccccctggcggaaggagtacctccgccaagcccttctctccaccgtcaggtccagggaggtttcctgtgccgtcccccggtcacaggtctggacccccagagccccagcgcaacagaatgccacctcccagaccagatgtaggctccaagcccgacagcattcctccacctgtaccctcgacaccaaggcccatccaaagttcgcctcacaatcgtggctcacctcctgtgcccggaggtcccagacagcccagcccaggtcctacaccgccaccatttccaggaaatcgaggaactgccctgggagggggttccataaggcagagtcccttgtcctcaagctcgcctttttccaatcggcctcccctcccaccaacccctagccgcgcactcgatgacaaaccgcctcctccgccacctcctgtgggaaatagaccatccatccacagagaagccgttcctcctccccctccccaaaacaataagccacctgtacccagcactcctaggccatctgcctcttcacaggcgccacctcctccccctccaccatcgcggccaggcccacccccacttcccccttcatcttccggaaatgatgaaacccctagattaccccaaaggaatctgtcacttagttcaagtaccccgccattgccttctcccggtaggagtgggcctctccccccaccaccctccgaacgcccaccaccccctgtcagagatccgcctgggagatcgggacctctgccaccgccacctcccgtctcaagaaacgggtctacttctcgggctttgcccgctacacctcagctgccctcgcggtcaggcgtggactccccaagatcaggaccaaggccaccgcttccccctgaccggccaagcgccggagccccacctccacccccaccatcaacatcaattcggaatggattccaggatagtccatgcgaggatgagtgggaaagtcgattttacttccacccaatttccgaccttcccccacccgagccttacgttcaaaccacaaagagttatcctagtaagttggcgaggaatgagagtagatcgggtagcaacaggcgtgagagaggcgctccacctctgcctcctatcccaagatag

SEQ ID NO: 31495 - DNA, 1512 bp, Artificial Sequence
  Description of Artificial Sequence: Synthetic coding sequence
atgccagtaccccctcctccagcacctccccctcctcccactttcgcactggctaatacagaaaaacccactctcaacaaaacagaacaggctgggcgaaatgctctgctgagtgatatcagcaagggcaaaaaactcaagaaaactgtgacgaatgaccgtagtgccccaatactggacaaacccaaaggagctggggcaggagggggaggtggcggatttggcggaggcggtggcttcgggggtggaggcggtggaggtgggggtggcagttttggcggaggcggacctcctggacttggtggactgttccaggccggtatgcctaagcttcggagcacagctaatcgggacaacgattctggcggatccagacctccccttctgccaccagggggtaggtcaactagcgccaaacctttttcacccccttccgggcctggcaggtttcccgtgccgtcgcctggacatcgctcaggaccccctgaaccccaaaggaaccgcatgccgccaccccgtcccgacgtgggaagcaaaccagacagcatcccaccccctgtcccaagcacccccagaccaattcagagctctccacataaccgtggaagcccaccagtgcccggtggcccacgtcagcccagtcccggtcctacaccaccacctttccctggcaataggggtaccgcccttggcggagggagcatacgccaatcacccctgagcagttccagtcccttctcaaacaggccacccttaccacccaccccaagtagagctctggacgataaaccccctccccctccccctcctgtcggtaacagaccttctattcaccgcgaggcagtgcccccaccccctccccagaacaacaagccacccgtcccttctactccccgacctagtgcttcatcacaagccccacccccaccccctccaccctctcggcctggtcctcctcctctcccccctagttcatcgggcaatgacgagacgcctaggctgccacaacgtaatctttcacttagctcatccaccccgccattgccctccccagggagatccggccctctccctcccccacccagtgagcggcctccccctccagtaagggaccctcccggtaggtctggacccttaccacctccccctcctgtaagcagaaacggttccaccagccgggctctgccagccaccccacagctgccctcacgaagcggagtggattccccacggtctggaccccgaccgcctttgccacccgaccggccttccgcaggtgctcccccacccccacctccctccacttccattaggaacggtttccaagacagtccttgcgaagacgaatgggagtccagattttacttccaccccattagcgacctcccaccacccgagccttatgtacagacgactaagtcttatccgagtaaactggcacgcaacgaaagccgaagcggctctaatcgtcgcgaaaggggagcgccacctcttccccctattccaagatag

SEQ ID NO: 31496 - DNA, 1512 bp, Artificial Sequence
  Description of Artificial Sequence: Synthetic coding sequence
atgccggtgccgcctccacccgctccacctccacccccaacatttgctcttgcgaacaccgagaagccaaccctgaataagaccgagcaagcaggaaggaacgccctactgagcgacataagtaagggcaaaaaacttaaaaaaactgttaccaacgatagaagcgccccaatccttgacaagcccaagggcgcaggcgctgggggtggcggtggaggatttggtggtgggggaggttttgggggtgggggagggggtgggggtggtggatcttttggtggcggaggcccacccggtctggggggtctgtttcaagctggaatgccaaagcttaggtctactgccaatagggacaatgacagcggaggaagtcgtcccccactgttacccccaggcggtcggtcaacttccgccaaaccgttctcacccccatctgggcctggacgctttcccgtcccctcccccggacaccgttcagggcctccagaacctcagcggaatcgaatgcctcctccccgacccgatgtcggatcaaaaccagatagtattcccccacccgtcccaagcactccacggccaattcagtcgagccctcataaccggggttctccccctgtacccggaggaccacggcagccaagccccggtcccacccccccaccatttccagggaatagaggtacagccctgggtggagggagcatccgacaatcacccctctccagctcttctccattcagcaaccgccctcccctcccaccaacccccagccgggctctggacgacaaaccgccaccccctcctccgcctgtgggaaatagaccaagcattcaccgggaggcggtacctccaccaccaccacagaacaataaacctccagtaccgtctacacccaggccaagcgcctcttcacaggcaccacccccaccccctcctccaagtagacccggtccccctccactcccacctagctccagcggtaacgatgaaacccctcgcctacctcagcgcaatctatctctttcaagcagtaccccccctctgccaagcccaggccgatcagggcctctcccgccaccccctagcgagcgacctccaccaccagtacgagaccctcccggaaggtcagggccactcccgccacctcctccagtctcacgtaacggaagcacatccagggccctccctgctacaccacagctaccctctaggtcaggagtcgatagcccccgatccgggcctcgccctcctttacctcctgatcgcccatctgcgggagctccgcctcccccacccccatccacatcaatacgtaacgggttccaggatagcccgtgcgaggacgagtgggaatcccgattttattttcacccaatatccgacctccccccacccgaaccatatgtgcaaacaacaaagagctacccaagtaagctggctaggaatgagagtaggtccggttccaatcgtcgcgaaagaggggcacctcctctgccacccattccaaggtag

SEQ ID NO: 31497 - DNA, 1080 bp, Artificial Sequence
  Description of Artificial Sequence: Synthetic coding sequence
atgccagtgccgcctccacctgcacctccacccccaccaacgttcgccctggccaataccgagaaaccaaccctgaataaaacagagcaagcgggacggaacgccttattatcagatatctcaaaggggaaaaagctcaagaaaaccgtgactaacgataggtccgccccaattctggacaaaccaaagggcgctggggctggcggaggaggtgggggattcggtggaggaggaggattcgggggagggggagggggaggtggtggcggaagtttcgggggaggtggccctcctggattaggagggctttttcaagcaggtatgcctaagcttcggtctacagcaaatcgtgacaacgacagtggagggtcacggcctcctcttttgcccccaggtggcagaagcacctccgcaaagcccttcagtccccctagcggcccaggcaggttcccagttccatcccctgggcatcgctcagggccacccgagccccagcggaaccggatgcctcccccacgaccagacgtaggtagtaagcccgacagtattccaccacctgttccctccacgccgagacccattcagtctagtccacacaatagggggtcccccccagttcccggaggccctcgacagccatcccctggcccaacacccccaccgcctccgcctgtgcgggatcctcctggacgaagcggccctcttccacctccccctccagtcagcagaaatggctccacgtcgcgcgctctgcccgcaacacctcaactgccttcccgaagtggagtggacagcccacggagtggtcctcgtcctccactgccacctgatagacctagcgcaggtgctcctccacccccacctccgagtacatccattcgcaacggcttccaagattctccctgtgaagacgaatgggagagtaggttctattttcatcccatttccgatctacctcctcccgaaccctatgtgcaaacaaccaagagttacccctccaagttggccaggaacgagtctagatctggttcaaatagaagagagagaggagccccacctcttccgcctatcccacggtag

SEQ ID NO: 31498 - DNA, 1482 bp, Artificial Sequence
  Description of Artificial Sequence: Synthetic coding sequence
atgccagtcccgccacccccagctcctccccctccccctacctttgccctggctaacactgagaaaccaacactgaacaaaacagagcaagccggacgaaatgcacttttatcagatatcagcaaagggaagaagctgaaaaagacagtgactaacgaccgctctgctcctatcttggataagcccaagggcgcaggagccggaggcggaggtgggggatttggtggcggtggagggttcggtggtggcggtggcggaggtggtggagggtcctttgggggagggggacccccaggcctgggcggactgtttcaggcaggaatgccaaagctgcgttcaaccgcaaaccgcgacaatgactccggcggttctagaccaccactgcttcctcctggaggcagatcgacatcagccaagcctttctcgccaccatccggacccggacgattccctgtacccagccccggacatcggtcagggcctcccgagccacagcgcaatcgaatgccgcctccccgtcccgatgtggggagtaaacctgactccataccacctcctgtcccttcgaccccaagaccaatccagtctagtcctcacaacagaggatcgcctccggtccctggcggacctaggcagccatctcctggtcctacacccccaccgtttcctgggaaccgaggcacagcccttggtgggggttccattagacagagccctttgtcctcgagctctcctttcagcaatagaccccctctccctcccaccccatcccgggcactggacgacaaaccccctccgccaccaccaccagtgggaaatcggccatcaatccaccgggaagccgtgccgcctcccccaccacaaaacaataagccaccagtcccatctacgccccgtccgtccgccagctcgcaggcccctcctccaccaccccctccctctcgtcctgggcctccgcctcttcctccctcatcttcgggtaatgacgaaacaccccgtttgcctcagcgcaatttatcattatcttcctcaacacctcccctgcctagcccagggagatcaggacccctgccgccacctcctagtgagagaccaccaccacctgtacgcgacccaccaggtagaagcggacccctcccaccaccaccaccggtcagtcggaacggctcaacatcccgagcactcccagcaacacctcaactaccatctcgtagcggcgtggacagtccacgctcgggccctcggccacctctgccgcctgacaggccatcggccggagcacccccacctccacccccatccaccagcatcagaaacggtttccaagattctccttgtgaagacgagtgggaatctcgattttattttcatcccattagcgatttacctccaccagagccttacgtccagaccaccaaatcatatccaagcaaactggccagaaacgagagtaggtccgaatacttttgccaagggttttag

SEQ ID NO: 31499 - DNA, 303 bp, Artificial Sequence
  Description of Artificial Sequence: Synthetic coding sequence
atgcctgtgccccctcccccagctcccccaccacctccaacatttgctctcgctaacactgaaaaaccaaccttaaacaaaactgaacaggctggacgtaatgccctcctgtctgacatctctaagggaaaaaaattaaagaaaacagttacaaacgatcggagcgccccaattctcgacaaacccaaaggcgcaggcgctggtggcggtggtgggggtttcgggggtggcggtggattcggaggaggcggagggggtggaggcggagggtcattcggcggtgggggaccaccaggactatag

SEQ ID NO: 31500 - DNA, 1647 bp, Artificial Sequence
  Description of Artificial Sequence: Synthetic coding sequence
atgaaaacactcgaaactcaaccgctggcccctgattgctgccccagtgaccaggaccccgcaccagcccatccaagtccgcatgcatcacctatgaataagaatgcagatagcgaactgatgccaccaccccctgaacgaggggacccacctagattaagccctgatccagtcgctggatcagccgtctcccaggagctacgagagggcgacccagtctccctgagcacgcctctggagacagagttcggctcccccagcgagctgagccccaggatcgaggaacaggagttgtccgaaaacacatccctacccgctgaggaagcgaatggctctttgagcgaggaggaggctaatggaccagaattaggttcgggaaaggccatggaggacacttctggggaacctgcggcagaggacgaaggcgacaccgcctggaactatagttttagccaactcccacggtttctctctggatcatggagtgaattttctacccagcccgagaatttcctgaagggctgcaaatgggccccagatgggagctgcattctcaccaattcagccgacaacatcctccgcatctataacctgcctccagagttgtatcatgaaggcgagcaggtggagtatgctgagatggttccggtgctgagaatggttgagggagacaccatatacgactattgttggtatagtctcatgtcctctgcccagcctgatacttcttatgtggcctccagttctagggagaaccctatccacatctgggatgcatttactggcgagcttcgcgcttcttttcgtgcttataatcacctggatgagcttactgcagcccattccctgtgtttttcccccgacggctctcagctattctgcggattcaaccgcaccgtccgggtattctcaactgctcgacccggaagggactgtgaagtgcgcgcaacatttgctaaaaaacagggacagtctggtatcatctcttgcatcgcatttagtcccgctcagcccttgtatgcctgcgggtcatatggccgaagtctgggattgtacgcatgggacgatggaagcccattagccctcttgggaggccaccaggggggaatcacccatctgtgtttccaccccgatgggaatcgtttctttagcggtgcgagaaaggacgccgaactcctttgttgggatctgagacagtctggctatcctttgtggagcctcggccgtgaagttacaactaaccaacggatctacttcgacctggacccaaccggccagtttcttgtgtctgggagcacaagcggagctgtatccgtctgggataccgatgggccaggcaatgacggaaagccagagcccgttttatcgtttcttccccagaaggactgtacaaatggtgtgtcattgcatcctagcctgcccctccttgccacagcatccggtcagcgtgtttttccagagcctactgaatcaggcgacgagggagaagagctcggactgccactgctgtccacaagacacgtgcaccttgaatgtagactgcagctctggtggtgtgggggagccccagacagctcaatccctgatgatcaccagggagagaaaggccagggcggtaccgaggggggagtgggggaactgatttag

SEQ ID NO: 31501 - DNA, 1647 bp, Artificial Sequence
  Description of Artificial Sequence: Synthetic coding sequence
atgaagacactcgagacgcaaccactcgcacctgattgttgcccatcagatcaagatccggctcccgctcatccctcaccgcatgccagtcccatgaataagaacgctgactccgagctgatgccccctcctcctgaaagaggcgatcccccacggctgtctccggatcccgtggctgggagcgcagtgtcacaggagctgcgggagggagatccagtgtccctgagtacgcccctcgagacggaattcggctcaccaagcgaactctctccccgaatcgaggagcaagaactgtccgagaacacgagtctgccagccgaagaggctaatgggagtttgtcagaagaagaagcaaatgggccagaactcggctccggcaaggccatggaggatactagcggagaacccgcagctgaagacgagggcgatacagcctggaattattctttttcgcaactccctcggttcttatctgggtcatggtccgagttcagcactcagccagagaactttctcaaaggctgcaaatgggctccagacggtagctgcattcttactaatagtgcagataatatactacggatctacaacctgcccccagaactgtaccatgagggggagcaggtcgagtacgccgagatggtcccggtgcttagaatggtggagggtgacaccatctacgactactgttggtattcgctgatgtcctccgcccagcccgatacttcttatgtcgcaagttcctcccgtgagaatcctatacacatctgggatgcctttacaggcgagttacgagctagttttcgggcatacaaccacttagacgagttgaccgccgctcactcactgtgttttagccctgatgggagccagcttttctgcggctttaaccgcactgtgagggtcttttccacagctagacctggcagggattgtgaggttcgggcaaccttcgcaaagaagcaggggcagagcgggatcatatcctgcatcgccttctctccagcccagccactctatgcttgcggctcgtatgggagaagcctcggactatatgcctgggatgatgggagccctttggcccttctcggaggtcaccaaggaggaatcacacatctttgtttccatcccgatggcaataggttcttcagcggcgctcggaaggacgctgaactgctttgctgggatctgcggcagtccggatacccactctggtccctgggcagagaggtcacaaccaatcagcgcatttacttcgatttggacccaactggtcagttcttagtgagtggctctacctcgggagccgtgagtgtgtgggatactgatggtcctggaaatgacggcaaaccggaacctgtgctgtcttttctgccccaaaaggattgcaccaacggggtgagtctgcaccccagcctgcccctcctggcaactgcctcaggacagcgagtctttcccgagcccactgaatccggcgatgaaggagaggagcttgggctgcccctgctgtccacacgacacgtccatctggaatgtagattgcaactgtggtggtgcgggggtgcccctgattcaagcattcccgacgatcaccaaggtgagaaggggcagggaggcacagaagggggtgtaggcgagttgatctag

SEQ ID NO: 31502 - DNA, 1647 bp, Artificial Sequence
  Description of Artificial Sequence: Synthetic coding sequence
atgaagactctggagacacagccattagcccctgactgttgtccaagtgaccaggatcctgcccctgcgcatccgagcccacacgcttcccccatgaataaaaacgctgattctgagcttatgccgccaccccctgagaggggtgatcctccaagactaagtccggacccagtcgctggatccgcggtctcacaggaactcagggagggggatcctgtgagtttgtcaacccctctcgaaactgagttcggcagtccttcagaactctcacccaggattgaggaacaggaactcagtgagaatacctctcttcctgcggaggaggctaacggctccctgtcggaagaagaagcgaacggtcccgaactgggcagcgggaaggccatggaagatacttccggcgagcctgcggctgaagatgagggagataccgcctggaattactcattttcacagctgccccgttttctgagtggatcctggtccgagtttagcacccagcccgaaaattttctgaagggttgcaagtgggccccagatggtagttgcatactcacaaattccgcggacaacatcttgaggatatacaatctgcccccagagctttaccacgaaggtgagcaagtggaatatgcagaaatggtgcctgtgcttcgcatggtcgaaggcgacaccatctatgattactgctggtactctctgatgtctagcgcacaaccagatacgtcctacgttgccagctcatcacgcgaaaaccccattcatatctgggacgcattcactggtgaactgcgtgcaagctttagggcatacaatcacctggatgagttgacagccgctcacagtctttgcttttcgccagacggtagccagctgttttgtggattcaatcgaacggtgagagtgttctccaccgcccgacccggaagagattgcgaggtgcgggcaactttcgccaagaaacagggacagtccggaattatcagctgtattgcctttagccccgctcaaccactgtacgcctgcggtagctacggacgctctttggggctttatgcctgggatgacggctctccactggcccttctgggcggtcaccagggaggtattactcatctctgtttccaccctgacggtaatagattctttagcggagcgagaaaagatgcggagctgctttgctgggatctgcgacagtcaggctaccccctttggagcctaggtcgtgaagtgacaacaaatcagagaatctatttcgacctggatcccactggacagttcttggttagcgggtccacatccggcgctgtatccgtgtgggacaccgatggtcctggcaatgacggaaagcctgaaccagtgttgagctttcttcctcagaaggactgtacaaatggtgtcagtctacatccttctttgcccctactggccactgcatctgggcaacgcgtctttcccgaaccgaccgaatccggggatgagggcgaagagctgggcctcccccttttgtctacaaggcacgtgcatttggagtgcaggcttcagctgtggtggtgtgggggagccccagactcctcaattcccgacgaccatcagggagagaaggggcagggtggaacagaaggcggagttggggaactaatatag

SEQ ID NO: 31503 - DNA, 567 bp, Artificial Sequence
  Description of Artificial Sequence: Synthetic coding sequence
atgaagacattggagacacagcctctggccccagattgttgcccatctgatcaggatcctgctcccgctcaaccagacacatcttacgtcgcttcaagcagtagagagaatcctattcatatctgggatgcattcaccggagaattgcgcgctagcttccgcgcatataaccatctcgacgaattgactgccgcacattccttgtgcttcagcccagacggctcccagcttttttgcggatttaatcgcacagtgagagtatttagcaccgctcggccaggacgggactgtgaggtgcgcgcaacctttgggaagcatttgtgcttgcagggacggaggcgcggtaagggaaccgcgacatgtaccggagccttttgcgaacccggagctacttgcggaggctcacgcagaccgctgtacggtccagggagcagatgctccccggttggaagaggagcaaatcggctgcgagcgggaagaaaaccctcgcagggccagcctgcaggacagaggaccgcaagtttccttaattcctatccagtctcatgtggggcatttgggctctag

SEQ ID NO: 31504 - DNA, 1647 bp, Artificial Sequence
  Description of Artificial Sequence: Synthetic coding sequence
atgaaaactctagaaacccagccactcgccccagactgttgccccagcgatcaagatccagcacctgctcatccgtcaccacatgcatcgccgatgaacaaaaacgccgacagcgagctaatgcctcccccacccgaaagaggagatcccccaagactgagccccgaccctgttgccggttccgcagttagtcaggagctgagggagggggatcccgtctcactgtccacaccactagagacagagttcggatcccctagcgaattgtctccaaggatcgaggaacaagaactgagcgaaaacaccagcctgccggcagaggaagctaacgggtctttatcagaggaggaagccaatggccctgagcttggctccggaaaggccatggaagacacatccggcgagcctgctgccgaggatgagggcgacacagcatggaattatagttttagccagctaccccgttttttgtccggaagttggagcgaattttctacccagcccgagaactttttaaagggctgtaaatgggccccagatggaagctgcatcctgacaaacagcgccgataacattttgagaatctacaatctacctcccgagctctatcacgaaggagaacaggtcgagtacgctgagatggtgcccgtgctcagaatggtggagggtgatacaatttatgactattgctggtactcccttatgtcttctgcacaacccgacacatcatatgtggcctcgtcgtctcgcgagaaccctattcacatttgggacgcattcacgggtgagttgcgcgctagcttcagagcctacaaccatctcgacgagctgaccgcagcccattctttgtgcttctcgcccgatgggtctcaacttttttgcggatttaatcgcaccgtccgggtttttagcacagcacggccagggagggattgcgaggtcagggccacatttgcaaaaaaacaaggacaaagcgggattatctcttgcatcgccttctctcccgcacagcctctttacgcctgtggttcatacggtaggtcactgggactctacgcatgggacgatggcagcccactagcgcttctcgggggacaccagggcggaatcactcatctctgcttccatcccgatggaaatcggtttttttcaggagccagaaaggacgcagaactgctgtgttgggacttgcggcagtccgggtatccattgtggagcctcggcagggaggtgaccaccaaccagagaatatactttgatttggatccaacaggccagtttctcgtgagcggcagcacgtctggcgctgtgtccgtttgggataccgacggccctggcaacgatgggaaacctgaacccgttttaagtttcctgccccagaaagactgtaccaatggagtgtcattgcacccttctctacccctgttggcaactgcatccgggcagagagtgtttcctgagccaactgaatcgggagacgaaggagaagaattggggctccccctactgtccaccaggcacgtgcatcttgagtgccgtctgcaactgtggtggtgcggaggtgcaccagattcatcaattccagacgatcaccagggcgagaaaggccagggcggaacagagggaggcgttggggagctgatatag

SEQ ID NO: 31505 - DNA, 1299 bp, Artificial Sequence
  Description of Artificial Sequence: Synthetic coding sequence
atggacactgaaaaaagcggcaaaagagagttcgatgtacgccaaacacctcaagtgaacataaaccccttcacccccgatagcctgctgctccactcatccggccagtgtcgcagacgcaagaggacctattggaacgacagctgcggcgaagacatggaggcctccgattatgagctcgaggatgaaacccgtcctgccaagcgcattacaatcactgagagcaacatgaaatctaggtacactacggagttccacgaactggagaagattggctccggcgagttcggttcggtgtttaagtgtgtcaaaaggctggacgggtgcatctacgctattaagcgcagcaaaaagcctctggctggaagcgtggacgagcagaatgcccttcgagaggtttacgcacatgccgttctcggacaacactcacacgtggtgcgctacttttctgcgtgggcagaggacgatcacatgttgattcaaaatgaatattgtaatgggggttcactggccgatgctatatccgagaactatcgtattatgtcatacttcaaggaagcggaacttaaggacctgctcttgcaagttggacgcggactgaggtacatccattctatgtcactggtccacatggacatcaagccttccaacattttcatcagccgcactagcatcccaaatgctgcctctgaggaaggcgacgaggacgattgggcatcgaacaaagtgatgttcaagatcggggatctgggtcacgtgacgaggatctcttcaccccaggtcgaagagggagacagcaggttccttgccaatgaagttcttcaggaaaattacacacacctgccaaaggctgatatctttgccctcgccctgactgtggtctgtgcagccggagcagagccccttccaaggaacggggaccaatggcatgaaattcgtcaaggcaggctgcctcggataccgcaggtgttgtcccaagaatttaccgaactgctgaaagtcatgattcatccagacccagagagacggccttcagccatggctctagtgaagcactccgttctgctctctgcttctcgcaagagtgccgaacagctgaggatcgagctgaatgcagaaaagtttaaaaactctctattgcaaaaagagctcaaaaaggcccagatggcaaaggcagcagcggaggaaagagcactgtttacggacaggatggctaccaggtccacgacacagtcaaaccggacctctcggcttataggtaagaagatgaatcgcagtgttagtttaacaatttattag

SEQ ID NO: 31506 - DNA, 1941 bp, Artificial Sequence
  Description of Artificial Sequence: Synthetic coding sequence
atgtcattcctgtcacgccagcagcctcccccaccaaggcgggcaggcgcagcctgcactttgcgccagaagctgatcttctctccctgttctgattgcgaggaggaagaagaggaagaggaggaggagggctctggccactctacaggcgaagacagcgcctttcaagagcccgactctccactgccacccgcacgatcccctaccgagcctgggccagaacgacggaggtcacccggaccagccccaggctcccctggagaacttgaagaagatctgctcttgccaggagcctgtccaggcgcagatgaggccggtggaggggcagagggcgactcttgggaggaagagggtttcggatcttcttcacccgttaagagccctgcagcaccatattttcttgggtcgagcttctctccagtgcgttgtggtggccctggggatgcaagtcctagaggctgtggcgctcgaagagccggagaagggaggcgatcgccccgacccgaccatcctggtactcctccccacaaaacattccgtaaactgcgcctcttcgataccccacatactccgaagagcctcctgtctaaggcgaggggtatcgactcatcaagcgtcaaactgaggggttcttccctttttatggatactgagaaaagtgggaagagggagttcgatgtacggcagaccccccaggtcaacataaacccattcacccccgatagcttattgctgcacagttccgggcagtgcagacggcgaaagcgcacttattggaatgacagctgcggtgaggacatggaggcctccgattacgagctcgaggatgaaacacgccctgcaaagcgcattacaataacagaaagcaatatgaagagcagatatacaacggaatttcacgaattggaaaaaattggcagcggcgaatttggctctgtgtttaagtgcgtgaagagattagacggttgcatttatgctattaaaagaagcaagaaacctctcgcaggttcagtggatgaacagaatgccctcagagaagtctacgcacatgcggtcctggggcagcacagtcatgtggtccgttacttttcggcttgggcggaagacgatcatatgttaattcagaatgagtactgtaacgggggttccctggctgacgccattagtgagaactaccgtatcatgtcctactttaaggaggcggagctgaaggatctgttgctgcaggtgggacggggactcaggtacatccactctatgagtctggtccatatggatattaaaccaagtaacatctttataagccggacttccatacccaacgctgcaagcgaagagggagacgaggatgattgggccagtaataaagtcatgtttaaaatcggcgacttgggccacgtcacccgcatatcctccccacaggttgaagaaggcgactcccgattcctggccaatgaggtgttacaggagaattacacacacctcccaaaggctgacatttttgccttagccctgactgtggtgtgcgccgctggtgctgaacctctgccacggaatggcgatcaatggcacgagatccgtcagggcagactcccaagaattccacaggtgttgtcccaggagtttaccgaactgctcaaggtaatgatccatccggatcccgagaggcgcccaagtgcaatggcattagtgaagcactccgtgttattaagcgcttcaagaaaatctgcagagcaactgaggatagaactcaatgccgagaaattcaagaactctctgctccagaaagaacttaagaaagctcagatggctaaggccgctgccgaggaaagagccctgtttaccgatcggatggctactcgctccactacccagtccaatagaacatcccgcctgatcgggaaaaagatgaataggtcagtgagcctgacaatatattag

SEQ ID NO: 31507 - DNA, 1554 bp, Artificial Sequence
  Description of Artificial Sequence: Synthetic coding sequence
ttgcaggatcccgcttcaacctgcgtgccagaacctgcctcacagcacacgctgcgctccgggcctggctgcctacaacaacctgagcagcagggcgttcgagatcccggtggcatctgggccaagctgggtgcggctgaagctagcgcggagagactccaaggaagacggtctaggggggctagcggaagcgaaccgcagcagatgggctccgatgtgagagatttgaacgccctgctacctgccgtgccatcactcggtgggggtggagggtgcgctctgccagtgagcggcgcagcacaatgggcacccgtgctggactttgcccctcccggtgccagcgcatacggatccctcggcggacccgcaccccctccagccccacctcccccacccccaccccctccacatagctttatcaaacaggagcccagctggggtggggcagaaccgcatgaggagcagtgcctgagtgccttcactgtccatttctctggtcaatttactgggaccgctggcgcatgccgctatggccctttcggcccacccccaccaagccaggcttcctctggccaggctcgcatgttccctaatgccccatacctcccttcgtgcctggaatcgcaaccggcaatccgaaaccaagggtattccactgtgaccttcgacggcacacccagctatggtcatacaccaagtcaccacgcagctcagttccctaaccattcctttaaacatgaagaccctatgggacagcagggtagcctgggagagcagcagtactcggtgccaccccctgtttacggatgtcacacccctacagatagctgcactgggtcgcaggccctactgctacggactccctattcttccgacaatttatatcaaatgacctctcagcttgaatgcatgacctggaaccagatgaatctgggggctacattgaaaggcgtggctgctgggagctcctcctccgtgaagtggactgagggccagtcaaaccacagtacaggctatgagtctgataaccacaccacacccatcttatgcggcgctcagtacaggatacacacacacggtgtcttcaggggtattcaggatgttcgtagggtcccaggagtggcacccacacttgtcagaagcgcatcagaaacttccgagaaaaggcctttcatgtgcgcctaccccggatgcaacaagcgatactttaagctgtcgcatctccagatgcattccaggaagcacaccggtgagaagccataccaatgcgactttaaggattgcgaacgtcgtttcagcaggtctgaccagctgaagaggcaccagcgtaggcataccggcgtgaaacctttccagtgtaagacatgccaaagaaaatttagcagatccgatcacttaaaaactcatacacggacacacaccggcaagacaagcgaaaagccattcagctgtaggtggcctagctgccaaaaaaagttcgcacggtctgatgagctggtacggcaccacaacatgcaccagaggaatatgacaaagctccagctggccctgtag

SEQ ID NO: 31508 - DNA, 954 bp, Artificial Sequence
  Description of Artificial Sequence: Synthetic coding sequence
ctgcaggatcctgctagtacctgcgtccctgagccggcttctcagcacaccctgagaagcggacctggttgtctccagcagcctgaacaacagggcgttcgggatccagggggaatttgggccaaactcggggcagccgaagcatctgctgagagactgcaaggcagacggagtaggggcgcttccgggtctgagccgcagcagatgggttctgatgtgcgcgacctgaacgccctgttgcccgcagtcccttctctgggaggtgggggaggatgtgccctgccagtgtctggagcagcccagtgggctcccgttttggacttcgctcccccaggcgcatcagcctacgggtcccttggaggacccgctcccccaccggctcccccaccgccaccaccacctccccctcattccttcatcaagcaggagccctcttggggaggggcagagcctcatgaggagcagtgtttgtcagctttcactgtacatttctcagggcagttcacaggtacagctggtgcttgtagatacggccctttcggcccacctcctcccagccaggctagtagcggtcaagccagaatgttcccaaacgctccttacctgccctcatgcctcgaaagccagccagccatccgcaaccaggggtactctactgttacattcgacggaacccccagttacggacataccccctcccatcatgccgcacagttccccaatcactcttttaagcatgaagaccctatggggcagcagggtagtctgggggagcagcagtacagtgtgccgccacccgtgtacggatgtcatactcccaccgacagctgtaccggatcccaagcactgctgctcagaactccttattcctctgataatctgtaccagatgacctcccagctggagtgcatgacttggaaccagatgaacctgggagccaccctgaaagggtag

SEQ ID NO: 31509 - DNA, 909 bp, Artificial Sequence
  Description of Artificial Sequence: Synthetic coding sequence
atggagaagggttactcaacagtgacctttgatggcaccccatcctacgggcacaccccttcacaccacgcggctcaattccctaatcattccttcaagcacgaggatcctatgggccaacagggtagcctaggggagcagcagtacagcgtgccaccaccagtgtacggttgccatacaccaacagattcctgcactggaagccaggctctgcttttacgaacaccctacagctcagataacctgtaccaaatgacatctcagctcgagtgcatgacgtggaatcagatgaatttaggagcaacattgaaaggggtagctgccggtagttcatcttctgtgaagtggaccgaggggcagagtaaccattcaacagggtatgagagcgacaaccatacaaccccaattttgtgtggtgcccagtacagaatacatacccacggcgtcttccggggaatccaggacgtgaggcgcgtgcccggtgtcgcgcctaccctggtgaggtcggcatctgaaacatccgagaaaagaccctttatgtgtgcgtaccctgggtgcaacaagaggtactttaagcttagccacctacagatgcattcccgcaagcacacaggcgaaaaaccttatcagtgtgattttaaggactgcgaaagacgcttctcaagatccgaccagctaaaacgccatcagcgcagacatacaggcgtgaagcccttccagtgtaagacctgtcagcgtaagttttctaggtcggaccacctgaaaacacacacaaggacccatacgggagagaagccattcagttgccgttggccatcatgccagaagaagtttgctcgatccgacgaactcgtgcgacatcacaacatgcaccaacgaaatatgaccaagttgcagctggcgctctag

SEQ ID NO: 31510 - DNA, 1545 bp, Artificial Sequence
  Description of Artificial Sequence: Synthetic coding sequence
cttcaggatccggcatcaacgtgtgtgccagagccagcgtcacagcacacccttcgctctggccctggatgcctgcagcaaccggagcagcagggcgtccgcgatcccggtggcatatgggcgaaactcggagcggctgaggcatccgcagagcgcctgcagggcaggagaagtcggggagcttctggctcagaaccacagcagatggggagtgatgtgcgcgacctgaacgctctcctgccagccgtgcctagccttggcggtggaggaggctgcgcactcccagttagcggggcagcgcagtgggcccctgttttggattttgcccctccaggtgcaagcgcctacgggagcctcgggggaccagcacccccacccgcacctcctcccccaccgcctccccctccccatagcttcattaagcaagagcctagttggggaggcgcagaacctcacgaggagcagtgtttgagcgccttcacagtgcatttctccggccagtttacgggcacagctggggcatgtagatacgggccattcgggcctccacctccctcccaagctagctccggccaggccaggatgtttcctaacgcgccttacctgccctcttgcctggaatctcagcccgctataagaaatcaaggatactctacagtaaccttcgacgggactccctcttacggtcacacccctagtcatcatgccgctcaattccccaatcactcttttaaacacgaagacccgatgggacagcaggggagcctgggtgagcagcagtactccgtgccccctcctgtgtatggttgtcacacaccaaccgattcctgcactgggagccaggctttgcttctgaggaccccctattcctccgataacctctaccagatgacaagccagctggagtgcatgacttggaaccagatgaatttgggagccactctgaaaggcgtcgccgctgggtcctcttcctctgttaaatggactgagggccaatcaaaccactctacagggtatgaatctgacaatcacaccacaccaatcctctgtggggctcaatatagaatccacactcacggcgtgttccgcggtatccaggatgtgcggagagttccgggagtagctccaacattggtgagatctgcctccgagacttctgagaagaggccctttatgtgtgcatacccgggatgtaataagcggtactttaaactgagtcacctgcaaatgcactcaagaaagcacaccggagagaaaccgtaccagtgcgactttaaagactgcgaaaggcggttttctcgctctgaccagttaaaaaggcatcagcgtaggcacaccggggtgaagccatttcaatgtaagacctgccagcggaagttctcaagaagcgatcatttaaagacccacacaagaacccacaccggtgaaaagccattttcatgtcgctggccatcctgccagaagaagttcgcacggagtgatgaactggtgagacatcataatatgcaccagagaaacatgactaagctccagctggcattgtag

SEQ ID NO: 31511 - DNA, 1494 bp, Artificial Sequence
  Description of Artificial Sequence: Synthetic coding sequence
ctgcaggacccggcatctacttgtgttcctgaacctgcttcgcagcatacacttaggtcaggaccaggttgcctgcagcagccagagcagcaaggagtgagagaccctggaggaatctgggcaaagctgggtgcggctgaggcctcagctgagcgcctgcagggacgcagatcaaggggagccagcggatcagagccccaacaaatgggcagcgacgtgagagatctgaacgcgttgttaccagctgtgccttcactaggaggagggggaggatgcgccctgccagtgtccggagccgctcagtgggccccagtcctggatttcgcccctcccggtgctagcgcctatgggagcctgggagggccagccccaccccctgcacctccccctcccccacccccaccgcctcattctttcataaagcaggagccgtcctggggtggggcagagcctcatgaagagcagtgcctctccgcctttaccgtgcactttagtggtcaattcacgggcacagctggtgcctgtcgttatggtccttttggaccccctcctcctagccaagcgtcctctggtcaggcaagaatgtttcccaacgctccatacctgcctagctgtctcgagtcccagcccgcaatcagaaaccagggctattctactgtgaccttcgatggtactccctcttacggccatacaccgtctcaccatgcagcccagttccccaaccatagctttaagcatgaagatcccatgggccagcagggcagtttaggagaacagcagtacagtgtgccgcctccagtatacggatgccacacaccaaccgatagctgcaccggttcccaggcattattgctacggaccccttattccagcgataacttatatcagatgacctcccagttggagtgtatgacctggaaccaaatgaatcttggcgcaacgttaaaggggcactctaccggatatgagtcagataatcacactaccccgattctgtgtggagcccaatacagaatccacacacacggagtgttccgtggcatacaggacgtacggcgtgttccaggggtggctccaacactcgtccggagcgcctcagagacctccgagaaacggccttttatgtgcgcctatcccggatgtaataaaagatactttaagttgtcccatctgcagatgcactccagaaaacataccggcgaaaaaccctaccagtgcgacttcaaggactgcgagaggcggtttagtcgctctgatcaattaaaaagacatcagagaaggcatactggcgtgaagccctttcaatgtaaaacttgccagcgcaaattcagcaggtccgatcatctgaaaacccacaccagaacccacacaggggagaaaccgtttagctgccgatggccctcctgccaaaagaagttcgcccgtagtgacgagctggtgagacatcacaacatgcaccagaggaatatgactaagctacagctggccctctag

SEQ ID NO: 31512 - DNA, 396 bp, Artificial Sequence
  Description of Artificial Sequence: Synthetic coding sequence
atgggccaacaggggtcgctgggagagcagcagtacagtgtgcccccaccagtgtatgggtgccacaccccaactgattcctgtacggggtcacaagccttgttgttgcgaaccccatactccagtgacaatctgtatcaaatgacgtctcagctggaatgtatgacatggaatcagatgaatctgggtgctaccttaaaaggcgtcgctgccggatccagttctagtgtgaaatggacagaaggccagtctaaccactcaacaggatacgaaagcgacaaccacaccacaccaattttatgcggggctcagtatcgcatccacactcatggggtgtttcgagggatccaggatgtgcgccgagtacctggagtggcacctacgctggtccggtag

SEQ ID NO: 31513 - DNA, 537 bp, Artificial Sequence
  Description of Artificial Sequence: Synthetic coding sequence
tgactaggcgctacactgaaaggtgtcgctgccggatcatcttcctcggtcaagtggacagaaggccagagcaaccacagtactgggtacgaatccgataaccacaccactccaattctctgtggcgcacaatacagaattcacacacatggagtctttcggggaatacaagacgtaagacgtgtacctggagtcgccccaactctggtgagatccgcttccgaaacaagtgagaaacgccctttcatgtgtgcctaccccggttgcaacaagcgttacttcaaactgtctcacctgcagatgcacagccgcaaacatacaggcgttaagcccttccagtgtaaaacctgccagcgtaaattttcaagatctgaccacttaaaaacacatacacgtactcacacgggaaaaacgtcagaaaagccattctcttgtcggtggccctcctgccagaagaagttcgcgcgatccgatgaacttgtgcggcatcataatatgcatcagaggaatatgaccaagctgcaactcgcactgtag

SEQ ID NO: 31514 - DNA, 867 bp, Artificial Sequence
  Description of Artificial Sequence: Synthetic coding sequence
atggaaaaaggctacagcacagtgaccttcgacggcaccccaagctacggccacacccctagccaccacgcagctcaattcccaaaccactcctttaagcacgaggacccaatgggccagcagggttccctcggagagcaacagtattcagtgccacccccagtgtacggctgtcacacacctaccgactcgtgcacagggtcacaggcgttgttgctgaggacaccgtatagcagcgataatctgtatcagatgacatctcagcttgagtgcatgacctggaatcagatgaatctcggcgctacattgaagggccattcgacagggtacgagagcgacaatcacacaacaccgatcctgtgcggtgcccagtaccgcatccacacacatggtgtgttccggggaatacaagatgtccgtcgggtccccggagtggccccaacgttggtgcggagcgcctcagaaacatccgagaagaggcctttcatgtgcgcctaccctgggtgtaataaaaggtatttcaagctgtcgcacctgcagatgcacagcagaaagcatacaggagaaaagccttatcagtgcgattttaaagactgtgagcgacgcttctccagatcagaccagcttaaacgccaccagaggcgacacaccggggttaaaccattccagtgtaagacctgtcagaggaagttttctaggtctgaccacctgaagacacacactcggacacacaccggcaagaccagcgagaagcctttctcgtgtcggtggcccagctgtcagaagaagttcgcacgtagcgatgagttagtacgacatcacaacatgcatcagcgcaacatgacaaagcttcagcttgctctttag

SEQ ID NO: 31515 - DNA, 1065 bp, Artificial Sequence
  Description of Artificial Sequence: Synthetic coding sequence
atgagagccaggcctcaagtctgtgaagcccttttgttcgccttggccctgcagaccggggtgtgctacggcataaaatggcttgcacttagtaagacgccttcagctctcgctctgaaccagacacagcattgcaagcaacttgaggggttagtttccgcacaggtacagctttgcaggtccaatcttgagctgatgcacacagtggtgcatgcagcaagagaggtgatgaaggcgtgcagacgcgcttttgccgacatgaggtggaactgttcttccatagagttggccccaaattacctcctcgatctcgagcggggaacacgcgaaagcgcgtttgtatacgccctgtcagccgcagccatcagtcacgccatcgctcgcgcatgtacatctggggatctgcctggttgtagttgcggccctgtacctggtgaaccaccaggaccaggaaaccgttggggcggatgtgctgacaatcttagttatgggcttctcatgggggctaaattctcggacgcccctatgaaggtgaagaagaccggatcgcaggccaacaaactgatgcgattgcacaattcggaagttgggagacaggcattgcgggcttcgctggaaatgaaatgtaaatgtcatggagtttcagggtcctgctccattcgcacttgttggaagggtttgcaggaacttcaagatgtggcagcggatttaaagaccagatatctctcggccaccaaagtggtgcatagaccgatggggaccagaaaacacctcgtgccaaaggatctggatattcggccagttaaggattccgagctggtatatctccagtcctcacccgacttttgcatgaagaacgaaaaggtggggtcccatggaactcaggaccgacagtgcaacaagactagtaatggctcagattcttgtgatctgatgtgttgcggaagaggatacaatccttacactgacagggtggtggaaaggtgccactgcaagtaccactggtgttgttacgttacctgccggaggtgtgaaagaacagttgagagatatgtatgcaagtag

SEQ ID NO: 31516 - DNA, 762 bp, Artificial Sequence
  Description of Artificial Sequence: Synthetic coding sequence
atgcgcgcaaggccgcaagtttgtgaggctctcctgtttgcgctagcactccagacgggagtctgctatggcatcaaatggctcgcgttgtccaagacaccttctgcactggccctaaatcagacccagcattgtaaacagctagaaggtctcgtcagtgcacaggtgcaactttgcagaagcaatcttgagcttatgcacaccgtggttcatgccgcacgggaagtcatgaaagcttgcaggcgcgctttcgcagacatgagatggaactgttctagcatcgaactggctcccaactacttattagacctcgaacggggtactagagagtctgcgtttgtgtatgcactttccgctgctgctatcagtcacgcaatagcacgggcttgcacctcaggggatctccctgggtgttcctgcgggccagtgcccggagaacctcccggacctggtaaccgctggggcggttgcgcagacaatctgtcctatggtctcctgatgggagccaagttcagtgacgcacctatgaaggtgaagaaaaccggctcacaggctaacaagctgatgcggctgcacaattcagaagtgggtcggcaggccctgcgggcttccctgctcgtcaacagccgctgccaggcatgggaggccgcttgtgctctgccttcgctgggaagtcaccaggaacagaaggtttggcctccgtggaaggaaggcagaacgtcaaaagagactgataagataaaaaacaaccttgcggcatag

SEQ ID NO: 31517 - DNA, 18 bp, Artificial Sequence
  Description of Artificial Sequence: Synthetic coding sequence
atgagggccaggccgtag

SEQ ID NO: 31518 - DNA, 1143 bp, Artificial Sequence
  Description of Artificial Sequence: Synthetic coding sequence
atgaagaaatcaatcggaatcctgtccccaggcgtcgctctgggaatggcaggttcggctatgagcagcaaatttttcctggtggccctggccatattctttagtttcgcccaagtcgtgattgaggctaattcatggtggtccctggggatgaacaatcctgttcagatgtccgaagtttatattattggtgctcagcccctgtgtagtcagttggcaggcctctcccagggtcagaaaaagctgtgccacctttaccaggatcatatgcagtacattggcgaaggggcaaagaccggaattaaggagtgtcagtatcagtttcgacatagacggtggaattgctccacggtggacaatacctccgtgttcgggcgagtgatgcagattggaagcagggagaccgcgtttacatatgctgtctccgctgccggagttgtcaatgccatgtcccgcgcatgccgcgagggagaactgtctacttgtggctgctcacgggcagctagaccaaaggacttgcctagagattggctctggggcggttgtggcgataatattgattatggatatcgcttcgccaaagagttcgttgatgccagagagcgagaaaggattcacgcgaaaggctcttacgagtctgccagaatcctgatgaacttgcacaacaacgaagccggaaggagaaccgtgtacaatttagctgatgtggcttgcaaatgccacggagtcagcgggtcttgttctctgaaaacttgctggctacaactcgccgatttccggaaggtcggagatgccctgaaagagaagtatgactctgccgctgccatgcggctgaattctaggggcaagcttgtacaggttaactcccgctttaattcccccacgacccaggatctcgtatatatcgatccgtctcccgactattgcgtgaggaatgagtctaccgggtccctggggacccagggcagactgtgcaataagaccagtgagggcatggacggctgcgagctcatgtgctgcggaaggggctatgatcagttcaaaaccgttcagacagagcgctgtcactgcaaattccactggtgctgttatgtgaagtgtaagaaatgcactgagattgtggatcagttcgtctgcaaatag

SEQ ID NO: 31519 - DNA, 390 bp, Artificial Sequence
  Description of Artificial Sequence: Synthetic coding sequence
atgaagaaatccatcgggatcctgtcccctggggtcgcattggggatggctgggagcgccatgagcagcaagttctttctggtggcattagcgatcttcttcagcttcgcccaagtggttatcgaagctaattcatggtggagtctgggaatgaacaacccagtccagatgtcccaggacgtgggtggtcacgggtggctgcgagctcacgttttgaggccctggttacgcccagtacaggatcgggctgacggcgctctcccactgcaggtgccacttgttctgctacgccaggtccaagaagtccacggagatcggggtccggtgtgtgtgcaggtggtaggagctacccagcactccgccccacttcctgggccagcttatctgtag

SEQ ID NO: 31520 - DNA, 1143 bp, Artificial Sequence
  Description of Artificial Sequence: Synthetic coding sequence
atgaagaagagcatcggtattttgagtccaggagtggcattgggaatggccggttcggcaatgtcaagcaaattcttcctggtggctcttgcgattttcttcagcttcgcacaggtggtaattgaggcgaattcttggtggtctctgggcatgaataatcctgtccaaatgtctgaggtgtatattatcggagcccagccattatgtagtcaattagcgggtctatcccagggccagaagaaactctgccacctctaccaggatcatatgcagtacattggggaaggggctaaaacgggcatcaaagaatgtcagtaccagtttaggcatcgcagatggaactgtagcacggtggacaacacctctgtgttcggccgagttatgcagattggcagcagagagacagcattcacctacgccgtatccgctgcaggagtcgttaatgccatgagccgcgcatgccgggaaggcgagctctccacttgtggatgcagcagagcggcacgtcctaaggatctacctcgtgattggttgtggggtggatgtggtgacaatattgattacgggtaccgttttgccaaagaattcgtggatgctcgtgagagagagcgcattcacgccaaagggagttatgagagcgctcgtatacttatgaatctccacaataatgaagccggtaggaggaccgtgtataacttagccgatgttgcatgtaaatgtcatggggtcagcggcagctgcagccttaagacatgttggctgcagctggctgattttagaaaagtaggagacgcacttaaagaaaagtacgattctgcagcagctatgcgcctcaactcacggggtaagctggtgcaagttaattctagatttaattcgccaacgactcaggacttggtctacatcgatcctagccctgattactgtgtgcgcaatgaaagcaccggatctcttggaacacagggccgactgtgcaacaaaacgtccgagggaatggacggttgcgaactgatgtgctgcgggagaggctatgatcagttcaaaaccgtgcagactgagagatgccactgtaagttccattggtgttgctacgttaagtgtaaaaagtgtaccgagatcgtggaccagttcgtgtgtaagtag

SEQ ID NO: 31521 - DNA, 645 bp, Artificial Sequence
  Description of Artificial Sequence: Synthetic coding sequence
atggcaggatcagcaatgtccagcaagtttttcctcgtggctttggcaattttcttttcattcgcccaggtggtgattgaggccaactcctggtggtcgcttgggatgaataaccccgtgcagatgtcagaagtgtacattataggggcacagcctctgtgttctcagctggctgggctgtcccagggccagaagaaactgtgtcatctgtatcaggatcacatgcaatacatcggggagggggctaaaaccggtatcaaggaatgccagtaccaatttagacaccgacgctggaactgctctactgtagacaatacgtcggtttttggtcgggtcatgcagatcggttccagagagacagcctttacttacgccgtgagcgccgctggggtagtaaacgccatgtctagagcatgccgagaaggcgaactatcaacatgcggttgctcgcgcgctgcccgacctaaagacctccccagagactggctctggggcggttgtggcgataacatagactacgggtatcgttttgcaaaagaattcgtggacgccagggagcgggagcgtattcatgcgaaggggtcctacgagagcgcacgaatcctgatgaacctgcataacaatgaagctggtcgccgagtctag

SEQ ID NO: 31522 - DNA, 1098 bp, Artificial Sequence
  Description of Artificial Sequence: Synthetic coding sequence
atggctgggagcgcgatgtcttccaagttcttcctcgtagccttggcgattttcttttcttttgctcaggtagtgattgaggcgaacagttggtggtcactcggcatgaacaacccagtacagatgagtgaggtgtatattatcggtgctcagcccctctgctcacagctcgccggactgtctcagggccagaagaagctatgtcatctttatcaggaccacatgcagtatatcggggaaggcgctaagactggaatcaaggaatgccagtaccagttcaggcatcgccgatggaattgttccaccgtggataacacctccgtctttgggagagttatgcagattggtagtagagaaaccgcttttacatacgccgtgtctgcggctggggtggtgaatgcaatgagtcgcgcatgccgcgagggagaactgtcaacctgtgggtgctcaagagcggctcgcccaaaagatttacctcgggactggctttggggaggctgtggggataatattgactacgggtatagattcgctaaggaatttgtggatgctcgggaaagagagcgaatccacgccaaaggttcgtacgaaagcgcgcgaattctcatgaatctccacaacaacgaggccggacgcagaacggtatacaaccttgccgatgtggcttgtaaatgccacggagtctctggttcctgttcactaaagacctgctggctgcagctcgccgattttcgcaaggtcggcgatgctttaaaagaaaaatatgactcggctgcagcaatgcggcttaattcgcgtggcaaactcgtccaggttaatagcagattcaactcccccaccacccaggaccttgtgtacatcgacccctcacctgactattgcgtgaggaacgaatccaccggaagcctaggcacccagggtcgcctgtgcaacaagacttcagaagggatggacggatgcgagctgatgtgctgtggcaggggctatgatcagttcaaaacggtgcagacagagagatgtcactgtaagtttcattggtgctgctatgtgaagtgtaaaaaatgtactgagattgtagaccagttcgtctgcaagtag

SEQ ID NO: 31523 - DNA, 876 bp, Artificial Sequence
  Description of Artificial Sequence: Synthetic coding sequence
atgcaatacattggcgaaggagccaaaaccggcatcaaggagtgtcagtatcagttcagacatcgcagatggaattgtagcacagtcgataatacaagtgtcttcggcagggtcatgcagattggctctcgtgagacagctttcacatatgcggtctccgctgcaggggtggtgaatgccatgtcgcgggcatgtcgggagggagagttgtccacctgcggatgctctcgagcagcacgaccaaaagacttgcccagagactggttgtggggtggatgcggggacaacatcgattatggttatagattcgcaaaggagttcgttgacgcaagagaacgcgaacggatccacgcaaaaggctcatatgagagcgctcgaatcctaatgaatctacacaataatgaagctggacggagaaccgtgtataacctggcagatgttgcctgtaaatgccatggggtctcaggatcatgttcgcttaagacatgctggctgcagcttgccgactttcggaaagtaggtgatgcactcaaagagaagtatgatagtgccgcagccatgcgcctgaatagtaggggtaagctcgtgcaagtgaactctagatttaacagcccaactactcaggatttggtgtatattgatccttctcccgactattgtgtgcgtaacgaaagcactggctctcttggtacccagggaagactatgtaataaaacaagcgaaggcatggatggatgtgagcttatgtgctgcgggagaggatacgatcagtttaagactgtgcagactgagaggtgccactgcaagtttcactggtgctgttacgttaagtgcaaaaagtgcacagagattgtggatcagttcgtgtgcaagtag

SEQ ID NO: 31524 - DNA, 1080 bp, Artificial Sequence
  Description of Artificial Sequence: Synthetic coding sequence
atgcctagccttttgctactattcaccgcagcccttctctcctcgtgggcacagctactaacagacgccaattcatggtggtcactggccctgaatccagtccaaaggcctgaaatgttcatcatcggcgctcaacctgtgtgctctcagcttcctgggctgagccccggtcagcgcaagctgtgccagttgtaccaggaacacatggcttatatcggcgagggggcaaaaacaggcatcaaagagtgccagcatcagtttcggcagcgtaggtggaattgctctacagctgacaacgcaagcgttttcggacgcgttatgcaaatcggatctcgagaaacagcgttcacacacgccgtgagcgccgcaggagtcgtgaacgcaattagtcgtgcctgccgtgagggggagctctcgacttgcgggtgttcacggactgcgaggcctaaagatctacctcgggattggctgtggggcggttgcggggataatgtggagtacggttacagattcgctaaggaattcgtcgatgcccgagaaagggagaagaactttgctaaggggagtgaagagcagggacgagtgctgatgaacctgcagaataacgaggccggacgaagagctgtgtataaaatggctgatgtggcgtgcaaatgtcatggagtcagtggcagctgttccttgaagacttgctggctacagctggctgaatttagaaaggtgggcgaccgccttaaagagaaatatgacagtgccgcagctatgcgagtgacccgtaagggaaggctggagcttgtaaacagtcgattcactcagcccacccccgaagacctggtctacgtagacccaagccctgattattgtctacgaaacgaatcaacaggatcccttggcacccaaggcagactgtgcaataaaacgtccgaaggcatggatggttgtgagctcatgtgttgcggcagggggtataaccagtttaagtctgtccaggttgaacgctgtcactgcaaatttcactggtgctgctttgtgcgctgtaaaaaatgtacagaaatcgtggaccagtacatatgcaagtag

SEQ ID NO: 31525 - DNA, 1080 bp, Artificial Sequence
  Description of Artificial Sequence: Synthetic coding sequence
atgccaagtttgctcctgttgtttacagccgctctgctcagcagttgggcccagttgctgacagatgcaaacagttggtggagccttgcccttaatcccgttcagagacctgaaatgtttatcatcggcgcacagcctgtctgctcccaactcccaggtctttctccgggtcagagaaaactctgtcaattgtaccaggaacacatggcttatattggtgaaggggctaagacaggcattaaagaatgtcaacaccaattcagacaaaggcgctggaactgttcaaccgctgataacgccagcgtgttcggtcgggtgatgcagatcggatcccgcgagaccgctttcactcacgcagtgtctgccgcaggcgtcgtaaacgcaatctcacgcgcatgcagggaaggagaacttagcacctgtggatgctcaaggaccgctcggccaaaagatctgcccagggactggctctggggtggatgcggtgacaacgtggagtacggatatcggtttgcaaaggagtttgttgatgctagagagcgggaaaagaactttgctaaaggctcggaagagcaaggccgtgtgcttatgaatcttcaaaataacgaagcaggaaggagagctgtgtataagatggccgatgtcgcctgcaagtgtcacggcgtgtccggtagctgcagcttgaaaacttgttggctccaactggctgaattccgtaaggtaggtgaccgactcaaggaaaagtacgactccgcagccgcaatgagggtgactagaaaaggtagactggagttggtcaacagcagatttactcagcccacaccagaggatctcgtgtatgtagatccaagccccgattactgcctaaggaatgagagcacagggagcctcgggacccaaggacggctgtgtaacaagacctctgaaggaatggatggatgtgagctcatgtgttgtggcagaggctacaaccagtttaagagtgtacaggtggagcgctgtcactgtaaattccattggtgctgctttgtgcgttgtaagaagtgcaccgagatagtagatcagtacatctgcaagtag

SEQ ID NO: 31526 - DNA, 1080 bp, Artificial Sequence
  Description of Artificial Sequence: Synthetic coding sequence
atgccatctcttttgttgctttttaccgccgctttactcagctcgtgggctcaactacttaccgacgcaaattcttggtggtccctcgcacttaaccctgttcagagacccgaaatgttcatcatcggggcacagccagtgtgttcacagctgcctggcctgtctcctggccagcgaaagctgtgccaattgtaccaggaacatatggcctacattggcgaaggggctaaaactggtattaaggaatgccagcatcagtttcgccagagaaggtggaactgttctaccgcagataatgcatccgtctttggaagggtaatgcagatcggctcgagggagactgctttcacccacgccgtctctgcagctggtgtcgtaaatgcaatctcccgggcatgtagagagggagaactttccacctgcggctgttcacggaccgcccgtcccaaggatttgcccagggattggttatggggcggatgcggggacaatgttgagtatgggtatcgtttcgccaaggaattcgtcgatgccagagaaagggagaaaaacttcgccaaagggtcggaggagcagggtagggtattaatgaacctccaaaataacgaggccggtcggagggccgtctacaaaatggcagacgttgcatgcaagtgtcatggcgtaagtgggtcttgctctctgaagacctgttggctgcagctcgccgaatttcggaaagttggcgataggctgaaagaaaaatacgacagcgcagccgctatgagagttacacgcaagggcagactggaactggtcaattcaaggttcacccagccaaccccggaagacttggtttacgtggaccctagccctgattactgcctcaggaatgaaagcacgggcagcctgggaacccagggacgactgtgcaataagacatcagaaggcatggacggctgcgagctgatgtgctgcgggaggggctataaccagtttaagtctgtccaggtggagaggtgtcactgcaagtttcattggtgttgttttgtgcgttgcaagaagtgtacagaaattgtcgaccaatacatatgcaaatag

SEQ ID NO: 31527 - DNA, 1398 bp, Artificial Sequence
  Description of Artificial Sequence: Synthetic coding sequence
atgaccggtcgcgcaatggacccgctgccagctgctgcagtgggagctgcagctgaagctgaggccgacgaggaggctgacccacccgctagcgatcttcctactccccaggctatcgagcctcaggctatcgtccaacaggtgcctgcgccaagtcggatgcagatgccccagggcaacccccttctactctcgcacaccctgcaggagctgctggcccgtgacacagtgcaggtggagcttattccggaaaagaaaggactgttcctgaagcacgttgagtatgaggtctctagccaacggtttaagtcctccgtctaccgcaggtataatgatttcgttgtgttccaggagatgctgcttcacaagttcccctaccgcatggtcccagctctccctcctaaacggatgcttggcgctgaccgggagttcatcgaggcgcgtagacgcgctcttaagaggttcgtaaatcttgtggcacgccatccactattctctgaggacgtggtgcttaagctctttctttcattttccggatcagatgtccaaaacaaactaaaggaaagcgcccagtgcgtgggagacgagttcctgaactgtaaactggcaaccagagcgaaagattttctacccgctgacattcaagcccagtttgccatctcgcgggaactgatccgtaacatatacaacagtttccataagcttagggatcgggctgaaagaatcgcctcccgggctatcgacaacgctgccgacctcctgatctttggcaaagagctcagtgcaatcggcagcgataccaccccgcttcccagctgggctgcacttaacagctccacatggggatcattaaagcaggcccttaagggcctgtcagttgagtttgccctcctggctgacaaagctgctcaacagggaaaacaagaggaaaacgacgtggttgaaaagctgaatctgtttctggacttactacagagctacaaggacctctgcgaacgccacgagaagggagtactgcacaagcaccaaagggctctccataaatatagtttgatgaaaaggcagatgatgtctgccactgcgcagaaccgcgaacccgagtccgttgaacaactcgagtccagaatagtcgagcaggaaaatgcaatccagacgatggagctccgcaattactttagcctgtattgtcttcatcaggagacgcagttgatccacgtttatttgcctctcacctcacatatcctccgagcatttgttaactcgcagatccaggggcacaaagaaatgtctaaagtttggaacgatttgaggcctaagctgtcttgtctattcgccggaccccatagcacactgacgcccccttgttcgcctcccgaagatggtctgtgtccacactag

SEQ ID NO: 31528 - DNA, 174 bp, Artificial Sequence
  Description of Artificial Sequence: Synthetic coding sequence
atgagttcggtacagcagcagccaccgccaccccgacgagtgaccaatgtcggatctttactgcttaccccgcaggagaatgagtcgctatttactttcctgggaaagaagtgcgtgacaatgtcatctgctgtggttcagctctatgcggcagaccgtaacctgtcttgttag

SEQ ID NO: 31529 - DNA, 1140 bp, Artificial Sequence
  Description of Artificial Sequence: Synthetic coding sequence
atggctcgacgcagcgccttcccagcagccgcactgtggctctggagtatcctgttatgccttttggccttgcgcgcagaggctgggccacctcaggaagagtcgctgtacctgtggatcgacgcccatcaagcgagggtgttgatagggtttgaggaagatattttgatcgtgtcggagggaaagatggctcctttcacccacgacttcaggaaggctcaacagagaatgcccgcaattccagtaaatatccactctatgaacttcacatggcaggctgctggccaggctgagtacttttacgaatttctctcactgaggtccttggacaagggaattatggccgatccgacagtgaatgtgccactgctcggaaccgtgccccacaaagcgtcagtcgtccaggtaggatttccctgcctagggaaacaagacggggtcgccgcttttgaggtggatgtcattgtcatgaatagcgagggtaacacgatactgcagacaccacagaacgcgattttcttcaagacttgtcaacaagccgagtgccccggagggtgcagaaacggtggattttgcaacgaaaggcggatttgcgaatgccccgacgggttccacggccctcactgcgagaaggcactgtgtacaccgagatgcatgaatggaggtctgtgcgtgaccccaggattttgcatatgtccgccagggttctacggcgtgaactgcgataaagccaattgctccactacatgctttaacgggggaacttgtttttaccctggaaaatgcatttgccccccaggcctcgagggtgaacagtgcgagatcagcaagtgcccccagccttgcagaaatggtggaaagtgtataggtaagagtaagtgcaagtgctcaaagggctatcagggcgacttatgttctaagcctgtctgcgaaccaggttgtggcgctcacggcacatgccacgaacccaataaatgtcagtgccaagagggatggcacggccgacattgtaataaaagatatgaagcctctctaatccatgccctgcggcctgccggagcacagctgcggcagcacaccccctccctgaagaaggctgaggaacgccgtgacccacctgagtccaactacatttggtag

SEQ ID NO: 31530 - DNA, 120 bp, Artificial Sequence
  Description of Artificial Sequence: Synthetic coding sequence
aaaaagcgcaaggaaaaaaaacgtgaaaagaggaggggtaaagaaagaaaagagctctttaaactggtgtcacacgtgctagagaaccgaatggggtggcagcaccttaaatggatgtag

SEQ ID NO: 31531 - DNA, 1095 bp, Artificial Sequence
  Description of Artificial Sequence: Synthetic coding sequence
atggccagggcatccgaggcggttagtcgaattcttgaagagtggcataaggccaaagtcgaggcaatgacccttgatcttgcactactgcgtagcgttcagcacttcgcagaggccttcaaggcaaaaaacgttcctcttcatgtcctggtgtgcaacgctgccacctttgccctgccctggagtttgacgaaggatggtttggaaacaactttccaggtaaatcacctcggacatttttacctcgtgcagctcctgcggatgttttgtgccgcacaactgctgccagtctcattgtggagtccgcagtccccaattgacctccagattttaactaccccatgggaaaactggacgtccgtcgcctctctacaacagaaaacaaccatcggcaggtgttggctgatcacaggccctagttcagcaacctcctcatcccccacctcctgtaccgtcgcccctacaagaggccacgtcgaacgaagcgcttcgtggaagtacgatgtcctccagcattcgagtcaactggttggcgtgcatactgctgtgtatctcggagaagcctttcatcaagtacatgctacaggctcatgtcaccacagggtgctttgctgttgtcctaggacaggtggtagcgggagagacgttttgcagcaactgcttcccctgcacgccctgacgagatcatccgagcggcgagacggacccgaccccgtcggtagcgaaaggctcatacaggaacggttagccagcccggcaaagtggagcagtgagagaatgggtactcatacgcgccctgtctgcgtgccaagcagaaaatgccaaggtcctctgcccaatgttcccccaacacagatccggaaaagtaagggcaataagagctcacataatcgggtgaagaacctgaaataccagtgggaggctggcaattcctggggcaaggtgagtcttttttggggctgggccaggcatcggtccctttgtttcctggtcgttgcttgcctcaaggttaaaacgtgcctggtgtgtaggttcaggatttccctggagaagcaccagcagttttcttttttttactgctacaggatcgcgtag

SEQ ID NO: 31532 - DNA, 570 bp, Artificial Sequence
  Description of Artificial Sequence: Synthetic coding sequence
atggcagctctgagatacgcgggactcgacgataccgatagtgaggacgaattgccacctgggtgggaagagagaactaccaaagacggctgggtgtactatgctaaccataccgaggagaagacacagtgggagcaccccaaaactggaaaaaggaaaagggtcgcaggcgacttaccctacgggtgggagcaagagactgacgagaacggtcaggtgttcttcgtagaccatattaacaaaaggacaacttacctagatccaaggctagccttcaccgtggacgacaacccaacaaagcctacaactcggcagcggtatgatggaagtactacagccatggaaatactccagggaagagacttcaccggcaaagtagtggttgtcactggggcaaacagcggaatcggcttcgagactgcgaaatccttcgccctccatggcgcacacgtaatactggcatgtcgcaacatggcgagggctagcgaggctgtatcgcggatcttggaagagtggaaaactaagtaccacccaccccctgaaaagtgcaggatcaaaatctttcattag

SEQ ID NO: 31533 - DNA, 936 bp, Artificial Sequence
  Description of Artificial Sequence: Synthetic coding sequence
atggcagctttgcggtatgccggattggatgacaccgacagcgaggacgagctgccccctggttgggaggagcgaacaaccaaggatggttgggtatactacgctaaccacacggaagaaaaaacccagtgggagcaccccaagaccggaaaaaggaagagagtggccggtgatttaccttatggctgggaacaggaaactgatgaaaacggacaagtgttttttgtcgatcatatcaacaaacggacaacctacttagacccgaggctggccttcacagtggatgataaccctactaaacctacaacccgtcagaggtacgacggtagcacaaccgcgatggagattctgcagggacgggattttaccgggaaagtggtagtggtaactggggcaaattctggtatcgcaaccggaagttgccaccatagggttctgtgttgttgtccacggactgggggatctggcagagatgtgctccagcagctgctgcctctccacgctcttacacgctccagcgaacgccgagatggtccagatcccgttggggcacaaagagaggccgacccacgaacagcttggcagcccgtaagactgtcaggagcccagtctggatgggctcatacgcccgctctttgcgtgagcccgcatgcatctgctagggccggacctctgcctaatgttccccctacacagattaggaagagtaagggaaataagagttcccacaaccgagttaaaaacctcaagtatcagtgggaggctgggaacagctggggcaaggtgtccctgttctggggctgggcccgacatcggtcactctgcttcctcgtggtggcgtgccttaaggtcaagacttgtctggtgtgccggtttcgcatttccttggagaagcaccagcaattttcatttttctactgctaccggattgcgtag

SEQ ID NO: 31534 - DNA, 705 bp, Artificial Sequence
  Description of Artificial Sequence: Synthetic coding sequence
atggctgccctaagatacgcaggtctcgatgataccgacagtgaggatgagctgcctccaggctgggaagagcgtactacaaaggacggctgggtgtactatgcgaaccacaccgaggaaaaaactcagtgggagcatccaaagaccgggaagaggaaaagggttgcgggtgatctgccatacggctgggagcaggagacagacgagaacggacaggtattttttgttgaccacattaataaaaggacaacctacctggacccgagactcgctttcaccgtggacgacaaccctacaaagcctacaaccaggcagcgctacgacggcagcacgactgccatggagatcctgcaagggcgtgacttcacagggaaggtcgtggtcgtgaccggagccaacagcggaatcggatttgagaccgcaaaatcttttgctctgcacggcgctcatgtgattctcgcatgtagaaacatggctcgtgcaagcgaagccgttagccggattctcgaggagtggcaacagggggctgctacgactgtatactgtgccgcagtgccagagctcgagggacttggtggaatgtactttaacaactgctgtcgttgtatgcctagccccgaagctcaatccgaggagaccgcaagaacactctgggcgctctccgagcgcctcattcaggaacggcttggtagccagtctggatag

SEQ ID NO: 31535 - DNA, 1245 bp, Artificial Sequence
  Description of Artificial Sequence: Synthetic coding sequence
atggcggcactgaggtatgccggactggatgatactgacagcgaggatgagctgcccccaggatgggaagagcggactaccaaagatggctgggtgtattatgccaatcataccgaagaaaagactcaatgggagcaccctaagacgggaaagaggaagagagtcgcaggggacctaccttacggctgggaacaggagactgacgaaaacgggcaggtcttctttgtggaccacattaacaaaagaacgacctacctcgatcctagactcgccttcactgtggatgacaatcctactaaacctaccacccggcaacgatacgatggatccacaaccgccatggagattctacaggggagagattttacgggtaaggttgtcgttgtcaccggggcaaattccggcattggattcgagaccgccaagtcctttgcccttcacggggctcatgttatactcgcttgtcgcaacatggcgagagctagcgaggctgtgtcccgaatactcgaagagtggcataaggccaaagtagaggccatgactttagatcttgctctgcttaggagcgtccagcattttgctgaagccttcaaggcgaagaacgtgccacttcatgtactggtctgcaatgccgctacattcgctctgccttggagccttaccaaggatggtcttgagactactttccaggtgaatcacctgggacacttctatctcgtacagctcctccaggatgttctgtgcagaagcgcacccgctagggtcatcgtggttagttccgagtcacatcgctttactgacatcaacgactccttgggaaaacttgatttcagtcgcctctcacctactaagaatgactattgggccatgctggcatataacagatcaaaactatgcaacatcctgttttcaaacgagttgcatcgtcgactaagccctaggggagttacgtcaaatgcggtgcatccaggaaacatgatgtattcgaacatccatcgatcttggtgggtatacactttgctgttcactttggctagaccttttaccaaaagcatgcagcagggcgctgctacaacggtgtattgcgctgctgtacccgagctcgagggcctgggcggtatgtactttaacaactgctgtcgatgcatgcctagccccgaggctcagagtgaagaaaccgcgagaaccctctgggccctgtccgaaagactgatccaagagcgcctcggtagtcagagcggctag

SEQ ID NO: 31536 - DNA, 642 bp, Artificial Sequence
  Description of Artificial Sequence: Synthetic coding sequence
atggccgcattgagatatgccggtctcgatgatacggactctgaagatgagctccctcccggttgggaggagcggaccacgaaggatggttgggtttattatgccaaccacacagaggagaaaactcagtgggagcatccaaagacaggtaaacgcaaacgggtggccggtgaccttccatatggatgggagcaagagaccgatgaaaacggacaggtttttttcgtggaccacattaataaaagaactacctacctggaccctagattggccttcacagtagatgataaccctaccaaacctactaccagacagagatatgacggatcaacaaccgctatggagatcctccagggacgcgattttacaggcaaagtggttgtcgtcacaggggctaatagtgggatcggaaaggcttcctgccatgtgggaaggatcctgaagcatacaagagtggaagaactgagcctgctgccaacagctataaacagagaattacctccgccatgcactgtgctgctcagtcaaaactggagggtatgggagggttgtacctctaccacggctgctgccgcttgccctcatcagaagcttagggccaaaaggcggccaggcccttgtgggaggtctgccaggggatag

SEQ ID NO: 31537 - DNA, 1245 bp, Artificial Sequence
  Description of Artificial Sequence: Synthetic coding sequence
atggcagcgctgcgatacgctgggcttgatgacaccgacagcgaagatgagctgcccccaggctgggaagagaggactactaaagatggctgggtttattatgccaatcacaccgaggaaaaaacccaatgggaacacccaaaaaccggaaaacgtaagcgagtcgctggcgacttaccatacggatgggaacaggaaaccgatgaaaacggccaggtgttctttgtggaccatatcaataagagaaccacctatctcgaccccaggctggcttttactgttgatgataatcccacgaaaccgaccacacgacagagatacgatggctctactacagctatggagatcctccaaggtagggattttacgggtaaagtggtggttgtgacaggtgccaactcaggcatcggattcgagacggccaaatctttcgcactccatggtgcccatgtcatcctagcgtgcagaaacatggctcgtgcctcagaagctgtaagtagaattctggaagagtggcataaggccaaagttgaagccatgacgttggacctcgcacttctccgcagcgtgcagcacttcgctgaagcattcaaggccaagaacgtgcctctgcatgtactagtgtgcaacgcggcaacgttcgctctgccatggtctctcaccaaggatggattggaaaccacttttcaggttaatcatctgggccatttctacctcgtgcagttgctccaggacgtcctgtgcaggtctgcccctgctagggtgatcgtcgtttctagcgagagtcaccggttcactgacataaacgacagcctgggaaagctggatttttcccgactaagccccacaaaaaacgattactgggccatgctggcctacaacaggagtaaactctgcaatattttattcagtaacgagctgcataggcggctttcaccaaggggagtgacttccaacgccgtccatccaggcaacatgatgtactccaatatccacaggtcctggtgggtatatacacttttgtttacactcgctcgaccattcacaaaatcaatgcagcagggtgccgctacaaccgtgtattgtgctgctgtaccagaactggaaggcctgggcggtatgtacttcaacaattgttgtagatgtatgccatctccggaagcccagtcggaggaaactgcccgaacactttgggccctgagtgagagactgattcaggagaggctcggttcacaaagtggttag

SEQ ID NO: 31538 - DNA, 111 bp, Artificial Sequence
  Description of Artificial Sequence: Synthetic coding sequence
atggctgccctgcggtacgccggactggacgacaccgacagtgaggatgaattacctcccggatgggaggagaggactaccaaagatggctgggtctactacgcaaagtag

SEQ ID NO: 31539 - DNA, 1047 bp, Artificial Sequence
  Description of Artificial Sequence: Synthetic coding sequence
atggctcactctcagaatagtttagagctgccaatcaatattaatgcaacacagattaccactgcttatgggcatcgggctttacctaagctgaaggaagagctgcagtcagaggatctccaaacccggcagaaggccctcatggcactctgtgacctgatgcacgaccctgaatgtatctataaagcgatgaacatcggctgcatggaaaacttaaaggccttgctcaaggactcaaatagtatggtgagaattaaaaccactgaggttcttcacatcacagcctctcactctgtgggtcgttacgcctttctggagcacgacatcgttcttgctttgtcatttctgttgaatgaccctagccctgtttgccgcggtaatctgtataaagcttatatgcagctggtccaggtgcctaggggtgcacaggagattatctccaagggcctgattagcagccttgtttggaaactgcaagtagaagtagaagaggaggagtttcaggaatttattctggacacccttgtcctctgcttgcaggaggatgcgactgaagcgttaggcagcaacgtagtcctcgtcttaaaacagaaactgcttagcgccaaccagaatatcaggtcaaaggcagcaagggcattgctgaatgtttcaatttctcgggaagggaaaaaacaggtttgccatttcgatgtgataccaatccttgtccatctgttgaaggatccagttgagcacgtcaagagcaacgctgcaggcgctcttatgttcgcaaccgtgatcaccgagggtaagtacgccgctctggaggcgcaggcaatcggtctcttactcgagttactgcattccccaatgacaattgctcgtttaaatgccaccaaggctctgaccatgctggctgaggcaccggaagggaggaaagcactccaaacccacgtgccaacatttcgggcaatggaggtggagacctacgaaaaaccccaagtggccgaggcgcttcagcgcgcagcccgtatcgcaatttctgtgattgaattcaaaccctag

SEQ ID NO: 31540 - DNA, 1131 bp, Artificial Sequence
  Description of Artificial Sequence: Synthetic coding sequence
atggtggttgttgccgctgctccgaaccccgctgatgggacgcctaaggtcctcctgctctcaggacaaccagccagcgcagctggggctccggctgggcaggctctgcccctgatggttccagcccagcgcggagcttcccccgaagcggctagtgggggattgcctcaagctcgcaagagacagcgcctaactcacctcagccccgaagagaaggctctgagaaggaaactgaaaaatcgtgtggccgctcagactgccagggatcgaaagaaggctaggatgagcgagctggaacaacaggtggtagatctcgaggaagaaaatcagaagctcctcctggaaaaccagctcttaagggaaaaaacccacgggctggtcgtcgaaaatcaggagctgaggcagcgacttggcatggatgcactagttgccgaagaggaggccgaagccaaggggaatgaggtccgccctgtggctggtagcgcagagtccgccgctggcgctggcccagtcgtaacccctcctgaacacctgcccatggacagcgggggaatagacagtagtgacagcgaaagcgacatcctattggggatccttgataacctcgaccccgtgatgtttttcaaatgcccctctccagaacccgcatctcttgaggagctgcccgaagtgtatcccgaaggccctagtagtctccccgctagcttgtccctctcagtcgggactagcagcgccaagcttgaggccattaatgaactgatccgattcgaccacatctataccaagccattggtgctggaaatcccttccgagactgagtcccaggcgaatgtggttgtcaagattgaggaagctccgttgagtccctcagagaatgatcatcccgagtttatagtgtcagtgaaagaggagccagtcgaagacgatctcgtgccggagcttgggatcagcaatctcctcagctcaagtcattgtccgaagccgagcagctgcttactagatgcctacagcgattgtggctacggtgggagcctgtccccctttagcgatatgtcatctctcctaggcgtgaaccacagctgggaggatacatttgctaatgagctgtttccacagttgatctcggtgtag

SEQ ID NO: 31541 - DNA, 801 bp, Artificial Sequence
  Description of Artificial Sequence: Synthetic coding sequence
atggtcgtggtcgccgctgcacctaatcccgcagatggcacccctaaagtcctgctgctcagcggccagcctgcctctgccgctggggctcccgcaggccaggcgttgccattgatggtgcctgcgcagcgaggagcatctcccgaggctgctagcggtgggctaccgcaggctcgtaagaggcagcgccttacccacctgagtccggaggaaaaggccctcagacgcaaactgaaaaatagggtcgcggctcagacagcccgtgaccggaagaaagctcggatgtcagagctggaacagcaagttgtggatctcgaggaggaggtgaaactcctcaaaaaccagaagctcttactcgaaaaccagctgctccgtgaaaagacacacgggttggttgtggaaaatcaggaattacgtcagaggcttggaatggacgctctggtggctgaggaagaggctgaggccaaggggaatgaagtacgtccagtcgcaggtagtgccgagagtgccgcactgcggttgcgggcaccactgcaacaagtacaggcacagctgagccctttgcagaatattagtccttggattttggctgtgctgaccttgcagatccagtccctgataagctgctgggctttctggactacatggacacaaagctgtagcagcaacgcacttccccagtctttgcccgcttggcgttctagccagaggtctacacaaaaggacccagtaccctatcagcctccgttcttgtgccagtggggaagacatcagccctcttggaagcccctgatgaactag

SEQ ID NO: 31542 - DNA, 636 bp, Artificial Sequence
  Description of Artificial Sequence: Synthetic coding sequence
atgcgtgctccggtgttccaggctctgctgctgtgtgggaggcggttggtggtgcagccacttaactccgacatgcgtaaattgaagaatcgggtggcagcccaaactgcgagagatcggaagaaggccaggatgagtgagctcgagcagcaggtggttgatctcgaagaagaaaatcagaagctcttgctcgagaaccagctgctgcgggagaagacccatggcttggtggtggagaaccaggaactgcgacagagacttggtatggacgccctggtggccgaagaagaagcggaagctaagggaaacgaagtgaggcccgtagcaggtagtgctgagtccgctgctttacgcctgcgggcaccactacagcaggtgcaggctcagctgtcgcccctgcagaacatctccccatggatcctggccgtattgacactgcagatccagagcctcattagctgctgggccttttggactacatggacccagtcctgctctagcaacgccctccctcagagcttgccagcgtggaggagtagccagagaagtacccagaaagacccagtgccataccagcctccatttctgtgccaatggggacggcaccagcctagctggaagccgcttatgaactag

SEQ ID NO: 31543 - DNA, 822 bp, Artificial Sequence
  Description of Artificial Sequence: Synthetic coding sequence
atggctgcagccgacggcgctttgcctgaagccgcagctctggagcagccggctgagcttcctgcctccgtccgggcatcaatcgaacgtaagaggcagcgtgctctcatgttgcgtcaggcacgcttggctgctcggccttatagcgcgaccgctgcggctgctaccggcggaatggccaacgtcaaagccgctccaaaaattatcgatactggtgggggattcattctcgaagaagaggaggaggaggaacaaaagattgggaaggtagtgcaccagcccggtcccgtgatggagtttgattacgtcatctgcgaagagtgtggtaaagaatttatggactcctatctcatgaaccatttcgacttgccaacttgtgacaattgcagggatgcggatgataagcataaactgataaccaagacggaggccaagcaggaatacctcctcaaggattgtgatctcgagaagcgggaaccacctcttaaattcattgtcaagaaaaatccacatcattctcagtggggggatatgaagctgtacctgaagctgcagatcgttaagcgatcgctggaggtttggggaagccaagaggcactcgaggaagcaaaagaggtgcgccaagagaacagagaaaagatgaagcagaaaaagttcgataaaaaagttaaggaactgcgaagagccgtccgtagtagtgtgtggaagcgggagacgatcgtgcaccagcatgaatacggtcctgaagagaacctggaagatgacatgtacagaaaaacatgcactatgtgcggccacgagctgacctatgagaagatgtag

SEQ ID NO: 31544 - DNA, 2823 bp, Artificial Sequence
  Description of Artificial Sequence: Synthetic coding sequence
atggctcgaaaacgggcagctggaggcgaacccagaggacgagagctcaggagccagaaatccaaagcgaaaagtaaagcccgaagagaagaagaggaggaggacgcttttgaggatgagaaaccccctaaaaagtccctgctgtctaaagtcagccaaggcaaacggaaacgcggatgctctcatcctggagggagtgccgacgggcctgcaaagaagaaagtggcaaaggtgactgtgaagagcgaaaacctgaaggtcattaaagatgaggccctgtcagatggagatgaccttagggactttccttcggatctcaaaaaggcccaccacctgaaaaggggtgcgaccatgaatgaggattctaacgaggaagaagaagaaagcgagaatgactgggaggaagtggaagagctgagcgaaccagtgctcggggatgtccgagaatcaacagcttttagtaggtctctactcccagtgaagccggtcgagatcgaaattgagacccctgaacaggccaagacccgcgagcgatcggagaagattaagctcgaatttgagacctatctccgaagagctatgaagaggttcaacaaaggagtgcacgaggacacccacaaggtgcacctcttgtgcctcctggcaaacggtttctataggaacaatatttgcagtcagccggacctccatgccattggactgagcatcattcccgcacgctttacaagagttcttccacgagatgtggatacctattatctgtccaaccttgttaaatggtttatcggaacgttcaccgttaatgctgagctgtccgcaagcgagcaggacaatttgcagaccactttggaaagacggttcgccatttactctgcccgtgacgacgaggagcttgtgcatatatttctcttgatcctccgagcgctccaactgctgacgcgcctggtgctgagcctgcagcccatccctctgaagtccgctactgctaaaggcaaaaaaccctctaaagaaaggctcactgccgatccaggcggatctagcgagacctcttcccaggtactggaaaatcatactaaaccaaagacctccaaaggaacaaaacaggaggagacattcgccaaggggacgtgccggccatcagctaaggggaagagaaacaagggtgggcgaaaaaagcgatcgaaaccatcctcctctgaagaggacgagggccctggcgataagcaggagaaggccacgcagcgcagaccccacggcagggagcgtcgggtcgcttcaagagtaagttacaaagaggagtccggatcagatgaggcgggtagcggctccgactttgagttaagctccggcgaggccagcgaccctagtgatgaagactccgaacccggaccaccaaaacaacgcaaggcgccagcccctcagagaaccaaagcaggtagcaaaagcgcttctcgcacccaccgcggtagtcataggaaggatccgtcactgcccgctgctagctcaagcagctcatcctctaaacgagggaagaagatgtgttccgacggcgagaaggccgagaaacgaagcattgctgggattgaccagtggctggaagtcttttgcgaacaggaagaaaaatgggtctgcgtggattgcgtacatggggtcgtggggcagccactgacatgttacaagtacgccactaaaccaatgacatacgtcgtaggtatagattccgacggttgggtgagagacgtgacgcagcgttatgatccagtgtggatgacagtgacaaggaagtgccgggttgacgccgaatggtgggccgaaactctccgtccatatcaaagccccttcatggaccgagagaagaaggaagatctcgaatttcaggccaagcacatggatcagccactgcctaccgcaatcggtctgtacaagaatcaccctctgtacgccctcaaacgtcatctgcttaagtatgaggccatttaccccgagactgccgctatcctcggatactgtcgtggggaagccgtgtattctcgcgactgtgtgcatacactgcactcacgggatacatggctgaagaaggcacgagttgtgcgcctgggtgaggttccatataagatggtaaagggtttctccaacagggccagaaaggctcggcttgccgagccccagcttagagaggagaacgacctgggcctcttcggatattggcaaacagaggaatatcagccaccagtcgccgtggacggtaaagtccccaggaatgagtttggcaacgtgtacttgtttctgccctcaatgatgccaattggttgcgtacagctcaacctccctaatctgcacagagtagcacgtaagctggacatagattgtgttcaggcgataacgggatttgactttcatggaggttactctcatccagtaaccgacggatacatcgtctgcgaagaatttaaagatgttctgctaaccgcgtgggaaaatgaacaggcagtcatcgaacgaaaggagaaagaaaagaaagagaagagggcacttggcaactggaaattgctggccaagggcctccttatccgcgaacgcctgaagcggagatacgggcctaagtcagaagctgctgctccccacacggatgctggcggaggtttgtctagcgatgaagaggaaggcacatctagccaagcggaagccgctcgcatcctggccgcaagctggccccagaaccgagaggatgaggagaaacagaagctgaaagggggtcccaagaagaccaagagagaaaagaaagctgctgcatctcacctctttccatttgaacagctttag

SEQ ID NO: 31545 - DNA, 2712 bp, Artificial Sequence
  Description of Artificial Sequence: Synthetic coding sequence
atggctagaaaaagagccgctgggggtgaacccagaggaagagagctgaggtcccaaaagagcaaggcaaagtcgaaagctaggcgggaagaagaagaagaggacgcctttgaagatgaaaaacccccaaagaaatctctgctcagtaaggtgtcacagggaaagaggaaacgcggttgcagtcacccaggaggcagcgccgatgggcctgccaagaaaaaggttgctaaagtgacagtcaaatcagaaaacctaaaagtgattaaggatgaggccttgtctgacggtgatgacctcagggatttcccatccgacttgaagaaagcccatcatttgaagagaggcgctaccatgaatgaggattctaacgaggaagaggaagaatcggaaaacgactgggaggaagccaaaaccagagaaagaagtgaaaagattaagttggaattcgagacgtatctcaggcgggcaatgaaacgatttaacaaaggcgttcacgaagacacgcacaaagttcacctgctgtgtttgttggctaatggattctatcgtaacaacatctgttcacaacctgaccttcacgccatcggtctgtcaatcatcccagctaggtttaccagggtgctaccccgtgacgtagatacctactacctcagtaatctggtaaagtggttcattggcacctttacagtgaatgccgaactgtcagcaagcgaacaggacaacctgcagacaacgttggagagacggtttgcaatctattccgctagggatgatgaggagctggtgcacatctttctcttgatattgcgcgcactgcagctgctgacaaggcttgtactctccttgcagcccattcctctgaagagtgcgaccgccaagggaaaaaagccaagcaaggagcgcttgacagctgatcctggtggctcgtccgagactagttcgcaagtgctcgagaatcacactaagcccaaaacatccaagggtacaaagcaggaggaaactttcgcgaagggcacttgccgaccttccgccaaggggaagagaaataaaggaggcagaaaaaagcggtcaaaaccatcttctagcgaagaggatgaggggccaggcgacaagcaggagaaggccacccaacgtcgaccccacggtcgagagcggagagtggcttctagagtgagttataaggaagaatccggcagcgatgaagctggctctggctctgacttcgagcttagtagcggagaagcttctgacccctcggacgaggattccgaacccggaccccctaaacagcggaaagcaccagcccctcagagaacaaaagcagggagtaagtcagctagtaggactcaccggggatcacacagaaaggacccttctctgcccgcagcttcgtcctcgtcgtctagctccaagcgcggaaaaaagatgtgttctgatggcgaaaaagcagaaaaacgcagtattgccggaattgaccagtggctggaagtgttttgcgagcaagaagagaaatgggtctgtgtggactgcgttcacggcgtcgtcggacagcctctgacatgttacaagtacgccacgaagccgatgacctacgtggtgggtatcgacagtgacggatgggtccgtgatgtcactcaacgatatgaccctgtgtggatgacagtgaccagaaaatgcagagtagatgctgagtggtgggccgaaactctcagaccgtaccagtctcctttcatggaccgcgagaagaaagaggacctcgaattccaggctaagcatatggaccagcctctgcctaccgctatcggcctgtacaaaaatcatcccttgtatgcactgaagcggcatctgctgaagtatgaagctatttatcccgagactgccgcaattttaggatactgtcgaggcgaggctgtttattccagagattgtgtccacaccctgcactctcgggatacatggctgaagaaggccagagtggtgaggctgggagaggtgccatacaaaatggtcaagggattcagcaatagagctcgcaaggctcgcctggcggaaccacagctcagggaagagaacgaccttgggctgttcggctattggcaaaccgaagagtaccagcctccggtggccgtggacgggaaggtgccccgtaacgagtttgggaatgtgtatctgttcctacctagcatgatgcctattggttgcgtgcagctcaacttgccgaacttacatagagtcgcaagaaagctcgacattgactgtgtgcaggcaataaccggtttcgacttccacggcggttacagccatcccgtcaccgacggatatatagtttgcgaagagttcaaggacgtgctcctgactgcgtgggagaatgagcaggccgtaatagaacggaaggaaaaagagaaaaaagaaaaacgcgcactgggaaattggaaactgctagcgaaaggcctgttgattcgcgaacgacttaagaggagatatggtcccaaaagcgaggcagcagcgcctcacaccgacgccggtggcggactatcttcagacgaggaagaggggaccagcagccaggcggaggccgcacgcattctggctgcctcctggcctcagaaccgggaggacgaggaaaagcagaaactcaaaggtgggccaaaaaaaaccaagcgggagaaaaaagctgcagcaagccatctttttcccttcgaacagttgtag

SEQ ID NO: 31546 - DNA, 423 bp, Artificial Sequence
  Description of Artificial Sequence: Synthetic coding sequence
atggcccgtaagagggctgcaggtggagaacccaggggccgagaactccgatcccagaagagcaaagccaagagcaaagcacgaagagaggaagaagaagaggatgctttcgaggacgagaagccaccaaagaaaagcctgttgtcaaaagtctctcaggggaagaggaagcgtggatgcagtcatcccggtggtagcgccgatggccctgcaaagaagaaggtagccaaagtgacagtgaagtcagaaaacctgaaggttatcaaggacgaagccctttcagatggggatgaccttcgagattttcccagcgatctgaagaaagcccaccacctgaaacgcggagcaactatgaatgaggatagcaatgaagaggaggaagagagcgaaaatgactgggaggaagtggaggtgaagagatag

SEQ ID NO: 31547 - DNA, 507 bp, Artificial Sequence
  Description of Artificial Sequence: Synthetic coding sequence
atggccaggaagcgcgctgccggtggcgagcctcgtggacgcgagctgcgctcacagaagtcaaaggccaagtctaaagctagacacgctttcgaagacgaaaaaccccctaagaagtccctgctctccaaggtgtcacaaggtaaaaggaaacgaggctgcagccaccccggtggcagtgccgatggtccagctaagaaaaaagtggcgaaagtgactgtgaagtcagagaacttaaaggtcattaaggacgaggcattgtcggacggtgacgatctgcgggatttcccctcggaccttaaaaaggcacaccacctgaagagaggcgctaccatgaacgaggacagtaatgaggaggaggaggagtccgagaacgactgggaggaggtggaggaattaagtgaacccgtgcttggcgatgtccgggagtctactgctttctcccggtcgttgcttccggtgaagcctgtggaaatcgagatagaaactccagaacaggcgaagtag

SEQ ID NO: 31548 - DNA, 462 bp, Artificial Sequence
  Description of Artificial Sequence: Synthetic coding sequence
tccagtagtaaacggggtaaaaagatgtgttctgacggtgaaaaggcagagaagagatctatcgccggtattgaccaatggctggaggtgttttgcgagcaggaggagaaatgggtgtgcgtggactgtgtccacggtgtggtgggccagcccttgacatgctataaatacgccactaagccaatgacctacgttgtcgggattgactccgacggctgggtgcgagacgtgactcaaagatacgaccccgtgtggatgacggtcacccgaaaatgcagggttgatgctgagtggtgggcggagactctgagaccttaccagtcgccattcatggatcgcgagaagaaggaagacctggaggggttatgtgcccatagcgccttccagggacacgtggccgaagaaagcaaatcgggcgaggcctggagatcaacattgcaggacggagaaaggctattttag

SEQ ID NO: 31549 - DNA, 177 bp, Artificial Sequence
  Description of Artificial Sequence: Synthetic coding sequence
atgtgctcagacggggagaaagctgaaaaaaggagcatcgcaggcatcgatcagtggctggaggttttctgcgagcaggaggagaaatgggtctgcgttgattgccggtgcggtggaccagcctcagacctcctacaggtgcgccatcaggcgcatgatctctgtggtggtcattag

SEQ ID NO: 31550 - DNA, 231 bp, Artificial Sequence
  Description of Artificial Sequence: Synthetic coding sequence
aaagccacgcagagacgacctcatgggcgagaaagaagggtggcttccagagtatcctacaaagaggagagtgggtcagatgaagccggatccggatccgatttcgaactcagttccggcgaagcatccgatcccagcgacgaggatagtgagcctggacctccgaagcagagaaaagccccagccccacaacgtactaaggccggatccaagagtgccagccgcacctag

SEQ ID NO: 31551 - DNA, 849 bp, Artificial Sequence
  Description of Artificial Sequence: Synthetic coding sequence
atggagggggacttttcggtgtgtagaaactgtaaaaggcacgtagtgtcagccaactttacactccacgaggcttactgcctaagattcctggttctgtgtcccgagtgcgaggagcccgtgccaaaagagactatggaggagcattgtaaattggagcatcaacaggccaatgagtgtcaggagagacccgtagaatgtaagttttgtaagctggatatgcaactcagcaagttagaactccatgagtcgtactgcggctctcgtaccgaactgtgccaggggtgcggtcagtttatcatgcatcggatgctggctcagcacagagacgtgtgccgctcggagcaggcacagctcggaaaaggagaacgcattagtgcccctgagagggaaatctactgtcattattgcaatcaaatgattcctgaaaacaagtactttcatcacatgggaaaatgttgtcctgacagcgagttcaaaaaacacttccctgtggggaaccccgagatactgccctcctccctccctagtcaggccgcagaaaatcagaccagcactatggagaaagatgtgaggcctaagaccaggtccattaatagattcccactccattccgagagcagttccaaaaaagccccaaggagtaagaacaagacactggacccccttctgatgagcgaaccgaaacctcgcaccagctcaccaagaggggacaaagcagcttatgacatcctgagaagatgttcgcagtgtggaattttactacccctccccatcctgaaccagcatcaggaaaaatgcagatggctggcttcaagcaaagggaagcaagtcagaaacttctcctag

SEQ ID NO: 31552 - DNA, 906 bp, Artificial Sequence
  Description of Artificial Sequence: Synthetic coding sequence
atggaaggagacttctccgtctgccggaattgtaaaagacacgtggtgtcagccaactttaccctgcacgaagcctattgtctgaggttcctcgttttatgtcctgagtgcgaggaacccgtaccaaaggagactatggaggagcattgtaaactggagcatcagcaagtgggttgtacaatgtgtcagcagagtatgcaaaagtcctccctggaatttcataaggctaatgaatgtcaggagcgtccggttgagtgtaagttctgcaagctcgacatgcaattgtcgaagctggagctgcacgaaagctactgtggaagtcggaccgagctctgccaggggtgcggacagttcatcatgcaccgcatgctggcacagcaccgcgacgtttgtcgctccgagcaggcccagctaggcaaaggagaaagaatatctgcacctgagagagagatatactgccattattgcaaccagatgattccggagaataagtactttcaccatatggggaagtgctgtcccgatagcgagttcaagaagcatttcccagtcggcaatccagaaattctaccctcctcactgccaagccaggccgcagaaaaccagacctctaccatggagaaggacgtccgcccaaagactcggtccatcaaccggttccctttgcatagcgagtctagcagcaaaaaggcccctcggagtaagaataaaactctggatccgctgctgatgagcgagcccaagcccaggacctccagccccagaggggacaaggccgcttatgatatcctgcgccgatgctcacaatgtggcatcctcctcccattacctatactgaatcagcaccaggagaagtgccgttggctggcaagcagcaagggtaagcaggtgagaaacttttcctag

SEQ ID NO: 31553 - DNA, 600 bp, Artificial Sequence
  Description of Artificial Sequence: Synthetic coding sequence
atgagtctacactacggctgttgttgtcccgaatgtacaagcgtcgctattaaagaaatgatgtgggtgatccgaccgagggtggcctgcgtggtgaaggatgctggaagtgccggagaacggatcagcgcccctgaaagagaaatatattgccattactgtaaccagatgatccccgagaataagtacttccaccatatgggtaagtgctgtccggattccgaattcaagaagcactttcctgttggaaatccggagattctgccctcatcgctacctagtcaggctgcagaaaatcagacttctacaatggaaaaggatgtccggcctaagacccggtcgataaatcggttcccactgcattcagaatccagctcgaagaaagctcctagatctaagaacaagacactcgaccccctgctcatgtctgagcctaaacctcggacttcatcacctaggggcgataaagccgcatacgacattctgcgcaggtgttcccagtgtggcatacttctacctctacctatactgaaccagcaccaggagaaatgtaggtggttggcctcctccaaaggtaaacaggtccgcaatttttcgtag

SEQ ID NO: 31554 - DNA, 495 bp, Artificial Sequence
  Description of Artificial Sequence: Synthetic coding sequence
atggaaggcgacttctccgtctgtcggaattgtaagcggcatgtggtgtctgccaatttcacgctgcatgaggcttactgtctgagattcctcgtcctctgtccagaatgtgaagagcctgttcctaaggagacaatggaagagcattgcaagctggagcatcaacaggtgggctgtactatgtgccagcaatctatgcagaaatcaagtctcgaattccataaagccaacgaatgtcaggaaaggccagtcgagtgcaaattttgcaagttggatatgcagctgagcaagctcgagttgcacgaatcatattgtggttcccgtaccgagctctgccaagggtgcgggcagtttataatgcatagaatgctggcacagcatcgggatgtctgtcggtcagaacaggctcaactggggaaggagaccagccccgatcctggaaagtgcctgtccattaccgtagcagccgctttaagcgcacacttgtggccatag

SEQ ID NO: 31555 - DNA, 906 bp, Artificial Sequence
  Description of Artificial Sequence: Synthetic coding sequence
atggaaggagatttttcagtttgccgcaactgcaaacgtcatgtcgtctccgctaacttcaccctgcatgaggcatattgtctcagattcctcgtgctctgtcctgagtgtgaagaacccgttcctaaagagacaatggaggagcattgcaagcttgagcatcaacaggtgtccgagatgggatctggcagggggaaatgctccattttgcctgcccgtaaaaaggcgaatgagtgtcaggaacgccctgtggagtgtaagttttgcaagctggatatgcaactgtcaaaactggaattgcatgaatcatactgtggctcacgaacagaactgtgccagggctgcgggcagtttatcatgcataggatgctagctcaacaccgggacgtgtgtaggtcggaacaagcgcagctcggaaagggcgagcgcatctcagccccagaacgcgagatctactgccactattgtaatcaaatgatccccgagaacaagtatttccaccacatgggcaaatgctgccccgattccgaatttaaaaagcattttcccgtagggaaccccgagatactaccatctagcctgcctagccaagcagccgagaaccagacctctaccatggagaaggatgtgaggcccaagactcgcagcatcaatcgcttcccactgcactcagaaagtagcagcaaaaaagcacccaggagcaagaataagacgctggatcccctgcttatgagcgagcctaagccacgcacatcttcccccagaggcgacaaagctgcctacgacattctgcgaaggtgtagtcaatgcggcatactcctgcctctccctattctgaaccagcaccaggagaaatgtcgatggttggcatccagtaagggcaagcaggtacgcaattttagttag

SEQ ID NO: 31556 - DNA, 1494 bp, Artificial Sequence
  Description of Artificial Sequence: Synthetic coding sequence
atgacatttaactcttttgagggctccaagacatgtgtccctgctgatatcaacaaggaggaagagtttgtggaggagttcaatagacttaaaacttttgcgaacttccccagcggcagtcccgtgtctgccagcacgcttgctagagcaggttttctgtataccggggagggtgacacagtgcggtgtttctcatgccatgctgccgtggatcggtggcaatacggagacagcgctgtcggaagacaccgcaaagttagtcctaactgtcgtttcatcaacggattttacttggagaattccgccacccagtcgactaactcagggatccagaacgggcagtacaaggtggaaaactatctcggtagcagagatcatttcgcgctggaccgaccctctgagacacatgccgactatctccttcggacaggacaggtagtcgacatttctgatactatttatcctagaaatccagcaatgtacagcgaagaggcacggttaaagtctttccagaactggcctgattatgcgcatcttacaccacgcgagcttgctagtgcaggactgtactacacaggcataggcgaccaggtacaatgcttctgttgtggcggtaaattgaaaaactgggagccctgtgaccgggcttggtcagaacatcgtaggcattttcccaattgcttctttgtcctggggaggaacctcaatatcagatcagagtccgacgcggtgagctcagaccgaaatttccctaactcgacaaaccttcccaggaatccatcaatggctgactatgaggccagaatctttacttttggaacatggatctatagcgtcaacaaagagcaattggctcgagccggattctacgccctgggggagggggacaaagtcaagtgtttccactgcggcggagggctaaccgattggaaaccaagcgaagatccatgggaacagcacgcgaagtggtatcccggttgtaaatacctgctcgagcaaaaaggtcaggagtacattaacaacattcacctgactcactctctggaagaatgcctggttcggactaccgaaaagactccttccctcacccggaggatagatgatactatcttccagaaccccatggtgcaggaggcaataagaatgggattctcctttaaggacattaaaaagataatggaggagaaaattcagatatcaggcagcaattataagtccctggaggtcctcgtggctgaccttgttaacgcgcagaaggattccatgcaagatgagtcctctcagacatctttgcagaaagaaataagcacagaggagcagctgcgccgactgcaggaggagaagctgtgcaagatttgcatggaccgaaacattgcaatcgtgtttgtgccttgcggccatcttgtgacctgcaagcagtgcgctgaagcggtggacaaatgtcctatgtgctacactgtgatcacatttaaacagaagatcttcatgtcctag

SEQ ID NO: 31557 - DNA, 1494 bp, Artificial Sequence
  Description of Artificial Sequence: Synthetic coding sequence
atgacattcaacagcttcgaaggcagcaaaacctgtgtgccagctgacattaacaaggaggaggaattcgtggaggaatttaacagattgaaaacgtttgcaaatttcccaagcggaagtccagtcagtgccagtaccctggcccgtgcgggatttctgtacacaggtgaaggcgatacagtgagatgtttctcctgtcacgccgctgttgatcggtggcagtatggcgattctgccgtgggcagacataggaaggtgtcacccaattgtaggtttatcaacgggttctaccttgaaaatagtgcaacccagtccaccaattcaggaatccagaacggccagtacaaggttgagaattacttggggtcgcgtgatcacttcgcattagaccgaccgtcagaaacccatgccgattacctgttgaggacgggacaagttgtggacatctcagacacaatttatccccgaaaccctgccatgtattcagaggaggcacgactcaaaagttttcaaaactggcctgactacgcgcacttgacaccacgcgagctagcatctgcgggtttgtattacactgggatcggagaccaggtgcagtgtttttgctgcggtggtaagctgaagaactgggaaccttgtgacagagcatggtccgagcacaggcgccacttccctaactgtttcttcgtcctgggaaggaatttgaatattcgcagcgagtcagacgcagtatctagtgaccgtaattttccaaatagcaccaacctgcccagaaatccttccatggcagactacgaggctcgtatcttcaccttcggtacttggatctactctgtgaacaaagaacagttggcgcgtgctggcttctacgcgctgggtgagggagataaagttaaatgcttccactgcggcggtggcctgacggactggaaacctagtgaggacccgtgggagcagcatgccaagtggtaccctggctgtaagtatctgctggaacagaaggggcaggagtacatcaacaatatccacctgacacacagcttagaggagtgtctggtccgcaccaccgagaaaactccctcactgacccggaggattgacgacacaatcttccagaacccaatggtgcaagaggctatacgaatgggcttcagctttaaggatatcaaaaaaataatggaggaaaagatacagatctctggatccaactacaaatcgctagaagtcttggtggccgacctggtgaatgctcagaaagattccatgcaggacgaaagttcacaaacaagtctgcagaaggaaataagcactgaggaacagctgaggcgattacaggaggagaagctttgtaagatttgtatggacaggaacatcgctatcgtatttgtcccttgtggacatctggttacctgtaagcaatgtgccgaagccgtggacaaatgcccgatgtgctatacagtcattacatttaagcagaagatcttcatgtcctag

SEQ ID NO: 31558 - DNA, 51 bp, Artificial Sequence
  Description of Artificial Sequence: Synthetic coding sequence
atgactttcaacagttttgagggatccaaaacttgcgtaccagccgactag

SEQ ID NO: 31559 - DNA, 471 bp, Artificial Sequence
  Description of Artificial Sequence: Synthetic coding sequence
atgacctttaattccttcgagggatctaaaacctgcgttcctgccgatattaataaagaggaggagttcgtggaggaatttaatcgcctcaagaccttcgccaacttcccctctggctccccggtttctgccagtaccctcgcacgcgctggctttttgtatacaggggagggggatacggtaagatgttttagttgccatgcagccgtcgaccgttggcagtatggtgattctgcagttgggcgacacagaaaggttagcccgaactgccgcttcatcaacggattctatctggagaatagcgcaacacaaagcacaaactctggaatccagaatggacagtataaggtggaaaactacctgggcagcagggaccatttcgctctggatcgtcccagcgagacacacgcagactaccttttgcgcacaggccaggtcgtagacatctccgacaccatctacccgaggtag

SEQ ID NO: 31560 - DNA, 1494 bp, Artificial Sequence
  Description of Artificial Sequence: Synthetic coding sequence
atgacctttaatagctttgagggaagcaaaacatgcgtcccagcagatatcaataaagaagaggagttcgtggaggagttcaacaggcttaagacatttgcaaactttcctagtggcagcccggtctccgcaagcactctggccagagccggtttcctctataccggcgagggtgacacagtgagatgcttttcctgtcatgccgctgtagatcggtggcagtatggggactcagcggttggtagacatagaaaagtgtcacctaactgtagattcataaatgggttttatctggaaaactccgccacgcaaagtactaatagtgggattcagaatggccagtataaggtagaaaattacttgggatcaagggatcacttcgcgctggataggccttccgagacacatgccgactatcttctgagaacggggcaggtggttgacatttccgacaccatctaccccagaaatcctgccatgtatagcgaggaagcaaggctaaagtcttttcagaattggcccgactatgcccatctgacacctcgagaactggccagcgctgggctgtattacacgggcatcggcgatcaggtgcaatgcttttgttgcggaggaaagcttaaaaactgggaaccctgcgatagagcttggagcgaacaccgtagacacttcccaaactgtttctttgtgcttggacgtaatctgaatatccggtctgagtcagatgccgtgagctccgataggaacttccccaatagtactaatctcccgcgaaacccctcaatggcagattacgaagcaaggatttttacgttcgggacttggatttactctgtgaacaaggaacaactggccagggcaggattttatgccctgggggagggcgacaaagtgaagtgttttcattgcgggggtggcctcaccgattggaaaccctcagaggacccttgggaacagcacgccaagtggtaccccggatgcaaatacctgttagagcagaaagggcaggagtacattaataacatccatctgactcacagtctcgaggagtgtctggtacggacaacagagaaaactccctcgctgactagaagaatcgatgacaccatcttccagaacccaatggtgcaggaggcaattcggatgggtttttctttcaaggacattaaaaaaatcatggaagagaaaatccaaatctccggcagcaactataagtccctggaagtgctcgtagcagacttggtaaatgcccagaaagacagtatgcaagatgagagttcccaaacatccttgcaaaaggagatcagcactgaagaacagctgcgcagactccaagaagaaaaactttgcaagatatgcatggataggaacatcgcaatagtgtttgtgccttgtggccatctcgtaacttgcaagcagtgtgccgaagctgtcgataagtgtcctatgtgttatactgtcattacctttaaacagaaaatttttatgtcttag

SEQ ID NO: 31561 - DNA, 2568 bp, Artificial Sequence
  Description of Artificial Sequence: Synthetic coding sequence
atggtggtcatggctcgcttatctcgccctgagaggccagacttggtcttcgaggaagaggacctcccctacgaggaggagataatgaggaaccaattcagtgtgaagtgctggttgcgatacattgaatttaaacagggggcacctaagccacgactgaaccagctgtacgagagggccctgaagctgctgccttgcagctataagctatggtataggtatttgaaagcacgacgggctcaagtgaaacaccgatgtgtcacagaccccgcttacgaagacgtaaacaattgccatgaacgggcatttgtgttcatgcataagatgcccaggctttggctggattactgtcagttcctaatggaccagggtcgggtcacccacacaagaagaacattcgacagggccctcagagcactgcctattactcagcattcacgcatttggcccctgtacttacggtttctgcgttcccaccccctgccggaaaccgccgtgaggggctataggcgcttcttgaaactgagccctgaatcagcagaggagtacatagagtatctgaaatctagcgacagactcgacgaggctgcccagcggttggctacagttgtgaatgacgagcgctttgtgtcaaaggccggaaaatctaactatcagctatggcacgagttatgcgatctgattagccagaacccggacaaggtgcagtcattgaacgtggacgctattatcagaggaggactgaccaggttcaccgatcaattagggaagctgtggtgtagtctcgcagactactacatccgtagcgggcacttcgagaaagccagagatgtgtacgaggaggcgatccggactgttatgacagtacgggactttactcaggtttttgactcttacgcccagttcgaagaatctatgatagccgcaaagatggagactgcttcggagctgggtagagaggaggaggatgacgtggacttagagttaagactggcacggtttgaacagcttatctctagacggcctcttctgctgaacagtgtgctcttgcgccagaacccacatcatgtgcatgagtggcacaagcgtgttgctctgcatcagggcagaccacgtgagattattaatacctacactgaggccgtacagaccgtcgacccctttaaagctaccggcaaaccgcataccttgtgggtggctttcgccaaattttatgaggacaacgggcagttggatgacgccagggtgattctggagaaagccacaaaagttaatttcaaacaggttgatgatcttgcctccgtgtggtgccaatgcggcgaactggagctcagacatgagaattacgacgaagccctgcgcctgttgcggaaggccacggcgctgccagcaagaagggccgagtacttcgatggcagcgaaccggtgcagaaccgcgtctacaaatcactcaaggtatggtccatgctcgctgacttagaagaaagcctgggtacatttcagtctacaaaggcagtttatgatcggattctggatttgcgcatcgcgacaccccagatcgttatcaattacgctatgtttcttgaagagcacaagtatttcgaggaaagctttaaggcttatgaacgcggtatcagtctgtttaagtggcctaatgttagcgacatttggtctacttacctcacgaaatttatagctcgctacggaggtcggaagttggagcgcgcacgggacctgtttgaacaagcccttgatggttgtccccctaagtatgccaaaacactgtacctcctttacgctcagctggaggaggagtggggcctagcccgacacgccatggccgtctacgagcgcgcaacccgtgcagtggagcctgcccaacagtacgacatgtttaacatttatattaagagggctgcggaaatatatggcgtgacccatacacgtgggatctatcagaaagctattgaagttttatccgacgagcacgctagagagatgtgcctaagatttgccgacatggagtgtaaactcggtgagattgatagagctagagccatttatagcttctgtagccagatctgtgatcccaggaccacgggtgccttttggcaaacttggaaggatttcgaggtgcgccatggaaatgaggataccataaaagaaatgcttcgcattcggagatcagttcaagctacatataacactcaggtaaatttcatggcaagccagatgctgaaagtaagcggatcagccacgggcaccgtaagcgaccttgcacctggccagtccggcatggatgacatgaagcttttggaacagagggccgagcagctggctgcggaggccgaacgcgaccagcctctgcgggctcagagcaagattctgtttgtgcgcagcgacgctagtagggaggaactggccgagctggcgcagcaggttaatcctgaggagatccagctgggcgaggacgaagacgaagatgagatggacctggaacctaacgaggtgcgtttagagcaacagagcgttcccgctgcagtcttcggcagcctgaaggaggactag

SEQ ID NO: 31562 - DNA, 2559 bp, Artificial Sequence
  Description of Artificial Sequence: Synthetic coding sequence
atggcgaggcttagtagacccgagcgtcctgaccttgtgtttgaggaggaggacctgccctacgaggaggagataatgagaaaccaattcagcgttaagtgttggttgcgctatatagagttcaagcagggagcacctaagccgaggttaaaccagttatatgaacgggcactcaaactgctgccctgctcgtataagctctggtaccggtacctgaaggcaaggagagctcaagtaaagcacaggtgtgtcacggatccggcttacgaggatgtgaataactgtcacgagagggcgtttgtgtttatgcataaaatgcccagactgtggcttgactattgtcaattcctgatggatcagggcagagtcacccacactaggagaacttttgatagggcattgcgggcactgcccataacccagcattcccgtatctggccactatatcttagattcctgcgctctcacccactccccgagacggctgttagagggtatagacgcttcctcaaactgagcccagaatctgccgaagagtatatagaatacctgaaatctagtgaccggttggatgaggcagcacagaggctggccacggttgtcaatgacgaaaggttcgtatccaaggccggaaaaagtaactatcagctgtggcacgagctgtgtgatctaatctctcagaatccagacaaggttcaatctctgaatgtcgatgcgattatcagagggggactcacccgatttaccgaccaattagggaaactgtggtgttccctggcggactattacattcgatctggacatttcgagaaggccagggacgtatatgaagaggcaatcagaacagtcatgacggttcgggatttcacacaggtgttcgactcgtacgctcagtttgaagaatctatgatcgccgctaagatggagaccgcatcggagttgggtcgtgaagaagaggacgatgtcgatctggagctcagactcgctagatttgagcaattgatctcacgcaggcccttgttgttgaattctgtcttgctgcggcaaaatccacatcatgtgcacgaatggcataaaagagttgctttacaccaggggcgtcccagagagattattaatacatacaccgaagctgtgcagactgtggatcctttcaaggcaactgggaagccacatactttgtgggtggccttcgccaaattttacgaagataacgggcagctagatgacgcgagagtgattttagaaaaagctacaaaggttaacttcaagcaggtggatgacttggcatcagtgtggtgccagtgtggagagctcgaactgcgtcacgagaattacgatgaggctctacgcctgcttcggaaggcaacagctctgcccgctagaagggccgaatacttcgacggtagtgagcctgtgcagaaccgggtctacaagtctctgaaggtatggtcgatgctggccgacctggaggaatcactgggcacttttcagagtaccaaagccgtttacgaccgaatcctggacctgagaatagcgaccccccagatagtgattaattatgccatgttcctggaagaacacaaatacttcgaggagtcatttaaggcgtacgagaggggcatttcgctgttcaaatggcccaatgtgtctgacatctggagcacgtatttaaccaagtttatcgctcggtatgggggtcgcaagctcgagcgcgcacgggatctgttcgaacaagcgctggacggttgcccacctaaatacgctaagacactgtatctgttgtatgcccagctggaagaggaatggggcctggcgcgtcacgccatggctgtgtacgagagggcaacgcgggcagttgaaccagcgcaacaatacgatatgttcaacatatacattaaaagagcagccgagatttacggggtcacgcacacaagaggtatctaccagaaagccattgaggtgctgagtgacgaacatgctagggaaatgtgtctgaggtttgctgacatggagtgtaagttaggggaaattgatcgcgcacgggctatttacagcttctgttcacagatctgtgacccccgtaccaccggcgcattctggcaaacctggaaggacttcgaggtccgtcatgggaacgaagacacaatcaaggaaatgctgcgcatccgccgaagtgtacaggcgacttacaatacacaagtaaattttatggcaagtcagatgctgaaggtgtcaggttccgccacaggtactgtgagcgacctagcacctgggcagtccggaatggacgatatgaagcttcttgagcagagagccgagcagctcgccgcagaggccgagagggatcagccactgagagcacagtcaaaaattctgttcgttcgcagcgatgctagccgggaggaactagccgaactggcacagcaagtgaaccccgaagaaatccagctcggcgaagatgaagatgaggacgagatggacctggagcccaatgaggtgaggctggagcaacagtccgttccggcagcagtgtttggcagcctgaaagaggactag

SEQ ID NO: 31563 - DNA, 1902 bp, Artificial Sequence
  Description of Artificial Sequence: Synthetic coding sequence
atgccagagattcgcctgcggcatgtggtttcttgctcttcccaggatagcactcattgtgcggagaatttactgaaggctgatacataccggaagtggagagctgcaaaagcaggcgagaagaccatttctgtggtcctacagctggagaaggaagaacagatacacagtgtggatataggaaatgatggatccgccttcgttgaagtgctggttgggagttcagccggtggggctggagagcaggactacgaagtattgctagtaaccagctcttttatgtcaccatcagagagtcggagtggcagcaatccgaaccgggtgcggatgttcggaccggataaactcgttcgagcggctgctgagaagaggtgggaccgcgtgaaaatcgtctgtagtcagccatactcgaaagattcacctttcggcctgtccttcgtgcgctttcacagccctcccgataaagacgaggcagaagccccttcacagaaggtaacagtaaccaagttaggccagtttagggtgaaagaggaggatgaaagtgcaaattctctgaggccgggagcacttttcttcagccgaatcaacaagacgtcccctgtaaccgcttctgacccggcaggaccctcttacgcggcagccactttacaagcatcctcagcagccagtagcgcctctcctgtcagccgcgctatcggaagcacgtccaagccccaagaaagcccaaagggaaagcgaaaattggatttgaatcaagaggagaaaaagactccatcaaaacctcccgctcaactgtccccctccgtccctaagcggcctaagctgcccgctcctaccaggaccccagctacagccccagtgcccgcacgagcgcagggtgccgttaccggaaagcccagaggtgaaggaaccgagcctcggagaccccgagcaggcccagaggaactgggcaaaatcctacagggcgtcgttgtggtgttaagcggcttccaaaaccccttccggagcgagcttcgcgataaggccttggagttaggcgctaagtaccgaccagattggacccgagactcgacccacctaatttgtgcattcgccaacaccccaaagtactcccaggtgctcgggttgggcggacggatagtgcgcaaggaatgggtgctggactgccatcgaatgaggcggcgtctgccctcccaacggtatctgatggctgggcctggctctagctccgaagaggatgaggcctcccattctggaggctctggagacgaggcacccaaacttccccagaaacagccacaaaccaagacgaaaccaactcaggccgctggaccctctagcccacagaagccaccaacccctgaagagaccaaggccgctagcccggtcctgcaggaggatatagatatcgagggggtgcagtcagaggggcaagacaacggggctgaggacagcggggacaccgaggacgaactccgacgggtcgccgagcagaaagaacacaggcttcctccgggtcaggaggagaacggcgaggacccttacgcgggttctaccgacgagaacactgattcggaggagcatcaagagccaccagatctgcccgtccctgagctgcccgacttttttcagggtaaacactttttcctgtatggtgagtttccaggagatgagcgacgcaagctcatacgctacgtgaccgcctttaacggcgagctggaagacaacatgtcagacagggtgcaattcgtgatcactgcccaggagtgggatccatcctttgaagaagcgttaatggacaatccctccttggctttcgtgcgaccacgttggatctatagctgcaacgagaagcaaaagttactcccgcatcagctgtacggggtggtcccacaggcctag

SEQ ID NO: 31564 - DNA, 1944 bp, Artificial Sequence
  Description of Artificial Sequence: Synthetic coding sequence
tctacatcatcgttttggccgggagaggcgcatgatgtggacatgcccgagattagacttagacacgtcgtttcatgtagttcgcaggattccacccattgtgcagagaatctactcaaagctgacacatatcgaaaatggcgtgcagccaaagccggagaaaagactattagcgtggtgctgcagctggagaaggaggagcagattcacagcgtggatatcggcaatgatggcagcgcattcgtcgaagttttggtgggcagtagcgccggaggggcaggggagcaggactacgaagtgctgttagtgacgagttcttttatgtcaccctctgaaagtaggagtggaagtaatccaaaccgggtcagaatgtttggccctgataaactagtccgagctgccgctgagaagcgctgggaccgggtcaagatagtgtgcagtcagccttacagtaaagattcccccttcggcctgagttttgtgaggtttcattcaccaccagataaagacgaagccgaagccccttctcagaaggtgaccgtcacgaagttaggccaattccgagtaaaggaagaggatgagtcagctaattcactgagaccaggagcattgtttttctctcggattaataaaacgtcccctgttacggcatcagatccggcagggccttcttacgcagccgcaacgctgcaggcatcttcagctgcttcgtcggcctcacccgttagcagagccattggtagcactagcaagcctcaggaatccccaaagggtaagaggaagctagacctgaatcaggaggagaaaaaaacaccatcaaaaccaccagctcagttaagcccctctgtgcccaaaaggccaaagctcccagctccaacacgcaccccagccacagctcctgtgccagccagggcgcagggagccgtcacaggcaaaccacggggtgaggggacagaaccaagacggccacgagctggacctgaggagctcggtaagattctccagggcgtagtcgtagtcctttctggattccagaacccatttcgttcagagcttcgcgacaaggccctcgaactgggggctaagtaccggcctgattggactcgggacagcactcacctgatttgcgcatttgccaatacacccaagtattcacaagtcctgggcctgggtggccgaatagtgcgtaaggaatgggttctggattgtcaccgtatgaggcgacgcctgcccagccagaggtacctgatggcgggtcctggatcatcctctgaggaggacgaagcctcacatagcgggggttctggcgacgaggcccctaaactaccccagaagcagccccagaccaagacaaagccaacgcaggccgctggaccatcgtcaccccagaaacctcccactcctgaggaaacgaaagctgccagtcccgtcctccaagaggacatcgatatagaaggggtgcagagcgaggggcaggataatggagctgaggattcaggtgatacggaggacgaactccgcagagtggcagaacagaaggagcatcgccttcctcctgggcaggaagagaatggcgaggacccctatgcagggtcaactgatgaaaacaccgacagcgaggaacaccaggaacctcctgacctgccagtgcctgagttacctgatttttttcagggcaaacacttcttcctatatggggagtttccaggggatgaacgcagaaaacttattcgctacgtcactgccttcaacggggaactggaagataacatgtccgatagggttcagttcgtgattacggcccaggagtgggaccctagttttgaggaagcactgatggacaacccaagcttggctttcgtgagacctcggtggatttatagctgtaatgagaagcaaaagttactcccccaccaactgtatggggtggtcccacaagcgtag

SEQ ID NO: 31565 - DNA, 1203 bp, Artificial Sequence
  Description of Artificial Sequence: Synthetic coding sequence
atgcctgagatcaggcttcgacatgttgtgtcctgctctagccaggacagtactcattgtgccgagaacctccttaaggccgatacataccgcaaatggagagcagccaaggccggagaaaaaaccatctctgtcgtgctgcagctggagaaggaggaacaaatccacagtgtcgacattggcaatgatggcagtgcgttcgtggaagtgctggtcgggtcttctgcaggcggtgctggcgaacaggattatgaggtgctgttggtcacgtcttccttcatgagtccttcagaatcacgctccggatctaacccgaaccgcgtgcgaatgttcggacccgataaactggtgagggccgcagctgagaaacggtgggaccgggtgaagattgtgtgttcacaaccttactccaaagacagcccctttggtctttctttcgtgcgctttcactctccgccagacaaagacgaagccgaggctccaagtcagaaggtgaccgtcaccaaactcggtcagtttagggtgaaggaggaagatgaaagtgctaactcccttcgaccaggtgcactgtttttttctagaatcaataagacctcacccgtgaccgcctcagatcctgcaggaccaagctatgctgccgctacattacaagcctcaagtgctgcctccagcgccagccccgtgtcacgcgctattggcagtactagcaagcctcaggaaagcccaaagggtaagcgcaagctggatctgaatcaagaagagaaaaagactccatcaaaaccccctgcgcaattgtcccccagcgtacccaagaggccaaaactgccagctcctactcgtacccctgcaacagcccctgtgcctgcacgagcccagggcgctgtcacaggtaaacccagaggcgaaggcaccgagcctcgccgacctagggcaggccctgaggagctaggtaaaatactgcagggggtggtcgtggtgctgtccgggttccagaacccattccgcagcgagctgcgggataaagccctggagctaggcgcaaagtaccggccagattggacccgtgatagtactcacctaatctgcgcgtttgccaacactcccaaacttccccagaaggtgccccctcagcacaccccagatcaaaatcaagcccactctggctcttggacacagctgacacctgaagctcccaatccatag

SEQ ID NO: 31566 - DNA, 1809 bp, Artificial Sequence
  Description of Artificial Sequence: Synthetic coding sequence
atgccggagattaggttgagacacgtcgtatcctgcagctcccaagacagtttagagaaagaagagcagatccacagtgtggatattggcaacgacggatctgcattcgtggaagtccttgtgggcagtagtgctgggggagctggcgaacaggactacgaagtgctgcttgtgacatcctcattcatgtccccttcggaatccaggtccggttccaaccccaaccgagtacggatgttcggcccagataaactagttcgcgctgcagcggagaaaagatgggacagggtgaaaatcgtctgctcacagccatacagtaaagattctccttttggcctgagttttgtacggttccattcgccccctgataaggacgaggccgaggctccgagccaaaaggtgacggtgaccaagctgggacaatttagagtgaaagaagaagacgagtccgctaactctctgcgaccaggcgctctcttcttctctagaatcaataaaacctctccagtaactgcctctgatcctgcaggcccttcgtacgcagcagcgacccttcaggcaagctcggccgcatcttcagcttcccccgtcagtagagctatcggcagtacaagtaagcctcaggaaagcccaaaagggaagcgcaaactggacctgaatcaagaggagaaaaaaactccttctaaacctccagcccagctaagtccaagtgtccccaaacggccaaaactgcccgcacccacacgaacccccgctacagctcccgtcccggctcgtgcccagggagcagtaacaggcaagccgcgaggcgaaggcaccgagcccaggcggcctcgggcaggcccagaagagttggggaaaatcttacagggagtggttgtagtgttgagtggcttccagaatcccttccggagtgaactgagggataaagccctcgagttaggggcaaagtataggccagactggacacgtgattctacccaccttatatgtgcttttgccaatacccctaaatacagccaggtgctcggtctgggcggtcgcatagtcaggaaggaatgggttctggactgtcaccggatgaggcgccgtctcccaagccaacgctacctaatggccggaccaggctcttcgagcgaagaagacgaggcttctcactctgggggaagtggtgatgaagctcctaaattgccacagaagcagccccaaaccaagacgaagcctacccaggccgcagggccaagtagcccacagaagccacctaccccggaagaaaccaaggctgcatctccagtgctccaggaggacatcgacatcgaaggcgtccagtcagagggccaggacaacggggctgaggattccggagatactgaggacgaactaaggcgggttgcagagcagaaagaacatcggttgcctcccggtcaagaagaaaacggtgaagatccatatgctggatcaactgacgagaacactgacagcgaggagcaccaggaaccgccagacctccctgtgcctgagctgcctgatttcttccagggcaagcacttcttcctgtatggggaattccccggagacgaacgccgtaaactgatccgctacgtgaccgcgttcaatggagagttggaagacaacatgagtgatcgggtccagttcgtgatcactgcacaggagtgggacccatccttcgaggaagccctgatggataaccccagcctggcttttgtccgcccacgatggatttattcctgcaacgagaaacaaaaactcttgccccaccagctctacggggtggtgccacaggcatag

SEQ ID NO: 31567 - DNA, 843 bp, Artificial Sequence
  Description of Artificial Sequence: Synthetic coding sequence
atgtgttcagccttccacagagctgagagcggcaccgagctgctggctaggctggagggacggagctctcttaaggagattgaacccaatttgttcgccgacgaagactcccccgtgcatggcgacatcttggagtttcatggacctgaggggacgggtaagaccgaaatgctataccacctgacagccagatgcatcctgcccaagagtgaaggcggtttggaagtggaggtgctgttcatcgacacagactaccacttcgatatgctgaggctcgtcacaatactcgagcaccgactgtcccaaagcagcgaagaaattatcaaatactgtctcgggcgattcttcctggtttattgctcatcgtctacacatttactactgaccctctactctttggaatctatgttctgcagtcacccctctctttgcttgctcatactggattccctgagcgccttctactggatagaccgcgtgaacgggggagagtcagtcaacctgcaggagagcaccttgagaaaatgctcacagtgtctcgaaaagctcgtcaacgactatcggcttgtattattcgcgacgactcagacgattatgcagaaggcttcttcatctagtgaggagccctcccatgcctcacggcgtttgtgcgacgtggacatcgattaccgcccttacctgtgtaaagcttggcagcaattggtgaagcatcgtatgttcttttcaaaacaggacgatagtcagtcatctaatcagttttcgctggtgagcagatgccttaaatccaactcacttaagaagcacttcttcattattggtgagtctggtgttgagttctgttag

SEQ ID NO: 31568 - DNA, 1041 bp, Artificial Sequence
  Description of Artificial Sequence: Synthetic coding sequence
atggacctagatcttctcgacttgaatccgcgtatcattgcagctatcaagaaggcaaaactcaagagcgtgaaggaggtgttgcatttttccggcccagaccttaaaagactcactaacctgagcagtcccgaagtctggcatcttctcagaacagcctccctgcatttgcggggatcttccatactgactgcattgcaactccaccaacagaaggagagatttcccacacagcatcagaggttgagtctgggatgtcccgtgctggatgcgctgctgagaggcggactgcccttagacggaatcactgagctcgctggacgctctagcgcaggcaagacgcagctggcactccagctctgcctagcagtgcaattccctagacagcacgggggattagaggctggcgctgtttatatttgcaccgaggacgcgtttcctcacaaaaggttgcagcagctcatggctcagcagcctcgtctaaggacagatgtgccaggggaactgctgcagaagctaagattcggctcacaaatttttatcgaacacgtagccgacgtcgatactttgttggagtgcgtgaacaagaaagtgcccgtgttgctgagccggggaatggccagactggtcgtaattgatagtgtcgccgctcctttcaggtgtgagttcgatagtcaggctagcgcacctagagcccgtcacttgcagtctttaggagcgactttgcgggagcttagcagcgcgtttcaatcccccgtgctgtgcatcaaccaggtcacagaagccatggaagagcagggcgcagcccacggccctctgggattttgggacgaaagagtgtcacccgctctgggcattacatgggccaatcagctattggtgcgactgcttgcagacaggcttagagaagaagaggccgctctgggatgtcccgcaaggaccttaagggtgctcagtgcgccacacctcccacccagctcatgttcttacacaatctcagctgagggcgtgcgcggaacacccggaacccagtcacactag

SEQ ID NO: 31569 - DNA, 1041 bp, Artificial Sequence
  Description of Artificial Sequence: Synthetic coding sequence
atggatttagacctgctcgacctgaatcccaggataattgctgcgattaagaaagctaaactgaagtcagtgaaggaggtgttgcacttctctggccctgacctgaaacgactcacaaatctgtctagtcccgaagtttggcacctgctgagaactgcgtccctccacctgcggggttcatcaatactcactgccctccaactccatcagcagaaggagcggtttccaactcagcatcagaggttgtcgctggggtgtcccgtgctggatgcattattacgcggagggctacctctggatggtattaccgaattagcaggtaggagttctgcaggaaaaacacagcttgcactgcagctgtgccttgcagtccaatttcctcgacagcacggaggcttagaagcaggggcagtttacatatgcactgaggatgcctttccccacaaacgcctccaacaactgatggcacaacagcccagactgaggaccgacgtcccaggcgaactgctacagaaactgcgcttcgggagccagatctttattgagcacgtagccgacgtggataccctcctcgaatgtgtgaataagaaagtacccgttctgctcagccgcggtatggcccgattggtcgttattgattcggtggctgccccatttcggtgcgagttcgatagccaggcaagtgccccaagagctcgacacctgcaatctctaggtgccactctaagggagctctctagtgccttccagtcacctgttctgtgtatcaaccaggtcacagaggcaatggaagaacagggggcagcccacggtcctctgggtttctgggacgaacgtgtctcgcccgcacttggtattacatgggcgaaccaattgctggtgagactgttggctgaccgtctgcgggaagaggaagctgcactggggtgcccagccagaactctccgcgtgctgtccgcgcctcacctgccacccagctcctgttcttatactatcagcgcggagggggtgcgaggaacaccgggaactcagagtcattag

SEQ ID NO: 31570 - DNA, 1041 bp, Artificial Sequence
  Description of Artificial Sequence: Synthetic coding sequence
atggatctcgacttgctcgacttaaatccacggattatcgctgctatcaagaaagcaaagctgaagagcgtcaaagaggtgctgcattttagtggtccagatctgaaaagactgacaaatcttagttccccagaagtttggcacctgcttaggaccgccagcctacaccttagggggtcaagcatattgactgcactgcagttgcatcagcagaaagagaggttccccacacaacatcagaggttgagccttggatgtccagtcctggacgcgctcctgcgcggtggactgcccctcgacggcataacggaactggccggtaggtccagcgctgggaaaacccagctggcactacagctgtgcctggccgtccagtttcccaggcaacatggcggtctagaagcaggagcagtgtacatttgtactgaggacgcctttcctcataaacgtcttcagcaactcatggcacagcaacccagattacgcactgacgtccccggtgaacttcttcagaagctgcgctttggctcccagatatttatcgaacacgtggccgatgtggataccctgttagaatgtgtcaacaaaaaggtgcctgtgctactctcacgcggtatggcccgactagtagtgatagacagcgtggccgctcccttcagatgcgaattcgatagccaagcttcggcccctcgcgctaggcacctccagagtctgggggcaacgcttagagagctgagtagcgcgttccagagtcctgttttgtgcatcaaccaggttaccgaagcaatggaggaacagggggctgcccacggcccactgggcttctgggatgagagagtaagtcctgctctcgggattacctgggcgaaccaactgcttgtgcgtcttctggcagatagactgcgcgaagaagaggcagccttgggctgccctgcaagaaccttgagagtgttgtctgctcctcaccttcccccaagttcctgtagctacactatcagtgcagagggagttaggggaacccctggaacccaatcccactag

SEQ ID NO: 31571 - DNA, 144 bp, Artificial Sequence
  Description of Artificial Sequence: Synthetic coding sequence
atggatctggatctgctggatctgaaccctagaataatcgcggctattaagaaagcaaagttgaaatctgtaaaggaggttctccacttctctggacccgacttgaaaaggctgacaaatctctcatcccccgaagtttggtag

SEQ ID NO: 31572 - DNA, 138 bp, Artificial Sequence
  Description of Artificial Sequence: Synthetic coding sequence
atggatctggatttgttggacctgaatcccaggatcattgctgcaatcaagaaggctaaactgaagagcgtcaaggaggtgctgcattttagcggacccgacttaaaacgtttaaccaatctctcatctcccgagtag

SEQ ID NO: 31573 - DNA, 1041 bp, Artificial Sequence
  Description of Artificial Sequence: Synthetic coding sequence
atggacctggatctgctggatttaaatccaaggattatcgccgcaattaagaaagccaagttaaaaagcgttaaagaagtgctccacttcagcggacccgacttaaagaggttaacaaacttgtccagccctgaggtctggcacctcctgcgaaccgcaagcctgcacctgcgcggatcttcaatcttgactgccctgcagctccaccagcagaaagagcgcttccccacccagcaccaacggctgtccctgggatgccccgtgctggatgcacttctccggggaggcttgccgcttgatggaatcaccgaactggctgggaggtcaagcgctgggaagactcaactggctctgcagctctgcctggccgtccagtttcccaggcaacacggcggactggaggcaggggctgtctacatctgtacagaagatgcttttccgcacaaacgcctccagcagctgatggcacagcagccacgtctcaggaccgacgttccaggggaactgctacagaaattaagattcggctctcagatttttatcgagcatgttgctgatgtggatacgctcctcgaatgtgtgaacaaaaaagtgcctgtgctgctttcccgcggtatggctcgccttgtggtcatcgacagtgtcgccgctcctttcaggtgcgaatttgacagtcaagcctctgcacctcgggctcggcacctgcagtctctaggtgccaccctgcgagagctttctagcgctttccagtccccggttctctgtattaatcaggtgaccgaagctatggaagaacagggggcagcgcatggcccactcggcttctgggacgagcgtgtgtcccccgctttagggataacatgggccaaccaactacttgttagactcctggccgacaggctgagggaagaagaagccgctctgggctgtcctgctcgcaccctgcgcgtgctcagtgcacctcatctgcctccgtcctcatgttcgtacacaatctccgctgaaggggtgcgaggaacaccaggaacgcagtcacattag

SEQ ID NO: 31574 - DNA, 1041 bp, Artificial Sequence
  Description of Artificial Sequence: Synthetic coding sequence
atggacttggaccttttagatcttaatcccagaattatcgccgctattaaaaaggcaaagctgaagagtgttaaggaggtgcttcacttttcaggaccagatttaaaacgcctgactaacttatcatctccagaagtttggcacctgctgcggaccgccagtctccacttgcggggaagcagcattttaaccgcactccagctgcaccaacagaaagagcgctttccgactcagcaccaacgcctgagtctggggtgccctgtcctggatgccttgttaagagggggactacctctggacggcattactgagctggccggacgttcctcagccggaaagacacagctggctctgcaactgtgtctggccgtgcagttcccacgacagcatggaggcctggaagctggggctgtatacatttgtactgaggacgcattcccccacaagcgattgcaacaactgatggcccaacaaccaagattgcggacggacgtcccaggggaactgctgcagaagttgaggttcggctcacaaatatttatagaacacgtggctgacgtcgatacactacttgagtgcgtcaataagaaggtcccagtgcttctcagtagaggcatggctcgactggtggttatcgactctgtggctgccccttttcgttgtgagttcgactcccaggcaagtgccccacgcgctagacacctacagtcactgggagcaaccctgcgggagcttagctccgcctttcagtctcctgtcctttgcattaatcaggtgacagaagcaatggaagaacagggcgcagcgcacggcccactcggcttctgggacgaaagggtgagtcctgccctggggatcacatgggccaatcagctgctggtacgtctgctcgccgaccgcctgcgggaggaggaagccgctctgggttgccctgccaggacactccgtgtgctgagcgcccctcacttgccgcctagctcttgttcatacactataagcgctgagggggttagaggaacgcccggaactcaatctcattag

SEQ ID NO: 31575 - DNA, 309 bp, Artificial Sequence
  Description of Artificial Sequence: Synthetic coding sequence
atggatctggatctcctggacctgaatccgagaatcatagcagctataaagaaagccaaactgaagtctgtgaaagaagtgttacacttctcggggcctgacctgaagcgactgacgaatctgtctagccccgaggtgtggcatcttctccggaccgccagcctgcacttaaggggctctagcatacttactgccctccaactccaccaacagaaggagagatttcccactcagcaccagcgcctgtctcttggctgcccagtgttagacgctctgttgcggggaggactgcccctcgacggcatctag

SEQ ID NO: 31576 - DNA, 186 bp, Artificial Sequence
  Description of Artificial Sequence: Synthetic coding sequence
atggaccttgacttgctcgatctgaaccccagaataattgccgcaatcaaaaaggcaaagctcaagtccgttaaggaggtactgcatttttcgggccctgacctgaagcgtctgaccaacctgagtagcccagaagtctggcacctgctccgaacggcgagcctccaccttcgcggttcttcgtag

SEQ ID NO: 31577 - DNA, 339 bp, Artificial Sequence
  Description of Artificial Sequence: Synthetic coding sequence
atggacctggatcttcttgatctgaacccacggatcatcgcagcgataaagaaggctaagctgaagtctgtcaaagaagtacttcacttctccggccctgatctgaaaagactgacaaatctgtcttcacctgaagtgtggcacctgctgagaacggcgtcgttacacctcagagggtcatcaattctcaccgcgttgcagttacatcagcagaaagaacgattccccactcagcaccagagattgtcccttggctgccccgtcttagacgcccttttgagggggggactaccccttgatgggattaccgagctggccggacggagttccgcgggatag

SEQ ID NO: 31578 - DNA, 1005 bp, Artificial Sequence
  Description of Artificial Sequence: Synthetic coding sequence
atggagcgcaagatctcccggattcatcttgtgtctgaaccctctataacccacttcctgcaggtgtcctgggagaaaacgctggagagtggattcgtgatcacactgaccgatgggcactctgcctggaccggaacagtctctgaatccgaaattagtcaggaggcggatgacatggctatggagaagggcaaatatgtgggggagctgagaaaagcccttctctctggcgctggacctgccgacgtgtacactttcaactttagtaaggagtcttgctactttttctttgagaagaatctgaaagatgtgtcattccgtttggggagcttcaaccttgagaaggtggaaaatcctgctgaggtgattcgagagcttatctgttattgcctggacaccattgccgaaaatcaagccaagaacgaacacctgcaaaaggaaaacgaacgcctgctaagagactggaatgacgtgcaagggaggttcgaaaaatgcgtcagcgcgaaggaggcgctagaaaccgacctgtacaagaggtttatcctggtattgaacgagaagaaaaccaaaattcggtctctgcacaacaaactgctaaacgccgctcaagaacgggagaaggatatcaaacaggaaggggagacagccatttgctcggagatgacagcagatagagatccagtctatgatgagagtactgatgaggaaagcgagaatcagacagatttgagcgggctggcttctgctgctgtaagcaaggacgactctatcatctcatctctggacgtgaccgacattgcgcctagtaggaagcgtcgacagcggatgcagcggaacctgggcaccgaacccaagatggcaccccaggaaaatcaactacaggagaaggagaaacccgacagctcactgccggagacatctaagaaggagcacataagtgccgagaatatgagtctcgagaccttgagaaatagtagtccggaagacctgtttgatgagatttag

SEQ ID NO: 31579 - DNA, 1011 bp, Artificial Sequence
  Description of Artificial Sequence: Synthetic coding sequence
atggagcgaaagatcagtcgcattcacctggtgtcagagccgagcattacccactttctacaggtctcctgggagaagactctggagtccgggtttgtgatcactctcaccgacggccattccgcttggacggggaccgtctcagaaagcgagatctcacaggaggctgatgatatggccatggaaaagggaaagtacgttggcgaactgcggaaggccttgttgtccggagccggacctgcagacgtatataccttcaacttctcgaaagagtcatgctactttttcttcgaaaagaacctcaaagacgtgtcatttaggctggggtctttcaaccttgagaaggttgaaaaccctgctgaggtgatcagggagttgatctgctactgtctcgataccattgccgaaaaccaggcgaagaacgaacacctacagaaagagaacgagcgattgcttcgcgattggaatgacgtgcaaggccgatttgagaaatgcgtgtctgccaaagaagccttagaaaccgacctctacaaaagatttatcttggttttaaatgagaagaaaactaagattcgtagcctccataataagctgttaaacgcggctcaggaacgtgaaaaggatattaagcaggaaggcgaaacagctatctgcagcgagatgactgctgatcgagaccccgtttacgacgagtcaaccgacgaagaatctgagaatcagaccgatctgagcggtttggcttccgcggcagtatctaaagacgattctatcatcagtagcctggacgtaaccgatatagcgccatcaagaaaacgacgtcagcgaatgcaacggaacttgggaacagaaccgaaaatggcgccacaggaaaatcagctccaggaaaaagagaattctaggcctgattcatcactgccagagacctcaaaaaaagagcacatcagtgcggaaaatatgtccctggagaccctgcggaactcttcgcccgaagacctattcgacgagatatag

SEQ ID NO: 31580 - DNA, 1005 bp, Artificial Sequence
  Description of Artificial Sequence: Synthetic coding sequence
atggagagaaagatttcacgcatccacctggtctccgagcctagcattacgcatttcctgcaggtctcatgggagaaaacactggaatcagggttcgttatcaccttgactgatggacattccgcgtggaccggaaccgtctctgagagtgagatatcccaggaggccgacgatatggcaatggagaaaggcaagtacgtgggtgaactaagaaaggcacttctgagcggagcaggccctgcagatgtctacaccttcaatttctcgaaggaaagctgttacttcttcttcgagaaaaatctcaaggatgtgtcttttcgcctcgggagctttaatcttgaaaaagtagaaaatccggcagaggtcattagagagctgatctgctactgtcttgatactatcgcagagaatcaagctaaaaacgaacacttgcaaaaggagaacgagaggctgctgcgcgactggaacgacgtgcagggcagatttgagaagtgcgtgtctgccaaggaagccctcgaaactgacttgtataagaggtttatcctggtgctcaatgagaaaaagactaaaattcgatcccttcataataaactgctgaatgctgcccaggagcgagaaaaggacattaagcaggaaggagaaaccgccatatgtagcgagatgacagctgaccgagatccagtatatgacgaatcaaccgatgaggagtcggagaaccagaccgatctgagcggattggcctccgctgctgttagcaaagatgactcaatcatcagctcactcgatgtcacagatattgcaccaagtcgtaagcggcgtcagcgaatgcagcgcaatttgggaacagagcctaagatggccccacaggaaaatcaactgcaagaaaaagagaagccagattctagtctccccgagactagtaagaaagagcacatttcagctgagaatatgtctttagagactttgcgcaattcatcacccgaggacctcttcgacgaaatatag

SEQ ID NO: 31581 - DNA, 1011 bp, Artificial Sequence
  Description of Artificial Sequence: Synthetic coding sequence
atggaacgaaagatttcaagaattcatctcgttagcgaaccgagcatcacccattttcttcaagtgtcgtgggaaaagacactggagtccggcttcgttatcacactgacagatggtcatagcgcctggactggcactgtgagtgaatccgagattagtcaggaggctgacgatatggccatggaaaagggaaaatacgtgggcgagttgcggaaagcgctgttgtctggtgccggaccggctgacgtctacaccttcaattttagtaaggagtcttgctacttttttttcgaaaagaaccttaaagacgtgtccttcaggttggggagcttcaatctagagaaagtggaaaacccggctgaggtgatccgggagcttatttgctattgtttagataccattgctgaaaatcaggccaagaatgaacacttgcagaaggagaacgaaagacttctgagagattggaatgacgtgcagggcagattcgagaaatgcgtgtctgcaaaagaagcccttgaaactgatctttacaaacggttcatcctggtattaaacgaaaagaaaactaaaatccggagtctgcacaataagctgttgaacgcggcacaggagcgagagaaggacattaaacaagagggagagaccgccatctgctccgagatgaccgccgatcgggacccagtctacgatgagtctacggatgaggagagcgagaaccaaactgacctctctggattagcttccgcagccgtctctaaagatgatagtattatctcgtcactcgatgtgaccgatatcgccccatccagaaagagacggcagcgtatgcagcggaatttggggacagagcccaagatggcccctcaggaaaatcaacttcaggaaaaggagaactctcgaccggactctagccttcccgaaacctccaaaaaagaacacatttcagcggaaaacatgtctctggaaaccctaagaaactctagccccgaggacttgttcgatgagatttag

SEQ ID NO: 31582 - DNA, 186 bp, Artificial Sequence
  Description of Artificial Sequence: Synthetic coding sequence
atgcagagaaacctggggactgagcccaaaatggcccctcaggaaaatcagttgcaggaaaaagaaaactcaagaccggatagctcactacccgagacctctaaaaaggagcatatcagcgccgaaaacatgtctctggagacattaagaaattccagccccgaggatctgtttgtctctatttag

SEQ ID NO: 31583 - DNA, 2199 bp, Artificial Sequence
  Description of Artificial Sequence: Synthetic coding sequence
atggtgagaagtgggaacaaggcagcagttgtgctgtgcatggatgttgggtttactatgtcaaactccatacccggtatcgaatcacctttcgaacaggccaaaaaagtgattaccatgtttgtgcagcgccaggtgtttgccgagaataaggacgagatagctctggtgttgtttggaacagacggcaccgacaaccctctctccggaggggaccaatatcaaaacatcaccgtgcacaggcaccttatgcttccggacttcgacctgctcgaggacattgaaagtaaaattcagcctgggagtcagcaagcagactttttagacgccctcatcgtgtctatggacgtgattcagcatgaaaccatcggaaaaaaatttgagaagcggcatattgaaatattcacagatctgtcatcgcgatttagtaagagccagctggatatcatcatccactcgctaaaaaaatgtgacatctccctgcagtttttcttgccgttttccctgggaaaggaagacgggtcaggagaccgcggtgatggaccgtttagattaggtggacatggaccgtcatttcccttgaagggaatcacagagcagcaaaaggagggtctggagatcgtgaaaatggtcatgatctccctggagggcgaggacggccttgatgagatatattcatttagtgaaagcctgcggaaactctgcgtttttaagaaaatcgagcgtcactcgattcactggccgtgtagattgaccatagggagcaatctgagtataaggattgcggcatacaagagcattctgcaggagagagtgaagaagacgtggacagtggtggatgccaagacactgaaaaaagaggacatacagaaggagactgtctactgtcttaacgatgacgacgagactgaagttctcaaggaggacattattcagggatttcggtatgggagtgacattgtccccttttcaaaggtggatgaagagcagatgaagtataagagtgagggaaagtgtttctccgtgctgggtttctgcaaatcctcacaggtgcagagacgattttttatgggtaatcaagtcctgaaggtgttcgccgcacgtgatgatgaagccgcagcggtggcactgagttcactaattcatgccctggatgacttggatatggtagcaatcgtgcgttatgcctatgacaagagagccaacccacaggtcggcgtcgcatttcctcacattaagcataactacgagtgtttagtctacgtgcagttgccattcatggaggatttgaggcaatacatgttttcctcactaaaaaacagcaagaaatacgcacccaccgaggcgcagctgaacgcagtggacgccctcatcgattcaatgagcttggccaaaaaggatgagaaaaccgacaccctcgaagatttgtttccaacgaccaagatccctaacccacgctttcagaggctcttccagtgcctcctgcatcgagcgctgcaccccagggagccactgcccccaatccaacagcacatctggaacatgcttaatcctcccgctgaggtgaccacgaagagccaaatcccactttcgaaaatcaagactctgtttccgctgatcgaagcaaagaagaaggatcaggttacagcgcaagagatctttcaggacaaccacgaagacgggcctaccgccaagaaactcaaaacagagcaaggaggagcccacttttcagtgtccagccttgccgagggtagcgtgacaagcgttggcagcgtgaatccagccgagaacttcagggttctagtgaagcaaaagaaggcaagttttgaggaagcaagcaatcagcttatcaaccatattgaacagttcctcgataccaacgagactccctatttcatgaaaagcatcgattgtattcgggcatttagggaagaagcaatcaagttttccgaggagcaaaggttcaataacttcttgaaggcactgcaagagaaggtggaaattaagcaattgaatcatttctgggaaatcgtggttcaagacgggatcaccctcatcacaaaagaggaggcaagcgggtctagtgtgacggcggaggaagccaaaaagttccttgctcctaaggataagccaagcggtgacacagctgcggttttcgaagagggtggagacgttgacgaccttctggacatgatatag

SEQ ID NO: 31584 - DNA, 2199 bp, Artificial Sequence
  Description of Artificial Sequence: Synthetic coding sequence
atggtgaggagcggaaataaagcggcagttgtactatgcatggatgtcgggttcaccatgtcgaatagcattcctggaatcgaatcaccatttgaacaagctaaaaaagtcatcaccatgttcgtgcaaaggcaggtatttgccgagaataaggacgaaatcgcgcttgtactgttcggcactgatggaacagacaaccctctgtccggcggtgaccaatatcagaacattactgtgcaccggcatcttatgctgcccgactttgatctccttgaagacatagagagtaaaatccagcctggctctcagcaggctgatttcctggatgctctcatcgtatccatggatgtgattcagcatgagactataggaaagaaatttgagaagcgccacattgaaattttcacggatctgagcagccggttctctaagtcccaattagatattatcatacattccctcaagaagtgcgacatttccctccagttctttctgcctttctctctcgggaaggaagacggctcaggagacagaggcgacgggccttttcgtcttgggggacatggacccagcttcccactaaaaggcataactgagcagcaaaaagagggactggagatagttaagatggttatgatttccctcgaaggcgaggacgggctagacgaaatttactcattctccgagtccttgagaaaattatgcgtcttcaaaaagattgaaaggcacagtatccactggccctgtagattgacaataggaagcaaccttagcatccggattgccgcttataaatccatcttgcaggagcgagtaaagaaaacatggaccgtggttgacgctaagacattgaagaaggaagatatccagaaagaaacggtgtactgtttgaacgatgacgatgaaaccgaagtgctgaaagaggacattattcagggatttcgatatggctctgatatcgttccgttcagcaaggtcgacgaagaacagatgaaatataaaagcgagggcaagtgtttctcggtgttggggttttgcaagtcgtcccaggtgcagcgacgttttttcatgggtaatcaggtgctaaaggtcttcgccgctcgggacgacgaagccgcagctgtcgccctctcatctcttattcatgcattggacgatcttgacatggtggccattgttcggtacgcctacgataagagagccaatccacaagtcggtgtggctttccctcatatcaagcataattatgagtgccttgtatacgtacagcttccttttatggaggatcttaggcaatatatgttctcttccttgaaaaatagcaagaagtacgctcccacggaggcacaactcaacgctgtcgatgccttgatagattcaatgtcactggctaaaaaggatgagaaaacggacacactcgaggatttattccctaccaccaaaataccaaatccacggttccaacgcctattccagtgcctgctgcatcgggcattacacccgagggagccactccccccaatacagcagcatatctggaacatgctcaaccccccagcggaggtcaccaccaagtcccagatacctctcagtaagataaagacactgttcccactgatcgaggcaaaaaaaaaagatcaggtcaccgcccaggagatcttccaggacaaccacgaggacggtccaacagcaaagaaattgaaaactgagcaggggggagctcacttttccgtctccagcttagctgaagggtccgttacctctgtggggagtgtcaacccggcagagaattttagagtgctggtgaaacagaagaaggccagcttcgaggaagccagcaatcagttgatcaaccatattgagcagtttctcgacacaaatgagacaccgtattttatgaagtctatcgattgcattagggccttcagggaggaagccatcaaatttagtgaagaacagaggtttaataactttctgaaggccctgcaggaaaaggtggaaatcaagcagctgaatcatttctgggagattgtggtgcaggacggtataacgcttattactaaggaggaagcctccggatcaagtgtgactgctgaggaagccaaaaagttcctcgcacccaaggacaagcctagcggtgacacagcggctgtcttcgaggaggggggtgacgttgacgacctgttggatatgatctag

SEQ ID NO: 31585 - DNA, 1830 bp, Artificial Sequence
  Description of Artificial Sequence: Synthetic coding sequence
atgtctggctgggagagctactacaaaacagagggtgatgaagaggcagaggaggagcaagaggaaaatttggaagcctctggggactataagtacagtggaagggacagccttattttcttagtggacgcatctaaggcaatgtttgagagccagtccgaagatgaattgacaccctttgacatgagcatccagtgtattcagagcgtatacattagcaagatcatctcatcagatcgtgaccttctcgctgtagtattctatggcacggagaaagataagaactcagttaattttaagaatatttatgtcctccaggagctggacaaccccggagccaagaggattctggaactcgatcagttcaaggggcagcagggacagaagcgctttcaagatatgatgggccacggatctgattatagtttatcggaggtgttgtgggtgtgcgccaacttgtttagcgacgtgcagttcaagatgtctcataaacgcattatgctgtttactaatgaggacaacccacatgggaatgattcagcaaaagcttcccgggcacgtactaaagctggcgatctcagagatacaggaatcttcctggacctgatgcacctgaaaaaacctggtggttttgacatctcactcttttacagggatataatttctattgctgaagacgaagatcttcgcgtgcacttcgaggagtcctccaaactggaggatctgctgagaaaggtgcgcgctaaggagacacgaaagcgggcattgagcaggctgaagctgaaactcaacaaggatatcgtgatttccgttggaatatataatctggtccagaaagccctaaagccgccacccatcaagctgtatcgggagaccaacgaacccgtgaagaccaagacacggacgttcaacactagtaccggaggactgctgttaccaagtgataccaagagaagtcagatctatggcagccgccagatcatcctggagaaagaagagactgaagagttgaagcgctttgacgatcccggattgatgctgatgggctttaagccgttggtgctcctgaaaaagcaccactacctgaggccgtcgctgtttgtgtatcctgaagagtcccttgtgataggctccagcactttgttttcagcactgctgatcaagtgtctcgagaaagaggtggctgcactgtgccggtacacgccgaggcgcaacatcccgccttacttcgtagctttagttccacaggaggaagaactcgatgatcaaaaaattcaggtgaccccacccggttttcaactggtcttcttgccgtttgcagacgacaagcggaaaatgccttttacagaaaagattatggctaccccagagcaggtgggcaaaatgaaagctatagtggaaaaactccgattcacctaccgcagcgatagctttgaaaacccagtgctccagcagcacttccgcaatctcgaagcattggcgctggatctgatggagccggaacaagccgttgacttgactcttccaaaagtggaagccatgaataagagattagggagtctagtggatgagttcaaagaacttgtctaccccccagattataatcctgaaggaaaggtgactaagagaaagcatgataatgaggggtcggggagcaaacggcctaaagtagagtactcggaggaggaactcaagacacatatttctaaagggacacttgggaaattcacagtgccaatgctcaaggaggcttgtcgcgcatatggacttaaaagcgggttgaagaaacaggagctcttagaggccctgactaaacatttccaggattag

SEQ ID NO: 31586 - DNA, 1830 bp, Artificial Sequence
  Description of Artificial Sequence: Synthetic coding sequence
atgtctggctgggagtcctactacaagacagaaggtgacgaggaggccgaagaagagcaggaagagaatttagaggcctcaggcgactacaagtattctgggagagactctctgatttttctagtggacgcatcaaaggcgatgtttgagtcccaaagtgaggacgagctcacaccgtttgacatgagtatccagtgcattcagtccgtctacatttctaagattatctcttctgatcgagacctgctggcagtggtcttttacgggaccgagaaagacaagaactctgtgaactttaagaatatctacgtcctgcaggaactggacaatcctggcgctaagcgtattttggagcttgaccaatttaagggccagcagggtcagaaacgtttccaggacatgatggggcatgggagcgactactcgttaagtgaggtcttatgggtgtgcgccaatctgttcagtgacgttcagttcaagatgtcgcacaagagaattatgttatttactaacgaagataacccgcatgggaatgattccgccaaggccagcagggctcggacaaaagctggcgatctgagagatacaggcatatttctcgatctgatgcatcttaaaaagccaggcggatttgacatcagtttgttctatagagatataatatccatcgcagaggacgaggatctaagggtccactttgaggagtcctcaaaactggaggatctgttacgcaaggtgcgggctaaagaaaccagaaagagggccttgtcaaggctgaagctcaaacttaataaggatattgttatctctgttggtatttacaacttagtccaaaaggccctgaagccccctcctattaagctttaccgggagactaatgagcctgtgaagaccaagacgcgaacattcaacacatctacaggaggacttctgttgccgagcgacactaaacggtcccaaatctacggctcccgtcaaatcatcctggagaaggaggaaacagaagagcttaagagattcgacgacccgggactcatgctcatgggcttcaagccactggtgcttctaaaaaagcaccactatctgcggccaagtctgttcgtgtatcctgaagagagtctggtgatagggtcctctacattgttctctgccctactgataaaatgcctagagaaggaggttgccgctctgtgcaggtatacacctcggaggaacattccaccatacttcgtcgccctggttccacaagaggaggaactggacgaccagaagatccaggtgaccccccctggttttcaattggtcttcttgcccttcgccgacgacaaacgcaagatgcccttcaccgagaagatcatggccaccccagaacaggtggggaagatgaaggctatcgtggagaaactgcgttttacttaccggtccgattcctttgaaaatccagttctgcagcaacacttccggaacctagaggcgctggccctggacttaatggagcctgagcaggccgtggacctaaccctgcccaaggtggaggctatgaacaaacggcttgggtctctggtggacgagtttaaggaactggtgtaccccccagattataatcccgagggtaaggtgactaaacggaaacacgataacgaaggttccggctccaaaaggcctaaagttgagtacagcgaggaggaattgaagacccacatctccaagggaaccctgggcaaattcacagtacccatgctcaaggaagcctgccgcgcatatggactcaagagcggcctgaagaaacaagaactgttggaggcacttacgaagcatttccaggattag

SEQ ID NO: 31587 - DNA, 1674 bp, Artificial Sequence
  Description of Artificial Sequence: Synthetic coding sequence
atgtccggctgggagagctactataagactgaaggcgacgaagaggcagaggaggagcaggaggaaaatctagaggcaagtggcgactataagtactccggtagagatagcctgattttcctggtcgatgcctcgaaagcgatgtttgagtctcaatccgaggacgagcttaccccatttgatatgtcgatccagtgtattcagagcgtttacatctcaaaaatcatttcaagcgatagagaccttctagcagtagtgttctacggaactgaaaaggataaaaatagtgtgaacttcaaaaatatttatgtcctgcaggaactggacaatccgggagcaaagagaatcttagaactggatcagttcaaggggcagcagggccagaaacgcttccaagacatgatggggcacggcagcgactattcactgtctgaagtattatgggtgtgcgccaacctgttttctgatgtgcagttcaaaatgagccacaaacgcataatgctctttactaacgaagataacccccacggaaacgattctgccaaggcttccagagctcggaccaaggcgggagatttgagagatacggggatctttcttgacctgatgcatttgaagaagccaggcggattcgatatttccctcttctacagagatatcatctctatcgcagaggacgaggacctcagagtgcactttgaagaaagtagtaaattggaagacctgctccgtaaggtgcgggctaaggagactcgcaagagggccctatctagattgaagttgaagttgaataaagacattgtgattagcgtcggtatttacaacttagtacaaaaagccctcaaacctcccccaattaagttataccgagagaccaatgaacccgtgaaaaccaaaacgagaacattcaacacctctaccggcggactgttgctacccagtgataccaaaagatcacagatctatggctctaggcagatcatcctggagaaagaggaaacagaagagctgaagaggttcgatgaccccggtctcatgctaatggggtttaagccgctggtgttgctgaagaagcaccattatctccgaccctctctgttcgtctaccccgaggagtcactggtaatcggaagctccaccttgttctcggcgctgttgatcaaatgcctggaaaaggaagtggccgcactgtgcagatatacacccagaaggaacatacccccttacttcgtcgcacttgtaccccaggaggaagagctcgacgaccagaagatccaggttactccccctgggttccagcttgtgtttctcccgtttgcggatgacaaacggaaaatgccctttactgaaaagattatggccactcctgagcaggtggggaagatgaaggctatcgttgagaagctgcgctttacttatcgaagcgattcctttgaaaaccctgtgctgcagcaacattttcgtaatctggaggcactcgctctggatctgatggaacctgagcaggccgtggacctgacattgccaaaagtggaagcaatgaacaagcgtctcggatccctggtagatgaatttaaagagttagtgtacccaccggactataatccagagggtaaggtaaccaaacgcaaacacgctaagggcccaaggtggtctatacagaagcggagttag

SEQ ID NO: 31588 - DNA, 1707 bp, Artificial Sequence
  Description of Artificial Sequence: Synthetic coding sequence
atgagtggctgggagagttactacaaaaccgagggggatgaggaggctgaggaagagcaagaagagaacctggaagctagtggggactacaagtacagcggccgagacagcctgattttcttggtggacgcctcaaaggccatgttcgagtcccagtctgaagacgagttgacgccatttgacatgagcatccaagagctggataaccccggtgctaagagaattttagagctcgaccagttcaagggccagcagggacaaaaaagatttcaggatatgatgggacacggctccgattattcccttagcgaggtgctgtgggtgtgtgctaatctttttagcgatgtgcagtttaaaatgagccacaaacgcatcatgctcttcactaatgaggataatcctcatggcaatgatagtgcaaaggcctcacgagccaggacgaaagccggagatctccgcgacacaggcatctttctggatttgatgcacttgaaaaaaccaggcggatttgacattagcctcttttaccgggatattatcagcattgcggaggatgaggacttaagggtacactttgaagagtcgtctaaactagaagaccttttacgcaaagtgcgcgctaaagagaccagaaagagggccctgagccggctgaagctcaagctcaacaaggacattgtcatttccgtgggcatatacaatttagtgcagaaggcgctcaaacccccaccaatcaagttatatcgggagactaatgaacctgtaaaaaccaagactaggacatttaacaccagtacagggggtctcctgctgccaagtgacaccaagaggagccagatatatgggagtaggcagatcattctggagaaagaggaaacggaggaattgaagcgctttgatgatccaggcctcatgctgatgggcttcaagccgctggtattactcaagaagcaccactaccttcgcccaagtttattcgtctaccccgaggagagtttggtcatcggatcctcaactcttttctcggccttactgatcaaatgcctcgagaaggaggtggctgcattgtgtcgctacacccccagacgcaacataccaccatatttcgtggcgctcgtccctcaggaggaagagctggacgaccagaagatacaagtcacaccaccaggatttcagctggtcttcctgccttttgccgatgacaaacgtaaaatgcccttcactgaaaagattatggctaccccggagcaggtgggcaaaatgaaggcaatcgtggagaaactgcgctttacatacagaagcgactcttttgaaaatcctgtgctacagcaacacttcagaaacctagaggcactggctcttgatctgatggaacccgagcaggccgtagatctgactttgcccaaggtggaagctatgaataagcggctcggttctctggttgacgagtttaaagaactggtgtatccccctgattataacccagagggcaaagtcacgaagcgtaagcatgacaacgaagggtctggctctaaacggcctaaagttgagtactccgaagaggaattaaaaacccatatatccaaggggactctgggaaaatttactgtcccaatgttgaaagaggcctgccgcgcatacggattgaagtctggcctgaaaaagcaggaactgttagaagctctgaccaagcactttcaggattag

SEQ ID NO: 31589 - DNA, 1680 bp, Artificial Sequence
  Description of Artificial Sequence: Synthetic coding sequence
atgaaaaaacaaaggaagaacaaaaagagaactcttaagcaggtgtgtatccagtcagtttacatcagtaaaatcatcagctccgaccgtgacttgctggccgttgtattttatggaaccgagaaagacaagaactctgtgaattttaagaacatctatgtgctgcaggagctggataaccctggagccaaacgcattctcgaactggatcagttcaagggccagcagggccagaagaggttccaggatatgatgggccatggttcggactattcattgagtgaggtcctctgggtttgtgcgaatctcttctccgacgttcaattcaagatgagccataagcgaattatgctcttcaccaacgaggataacccccacggcaatgatagtgcaaaagcgtcccgcgctcgaaccaaggctggagatttaagggatactgggatcttcttggacttgatgcacttaaagaaaccagggggattcgatataagtctgttctaccgggatattatcagcatcgcggaggacgaagatttgcgcgtacactttgaagaatctagcaaactcgaggacctccttagaaaggtcagggccaaggaaaccaggaaaagggcgctaagtagattgaagctgaaactgaacaaagatatagtcatcagcgtcggaatctataacctggtgcaaaaagcccttaaaccccctccaatcaaactttatagagaaacgaacgagcctgttaagaccaaaaccaggactttcaacaccagtaccggtggcctgctgctgccgtccgacaccaagagatcacagatctacggctccagacagataatcctagaaaaagaggagacggaggagctcaagagattcgatgatcccggacttatgcttatgggctttaagcctctggtcctcctaaagaaacaccactacctgaggccatctcttttcgtgtatccagaggagagcttggtcattggttcatccacactgttctccgccctcctaattaagtgccttgagaaggaggtcgctgcgctatgccgctacacacctcgcagaaatattcctccctactttgtggcactggtaccccaggaggaagagttggatgatcagaaaatccaggtgacgccccctgggttccagctggtgttcctaccctttgcagatgacaagagaaagatgccttttacagagaagattatggccaccccagagcaggttggcaaaatgaaagcaattgtggagaagttaaggttcacatacagatctgactctttcgaaaaccccgttctgcagcagcacttcagaaacttagaggccctggctttagatctgatggagccagaacaggccgttgatctgactctgcccaaagttgaggcaatgaacaagcgactgggatcccttgtcgatgagtttaaagaactggtgtatcctccagattacaatcctgagggaaaggtgaccaagcggaagcacgataacgaaggctctgggtccaaacgcccaaaggtcgaatactcagaagaggaactgaagacgcacatttctaaaggaaccttagggaagttcaccgtacccatgctgaaggaggcttgcagagcctatggcctgaagagcggccttaagaagcaggaactgctcgaggctctgaccaagcactttcaagactag

SEQ ID NO: 31590 - DNA, 1830 bp, Artificial Sequence
  Description of Artificial Sequence: Synthetic coding sequence
atgtctgggtgggaatcttactacaagactgagggagatgaggaggctgaggaagagcaagaggaaaatctggaggcctctggcgattacaaatatagtggtagagacagtttaatttttttggtcgatgcttctaaggctatgttcgagtctcagagtgaggatgaactgactccatttgacatgagcattcaatgcatccaatcagtttacatttctaagatcattagtagcgatcgggatcttttggcggttgtcttttacggaacggagaaggacaaaaattcggtgaatttcaagaacatctacgtgttgcaggagctcgataatccgggagccaagcggatactcgaactcgatcagtttaaggggcagcagggccagaagcgattccaggacatgatgggtcacggctcagattacagtctaagcgaagtcctgtgggtttgtgcgaatctgttcagcgacgtgcagttcaagatgtcacacaaacgcatcatgctgttcacaaatgaggacaatccccatggcaatgattccgcgaaggcatcacgcgcaaggacaaaagccggtgatctgcgcgacactggcatcttcctcgaccttatgcatctcaaaaaacctggaggcttcgacatctcactgttctaccgggatattatcagcatcgctgaggacgaggacctgcgcgttcatttcgaagaatcgtcaaagctggaggacttgctgcggaaagtcagagcaaaggagacaagaaaacgggcactgagccgattgaaactgaaactgaacaaggacatagttatctcagttggaatttacaatctggtccagaaagcccttaagcctcccccaatcaaactgtatcgtgaaaccaatgaaccagtcaagaccaagactaggacctttaatacatctaccgggggtttgctcctgccgtccgatacgaagcggagccaaatatacggctcccgtcagataatcttagagaaagaagagacagaggagttaaagcggtttgacgatcccggtctgatgctcatggggttcaagccgttggttctgctgaagaaacatcattatctcagaccgtccttgttcgtctaccctgaagagtcgttggttataggttcttcgactcttttttccgccctgctgattaaatgcctggagaaagaggtggccgctctttgccgttacacacccagaagaaacatccccccatacttcgtggctctggtgccccaggaagaggaactcgatgatcaaaaaatccaggtgacccccccagggtttcagttggtcttcttacctttcgctgatgataagcgcaagatgccttttactgaaaaaattatggctacccctgaacaggttggaaaaatgaaggctatcgttgagaaactgagattcacttatcggtctgattcgttcgagaatcccgttttgcagcagcactttcggaatctagaggcactggctttagatctgatggagcccgagcaagctgtagacctcactctgcctaaggtagaggctatgaataaacggcttggatccctagtggatgaattcaaagaattagtttatccccctgattacaatcctgaaggcaaagtaaccaagaggaagcacgacaacgagggaagtgggtcaaagagacccaaagtagagtactcggaggaggagctgaaaactcacattagtaaggggactctgggcaaatttaccgtgccaatgctgaaggaggcctgcagagcgtacgggctgaagtcaggattaaagaagcaggagcttctcgaggcactgacaaagcacttccaggactag

SEQ ID NO: 31591 - DNA, 1431 bp, Artificial Sequence
  Description of Artificial Sequence: Synthetic coding sequence
atgatgggccatggttccgattattctctgtcggaagtgctgtgggtctgcgcaaacctcttcagcgatgtgcaattcaagatgtcacacaaaagaatcatgctttttacaaatgaagataacccccacggcaacgattccgctaaggcttcacgcgcacggaccaaggccggtgaccttcgagacaccggaatcttcctggacctgatgcacctgaaaaaacccggaggtttcgatatttccctgttctaccgcgacattatttcaatagccgaagacgaggatttgcgtgtccatttcgaagagagttccaagctagaggacctgctacgcaaggtgcgtgctaaggagacccggaaacgggctctgtcccgcctaaagctgaagctgaataaggatattgtgatctctgtcggtatatataacctggtgcaaaaggccctgaaacctcccccaatcaagttatatcgtgaaaccaacgaacccgtcaagactaagacacgcaccttcaatacctccacaggaggattgttgttgcccagtgacactaaaaggagccagatttacggaagcaggcagatcattctggagaaagaggaaacggaagaactgaaaaggttcgacgaccccggattaatgcttatggggttcaagcctctagtcctgctcaaaaagcatcactatctgaggccctcacttttcgtctaccctgaggaatccctcgttatcggctcgtcgacccttttctccgccctgctgataaagtgtctggagaaagaggttgccgctttgtgccggtacacgccacgacgtaacatcccaccctattttgtagccctagttcctcaggaagaagagctcgacgatcagaaaatccaagtaacgccacctggcttccaactagtgtttctgccatttgctgatgataaacggaagatgcctttcactgaaaaaataatggctactcctgaacaggtgggaaaaatgaaagcaatcgtggagaaactgcgatttacgtacagatctgattcattcgagaaccccgtgctgcaacagcatttccgcaatctggaggctctggcgctagacttaatggagcccgagcaagccgtggacttaactctgcccaaagtagaggccatgaataagcggctcggctcccttgtggacgagtttaaagaacttgtgtacccacccgattacaacccggagggcaaggttaccaagagaaagcatgataacgaaggcagcggtagcaaaagaccgaaggtggagtactccgaagaggaactaaaaacccacatttctaaaggcaccctgggcaaattcaccgtgcccatgctgaaagaggcatgccgcgcttatggtttgaaatcaggactgaaaaaacaggaactactcgaagccctcactaagcatttccaggactag

SEQ ID NO: 31592 - DNA, 741 bp, Artificial Sequence
  Description of Artificial Sequence: Synthetic coding sequence
atggccggagctcctgacgaaagacgcaggggtcccgctgcaggggagcagctgcagcagcagcacgtgagctgccaggtgttccctgagcggcttgcccaaggcaatcctcagcagggttttttttcgtcattcttcacatcaaatcaaaagtgccagttgagactgcttaagacactagaaacgaacccctacgttaaattgctgctagatgcaatgaaacactctggttgtgcggtcaataaggaccgccatttcagttgcgaggattgcaatgggaacgtgtctggcggatttgacgcctcgacgagccagattgtgttgtgtcagaataacattcataatcaagctcatatgaatcgtgtggtgacacatgaactcatccatgcctttgaccactgccgcgcacacgtggactggtttacaaacattagacacctcgcctgctcagaagttcgagcagccaacctgagtggtgattgtagcttggtgaacgagatttttaggttacactttggacttaagcaacaccatcagacatgtgtgagagatcgtgccaccttaagtatcctggcagtgcgtaatatctctaaagaggtcgcaaaaaaagccgttgacgaggtcttcgaaagctgttttaacgatcatgaaccgtttggcaggatccctcataataaaacatacgccagatacgcacatcgggatttcgagaatcgcgatagatactattccaatatctag

SEQ ID NO: 31593 - DNA, 1515 bp, Artificial Sequence
  Description of Artificial Sequence: Synthetic coding sequence
atggatccaggccaacagcccccacctcaaccagccccacaggggcagggccagccaccttctcaacctccccaagggcaaggcccaccaagcgggccaggacagcctgcccctgccgctacccaggcagcacctcaggcacctcctgcaggacaccagatcgttcatgttaggggcgattccgagaccgaccttgaggctctctttaatgccgtgatgaatccaaagaccgctaacgtcccgcaaacggtgcccatgaggctccgcaagctcccggatagcttttttaagccacccgaacctaaatcccactcccgccaagccagcaccgatgcaggtaccgccggagccctgaccccacagcatgtccgcgcacacagttcaccagcctcacttcagctcggcgcagtctcgccgggtaccctaaccccaacgggagttgtctcaggacctgccgcaactcctactgctcagcacctgcggcagtctagcttcgagattcccgacgacgtgccgttacctgccggttgggagatggcaaaaacttctagcggtcagagatatttcctgaaccacattgatcagacaaccacctggcaggacccccgaaaggccatgctgagccaaatgaacgtcacggcccctacatccccccctgtgcagcagaatatgatgaacagcgcatcaggaccattgcctgatgggtgggagcaggccatgacccaggacggggaaatatactacatcaaccacaaaaacaagacaactagctggctggacccccgtttagatcctcggttcgctatgaatcaacggatcagccagtccgctcccgtcaagcagccccctcctttggccccacagagtccccaggggggtgtgatgggaggctcgaactctaaccagcagcaacagatgcggcttcagcagcttcaaatggaaaaagagagattacgcttgaagcagcaagagctgctgcgtcaagccatgcgtaacatcaacccttctacggccaatagcccgaagtgtcaggagttggctttgaggagccagctgcctaccctagaacaggacggcggaactcagaaccccgtctcttctccaggcatgagccaggagcttagaacaatgacaacaaactccagcgatcccttccttaacagcggaacatatcactcacgagacgaaagcacagattctggactgagcatgagttcctattcggtgccaaggactcccgacgatttcctcaattcagtggatgagatggatactggtgatacgattaatcagtctaccctgccctctcagcagaacaggtttccagactacttagaagctatccccggtactaatgtggatctagggaccctggagggggatggtatgaacatcgagggggaggaattaatgccttctttacaggaagccttgagttcagacatattaaatgatatggagagtgtcctggccgcaaccaagttggacaaggagagcttcctgacgtggctatag

SEQ ID NO: 31594 - DNA, 1365 bp, Artificial Sequence
  Description of Artificial Sequence: Synthetic coding sequence
atggacccagggcaacagccaccaccacaaccagccccacagggccagggtcagccacctagtcaacctccccagggtcaaggacccccttccgggcctgggcagcctgcgccagcagctacacaggcagccccacaagcaccacctgctggacaccagattgttcacgtcagaggggattccgaaacagatctcgaggctttatttaatgccgtgatgaatcccaagactgccaatgtgccccagacagtccccatgagactgcggaaacttccagattctttctttaagccgcctgagcctaagagccacagcaggcaggcttctactgacgctggtactgcaggggcactaacgcctcagcacgtgcgggctcacagttcaccagcgagccttcaacttggcgctgttagcccaggtacgctgacccccaccggcgtcgtgagcggcccagccgctaccccaacagctcaacatcttcgccagagctcctttgagatccccgacgatgtgcctctccccgcaggttgggaaatggctaaaacatcctctggacaaagatactttctgaatcatattgaccagaccactacatggcaagatccaagaaaggccatgctctcacaaatgaacgttactgctcctacctcacctccggtgcagcagaacatgatgaacagtgcttctgctatgaaccagcgaatcagccagtccgctccagttaaacagccgccacccctcgcaccacagtctcctcagggaggggttatgggcggaagtaatagcaaccagcagcagcagatgagactgcagcagctccaaatggagaaagagcggttacggctcaagcagcaggagctcctgcggcaagtcaggccccaggaacttgcattgaggtcacagctgccaacgcttgagcaagatggcggaacgcagaaccccgtaagctcccccggaatgtctcaggagctgcggacaatgacgaccaattcttccgatccttttttgaattcaggcacctaccattccagggatgaatccaccgattctgggctgtccatgtcttcttacagtgtgccacgcacccccgatgattttctgaactcggtcgatgagatggacacaggggataccattaatcagagcacactccctagccagcagaatcgcttccccgattatttagaagccattcccggaactaacgtggatcttgggactttggagggcgatggaatgaatattgagggggaagaattgatgccctcactccaggaagcacttagctctgatatcctgaacgacatggagtctgtgctcgcagctaccaagctcgacaaggagagttttctcacatggctgtag

SEQ ID NO: 31595 - DNA, 1266 bp, Artificial Sequence
  Description of Artificial Sequence: Synthetic coding sequence
atgcgcctgaggaaattgccagatagctttttcaagccaccagagcccaaatcacattcgcgtcaggccagcactgacgcgggaacagcaggcgctttaacgcctcagcacgtcagggctcactcctctcctgcgagcctccagctgggggcagtttcccccggtactctgacaccaactggcgttgtttcaggcccagctgcaacacctacggcgcagcaccttcgccaatcttcatttgagatcccagacgacgttcccttacctgccggatgggagatggccaagaccagcagcggtcagcgctacttccttaaccacatcgatcagacaacaacatggcaggacccacgaaaagctatgctgagccagatgaacgtgacagcacccacgtctccccctgtgcagcagaacatgatgaactctgcctccggaccgctgcccgacggctgggagcaagcgatgacacaggacggcgaaatatattatattaaccacaagaacaaaacgacatcctggctcgatccccgactcgacccaagatttggcaaggctatgaatcagaggatcagccaaagcgctcccgtgaaacagccaccaccgctggccccacagagccctcaaggtggcgtcatgggtggatccaactccaatcaacaacagcaaatgcgtctgcagcagctgcagatggaaaaagagcgtctgagattgaagcagcaagagctcctccgacaggccatgcgtaatattaacccatccaccgctaatagccctaaatgccaagagcttgcattgaggtcacagctccccaccctggagcaggacggcggaacacaaaacccggtgtcttctccaggaatgagccaggagctgagaacaatgactaccaacagctccgacccctttttgaatagcggtacctatcatagccgggatgagagcaccgactctggactcagcatgagcagttactccgttcccagaacaccagacgacttcctgaattctgtcgatgagatggacacgggagatacgatcaaccagtctactctgccctcgcaacaaaatagattccctgattatctggaggctattccaggcacgaatgtggatctcggcactttggaaggcgacggaatgaacatcgaaggtgaggagctaatgccgtctttgcaggaggccctcagcagtgacattctgaatgacatggagagcgttttagctgcaaccaaacttgacaaggaatcctttctgacatggctttag

SEQ ID NO: 31596 - DNA, 981 bp, Artificial Sequence
  Description of Artificial Sequence: Synthetic coding sequence
atggcgaaaacatctagcggtcagcggtatttcctgaaccacatagatcagaccaccacctggcaggatccgagaaaggctatgctgagccagatgaacgtcactgcccctacttccccccctgtgcagcaaaacatgatgaacagtgcgagtggccctctgcctgatggttgggagcaggccatgacccaagatggcgagatttattacatcaaccataagaacaagaccaccagttggctggatccacgcctagacccccgatttgccatgaatcagagaatctcccaatcagctcctgtcaaacaaccacccccactggcaccccaatcgccgcagggtggcgtcatgggcggtagtaatagtaaccagcagcagcaaatgcgattacaacagctgcagatggaaaaagagagactgagactcaagcagcaagagttactccgacaggccatgagaaatatcaaccccagtactgctaactctcctaaatgccaggaattggcgctcaggagtcagctccccaccttggagcaggacgggggaactcaaaacccagtctcgagcccaggcatgagccaagaattacgcaccatgactaccaatagctccgacccgtttctgaacagcggaacctatcacagtcgggacgagtccacagacagtggtctctccatgtcaagttatagtgtcccacggacaccagacgatttccttaatagcgttgacgagatggacaccggcgatacgataaaccaaagcacactgcctagccagcagaatcgtttcccggactatttggaggcgattcctggaaccaatgtcgacctcggaaccctggagggggacggaatgaacatcgaaggcgaagagctgatgccgtctctgcaggaggccttgagcagcgatatccttaacgatatggaatcagtgttggccgcaacaaagctggataaggagagtttccttacttggctgtag

SEQ ID NO: 31597 - DNA, 1467 bp, Artificial Sequence
  Description of Artificial Sequence: Synthetic coding sequence
atggacccaggacagcagcctcccccacaacctgcaccacagggtcagggacagcccccatcccaacctccccagggacaggggccacccagtggcccaggacaacccgctcccgctgcaacccaggccgctcctcaagcgcctcccgctgggcatcagatcgtgcacgtgcgcggtgatagtgagaccgacttggaggccctcttcaatgcggtcatgaaccccaaaacagctaatgtgccccaaactgtgcctatgaggctgagaaagctgcccgatagtttctttaaaccgccagaacctaaaagccactctagacaggcgtccaccgatgccggaacagcgggagctttgacacctcagcatgtgcgggcacattcgagccccgcatccctgcaacttggcgcagtatcaccaggaacgttgaccccaaccggtgtcgttagcggacctgccgcaacgcccactgcgcagcacctgaggcaaagtagcttcgagattcctgacgatgtcccactgccagccggttgggaaatggctaagacttcatccgggcaaagatactttctgaatcacatagaccagaccacaacatggcaagatcctaggaaggcgatgctgtctcagatgaacgtgaccgcacctacaagcccacctgtacagcagaacatgatgaatagcgcctcagggcctctgccagacggatgggaacaggcaatgacacaggatggcgagatctactacataaatcacaaaaacaaaactacaagttggctcgatccaagactcgatccaaggtttgccatgaatcagagaatttcccagtcagcccctgtgaagcagccgcctccactggctcctcagtcaccccagggtggggtcatgggaggcagcaactccaaccaacagcagcagatgaggctccagcagttgcagatggagaaggaaaggctccggctgaaacagcaggagctcctgagacaggagttagctctgagatcccagcttcctactctcgaacaggacggcggaactcagaaccccgtgtcatctccaggcatgtcacaggaattgagaacaatgactacaaatagttcagaccccttcttaaactccgggacatatcacagtcgagacgaatccacggattccggtctcagcatgtcatcatactccgtaccgcgaaccccagacgacttcttaaacagtgtagatgagatggataccggcgacaccattaatcagagcacgttaccctctcagcagaacagatttccagactacctggaggccattccgggaacaaacgtcgacctgggcacactggagggcgatggcatgaatattgagggggaagagctgatgccctcccttcaggaggctctgagttccgacatccttaacgatatggaaagtgtactcgctgccaccaaactggataaggagtcatttttaacttggctatag

SEQ ID NO: 31598 - DNA, 1479 bp, Artificial Sequence
  Description of Artificial Sequence: Synthetic coding sequence
atggacccagggcagcagcctcccccacagcctgctcctcagggccagggacagcctcctagccagccccctcaaggacaaggcccaccctccggtccagggcaaccagctccagccgctactcaggcagcccctcaggcaccccctgctggccaccagattgtgcatgtccggggtgacagtgaaacagacttagaggctctgttcaacgctgtcatgaatcctaaaacagccaatgtcccacagactgtgcccatgcgcttgcggaagctgcccgattccttttttaagccacccgaacccaaaagccacagccgccaggcgagcaccgatgcagggacagcaggtgccctaactccgcagcatgtgagagcccacagtagtccagcaagcctgcaattgggcgcagtctcccccggtacactgacaccaaccggagtggttagcggcccagccgctacgccaacagctcagcatctgagacaatccagctttgagatcccagacgatgttccactaccagccggttgggaaatggccaagacctcctccggacaacgatactttctgaaccacatagatcagaccactacgtggcaagatccgcgaaaagccatgctgtctcaaatgaatgttacggctcccacatccccgcctgtgcaacagaatatgatgaatagcgccagcggccctctgcccgacggatgggagcaggccatgacacaggatggcgaaatttactacatcaatcacaagaacaagactaccagttggctggatccacgtcttgatcctaggtttgctatgaatcagcggatatcccagtccgccccagtcaagcagccccctccactcgcccctcaatcgccccagggcggtgtaatggggggaagcaattccaaccagcagcagcagatgcgcctccagcagctgcagatggaaaaggagcgcttacgactcaagcagcaggagttgttacgacaagtgcgacctcaagaactggccttgagaagccaacttcctaccttggagcaggacggcggtacccaaaacccagtgagcagtcctggaatgagccaggagcttaggaccatgacgacgaattcctccgaccctttcctgaattctggcacttaccactccagggatgagtcaacagactcgggcttatccatgtcgtcctactccgtccctcggactccagatgattttctaaactccgtcgacgaaatggacacaggggacaccatcaaccaaagtaccctgccgtctcaacaaaatcgcttccctgattacctggaagccataccgggaactaatgttgacctcggaacattggaaggcgacggcatgaacatagagggagaggagctgatgcctagcctgcaggaggccctgtcttccgatatactgaatgatatggaatccgtcttggctgcaaccaagctagataaggagtccttcctgacgtggctctag

SEQ ID NO: 31599 - DNA, 1353 bp, Artificial Sequence
  Description of Artificial Sequence: Synthetic coding sequence
atggatcccggacaacagccacccccacagcctgcaccccagggtcagggtcagcctccaagtcagccccctcaggggcagggcccaccaagcggccctggtcaacctgcccctgccgctactcaagccgctccccaggcccctccagccggtcatcagatagtccatgtgaggggagattcagagaccgacttagaagcgttgtttaatgccgtcatgaacccaaaaaccgccaatgtgccgcagacagtgcccatgagactccgcaagctgcctgattctttcttcaagcctcccgagccaaagagtcactctcggcaggcgagcactgacgcaggcactgcaggcgctcttaccccacaacacgtccgcgctcattccagtccagctagcctgcagctgggggcagtgagtcccggaactctgacccccacaggcgtggtgagtggtcccgctgccacccccactgcccaacacctcagacagtccagcttcgagattcccgatgatgttccgctgcctgctggctgggaaatggcaaagacaagttccgggcagcggtacttcctgaatcacatcgatcaaactacaacgtggcaagacccgcgaaaggccatgttgtcccagatgaatgttaccgcccctacaagcccaccagtgcaacaaaacatgatgaactctgcttcagccatgaaccagaggattagccagagtgccccagtgaagcagccgcctccactcgctccccagtctccacagggcggagtaatgggaggctctaacagcaaccaacaacagcagatgcgactgcagcaactacaaatggaaaaggagcggctgcggttaaagcagcaggaacttttgcgtcaggagttagccctgcggagtcagctccctacgctagagcaagatggaggaacccagaacccggtctccagtcccggtatgagccaggaattgcgaaccatgacaactaattcaagcgatccctttctgaactcgggaacataccattcccgggatgagtccaccgactccggcctgtcaatgagctcctactcagtacccaggactccagacgatttcctcaattccgtggacgagatggacaccggagacactataaatcagtcaacgctccctagccaacaaaataggtttccagactaccttgaagcaatcccgggaaccaatgtagatctcggcacattagagggagatggcatgaacatcgagggcgaggagttgatgcctagcctccaagaggcactctcctcggacatccttaatgatatggagtccgtcctagcagccactaaactggataaagaatctttcctgacgtggctctag

SEQ ID NO: 31600 - DNA, 1860 bp, Artificial Sequence
  Description of Artificial Sequence: Synthetic coding sequence
atggctaatgatatcgatgagcttatcgggatcccattccctaatcatagcagcgaggtcctttgctccctgaacgagcagaggcatgatggcctgctgtgtgacgtgctgctggtggttcaggaacaggagtatcgtactcaccggagcgtgctggctgcctgtagcaagtacttcaagaaactttttactgccggaaccctggcctcccagccctatgtgtacgagatagacttcgtgcagccggaagcactagccgctattctagaattcgcgtacacatcgacactgactattaccgccggaaacgtgaagcacattctcaacgctgctaggatgcttgagatacagtgcatcgttaacgtatgccttgagataatggaacccggtggggacggtggggaggaggacgacaaggaggacgatgatgacgatgaggacgacgacgatgaggaggatgaagaagaggaagaggaggaagaggaggatgatgatgacgataccgaagattttgcggaccaggagaacctgccagacccccaggacatatcttgtcatcagagtccgtccaagacagaccacctcacagaaaaagcatactccgatactccacgggatttccctgactcctttcaggccggatctccagggcacttgggagtgatcagggacttctctattgagagcctactccgggaaaacctctatcctaaagctaacataccagatcgtaggccttcgctgagtcccttcgccccagatttcttcccgcatctctggcctggagatttcggtgctttcgcccagctgcctgagcaaccaatggatagcggcccattggatctcgttataaaaaatcgcaaaatcaaggaagaggaaaaagaggagctgccccctcctcctccccctccattccctaacgattttttcaaggacatgtttccagacttacccggagggccacttggccctattaaggcggagaatgactacggtgcttatttgaatttcttgtctgccacgcacctggggggattgtttcccccatggccactggtagaagagcggaagctgaaacccaaggcctcccaacagtgtcccatttgtcacaaggttatcatgggtgctgggaaactgccgcgacacatgcggacacacaccggcgagaagccatatatgtgcaccatttgtgaggtgaggttcacaaggcaggataaattaaaaatccatatgcgtaaacatacaggggagagaccatacctctgcattcattgtaacgccaagtttgtccataattatgacctgaaaaatcatatgagaatccataccggagtccggccataccagtgcgagttctgttacaaaagcttcactcgctcagatcacttgcaccggcatataaagcgacaatcctgtaggatggcccgacccaggcggggaaggaagcctgccgcttggcgcgctgctagccttctgtttgggcctgggggtcctgctccagataaggcagccttcgttatgccaccagcactgggagaggtggggggacacctcggcggagccgcagtgtgtctacccggaccgagtcctgccaagcacttcctggcggctcctaagggcgctctctccttgcaagagctggagcggcaatttgaggaaacccagatgaaattattcgggcgtgcccagctggaggccgagcggaacgccggtggtctcctggctttcgccctagcagagaacgtggcagctgcaaggccgtactttcctctaccagacccctgggccgctgggcttgccggtctgcctggactagcaggcctcaaccatgttgcttctatgtctgaagccaacaactag

SEQ ID NO: 31601 - DNA, 1860 bp, Artificial Sequence
  Description of Artificial Sequence: Synthetic coding sequence
atggccaacgatattgacgaactgattggtataccgtttcctaatcattcatccgaggtgttgtgtagcctcaatgagcaaagacacgacggcttgctgtgcgacgtccttttggttgtacaggaacaggaataccggacacaccgatccgtactggccgcatgttctaagtactttaagaaattgtttaccgcaggcactctggctagtcagccttacgtttacgagatcgatttcgtgcagccggaagccctggccgcaattctggaattcgcttacacctccacacttaccatcacagccggaaacgttaaacacatcctgaatgctgctcgaatgttggaaatccagtgcattgtgaatgtttgtctcgaaattatggagccaggcggagacggaggcgaagaagatgacaaggaagacgacgatgatgacgaggacgacgacgacgaggaagacgaggaagaggaagaagaagaggaagaagatgatgacgacgacactgaggactttgccgatcaggaaaatcttcccgacccccaggacatctcctgtcaccaatctcctagcaagaccgaccacttaactgaaaaggcctacagtgacacaccaagagattttcccgacagcttccaagctggctccccaggccacctcggtgtcatccgcgatttctccattgagtcattgttgcgcgaaaatctctatcctaaggcaaacatacctgacagacgcccatcactatccccgtttgcaccagacttcttcccccacctttggcccggagacttcggcgcatttgctcagttgcccgaacaacccatggattctggtcctctagatctggttatcaaaaaccggaagatcaaagaagaagaaaaggaggagctcccacccccaccacccccaccttttccaaacgatttctttaaagacatgttcccagatcttccaggcggtcccctcggccctattaaggcagaaaacgactatggtgcgtatctgaacttcctcagcgccacccacctcgggggtctgttccccccttggcccctggtcgaggagagaaagttgaaacccaaggccagtcagcagtgcccaatctgccataaggtcattatgggagcaggtaagttgccaaggcatatgcgcacccatactggcgagaaaccttacatgtgtaccatatgcgaagtcaggtttaccagacaggataagcttaaaatccatatgagaaaacacacaggggaaaggccttatttatgtatacactgcaatgctaaatttgttcacaactatgacctcaaaaaccacatgcggatccatactggcgttcgcccatatcagtgtgagttctgttacaagtctttcacgcgctccgaccacttgcataggcatatcaaaagacaatcttgtcgcatggccaggcccaggaggggcagaaaacctgccgcttggagagccgctagtttgctcttcggacctggaggcccagcgccagataaggcagctttcgtgatgccacccgcattgggggaggtgggaggtcatcttggaggagccgcagtctgtctccccggaccctcccccgctaaacatttcttggcagcaccaaagggagccctctcactgcaggagctggaaaggcagttcgaagagacacagatgaagctgttcggacgagcccagttagaggcggagaggaatgcagggggattgctggcctttgccctggcagaaaatgttgctgctgccagaccgtatttccccctgccagatccttgggctgctggcttggccggactaccaggactggctgggctgaatcacgtagccagtatgtcagaggccaacaattag

SEQ ID NO: 31602 - DNA, 78 bp, Artificial Sequence
  Description of Artificial Sequence: Synthetic coding sequence
atggcaaacgatattgatgaactcattgggatcccatttccaaatcacagtagcgaagtactctgttctttaaattag

SEQ ID NO: 31603 - DNA, 57 bp, Artificial Sequence
  Description of Artificial Sequence: Synthetic coding sequence
atggctaatgatattgacgagctgatcgggattcccttcccaaatcattcctcgtag

SEQ ID NO: 31604 - DNA, 3375 bp, Artificial Sequence
  Description of Artificial Sequence: Synthetic coding sequence
atggctgacggaccacgttgcaagaggagaaaacaggccaatcccaggagaaacaatgtgaccaactacaacaccgtggtggagactaattcagactctgatgatgaagataagctacatattgtagaagaagagagtgtcacagacgccgcagactgtgaaggagtgcccgaggatgatctccccacagatcaaacagttctgcccggtcgctcatccgaacgcgagggcaacgcaaaaaattgttgggaggacgacagaaaggagggtcaggaaattctcggccctgaggcacaagccgacgaggcaggctgtaccgtgaaggacgacgaatgcgaaagtgatgctgaaaacgagcaaaaccatgacccaaatgtggaagagttcctacagcagcaggacaccgccgtcatttttcccgaggcccctgaagaggaccagagacagggtacgcctgaagccagcggacacgatgagaacgggacgcctgatgcattctcccaacttttaacatgtccctattgtgatcgtggatataagcggttcacgtctcttaaagaacatatcaagtaccgacacgaaaagaatgaagataactttagttgcagcctctgctcgtacacattcgcgtatagaacccagttggagcgccacatgactagccataagagcggaagagaccagagacatgtgacccaaagtggatgtaatcggaagttcaagtgcacagaatgcggtaaggcttttaagtacaagcaccacttgaaggagcacctgcggattcacagcggcgagaaaccttacgagtgccctaactgtaaaaaaaggttctctcattccgggtcctattccagtcacattagtagcaagaagtgcatcagtctgataccggtcaacgggagaccgcgtaccggcctcaaaaccagccaatgcagctcaccttccctgagtgccagcccaggcagccctaccaggccacaaatccgacaaaagatcgagaataagcctctgcaagaacagctttcagtcaaccaaataaagaccgagccagtggattacgaattcaaacccatcgtggtggcctctggaattaattgtagcactccattgcagaacggcgtctttacagggggaggaccccttcaggccacgagttccccccaaggcatggtacaggcagtcgtgctcccgactgttggcctcgtttctcctattagtataaacctgtctgatattcagaacgtgctcaaggtcgccgttgacggaaatgtaataagacaggtcttggaaaataaccaggccaatttagcatccaaagaacaagaaaccatcaatgccagccccattcagcaggggggacattctgtaatttctgccatcagtttgcctcttgtcgaccaggacggtacaactaagatcattatcaactacagtctggagcagcccagtcaactccaagtggtcccccagaatttgaagaaggagaaccctgttgctactaactcatgcaagagcgaaaaactaccggaggaccttacagtgaagagcgagaaggataaatcgttcgagggaggggtcaatgactccacatgccttctatgtgatgactgccccggagatatcaacgcacttccagaactgaagcattacgatctgaagcagcctacgcaacccccaccactaccagcggctgaagccgagaaaccagaatcctcagtctcctccgctacaggcgacggaaacctgtcccctagccaacctccgctgaagaatctcctcagcctgttaaaggcatactatgcactgaatgcacaaccctcggcagaggagctgtcaaaaatcgccgatagtgtgaacttaccgctggacgtagtcaagaagtggtttgaaaaaatgcaggctggacagatcagcgtccagagcagtgagccttcatctccagagcccggaaaagtgaatattcccgcaaaaaacaatgaccagccccagtctgccaatgctaacgagcctcaggactccacggtgaatctgcagagtccccttaagatgacaaactctccagtactccccgttggaagcactactaatggctctcggagtagtactccctcacccagtccccttaatctgtcctcttctagaaacactcaaggttatctctataccgccgaaggggctcaggaagaacctcaggtggagccattggatctcagcctgccaaagcagcagggagagctcctcgaacgttctaccattacttctgtgtaccagaactccgtatacagcgtgcaggaagaaccacttaacctgtcctgcgccaaaaaggaaccccagaaggactcttgtgtcacagatagcgagcctgtggtgaacgtcattccgccttctgccaaccctatcaacatcgcaattcctacggtgacagctcaactgcctaccatagtggctatagcggaccaaaattctgtgccctgcctccgcgcattagcagctaataagcagaccattctcataccccaagttgcctacacttattccactaccgtctctcccgcagtgcaggaacctcctctaaaggtgatacaaccaaacgggaatcaggatgagaggcaggacacaagttctgaaggggtcagcaacgtcgaggatcagaacgactccgacagcacacccccaaagaaaaagatgagaaaaactgaaaatgggatgtacgcatgtgacttgtgtgataagatcttccagaaaagttcatccctgctgaggcataagtacgaacacaccggtaagagaccccatgagtgcgggatttgcaagaaggcttttaagcacaaacatcatttgatagagcatatgcggctgcatagcggagagaagccctaccagtgcgataagtgtggaaagaggttttcacacagtggcagctatagtcaacacatgaatcataggtacagttattgcaaaagagaagccgaggagagagattccaccgagcaggaggaagcagggccagagatattgtcaaacgaacacgttggtgcgcgtgcctcgccttctcaaggagatagcgatgaaagagagtcactcacacgggaggaagatgaggatagtgaaaaggaggaagaggaagaagataaggagatggaggaactgcaagaagaaaaggagtgtgaaaagcctcagggagacgaagaggaagaagaggaagaagaggaggtggaggaggaggaagttgaggaggccgaaaacgaaggagaggaagcaaagactgaggggctgatgaaggacgaccgagccgaatcccaggcaagttctctcgggcaaaaagtgggggagtcctccgagcaagtgagcgaggaaaaaactaatgaagcttag

SEQ ID NO: 31605 - DNA, 3378 bp, Artificial Sequence
  Description of Artificial Sequence: Synthetic coding sequence
atggcagatggtcctagatgtaaacgtcgcaagcaagcaaaccctcgaagaaacaatgtgacaaactacaataccgtggtggagaccaattcagatagtgatgatgaggataagctgcatatcgtggaagaggaaagcgtcacagatgccgctgactgtgaaggcgtgcctgaagatgacctgccaactgaccaaacagttttgcccggacggtctagcgaacgcgagggcaatgcaaaaaattgttgggaggacgataccgggaaagaaggacaggagattctgggacctgaagctcaggccgacgaggcaggttgtactgttaaggacgacgaatgcgagagtgacgccgagaatgagcaaaaccacgatccgaacgtggaagagtttctgcagcaacaggatacagctgtgatatttccagaggcaccggaggaggaccagaggcagggaactcccgaagcatccggacatgatgagaacggtacgccagacgcgttcagccagcttctcacatgcccatattgcgacagaggctacaagaggttcacctcccttaaggaacacattaagtatagacacgaaaaaaatgaggataatttttcctgctccctgtgttcctacacgttcgcttatagaacccagttagagaggcatatgaccagccataagtctgggcgagatcagcgacatgtcacccagagcggttgcaatcgcaagtttaagtgcaccgaatgtggcaaggctttcaaatacaaacatcacctaaaggagcacctgcgaattcacagcggagaaaagccgtacgagtgcccaaactgcaagaaaagatttagccactctggttcatatagttcccacatttcctctaagaagtgtattagtctcatcccagtcaatggtagacccaggactgggttgaagacctctcagtgtagcagtcccagcctgtctgccagtcccggaagcccgaccaggcctcagattcgacagaaaatcgagaacaagccattgcaggaacagctgtctgtaaatcagatcaagactgaaccagtggattatgaattcaaacccattgtagtggcaagtggcatcaattgctctacaccactgcagaacggagtctttaccggtggagggccacttcaggcaacgagcagtccacagggaatggtacaggccgtggtactgcccacggtggggctggtgagcccaatctcaatcaacctttcagacatacagaacgttctcaaggtcgctgtcgatgggaacgtgattcggcaagtccttgaaaacaaccaggcaaatctggcctccaaagaacaagagaccataaacgccagccctatccaacaggggggtcactctgttatctctgctatttctctgccccttgtagatcaggatgggaccactaagattatcataaattacagcctcgagcagccgagtcaactccaagttgttcctcagaatttgaagaaggagaaccctgtggcgactaattcttgcaagtccgagaagctgcctgaagatctgactgtcaagtccgaaaaagataaatctttcgaaggtggggtaaatgatagcacatgtttactgtgcgacgactgtcccggagatatcaacgcattacctgagctaaagcattacgatctgaaacagccaacgcaaccacctcctctgcctgcagccgaagccgagaagcctgagtcaagcgtctcctccgccaccggggatggtaatctgagtccttctcaacctccactgaagaacctactgagtctgctgaaggcttactatgcgctgaatgcccagcctagcgcagaagaactttccaaaattgccgacagcgtgaacctgccactggacgttgttaagaaatggttcgagaagatgcaggccggtcagatcagcgttcaaagcagcgaaccttcatctccagaacccggaaaggttaacatccctgccaagaacaatgatcagcctcagagcgccaatgccaacgagccacaggactccaccgtcaatttacagtccccactgaaaatgactaatagcccagtgctgcctgtcggttctactacaaatggttcccggagctccacaccttctcccagccccctgaatttgagttcttctcggaacacccaggggtatttgtacaccgctgaaggtgctcaggaggaaccccaggttgaaccccttgacttgagtctgcccaaacagcagggtgagctgctggaacgaagcaccatcactagcgtgtatcagaattctgtctactccgtgcaagaagaaccgctcaacctttcctgtgccaaaaaggagcctcagaaagactcatgtgtcactgacagcgagcctgtggtgaatgtgatacccccatctgctaatccgattaacattgctattcccaccgtgaccgctcaactaccaacgatcgttgctatcgccgaccaaaactccgtgccgtgcctgagggccctggccgcaaataaacaaaccattctcattcctcaagtagcatatacctatagcactaccgtgagtccggcagtacaagagcctccactgaaggtgatccaaccgaatggaaaccaggacgagcgccaagatactagtagcgaaggtgtaagcaacgttgaggaccaaaatgattctgactccactcctcccaagaaaaaaatgaggaagactgagaatggtatgtatgcatgtgacctgtgcgataaaatttttcagaagagctccagcttactgcgccataaatacgaacataccggcaagcgtccacacgagtgtggaatctgcaagaaggctttcaagcataaacatcatctgatcgagcatatgaggctgcatagcggggagaagccttaccagtgcgacaagtgtggaaagcgtttttcgcacagcgggtcgtattctcagcacatgaaccatcgctactcatactgcaagagagaggctgaagaacgagacagcacagagcaggaagaagcaggcccagagattctaagtaacgaacacgttggcgctcgcgctagcccaagtcaaggcgacagcgacgagcgggagagtcttacacgggaggaggacgaggattctgaaaaagaggaggaggaggaggacaaagagatggaggagctgcaggaggaaaaagagtgcgaaaaacctcagggggatgaggaagaagaggaagaggaggaggaagtcgaagaggaagaggttgaagaagcagaaaacgagggagaggaggcgaaaacggaggggctgatgaaggacgaccgggctgaatcccaggcgagtagccttggacagaaggtcggagagtcttctgagcaggtaagcgaagaaaaaacaaatgaggcatag

SEQ ID NO: 31606 - DNA, 870 bp, Artificial Sequence
  Description of Artificial Sequence: Synthetic coding sequence
atggcagatggtccacggtgtaaaaggaggaagcaggcgaaccccaggagaaataatgtcaccaactataatactgtcgtggagacaaattcagactcagatgatgaggataagctccatatcgtcgaggaagagagtgtaacagacgcggctgactgtgagggtgtgcccgaagatgacttacctactgaccagactgtcctacctggccgatcttcagagagagaagggaacgctaagaactgctgggaggatgatacggggaaagaggggcaggagatcctgggtcccgaggcccaggccgatgaggcagggtgcactgtgaaggatgatgaatgcgagtccgatgcggaaaatgagcagaaccatgatccaaatgtggaggagttccttcagcagcaggacacggccgtgatttttcccgaagcacctgaagaagaccagcgacaaggaacccctgaagcttctggacatgatgagaatgggactccagacgcttttagccagcttttaacttgcccttattgcgaccggggttacaagcggtttacatctctcaaagagcacattaagtacaggcacgagaaaaatgaggataacttttcctgcagtctgtgcagttacacatttgcctatagaacacagctggagcgccatatgactagccataaaagcggcagagaccagcgccacgttacccagtcagggtgtaataggaagtttaagtgcacagagtgtggtaaggcattcaagtataagcaccacctaaaagaacacctgcgtattcacagcggcgaaaaaccctacgaatgcccgaactgcaagaagcgattctcccattctgggtcttactcgagtcacatcagttag

SEQ ID NO: 31607 - DNA, 2721 bp, Artificial Sequence
  Description of Artificial Sequence: Synthetic coding sequence
atgacaagccacaagtccggacgagaccagcgccatgttactcagtccggctgcaaccgcaagtttaagtgcacagagtgcggtaaggctttcaagtataagcaccacctgaaggaacacctccgtatccatagcggggaaaagccgtacgaatgtccgaattgtaaaaagagatttagccactccggatcctatagtagccacatctcctctaaaaagtgtattagtctgatccccgtcaatggacgtccgaggacggggctgaaaacaagtcagtgttctagcccttcgttatctgcgagtccagggagcccgacgaggccccaaatccgccagaaaatcgagaacaagcctcttcaagagcagttaagcgtgaatcagatcaagaccgaaccagttgactacgaatttaaacccatagtagtcgcatctggaatcaattgtagtacccctctccagaatggcgtctttaccgggggaggacccctgcaagccacatccagtccacaaggtatggtacaggctgtcgtcctcccgaccgttgggctggttagccctatcagcattaatctatccgacatccagaacgttctcaaggttgcagtggatggcaatgtaattagacaggtgttggaaaataaccaggctaacctagccagcaaagagcaggaaactataaacgcatctcctatacagcaggggggacacagcgtgatcagcgccatctcgctgcctctcgttgatcaggacggcacaacaaaaattattataaactacagcctcgaacagccaagtcagcttcaagttgtgccccagaacctgaaaaaggagaaccccgtcgccacaaactcgtgcaagtccgagaagctcccggaggacctgacagttaaaagcgaaaaagacaaatcatttgaggggggagttaacgactccacgtgcctcttgtgcgacgattgcccaggtgacataaacgctttgccggagctgaagcattatgacctgaagcagccaacacagcccccaccccttccagcagccgaagctgagaagccagagtcttcagtgtcaagcgctactggcgacggcaatttaagtcctagtcagcctccccttaagaacctcctctccctgctgaaggcctactacgctctaaatgcacagccatccgcagaagaactctctaagatagccgactctgtcaacctgccactggacgtggtgaaaaaatggttcgaaaaaatgcaggctggccagatctcagtgcagtcatccgagccctccagtccagaacccggaaaggtcaacatacctgctaaaaataacgatcagcctcaatccgctaacgcaaacgaaccacaagattcaactgttaatctccagtccccactcaaaatgactaatagtcctgtgcttccagttggcagcactactaacggatctcggtcttctactccctccccctcacctcttaacctgtcgagctctcgcaatactcagggctatctgtacacagcagagggcgctcaggaggagcctcaagttgagcccctcgacctgtcgttaccaaagcagcagggcgaactcctcgagcggagtactatcacaagtgtctatcaaaattcggtgtattccgtgcaggaggagcccctcaacctgtcatgcgcgaagaaggagccacagaaggattcttgcgtcaccgatagcgaacctgtcgtaaacgtgatcccgcctagcgccaatcccatcaatattgccatccctacagtaactgcccagctaccaactatagtggctattgctgaccagaatagtgtcccatgcctccgtgctctggccgcaaacaaacagaccattttaataccccaggtggcttatacttacagcactaccgtcagccctgccgtgcaggagcccccacttaaagtgatccagccaaacggcaaccaggacgaaaggcaggatacgagcagcgaaggcgttagcaatgtagaggatcaaaatgactctgactccactccaccgaagaagaaaatgcggaagacagagaatggaatgtatgcctgtgacctgtgcgacaaaattttccagaagtcctcttccctcctgcggcacaagtacgagcacaccggaaaaagacctcatgagtgcggcatatgcaagaaagcttttaaacacaagcaccacctgattgaacatatgaggctgcatagcggggaaaaaccctaccagtgtgataaatgcggaaaacgttttagccacagtggatcgtattcgcaacatatgaaccacagatattcatactgcaagcgtgaggccgaagagagagatagcactgaacaagaggaggccggtccagagatactgtccaacgaacatgtgggcgctagggcgagtcctagtcagggcgattcagatgagagagagtcccttactagggaagaggacgaagactctgaaaaggaagaggaggaggaggacaaggaaatggaggaactgcaagaggaaaaggagtgcgaaaaaccgcagggtgatgaagaggaagaagaggaggaggaagaagttgaggaagaggaagtggaagaagccgagaacgaaggagaggaagcaaagacagagggactgatgaaagatgaccgagcagagagtcaggcatcgtccctgggccagaaggtgggggagtcttcagagcaggtatcagaagagaagaccaatgaagcctag

SEQ ID NO: 31608 - DNA, 3327 bp, Artificial Sequence
  Description of Artificial Sequence: Synthetic coding sequence
atgaaggtgaccaattacaacactgtcgtggaaactaactcagatagtgacgacgaggacaagcttcacattgtcgaggaggagtctgtaaccgatgcagctgattgcgagggagtacccgaggatgacctcccaaccgaccagactgtccttccaggaagatccagcgagagagaggggaacgcgaagaattgctgggaggacgacacaggcaaggaagggcaggagatcctggggcctgaggcccaagcagacgaggccggttgtactgtgaaagacgacgaatgcgagagtgatgcggagaatgagcagaaccatgatcctaacgtggaggagtttctccagcagcaggacacggctgtcatcttccctgaggcacctgaggaggatcaacgccagggaacgccagaggcatcagggcacgatgaaaacggcactcctgatgcattcagccaactcctgacatgcccctactgtgaccgtgggtacaagcgttttacaagcctgaaggagcacatcaagtacaggcacgagaagaacgaagacaatttctcctgcagcctgtgttcttacacattcgcctacaggacccagttagagcgtcacatgacctcccataagagtggcagagaccagcggcacgtgacgcagagtggttgcaacagaaagttcaagtgcacagagtgtgggaaggctttcaaatataaacaccatctgaaggaacacctgagaatacatagcggcgagaagccttacgaatgtcccaactgcaaaaagcgcttctcccactccggttcttatagctcacacatctctagcaagaagtgcatttccttaattccagtgaacggacggccaagaaccggtctgaagacatcccaatgctctagcccgtcactgagtgcttctcctgggtcgcctactaggccccaaattcggcagaaaatagagaataagccacttcaggaacagctctccgtgaaccagatcaagacagagccagtcgattacgagtttaagccaattgtggtggcctccgggatcaattgctctactcctttgcaaaacggcgtgttcacaggtgggggaccccttcaggcaacctcctcacctcagggcatggtgcaggcagtagtgctccccaccgtggggctggtgtcacctatcagcattaacctgtcggatatccaaaacgtgctaaaggtggccgtggatggcaatgtgattagacaggtgctggagaataatcaggcaaatctcgcttcgaaagagcaggaaactatcaacgccagccccatacagcaggggggacattccgtgatttcagcgatatctctgccgctggtcgaccaggatggaaccacaaaaataatcattaattactccctggagcaaccctcacaattacaggtcgtcccgcagaacctaaagaaagaaaatccagtagccacaaattcttgtaagagcgagaaactaccagaggatctgacagttaaatcagagaaagataagtcatttgaaggaggagtcaacgattctacttgcttactctgcgacgactgccctggggacataaacgcactgcccgaactcaagcattatgacctgaaacagcccacgcaaccacccccactgcccgcagccgaggctgagaagccagaatctagtgtgagcagtgcaacaggggacgggaacctgtccccgtctcagccccctttgaagaaccttctaagtttgctcaaagcatactatgctctcaacgcccagccaagtgccgaagagctctctaagattgccgacagcgtcaacttacctctcgacgtggttaaaaagtggttcgaaaaaatgcaagccggacagatatccgttcagtcttctgagccctcaagtcccgaacccggaaaggtcaacattccagctaagaacaatgaccaaccccagagcgccaatgcaaacgaaccccaggactcgacggttaatttgcaaagtcctctgaaaatgaccaatagtccggtgttgcccgtcgggtccaccaccaacggctctcgctccagcacaccaagccccagcccactgaacctttccagcagcagaaacacacagggctacctatacaccgccgagggggctcaggaggagccacaggtggaaccgctggatctgagcctgcctaaacagcaaggggagctcctagagcggagcaccattaccagcgtgtaccaaaattccgtctacagcgtgcaggaggaaccgctgaacttgagctgcgcaaagaaggagcctcaaaaagatagctgtgtgaccgactccgagcccgtggtaaacgtgatccccccttctgcaaacccaatcaacattgccatcccgaccgtaactgcccagctaccaaccatcgtggctatcgccgaccaaaattcagtaccatgtcttagggcgcttgccgcaaataagcaaaccatcctgataccccaggtagcatacacgtactcgacaacggtatcacctgccgtgcaggagccgcctctgaaggtgattcaaccaaatgggaatcaagacgaacgacaggataccagttccgaaggagtttcaaatgtagaggatcagaacgactctgactccacacccccaaagaaaaagatgagaaagactgagaatggtatgtatgcctgcgatctgtgcgataagatctttcagaagtccagttccctgctgcgccataagtacgagcacacaggcaagaggcctcacgagtgcggcatttgcaaaaaggccttcaagcacaaacaccatcttattgagcacatgcgccttcacagcggggagaaaccctatcagtgcgacaaatgcggaaagcggttttcgcacagtggcagttactcccagcacatgaaccatagatatagctattgcaagagggaggcagaggaacgcgacagtaccgagcaagaggaagccggtcctgaaatcctctccaacgagcatgtgggtgcacgggctagcccaagccagggggactccgatgagcgggagtctttaacgcgcgaagaagacgaggactctgagaaagaggaagaggaggaagacaaagagatggaggaactgcaggaagaaaaagagtgtgaaaagcctcagggcgatgaagaagaggaagaggaggaggaggaggtggaggaggaggaagttgaggaagctgaaaatgagggagaggaggcaaagaccgagggccttatgaaggacgatcgcgctgagtctcaagccagcagtcttggacagaaagtgggcgagagcagcgagcaggtaagtgaagagaagacaaatgaagcctag

SEQ ID NO: 31609 - DNA, 3180 bp, Artificial Sequence
  Description of Artificial Sequence: Synthetic coding sequence
atggcagatggtccgaggtgcaaaagacgcaaacaagccaatccacgcaggaacaatgtgactaactataacactgttgtggaaactaattctgattctgatgatgaagataagctgcatatcgtggaagaggagtcggtgacagacgctgctgattgcgagggagtcccagaggacgacttacctaccgaccagacagtgcttccaggccgatcatccgagagggaaggtaatgctaagaactgttgggaggatgaccggaaagaggggcaggagatccttgggccagaggcccaggctgacgaagcagggtgcaccgttaaagatgatgaatgcgaatcagacgcagaaaacgagcagaaccatgaccccaacgttgaggaatttctgcagcagcaggataccgctgtgatattcccagaggcaccagaagaggatcagcgacaagggacgccggaggcatcgggccacgacgagaatggaactccggacgctttcagccagctgcttacatgtccctactgcgacagagggtataagaggtttactagcctgaaggagcacattaagtaccggcatgagaagaatgaggacaatttctcctgcagcttgtgctcatatacttttgcgtaccgcacgcagctagagcggcacatgacaagtcacaaaagcggcagagaccagcgccatgtgacacaatctggctgtaacaggaagtttaaatgtaccgaatgcgggaaagccttcaagtataagcaccacctaaaagaacacctgcgaattcacagcggcgaaaagccctatgagtgtcctaactgcaagaagcggttcagccatagcggatcatattcgtctcatattagcagcaagaaatgcatttctctcataccagtgaatggaagacctcggacagggctcaagacaagccagtgctctagcccaagtctttcagcatctcccggatcaccaacacggccacaaattcggcagaaaattgaaaacaagcctctacaggagcagctgagtgtgaaccaaattaaaactgaaccagtcgactatgagtttaagcctatcgtcgtggcatctgggatcaactgctcgactcccctgcagaatggggtgtttaccggaggcggacctctgcaggccacatcgagtccgcaagggatggtgcaggctgtggttcttcccaccgttggcctagtatcacctatctccatcaacctaagcgacatacagaatgtgctcaaggtcgccgtggacggaaatgtgattaggcaggttctcgagaacaaccaggctaacttggcaagcaaggaacaggaaacaatcaatgcttcaccaattcagcaagggggacacagtgtgatcagcgcaatatctcttccactggttgatcaggatggtaccacaaagatcattatcaactactccctggagcagccatctcagttacaggtagtgccacagaatctgaaaaaggagaatcctgtggccacaaatagctgtaagagtgagaagttaccagaagacctgacagtgaagagtgagaaggataaaagcttcgagggcggtgttaatgacagtacctgtttgttgtgcgacgattgccccggagatattaacgcactccctgagctaaaacattacgacttaaaacagcccacccagcctccacccttacccgcagcagaggccgaaaaaccagagtcaagcgtcagctctgcgacgggggacgggaacttgagtccctctcagcctcctctgaaaaacttactgtccctgcttaaggcatattatgctctgaacgcgcagccctccgctgaagagctgtccaaaatcgcggatagcgtgaaccttcctctggacgtagtcaagaaatggttcgaaaagatgcaggctggacagatcagtgttcagtcatctgagcctagctctccagagccaggcaaggtgaacataccagctaaaaacaatgaccagccgcaaagcgcaaatgcaaacgagccacaggatagcacggtgaacctacaatctcccctaaaaatgaccaacagcccggttctccccgtggggtcgaccactaatgggtccagatcgagcacaccaagtccctctcccctgaatctctctagtagtcggaacacacaagggtacctgtatactgcggagggcgctcaggaggaaccacaggtggagcctctggatctctccttgcctaagcaacagggtgagctgctggagaggtcgacaatcacctccgtgtaccaaaattccgtgtacagcgtgcaagaagaacccctgaatttgtcttgtgctaaaaaggaaccccagaaggacagctgtgttaccgattcagagcctgtggttaatgtgattcctccaagtgcaaacccaattaatatcgcaatccctaccgtaacggctcaattgccgactatcgttgccattgccgaccagaactcagttccgtgccttcgagccttggctgcaaacaaacagaccatcctcattccccaagtcgcatacacatattcgaccacggtatcccctgctgtacaagagccacccctaaaagtaatccagccgaacggcaaccaagatgagaggcaagacacaagctctgagggtgttagtaatgtggaagaccaaaacgacagcgactccacccctcccaagaaaaagatgcggaaaactgagaacggcatgtatgcgtgtgacttgtgcgacaaaatctttcaaaagtcttcatctttgcttaggcacaaatacgaacacacaggcaaacgccctcacgaatgcgggatttgcaaaaaagcctttaaacacaaacaccatcttatcgaacatatgagactgcactccggtgagaagccataccagtgtgacaaatgtggaaagagatttagtcatagtgggagttattcccagcatatgaaccatcgctacagctactgtaaaagagaagctgaagagcgcgatagcacagaacaggaggaagcaggccctgaaatcctcagcaacgagcacgtcggcgcaagagcaagtcctagccagggtgactctgatgagagagagagcctaaccagagaagaggatgaggatagcgagaaggaggaagaagaagaagataaggagatggaagaacttcaagaagagaagcacaaaaaaaaaaagtag

SEQ ID NO: 31610 - DNA, 1932 bp, Artificial Sequence
  Description of Artificial Sequence: Synthetic coding sequence
atggcagatggaccacgttgcaagcgtcgcaaacaggccaatcctaggaggaacaatggaacaccggacgccttttcccagttactgacatgcccgtattgcgaccgaggatataaacggttcacatctctgaaggaacacattaagtaccgccatgagaagaacgaggacaatttcagttgttccctgtgctcatacacattcgcttatcgaactcagctagaaagacacatgacaagccacaagtccggccgtgaccaacgtcacgtcactcaatcaggatgcaaccggaagttcaagtgtaccgagtgtggcaaagcttttaagtacaaacatcacttaaaggagcacttgcgtattcactcaggggaaaaaccatacgaatgccccaattgtaagaaacgcttctcacattccggatcttattcctcacatatttctagcaaaaaatgtatcagcttgattccagttaatggaaggcccagaacaggcttaaagacgtcacagtgctcctctcccagcctgtcggccagccctggatcccccactcgaccccagattcgccagaagatcgaaaacaaaccccttcaggagcagctctccgtgaatcagattaaaaccgaaccagttgattatgagtttaagccgatagtagtggcctctggcattaattgcagcacccctctgcaaaacggcgttttcacgggcggagggccactacaagccaccagttcgcctcaagggatggtgcaggccgtggtgctgcctacagttgggttggtaagtccgatcagcattaacctgagtgacatccagaatgttttaaaggtggctgtcgacggcaatgtgattaggcaggtgctggagaataaccaggcaaatctagcctcaaaggaacaagaaacaattaatgcatctcctattcagcaaggcggacacagcgtcatctccgccatttccctgcccctcgtcgaccaggacggaactactaaaatcatcatcaattattccctggaacagcctagccagcttcaggtcgtgccacagaacttgaaaaaggagaatcctgtggcgactaatagttgcaagtcggaaaaactacctgaggaccttaccgttaagtccgagaaggacaagagcttcgagggaggagtgaatgactctacctgccttctgtgtgacgattgtcccggtgacattaacgccctgcctgagttaaagcactacgatttaaagcagcctactcaacctccgcctctgcctgccgctgaagccgaaaagccagagagcagcgtgagctctgccactggagacgggaatttgagcccatcacagcccccacttaagaatctgctgagcctcctcaaggcttattacgccctgaacgcccaaccttccgctgaggaattgagcaagatcgccgacagtgtgaatctgccactggacgtggtgaagaagtggtttgagaagatgcaggccggtcagatctccgtgcagtcatccgagccttcgagtcccgagcctggcaaagttaacatcccagcaaagaataacgaccaaccccagtcagcaaatgcaaatgagccacaggacagtacagtaaacctgcagtcgcccttgaaaatgaccaactccccagtcctgcccgtcgggtctaccacaaacggctcacgatctagtacgccttctcccagtcctttaaatctcagcagttcaaggaacacccaggggtacctgtatacagcggagggggcacaggaggaaccccaggtcgagcctcttgatctgtcgctcccgaaacaacaaggcgaggaggcaaaaaccgaaggcctgatgaaagacgaccgcgcagagtcgcaggcgagcagcctgggtcaaaaggtgggtgagagtagtgagcaggtgagcgaggagaaaaccaacgaggcctag

SEQ ID NO: 31611 - DNA, 3174 bp, Artificial Sequence
  Description of Artificial Sequence: Synthetic coding sequence
atggcagacggcccacgctgcaagaggcgcaagcaagccaacccccgaaggaataatgggaaggagggtcaggagatcctcggtcccgaagctcaggccgatgaggccggatgcaccgtgaaggatgatgaatgtgaatccgacgcggagaatgaacagaaccacgacccgaatgtcgaggaatttttgcagcagcaggacacagctgtcatcttccccgaagcccctgaggaagaccagcgccaggggacaccagaagcgtccggccatgatgaaaacggcactcctgatgccttctctcaactactaacttgtccctactgcgaccggggatacaaacgcttcacatccttaaaggaacacattaaataccgccacgagaaaaatgaggacaatttctcctgcagtttgtgttcctacactttcgcttacagaacacagctggagaggcatatgacatcacacaagtcaggccgtgatcagcgtcatgtcacccagagcggttgtaacagaaaatttaagtgcaccgagtgcggtaaggcctttaagtataaacaccatctgaaggagcacctccggattcactctggggaaaagccctatgagtgccctaactgtaagaaacgcttttctcacagtggtagttatagttcccacatttcctctaagaagtgcatcagtttgattcccgtcaacgggcgaccgaggaccggcctgaaaacctcccagtgtagcagtccaagtctcagcgcttctccaggtagtcccacccgccctcagatccgacagaagatcgagaataagccactgcaagagcagttgtctgtaaaccagataaaaacagagcctgtggattacgaatttaagccaatcgttgttgcgtctggcataaattgctccactcccttgcaaaacggcgtgttcactgggggagggccactccaggccacgtcgtccccacagggcatggttcaggccgtggtgctgcccacagttggactcgtgtcccctatctccatcaatttgagcgatattcagaacgtattgaaagtggcagtcgacggcaacgtaattcgccaggtgctggagaacaatcaggcgaatctagcttccaaagaacaggaaaccattaacgcttcccccatccaacaaggtgggcactcagtcatcagtgccatctccctgcccctcgtggatcaggacgggaccaccaagataattatcaattatagcctggagcagcctagccaattgcaggtggtcccccaaaacctgaaaaaagagaatcccgtggctactaatagttgcaagtctgaaaagctcccggaagacctcaccgttaagagcgaaaaagataaaagtttcgagggcggtgtaaacgactcgacctgcttattgtgcgatgattgccctggcgatatcaatgcactgccggagctgaaacattatgacttaaagcagcctacccagccccctcctctgcccgcagctgaggccgagaagcctgaatcaagcgtctcaagtgccacaggtgatggtaatttgtctccaagccaaccaccactgaagaacttgctcagcctcctgaaggcctattacgcgttgaatgcccaaccttctgcagaagaactgtcaaagatcgctgacagcgttaatttgcccctcgatgtggttaaaaagtggtttgaaaagatgcaggctgggcagatttcagtacagagctctgagccctcctctcccgagcctgggaaggtaaatattcccgctaagaataatgaccagccacagtccgccaatgctaacgagccccaggattcaactgtgaacctgcaatcccccctcaaaatgacgaacagccctgtcctccccgtgggatccacaaccaatggatcccggagcagcacccccagcccctctcccctgaatctgtcatcaagccggaacacacaaggttacctgtatacggccgaaggggctcaggaggagccccaggtcgagccgctggaccttagcttacctaaacagcagggtgagttgctggagcggagcaccatcaccagcgtttatcagaattccgtctattcggtgcaggaggaacctctgaatctcagctgcgccaaaaaggagccccaaaaggatagctgcgttacagactctgagccagtggtgaacgtgatcccgccatccgccaatccgatcaacatcgctatccctaccgtgacagcccagctccccacaatcgtcgccatcgccgaccagaattcagtcccttgcctgcgcgcactagccgctaacaaacaaactattctgatcccgcaagtggcttacacgtatagcactaccgttagccctgccgtgcaggaacctcccttgaaagtgatccagcctaacggaaatcaggacgagcggcaggacacaagctctgaaggggtcagtaacgtggaggaccaaaatgacagtgatagtacgccaccaaagaaaaaaatgagaaagaccgaaaatggaatgtatgcatgcgatctatgtgataaaatttttcagaagtcctcaagcctgctgagacataagtatgaacacacagggaaacgcccacacgaatgcggcatttgtaaaaaggcgtttaaacacaagcatcatctgattgagcacatgcggctacattctggcgagaagccctaccagtgtgataagtgcggcaagagattttcgcatagcggatcatattcccagcatatgaatcatagatattcctattgcaaacgcgaggcggaagagagggacagtacagagcaggaggaggcaggccctgagatactttcaaatgaacatgtgggcgcacgggcttctcctagccagggcgactcagatgagagagagtctttaactagagaggaagatgaggatagcgagaaggaggaagaagaggaagacaaggaaatggaggagctgcaagaggaaaaggagtgtgagaaaccacagggcgatgaagaggaggaggaagaagaggaggaagtggaggaggaagaagtagaagaggccgaaaatgaaggagaagaggcaaagacagaaggtttgatgaaagatgacagagccgagagtcaggcttcctctctcggacagaaggtgggagaatcatccgaacaggtatccgaggaaaaaactaatgaagcttag

SEQ ID NO: 31612 - DNA, 3048 bp, Artificial Sequence
  Description of Artificial Sequence: Synthetic coding sequence
atgatgaacgccagtcagatgcagaaaatgagcaagaccatgatcctgatgctgaaaagcttttataataacaagactctgctttcgttcttcctgaggcatcttaaacgcacccgcggacgtgcccaccagaagccagtcgtgatgatgaaaatggagcatcagatgcatttccacaactattctccagtgcatatagtgataggctacaagaggttcacctccttgaaagagcacatcaagtacaggcatgagaagaacgaagacaacttcagctgcagcttatgtagctatacgtttgcttatagaacccagcttgagcggcatatgacatcccataaaagtggtagagaccaacgtcacgttacccagtctggctgtaaccgaaagttcaagtgtaccgagtgtggaaaggccttcaagtataaacaccacctgaaggaacacctgagaatccatagtggggagaaaccatacgagtgccccaattgcaaaaaaagattttctcactccgggtcttatagttcccacataagctctaagaagtgcatttccctgatacctgtaaatgggagaccgaggactgggctaaaaacttctcagtgctcaagcccttctctcagtgccagtcctggcagccctactaggcctcagattagacagaaaatcgagaacaagcctctccaggagcagctgtctgtgaatcaaattaaaactgagccggtcgactatgagttcaagcccattgtggtagcatcaggcattaactgttccactccccttcaaaatggagtgttcaccggcggaggtcccttgcaggctaccagctcccctcaggggatggttcaagcggtagtgctcccgactgtgggactcgtaagtcccatcagcatcaatctatctgatattcagaatgtgctgaaggtcgccgtggacggtaacgtcatccgccaagtccttgagaataatcaggcaaatcttgcctctaaagaacaggagaccattaacgcgtcacccatccagcagggaggccactcagtgatttctgccatctcactaccactcgttgaccaggacggcactaccaagataataattaactacagcctagagcagccgagccagctgcaggtggtaccccaaaacctcaagaaggagaatccggtggccacaaacagctgcaaaagtgagaaactgccagaggatctgacggttaagtcggagaaagataagtcgttcgaggggggagttaacgactccacctgtctgctttgcgacgactgtcccggagacattaatgctcttccagagctgaagcactatgacttaaagcaacctacgcagcctccacccctaccggcagcagaggctgagaagcccgaatctagcgtgtctagcgctactggagacggcaatttaagtcccagtcagcctccgctgaaaaatctgctttcacttcttaaagcctattacgccctcaatgcccagccctcagccgaggagttaagtaaaattgcggatagcgttaatctccccctggacgtggtgaaaaagtggttcgagaaaatgcaagccggacaaatttccgttcagtcctccgaaccttcttctccagagccgggtaaggtcaacataccggctaaaaataatgaccagccacagagtgcaaatgccaatgaaccacaggattctactgtcaacctgcagtctccactgaagatgaccaactctcctgtactgcctgtgggcagtacaaccaatggcagtagatcgtccacaccttcaccttcacccttgaacctctcatcatccaggaacacccagggttatttatacacagctgaaggggcacaggaagaaccgcaagtggagccactggatctctctctgcccaagcagcagggtgaactgcttgagcgtagcaccatcacatctgtctatcagaattccgtgtactctgtacaggaggagcctctgaacctctcctgcgctaaaaaggagccccaaaaggatagctgcgtgacagacagcgaacccgtggtcaacgtgatacccccatcagctaaccccatcaatatcgctattccaacagtaacagcacaactgcctaccatcgtcgcaatagccgatcagaacagtgttccttgccttagagccctggctgcgaataagcagactattttaatcccccaggttgcatatacttatagtacaacggtatcaccagcggtccaagaacctcctctcaaggtaattcagcccaacggtaatcaggatgagcgccaagacacttctagcgaaggggttagtaatgttgaggaccaaaatgattccgactctacgcctccaaaaaagaaaatgcggaaaaccgagaacggcatgtacgcctgcgacctgtgtgataaaatctttcagaaaagcagttcactgctgaggcacaagtatgaacatacgggaaaacggccacatgagtgcggaatatgcaagaaggctttcaagcacaaacatcatctcattgaacatatgaggctgcactccggagaaaaaccataccagtgtgacaaatgcggaaagaggttcagtcatagtggatcctactctcagcacatgaatcacaggtactcgtattgcaagagggaggccgaagagcgagattctacagaacaggaggaggctggtccggaaatactatcgaacgaacacgtcggtgcacgcgcaagccctagccaaggggatagcgacgagcgagagtccctcacaagagaagaagacgaagacagcgaaaaggaggaggaggaagaggacaaagagatggaagagctgcaggaggaaaaagaatgcgaaaagccccagggtgacgaggaggaagaagaggaagaggaagaagttgaggaagaggaggttgaggaagccgagaacgagggcgaagaggcaaaaacagaggggctgatgaaggatgaccgagccgagagccaggcaagttccctcggccaaaaggtgggagaatctagtgagcaggtctcagaggaaaagacaaatgaagcgtag

SEQ ID NO: 31613 - DNA, 3360 bp, Artificial Sequence
  Description of Artificial Sequence: Synthetic coding sequence
atggccgatggacccagatgtaaacggcgtaaacaagccaatccacgcagaaataacgttactaattacaatactgttgtggagactaatagcgattctgatgatgaggataagctgcatatagttgaggaggagtccgtcacggacgcagctgattgcgagggagtgcccgaagatgacctgcccacagaccagacagtgctgcctggccgttcttccgaacgtgagggtaacgccaaaaactgttgggaggatgatagaaaagagggtcaggaaatccttggaccagaggcacaggctgacgaggcaggctgcaccgtcaaggacgatgagtgtgaaagcgatgccgaaaacgagcaaaaccatgaccccaatgtggaagaattcctacagcaacaggacactgctgtgatattccccgaggcgccagaagaggaccaaaggcagggaacacctgaggcaagcggtcacgacgagaatggtaccccagacgcttttagccagctgctgacctgtccatattgcgatcgtggctacaaacgatttacttccttaaaggagcatatcaaatatcggcacgagaaaaatgaggacaattttagctgcagcctgtgcagctacaccttcgcgtatcggacccaattagaaagacatatgactagccacaaaagcgggcgagatcagcggcacgtaacacagtcggggtgcaaccggaaattcaagtgcactgagtgcgggaaggctttcaaatacaagcatcacttgaaggaacaccttcgaattcactctggtgaaaaaccatacgaatgtccgaattgcaaaaagaggttcagccactccggaagctacagttcccatattagcagcaaaaagtgtatcagtctgatccccgtcaatggaagaccacggacgggtctgaagacatcccaatgttctagcccaagcctgagcgcctccccaggctcccccaccagaccacaaattcgacaaaagattgaaaacaaaccccttcaggaacagctttccgtgaaccaaattaagactgaacccgtagattatgagtttaaaccaattgtggtagcaagcggcattaactgtagcacacctctacaaaatggtgttttcactggcggtggacccctccaggccacaagcagcccccagggaatggtgcaggcggtggtgttgcccaccgttgggctcgtcagccctatatcaatcaatttaagtgacattcaaaacgtgctgaaggtcgccgtggacggcaatgttattagacaggtgttagaaaacaaccaagctaacttggcttcaaaagagcaggagactatcaatgcctcccccattcaacagggagggcatagcgtgatctccgctattagcttaccactcgttgaccaggacggcactacaaagatcattatcaattactctttggagcaaccttcacagctgcaagttgtacctcagaacctcaagaaggagaacccggtggccacaaatagctgtaagtcggagaaactgcctgaggacctgactgttaagagtgaaaaggacaagtcttttgagggtggcgttaacgactcaacgtgtttattgtgcgatgattgtcccggagatattaatgccctaccagaattgaagcattatgacctgaaacagcctacacaaccacctcccctgcccgcagctgaagccgaaaagcccgagagctctgtaagttcggcaaccggggatggcaacctgtcacctagtcagccaccactgaaaaatctcctaagcttgttgaaagcttattatgcactcaacgctcagccctctgcagaagagctctccaaaatcgccgactccgtcaatctgcccctcgatgttgttaagaagtggttcgagaagatgcaggccggtcagatatcagtacaaagttcagaaccatcgagccccgaacccggaaaggttaatattccggcaaaaaataacgaccagccccaatctgctaatgcaaatgagcctcaagattcaactgtgaaccttcaaagcccattgaagatgacaaatagcccagtgctgccagtagggagcactactaacggcagccggtctagcactccaagcccttcccctttgaatctctccagtagtagaaacactcagggatatctatatactgctgagggcgctcaggaggagccgcaggttgaaccccttgacttgagtctgccaaagcagcagggtgagctactcgagcgttcttctctgcctgagcagtgtctgttctgtccaggccgtaccctggaactggttctgaaaaaggagcctcagaaggattcctgcgtgaccgactccgaaccggtagtgaacgtaatcccaccctccgccaaccctatcaatatcgcaatccccaccgtgactgcccaactgcctaccattgtggcaatagctgatcagaatagtgtcccttgcctgcgcgctttggctgcgaataagcagaccattcttatacctcaggtcgcatatacatatagcaccacggtgtctcctgctgtccaggaaccaccactaaaggtgatccagcccaacggcaatcaggacgagcgacaagacacctcatccgagggcgtttccaatgtggaggatcagaacgattcagattccactcccccaaagaagaagatgagaaagaccgaaaacgggatgtacgcttgcgatctgtgtgacaagatctttcagaaaagctcctccctccttagacacaagtatgagcataccggcaaacggccacatgaatgtggtatatgcaagaaagcctttaaacacaaacatcatctcattgaacacatgcggctgcactccggagaaaaaccgtatcagtgtgacaagtgtggaaagaggttcagtcattctggaagctactctcagcatatgaatcatagatactcgtactgtaagagggaagctgaggagcgcgattcaacagagcaggaggaggccggtccggagattctttccaacgaacatgtgggtgctagagcctcaccctcacagggagattcagacgaacgagagtccttgacacgcgaggaggatgaggattccgagaaagaagaagaagaagaagataaggaaatggaggaacttcaggaggaaaaggagtgcgagaaacctcagggtgatgaggaggaagaggaggaggaagaggaggtggaagaagaggaggtggaagaggcagagaatgagggcgaagaagccaagaccgagggtttaatgaaggacgacagagcggagagtcaggctagttccctgggacaaaaggtgggcgagagttctgaacaggtctctgaagaaaagactaatgaggcctag

SEQ ID NO: 31614 - DNA, 834 bp, Artificial Sequence
  Description of Artificial Sequence: Synthetic coding sequence
atgaaagtcaccaactataatacagtagtggaaactaactctgattcggacgacgaagacaaattgcacattgtagaagaggagagtgttacagacgccgcagactgtgagggcgtgcctgaagacgacctcccaaccgaccagactgtcctaccaggacgcagctccgagagggagggcaatgctaaaaactgttgggaagatgatactggcaaagagggtcaggagattttgggcccagaggcccaggctgacgaagccggttgcactgtaaaagacgacgagtgtgagtccgacgccgagaatgaacaaaatcatgatccaaatgtcgaagaattcttgcagcagcaggacaccgccgtcattttccctgaagccccagaggaggaccagaggcagggcaccccagaagcaagtggtcatgatgagaacgggacacccgacgccttctcccagctgcttacatgcccctactgcgacagggggtataaacgtttcacgtctctgaaggaacatattaaataccggcacgaaaagaacgaagataacttctcctgctccttgtgctcttacaccttcgcgtataggacacaacttgaaagacacatgaccagccacaaaagcggaagggaccagcgacatgtgactcagtccggctgtaatcggaagttcaaatgcaccgagtgtggaaaagcattcaaatataagcatcatcttaaggagcacctccggatccattccggagaaaagccttacgagtgccctaactgtaagaagaggttcagccactccggaagctattcttcccatatctcatccaaaaagtgcatctag

SEQ ID NO: 31615 - DNA, 3315 bp, Artificial Sequence
  Description of Artificial Sequence: Synthetic coding sequence
atggcagatggcccacggtgcaagcgcagaaagcaggcaaaccctcgccgaaataacgttaccaactacaacacggtggtcgaaacaaactccgactctgatgatgaggacaagctacacattgtggaggaagagagcgttactgacgccgctgattgtgagggtgtaccagaagacgatctgcccaccgaccagacagtgctgccagggaggagctctgagagagaggggaatgccaagaattgctgggaagacgacattaaggatgacgagtgtgaaagtgacgccgaaaacgaacagaatcatgatcccaatgtggaggaattcctgcagcagcaagataccgccgtgatcttccccgaggcacccgaggaggatcagcgccaggggacgccagaggccagcggacacgatgagaacggcacccccgacgccttcagtcaattgctgacctgcccatactgcgacagaggatacaagagatttacctcactcaaagagcatattaagtatcggcatgagaagaatgaggataacttttcctgtagcctgtgtagctatacgttcgcctatcggactcagctggagaggcacatgacctcccacaagagtgggagagatcagaggcatgtgacacagagcggctgtaaccgcaagttcaagtgcactgagtgcgggaaagcttttaagtacaagcaccatttaaaagaacatttgaggattcattctggcgaaaaaccttacgagtgtccaaactgtaagaagagatttagtcactcaggatcatattcctctcacatctctagcaagaagtgtataagtctgattcccgttaacggaaggcccagaaccggactcaaaactagccaatgttctagccctagcctatccgcctcaccaggctcccccaccagaccccaaattcgtcagaagattgagaacaaaccattgcaagaacagctatctgtgaatcagatcaaaaccgagccagttgactacgagttcaagcctattgtcgtggctagcggcataaattgcagcactcctctgcaaaacggggtctttacaggaggagggccattgcaggccacgtccagcccccagggaatggtacaggccgtggtgctgccaacagtcggattagtgtccccaatcagcatcaacctgagcgacattcagaatgtgttaaaggttgctgtcgatggcaacgtcatcaggcaagtgcttgagaacaatcaggccaacctggcgagtaaggagcaggagaccatcaatgccagccccatccagcaaggcggacattcagtgatcagcgccatctctctgcctttggtggaccaagacggcaccacaaagattattatcaactatagcttagaacagccttcccagctacaggtagtgccccagaatttgaaaaaagaaaatcctgtcgccacgaactcttgtaaatccgaaaaacttccggaggacctgactgttaaaagtgaaaaggacaagtcttttgagggaggcgtaaatgacagcacctgcctactctgcgacgactgtcctggagacattaacgctctgcccgagctcaaacactacgacctgaaacagcccacacagccccctcccctgccagctgccgaggcagagaagccagagagctccgtctccagtgctacaggcgatggaaatctgtccccttctcagcccccactgaaaaatcttctgtccctacttaaagcttactacgcactgaacgcccagccctcagcagaggaattgtctaagatcgccgattccgtgaacctgcccctcgatgtcgtgaagaagtggttcgaaaagatgcaagctgggcaaatatcagtgcagtcctcagagccttcctcgccagagccagggaaagtgaatattcctgctaagaataatgaccaaccgcagtccgccaacgctaatgagcctcaggacagcaccgtgaatctgcagtctccactaaaaatgactaattcaccagttctgcctgtcggctctactaccaacggctccaggagcagcactccaagtccctcccctttgaatctctcttcttccaggaacactcagggatacctgtatacggctgagggtgcccaggaggaaccccaggtcgaacctctcgatcttagccttcccaaacagcagggagagctgctcgagcgttcgacgatcacaagtgtctaccaaaacagcgtctattctgtgcaggaagagccactcaacctctcttgcgcgaagaaggagccacagaaggacagctgcgttactgactcagagccagtggtgaacgtgatccctccatcagcaaacccgattaatattgccataccaacagtgactgcacagctgccgaccattgttgctatcgccgatcagaactccgtgccatgtctgagggccctggccgcaaacaaacaaactattctgattccccaggtagcttatacctacagcacaactgtgtcccctgcggtccaggagccgccactgaaggtaattcagccaaacggcaatcaggacgagcgccaggataccagctctgagggtgtgtccaacgttgaggaccagaacgacagcgactccacaccacctaaaaagaaaatgaggaaaacagaaaatggtatgtacgcgtgcgacctgtgcgacaaaatattccagaagtctagctctctcctgcgacataagtacgaacatacaggaaagagacctcatgaatgcggaatatgcaagaaggcttttaaacataagcatcacttgatcgagcacatgcgactccattccggggagaagccttatcaatgtgataagtgtggaaaacggtttagtcactctggaagttatagtcagcacatgaaccaccgctactcttactgcaagcgcgaggcagaggagcgggacagcactgaacaggaggaagccggtcctgagatcctgagcaacgagcacgttggggctcgcgcatcaccgtctcaaggggactcagacgaacgcgaatcgctgactcgggaggaagacgaggactctgagaaagaagaagaggaagaggataaggagatggaagagttgcaagaagagaaggagtgtgagaagccacagggtgacgaggaggaagaggaggaagaagaagaagttgaagaggaggaggtggaggaggctgagaatgagggcgaggaggccaaaaccgagggcctcatgaaagatgatagggctgagagtcaggcctcgtctctgggccaaaaggtgggggagtcatctgagcaggtgtctgaggaaaagacaaatgaggcctag

SEQ ID NO: 31616 - DNA, 3645 bp, Artificial Sequence
  Description of Artificial Sequence: Synthetic coding sequence
atgaagcaaccgattatggccgacggcccacggtgtaaaaggagaaaacaggccaatccacgcagaaaaaatgtagtgaactatgataacgtcgtggacaccggctcagaaacagatgaagaggacaagcttcacattgccgaagatgacggaatcgcgaatccgttggaccaggagacgtcacccgcttcggtccccaaccatgagagctcaccacacgtttctcaggcactgctgcctagagaggaagaggaagatgagatcagggaagggggagtagaacacccatggcataacaacgagatcctacaggcttccgtggacggcccagaagagatgaaggaggactacgacaccatgggtccggaggctaccatacagactgccatcaataatggaactgtcaaaaacgccaattgcacgtcagacttcgaggagtacttcgcaaaacgaaagctcgaggaacgggatggacacgcggtctccatagaggagtatctccagaggtcagatactgccatcatctacccagaggccccagaagagttgtcccgcctcggtaccccggaggcaaacgggcaggaagaaaacgatttgccacctggaacacccgatgccttcgcacaacttttgacctgcccctactgtgatagggggtataaacgtctgacctctttgaaggagcatatcaagtacaggcatgaaaaaaatgaggaaaactttagctgtcccctgtgctcctatacctttgcctatcggactcagctggaaaggcatatggtgacgcacaaaccgggaacagatcagcaccaaatgctgacgcagggagccggtaacaggaaattcaagtgcaccgagtgtggtaaagccttcaaatataagcatcacctaaaggagcaccttagaatccactctggggaaaaaccgtacgagtgcccaaactgcaagaagcggttcagccattcaggctcttactcctcccacatatctagcaaaaaatgcataggtctgatcagtgtaaacggacgaatgaggaacaatatcaaaaccggttccagcccaaatagcgtctctagttctcccactaactccgctattacgcagctgcggaacaaattggagaatgggaaacccctatctatgtctgagcaaacaggcttgctcaagatcaaaacggaacccttggatttcaatgattacaaggtccttatggctacccatggcttcagtggaacttcaccatttatgaacgggggactgggggctacaagccccctgggagtccacccctctgctcaatcccctatgcaacatctgggagttggaatggaagccccactcttaggattccctactatgaacagtaatctcagcgaggttcagaaggtgcttcagattgtcgacaatacggtgtcccggcagaagatggactgtaaagcagaagaaatctcaaaactgaaaggatatcatatgaaggatccgtgttctcagcctgaagaacagggcgtcacttcaccaaacattccacctgtcggactgcccgtggttagtcataatggagcaaccaaatccatcattgactataccttagagaaggtaaacgaagcaaaggcgtgtctgcagagtctgaccacagactcaagaaggcagatcagcaatatcaagaaggaaaaactaagaacgctgatcgatctggttacggatgataagatgattgaaaatcacaacatatcaacacctttcagttgccaattttgtaaggagtctttcccaggcccaatacctctccaccaacatgaaaggtatctatgtaaaatgaacgaggaaattaaggcagtactgcagcctcatgaaaacatagtgcctaacaaagccggtgtcttcgttgacaacaaagcactcctcttaagcagcgttctgagtgagaaaggcatgacaagtccaattaatccctacaaggatcacatgtctgtactcaaggcctactatgcaatgaacatggagcccaattctgacgagttgcttaaaatcagcatagctgtcggtttacctcaggagttcgttaaagaatggtttgaacagagaaaggtgtaccaatactcgaatagccgctccccgtccttggagcgtagctcgaagcctcttgcaccaaacagcaaccctcccaccaaggactctctgctcccacgaagtccagtgaaacccatggactccataaccagcccctccattgccgaactgcataatagcgtgactaactgtgatccacccctgcgactgactaaaccgtcgcacttcactaacatcaagccggtcgagaagctggatcattcaagaagcaataccccatctccgctgaatttgagctcaacaagttctaaaaacagtcatagtagttcctacacccctaacagtttctccagcgaagaattacaggccgaacctcttgaccttagtctgcccaaacaaatgaaagaacctaaaagtataatagccacaaagaacaagaccaaggccagtagcatctccctggatcacaatagcgtttcttcatccagtgagaactccgacgagccactgaatctaaccttcataaagaaagagttttctaacagcaacaaccttgacaacaagtctacgaaccctgtattttccatgaacccattttccgcaaaaccactgtacacagcgcttcccccacagtctgcattcccgcctgccactttcatgccaccggtgcaaacgtcgatccccggactgcgtccttaccctgggctcgatcagatgtcgtttttaccccatatggcctacacctatcctacaggagccgcaaccttcgcagatatgcagcaacgccgaaagtaccaaagaaagcagggttttcagggcgaattgttagacggcgcacaggattatatgtctggtctcgatgatatgaccgactctgattcctgcctgtccagaaagaaaattaagaaaacggagagcggaatgtatgcatgcgacctgtgcgacaagacgttccagaagagcagttctctgttgcggcacaagtatgagcacacgggcaaacgccctcaccagtgccagatctgtaaaaaggccttcaaacataagcaccatttaatagagcatagtcggctgcattcaggcgagaagccttatcagtgtgacaagtgcggaaaacgcttctcacactcggggagctactctcaacacatgaatcacaggtactcatattgtaaaagagaggctgaggaaagagaagctgcagagcgagaggcaagggagaagggccaccttgagcccacagagctcttgatgaaccgcgcatacctacagagtattacccctcagggctactccgattctgaagagcgtgagagcatgccgagagatggggagagcgagaaagaacacgaaaaggagggtgaagatgggtatgggaaacttgggagacaggatggcgacgaggagtttgaggaggaagaagaggagtctgaaaataaaagtatggataccgatcccgaaaccattcgcgatgaggaggagacaggcgaccactccatggacgattccagcgaagatggcaagatggaaacaaagtctgaccatgaagaggacaatatggaagatggcatgtag

SEQ ID NO: 31617 - DNA, 1275 bp, Artificial Sequence
  Description of Artificial Sequence: Synthetic coding sequence
atggcagatggacctaggtgcaaacgtagaaaacaagccaatccacgcagaaaaaatgtggtcaattatgacaacgtggtggacaccggctccgagaccgatgaagaggacaaattgcatatcgccgaagacgacggaatcgctaacccgctagaccaggaaacttcccccgcttcggtccccaatcatgagagctcaccacatgtcagtcaagccctgctgccgagggaggaggaagaggatgagatcagggaaggaggagtggagcatccatggcacaataacgagatcctccaggcatctgtggacggtcctgaggagatgaaggaggattacgataccatgggcccagaagctacaattcagaccgccatcaataatgggactgtgaagaacgcgaactgtacaagcgattttgaagagtactttgccaagcgtaagcttgaagagagggatggccacgcagtctctatcgaagaatacctacagagatcagataccgccatcatttaccccgaggcacctgaagagctcagccggttgggcacacccgaggccaacggccaggaggaaaatgacttgcccccaggaactcctgacgcatttgctcagcttctgacatgtccctactgtgatagagggtacaaacgtcttaccagcctgaaggaacacattaaataccgtcatgagaaaaacgaggagaatttcagttgtcctttgtgttcctatactttcgcctataggactcagctggaacggcatatggttacacataagccagggactgatcaacatcaaatgctcacccaaggtgccggaaatcggaaatttaaatgcacagagtgcgggaaagcatttaagtacaagcaccatttgaaagagcatcttcgaatccactccggagagaaaccttacgaatgcccgaattgcaagaagcggttctcacacagtggctcctactcaagccacatctcatccaaaaagtgcattggacttatctccgtcaatggacgaatgaggaataatatcaaaacagggagctcccctaactcagtgagctcaagtcccacgaactccgctataacacagctacggaacaagctggaaaacggtaagccactgtcaatgtccgagcaaaccgggttactgaagtccgggcgtgcccagtggctgacgcctctgatccccgcactgctcgaggccgaagtggggaggtcacgtggacagaagatagagactctactcgccaatatggttgagcccagactgtattag

SEQ ID NO: 31618 - DNA, 1320 bp, Artificial Sequence
  Description of Artificial Sequence: Synthetic coding sequence
atgaagcagcccatcatggcagatggaccacgatgcaaacggagaaaacaggccaaccccagacgtaagaatgtggtgaactatgacaatgtggtggacactgggagtgagacggacgaagaggacaagcttcatatcgccgaagatgatggcattgctaatccattggaccaagaaacgtccccagcatccgtcccaaatcatgagtcaagcccccacgtgagtcaggccctgctgccacgtgaagaagaagaggatgaaatcagggaggggggagtggaacacccatggcataataatgagatccttcaagcttcagttgacggaccagaggagatgaaggaagattacgacacaatggggccagaggccactatacagacggcaataaataatggcacagtcaagaacgccaactgcacatcagacttcgaagagtacttcgctaagagaaaactagaagaaagagatggccacgcggtctctatcgaggaatacctgcagagatctgacacagcaattatctacccagaagctcccgaagagttgagcaggctgggaacccctgaagccaacggtcaggaggagaatgacctgccacccggaaccccagacgcatttgctcaactgctcacttgtccttattgcgataggggctacaagcggctgaccagccttaaagagcacatcaagtacaggcacgagaagaatgaagaaaacttctcctgtcccctctgctcctatacctttgcctaccgcacccaactggagagacacatggttactcacaaaccgggaacagatcagcatcagatgctgacccagggtgctgggaatcgcaagttcaaatgcacagagtgcggaaaggccttcaaatataaacaccatctcaaggagcatctgagaatccattctggagagaagccctatgaatgtccaaattgtaagaaacggttttcacactcgggatcttattcctcacatatctcctcaaaaaaatgtatcggtctgatcagtgttaacgggcgaatgcgtaataatatcaaaactggctcttcgcccaatagtgtctcatccagtccaacaaacagtgctattacgcagctgaggaacaagcttgagaatggcaagcccttaagcatgtctgagcagacaggcctgctgaagatcaagaccgagcctctagattttaacgactacaaagtcctgatggctacccacggatttagcgggacatctccattcatgaacgggggattaggggctacttcccccctgggagtacatccttcagctcagtcgcctatgcagcacctgtag

SEQ ID NO: 31619 - DNA, 408 bp, Artificial Sequence
  Description of Artificial Sequence: Synthetic coding sequence
atgaaacagcctattatggctgacgggcctcggtgcaaaaggaggaagcaggccaacccaaggagaaagaacgtggtgaactatgacaacgtagtggacaccggaagtgagaccgatgaggaggataagctgcacattgccgaagatgacgggatcgctaatcctttagaccaagagacttcacctgctagtgttccaaatcatgagagttccccacacgtcagccaggccttgctccctcgagaggaagaggaagatgagattagggagggcggagttgagcacccctggcataacaacgagattttgcaagcttccgtggacggccctgaagagatgaaagaagactacgacacaatgggacctgaggccacaatacagacagccatcaacaatggtacagggtag

SEQ ID NO: 31620 - DNA, 3645 bp, Artificial Sequence
  Description of Artificial Sequence: Synthetic coding sequence
atgaagcagccaatcatggctgacggtccacgttgtaaacgcagaaagcaggcaaacccacgccgaaaaaacgtggtgaactacgataatgttgtggatacagggtcggagaccgacgaagaagacaaactgcacatcgccgaggacgacggaatagccaacccgttggatcaggagacctctcccgcttctgtccctaaccacgaatcatcgcctcatgtatcacaggctctgctgccacgcgaggaggaggaggatgagatacgcgagggtggcgtggagcatccttggcataacaatgaaatcctgcaggcctctgttgacggcccagaggagatgaaagaggattacgatacaatggggccagaagcgaccattcagacagccatcaataacggcaccgtgaagaatgcgaactgcacgagcgattttgaagagtatttcgctaaaagaaaactggaggagagggatggccatgccgtgagcattgaggagtacttgcaaagaagtgacacggcaatcatttatccagaggcaccggaagagttaagcagactgggcacgcctgaggcaaacggccaagaagagaacgatctcccgcctggcacccccgatgccttcgcacagctgcttacgtgcccatactgcgatagaggctataagaggcttaccagtctaaaggagcacatcaagtaccgacacgaaaagaacgaagaaaacttctcctgccccttatgcagctatactttcgcttaccgcacacagctggaacgccacatggtcacccataaacccggtactgaccagcatcagatgctgacccaaggtgccggaaatcggaaattcaaatgcacagagtgcgggaaagcttttaagtataaacatcacttgaaagagcatcttcgcatccactctggagagaagccttatgagtgccctaactgtaagaaacgcttctctcatagtggatcttatagctcgcatatttcttctaagaaatgtatcggactgatctcggttaatggcagaatgcggaacaatataaagacaggcagctcccctaactccgttagttcctcccctactaatagcgccatcacacaacttaggaataaactcgaaaacggcaagcccctgtctatgtccgagcaaaccggccttctgaagattaaaacggaaccgctagattttaatgactacaaagtcctgatggcgactcatggcttttccgggacgtctccctttatgaatggaggtctgggagccacgtcgcccctgggagtgcaccctagcgcacagagcccaatgcaacaccttggggtgggtatggaagcccctttgctcgggttcccaacgatgaactctaacctcagcgaagtccagaaggttctgcagatcgtggataacaccgtcagtagacagaaaatggattgcaaagctgaggaaatctcaaagcttaaggggtaccacatgaaagatccttgctcacaacctgaggaacaaggggtgacttccccaaatatacccccagtgggattgcccgtggtcagccataacggggcaaccaagagcataattgattataccctcgagaaagttaatgaagcgaaggcctgcttacaaagtctgacaaccgatagccgacgacaaatttctaatatcaagaaggaaaagctccggacacttatagatttagtcaccgacgataagatgatcgaaaatcacaacatcagcactccattttcctgccaattctgtaaggaatccttccctggtccaatcccactgcatcagcacgagcgctacctgtgcaagatgaacgaagagataaaggcagtgctgcagccacacgagaatatcgtgccaaacaaggctggtgttttcgtcgataataaggcacttctcctgagctcagttctctccgaaaaggggatgacgagcccaattaatccgtataaagaccacatgagcgttctaaaagcctattatgccatgaatatggaacctaactctgatgaactactgaaaatctctatcgctgtgggcttgccccaggagttcgtcaaagagtggttcgagcagagaaaggtgtaccagtattccaactccagatctccttcactcgagcgttcttctaagcccttggctccgaatagcaatccacctactaaggacagcctactccctaggagtcccgtgaagccaatggactcaataaccagtccgagtatagctgagctgcataactctgttaccaattgtgaccctcccctgcgcctgactaagccttcccattttactaatattaagccggtcgagaagcttgaccactcaagaagcaatactcccagccccttgaaccttagctccacatccagcaagaacagtcatagtagttcctacacgccaaactccttcagctcagaggaacttcaggccgaaccactggacctgagtctgcccaaacagatgaaagagccgaaatcaataatagccaccaagaataagacaaaggcttcgagtatctctctggaccataatagtgtgtccagctcctcggagaattcagacgagcctctgaacctgacatttatcaaaaaagaattctctaattccaataaccttgacaacaagtcaacaaatcctgtgttttccatgaaccctttttcagcgaaacccttgtacacggccctgcctcctcaaagtgcattcccccctgccacattcatgcctccagttcagacatctatcccaggcctgcgtccataccctggacttgatcagatgtcttttctgccccatatggcatacacatatccgaccggtgccgctacttttgcagacatgcagcagagacgcaaatatcagcgtaagcagggttttcagggagagctgctggacggggcacaggattatatgtctggacttgatgatatgaccgatagtgactcttgtctgagccgaaagaaaataaagaagactgaaagtggcatgtacgcgtgcgacttatgcgacaaaaccttccagaagagcagctctttactgagacacaaatacgagcacactggtaaacgtccccaccagtgtcagatttgcaagaaagcgtttaagcacaaacaccatttgatagagcacagcagacttcatagcggagaaaagccatatcagtgtgacaaatgcggcaaaagatttagccactcgggctcttacagccagcacatgaatcaccgctatagttactgtaagcgggaagcggaagagagagaggcggcagagagggaggcccgagaaaagggccatctggagcccaccgagctccttatgaatcgggcttatttgcagtccatcacgccccaaggctacagcgactctgaggaacgcgagtccatgcctcgtgacggcgagagcgaaaaggaacacgaaaaagaaggtgaggacggctatggcaagttgggcagacaggacggagacgaggagttcgaggaagaggaggaggagagtgagaacaaaagtatggacaccgatcctgagaccattagagatgaggaggagacgggagaccactctatggacgactctagcgaagacggtaaaatggagaccaaatctgaccacgaagaggataatatggaagacggtatgtag

SEQ ID NO: 31621 - DNA, 2109 bp, Artificial Sequence
  Description of Artificial Sequence: Synthetic coding sequence
atgaagcagcctattatggcggatggacctcgctgtaaaaggagaaaacaggccaatcctagaagaaagaatgtcgtaaactatgacaatgtggtcgacactggctccgagacagatgaggaggacaaactgcacatcgccgaagatgacggcatcgcgaatccgctagatcaggaaacctccccagcaagcgtccctaatcacgagtcttccccccacgtctctcaggctcttctccctcgagaagaggaggaggatgaaattcgggaggggggtgtggaacatccttggcataacaacgagatccttcaagcatccgtggacggcccagaggaaatgaaggaagattatgacacaatgggtcccgaggcaaccattcagaccgccatcaataacggcaccgtcaaaaacgccaactgtaccagcgattttgaggagtacttcgctaagcgtaagctggaggagcgggacgggcacgctgtgtcaatcgaggaataccttcaacgatccgataccgcaatcatctatcccgaggctcctgaggaactgagtaggctcgggacacctgaggctaacggccaagaagagaacgatctgcccccaggcacacctgatgctttcgctcaactgctgacgtgcccatactgtgatcgcggttacaaaaggctgacgagcctgaaagagcatattaagtaccgccacgagaagaatgaagagaacttcagctgccccctctgtagttatacattcgcgtaccgcacgcaattggagcggcacatggttacacataaaccgggaaccgaccagcatcagatgcttacccagggcgcagggaacagaaagtttaaatgtaccgagtgtgggaaagctttcaagtataaacatcacctgaaggagcatttacggatacacagtggggagaaaccttatgagtgtcccaactgtaaaaaacgcttttcccattctgggagctactcaagccatatctcgagcaagaagtgtatcggcctgataagtgtgaacggcagaatgaggaacaatattaaaaccggatcgtctccgaattctgttagctcatcacctaccaacagcgccatcactcagctgaggaacaagcttgagaacggcaagcccctgtcgatgtctgagcaaaccgggctcctgaaaatcaagacggagcccctcgatttcaatgactacaaagttcttatggccacccacggattctctggcacgagcccattcatgaacggcggattaggcgctacgagcccactgggtgttcatccctcagcccagagtccgatgcaacatctgggtgttggaatggaggctcctcttctgggctttcccacaatgaattccaatcttagtgaggtgcagaaagtgctgcagattgtggataataccgtgagccgacagaagatggactgcaaggcggaagagatctccaagctcaagggctatcacatgaaggacccttgttcacaacccgaggagcagggtgtgacatccccgaatatcccccctgttggactcccagtggtgtcacacaacggagcaactaaatccattatcgactatactctcgaaaaggtgaacgaggctaaagcctgcctgcagtcactaaccacagatagtcggaggcaaatttcaaacatcaaaaaggagaagcttcgtaccttaatcgacctggtgacagatgataaaatgatcgagaatcacaacatttctacaccgttttcctgccaattctgcaaagagtcttttccaggaccaatcccacttcaccagcatgagcgttacttatgcaaaatgaatgaagagataaaagccgttctgcagccacacgagaatatagtacctaacaaggccggagtgttcgtcgacaataaggctttgctgctcagttcagtgctgtctgagaagggcatgacttcacctattaacccatataaggaccacatgtcggttttgaaggcttactatgctatgaacatggagccaaatagcgacgaactcctcaaaatctctatagcagttggtctgccccaggagttcgttaaggaatggttcgagcaacgtaaggtataccagtattcaaactag

SEQ ID NO: 31622 - DNA, 276 bp, Artificial Sequence
  Description of Artificial Sequence: Synthetic coding sequence
atgaagcaaccaatcatggcagatgggcctcggtgtaaacgaagaaaacaagcgaaccccaggagaaaaaatgtggtgaactacgataatgtagtggacacaggtagcgagactgatgaggaagataagctacacattgccgaggacgatggcattgctaaccccctggaccaggaaacatctcccgcatctgtccccaaccatgaatcttcacctcatgtcagtcaggcactgctgcccagagaggaggaggaagatgagatccgtgagggttag

SEQ ID NO: 31623 - DNA, 192 bp, Artificial Sequence
  Description of Artificial Sequence: Synthetic coding sequence
atgaaacagcctatcatggcagatggccctcgttgcaaacgaaggaagcaggccaacccgagacggaagaacgtggtaaactacgataatgtggtggataccgggtctgaaactgatgaggaagataagctgcacatagccgaagatgatggaattgccaacccactcgaccaagagacatctcccgcttag

SEQ ID NO: 31624 - DNA, 3573 bp, Artificial Sequence
  Description of Artificial Sequence: Synthetic coding sequence
atgaagcagcctatcatggctgacggaccacggtgcaagcgaagaaagcaggccaaccctcggcgtaagaacgttgtaaattacgacaacgtggtggacactggctctgagactgatgaggaggacaaactacatatagccgaggacgacggcattgccaacccccttgatcaggagacatccccagccagcgtacctaatcacgagtcatctcctcatgtaagtcaggccttgctgccaagggaggaggaagaggacgaaatacgcgaaggcggagtcgaacacccttggcataataatgaaatcttgcaagcctcggtcgatgggcctgtgaaaaatgccaattgtacgtcagacttcgaagagtatttcgcaaagcggaagttagaagagcgcgatgggcacgccgtctccattgaggagtacttgcagagatccgacaccgccataatctatcctgaggcacctgaggaactatccaggctcggcacccccgaagcgaatggacaggaggagaacgacttacctcccggtacgccagatgcattcgctcagctgctcacatgtccctactgtgaccggggttacaagagattgacatctctgaaggagcacatcaaatataggcacgaaaaaaatgaggaaaactttagttgccccctttgctcttacactttcgcatacagaacccaactggaaagacacatggtgactcacaaaccaggaaccgaccagcaccagatgctgacccaaggagcagggaacagaaagttcaagtgcactgagtgcggcaaggcctttaagtacaaacaccaccttaaagaacatctaagaatccacagtggagaaaagccgtatgagtgccctaactgtaaaaaaaggttttctcattctggcagttactcatcacatatctcaagtaagaaatgtatcgggctgatcagtgttaatggaagaatgagaaacaatattaagacgggctcgtccccgaatagcgtttcaagttctccaacaaatagtgctataacccagttgcgcaacaagctcgaaaacgggaaacctttatctatgtctgagcagacaggattattgaagatcaaaaccgagcctctggattttaatgactataaagtgctaatggctactcatgggtttagcgggacatctccctttatgaacggtggactgggcgcaacatcgccactaggtgtgcatccttctgctcagagccctatgcagcatctcggcgttggtatggaggctcctttgctgggttttccaacgatgaactccaatctgtcagaggtgcaaaaggtgctccagattgtggacaatactgtaagtcgccagaagatggactgcaaggctgaagagattagcaagctgaagggctatcatatgaaggacccatgcagccagccggaggaacaaggtgtcacatctccaaatatccctcccgtgggtttgcccgtagtttcccacaatggcgctaccaagtccataatcgactatacgctagaaaaggtgaacgaggccaaagcatgtctccaaagtttgaccaccgattcaaggcgccagatctcgaacattaaaaaagaaaaactgcgcactttgatcgatttagtcacagacgataagatgatcgagaaccacaatatctcgacaccattttcttgccagttctgcaaggagtcttttccagggccaatcccattgcatcaacatgagcgatacctctgcaaaatgaacgaagagattaaagccgtgcttcagccacacgaaaatatcgtgccaaacaaggcgggagtctttgtagacaacaaggctctcctgctctcctctgtcctaagcgagaaaggtatgactagtcctatcaacccatacaaagaccatatgagcgtgttgaaggcttactacgccatgaacatggaacccaatagtgatgaactgttaaaaatttccattgccgttggcctgccccaggagttcgtgaaggagtggttcgagcagcgcaaggtgtaccaatacagcaacagtcgctcaccttcacttgaaaggtcctctaagcctttggctcccaatagcaaccctcccaccaaggactctttacttccgagatcgcccgtcaaaccaatggacagcatcacttccccttctattgccgagctccataacagtgtcacaaactgtgatccacccctgaggttaaccaagccgtcccactttaccaacattaagccagtcgaaaaacttgatcacagccgatcaaacaccccaagccctctgaacctctcctctaccagctcaaagaattcgcactcctcaagttatactccaaacagcttttctagcgaagagctacaggctgagccgctggacctcagcttgccaaagcaaatgaaggagcctaaaagcattattgctaccaaaaataagaccaaggcatcttctatctccctggaccacaattccgtctccagtagctctgagaattccgacgaacctctgaacttgaccttcatcaagaaggagttctccaacagcaataacctggataacaagagcacaaacccggtcttttccatgaaccctttttccgcaaagccactgtacaccgcccttcctccgcagtcagcatttccaccggcaacattcatgcccccagtccaaacgagcattcctgggttgcgaccttatcccggtctcgatcagatgtcttttcttccccacatggcatacacctatccaaccggagccgctaccttcgcagatatgcaacaaaggcgcaaatatcagagaaaacagggcttccagggtgaactgctcgacggtgcacaggattacatgtctgggcttgatgacatgaccgattccgactcatgcttgagcaggaaaaaaatcaaaaaaacagagagtggaatgtacgcatgcgacttgtgcgacaagacgtttcagaaatccagttcacttctgcgacataaatacgaacatactggaaagaggcctcatcaatgtcagatttgtaaaaaagcatttaagcacaagcatcacctcattgaacacagccgtctgcactctggagaaaagccttatcaatgcgacaagtgtgggaagaggttctcccattcaggttcatactctcagcacatgaaccaccgctatagctactgcaaaagagaagcagaagagagagaggcagcagaacgggaagcacgcgagaaaggtcaccttgagccaacagagctcctgatgaatcgcgcttacctccagtccataaccccacagggctacagtgactcagaagagcgcgagtccatgccccgtgacggagagtctgagaaagagcacgagaaagagggtgaggacggatacgggaaactgggccgacaagacggagatgaggaattcgaggaagaagaggaagaaagtgagaacaagagcatggacaccgaccccgaaacgattagggatgaagaagagacaggggatcatagcatggacgatagttcagaagatggtaagatggaaaccaagagcgaccatgaagaagataacatggaagacggcatgtag

SEQ ID NO: 31625 - DNA, 3645 bp, Artificial Sequence
  Description of Artificial Sequence: Synthetic coding sequence
atgaagcaacctatcatggcagacggcccaaggtgtaagcgcaggaagcaggctaacccaaggcggaaaaatgttgttaattatgataatgtggtcgatactgggtctgagactgacgaggaggacaagctccacattgccgaagatgacggtatagctaatcccctggaccaggaaacctctcctgcaagcgtgcccaatcacgaatccagtcctcacgtgtcgcaggctctgttacctcgtgaggaagaagaagacgaaatccgtgaaggtggggtggaacacccttggcacaataatgaaatccttcaggcatctgtcgatggcccagaagaaatgaaggaggactatgacactatggggcctgaagccaccattcaaactgccatcaataacggcaccgtcaaaaacgcaaattgtacaagcgactttgaagagtatttcgccaaaaggaagcttgaggagcgggacggccacgctgtgagcatagaggagtacttacagaggtccgacaccgctattatatatcccgaagcccctgaggagctgtccaggcttgggacgcccgaggccaatgggcaggaggagaacgacttgcctcctggcactccagatgcctttgcccagctgctgacatgcccatactgtgaccgcggttacaagcgcctgacatccttgaaggagcatattaaatatagacatgagaagaatgaggaaaacttctcctgtcccctgtgttcatatacatttgcttacaggacacaattggagagacacatggtgacgcataaaccgggtacggatcagcaccagatgcttactcaaggggctggaaatcggaaattcaagtgcactgagtgcggaaaggcctttaaatataaacaccaccttaaagaacacttacggatccatagtggggaaaagccttacgagtgcccaaactgcaaaaagcgcttttctcactctggatcctatagttcgcacatcagctctaaaaagtgtatcggactgattagtgtcaatgggagaatgcgtaacaatatcaaaactggcagcagcccaaatagtgtcagctcgtccccaactaattccgcaattacacagctaagaaacaaactcgaaaacggtaagccacttagcatgagcgagcagaccggtctcctgaagatcaaaaccgagcctctagacttcaatgattacaaagtgctgatggctacccatggattttcaggcacgtccccattcatgaacggtggcctcggcgcaacgagtccactcggcgtgcaccctagcgcccaatccccgatgcagcatctcggagtcggcatggaggcccctcttctgggcttccctacaatgaactcgaatctgtctgaggtccaaaaagtgctgcagatcgttgataacactgtgagtcggcagaagatggactgtaaagcagaggaaatctcaaagttaaaaggctaccacatgaaggacccttgctctcagcctgaagaacagggcgtgacctcccctaatatcccccctgtcgggctccctgtcgttagccataacggggcaactaagagcattattgattacactttggagaaggttaatgaggccaaggcgtgtttgcaatccttgactacagacagcagaagacaaattagcaacataaagaaggagaagttgagaaccctgatcgacctagtcacagatgacaagatgatagagaaccataatattagcacaccatttagctgtcagttttgcaaggagtcctttcccggtccgattccactgcatcaacatgaaagatacctttgcaagatgaatgaagaaattaaggcggtgctgcagccccacgaaaatattgtgccaaataaagccggagtatttgtcgataataaggccttgctcctcagcagcgttcttagcgagaagggtatgacatcgccgattaatccttacaaagatcatatgagtgtgttgaaggcctactatgccatgaacatggaacccaattctgacgagctgctcaagatttcaatcgccgttggcctgcctcaggagttcgttaaagagtggttcgagcaaaggaaagtgtaccagtacagtaattctcggtcccccagcctcgaacgctcaagcaaacccctggcccctaactccaatccacccaccaaagacagtctgttgccacgaagcccagtcaagcccatggactcaatcacctcgccatccatcgccgagctgcacaatagcgtgaccaactgcgatcctcctctacgcctgactaagccaagccatttcactaacataaaacccgtggagaagctcgaccatagcagaagtaacacaccatcccctctgaacttgagctccacgagctccaaaaacagtcactctagctcctacactcctaactcattttcgtctgaggaattacaggcggaaccgttagacctgagcttgcctaagcagatgaaagagccaaaaagtatcatagccacgaagaacaagaccaaagcgtcttccatttctctagaccacaatagtgtgtcttcctcctcagagaactctgacgagcctctgaacctcacctttattaaaaaggaatttagtaattccaataatcttgacaacaagtcaacaaatcccgtcttctctatgaacccttttagcgccaaacctctgtacacagcactgccacctcagagcgcatttcccccagccacttttatgcctcccgttcaaaccagcatccccggactcagaccttaccctggcttggatcagatgagctttctgccgcacatggcctacacttaccctactggcgctgcaacttttgctgatatgcaacaacggaggaagtatcaaaggaaacagggtttccagggagaacttctcgatggcgctcaggattatatgtcggggctggatgacatgactgactcagattcttgtctgtcccgaaagaagatcaaaaaaacagagagcggaatgtacgcctgtgatctgtgtgacaagactttccagaagagttcgtccctcctgcgccataagtacgagcatacaggtaaacgtccccaccagtgtcagatctgtaagaaagcattcaaacataaacaccacctgatcgaacacagtcgcctgcacagcggagagaagccctatcaatgtgataaatgtgggaagcgtttctcccatagtgggtcttactcccaacatatgaatcaccggtattcctattgtaagcgggaagcagaggagagggaggctgccgaaagagaagccagagagaagggtcatcttgaaccaaccgaattgctgatgaatcgggcatacctccagtcaataaccccacagggctattccgactctgaagagcgggagagcatgccccgagatggtgaatcagagaaggaacacgagaaggagggcgaagatggatatgggaaacttggaagacaggacggcgacgaggagtttgaagaggaggaggaggagtcggagaataaatccatggacaccgaccccgagaccattcgggatgaagaggagaccggagatcatagtatggacgactcttctgaggacggtaaaatggagaccaagagcgaccacgaagaagacaacatggaagatggtatgtag

SEQ ID NO: 31626 - DNA, 1893 bp, Artificial Sequence
  Description of Artificial Sequence: Synthetic coding sequence
atgagcatcagcgcactaggcggtcgcacaaagggcaaacccctgccacccggagaggaggagagaaataatgtccttaaacagatgaaggtgcggaccaccctgaagggagataagtcgtggatcaccaagcaggacgagtccgagggaaggaccattgagctgccttccggcagatcccgtgccacttctttcagctccgctggcgaggtccctaaaccaaggcctccaagcacccgtgctccaaccggttacatcatcagaggggtctttacaaagcctatcgatagcagcagccagcctcagcagcagtttcctaaagctaacgggacccccaagtctgccgcttcactcgtcaggaccgctaacgctggtcccccacgaccctcatcgagtgggtataaaatgaccactgaagattacaaaaagctcgccccatacaatatacgcagaagttcaacttcaggagatacagaggaagaggaagaagaggaagttgtccccttttctagtgatgagcagaagcgacggtccgaggcagctagcggtgtgctgcgacggacagcacctcgggaacattcatacgtcctgagcgccgcaaaaaaaagcaccggccctacccaagaaacacaagcccctttcattgcgaagcgggtagaagtagttgaggaagatggaccaagcgaaaagtctcaggacccgccagcccttgcacgcagtacccccggtagcaaccgctcaagcccaggcaataaagacaaagaggcaccttgttccagggaactgcagagggacttagcgggtgaagaagcctttagagccccaaataccgacgcggctcggtcttcagcccagctctcagatggcaatgtgggctcaggcgctactggatctagacccgaaggcctcgctgctgtggatatcggttcagagagaggctccagctccgccacgagcgtctctgccgtgcctgccgaccgcaaaagtaactccaccgccgctcaggaggatgccaaagccgatcccaaaggtgccctggctgattacgagggcaaagatgtggccaccagagtcggtgaggcttggcaggagcgacccggagcacctcggggtggacagggcgatcccgctgtccccgcacagcagcccgctgacccctctactcctgaacgacagtcatctccaagtggctctgaacagctggtgaggagagaatcttgcggcagttctgtgttgacggactttgagggtaaggacgtggctaccaaagttggggaagcatggcaagaccgaccaggcgcaccccgaggaggccaaggagatcccgcagtccctacccaacagccagctgatccctccacccccgaacagcagaattcgccttcagggtctgagcaattcgtgcggagggaaagctgtacaagtcgcgtaagatctcccagctcctgtatggtgacagtgaccgtgaccgcgacgtcggaacagccccatatctacattcccgctccagcatcagagttagacagcagcagcaccacaaaaggcattctgtttgtgaaggagtatgtcaatgccagcgaggtcagctcaggcaaaccagtctctgccaggtattccaatgtgtcctcgatcgaggatagctttgccatggagaagaagcctccctgcggatccaccccttacagcgagaggacaactgggggaatttgtacctactgcaacagggagattcgggactgtccaaaaatcacactcgaacacctggggatctgttgccatgagtactgtttcaaatgcggaatatgctccaaaccgatgggcgaccttcttgaccagatcttcattcacagggacacaatccattgcggtaagtgctacgaaaagctcttttag

SEQ ID NO: 31627 - DNA, 1407 bp, Artificial Sequence
  Description of Artificial Sequence: Synthetic coding sequence
atgacgaccgaggactacaaaaaactcgcaccatacaatatccgtcgatcatcaacctccggtgatacagaagaggaggaggaagaggaagtggtcccttttagttcagacgaacagaagaggtcatccccgacgcaggagacacaagcaccatttatagctaaaagggtcgaggtggttgaggaagacgggccaagcgaaaaatctcaggacccgcctgcactagcccgtagcactcccggtagcaatcggtctagtccgggtaataaggataaagaagcaccttgttccagggagttgcagcgcgatctggcgggagaggaggctttcagagctccaaatactgatgcggcacgctccagcgcacaactcagcgacgggaacgtgggcagcggagcgacaggctctaggcccgagggcctagccgcagttgatatcgggtccgaaagggggtcctcttccgctacttctgtatctgccgtgcccgcagaccggaagtctaacagcaccgcagcacaggaagacgcaaaggccgacccaaaaggggctttggctgactatgaagggaaagacgttgctaccagggtgggagaggcctggcaagaacggccaggcgcaccacgtggcggtcagggagatcccgctgtccccgctcagcagcctgcggaccccagtaccccagaaagacaatctagcccttcaggtagcgagcaacttgtgcgacgcgagagctgcgggtcttctgtactgactgatttcgaggggaaggatgtggccacgaaagtcggtgaggcctggcaagatagacccggagctcctcgaggaggccagggagacccagctgtacccactcaacagcctgcagatccatctaccccggaacagcaaaacagcccttccgggtctgagcaatttgtccggcgagagtcatgcacctccagggtgcggtctccttcatcctgtatggtaacagtgactgttacagcaacttccgagcagccccacatctatatcccagcacccgcttccgagctggattcatcctcaacgactaagggaatccttttcgtaaaggagtacgtgaacgccagtgaagtttcttcaggaaagccagtttctgcaaggtatagtaatgtctcttctattgaggactcttttgctatggaaaaaaagcctccctgcgggtccacaccatatagtgaacgaacaacaggcggtatctgcacctattgcaacagggagatcagagattgtcccaaaatcacgcttgagcacctgggcatttgctgccatgagtattgctttaagtgcggaatttgttctaaacctatgggcgatctccttgaccagattttcatccatagggacaccattcactgcggcaagtgttatgagaaactgttttag

SEQ ID NO: 31628 - DNA, 1374 bp, Artificial Sequence
  Description of Artificial Sequence: Synthetic coding sequence
atgacaaccgaagattataagaaattggcaccatacaacattagaaggtcttccacaagcggcgacaccgaggaggaagaagaagaggaagtggtgccgttttcctctgatgagcagaaacgccgttcggaggccgcttcaggcgtgctccggaggactgccccaagagagcactcctacgttctatctgccgcaaaaaaaagcactggtagccccacacaggaaacccaggccccattcatagcaaagcgtgttgaggtcgtcgaagaggatggccctagcgaaaagagccaggatccacctgccctcgccagatccacgcccggatcaaactcttctcgcggagaagagatcgttcggctccaaatcctgacacctcgggcagggctgcggctggttgcccctgacgtagaggggatgtcctcttctgcaacatctgtgtcggcggttcctgctgataggaagtcaaacagcactgctgcccaggaggacgccaaggccgatccaaagggcgcactggcagactacgaagggaaggatgtggcaacccgggttggggaagcgtggcaggagaggccgggagcccctcgcggaggacagggagatcctgctgttcccgcacagcaacccgcagaccctagcacacctgaacggcaatccagcccatccggatcggagcagctggtaaggcgggaaagttgtggatcaagcgtcctgaccgatttcgaggggaaggacgtggccaccaaggtgggggaggcctggcaggatcgtcctggagcgccaaggggcggacaaggagaccctgccgtccccacgcagcaacccgcagacccctccacccctgaacagcagaattctccctcaggctctgaacagtttgtgagaagagagtcctgtacctcacgagtcaggagcccctcatcttgcatggttaccgttacggtgactgcaacgtccgaacagccccatatctacatcccagcccctgccagtgaactggacagttcatctacaacaaaagggatcttgttcgtgaaggagtacgtgaacgcctccgaagtgagttccggcaaacccgtgagcgctagatacagcaacgtaagctcaattgaagacagcttcgccatggagaagaaaccaccatgcgggagtactccgtacagcgaaagaacaaccggtggaatctgtacatattgcaatagggagattagagactgccccaagatcacactggagcatttgggcatctgttgccatgaatactgctttaagtgtgggatttgcagcaaaccgatgggcgacctcctagaccagattttcattcatagggacactattcactgtggaaaatgctatgaaaagctgttctag

SEQ ID NO: 31629 - DNA, 2070 bp, Artificial Sequence
  Description of Artificial Sequence: Synthetic coding sequence
atgtcaataagtgcactagggggtcgcactaaaggaaaacccctcccgccaggcgaggaagagagaaacaacgtgctaaaacaaatgaaagttaggaccactttgaaaggtgataaaagttggattaccaaacaggatgagtccgaaggacggacaattgaactcccgtcggggagatctcgggctacttcttttagctccgcaggagaggtgccaaaacccagacctcctagtacgagggcccctaccggctatattatcagaggtgtcttcaccaaacccatcgacagctctagtcagccccagcagcaattccctaaagccaacggcacccctaaaagcgccgctagcctggttaggaccgcaaacgcagggcctcctcgacccagctctagtggatataagatgaccacggaggactacaagaaactggcgccatacaatatccggcgatcttccaccagcggcgacaccgaagaggaggaggaggaggaagtagtgccctttagtagcgacgagcagaagagaaggagtgaggcggcaagcggcgtgttgagacggaccgctccgagggagcactcatatgttctgtcagctgctaagaaatccacagggcctacgcaagagactcaggccccttttatcgctaagcgggtggaagtcgtggaagaggatgggccatccgagaagtcccaagacccaccggcacttgcacgaagtactccagggtccaacagtgcggacgggggtcggacaaaggccagtagagcgatctggatagaatgtctcccttccatgccctccccagctgggtctcaggagctatccagcagaggcgaagaaattgtcagactgcagatcctcacacccagagccggactccgacttgtggctccagatgtcgaagggatgcgcagcagtccaggcaacaaagacaaagaagccccttgcagcagggaactccaacgggacctggccggtgaagaggcattcagggctcctaacaccgatgccgcacgctcctcggctcagttgagcgatggaaacgtgggcagcggagcaactggaagcagacccgaggggctggctgctgttgacattggtagcgagcggggatctagcagcgctacaagtgtatccgccgtgccagcagacagaaaatcaaatagcacagccgcacaggaagatgcaaaggccgacccaaaaggcgcattggccgactatgaaggcaaggatgtggccaccagggtgggagaagcgtggcaggaaagacccggtgcccctaggggcggacagggcgatccagcggttcctgcacagcagcccgcagacccctcaacccccgaacgacagagctcgccaagcggaagcgagcagctagttcgcagggaaagctgcgggtccagcgtgttgactgacttcgaaggcaaagacgttgctacaaaggtcggggaagcctggcaggacaggcccggtgccccaaggggcggtcagggagatccagccgtacctacccagcagcctgccgatccttccactcctgaacagcagaacagcccatcagggagtgagcaattcgtcaggagggagtcgtgtacctctagggttagatcaccgtcctcatgtatggtcaccgtgactgtgacagccacgagcgagcagcctcacatctacatcccagcccctgcttcagaattagactcaagttccacgactaaaggtatcctcttcgttaaagaatacgtcaacgcgagcgaggtttcaagcggaaagcccgtttccgcaagatactcaaatgtgtcttccatcgaagactcatttgccatggagaaaaagcctccctgcggttccacgccctactctgaaaggaccacagggggaatttgtacatactgtaacagggagattagggactgtcctaaaatcaccctcgagcatctgggaatctgctgtcatgagtattgttttaagtgcggaatctgttctaaaccaatgggcgatctgctcgaccaaatctttatccaccgggataccattcactgtggcaagtgttacgaaaagttattttag

SEQ ID NO: 31630 - DNA, 1359 bp, Artificial Sequence
  Description of Artificial Sequence: Synthetic coding sequence
atgcaacgccaggctccttataacattcgaagaagttcaacatctggcgacaccgaagaggaagaggaggaggaggtggtaccattctcatccgacgaacaaaagcgaagaagtgaggcagctagcggtgttctgcgtcggaccgccccacgggaacattcttatgtgctttccgcagccaagaagtcaaccgggagtcctacccaagagacccaggctcctttcatcgccaagagagtggaagtggtagaagaagatgggccttccgagaaatcccaggaccctccagctctggcacgaagcactccgggaagtaatagctcccgcggagaagagattgtaaggttgcagatcttgactcctagggctggcctccggctggtggccccagacgtggaaggaatgagctcctctgcaacctccgtgagcgccgtgcctgcggatagaaagtcaaattccacagctgcccaggaggacgcgaaggcagaccctaagggcgcacttgcagattacgaagggaaggatgtggctacacgtgttggtgaagcctggcaggagaggccgggagctccaagaggcggacagggagatcccgctgtgcccgctcagcagccggctgaccccagcactccagagcgtcaatcaagcccttcaggttctgaacagctggtcaggagagagtcatgcggctcatcggtgctgactgacttcgaaggcaaagacgttgccaccaaagtgggagaggcctggcaagataggccgggagctccacggggaggacagggcgatcctgcagttcctacccaacaacccgctgacccaagcacacctgagcagcagaacagtcctagtggctcagagcagtttgtaagaagagaatcctgtacctcacgggttcggtcacccagtagttgcatggtcaccgtcactgttacggcaaccagtgaacagccgcatatatacatacctgcgcctgcgtcagaactcgattccagctccacaactaaagggatcctatttgttaaagagtatgtgaatgccagcgaggtgtcaagtggcaagcctgtgagcgcacggtatagtaacgtgagctcaatcgaggactcctttgccatggagaagaaacctccctgcggtagcaccccttatagcgaaagaaccaccggaggtatctgtacatactgcaacagagagatccgagactgtccaaagatcactcttgaacacttggggatatgctgccacgagtactgtttcaaatgtgggatatgctcaaagcccatgggggaccttctggatcaaattttcatacatcgtgacacaattcactgtggtaagtgctatgagaaactattctag

SEQ ID NO: 31631 - DNA, 1428 bp, Artificial Sequence
  Description of Artificial Sequence: Synthetic coding sequence
tgaaggtcatccacctccggtgacaccgaggaggaggaggaggaggaggtagtgccgtttagttccgatgagcaaaaacggagccttaggaggacagcgcctagggagcatagttatgtgctgagtgcagctaagaaaagtaccggctcccctacccaagagacacaggctccattcatagcgaaacgcgtggaggtagtcgaagaggacgggccatccgaaaaatctcaggatccccctgccttggccaggtccacgcccggaagcaatcggtcctcaccgggaaacaaagataaggaagcaccttgcagccgagagttacagcgcgatctcgccggagaggaagcatttcgcgcaccaaacactgacgctgcacggtctagcgcccagctctcggatgggaatgttgggtctggcgcaaccggcagccggccagaaggactcgctgccgtggacataggctcggaaagggggagctcgagcgcaacctcagtgtctgctgtgccggctgatcgcaagagcaactccaccgctgcccaagaagatgctaaggccgatccgaaaggagctctcgcagactatgagggaaaagatgtggcaacccgcgtaggtgaagcctggcaggagcggcctggggcacctcgtggcggacagggggaccccgctgtacctgcacaacagcctgcggatcctagcacacctgaacgtcagtcctccccttccggaagcgagcaattagtgcggagggagtcttgcggcagctcagtcctgacggatttcgagggaaaggacgtcgccactaaggtcggtgaggcctggcaggaccgtccaggggctccaaggggcggacagggcgatcctgctgtgcccacgcagcagcctgccgacccgtccacccccgaacagcagaatagccctagcgggagcgagcagtttgttcgccgtgaatcctgtacttcccgggtgcgcagtccatcctcttgcatggtgaccgtgactgtaacggctactagcgagcaacctcacatttacattccagcacccgctagcgaactcgatagtagttccacaacgaaaggcattttatttgtcaaggagtatgtaaatgcaagtgaggtgtcttccggcaagccagtgagcgctagatactcaaatgtatccagcattgaggatagcttcgctatggaaaagaaacctccttgtggaagtacgccgtactcagaacggactacaggcggtatttgcacatattgcaatagagagatccgggactgtccaaagatcaccctggagcaccttgggatttgctgccatgaatattgtttcaaatgcggcatctgtagcaagcccatgggtgatttgctcgaccaaatatttatacacagagacaccatccattgcggaaagtgctacgaaaaactcttttag

SEQ ID NO: 31632 - DNA, 1146 bp, Artificial Sequence
  Description of Artificial Sequence: Synthetic coding sequence
atgactacagaagactataagaagttggctccttacaatataagacgttcgtcgacatcaggggacaccgaggaggaggaagaggaagaagtggtaccttttagtagtgatgagcagaaacggaggtccgaggcggcatctggcgtgcttcgcaggaccgctcctcgagagcattcttacgtgctaagtgccgctaaaaaaagtaccgggtcacccactcaagaaacgcaggctccctttattgccaagcgggtagaggtggtggaagaggacggcccaagtgagaagtctcaggatcctcctgccctcgccaggagtacacctggatctaactctgctgacgggggtcgaaccaaggcctccagagcaatctggatcgagtgtctgccctctatgccctcaccagccggttcacaggaactttcaagcagaggcgaggaaatcgtgaggttgcaaattctgacaccaagggctggtcttcgactcgtggcacccgacgtcgaaggcatgcgctcctcccctggcaacaaagacaaagaggcgccttgttcacgggagctgcagagggacctggcaggtgaagaagctttccgagctccaaacactgatgcagcacggtccagcgcacaactgagcgacggaaacgtggggtccggcgctactggatcgaggccagagggcctggctgctgtggatatcggttctgagcgaggttcaagcagtgcaactagtgtgtctgccgttcccgctgataggaaaagcaattcgacagctgcccaggaggacgcgaaagccgaccccaagggtgcattggccgattatgagggaaaggacgtggccacccgcgtgggggaggcatggcaggagagacctggagcacctcgaggtggtcagggcgaccccgctgtgcctgcccagcagccggcagatccgtccaccccagagcgccaatcctcaccctccggcagcgagcagctggtgcggagggaatcatgtggctcttcagtgctgaccgacttcgaagggaaagatgtcgccaccaaagtgggcgaggcatggcaggaccgtccgggtcctagttgcacgcactcagccacctgcagatcccagtatcccagaaccgctgagcagccgcagcgtatctag

SEQ ID NO: 31633 - DNA, 636 bp, Artificial Sequence
  Description of Artificial Sequence: Synthetic coding sequence
gaggaggcgtttagggcccctaataccgacgccgctcggtcctccgcccagctgtcagacggaaacgtcggctccggagctaccgggagtcggcctgaaggcctcgctgctgtagacatcggcagtgagagggggagactctgtgccgctgcctcctttgcctctttcctggaagaccaggatggccactcggccaatagccaaagctgtaagcctagacctgctgcaatctcctcttcagccacgtcagtgtcagccgtgcctgcagacagaaagtccaacagcaccgctgcacaggaggatgcaaaggcagatccaaaaggagccctggccgattacgagggtaaggacgtcgctacccgagtgggtgaggcatggcaggagaggccgggtgctccacgagggggacagggcgacccggcagtgccagcccagcagccggcagacccatccacacccgagagacagtcttcaccatctgggtctgagcagctcgtgcggagagaatcctgcggaagctcagtgttgaccgattttgaaggcaaagacgtggcaacaaaggtcggagaagcctggcaggataggcctggcgctcctcggggaggccaaggagaccctgctgtacccacccaatag

SEQ ID NO: 31634 - DNA, 666 bp, Artificial Sequence
  Description of Artificial Sequence: Synthetic coding sequence
tgattgcgccgaacagcacccagagaacactcttacgtgttatccgctgcaaagaagtccactggatcccccacgcaggaaacgcaggccccttttatagctaaacgcgtggaagtagtggaggaggatgggccaagcgagaagagtcaggacccaccggcactggctcggtcaacccccggttcaaatagcgccgatggagggcgaaccaaagcctcaagagccatctggattgaatgcctgcccagcatgccgtctcctgccggaagtcaggagttgtcctcgcgaggagaggaaatcgtgcggctgcagatccttactccgcgagccggactaaggctggtcgcacccgacgtggagggcatgaggagttccccaggcaataaggacaaagaggccccttgcagtcgtgaactgcagcgagacttagctggcgaggaggcctttcgggcacccaacaccgacgccgctagaagtagcgcccagctgagcgatgggaatgtaggaagcggcgcaaccggcagccggcctgagggactggcagccgtggatatcggctcagagcgagggtcttctagtgccacctcagtgtcggccgttcccgctgatcggaaatccaactctaccgccgcacaggaggacgccaaagctgacccaaaaggctag

SEQ ID NO: 31635 - DNA, 414 bp, Artificial Sequence
  Description of Artificial Sequence: Synthetic coding sequence
tgagttcttccgcgacgccatcgacatcggctgagcagaagaggctggcggtggtggaagcggaccggactcttgcgaagagccagaactcatctgctgtggcaggatccccttttagcccaaacagtcagaatggaggccggaccaaagaggctaggtcaatttggcagctcagcatgtcaagtgtgtctggcaccacttggggcaaggtcttcgggcctgccgcaggcaaccaagactcgaagacccccagctcctgaaagctcaagaggaacctggttagtacggcgtctgagcggaccccctactcagatgcttcaggcgcctgtgcccctgcagtccctgctgtccttactgataggacgcgctaccgcgcagcagcctcgtcgcatgcagaggcagacacagagatag

SEQ ID NO: 31636 - DNA, 2073 bp, Artificial Sequence
  Description of Artificial Sequence: Synthetic coding sequence
atgtccatcagcgcactaggcggtcgtactaagggcaagcctctgcctcccggagaggaagaaaggaacaacgttttaaaacagatgaaggtgaggacaaccttgaagggtgacaaatcatggattactaagcaagacgagtcggaaggacgtacgatagaactgccatcgggcagaagtagagctaccagtttcagcagcgcaggcgaggttcccaagcctcgacctccctcgacaagagccccaacgggctacataattcgcggagtttttacaaagcccattgatagtagctcccagccccagcaacaattccctaaggccaacggtacccctaagtcagccgcttcgttggtgcgaacagcgaatgcgggtcctcccaggccatccagctccggctataagatgaccaccgaagattataagaagcttgcaccttacaatatccgaaggtcttcaacaagcggggacaccgaggaggaggaagaggaggaggtcgtgccattttcaagtgatgagcaaaagagaagaagcgaggcagcatccggggtgctgcgcagaactgcccctcgggagcacagttatgtattatcagccgctaaaaagagtacggggtcaccaacacaggagacacaggctccgtttatcgctaaacgggttgaggtggtggaagaggatggccctagtgagaagtcacaggatccacccgcactggcacgctctacacccggaagcaactctgctgatgggggaaggaccaaagcaagtcgcgctatttggattgagtgtctaccttcaatgccctcccctgcgggatcgcaagaactgagtagccgaggcgaagaaatcgtccgcctgcagatcctaactcctagagcaggcttacgccttgtggcccctgacgttgagggaatgaggtcatcaccaggcaataaggataaagaggccccttgttctagggaactacaacgcgatttggctggggaggaagctttccgggctccaaacacggatgccgctcggtcttccgcacagctctcagacgggaacgtcggctcgggggcaaccggctctagacccgaggggctggcggctgtcgacattggaagtgaacgaggtagcagcagcgctacttctgtttctgcagtgcctgccgaccgcaagtctaactctacagcggcacaggaggacgcgaaggcggacccaaagggcgctctcgcggactacgagggtaaagacgttgctacgagggtcggcgaggcctggcaggaaagacctggggcacctcgcggtggtcagggcgatcccgcagtccccgctcagcagcctgccgacccatccacacccgagagacaatcttccccaagcgggagcgagcagctagtgcgacgcgagtcatgcggctcatctgtgcttaccgacttcgaaggcaaggatgttgctaccaaggtgggcgaggcatggcaggatagaccaggtgccccaagaggcggacagggggatcccgcagtgccaactcaacagcctgcagaccccagcacccccgaacagcaaaattcgccttctggttccgagcagttcgtgcggagggagagctgcaccagccgcgtccgctccccgtcatcatgcatggtgacggtaactgtaacggcaacaagcgaacagccccatatatatatccccgctccagcctccgagcttgactcatcctcaactaccaaaggtattctattcgtcaaggagtacgtgaatgctagcgaggtgagctccgggaaacccgtctctgcaagatatagcaatgtttcgtctattgaggattccttcgcaatggagaagaaacctccctgtgggtcaactccctacagtgaacgaacgaccggcggaatatgcacttattgtaatcgtgagattagggattgccctaagatcactctcgagcacttggggatctgctgccatgaatactgtttcaaatgtggaatatgcagtaaacccatgggagacctactggatcagatattcatccatcgggacacgatccactgtgggaagtgctatgagaaattgttctag

SEQ ID NO: 31637 - DNA, 993 bp, Artificial Sequence
  Description of Artificial Sequence: Synthetic coding sequence
tagagtgaaatggccgcacgggacgagctcgggcttgggggtgactctctggaggctatgcccgtgcccgcagcacgtgggagacctcgtatcactaatgggccagaggagttggccgcacctagtcccgctgccctcgcggattatgaggggaaagatgtggcaaccagggtgggtgaagcctggcaggaacgccctggagccccaagagggggacagggcgatccagcagtgccagcccagcaacctgctgatccttcaacaccagagagacagagcagcccatccggatcggaacaactggtccggagagaatcctgtgggtctagcgtcctgactgacttcgagggcaaagatgttgccacaaaagtcggtgaagcgtggcaggacagacccggtgcccctaggggcggacaaggagatcctgctgtgcccacacagcagcctgctgatccaagcaccccagaacaacaaaatagcccctcaggaagtgagcagttcgttagacgtgaaagttgcacatccagagttagatctccatccagctgtatggtgaccgtcacggtaactgcaacgagtgagcagccccacatttatatccccgcacctgcatcggaacttgatagttcctcaactactaaaggaatactgtttgtcaaagaatatgtcaacgcgagcgaagtctcctctgggaaaccagtgagcgccagatatagcaacgtcagttctatcgaagattcgttcgctatggaaaaaaagcctccatgcggaagcacaccatatagtgaacggaccacaggtggcatctgcacatactgcaacagagaaatcagggactgccctaagattactctcgagcacctaggcatttgctgccatgagtattgcttcaagtgtggcatttgctcaaaaccgatgggagaccttttggatcagatatttatacaccgcgacaccatccactgcggcaaatgttatgagaagctgttctag

SEQ ID NO: 31638 - DNA, 1575 bp, Artificial Sequence
  Description of Artificial Sequence: Synthetic coding sequence
atgacgacagaagattataagaaactggccccttataatataaggagatctagcacaagcggtgatacagaagaagaagaggaggaagaggtagtgcctttctcctcagatgagcagaagaggagatcagaagctgcctcaggggttctgcgccgaaccgcccctcgggagcacagctatgttttgtcggcggctaagaaatccacagggcctacacaggaaacgcaggcgccattcatcgccaaacgagtggaggtcgtagaagaggacgggccttccgagaagagtcaagatcctcccgcactcgcacggagtacgcccggaagcaatagcagcaggggcgaggagatcgtcagactccagatactgacacctcgagcgggtttgaggctggtcgctcctgatgtagagggaatgaggtcgagtcctggcaataaagacaaagaagccccatgttcgagggaacttcagcgggatctggccggagaagaggcctttcgcgcacctaacacagatgccgctcgctcttccgcacagctgtcagatgggaacgtgggcagcggcgctaccggatcccgtcctgaggggttagccgctgtggacattggcagcgagcgcggaagttccagcgctacctcagtgagtgcagttcctgcagacaggaagtcaaattccactgcagcccaggaagacgccaaggcagaccctaaaggggctctggccgattacgaaggcaaggatgtggctaccagagtcggggaggcatggcaggaacgcccaggtgccccacggggaggccagggcgaccccgctgtccccgcacagcagcccgctgatccaagtaccccagaaagacagtcatctccatccggaagcgagcagttggtaaggagggagagctgcggtagttccgtgcttaccgactttgagggaaaagacgtggccaccaaagtgggggaggcgtggcaggatcggcctggcgctcctcggggtgggcagggagatcctgccgtgcctactcagcagcctgcggacccatccactcctgagcagcagaactctccctcagggtcggaacagtttgtgcgcagagagagctgcactagtcgagtcaggagcccatctagttgcatggtgactgtcacggttactgctacatcggagcaaccccatatctatattcctgccccagccagcgagcttgactccagctcgaccacaaaaggcattctctttgtaaaggagtacgtaaacgctagcgaggtgtcctcagggaagccagtctctgccagatattcgaacgtgagtagcatcgaggattccttcgcgatggaaaaaaagcccccttgtggtagtacgccctacagcgagaggaccacgggcggtatatgtacgtattgtaaccgggagattcgcgattgccccaaaattacactggagcatctgggtatttgctgtcatgaatattgtttcaaatgtgggatctgttccaaaccaatgggcgatttgttggatcagatctttattcatagggatacaatacactgtggcaaatgttatgagaagctcttctag

SEQ ID NO: 31639 - DNA, 2166 bp, Artificial Sequence
  Description of Artificial Sequence: Synthetic coding sequence
atgagcataagcgcgctggggggacgcactaaggggaagcctctgccaccgggagaagaggaaagaaataacgtcctgaagcagatgaaggttagaaccactctgaagggggataagagttggattacaaaacaggacgagagcgaaggtcgcacaatagagctcccaagcggccgaagccgggcaacaagtttctcaagtgccggagaagtgccaaaacctagacccccatcgacacgggctcctacaggttacatcattcggggtgtgtttaccaagccaatcgactcctcctcacagccgcagcaacagttccctaaggccaacgggacaccgaagagtgcagcctccctcgtccgaacggctaacgctgggccacctcgcccatcatctagcggatataagatgaccactgaagactataaaaagctcgccccatacaacattcggaggtccagcacctcaggcgacacggaggaagaggaggaggaagaggtggtacctttcagttccgacgaacagaagcgaagatccgaagcggcttccggggtgctcagacgaacggctccacgcgaacatagctatgtcttgagcgccgcaaagaagagtactggacctacgcaggaaacccaggcaccgtttattgctaagcgtgtcgaggtcgtcgaggaggatggaccaagcgaaaaatcccaggatcccccagcactggcgaggtccaccccaggatcaaactccgcagacgggggtcgaaccaaagccagtagggcgatctggattgaatgtctcccaagcatgcctagtccggctggatcccaggaattgtctagccgtggggaagaaattgtccgattacagattttgaccccacgggcaggattgcgcctagtggcaccagacgtggaaggtatgagatctagccctggaaacaaggacaaagaagcgccttgttcccgggagcttcagagagatctggccggtgaagaggcatttcgcgctcccaacacagacgctgctcggagcagcgctcaattgtctgacggcaatgtcgggagcggggcaaccggcagtcgccctgaaggactcgctgccgtcgatatcgggagtgaaaggggcagattgtgtgctgccgcaagcttcgcttcattcctggaagaccaagatggacatagcgctaattctcagtcatgcaagcctcgtccagcggctatttcttcaagcgccacgtccgtttcagctgtgcctgccgatcggaaaagcaactccaccgcagcccaagaggacgctaaggccgatcccaaaggggctctggccgattacgaggggaaagatgtggctactcgcgtcggagaggcttggcaagagcggcctggtgcaccgagaggcggacagggcgatccagcagtacccgctcaacagccagctgatccctccaccccagagagacaaagcagcccgagtggaagtgaacaactagtccgcagggagagttgtggctctagtgtcctcacagactttgaaggtaaagatgtcgccaccaaggttggcgaggcttggcaggaccggcctggagcgcctagaggagggcagggcgaccctgcagtgcccacccagcagccagccgacccttcgactccagagcagcagaatagcccatctggatccgagcaatttgtgcgccgtgaaagctgcactagccgggttcggagcccgtccagctgtatggtcactgttactgtgacagccacgtccgagcagcctcatatctacatccctgcgccagctagcgagctcgattccagctcgacgacaaaagggatcctgttcgtgaaagagtatgtcaacgcgtccgaggtgagtagcggtaagccggtaagcgctcgctatagcaatgtgtcctcaattgaggactctttcgccatggaaaagaaaccaccatgcggttcgaccccgtatagcgagcgcactaccggcggaatatgcacttattgtaatcgcgaaatacgcgattgccctaagattacgctggagcaccttggcatctgttgccatgagtattgcttcaagtgcgggatttgttccaagccaatgggggacctactagatcagatttttattcatcgagataccatccactgtggcaagtgttacgagaaactgttttag

SEQ ID NO: 31640 - DNA, 2079 bp, Artificial Sequence
  Description of Artificial Sequence: Synthetic coding sequence
atgtcaattagcgccctcggtggcaggacgaaaggcaaacccctacccccaggcgaggaggaaagaaataacgtgctgaaacagatgaaggtgcgcactacattgaagggggataaaagttggatcaccaagcaggatgagtcggaggggagaaccattgaactgccgtccggcagaagccgggcaacatcctttagttcagccggtgaggtgcccaagcccagacctccatccactcgggctccaactggatacattattcggggagtgttcactaagcccatcgactctagctcccagccccaacagcagttcccgaaggccaatggtacaccaaagagcgccgcatcgctcgtgagaactgcaaatgccggacccccaagacctagctcctctggctataagatgactacggaggattacaaaaaattggccccttataatataaggcgctcgtccaccagcggtgacactgaagaggaagaggaggaggaggtggttccctttagctccgacgagcagaaacgcaggtccgaagcggcatcaggcgtgctacggcgaactgccccacgtgagcactcctatgtcctgagcgccgctaaaaagtccaccgggcctacacaggaaactcaggctccctttattgcaaagagggtggaagtggtagaagaggatggtccctccgaaaagagtcaggaccccccagcccttgccaggtccacacccggatcaaattccgcagatgggggaagaaccaaggcttcccgggctatttggatcgagtgtctgcccagtatgccgtcccccgcagggtctcaagagcttcgctcgagccccggaaacaaggacaaggaggctccctgttcaagagagttgcagagagacctagcgggtgaagaggcatttcgtgctccaaacaccgatgctgctagatcgagcgcccagctctccgatggcaatgtaggatccggggcaactggctcacgacccgaggggctggccgcagtggatatagggagcgagagaggcaggctgtgtgccgctgcctcgtttgcatccttcctggaagaccaggatggccatagcgctaatagccagagctgtaaacccagacccgctgcaatctcttcctctgctactagtgtttctgccgtcccagccgacaggaaaagtaattcgactgcggctcaagaagacgctaaagcagatccgaaaggggcactcgctgactacgaggggaaggatgtggctacaagggttggggaggcatggcaagaaagacctggcgctcccagagggggacagggtgacccagcggttcctgcccagcaacccgctgatcctagcacgcccgagcgccagagttcgccgagtggctctgagcaactggtccggcgtgaatcgtgtgggagcagcgtactgacagatttcgagggcaaggatgtcgctaccaaagtcggcgaagcctggcaagataggcccggtgcccctagagggggacagggcgatccagccgtgcccacccaacagcccgctgatccttcgacccccgaacaacagaatagcccgagcggttcggaacagtttgtgaggcgcgaaagctgtacgagccgagttcggtctccatcctcttgtatggtcaccgtgacagtgacggccacttccgagcagccacacatctacattcccgcaccggcatcggagcttgattcctcatcgaccaccaaagggattcttttcgtcaaagaatacgtgaatgcaagtgaggtcagtagcggtaaaccagttagcgccaggtactcaaacgtgtcctcaattgaagactcattcgccatggagaagaaaccaccatgcggctctacgccctactctgaaaggacgacaggtgggatttgtacatattgtaacagggagattagggattgcccaaagataaccctagaacacctcgggatctgctgccacgaatattgtttcaagtgtggtatttgctcgaagccaatgggtgatcttcttgatcagatattcatacacagggacactatccattgcggcaaatgttatgagaaactgttctag

SEQ ID NO: 31641 - DNA, 1899 bp, Artificial Sequence
  Description of Artificial Sequence: Synthetic coding sequence
atgcagcgggaagagggattcaacaccaagatggcagacggccctgacgagtacgataccgaagcagggtgcgtccccttgttgcatccggaagaaataaagccgcaaagtcactataaccatggctacggagaaccgctgggaagaaagactcatatcgacgattattcaacttgggatatcgtgaaggctacccagtatgggatttacgagcgttgcagggagttggtcgaggcaggttatgatgtgagacagcctgacaaggaaaacgtcaccttgttgcattgggccgctattaataacaggattgatctggttaagtattatatatctaaaggagccattgtcgaccagttgggaggcgacctgaattccacacctctccattgggccacacggcaaggccatttgtccatggttgtgcagttgatgaaatacggagctgacccatctctcattgacggcgagggctgttcctgtattcacctggccgcacagttcggtcatacatctatcgtcgcctatttgattgcaaaaggccaggacgtcgatatgatggatcagaacgggatgactcctcttatgtgggccgcatataggacccactctgtcgatcccactcggctcctgttgaccttcaacgttagcgtgaatctgggtgacaagtatcataagaataccgccctgcattgggctgtgctcgctgggaacaccaccgtgatctctctcctgctggaggcgggagccaatgtcgatgctcagaatatcaagggcgagagtgcattggacctggctaaacagcgcaagaacgtgtggatgatcaatcatttgcaggaggcaaggcaggccaaaggctatgacaaccctagtttccttcggaaattgaaagctgataaggagtttcgacagaaagttatgctgggtactccattcctcgtcatttggttggtgggattcatcgcagatctcaatatagactcctggttaattaagggactgatgtacgggggagtgtgggcgaccgtgcagttcttatccaaaagtttttttgatcactcgatgcattccgctcttcctctgggtatatatctcgctaccaagttttggatgtatgtgacctggtttttttggttttggaacgatctcaactttctatttatccatttgcccttccttgccaactctgtggcattgttctataacttcggcaaatcttggaaaagtgacccaggtattataaaagcaaccgaggagcagaaaaagaagaccattgtggaactcgccgaaaccggaagccttgatctatcaattttctgctccacttgcctgatcaggaagcctgtaaggagcaagcattgcggcgtttgcaaccgctgtatagcaaagtttgaccaccattgtccttgggtgggcaattgtgtgggagctggaaatcataggtacttcatgggttatttgttctttctgctttttatgatttgctggatgatctatggatgtatctcttattggggtcttcattgcgagaccacatacaccaaagatggcttttggacttacataacccagatcgcaacgtgctccccgtggatgttttggatgttccttaatagcgtgtttcacttcatgtgggtggcggttctcttgatgtgtcaaatgtaccagatctcctgtctaggaattaccacaaacgagagaatgaacgcgaggcgctataagcactttaaggttaccactacgagtattgagagcccattcaatcacggatgtgtgaggaatatcatcgatttcttcgagttcaggtgttgcggcctgttccgcccagtgatcgtggactggacaaggcagtataccatagagtatgaccagatctcaggaagtggctaccaattggtctag

SEQ ID NO: 31642 - DNA, 651 bp, Artificial Sequence
  Description of Artificial Sequence: Synthetic coding sequence
atgagcacaatccctaagagagctgtgtgtccattttccacccagagatatggaatttatgaaagatgtagagaattggtagaggccggttacgacgtccggcagcctgacaaggagaatgtcacactgttgcactgggctgccattaacaacagaatcgacctggtgaagtattacatctctaaaggtgctatcgtcgaccagctaggcggagacctgaacagcacacccctgcattgggccactcggcaagggcacctgtctatggttgtccagctgatgaagtatggggctgacccctcattgatagacggcgaaggatgtagctgtatccacctggcagcccagttcggccacacctctatcgtcgcgtacctgatcgctaaaggacaggacgtcgatatgatggatcagaacgggatgactcctctaatgtgggctgcttacaggacacatagcgtggaccccactcgcctgttattgactttcaacgtaagcgtgaacctgggggacaagtaccacaagaacaccgccctccattgggccgtcctggcgggaaacacgaccgtaattagcctgctcctagaagccggagccaatgtagacgcccagaacataaaagccatattgaggtgtcatatggctctctag

SEQ ID NO: 31643 - DNA, 1899 bp, Artificial Sequence
  Description of Artificial Sequence: Synthetic coding sequence
atgcaaagggaggagggctttaacactaagatggctgacggtcctgatgagtacgatactgaagcgggttgcgtgccccttctgcatcccgaggaaatcaagccacagagccattataaccacggatacggcgagccgcttggacgaaagacacatattgacgactactctacatgggatattgtgaaggccacccagtacggcatctatgaacgatgccgagagctggtggaagcaggatatgatgtgcggcaaccagataaggagaacgtgactttgctgcactgggcggctataaataaccggattgacctcgtcaagtactacatctcaaaaggagctattgtggaccagttaggcggagacctgaacagtaccccactccactgggcaaccaggcagggacatttaagcatggtagtacagctcatgaagtacggggctgaccctagtctgattgacggggaagggtgctcatgtatccacttagccgcacaattcggacacacatcaatagtggcctacttgattgccaagggccaggatgtggacatgatggaccaaaatggaatgaccccacttatgtgggccgcttaccgcacccactccgttgacccgacacggctgctgttgacctttaatgtcagcgtgaacttgggggataagtaccacaagaacaccgcactccactgggctgtgctcgcaggtaacaccaccgttatctcgctgctcctggaagcaggcgcaaatgtcgacgctcaaaacattaagggcgagagcgcactggacttagcaaagcagaggaaaaatgtctggatgatcaatcacctccaagaggcgagacaagccaaaggttatgataacccgtccttcctgaggaagttgaaggctgacaaagagttccggcagaaagtaatgttaggcacacccttccttgtgatctggcttgttggatttatcgctgatcttaacatcgatagttggctgatcaagggcctgatgtacgggggtgtttgggctaccgttcagttcctttctaagagcttcttcgatcattcaatgcacagcgcgcttcctcttggaatctacctagctaccaaattctggatgtatgttacctggttcttttggttttggaatgatctcaattttctcttcatccatctgccattcctggctaactctgttgccctgttttacaactttggtaaatcttggaagtctgaccccggtatcataaaagccacagaagaacagaaaaaaaaaacaattgtcgagctcgccgaaactggaagcctggatctgagtatattctgttcaacctgccttatcagaaagcccgttcgctcgaaacactgtggcgtgtgcaaccgatgcattgccaagttcgaccatcattgcccctgggtggggaattgcgtgggcgcaggaaaccacagatacttcatggggtatctgttctttttactgttcatgatttgttggatgatctacggctgcatctcatactggggactgcattgtgagactacctacactaaggacggcttctggacctacatcacccagatcgcgacatgctccccctggatgttctggatgtttctaaactccgtgttccattttatgtgggttgcggtccttctgatgtgtcaaatgtaccagatttcatgcttggggatcactactaatgagcgcatgaatgccaggaggtataaacattttaaagtcacaacgaccagcatcgagagccccttcaatcacggatgtgtccgtaatattatcgatttctttgagtttcgatgctgtggccttttcaggccggtcatcgttgactggacaaggcaatataccatcgaatacgaccagatcagcgggagcggatatcaactggtctag

SEQ ID NO: 31644 - RNA, 1494 nt, Artificial Sequence
  Description of Artificial Sequence: Synthetic coding sequence
augacagucuuucugaguuucgccuuucuggcugccauccucacacacaucggcuguagcaaccagagacggaguccggagaacucuggcaggagguacaaucgcauucagcacggucaaugugcuuacaccuuuauucuccccgaacacgauggcaauuguagggaaucaaccacagaccaguacaacacgaaugccuuacagcgggaugccccucauguggagccagauuucuccucccagaagcugcagcaccuugaacaugugauggaaaacuauacacaaugguugcaaaagcuggaaaauuacauuguggagaauaugaaaucagaaauggcccagauccagcaaaaugccguccagaaccacacagccacaaugcuggaaauuggaacuucccucuugucacagaccgcugagcagaccagaaaacuaacugacguugaaacucaggugcugaaucagaccagcagacuugagauccaacugcucgaaaauagcuugaguaccuacaaauuggaaaaacagcuccuucaacagaccaaugaaauccuuaagauacaugagaagaacucgcugcucgagcacaaaauccucgagauggagggcaagcacaaagaagaguuggauacuuuaaaagaagaaaaagagaaccugcaaggguugguuacacgucagacauacauuauucaggaauuggaaaaacagcuaaauagggccaccacaaacaacucaguccugcagaagcaacaacuggaguuaauggacacuguucauaaccugguaaaucugugcacaaaagaggucuuacugaagggaggcaaaagagaagaggagaagccuuuuagagacugcgcugaugucuaucaagcgggauuuaacaaaagcggaauauacacuaucuacaucaacaacaugcccgagccuaagaagguguucugcaauauggacguaaacgggggggguuggacagugauucaacacagggaggacgggucacucgacuuucagcgaggauggaaggaguacaaaauggguuuuggaaauccuagcggcgaauauuggcuaggaaaugaauuuauuuuugcuaucacuagccaacgacaguacauguuacggauagagcugauggacugggaagggaaccgggcauacucacaguaugauagguuucauauugggaacgagaaacagaauuauaggcuguaccucaaaggacacacaggcacggcuggaaaacaaucaucuuuaauucugcacggagccgauuucagcaccaaggacgccgauaaugacaacugcaugugcaaaugcgccuuaaugcucacugggggcuggugguucgacgccugcggcccaucaaauuuaaacggaauguuuuacacagcgggacagaaccauggcaagcugaaugggauuaaauggcauuauuucaagggcccuuccuacucccugcgcucaacuacuaugaugauucggccacuggacuuuuag

SEQ ID NO: 31645 - RNA, 459 nt, Artificial Sequence
  Description of Artificial Sequence: Synthetic coding sequence
acagugaguaaucuucuggagcacaagauucucgagauggagggcaagcauaaagaggaguuagauacccugaaagaagagaaggagaacuugcagggccugguaacaaggcagaccuacaucauacaagaacuggagaaacaguugaaucgggcuacuacaaauaacagugucuuacagaaacagcagcuagagcucauggacacuguacacaauuuggucaaucuguguacaaaggaaggcguacugcugaagggggguaagagggaagaggagaaaccauuuagggauugugcagaugucuaccaggcaggguucaauaaauccggaaucuauacuauauacauaaacaacaugcccgagcccaagaagguauucuguaacauggacgugaauggcggcggauggacugugauacagcaccgagaggacggcagucuggauuuccagcgugguuag

SEQ ID NO: 31646 - RNA, 1497 nt, Artificial Sequence
  Description of Artificial Sequence: Synthetic coding sequence
augacaguuuuucuaucguuugcguuccuggccgccauccucacacauauuggaugcucgaaccagcgacggagccccgaaaacucaggaaggcgguauaauagaauccaacacgggcagugcgcauauacauuuauacuacccgaacaugauggaaacugccgcgaaucuaccacugaucaguauaauacaaacgcucuucagcgggacgccccccacguggaacccgauuucaguucgcaaaaauuacagcaucuggagcacgugauggaaaauuacacacaguggcuucaaaagcucgagaauuauauaguggagaauaugaagagugagauggcacagauacaacaaaaugcagugcagaaccacacagcaaccaugcucgagauuggcaccucccugcucagucagacugccgagcagacccggaagcugacggacguggagacucaggugcuuaaucagacuagccgauuagagauccagcuccuggaaaacaguuuaagcaccuauaagcucgagaaacagcuccuccaacagacuaaugaaauauuaaagauccacgaaaagaauucgcuucucgagcacaagauuuuggagauggaggguaagcacaaggaggaguuggacaccuugaaagaggaaaaagagaaucugcaggggcucgugacacgucagaccuacauuauccaagaacuggaaaaacaacucaaucgcgccacuacaaauaacucaguauugcagaaacaacagcuggaauuaauggacacugugcauaauuuagucaauuugugcaccaaggaagggguguugcugaaaggcgggaaacgggaggaggagaagccauuucgcgauugcgccgacguuuaccaagccggauucaauaaguccggaaucuauacgaucuacauuaacaauaugcccgaacccaaaaaaguuuuuugcaauauggaugugaacggugguggauggacagugauacagcaccgugaggacggcucacuagauuuucagcggggcuggaaagaguauaagaugggcuucggcaauccguccggugaauauugguugggaaacgaauuuauuuuugcuaucacuucgcaacgucaguauaugcucaggauugaacugauggauugggagggaaaccgggccuauagccaguacgauagauuucauaucggcaacgaaaaacagaacuaucggcuuuauuugaaaggucacaccgguacugccggaaaacaaucuucacucauucuucacggcgccgacuuuagcacaaaagacgcggacaaugauaauugcaugugcaagugcgcacuuauguuaacagggggauggugguuugaugccuguggcccauccaaccucaaugguauguucuacacagccggacagaaccacgguaaacugaacgguauaaaauggcauuacuucaaagggccuuccuauucauuacgcuccacuacgaugaugauuaggccacuggauuucuag

SEQ ID NO: 31647 - RNA, 894 nt, Artificial Sequence
  Description of Artificial Sequence: Synthetic coding sequence
auggaagguaagcacaaagaggaacuggauacacugaaggaggaaaaggagaacuugcaagggcuagugacaagacagaccuauaucauacaggaauuagaaaagcaguugaaucgugccaccaccaacaacucuguucuucagaaacagcagcuggagcuuauggacacaguucacaaccuuguuaaccucugcacaaaggaaguucugcugaaaggcggcaagagggaggaagagaagccuuuccgggacugcgccgacguguaucaggcuggauucaauaaaaguggcauuuauacuauauauauuaauaacaugccagagccgaagaaaguguuuuguaacauggacguaaacggcggcggauggacggucauacagcaucgugaggacgguucccucgauuuucagagaggguggaaagaguacaaaaugggcuucggaaauccauccggggaauacuggcucgggaaugaguuuaucuuugcuaucacaucccaaaggcaauacaugcuucgcaucgagcugauggauugggaaggaaaucgagcauauagccaguacgaucgcuuccacaucggaaaugaaaaacaaaacuaccggcucuaccuuaaagggcacacugguacagcagguaagcaguccagccucauucugcacggggccgauuuuuccaccaaagacgccgauaaugacaacugcauguguaaaugugccuugauguugaccgggggcuggugguucgaugccuguggaccuagcaauuugaauggaauguucuacacugcaggccagaaucacggaaaguuaaacggcauaaaguggcacuacuucaagggccccuccuauucacugcgaaguacaacgaugaugauccgaccacuggauuucuag

SEQ ID NO: 31648 - RNA, 897 nt, Artificial Sequence
  Description of Artificial Sequence: Synthetic coding sequence
auggagggaaaacauaaagaagaacuagauacauugaaggaggagaaagagaaccugcaaggauuggucacaaggcagacuuauauuauucaggagcuagaaaagcagcuaaaucgggcaacgacaaauaauucugugcuccagaagcagcagcuggaacugauggauaccguccacaaucucguuaaucuguguacgaaggaaggcgugcugcuuaagggggggaaaagggaagaggagaaaccguuccgcgacugugcggacguguaucaggccggguuuaauaagucaggcauuuacacgauuuacaucaacaacaugccugagcccaaaaaaguguucuguaacauggacgugaacggaggcggcuggaccgugauucagcaccgugaggauggcaguuuggacuuccaaagaggcuggaaagaauacaaaauggguuucgggaauccguccggcgaguauuggcucggaaaugaauucaucuucgcuauuacaagccaacgccaauauauguuacgcauugaacuaauggacugggaggggaaccgcgcauauucacaauacgauagauuccacauaggcaacgaaaagcagaacuaucgccucuaucugaagggccacacaggaacagcaggaaaacagagcucucucauucugcacggagccgacuucucuaccaaagaugcugacaaugauaacugcauguguaaaugcgcucucauguugacuggcggcuggugguucgacgcauguggcccuaguaaucugaaugggauguuuuauacagccggacaaaaucacggcaaguugaacgggauuaaguggcacuacuucaaagguccuucuuacagucuucgaucaacuaccaugaugauccgaccccuggauuucuag

SEQ ID NO: 31649 - RNA, 720 nt, Artificial Sequence
  Description of Artificial Sequence: Synthetic coding sequence
auggcucacgccgguaggacgggauacgauaacagggagaucgugaugaaauacauacacuauaagcucucccagaggggcuaugaaugggacgccggagaugugggugcugcgccgccgggagcugccccagccccuggaaucuuuucuucucaacccggccacacuccgcaccccgcugccucucgcgaucccguugcaagaacgagcccucuucaaacuccagccgcccccggagccgccgcggguccagcccugucaccgguuccgcccguaguucauuuaacacugagacaggcaggagaugauuuuucaagaagauacagacgggauuuugcagagaugagcagccaauugcacuuaaccccauucacggccaggggcagauuugcuacagugguagaagaguuguuccgagacggcguuaacuggggaaggauugucgcauucuucgaguucgguggagugaugugcguugaauccguuaaucgugaaaugucaccccucguagacaauaucgcucuguggaugaccgaauacuugaauagacaucugcacaccuggauucaggauaacgggggaugggacgccuuuguggaguuauacggacccagcaugagaccccuguuugacuuuucuugguugagcuugaagacccuacuuucucuugcccuugugggggccugcaucacucugggcgccuauuuggggcacaaguag

SEQ ID NO: 31650 - RNA, 720 nt, Artificial Sequence
  Description of Artificial Sequence: Synthetic coding sequence
auggcacaugccggccgaacagguuaugacaaucgcgagauugugaugaaauacauucauuacaaauugucucagcggggcuaugagugggaugcaggcgacguuggugccgcucccccgggcgcagcucccgcccccgggauauucucaucacagccgggccauaccccccacccagcagcuucuagagaucccguugcucgcacuagcccauuacagacucccgcggcccccggagcggccgccggccccgcccugucccccgugccccccgugguucaccugacucucagacaggcuggggacgacuucucucgccguuauagacgcgacuucgccgagauguccucucagcuccacuuaacacccuuuacagcacgcggacgguucgccaccgucguggaagaacuguucagagauggugucaacuggggacguauaguggcauuuuuugaauuuggagggguuaugugugucgaaagugugaaccgagaaaugagcccgcucgucgauaauauagcccuguggaugaccgaauaccuaaaccgucaucuccacaccuggauccaagacaacggcggaugggacgccuucguggaauuauacggaccaagcaugcggccucuguuugauuucaguugguugagccugaaaacgcugcucuccuuagcgcugguaggcgcuugcaucacccuuggggccuacuuagggcauaaguag

SEQ ID NO: 31651 - RNA, 618 nt, Artificial Sequence
  Description of Artificial Sequence: Synthetic coding sequence
auggcacacgcagggcggacaggguacgacaacagagagauagugaugaaguauauccauuauaagcugucacaacguggauaugaaugggaugcuggcgacgucggagcugcaccucccggcgcagcacccgcacccggaauauuuucgagccaaccagggcauaccccucauccugcagcgagccgggacccaguagcucgcaccuccccacugcaaacacccgcggcaccaggagccgcggcuggaccggcacugagccccguuccucccgugguacacuugacccucaggcaggccggggaugauuucagccgccgcuauaggagggauuucgccgagaugucuucacaguuacaccugacaccuuuuaccgcccggggccguuucgcaacgguugucgaagaacuguuucgcgauggggugaacuggggacgcauaguggccuucuucgaguuuggaggaguuauguguguggaaucuguaaaucgcgaaaugucaccgcugguagauaacaucgccuuauggaugacggaguaucugaauaggcaucuucacaccuggauccaagauaacggaggcuggguuggcgcacuaggugaugugucccuuggcuag

SEQ ID NO: 31652 - RNA, 939 nt, Artificial Sequence
  Description of Artificial Sequence: Synthetic coding sequence
auggcuaaaguguuuucuuuuauacuggucacgacggcucugacuauggggcgggagauuucugcccuggaagauugugcacaggaacagaugaggcuucgugcccaaguucgcuuacuugaaacucgugucaaacagcagcaagugaagaucaagcagcuucuucaggaaaacgaagugcaauuccuugauaagggagacgaaaacaccgugauugaucugggcucuaagcggcaguacgccgauugcucugaaauuuuuaacgauggauauaagcugucugguuuuuacaaaaucaaaccacuccagucucccgcagaauuuucgguuuauugcgacaugagcgacgggggaggauggacaguuauccaaagacggagcgacggcuccgaaaauuuuaaucgaggcuggaaagacuacgaaaauggcuuuggaaauuuugugcagaaacacggggaguacuggcugggcaacaagaaccugcacuuccugacuacgcaagaagauuauacuuuaaaaauagaccuagcugacuuugaaaagaacagccguuacgcccaguauaaaaauuuuaaggugggagaugagaagaacuuuuaugaacugaauauuggggaauacucgggaaccgccggcgacagcuuagcugguaacuuucauccugaaguccaauggugggccucacaucagcguaugaaguucucuacaugggaccgggaccacgacaauuacgaaggaaacugcgccgaagaggaccagucaggguggugguucaacagaugccauagcgcuaaucuaaacggugucuacuauuccggucccuauacagcuaagacagacaauggcauaguaugguacacuuggcacgguuggugguauucccugaagucuguggucaugaaaauccgacccaacgacuuuaucccgaacgugaucuag

SEQ ID NO: 31653 - RNA, 702 nt, Artificial Sequence
  Description of Artificial Sequence: Synthetic coding sequence
augucccagucgaacagagaacucguggucgacuuucucagcuacaaacuuucucagaaaggauauucguggucccaauucucugauguugaagaaaauaggacugaagcccccgaaggaaccgagagugaaauggagacuccuagcgcgaucaacggcaacccaagcuggcaucuggcagacagucccgcggucaacggcgccaccgggcauuccucgucucuugacgcucgagaaguuaucccuauggccgcugugaaacaagcccugagggaagccggcgacgaguucgaacuccgguaccggagagcuuuuucugaucugacuucacaguugcauauuacgccaggcacagcuuaccagucuuuugagcaaguuguaaaugaauuguucagagauggcguaaacuggggaagaaucguagccuuuuuuucauuugguggcgcucugugcgucgaaagcguugacaaggaaaugcaagugcuugugucucgaauugcagccuggauggcuacauaccuuaaugaccaccucgaaccauggauucaggagaauggcgguugggauacauuuguugaacuauacgggaauaacgccgcugcugaaucacguaaaggccaggaacgguucaaucggugguuucuuacaggcaugacuguugcuggggucguucugcucggcucacuguucucgcgcaaauag

SEQ ID NO: 31654 - RNA, 513 nt, Artificial Sequence
  Description of Artificial Sequence: Synthetic coding sequence
augucgcagagcaaccgagaacucgucguugacuuucuguccuacaagcuuagucagaaaggcuacuccuggucacaguucuccgauguggaggaaaacagaaccgaagccccugaggguaccgagagugagauggagacucccucagcaaucaacggaaaucccagcuggcauuuggccgacucccccgcuguaaacggcgcuaccggacauucaucaucucuugacgcucgcgaagucauuccuauggcugccgucaaacaagcccugagagaggcaggcgacgaguuugaacugagauauagaagagcuuuuagcgauuugacaucacaacuucauaucacccccggaacagcuuaucaguccuuugaacaagacacuuuuguggagcuguacgggaacaacgcagcagcagagagcaggaaggggcaggagcgauuuaaccgcugguuucucacuggcaugacaguggccggagucguccuacuagguucccuguuuaguaggaaauag

SEQ ID NO: 31655 - RNA, 702 nt, Artificial Sequence
  Description of Artificial Sequence: Synthetic coding sequence
augucucagucuaaucgcgagcucguuguggacuuucucucguacaaauuaucgcagaaggguuauagcuggagccaguuuagcgauguugaggaaaaucgaaccgaggcucccgagggaacugaaucagagauggaaacaccaucugcaaucaaugguaacccaucauggcacuuagcagacucucccgcugucaauggagcuacgggccacuccucaagccucgaugcucgggaggugauacccauggcugccgucaaacaagcauugcgcgaggcuggcgaugaauucgaauuaagauaccgucgggccuucagugaccugaccucccaacugcauaucacuccuggaaccgcauaccaaaguuuugaacagguuguuaacgagcucuucagagauggcgucaacuggggcagaauuguagccuucuuuagcuucgggggggcccuguguguggaaagcguggacaaggaaaugcagguccucguuagccggaucgccgccuggauggcuacauauuuaaacgaucacuuggaacccuggauucaggagaacggggguugggauacuuucguggaacuuuacggaaacaaugcggcggccgaaucacgaaaggggcaggaacgcuucaaccgcugguuccugaccgguaugacggucgcggggguuguauuauugggcucacuauucagcaggaaauag

SEQ ID NO: 31656 - RNA, 567 nt, Artificial Sequence
  Description of Artificial Sequence: Synthetic coding sequence
augucacaaucaaaucgcgaacuggucguggauuuucugagcuauaaauuaagucagaagggcuacagcuggucacaauucagcgacguagaggaaaauaggacugaagcgcccgagggaacggaaucagagauggagacucccuccgcuauuaaugggaacccauccuggcaucuggcagacagccccgcuguuaacggagcgaccggacauagcucuaguuuggacgcuagagaaguaauuccuauggccgcagucaagcaggccuuaagagaagccggagaugaguuugaacugagauaucggcgugcuuuuagcgaccugacuagccaacugcauaucacacccggcacagcauaccaaagcuuugaacagguugugaaugaacucuucagagauggcgugaauugggggagaauugucgccuuuuuuaguuuuggcggcgcccuuugcguggaauccguggacaaggaaaugcaggugcuggugaguagaaucgccgcuuggauggccaccuaccuaaacgaccaccucgagcccuggauucaggagaacggcggaugguag

SEQ ID NO: 31657 - RNA, 702 nt, Artificial Sequence
  Description of Artificial Sequence: Synthetic coding sequence
augucucagagcaaccgcgaacugguggucgacuucuuauccuauaaguuaucacagaagggauacagcuggucucaauucagcgacguggaggagaaccgcaccgaagcccccgagggcacagaaucagagauggaaacgcccagugccaucaauggcaacccaagcuggcaucucgccgauucucccgcgguuaauggggccaccggccacucuuccagccucgaugcccgggaaguuauccccauggcugcaguaaaacaggcacucagggaagcaggggaugaguucgagcugagauaucgccgagcuuucucagauuugacaucucagcugcacauuacgccaggaacagccuaccagucuuucgaacagguugugaacgagcuauuuagggauggcgucaauuggggccgcaucguagcuuucuucucuuuuggaggagcccugugugucgaguccguugacaaagaaaugcaaguccucgugucccguaucgcugcauggauggcuaccuaccuaaacgaccacuuggagccuuggauucaggagaacggcggcugggacacuuucguggagcuauauggcaauaacgcggcagccgagucuagaaagggccaggaaagguuuaaucgaugguuccugacgggcaugacuguugccggugucguacugcugggaucucucuuuucccgcaaauag

SEQ ID NO: 31658 - RNA, 567 nt, Artificial Sequence
  Description of Artificial Sequence: Synthetic coding sequence
augucucagaguaaccgagagcuuguuguggauuuuuugagcuacaaacuuagccagaaaggguauucauggucccaguuuucggacguugaggaaaacaggaccgaagcaccagaagggacggagucggagauggaaacccccagcgccaucaacggaaaucccucuuggcaccuggccgacagccccgcggugaacggcgcaaccggucauagcucuucccuugaugcccgcgaagugaucccgauggcugcugugaaacaggcucugcgggaggccggagaugaauucgaacuacguuacaggagggcuuucucagaucucacaucucaguugcauaucacacccgggaccgcauaccaaagcuuugaacaaguagucaaugagcucuuccgcgacggaguuaacuggggccgcauuguggccuuuuuuucauucgggggugcgcugugcguggaaucaguggauaaggagaugcagguacucguuuccagaaucgccgcuuggauggcuacauaucuaaaugaucaccuagaaccuuggauccaggaaaacggggguugguag

SEQ ID NO: 31659 - RNA, 147 nt, Artificial Sequence
  Description of Artificial Sequence: Synthetic coding sequence
augucacaaucaaacagagaacucgugguggauuuucucucuuacaaacucucgcaaaagggauauucauggagccaguucucagacguggaagagaacagaacugaggccccugaaggaacagaaagcgaaauggagacccccuag

SEQ ID NO: 31660 - RNA, 546 nt, Artificial Sequence
  Description of Artificial Sequence: Synthetic coding sequence
augagucagucuaacagagagcucguuguggauuuccuuagcuacaaacuaucccagaaaggcuauucuuggagccaauucagugacgucgaagaaaaucgcacugaggcacccgaagguacugagucugagauggagacuccuuccgccaucaaugguaacccaucuuggcaccucgcagacaguccugcagucaauggcgccacaggacacuccucuucuuuagacgcuagggaggucauccccauggcagcagugaagcaagcacucagggaagcaggugacgaauucgaacuuagguaucggagggcauucagugaucugaccucacagcugcauauaacuccuggcacugcauaccagagcuucgagcaggucgucaaugaauuauuuagagacgggguuaacuggggacggaucguggcuuucuuuuccuucggaggugcucucuguguugaaucuguagacaaggaaaugcagguccuugugucucgcauugcugccuggauggcaacuuaccugaacgaucaccuggagccaugguag

SEQ ID NO: 31661 - RNA, 618 nt, Artificial Sequence
  Description of Artificial Sequence: Synthetic coding sequence
augucucaaucaaacagagaauuggugguagacuuucugaguuacaaguuaucccaaaaagguuacucuuggucccaguucagugaugucgaggaaaauagaaccgaagcucccgaagggaccgaaagcgagauggagacaccaucagcuauuaaugggaaucccucguggcaucucgcagacagcccugcuguaaauggcgcaacaggacacagcuccagccuggacgcucgagaaguuaucccuauggccgccgugaagcaggcgcuucgugaggcuggcgacgaguuugagcucagauacaggagggcauucagcgauuugaccagucagcuacacauuacccccggaacugccuaccagucguucgaacaaguggugaaugaacucuucagagacggcguaaacuggggccgcaucguggcauuuuucagcuuuggaggugcucugugcguugaguccguggauaaggaaaugcagguucuuguaagucguauugcugcauggauggcuaccuaccuuaacgaccacuuagagccuuggauucaggaaaacggcgguugggacaccuuuguggaauuauacggaaauaaugcugccgccgagucccgaaaauag

SEQ ID NO: 31662 - RNA, 567 nt, Artificial Sequence
  Description of Artificial Sequence: Synthetic coding sequence
augagccagaguaacagagaacuggugguggacuuucucuccuauaagcucucacagaagggcuauuccuggagucaauuuagcgauguagaggagaaccgaacagaggcccccgaaggcacagaguccgagauggagaccccuucggcaauuaacgguaauccaucuuggcauuuggcugauaguccugcaguuaauggggcaaccggacacaguuccuccuuggaugcacgggagguuauacccauggccgccguaaagcaagcccuccgagaggccggcgaugaauucgagcugagguauagacgagcauucagcgaucuuaccucccaacugcacauuacuccagggacugcauaucagucauuugaacaggugguuaacgagcuauuccgcgauggcgugaacugggggagaauugucgcuuuuuuuucauuuggcggugcucuguguguggaaucaguugacaaagaaaugcaaguucugguuagccggaucgccgcguggauggcuaccuacuuaaacgaucaccucgaacccuggauacaagagaacggaggcugguag

SEQ ID NO: 31663 - RNA, 2613 nt, Artificial Sequence
  Description of Artificial Sequence: Synthetic coding sequence
augaaucacuugaaugugcuggcuaaggcccucuacgauaauguggcagaaucgcccgaugaguuaucuuuucgcaaaggagauauaaugaccguucucgagcaggacacccaaggguuagacggaugguggcuuugcucccuucauggaaggcagggaaucgucccaggaaaucguuuaaagauucuagugggcauguaugauaagaagccugccgggccgggaccagguccacccgccaccccagcucaaccacaacccggccuccacgcgcccgcgccucccgcuagucaguauacuccaaugcuccccaacacauaccaaccccagccugauucuguauaucuggucccaacccccagcaaggcucaacagggccuuuaucaggucccugguccgaguccccaguuucagucuccaccggcuaaacaaacaucuacuuucucuaaacagaccccacaucauccauuccccucgcccgcaacugaccuguaucaagucccaccagggccuggaggaccagcucaggauauauaucagguaccaccaucugccgggaugggccaugacaucuaccaggucccuccgagcauggacacucgaucuugggaagggacaaagccaccugcaaagguggucguacccaccaggguggggcaaggguauguuuaugaggcugcccagcccgaacaggaugaauacgacaucccucgucacuuacuggcuccaggcccacaggauauauacgacgugccucccguacgcggacuccuccccucccaauacgggcaggaaguguacgauaccccaccaauggcagugaaagggccuaacggucgggacccccuacuggaggucuaugacgucccacccucaguggagaaaggcuuaccacccuccaaccaccacgcuguguacgacguaccccccucagugucuaaagaugucccugauggaccgcugcugagggaggaaacuuacgacguuccucccgccuucgcuaaggcuaagccauuugaccccgccaggacaccccucguccuugcugccccuccucccgacucucccccagcagaggaugucuacgacguucccccgccugcgccggaccucuaugaugugccccccgggcuuaggcgcccgggccccggcacucuguaugacgugccucgugagcgcgucuugccaccugaaguagcagacggcggcgugguugacucuggugucuaugcugucccuccucccgcugaaagagaggccccagcagagggcaaaaggcuguccgccucaucuacgggcaguacccgaucaucucaauccgccucuucucuugaaguggcagggccaggacgggaaccacucgaauuggagguggccguggaggcccuugcccggcugcagcagggggugucagcuacaguggcucaucuacuggaucuagccgguagugccggagcaaccggaagcuggaggucucccucugaaccucaggagccacugguucaagacuugcaggcugccgucgccgcuguccagagugccguucacgaacuguuagaguuugcacgaucggccgugggaaacgcagcacacaccagugauagggccuugcaugcuaagcuuucucgacaacuccagaaaauggaagacguccaccagaccuugguagcccauggacaggcuuuggaugcugggcggggugguaguggggcaacccuugaagaccuugaccgguugguagcuugcagucgggccgucccggaagacgccaagcaacuggcgaguuuucugcacggcaacgcaagccuacuauucagacggacuaaagcuacagcaccaggcccggagggagguggaacucuccauccuaauccgacugacaaaacuuccucaauucaaucuagaccacugccuucucccccuaaguuuacaucucaggauagucccgauggucaguacgagaauagcgaaggagguuggauggaggauuacgauuaugugcaccugcagggcaaggaagaauucgagaagacccagaaagagcugcuggagaaaggaaguaucacccgacaagguaagagucaguuagaacugcagcaguuaaaacaguuugagagauuggaacaggaaguaucuaggccuauugaccacgacuuggcgaauuggacaccggcgcagccauuggcacccgggcguacuggcggccucggcccuucagauaggcagcugcuacuguuuuaccucgaacaaugcgaggcuaauuugacaacccuaacuaaugccgucgaugcauucuucacggccguggcaacuaaccagccaccuaaaaucuucguggcacacucgaaguuuguaauucugucagcccauaaacugguguuuaucggggacacccucucuaggcaagcaaaggcugccgacguccguucccaaguaacacacuauagcaaccucuugugcgaucuacuucguggcauaguagcuacuacgaaagcugccgcgcuucaguaccccaguccaagcgccgcgcaagauaugguagagcguguuaaggaacuggggcacucaacucaacaauuuaggcgcguguugggccaacuggcugcagccuag

SEQ ID NO: 31664 - RNA, 1563 nt, Artificial Sequence
  Description of Artificial Sequence: Synthetic coding sequence
auggaaggagggcccgccguauguugucaggacccccgcgccgagcugguggaaaggguugccgcaauagaugugacccauuuggaggaggcggacgguggccccgagccaacccgaaaugguguugauccucccccccgagcccgggcugccagcgugaucccugggaguaccucaaggcuuuugccggcuagaccaagucugucugccaggaagcugagccugcaggagcguccagcuggaaguuaccucgaggcacaggccggcccuuaugcaacuggcccagcuagccacauuucaccucgcgcguggagacggcccaccaucgaaucucaucauguggcuauuagcgacgcagaagacugugugcagcuuaaucaguacaagcuucagagcgagauugggaaaggcgccuauggcgugguucgacucgccuauaacgaaucugaggacagacauuacgcaaugaaaguucuaucuaaaaagaaacuacuuaagcaauauggauucccccgccgcccgcccccacguggcucccaggcugcccaggggggaccugcuaagcagcuccuaccgcuggagaggguguaucaggaaaucgccauccuuaaaaaacucgaucaugugaaugucgugaagcucaucgaagugcuggacgacccagcugaagacaaccuguauuuggcucugcagaaccaggcucagaauauacagcuggacuccacgaauaucgcaaagccucauagucuuuuaccuucggagcagcaggacucagguagcaccugggcagcacgcaguguguucgaccuacuuagaaaaggaccuguuauggaggugccuugcgacaagccuuucagcgaggagcaggcuaggcuuuaucucagggacgugauacucgggcuugaguaccuacacugucagaaaauuguucaccgagauauuaagccaaguaaccuccuccucggggaugaugggcacguaaaaauugcagauuucggcgucucaaaucaauucgaagguaacgaugcucagcucuccucaacagccgguacuccugcuuucauggcgccugaggccauaucagacaguggacaaucauucuccggaaaagcucuggaugucugggcuaccggcgugaccuuguauuguuucguguacggaaaaugccccuuuauagacgacuucauacuggcuuugcaccgaaagaucaagaaugagccugugguguuuccagaagaaccugagauuagcgaggaauugaaggaccugauccugaagaugcuggauaaaaacccugagacuagaaucggcgugcccgacaucaagcuccaccccugggugacuaaaaacggugaggaaccacucccaagugaggaagagcauugcaguguggucgaagugacggaagaggaggucaagaauaguguccggcuuauaccaagcuggacuacggugauucugguaaaaagcaugcuuagaaagcgcagcuucggcaauccauuugagccucaggcgcgaagagaagaacggucgaugagcgcccccgggaaucuacuuguauag

SEQ ID NO: 31665 - RNA, 1020 nt, Artificial Sequence
  Description of Artificial Sequence: Synthetic coding sequence
auguggcagcugugggcaagccucuguugccugcuggugcuugcaaacgcccggagcagaccaucguuucacccucuuuccgacgagcucguuaacuacgugaacaaaagaaacacaacuuggcaggccggacauaauuuuuacaacgucgauaugucauaccucaaaaggcugugcgguacuuuuuuagggggaccaaagcccccucagcgugucauguuuacagaggaccuuaagcugccagcuucuuuugaugcuagagaacaauggccccaauguccaacaauuaaagagauuagagaccagggcagcuguggcaguuguugggcauuuggagcuguggaggcaaucagugauagaaucugcauccacaccaaugcacacguuucaguagaagugagugcugaagaccuucugacaugcuguggaaguauguguggcgacggcuguaacggcgguuacccagcagaagcauggaacuuuuggaccaggaaggguuugguuagcggcggcuuguaugagagccauguugguugccgcccuuacuccauaccuccuugcgagcaccacgucaauggcucaagaccccccugcacaggcgagggggauaccccaaaauguagcaaaaucugcgaaccgggcuacuccccuacauauaaacaagacaaacauuaugguuauaacagcuauucagucucuaauuccgagaaagacaucauggccgagaucuacaagaacggaccuguugagggagcauuuucuguguacagugacuuccuucuguauaaaucugguguguaccaacacgucacaggagagaugaugggcggccaugccaucaggauccugggauggggaguggagaaugggaccccauacuggcugguagcuaauagcuggaauacagauuggggggacaacggauuuuucaagauucuucggggccaagaucacugcggcaucgaguccgaagucguggccggaauaccuaggaccgaccaguacugggagaagauauag

SEQ ID NO: 31666 - RNA, 1020 nt, Artificial Sequence
  Description of Artificial Sequence: Synthetic coding sequence
auguggcagcucugggccucucugugcugccuucuggugcuggccaaugccagaagucgcccaucuuuucacccccucucugaugagcugguaaauuacguuaacaagcgaaacacaacauggcaggccggccacaacuuuuauaauguugacaugagcuauuuaaagaggcuuugcggcacuuuccuuggcggacccaaaccuccccagcgcguuauguucaccgaagaucuaaaacuuccggcuucuuuugacgcccgggaacaguggccccaguguccaaccauuaaggagauccgggaccagggauccuguggaucaugcugggccuucggcgccguagaagcuauauccgaucguauuugcauccacaccaaugcucauguaucaguggaagucucugccgaagaccugcucaccugcugugggucuaugugcggcgacggguguaaugguggguacccagcugaagcguggaacuuuuggacccggaagggucuugugucuggaggccuguacgagucucacgucggcuguagaccuuacucaaucccuccaugugagcaccaugugaaugguagccgccccccguguacaggagaaggggacacacccaaaugcucaaagauuugugaaccuggauacucacccacauauaaacaagacaagcacuacggcuacaacaguuauucugugucuaacucagaaaaagauaucauggcugagaucuauaagaauggaccgguggaaggcgccuuuucaguguacagugacuuccucuuauacaaguccggaguguaucagcacgugacuggcgaaaugaugggugggcaugcuauucgaauccucggcuggggcguagaaaacggcacacccuauuggcuggucgccaauucuuggaacaccgauuggggcgauaaugguuuuuuuaaaauccugcgcggacaggaccauugcgguaucgaauccgaagugguagccggaaucccuagaaccgaccaguacugggagaagaucuag

SEQ ID NO: 31667 - RNA, 333 nt, Artificial Sequence
  Description of Artificial Sequence: Synthetic coding sequence
auguggcaacuuugggcuucauuaugcugucuucuaguucuggcuaaugcgcgcucccgcccuuccuuccauccucuguccgacgagcuggugaacuacgucaauaagcgcaacacuacauggcaggccggacacaacuucuauaauguagauaugaguuaccuaaagagacucugcggaaccuuuuugggcggaccaaagccuccacaacgcguaauguuuacugaggaucugaaguuaccugccuccuucgacgcacgcgaacaguggccacagugcccuaccaucaaagaaaucagagaucaaggguccugcgguucuugcuggcucuag

SEQ ID NO: 31668 - RNA, 1020 nt, Artificial Sequence
  Description of Artificial Sequence: Synthetic coding sequence
auguggcagcuuugggccucccucugcugcuuacugguuuuggcuaaugcccgaucucgcccauccuuccacccccuguccgacgagcugguuaacuacgucaauaaaagaaacaccacuuggcaggccgggcauaauuuuuacaacguugacaugaguuaucuuaaacgccucugugguacguuucugggcggaccuaaaccaccucagcgcgugauguuuaccgaagaccugaagcuccccgccucauucgaugcucgugaacaauggccucagugccccacaauuaaggaaaucagagaccaaggcuccugcggaaguuguugggccuucggagccguggaagccauuucugaucgcaucugcauacacaccaacgcucacgucuccguugagguuucggccgaggacuuguugacguguugcggguccaugugcggcgacgguuguaaugggggauacccagcagaagcguggaauuuuuggacaaggaaaggacuggugaguggagggcuguaugagucacauguuggcuguaggccuuauucuaucccuccaugugaacaccaugugaauggaucucgaccucccuguacuggagagggugauaccccuaaguguaguaagaucugcgagcccggguauucucccacauauaaacaggacaagcacuaugguuacaacuccuacagugugucaaauucugagaaggauauuauggccgagaucuauaaaaacggcccuguagaaggcgccuuuuccgucuacucugacuuccugcuguauaagucuggaguguaccaacacgugacaggcgaaaugaugggcggccacgcuauaaggauucugggcuggggagucgaaaacggaaccccauacuggcucguggcuaacagcuggaauacagauuggggagauaacggauucuucaagauccugcgagggcaagaccauuguggaauugagucagaaguggucgcugguaucccuaggacagaucaauacugggagaagaucuag

SEQ ID NO: 31669 - RNA, 1020 nt, Artificial Sequence
  Description of Artificial Sequence: Synthetic coding sequence
auguggcaacuuugggcuuccuuguguugccuguuagugcuagccaacgcgcggucaaggccaucuuuucacccucugucugacgaacuggucaacuacguaaacaaaaggaauaccaccuggcaagcuggccauaacuucuauaacgucgauaugucuuacuuaaaacgacuuugcgggacauucuugggaggaccuaaaccuccccagagaguaauguucaccgaagaccugaaacucccagcuagcuuugaugcacgggagcaguggccucagugcccuacaauaaaagagauaagggaucaggguucuugcggcagcugcugggcguucggggccguggaggccauuagcgaucgaauuugcauucauaccaacgcucacgugucuguugaagugucagcggaagacuugcucacuuguugcgguagcaugugcggcgauggaugcaacggagguuauccagcugaggccuggaacuuuuggaccaggaaaggucugguuucugguggucuguacgaaucccacguagguugccggccuuacuccauuccacccugcgagcaucaugucaacgggagcagaccaccuuguacaggagagggcgauaccccgaaauguagcaaaauuugugagcccggcuacucccccacauacaagcaagauaagcacuacggguacaacucauauagcguaucuaacucugagaaggacaucauggcugagaucuauaaaaacgggcccgucgaaggagcuuucucaguguacuccgacuuccuauuauacaaaucugggguguaucagcaugucacuggugagaugauggggggucaugccauucggauucuggguuggggggucgagaacggcacgccauacugguuaguggcuaacuccuggaacaccgacuggggggauaacgguuucuuuaaaauccugcgcggucaggaucacugcggcauugaaagcgaaguuguugcaggcaucccuagaacugaccaauacugggagaagauuuag

SEQ ID NO: 31670 - RNA, 1020 nt, Artificial Sequence
  Description of Artificial Sequence: Synthetic coding sequence
auguggcaacuuugggcaucccuuuguugccuccuuguuuuagcuaacgccaggucccgcccgucguuccaucccuuauccgaugaacucgugaauuacguaaauaagagaaacacuacguggcaggcaggucauaauuuuuacaacguagacaugucuuacuugaagcgacugugugguaccuuuuugggaggaccaaaaccgccccagcgagucauguucacugaggaccuuaaacucccugcaagcuuugaugcgcgcgagcaauggccucagugccccacuauaaaggagauaagagaucaggggucgugcggcucauguugggcauucggcgcuguggaggccaucucggacaggaucugcauccauaccaacgcacacguuagugucgagguuagcgcggaagaucugcuaacaugcugcggcaguaugugcggagacggcugcaacggugguuauccagcggaagcauggaacuucuggacaaggaaaggccuugugagugguggacuuuacgagucucacgucggcugucgccccuacaguaucccgccgugugagcaucacgugaaugguuccagaccuccuugcaccggcgaaggcgacaccccaaaguguucaaagaucugugagcccggcuacuccccaacauacaaacaggauaagcauuauggguauaacucuuacagugucaguaacagcgagaaagauauaauggcagaaauauacaaaaauggaccagucgaaggagccuuuucaguguacagcgauuuucuccuguacaaguccggcguguaucagcauguaaccggugagaugaugggggggcacgcaauuaggauccuugguuggggcguggagaacgggacuccuuacuggcucguggcuaacagcuggaacacugauuggggggauaacgguuucuuuaaaauuuugagggggcaggaccacugcggcauagaaagcgaagucgucgcaggcauaccaagaacagaccaguacugggagaaaauuuag

SEQ ID NO: 31671 - RNA, 1020 nt, Artificial Sequence
  Description of Artificial Sequence: Synthetic coding sequence
auguggcaacugugggcuagccucuguugcuuauuaguccucgcuaaugcacgaucgcgcccaagcuuccauccauugucagacgaauuaguaaauuacguuaauaaaaggaauacgaccuggcaagcugggcacaacuucuacaauguugacaugagcuaucucaagagacucugcgggacauuccuuggcgggccuaagccaccacagagagugauguucacggaggaccugaaacuaccagcaucauucgaugcucgggaacaguggccucagugcccuaccauaaaggagauacgagaccaaggcaguugcggaucuugcugggcguucggggcaguagaagcgauuuccgauagaaucuguauacacacuaaugcacacguuuccguggaagucucugccgaggaccugcuuaccugcuguggaagcauguguggugauggcugcaacggcggguacccggcagaagcauggaacuucuggacucggaaaggucucgugagcggcggccucuacgaaagucauguaggaugucgaccauacagcaucccacccugcgaacaucaugucaacggcagccgaccuccuugcacaggugaaggggauaccccuaaauguagcaaaaucugugagcccggauauucucccaccuacaaacaggacaaacacuacggcuauaauucuuacagcguguccaacucugaaaaagauaucauggccgaaauauacaaaaacggucccguggagggagccuucucugucuacagcgauuuucuccuguauaagagcggcguguaucaacauguuaccggcgaaaugaugggggggcacgcaauacgcauccuggguuggggcguggagaaugggacccccuacuggcuggucgcuaauucuuggaacacugauuggggggauaaugguuucuucaaaauccugcgggggcaggaucacugugggaucgaaucggaaguaguggccggaaucccuagaacagaccaguauugggagaaaauuuag

SEQ ID NO: 31672 - RNA, 1020 nt, Artificial Sequence
  Description of Artificial Sequence: Synthetic coding sequence
auguggcagcucugggccucucucugcugccugcuggugcucgccaaugccaggaguagacccuccuuccauccucuguccgacgaacuggugaacuacgugaacaaacggaacacaacauggcaagcagggcauaauuucuacaaugucgauaugucauaucugaaacggcucugugggacauuucuuggaggacccaaaccaccacagcgggucauguucaccgaagaccucaaacugccagcuuccuuugacgcacgagaacaguggccccaauguccgacuauuaaagaaauaagagaccagggaucaugcgggagcuguugggccuuuggagccguggaggcuauaagugacagaaucuguauccacacaaacgcccacguaagcgucgaagucucugcugaagaccugcucacaugcugcggaucaaugugcggagacgggugcaacggcggguacccugccgaggcauggaacuucuggacucggaagggccuggugucgggcggacuguaugagucucacgugggaugucgacccuauucaaucccuccuugcgaacaccaugucaaugguagccgcccuccuugcacuggcgagggggauacuccaaaaugcuccaagaucugcgagccaggauacuccccuacauacaaacaggauaagcauuacggauauaacagcuauuccguguccaauucugagaaagauauuauggcugagauuuacaagaauggcccgguugagggugcauuuagcguguauucugacuuccugcuauacaaauccggaguauaccaacauguuaccggcgaaaugauggguggacaugccauacgcauccugggauggggcguggagaauggaacuccuuauuggcugguugcuaacagcuggaauaccgacuggggcgauaacgguuuuuucaaaauccugaggggacaggaccacugugguauugagucugaaguuguggcaggcaucccccggaccgaucaauauugggagaagauauag

SEQ ID NO: 31673 - RNA, 1020 nt, Artificial Sequence
  Description of Artificial Sequence: Synthetic coding sequence
auguggcagcugugggcaucccuuuguugccuccugguguuggccaaugcccgcucccgaccuucuuuccauccguuaagugacgaacugguuaauuacgugaacaagcggaacacuacuuggcaggccggucacaauuucuauaauguagacaugucauaccugaagaggcugugugguaccuuccuaggcggcccaaagcccccgcaacgcgugauguuuacugaggaccucaagcucccugccaguuuugacgcccgugagcaguggccccaaugccccaccauuaaagaaauccgagaucaagguagcugcggcucgugcugggcauuuggcgccguggaggcuauaucagacagaauuugcauacacacuaacgcacaugucuccgucgagguuuccgcugaagaucugcugacauguugugggucuauguguggcgaugguugcaauggaggcuaucccgcggaggccuggaauuuuuggacacggaagggcuuggugagcgggggguuguacgaaucccacgucgggugucguccguauuccauuccgccgugugagcaccacgucaauggcucaagaccacccugcacuggcgaaggcgauacccccaaaugcucuaaaaucugcgagcccgguuacucaccaaccuacaagcaggauaagcauuacggguauaauaguuacuccgugucuaauucggaaaaggacaucauggccgaaauauauaaaaauggacccguggagggugcuuucuccguauacucugacuuccuucucuauaagucuggaguauaucagcacguaacuggagaaaugaugggcggccacgccauuaggauucugggauggggaguggagaauggcacacccuacuggcugguggcaaauaguuggaauacagauuggggagauaauggguucuuuaaaauucugaggggucaagaucauugcggcauugaaucugaggucgucgccggcauuccucgaaccgaccaguacugggagaaaauuuag

SEQ ID NO: 31674 - RNA, 831 nt, Artificial Sequence
  Description of Artificial Sequence: Synthetic coding sequence
auggauaugaaccgccgcgccucuugucucuugcccgaucugugugggcagggcuggggguggcgccucuuccccgcaagcugugccuaccucggcagugugccauggcgaguguggggccuagggggauugcuugcaccucuggccgccgccggcgggggcagcaccuccggauuggggcaccuugguaguacgcaauggucgggcgagcucguuguacucuugagugaaguauucauuagaggaugucuuuucucuugcaauggaggcuauccagcugaggccuggaacuucuggacccgcaagggccugguuucaggaggccuuuacgaaucucacguugguugccgacccuacucuaucccacccugcgagcaccaugucaauggcuccagaccccccugcaccggugaaggcgauacuccaaaaugcucaaaaaucugugaaccaggauacagccccacguacaaacaggacaagcauuaugguuacaauaguuauucaguuucuaacuccgaaaaagauauuauggcagaaaucuacaaaaaugguccuguugaaggagcauuuagcguuuacagcgacuuccuacuuuauaaaucuggaguuuaccagcaugugacaggggagaugaugggcggccacgcgaucaggauucuagggugggggguggagaacgguacuccauacugguuaguugcuaacucauggaacacagacuggggggauaacgguuucuucaagauuuuaagaggccaggaucauugcgggaucgagucagaggucguugcugggauaccgaggaccgaucaguauugggagaagauuuag

SEQ ID NO: 31675 - RNA, 738 nt, Artificial Sequence
  Description of Artificial Sequence: Synthetic coding sequence
augccuggggccggcccccucuccaucccaugucgcaugucgugggccuucggggcaguggaggcaaucagugacagaauuugcauccauacaaacgcucacguaucagucgaggugucugcggaagaccuguuaacuuguugcggaaguaugugcggggaugguuguaaugguggguaucccgcagaagccuggaauuucuggaccagaaagggccuggucagcggaggcuuguaugagucacauguugguuguaggccuuauagcauuccgccuugugaacaccacguuaacggcaguagaccuccaugcaccggcgagggcgacaccccuaaguguuccaagauuugugagccuggcuauucaccuacuuauaaacaggauaagcacuacggauauaacagcuacagcguuaguaacagugagaaggacaucauggcagaaauuuauaagaaugggcccgucgaaggagcuuucaguguguauucggacuuccuguuguacaagucuggaguguaucagcacgugaccggagaaaugaugggcggccacgcaauccgaauccucggcuggggaguggaaaacggcacaccauauuggcucgucgcaaauuccuggaauaccgauuggggcgauaacgguuuuuucaagauucucagaggacaggaucacugcgguaucgagagcgaaguggucgcuggcauaccacguacagaccaauauugggaaaaaauauag

SEQ ID NO: 31676 - RNA, 1002 nt, Artificial Sequence
  Description of Artificial Sequence: Synthetic coding sequence
augaacccuacucugauucuagccgcuuucugucuuggcauagcuucugcaacacugacguucgaccacagucuugaggcccaauggacuaaauggaaggcuaugcauaacaggcucuauggaaugaacgaggaaggguggcgccgcgccguuugggagaagaacaugaagaugaucgaacuucacaaccaggaauacagagagggaaagcacucuuuuacuauggcaaugaacgcauuuggggauaugacaagcgaggaauuccgacaggugaugaacggcuuccagaacagaaaaccccgcaagggaaagguguuucaggaaccuuuguucuacgaagccccucgaucaguagacuggcgcgaaaaagguuacgucacacccgugaagaaucaggggcagugugggucuuguugggcuuuuagcgccacaggcgcccuggaaggccagauguuuaggaaaacuggaagacugauuucacuuagugagcaaaaucucguggauugcuccggcccacaggggaaugaaggcuguaacgggggccugauggacuacgcuuuucaauauguccaagacaauggggggcuugauuccgaggaaucauaccccuaugaagcuacugaggaguccuguaaguacaacccuaaguauuccguugcuaacgacaccggcuuuguggacaucccuaagcaagaaaaggcauuaaugaaagcuguggcaacuguuggcccaauauccguggccaucgacgcuggccacgaaucuuuucuauucuacaaggaagggaucuacuucgagccagacuguucaagugaagacauggaucacggugugcuggucgugggguauggauuugaguccaccgaguccgauaauaauaaguauugguuggucaagaacuccuggggagaggaguggggcauggggggguacgugaaaauggcgaaggauaggcggaaucauuguggcauagcaucagcagccuccuacccaacggucuag

SEQ ID NO: 31677 - RNA, 678 nt, Artificial Sequence
  Description of Artificial Sequence: Synthetic coding sequence
augaauccaacccugauauuagccgcuuuuugccucggaauugcaagcgccacucuaacguucgaucauucuuuggaggcccaauggacaaaguggaaagcuaugcacaaucgucuguacggcaugaaugaggaaggcuggaggcgagccgugugggaaaagaacaugaaaaugauugaauuacacaaccaggaauacagagaaggaaaacacagcuuuacaauggcgaugaacgcuuucggagacaugacaagugaagaauuuagacaggugaugaaugguuuccagaauagaaaaccccgcaaaggcaagguguuucaagagccacucuucuacgaagccccgcgcuccgucgauuggagggagaagggguaugugacacccguaaaaaaccagggucagugcgguaguugcugggccuuuucagccaccggagcacuagaggggcagauguucaggaaaacaggcaggcucauuucacugagugaacaaaaccugguagauugcagugguccacaggggaacgaaggauguaauggcggacuaauggauuacgcuuuccaguacgugcaggacaacgguggacuggacucugaggaaagcuauccauaugaggcaacuguguccggagcuccaugccaucacucuucauccgccuucggacguuggacccucuag

SEQ ID NO: 31678 - RNA, 1002 nt, Artificial Sequence
  Description of Artificial Sequence: Synthetic coding sequence
augaauccgacccucauccucgcagccuuuuguuuagguaucgcaagcgccacccuaaccuuugaccacucucuagaggcacaguggacgaaauggaaagcuaugcauaacagguuauauggaaugaacgaggaagguuggcgccgcgcggugugggagaagaauaugaagaugaucgagcugcacaaucaggaguacagggaaggcaagcacuccuuuacaauggcaaugaaugcauuuggagauaugacuuccgaagaauuccgccaggucaugaacggauuucaaaaccgcaaaccccgaaaaggcaagguuuuccaggagccacuuuuuuacgaagcuccuagaucuguugauuggcgcgagaaaggcuacgugaccccaguaaaaaaccagggacaguguggaaguuguugggcauuuuccgccacgggagcucucgaaggacaaauguuuagaaagacuggccgcuuaauuucuuuaagugaacaaaaccucgucgauugcuccgguccucagggcaaugaaggaugcaaugguggacucauggacuaugcauuucaguacguccaggacaaugggggacucgacagcgaggagagcuauccauaugaggccaccgaagagucauguaaauauaauccuaaauacagcguggcuaacgacaccggauucguugacauuccaaaacaggagaaagcccucaugaaggcuguggccacugugggcccaaucagcgucgcaauagaugcugggcaugaaucuuuucucuucuacaaggaaggcauuuauuucgaaccugacugcagcuccgaggacauggaucauggcguguugguagucggguauggguuugagucaacagagucugacaacaacaaauauugguugguuaaaaacucauggggggaggagugggguauggggggcuaugugaaaauggccaaagauagaaggaaccauugugggaucgcuagcgcggccucguacccaacuguuuag

SEQ ID NO: 31679 - RNA, 120 nt, Artificial Sequence
  Description of Artificial Sequence: Synthetic coding sequence
augaaccccacucugauuuuagccgcuuucugucuugguauagcuagcgcaacauuaacauuugaucacucacuggaggcccaauggacaaaauggaaagcuaugcacaaccgacucuag

SEQ ID NO: 31680 - RNA, 2544 nt, Artificial Sequence
  Description of Artificial Sequence: Synthetic coding sequence
augcaccuacuuggcccuugguuacuacuccucgugcucgaguaccucgcauuuagugauucuagcaaauggguauucgaacacccagaaacacuauaugccugggagggcgccuguguauggaucccguguacauaucgagcuuuagauggcgaucuagagaguuuuauuuuauuccacaauccagaguacaacaagaauaccagcaaauuugacggcacccggcuuuacgagucaacaaaggacggcaagguucccagugagcagaagcgcguccaguucuugggagacaagaacaaaaacugcacucugucaauccaccccguccaucugaacgacucagggcagcuaggacuucggauggagaguaaaaccgagaaauggauggagcgcauccaccuuaauguuucagaaaggccuuuucccccucauauucagcuuccccccgaaauacaggagucucaggaggucaccuugaccugccugcucaacuuuagcuguuacggcuauccgauccaguuacaguggcuccuggaaggugucccuaugagacaggccgccgugacgucgacuucacuuacgauaaaauccguguucacccgaagcgaacugaaguucuccccacaguggucacaccauggcaagaucguuaccugucagcuucaggaugccgacggcaaguuuuuguccaaugauaccguucagcugaacgucaaacauaccccuaagcucgagauuaaaguaaccccuucagaugccaucgugagggagggagauaguguaacuaugacaugcgaagucucauccuccaaccccgaauacaccacggucucuuggcuuaaagacggaacuucacucaagaagcagaauaccuuuacccugaaucuccgagagguuacuaaggaucaaucuggaaaguacugcugccagguuuccaaugacgucggucccgguagauccgaggaggucuucuugcaggugcaguacgcgcccgagccaucuacaguccaaauccuucauaguccagccguggaggggucucaggucgaauuuuuaugcauguccuuggccaacccacugccuaccaauuacaccugguaccauaacggaaaagagaugcagggccggacagaagagaaagugcauauaccaaaaauuuugcccuggcacgccgggacguauuccugcguugccgaaaacauccuggggacuggucagaggggcccgggggccgaacuggaugugcaguacccaccgaaaaaagugacuacagucauucagaauccgaugccgauccgagaaggagacacuguuaccuugucuugcaacuacaacuccucaaaccccuccgucacccgguacgaguggaagccgcauggcgcaugggaagagcccucccugggaguucugaagauccaaaauguggggugggauaacacuacuaucgccugcgccgcauguaacagcuggugcucgugggccucucccguggcucugaacgugcaguaugccccccgggacgugagagugagaaagaucaagccccuuucagagauucacuccggcaacuccguguccuuacagugugacuuuucaagcucucauccgaaggaagugcaauucuuuugggagaagaauggacgguuauugggaaaggaaucccaacuuaauuuugauucuauaucuccugaggaugcaggcaguuacagcugcugggugaacaauucaauagggcaaacagcgaguaaggccuggacucuggaaguacuguaugcaccaagacgacugcgagugucaauguccccaggggaucaagucauggagggaaagucagccacgcuaacgugcgaaucagaugcaaacccgccaguuucccauuauaccugguuugauuggaacaaucagagccugccuuaccacagccagaaacugagguuggaaccggugaaaguccagcauuccggugccuacuggugccagggcacuaacaguguuggcaaaggacgguccccccugagcacccugaccguauauuacagcccugagacuaucggccggcgcguggccgugggacugggcuccugccuggccauucuuaucuuggcuaucuguggucucaagcuucagaggagguggaaacgcacgcagucucaacagggucugcaagaaaauuccaguggacagucuuucuuugugagaaacaagaagguacgcagggcgccacuguccgaggguccgcacucccuuggcugcuacaaccccaugauggaagacgguauuaguuauacgacauuaagauucccugagaugaauauuccucgaacaggugaugccgaaagcagcgaaaugcaaaggccaccgccugauugcgaugacaccguuacguacuccgcacuccacaagaggcaaguuggagauuaugagaaugugauuccugauuuccccgaggaugaggguauucacuauagcgagcucauccaguucggcguaggggagagaccacaagcucaggaaaacguugacuacgucauucucaagcacuag

SEQ ID NO: 31681 - RNA, 1377 nt, Artificial Sequence
  Description of Artificial Sequence: Synthetic coding sequence
augaaccgaggcgugcccuuucgccaccuuuugcuaguucugcagcuggcacugcugccugcugcgacucaggguaaaaaaguaguuuugggaaagaagggagacacuguugaacucaccugcaccgcuagucagaagaaguccauccaguuccacuggaaaaacucaaaucaaauuaaaauucucggaaaucagggcaguuuucucacaaagggucccucgaaguugaaugauagggccgauagccggagaucacucugggaccaagggaacuuuccccugaucaucaagaaucuuaagauagaagacagcgacacauacaucugcgaggucgaggaccaaaaagaggaaguucaacuccugguauuuggacucaccgcuaacucggauacacauuuacugcaggggcagucucugaccuuaaccuuggaauccccuccaggcaguucgccauccgugcaaugucgguccccgcgaggaaagaacauucagggcggcaagacacugagcgugagccaauuggagcuucaagauagugguacauggaccuguacugucuugcaaaaucagaagaagguggaauuuaaaaucgacauuguagugcuagcauuucagaaagcaucgagcauuguuuacaaaaaagagggggagcaaguugaauuuagcuucccccucgcguuuaccgucgaaaaauugacuggaucaggagaacuaugguggcaggcugaacgagccaguucaagcaagucauggauuacauuugaucuuaagaauaaagaagugucagugaaaagagugacacaggauccgaagcugcagauggggaagaaacugccccuucaccucacucucccccaagcucucccccaguacgcaggcagcggaaaccugacacuagcucuggaagcaaagaccggaaagcugcaucaggaggucaaccugguuguuaugcgggccacucaacugcagaaaaaucuaaccugugaggucuggggacccacaagccccaagcuaauguuaucuuugaagcuggagaauaaggaggcgaagguuucuaagagagagaaggcuguuugggugcuaaacccagaagccggcauguggcaaugucuguugucugauucuggccagguccuguuagaguccaauaucaaggucuuacccacuuggaguaccccagugcaaccaauggcucuuaucguccugggggggguagcaggccuacuucuuuucauuggcuuaggcaucuucuuuugugucagaugccgccaucggaggaggcaggcggagcgaaugagucagauaaaaagacuacugagcgaaaagaagaccugucagugcccacaccgcuuccaaaaaacaugcucuccuauauag

SEQ ID NO: 31682 - RNA, 276 nt, Artificial Sequence
  Description of Artificial Sequence: Synthetic coding sequence
augaaaguguccgccgccgcccuggcuguuauccugauugccaccgcccugugcgccccugccucggccucuccuuacaguuccgauacaaccccuuguugcuuugccuacauugcccggccccuuccccgugcccacauuaaggaauauuucuauacguccggaaaauguucaaaucccgcagugguauucguuaccaggaagaaccgacaagucugugccaaucccgagaagaaaugggugagagaauacauaaacucucucgaaauguccuag

SEQ ID NO: 31683 - RNA, 276 nt, Artificial Sequence
  Description of Artificial Sequence: Synthetic coding sequence
augaaaguuucugcugcagccuuggccguaauccuaauugcuacagcccugugcgccccugcuuccgcaucgcccuacucaucagauacuacacccugcuguuucgcuuacaucgcgcgacccuuaccacgugcgcacauuaaagaauacuucuauacuucuggcaaaugcucgaaucccgccguuguauuuguuacaagaaagaacaggcagguaugcgccaacccugagaagaaguggguucgagaauauaucaacucacuagagaugaguuag

SEQ ID NO: 31684 - RNA, 270 nt, Artificial Sequence
  Description of Artificial Sequence: Synthetic coding sequence
augaaugcuaaagucgugguaguuuuaguuuugguuuuaacagcccuuugucuuagcgauggcaaacccgugagccucuccuaccgaugcccauguagguucuucgagucccacguggcccgcgcgaacguuaagcaccugaagauccucaauaccccuaacugugcuuugcaaauuguggcgagacuuaagaauaacaaccggcaaguguguaucgaccccaaacucaaguggauucaggaguauuuagagaaggccuugaacaaauag

SEQ ID NO: 31685 - RNA, 360 nt, Artificial Sequence
  Description of Artificial Sequence: Synthetic coding sequence
augaaugccaaaguggucguggucuuggugcucguacucacagcucugugucucucggauggcaagccagugucuuugucuuacaggugcccuugucgcuuuuuugaaucccacguggccagagcaaaugugaaacaucuuaagaucuuaaauacaccgaacugugcacuacaaaucgucgcacgauugaagaacaacaaucgacaaguauguaucgaucccaaguuaaaguggauccaagaguaccuagaaaaagcccugaacaaggggaggcgcgaagaaaaaguaggaaagaaggagaaaauuggcaagaagaaacgccagaaaaaaaggaaagcagcccagaagaggaagaauuag

SEQ ID NO: 31686 - RNA, 282 nt, Artificial Sequence
  Description of Artificial Sequence: Synthetic coding sequence
augaaugcaaagguugugguaguucucguccuggugcuuacggcuuuaugccuaucugaugguaagccagugucccuuuccuacagaugcccuugcagguuuuucgagucacaugucgcuagggccaacgugaaacaucuaaaaauucucaauacaccaaauugcgcauuacagaucguggcaaggcugaaaaauaauaacaggcagguuuguaucgauccuaagcugaaauggauucaggaguaucucgaaaaagcacuuaauaaacgcuucaagauguag

SEQ ID NO: 31687 - RNA, 423 nt, Artificial Sequence
  Description of Artificial Sequence: Synthetic coding sequence
augaacgcuaagguuguugugguccucguucuuguucuaaccgcccuuugucucucagaugguaagccuguuucccuuaguuaccgcuguccauguagauucuuugagucccauguagcccgagccaacgucaaacaucugaaaauacuuaacaccccaaacugcgcccuucagauaguugcuagacuuaagaauaauaaucgccaaguuuguauugauccaaagcugaaauggauacaagaauaucucgagaaagcccucaauaaucucaucagcgcggcaccugcuggaaagcguguuaucgcuggagcaagggcauugcauccuaguccccccagagcguguccaacggcaagggcucugugcgagauucgauuguggcccccaccagaaugguccuggccaucuccaggugaugucuag

SEQ ID NO: 31688 - RNA, 273 nt, Artificial Sequence
  Description of Artificial Sequence: Synthetic coding sequence
augaacgccaaagucguggucgugcuagugcugguccucaccgcucuuugucuuucugacgguaaaccagucucccuuucguaucggugcccuugcagauucuucgagagccacgucgcacgagccaauguuaaacaccugaagauccuaaacaccccgaauugcgccuuacaaauaguggccagguuaaaaaauaauaacagacagguuuguaucgauccaaaauugaaauggauccaagaauauuuggaaaaggcccugaacaacugcuag

SEQ ID NO: 31689 - RNA, 4101 nt, Artificial Sequence
  Description of Artificial Sequence: Synthetic coding sequence
augcuguccuuugucgauacuaggacauugcuacuacuggccgugacauugugucuggcuacaugucaaucuuugcaagaggagacugugagaaaggggcccgcuggcgaccgugggccccggggagaaagggggcccccuggaccuccaggcagagauggagaagauggccccaccgggccucccggucccccgggcccaccaggcccuccuggucucggagguaacuucgcagcccaguacgauggcaagggcguggggcucggucccggaccuauggggcugauggggccacgcgggccgccaggggcugcuggcgcgccgggcccccaaggguuccaaggccccgcuggggagcccggagaaccaggccaaacagggccugcuggagcaagaggcccugcgggaccuccugggaaggcuggagaggacgggcacccaggcaagccugggcggcccggggagcgaggcgucguggggccccaaggagccagagguuuucccgguacacccggccuuccuggauuuaaaggcauaaggggucacaauggacuugacggguugaaagggcaaccgggcgcaccgggagugaaaggcgaacccggugcuccaggggagaauggaacgccaggucagacaggcgccaggggacugccaggggaacguggaagggugggagcacccgggcccgccggagccagagguucagaugggagugucggaccaguagguccggccggccccaucggaucagcaggcccuccaggcuuuccgggagccccugggcccaaaggcgaaauuggagcugugggcaacgcuggaccagccgggcccgcugguccccguggagagguaggucuuccuggguugucagggccuguagguccaccgggcaaucccggcgcuaacggucugaccggcgccaaaggcgcagcugggcugccugggguugcuggggcacccggacugcccggaccccgagguaucccugggccggugggugcggcuggcgcgacaggcgccaggggacuaguuggugaacccggcccagcgggcuccaagggcgagucuggcaauaaaggcgaaccagggagcgcggggccacagggcccgcccggccccagcggggaggaggguaagcguggaccgaauggagaagcgggaucagcaggacccccuggccccccuggacucaggggaucuccuggcagcagggggcugccuggggccgaugguagggcagggguuaugggcccaccaggcaguaggggcgcauccggccccgcggggguccgcggaccuaacggugaugcuggacggcccggugaaccagggcucaugggcccuagaggcuuaccuggcagcccaggcaauauuggaccugccggcaaagagggccccgucgggcuaccagguauugauggacgccccgguccaauagguccagcaggcgcaaggggcgagccugguaacaucggauuucccggucccaaaggccccacuggggauccagguaagaacggcgacaagggacacgcuggcuuggccggagcacgcggagcaccagguccggauggcaacaacggcgcacaggguccaccagggccucagggcgugcagggaggaaaaggagaacaggggccgccagguccucccggauuucagggacucccaggccccucgggaccagcuggagagguuggcaaacccggugaaagaggacuucacggcgaauuuggcuuacccgguccugcgggcccccgcggagaacgggggccuccuggugaaaguggagcagcaggccccacuggccccauuggcagcagagggcccagcggccccccuggucccgaugggaauaagggcgagccggggguugugggcgcugugggaacagcagguccgagcggcccuagcggccucccaggcgaacggggagcagcaggaauaccgggagguaaaggggagaagggugagccuggccugcguggcgagaucgggaaccccggacgagauggcgcgcggggggcgccuggagcugugggagcucccggacccgccggggccaccggagacagaggagaagcaggagcugccggcccugcaggcccagcugguccaaggggcagcccgggcgaacgaggcgaaguuggaccugccggccccaacggauucgcaggcccagcaggagccgccgggcagccuggcgccaaaggagaaagaggagcuaagggaccaaaaggcgagaaugggguagugggccccacugguccuguuggggcagcgggcccagccgggccuaacggaccaccuggacccgcugggucccgaggcgacggcggaccccccggaaugacaggguuccccggugccgccggaagaaccgguccaccugguccuucuggcauuagcgggccaccugggccgcccggaccggccggcaaagaagggcuccggggcccucgaggggaccaggguccugucgggagaacuggagagguaggggcuguagggccuccaggcuuugcuggcgagaagggcccaagcggcgaggcugguacugcugggccccccggaacaccagggccacaagggcuacugggagccccaggcauccugggguuaccuggcucccggggugagagagggcuaccuggaguugcuggagccgugggagagcccggcccucucggcaucgccgguccaccaggcgccagaggucccccuggcgccgugggaagccccgggguuaacggagcaccuggcgaagcaggacgcgacgggaacccaggaaaugaugguccacccggccgggacggucaacccgggcauaaaggagaaagaggcuaccccggcaacauaggcccagugggugcagcaggagcaccaggcccucauggcccugugggccccgccgguaaacauggcaaccgcggugaaaccggcccaucuggcccagugggccccgccggugcagucggcccccgcgggcccuccgguccucaaggaaucaggggggauaaaggggagccgggagagaaaggaccuaggggucuccccggccucaaaggacauaaugggcugcaaggccugcccggaauugcaggccaccacggagaucaaggggccccagguagcgucggucccgcggggccccguggccccgccgggccaagcgggccugccggaaaagauggucggaccgggcauccuggcaccguaggaccagcuggaaucagggguccccaaggccaucaaggccccgccgguccaccuggcccucccggaccgccuggcccuccuggggucucaggaggcggauaugauuuuggauacgacggcgauuuuuaccgggcagaucagccucggagcgcaccuaguuugcggcccaaagauuaugaaguugacgccacacugaaaagccugaauaaccagaucgagacgcuccucacuccagaagguagcaggaagaacccugccaggacaugcagggaucuuagacugucccacccugaaugguccuccggguauuauuggaucgaucccaaccaggggugcacaauggacgcgaucaaagucuacugugacuuuaguacaggugagacaugcauccgagcacagccagaaaacauccccgccaaaaauugguaccgauccaguaaagauaaaaagcaugucuggcugggagagacaauaaaugccggaucacaauuugaguacaauguugaaggcgucaccucaaaggagauggcaacccaacuggcguuuaugagacuacuggcgaauuacgcaucacagaacaucacauaucauugcaagaacuccaucgcuuauauggacgaagagaccggcaaucugaaaaaggcuguuauccugcaggguucgaacgacgucgaacucguggccgaggggaauagucguuuuacauacaccguccugguggauggaugcuccaagaagaccaaugagugggguaagacuaucaucgaauauaaaacuaacaagccaagucgacugccuuuccuggacaucgcgccacuggauaucgguggcgccgaucaggaguuuuucguugacauuggcccagugugcuuuaaguag

SEQ ID NO: 31690 - RNA, 4104 nt, Artificial Sequence
  Description of Artificial Sequence: Synthetic coding sequence
augcucucuuucguggauaccaggacacuccugcuccucgccgugacccugugucuagcaacgugccagugcacccuuggaggacagacauuaucuaaauucccgcccuaccuccacauugagagaucugaacaggguccaccaggcccaccugggagagacggagaagacgggccaacaggccccccaggcccucccgguccuccugggccccccggccugggcggaaacuucgcugcacaguaugacggaaaaggagugggucuuggaccuggaccuauggggcuuauggggccuagggguccacccggugccgccggagcucccggcccgcaaggcuuucagggccccgcuggugaacccggggaaccuggacagaccgggcccgccggcgcucggggaccggccgguccccccggaaaagcgggggaggauggucauccaggcaagccgggccgucccggugaaagaggggugguagggccucagggagcgcgcggcuucccgggaacacccggucugcccggguucaaaggaauccggggucacaacggccuagacggccuuaaggggcagccuggcgcaccuggaguuaaaggagaaccaggagcucccggagaaaauggaaccccaggccaaacuggcgcccgcggucuucccggagagcgcggcaggguaggagccccaggaccugccggagcaaggggaagcgacggcucuguuggccccguagggccugcugggcccauuggaagugcaggaccccccggauuucccggagccccggguccaaagggcgagaucggggcaguggggaacgcggggccagccggaccagccgggccuagaggagaaguuggccuacccggacucuccgggcccgucggcccacccggcaauccuggagccaauggccugacaggcgcaaaaggagcagcuggacucccaggcguggccggagcuccugggcuaccuggaccccgcgggauacccggcccugugggcgcugcuggugcaacuggcgcacgaggucuggugggcgaaccgggaccugcagguucaaagggggagucuggaaacaagggggagccuggaagcgcagggccucagggcccaccgggaccgucaggugaggaaggaaagcgagggccaaauggagaggcuggcucagcggggccaccuggaccccccggucugaggggaagcccagguagccgcggucucccuggcgccgauggaagggcugggguaaugggcccaccaggcagcagaggagccucggggccugcaggaguacggggccccaacggcgacgccggcagaccgggugagccgggccugaugggcccccguggacugcccgguucaccaggcaauauuggaccugccgggaaagaaggaccggucgggcuuccugguaucgacggacgccccggacccauuggccccgcaggagcccgaggcgagccagguaacaucggauucccuggccccaaggguccgacaggcgauccuggaaaaaauggagacaagggacacgccggacucgccggagcacgcggagccccuggcccggacggcaauaacggagcacagggaccgccugguccccagggcgugcagggcggcaaaggagaacagggucccccagggcccccaggcuuucaaggguuacccggcccauccggcccugccggggaggugggcaaaccuggggaaagagggcugcauggcgaguucggacuccccggcccugccggcccucggggcgaacgggguccgccuggggagaguggagccgccggaccuacaggcccuauaggcucgagagggccuagcggccccccaggucccgaugggaauaaaggagaacccggcguagucggcgccgugggaaccgccgggccuucuggacccucuggguuacccggugagcgcggggccgccggcauaccugggggcaagggagagaagggcgaaccggggcugcgcggggagauugggaaucccggcagagauggggcccguggagcgccuggugccgugggagcuccaggcccggcgggcgccaccggcgaucggggagaggcaggcgcugcaggacccgcaggccccgccggaccuaggggcagcccuggagaaagaggggaagugggcccggcggggccaaauggauuugccggccccgcuggugccgcaggccagccuggcgcuaaaggcgaaagaggugcuaaaggcccaaagggagaaaaugggguaguggggccuacggggccagugggcgcagcugguccggcagguccaaauggcccacccggaccagccggaagccgcggggacggagggccucccgguaugacuggauuucccggugcugccggaaggacugggccaccugggccaucuggcaucucuggcccaccugggccacccggaccagccggaaaggaaggacuccgaggaccuagaggagaucaaggccccguaggccggacaggagaaguuggcgccguggggcccccugguuucgcuggggagaaggggcccucgggcgaggcggguacugcggguccaccagguacacccgguccucaggggcuucucggagcacccggcauccugggguugccuggaagcaggggagaacguggcuugccugggguugcgggagccgucggagaacccgguccucucggaauugcagggccacccggcgcucggggccccccuggcgccgucggcagcccaggcguuaauggcgcucccggggaagccggucgagauggcaaucccgguaacgauggaccuccuggcagggauggccagccugggcauaaaggagagagagguuaccccggaaauaucggaccuguuggagcugccggggcaccugggccgcauggucccguugggcccgccggcaaacauggcaaccggggagagacuggacccucuggcccaguggggcccgcaggcgcaguaggaccgagaggccccuccgggccgcagggaauacgaggcgacaaaggggaacccggagaaaaggggccaagaggccugccaggccugaaaggacauaacggguugcagggacuaccagggauugccggacaucacggagaccagggcgcucccggcuccguggggccagcuggcccacgcggcccagcaggacccaguggucccgcuggaaaggacggacguacaggccacccuggcacugucggccccgccggcauccgcgguccgcaggggcaccagggcccugccggcccgccugguccuccuggcccgcccggaccuccaggcgugucuggugggggauacgacuucggcuacgauggcgauuuuuauagggcugaccaaccccgaagugccccaucacugcgccccaaagacuaugagguggaugcaaccuuaaaaucccucaauaaccagaucgaaacccugcuaaccccugaggggucgaggaagaaccccgcacgaaccugucgggaccuccgccuaagccacccagagugguccuccggauacuauuggauugaucccaaccagggauguacuauggacgcuauuaagguguacugcgauuuuucuaccggagaaaccuguauaagagcucagccggagaauauuccggcgaagaacugguauagaucuuccaaagauaaaaaacacgugugguuaggugaaacaauuaaugccgggucccaguuugaauacaacguugaaggugugacaucuaaagaaauggcuacacagcucgcguucaugcggcuguuagcaaauuacgccucccaaaauaucacuuaucacugcaaaaacuccauagcguauauggacgaagagaccggcaacuugaagaaggcggugauacuucaggggucgaacgacguggaacugguggccgagggcaauagcagauucacuuauacagugcuaguggacgggugcucuaagaagacgaaugaaugggggaagacaaucauagaauacaaaaccaauaagcccuccaggcuucccuuccuugauauugccccuuuggauauuggcggcgccgaccaagaauuuuuuguggacaucgguccuguuuguuucaaauag

SEQ ID NO: 31691 - RNA, 5304 nt, Artificial Sequence
  Description of Artificial Sequence: Synthetic coding sequence
auggagcccuggucgaguagauggaagaccaagagauggcugugggauuucaccgugaccacccuggcacugacuuuucuguuucaggcacgugaggugaggggcgcugcaccaguugauguacucaaggcccucgauuuccacaacaguccagagggcauaucaaagacgacuggguucuguacuaacaggaagaauuccaaaggaucugacacugcauaucggguuucaaaacaggcucagcucagcgccccuaccaaacaacuguuuccgggugggacauuccccgaggacuuuucaauacuguucacagugaaaccuaaaaaaggcauccaauccuuucuuuugucaaucuauaaugaacacggaauccagcaaauaggaguugaggugggaagaagucccguuuuucuuuuugaagaccacacuggaaagcccgcuccagaggacuacccacuguuccgcaccguuaauauugcugacggcaaguggcauagaguggccauuagcguggagaaaaaaacggugacgaugauagucgauugcaagaaaaagacaacuaaaccucuggaucgaucugaaagagccaucguggacaccaacggcaucacggucuuuggcacccggauccuugaugaagaaguguuugagggcgacauucagcaguucuugaucacaggcgauccuaaggcggcauacgacuacugcgagcacuacucuccagauugugacagcucagcuccgaaagcugcacaggcacaggaaccccagaucgacgaggcuaacauuguugacgacuuccaggaguacaacuacggcacaauggagucuuaucagacagaagcuccuagacaugucuccggaacaaacgaaccaaauccagucgaggagaucuucacggaggaguaucucacaggagaggacuaugauucacaacggaaaaauuccgaagauacccuguacgaaaacaaggaaaucgacggcagggacucggaccuguuggucgauggcgaccuuggagaauacgauuucuacgaguacaaggaauacgaagauaaacccaccagcccaccuaaugaagaguuuggaccgggcgugcccgccgaaacugacaucaccgagacauccaucaacgggcacggcgcuuauggcgaaaaggggcaaaaaggcgaaccagccguaguggagccagguaugcuuguugagggcccaccagggcccgcugguccagccggcauuaugggccccccuggccuccagggcccaaccgggccucccggcgacccgggcgauagagguccaccgggccgaccaggacucccgggagcagaugggcuaccgggcccccccgguacaaugcucaugcugccguuucgguacggcggcgacggaagcaaggguccgacaaucucugcgcaagaggcccaggcucaagcuauccuccagcaggcacgcauugcgcuucguggucccccuggaccuauggggcucacaggucgccccgguccagugggcgggccaggauccagcggcgcaaaaggcgaaucaggugaucccgguccacagggaccucgaggggugcaagguccaccggggccgacugguaagccugguaaaagagggcggccaggcgccgacggcggacgcggcaugccgggcgaaccaggcgccaagggagauagagguuucgacggucugccaggauugccuggagacaaagggcacaggggcgagagaggcccacaaggaccaccggggcccccaggggaugauggaaugcggggugaggacggggagauagguccucgcggucugccgggcgaggcuggcccccggggccuguuagggccucgggggacucccggugccccaggccagcccggcauggcaggugucgacgguccccccggccccaaaggcaacaugggaccucagggagaaccagggccaccaggccaacaggggaacccagggccucagggccuccccggaccucagggccccauaggaccaccuggcgaaaaaggaccacaggguaaaccgggucucgccggcuugccuggagccgauggcccaccaggccacccggguaaagaggggcagucgggugagaagggagcccuaggaccgcccggcccucaagguccgauuggauacccugguccacgcggugugaaaggcgccgauggggucaggggccucaaggguagcaagggcgagaaaggcgaagacggguuccccggauucaaaggugacaugggauugaagggggauaggggggaaguuggccagauugguccucgaggcgaggauggucccgaggguccaaagggacgggccggucccacgggugacccuggacccagcggacaggcaggagagaagggcaagcucggugugccgggccugccuggauaucccggacgucaggguccuaagggaucaacaggguuuccaggcuucccaggugccaauggcgaaaagggugccagaggcguggcggguaaaccagguccgagagggcagagagggccuacugguccaagaggcucccggggcgcuaggggccccaccggaaagccgggcccaaaggguaccagcgggggcgacggaccgccagggccuccaggagaaagggguccacaggguccccaaggacccguugguuuuccagggcccaaggggccucccggaccucccgggaaagaugggcuuccagggcauccaggccaaagaggagaaacaggguuucaagguaagacaggucccccuggaccuggcggcgucgugggaccucaggggccuacuggugagacaggccccauaggcgagaggggucacccagggccccccgguccccccggggaacaaggcuuaccuggugccgcuggcaaggaaggagccaagggagauccuggaccccaggggauauccggaaaagauggaccugcuggacuccgcggcuuucccggcgagaggggauugccaggcgcccaaggcgcaccaggccugaagggaggugagggaccacaggggcccccgggcccugucgguucgccuggcgaacgcggauccgcuggaacagccggcccuaucggucuuccgggucgaccuggaccacagggucccccuggcccagcuggcgaaaagggggcuccaggagaaaagggcccccaggggccagccggccgggauggugugcaaggcccuguuggucugcccgguccggcugguccagccggguccccaggagaagauggggauaagggagaaauuggggagccuggccagaaaggcucaaagggagauaaaggugaaaauggcccuccgggcccacccggacugcaagggccugugggcgcuccugggauagcagguggugauggagagccugguccgagggggcagcaaggaauguucggccagaaaggggaugagggcgcgcgcggauucccagggccacccggccccaucggacugcaaggguugccgggccccccgggugagaagggugagaacggcgauguuggaccuauggguccuccaggcccucccgguccaaggggcccucagggacccaauggugccgacggaccccaagggccucccgggaguguugggucaguaggaggagugggugaaaaaggggaaccuggggaggccggaaauccuggccccccaggggaagcgggugucggcggaccuaagggcgagagaggcgaaaagggcgaggcuggacccccgggagccgccggcccgccgggggcgaagggaccuccuggggacgacggcccaaagggcaaucccggaccaguaggcuucccaggcgaccccgguccacccggggagcccggcccggcuggucaggauggcguuggcggagacaaaggggaagauggagauccaggacagccuggacccccaggcccgucgggggaggcuggaccaccaggacccccuggcaagcggggaccuccuggcgccgccggggcugaaggaagacagggcgaaaagggcgcgaagggcgaagcaggagcagaggguccuccagggaagaccgggccuguugguccacaaggacccgccggcaagccaggaccugaaggccuccguggcauucccggaccagucggugagcagggccucccuggugccgcaggacaggacggcccucccggcccaauggggcccccaggacugccggguuugaaaggggaccccggcuccaaaggcgagaaggggcacccuggccucauaggccugauuggcccgccaggugaacagggcgagaaaggagacaggggccugccagggacccagggcucuccaggcgcgaaaggcgacggggguaucccaggaccugcaggcccacuaggcccgccuggaccuccugggcucccggguccccagggaccaaaaggcaauaaggggucuaccggaccugcuggacagaagggagauagugggcuccccggcccaccaggaucccccggaccuccaggcgagguaauccaaccacuuccaaucuuguccucuaaaaagacucgcagacauacagagggaaugcaggccgaugcugacgauaauauucuagacuacuccgauggcauggaggagauuuuuggcucccuuaauucucucaagcaagauaucgagcacaugaaguuucccaugggcacacagaccaaucccgcgcggacauguaaggaccuucagcuaucccacccagauuuccccgauggggaguacuggauugaucccaaccagggauguuccggcgauaguuucaaaguuuauuguaauuuuaccucagggggcgagacuuguauuuauccugacaaaaagagcgagggggugcguauaaguucauggccgaaggagaaaccagggucuugguuuucagaguucaagcgaggaaaacuucugucauaucuagauguggaggguaauuccauuaacauggugcaaaugaccuuccugaaacuucucacagcaagugcaagacaaaacuucacauaccacugucaccagucggcagcuugguaugaugugucauccggcucauaugauaaggcuuugcgguucuuaggcucuaaugacgaggaaaugagcuacgacaacaauccauucaucaaaacucuguaugaugguugugccagccggaaagguuacgagaagacugucauagaaaucaauacgccaaaaauugaucagguaccuauagucgacgugaugauuaacgacuucggggaccagaaucagaaauucggauucgaagucgguccuguguguuuucugggauag

SEQ ID NO: 31692 - RNA, 5457 nt, Artificial Sequence
  Description of Artificial Sequence: Synthetic coding sequence
auggaacccuggagcaguagauggaagaccaagcgauggcuaugggauuuuaccguuacgacucuggcucuuacuuucuuauuucaggcccgagaagucaggggagcggccccuguggaugugcucaaagcuuuagacuuucacaauagcccugagggcaucucaaaaacaaccgguuucugcacaaaucgcaaaaauucuaagggaucugacaccgcguauagggugagcaaacaggcccaacuuucggcaccuaccaagcagcucuuccccgggggaaccuuucccgaagauuucuccauauuauuuacaguaaaacccaagaaggguauacagucuuuucuuuugaguauauacaaugaacacggcauccagcaaaucgggguggaggugggccgcucaccuguguuccuguuugaggaucacaccgggaagcccgcccccgaggacuacccgcucuuucgcacugucaauauagcggacggcaaguggcaucggguugcuauaagcgucgaaaagaagaccgugacgaugaucguagacugcaaaaaaaaaacaacaaaaccucuggauagaagugagagggcaaucguggacaccaacgggauuacuguguuugguacuaggauccucgaugaagaagucuuugagggagacauccagcaguuccugauuaccggagauccgaaggcugcuuaugacuacugugaacauuacucaccugauugcgacagcucagcccccaaggccgcucaggcacaggaaccccaaauagacgaaaagaaaaagucgaacuucaaaaaaaaaaugaggacaguugcuaccaagagcaaagagaaauccaaaaaauuuacaccuccaaaaagcgaaaaauucucuagcaagaaaaaaaagucuuaccaggcaucagcaaaagcaaaacucggaguuaaggcuaacauuguggacgacuuucaggaguacaauuauggcaccauggaguccuaucagacugaagcaccucgccaugucagugggacaaaugagccgaacccuguggaagaaauuuucaccgaggaguaccugacaggcgaagauuacgauagccagcgcaagaauagugaggauacucucuaugaaaauaaggagauugacggucgagacucugacuuguugguggauggugaucugggcgaauaugauuucuaugaguauaaagaguacgaagacaagcccacgucgcccccaaaugaggaauuuggaccuggugugccagccgagacugauaucacggagaccucuauaaacggucauggcgcauacggagagaagggccaaaagggggaaccugcaguuguggagccagguaugcucgucgaaggaccaccaggucccgcuggccccgcaggcaucaugggaccgcccgggcuacagggcccaacuggucccccaggagaucccggagauagagggcccccuggacggcccggcuugccaggggcagauggacugccaggaccaccgggaacaaugcucaugcucccuuuccgcuacggaggagauggcuccaaaggcccuacgaucagcgcacaggaagcacaggcacaggcgauucugcagcaggccaggaucgcccugcggggcccgcccggacccaugggauugaccggccggcccggaccaguuggaggcccaggguccucuggagcaaaaggagaguccggagacccugggccccagggaccacguggcgugcaaggcccaccaggucccaccgguaaaccugggaaacggggcagaccaggagccgauggcggaagaggcaugccaggcgagccgggagcuaagggagaccgaggcuuugacggccuuccaggccuuccgggagacaaagggcaccgaggugagagaggcccucagggcccgccugggcccccaggggacgacggcaugcgaggggaggacggagagauuggaccacggggacugccgggcgaagccgggccccgagggcugcucgggccaagagggacuccuggagcuccaggccagcccgggauggcaggaguagaugguccuccugggccuaaagguaauauggguccucagggugagccuggccccccuggacagcaaggcaaccccggaccacaaggccucccagguccccagggacccauuggcccccccggugagaagggaccgcaagggaagccggggcuggcugggcuccccggcgcagacggcccucccggucacccgggcaaagaagggcaguccggagaaaaaggcgcucugggcccuccugggccccagggucccaucggguaccccgguccuaggggggugaaaggcgccgacggcguuaggggccugaagggcuccaaaggcgagaagggcgaggacggauuccccggguucaaaggagauauggggcugaaaggcgacagaggagaggucggacagauugggccaaggggggaggacggaccagaggggccuaaaggccgugccggcccuaccggcgaucccgguccauccggucaggcaggagagaaagggaagcuuggggugccugggcuuccuggauaccccggacggcaggguccaaaaggaagcacaggcuuccccggguucccaggcgcuaauggagaaaagggagcuaggggggucgccggaaaacccgggccuagaggccagcgaggccccaccggcccucgcggcagucgcggagcucggggacccacaggcaagcccgguccaaagggaaccucggguggagauggcccaccaggaccuccgggugaacgcggaccgcaggggccccagggcccaguaggguuuccuggaccuaaagggccucccggccccccuggcaaagacggccucccaggacaccccgggcagaggggggagacaggcuuucagggcaagaccggaccaccuggaccaggcggcguggugggcccacaaggacccacgggagagacgggcccaaucggagaacggggccauccagguccuccagggccucccggugagcaggggcuuccuggagcugccgggaaagaaggcgccaaaggagacccugggccccaggggaucagcgguaaggacggcccugcaggucugaggggguuccccggcgagcgggggcuccccggugcacagggggcuccaggccugaaaggcggcgagggcccucaggguccuccuggaccagugggcuccccaggagagcguggcucagcgggcacugccgggccuauuggauugcccggucgaccuggaccucagggccccccaggaccagccggcgagaagggugccccaggugagaaaggaccccaaggaccagcuggucgcgacggugugcaggggccgguuggguugcccggccccgccggaccggcuggcucaccuggcgaggacggcgacaagggggagaucggagagccuggucagaagggaagcaaaggagauaaaggagagaacgggccacccggcccccccggauugcaagguccgguaggcgcuccugggaucgcuggcggagacggggagccugggcccagaggccagcaaggcauguuuggacagaagggugaugagggcgcuagggguuuucccggacccccuggcccuauugggcuccaaggccuaccaggcccaccaggcgaaaaaggggaaaacggugaugugggaccuaugggcccgcccggcccuccuggaccacgcgguccacaagguccuaacggugcugaugggccacagggaccaccaggaucugucggcucuguggggggcguuggagagaagggcgagccaggcgaagcuggaaauccggguccucccggcgaggcaggugugggaggaccuaaaggggaacgcggagaaaaaggcgaggccggcccucccggcgcagccggcccaccgggagcaaaaggcccaccuggcgaugacggacccaaagggaaucccggaccaguggguuuuccgggugauccuggucccccaggcgagcccggcccagcuggccaggauggugucggcggcgacaagggggaggauggggauccaggccagccuggacccccgggacccucuggugaagcugggccaccaggucccccagggaagcggggcccaccuggugcggcuggcgcagaaggcaggcaaggggaaaagggcgcuaaaggcgaagcaggcgccgagggcccccccggcaagaccgguccaguggguccccagggccccgcagguaagccaggccccgaagggcugcgcgggaucccggguccugucggcgagcagggacuccccggugccgcaggccaggauggccccccugguccgauggguccaccggguuugcccggccuuaagggcgaucccggaucuaaaggggagaaaggucacccaggcuuaauaggccugauugggccaccuggagagcagggagaaaagggagaucgagggcucccuggcacccagggaucccccggggccaagggugauggagguauccccgggcccgcuggaccccuggguccccccggaccuccuggccugcccgguccacagggccccaaaggcaacaaagggucaacugggccagccgggcagaagggagacucagggcugcccgggcccccuggcagccccgggcccccaggcgaagugauucaaccgcugccuauucucagcucuaaaaagacaagacggcauaccgagggcaugcaggccgacgcagacgacaauauccuugacuacucagacgguauggaagaaaucuucggaucccucaacagucugaaacaagauaucgaacacaugaaguuccccauggggacgcagacaaauccugcucggacaugcaaggaccuucaacucagccaucccgacuuuccugacggagaguacuggauugacccaaaucagggcugcaguggcgacaguuucaagguuuacuguaauuuuaccucugggggugagacauguaucuauccugauaagaagucugagggggugcgcauuagcuccuggcccaaggagaagccuggaaguugguucagcgaauucaagagaggcaagcuccugucuuaccuggauguggagggcaauuccauaaauaugguccagaugacuuuccucaaacugcugaccgccuccgcuagacaaaacuucacguaccauugucaccaaagcgccgcuugguacgauguaaguucuggcagcuacgacaaggcacuccgguuuuugggcuccaacgacgaggagaugucuuaugacaauaacccuuucaucaagacauuauacgaugguugugcuaguagaaagggcuacgaaaagaccgugauugagauaaacacaccaaagaucgaccaggucccuauaguggacgucaugaucaaugacuuuggcgaccaaaaucaaaaguuuggauuugaagugggacccgugugcuuccugggauag

SEQ ID NO: 31693 - RNA, 3081 nt, Artificial Sequence
  Description of Artificial Sequence: Synthetic coding sequence
augguauccgaggugagccgggaccuaaaggucaagcgcgagaaacugguaaaguuggcccaggaagggaaaauggcccuuaaggacccaaagguggaacaggcccaacuggagacccaggucuuacaggugaagcaggagaagcgcgaaaauuuagaauuccaggauuaucaagauauccaagaggauaaagugcagaggaucagcgaugugauuggaucaacaggguucccaggauuucccggagcaaauggagagaagggagcgaggggugucgcuggcaagccugggccuagagggcagagggggccuaccgguccacgcggaaguagaggcgcacgcggaccgaccggcaagccaggcccaaaagggacgucgggaggcgacgggccgccaggaccuccaggagaacguggaccccaggggccgcaggggccgguuggcuuucccgggccaaaggggccuccgggcccuccagggaaagacgggcuccccggacacccaggacaaagaggggagacgggauuucaggguaagacaggaccuccagggccagguggaguggucgguccacagggccccaccggggaaacagggccuauaggugaacggggccaccccgguccacccgggccgccgggcgaacagggccucccgggcgccgcuggaaaagaaggugcuaaaggcgauccaggcccacaagggauuucaggcaaggacgggccagcaggacuccgcgguuucccaggagagagaggucugcccggugcucagggagcuccaggucuuaaggguggcgagggcccacagggaccuccugggccaguuggcagucccggagagagagggagugccggaacugcagguccaaucggccuuccagggcggcccggcccccagggcccccccgggccugccggugaaaaaggggcccccggugaaaagggaccucaaggccccgcaggacgggacggggugcagggcccugugggcuugcccgguccagccgggcccgcugggucucccggcgaggacggggacaaaggcgaaaucggugaacccgggcagaaagguuccaaaggcgauaagggcgagaacgguccucccggaccaccugggcuacagggcccaguuggagccccagguauagccgggggugacggcgaaccagggccuaggggucagcaagguauguucgggcagaagggcgacgagggggcccggggcuucccuggaccuccuggccccauuggacuacagggucugccugguccaccuggugaaaagggcgagaauggcgacgugggcccgauggggcccccuggcccccccgggccaagggggccccagggaccuaacggugccgacggcccacagggcccaccugggagugucggaucugugggcggcgucggggagaagggcgaacccggcgaagcggguaacccgggacccccgggggaagccggggugggaggacccaaaggagaaagaggagaaaaaggggaagcugguccuccaggagccgcuggaccacccggggcgaagggaccacccggcgacgauggaccaaaagguaacccagggcccgugggguuccccggcgacccuggcccuccaggcgaaccggguccugcaggccaggacggaguaggaggugauaagggagaggacggugacccaggacaaccuggacccccuggaccuucgggggaagcaggaccaccgggaccacccgguaaaagaggaccaccaggugcagcuggcgccgaaggcaggcagggugagaaaggcgcuaaaggggaagcuggcgcugaagguccaccagggaaaacagggccgguggguccacagggccccgcugggaaacccgggcccgaaggucugcgaggaauaccuggccccgugggcgagcaggggcucccgggagcagcaggccaggacgguccgcccgggccgaugggcccuccuggccucccuggauuaaagggagacccugguagcaaaggagagaagggccauccuggccugauugggcugaucggaccuccuggagaacagggugagaagggagaucgagggcugcccggaacgcaggguagccccggcgccaaaggcgauggcgguauuccugggcccgcgggccccuugggaccuccuggcccccccggccugcccggaccucaggggccuaagggcaauaaagggagcacuggaccagccggccagaaaggugacucgggcuuacccgguccgccuggcucuccggggccuccgggugaaguaauacagccacucccaauucugagcucaaaaaagacgcgacggcacacugaggggaugcaggccgacgccgaugacaauauccucgauuacuccgaugggauggaagaaauuuucggaagccugaauagucugaagcaggacaucgaacauaugaaguucccuaugggaacgcagaccaauccagcccggaccuguaaagaucugcagcugucacaccccgauuucccugauggcgaauacuggaucgauccuaaccaggguuguucaggugauucuuuuaaggucuauuguaacuuuaccagcgggggugagaccugcaucuacccagauaaaaaaagugagggaguuagaauuagcucguggcccaaagagaaaccugguucaugguuuucagaguucaagaggggcaaguugcuuaguuaccucgacguagaggggaacuccaucaauaugguacagaugacauuccugaagcugcugaccgcuuccgccagacagaauuucacauaccacugccaucagagcgccgcaugguacgauguuaguuccgguaguuacgacaaagccuuacgguuucuuggaucaaacgacgaagagaugagcuacgacaauaauccauucauaaagacccuguacgacggcugcgcuucucgcaaggguuaugagaaaacugucauugaaaucaauaccccaaagaucgaccaaguuccaauuguggacgucaugaucaacgauuuuggagaccagaaccagaaguucgguuuugaagugggcccuguuuguuuuuugggcuag

SEQ ID NO: 31694 - RNA, 5421 nt, Artificial Sequence
  Description of Artificial Sequence: Synthetic coding sequence
auggaaccuuggucaagccgguggaagacaaagcgcuggcuaugggacuuuacuguuacgacccucgcccugacauuuuuauuccaagccagagaggucagaggggccgcgccuguugacguucucaaggcacuggauuuccauaacucaccagagggaaucagcaagaccacuggauuuugcacaaauagaaaaaacuccaaaggauccgacaccgcuuaucgaguuagcaaacaggcucagcuaagcgccccuaccaagcagcuuuucccaggcgggacguuuccugaggauuucaguauucuauuuacugugaaacccaagaaggguauccagucuuuucuccuguccauauauaaugagcacggcauacagcagauuggcgucgaggucggacgcucacccgucuuucuguuugaggaucacacagguaagcccgcaccagaggauuacccccuguucagaacuguuaacauagccgauggcaaguggcauaggguggcaauuucuguggagaaaaaaacagucaccaugaucguggacugcaagaaaaagacaacuaagccacuggacagguccgaaagggcuauagucgacacgaauggaauuacgguguucgguacaaggaucuuggacgaagagguguucgagggcgacauucagcaguuucugaucaccggugaccccaaggccgccuacgauuacugugagcauuacucucccgauugcgacucauccgcucccaaagccgcccaggcccaggagccacaaauugacgaauaugcucccgaagauauuauugaguacgacuaugaguauggagaagccgaauauaaggaagcagaaagcguuacagaaggcccuaccgucaccgaagagaccaucgcacagaccgaagccaauaucgucgacgacuuucaggaguauaauuacggaaccauggagaguuaucagaccgaagcaccucggcauguguccggcacaaaugaaccgaacccugucgaagaaauuuuuacagaggaauaucucacgggggaagauuaugauucucagaggaagaacagcgaggauacccucuacgagaacaaagaaauugauggacgcgauuccgaccuguuaguggauggcgacuuaggcgaguaugacuuuuacgaguauaaggaauacgaggacaagccgacuaguccacccaacgaggaguucggaccuggggugccggccgagacugauaucacagaaacuucuauaaaugggcacggcgcauauggggagaaagggcagaaaggggagcccgcggucguggagccuggcauguuagucgagggcccaccuggacccgcugggcccgcuggaaucaugggcccuccaggccuccagggcccaacagggccaccuggcgaccccggcgauagaggacccccaggacggccuggccucccaggugcagauggucuccccggcccacccgggacaaugcuaaugcugcccuuucgguacgguggcgaugguagcaagggucccacaaucucggcucaggaggcucaggcucaggccauacuucaacaagcgcgaaucgcucuccgcggacccccaggccccaugggacuuacaggaagaccaggcccugucggcgggcccggcagcaguggugcaaaaggcgagucaggcgaucccgggccacaagggccccgcggcguccaggggcccccagggccuacuggcaaacccgguaaacgaggacgacccggcgcugacggcggcaggggcaugccuggggagccaggagccaaaggcgauagaggcuucgacggauuacccgguuuaccuggggacaaaggacaccggggagagcgcggcccacaaggacccccaggaccuccaggagacgauggcaugcggggagaagauggcgaaauaggaccaagagggcuccccggcgaggccggcccuagaggacuucuugggcccaggggaacccccggggcuccuggacagccuggaauggcaggaguggauggccccccagggccaaaggguaacaugggaccacagggugagcccggccccccaggucagcaggggaacccuggcccgcaaggacugccagggccucagggcccaaucgguccucccggcgagaagggcccgcaggguaagccaggccucgcuggguugccaggcgccgauggcccuccaggucauccgggaaaagaaggucagagcggcgagaagggcgcuuugggaccacccggaccucaaggaccaaucggguauccugguccccgggggguaaagggagcugacggcguaagaggucugaagggcaguaaaggcgaaaagggcgaggauggcuucccuggauucaagggcgauauggggcugaaaggagaccgaggugaagugggccagauugggccccggggggaggauggaccugagggaccaaaagggcgggccggaccgacgggggaccccgggccaucugggcaggcuggagaaaaagguaagcuggggguucccggacugcccggcuacccagguaggcaggguccuaagggaucuacgggguucccuggauucccuggcgccaauggcgaaaagggggcccggggcguggccggaaagcccggaccccggggacaacggggcccaacuggacccagggguagccggggcgcccgcggcccaacagguaagccaggaccgaaagggacgagcggcggcgacgguccccccggacccccuggagagagggguccacaaggaccucaggggccagucggcuuucccggcccaaagggcccacccggccccccaggaaaagacggacuucccggacaucccggccaacggggugagaccggguuucagggaaaaaccggaccucccgggccuggugguguuguuggcccccagggaccaaccggcgagacgggaccaaucggugaacguggccacccuggaccuccuggacccccaggcgaacagggucuaccaggggcugcuggaaaagaaggagccaaaggcgaccccggaccacaaggcaucuccggcaaggacgggccagcuggauugagaggcuuuccaggggagcgcggacucccgggggcucagggcgcuccaggacugaagggaggggagggcccucaaggaccgccaggcccggugggcucccccggagagagaggcuccgccgggacugcuggccccaucgggcugccuggccgacccgggccucagggucccccuggcccugcuggggagaaaggagcuccaggugagaaagguccccagggcccugcaggccgggacgggguucagggcccugugggauuaccuggaccugcuggccccgcuggcuccccgggcgaagacggggacaagggagagauaggagaacccggacagaaggguucuaaaggcgacaaaggcgagaauggcccaccgggaccccccggccuacagggcccuguuggcgcuccaggaauugcugggggagauggcgagcccggcccacguggccagcagggcauguucggccaaaagggcgacgagggugccaggggauuccccggaccaccaggccccauuggccuucagggccuaccaggaccccccggagaaaaaggagaaaauggcgauguugguccgaugggccccccuggcccucccgguccacgugguccacagggcccaaacggcgccgacgggccucagggcccuccgggcuccguggggaguguagggggcguuggggagaagggcgagccuggggaggcaggaaauccuggcccuccaggagaagcuggaguuggcggaccaaaaggugagagaggugagaagggcgaagccgggccacccggggcugcugggccuccaggggcuaagggcccaccaggcgacgacgguccaaaaggcaacccuggaccaguuggcuuuccaggcgaccccgggcccccaggagaaccgggcccggcugggcaagacggcgugggcggcgauaagggagaggauggcgaucccggacagcccggccccccaggcccuagcggagaagcagggccacccggaccuccuggaaaaaggggaccaccaggagcagccggcgcagaaggcaggcagggggaaaagggcgccaagggugaggcgggcgcugagggcccuccuggaaaaacaggccccgugggaccucaaggcccugcaggcaaaccagguccugagggcuugcgcgggauccccgggccugucggcgaacagggccucccaggcgccgccggacaggacggcccgccgggucccauggguccgcccggacugccaggucuuaagggcgaucccggauccaagggagaaaaaggucacccugggcugaucggccucaucggcccgccuggagaacagggcgagaaaggcgacagggggcucccaggcacacagggcagcccuggcgcuaaaggugacggcgguauaccgggacccgcuggaccccucggaccccccggcccacccggucugcccgggccucaagggccuaaaggcaacaagggaaguacggguccagcaggccagaagggagauucuggacuucccggcccgcccggaucucccgggccgccuggcgaagugauucagccguugcccauucuguccucuaagaagacaaggaggcauacugagggcaugcaggcugaugcugaugauaauauucuggauuacuccgacgguauggaagaaaucuucgggucgcuuaacucguuaaagcaggauaucgagcacaugaaauucccgaugggcacacagacaaacccugcccguaccuguaaagaucuacaauugagccaccccgacuuuccagacggcgaguacuggaucgauccaaaucaggggugcuccggcgauaguuucaagguguacuguaauuucaccucaggaggcgaaacauguauuuacccugacaaaaagagugagggggucaggaucucaucauggcccaaggagaaacccggauccugguucagcgaauuuaagaggggcaaacuucucuccuauuuagaugucgaaggcaacucuauuaacauggugcagaugaccuuucucaaacugcugacugcaucggccagacagaacuucacuuaucacugucaccaaucugccgcgugguaugacguguccucggguaguuacgauaaagcacugcgauuccuugggagcaacgacgaggagaugucauaugacaauaaucccuucauaaagacucuuuaugauggaugcgccuccagaaagggauacgagaaaacuguaauagagauuaacaccccgaaaaucgaccaggugccaaucguggaugugaugaucaaugacuucggagaccagaaccagaaguuuggguuugaagugggcccagugugcuuccuuggcuag

SEQ ID NO: 31695 - RNA, 5073 nt, Artificial Sequence
  Description of Artificial Sequence: Synthetic coding sequence
auggaaccuugguccucucgguggaagacuaaacgaugguugugggauuuuacugugacaacuuuggcccugacuuuucuguuucaggcaagggaggucaggggcgccgcuccuguggaugugcuaaaggcucucgauuuucacaauuccccagaggggaucagcaagacuacugguuuuugcacuaaccguaaaaacucuaaagggagugacaccgcauacagggucagcaagcaagcccaacucagugccccgacuaagcaacuguuuccaggcgggacguucccagaggauuucucuauacuguucacugugaagccuaaaaaaggaauccagagcuuccugcugucuauuuacaacgagcacgguauccagcagauugggguugagguaggucgcuccccuguguuuuuauuugaggaccacaccggaaaaccagcgccugaagacuauccucucuucagaaccgucaauauugccgacggcaaauggcaccgcguggcuaucucugucgagaagaaaacagugacaaugaucguggacugcaaaaaaaagaccaccaaaccucuugaccgaagcgagcgggccauuguggauacaaauggcaucacgguuuuugguaccaggauucuggacgaggaggucuuugagggggacauucagcaguuucugaucaccggagauccgaaagcugcuuacgauuauugugagcauuauucacccgauugugacucauccgcgccaaaggccgcucaggcacaggaaccccagaucgacgaauacgcuccggaggacaucauugaguaugacuaugaauacggcgaggccgaguacaaagaagccgagaguguuacugaaggaccaacagugacagaggaaacuaucgcccagacugaaaucaaugggcacggcgcuuacggugagaagggacagaagggugagccagcugugguggaaccggggaugcuggucgaggggccccccgguccugcuggaccugccggcauaauggggccccccggucuccaaggccccacagguccaccuggagacccuggugaccgcgggccucccgggcgacccggacugccuggcgccgacggucugcccggaccuccgggaacaaugcuuaugcugccauucagguaugggggcgauggauccaaagggccuacgaucagugcucaggaggcccaggcccaagccauucuccagcaggcuagaaucgcucuccgcggcccgccaggacccaugggccugaccgggcgcccuggccccgucggcggcccagguucaucaggcgcgaaaggugagagcggagauccuggcccccaggguccacgggggguucagggacccccggggccaacagggaaaccggguaaacguggccggccaggggcugauggcggucgcggaaugccaggagaaccgggcgcuaagggcgaccgcggcuucgacggacuuccaggacuucccggagauaagggacacagaggcgagcgaggaccucaggggcccccugguccuccaggcgacgacgggaugcgaggggaggacggcgaaauagguccucgcggacugcccggagaggcgggaccuagaggccugcugggucccagaggaacacccggagcacccggacagccggggauggcuggagucgauggcccucccggcccuaagggcaacaugggaccccagggggaaccuggcccacccggacagcagggcaaccccgggccucagggcuugcccggaccacaaggucccauaggcccuccaggugagaaagguccccaggggaaacccggacuggccggccucccaggugcugacggcccaccuggccaucccggaaaagaaggucagucaggagaaaaaggugcucucggacccccuggaccacagggaccuauugguuauccuggcccacgaggagugaagggggcugauggggugcggggccuuaagggauccaagggggagaaaggggaagauggguuuccuggauucaaaggcgacaugggucugaagggggacagaggggaaguuggccagaucggaccgaggggcgaggacggccccgagggcccuaaaggacgagcugggccuacaggugacccuggucccucuggccaggcuggcgaaaaggguaaacucggggugcccgggcucccgggcuauccugggaggcaggguccaaaggguagcaccggguuuccagguuuucccggcgcaaauggagaaaagggcgccagagguguagccgguaaaccaggcccaagaggccagcggggaccuaccggaccgcggggcagcaggggggcgcgggggccgacaggcaagccaggcccuaaagggacuagcggcggggacggaccccccggaccuccgggugagcgggggccacaaggcccacaggguccuguaggguucccagguccuaaggggcccccuggcccaccuggaaaagacggauugcccggucauccaggucaaaggggagagaccggguuccagggaaaaaccggaccuccaggaccuggggguguuguaggaccacaggggccaacuggcgagacuggaccuauuggugaaagaggacaccccgggccaccgggaccaccuggcgaacagggauugccuggcgccgcgggcaaggaaggagccaagggugaccccggcccccaggggaucucugguaaggacggccccgccggucugcgaggguuuccuggagagagaggacucccaggcgcccaaggagcuccaggccugaagggcggagagggcccacaggguccacccggcccagugggaucuccuggagagaggggauccgcggggaccgccggcccaaucggacucccaggccgccccggaccgcaaggaccucccgguccugcaggcgaaaagggugcgccaggggaaaaaggcccacaggggccugccgggcgagaugguguccagggacccgucggccuuccagggccugcugggcccgcuggcuccccuggggaggacggggacaaaggggaaauuggggaaccagggcaaaaaggcucuaaaggggacaagggcgagaacggaccuccagguccaccuggacugcagggaccuguuggugcuccugggauugccgguggcgauggugaaccgggucccagaggucagcagggaauguucgggcagaagggagacgaaggcgcucgcggauuucccggcccaccaggaccgaucggacugcagggucugccugggccuccgggugagaagggagagaauggagacgucggaccaauggggccuccuggccccccaggacccaggggcccacagggacccaauggcgcagacggaccccaagguccacccggcucuguugggagcgugggugguguuggagagaaaggagagccaggggaggcaggcaauccuggccccccuggagaggccgggguagggggucccaaaggagaacguggagagaagggggaggcuggaccgcccggggccgcugggccuccuggcgcgaagggaccacccggagacgacgggcccaagggaaauccagggccagugggguuccccggcgacccugggccucccggggagccaggcccugcaggacaagacggcgugggaggcgacaaaggugaggacggggacccaggucaaccugggccgccaggcccaucaggagaagccggcccuccagggccaccagggaagagggggccacccggcgcagcuggggcagagggucgucagggcgaaaagggcgccaaaggcgaagccggagcggaaggcccacccggcaaaaccggcccaguaggaccccaaggaccagcuggaaagccgggcccagaaggucugagaggcaucccugguccggugggcgagcagggccugccuggcgcugcuggucaagacgggccucccgguccaaugggaccucccggccugccugggcucaaaggagauccagggucuaaaggggagaagggacaccccggucucauagggcucauaggaccaccuggagaacagggggagaagggggacaggggguugccugguacucagggaagcccuggggccaagggggacggcggcauucccggacccgcuggcccucuggggccaccaggaccccccgguuugccgggcccccaggguccuaaaggaaauaagggauccacuggcccagccgggcagaaaggugauaguggucuccccggaccaccggggagccccgguccaccaggagagguuauccagcccuugccuauccucagcuccaagaagacgcguagacauacagagggcaugcaggcugacgcugacgacaauaucuuggauuacucugacggcauggaggagauuuuuggguccuuaaauuccuuaaagcaggauaucgaacauaugaaguuucccaugggaacacagacaaacccugcccgcacuugcaaagaucuacagcugagccauccugauuuucccgauggcgaguacuggauagacccuaaucaaggauguucuggugacuccuucaagguuuacugcaauuuuaccucuggcggcgaaacauguaucuacccugacaagaagucugaggggguacggauuagcuccuggccaaaagagaagcccggcucuugguucagugaauucaaacgcggcaagcuccuuucuuacuuagaugucgagggcaauaguauuaauauggugcaaaugacuuucuugaagcuguuaacagccagcgcccgacagaacuuuacauaucacugucaccaguccgcggccugguaugaugugaguuccggaagcuaugauaaggcucugcguuuucugggaaguaacgacgaggagaugagcuacgauaacaaccccuuuauaaagacccuuuacgacggcugugcaucuaggaaaggguaugagaagacaguuauugagaucaauaccccaaagaucgaccaggugccaaucguugauguuaugauaaacgacuucggagaucagaaccagaaguuuggcuucgaggugggccccgucugcuuucuuggauag

SEQ ID NO: 31696 - RNA, 1761 nt, Artificial Sequence
  Description of Artificial Sequence: Synthetic coding sequence
augggcgucaacgcugugcacugguuucggaaggggcucaggcuucacgauaauccagcucuuaaagaaugcauucagggagcugauacaauccgcuguguguauauccuugacccaugguucgcagggucuucgaacguggguauuaaccgauggagguuucuccugcagugccuggaagaccuggaugcaaaucugcggaaacugaacucccggcuguucguuauccggggccaaccagcagacgucuuuccucgacuguuuaaagaauggaauaucacgaaacucagcaucgaauacgacucggaacccuucgggaaagagcgggacgccgcaaucaaaaagcucgccacugaggcuggggucgaggucaucgugaggauuucccauacacuguacgaucuggacaagaucauugagcugaacggaggccagccaccccugacguacaaacguuuucagacgcucauuucaaagauggaaccuuuggaaauccccguugaaaccauuaccagcgaagugauagaaaagugcaccacuccacugagcgacgaucacgacgagaaauacggggugcccucccuggaggaacuuggguuugacaccgacggccugucguccgccguguggccaggaggggaaacugaggcccucacacgccuggagcgccauuuagagaggaaggcuuggguugcuaacuucgaacgcccucguaugaacgccaauucucugcucgcuagccccaccggacuuucgcccuaucugcgauucgguugccuaaguuguaggcuguuuuauuucaaacugacugacuuauacaaaaaggugaagaagaauucgagcccaccccuuucccucuauggacagcucuuauggagagaguuuuucuauaccgccgccaccaacaauccaagguuugauaagauggaaggaaacccaaucugcguccagaucccaugggauaagaacccagaggcucuggcaaaaugggcugaaggccgcaccggauuuccauggauugacgcgaucaugacucaauugaggcaggagggguggauucaucaucuagcacggcaugcgguagccugcuuuuugacgaggggagaucuguggaucagcugggaggaaggcaugaagguguuugaagaacuacuuuuggaugccgauuggaguaucaaugcugggaguuggauguggcucucuuguaguucuuucuuucaacaguuuuuucacugcuauugcccugucggauuuggaaggcgcaccgacccuaauggggauuauaucaggcgguaucugccuguacugagaggguuuccggcuaaguacauuuacgauccauggaaugcgccugagggaauacaaaaaguggcaaagugccugauuggcgucaauuacccuaagccaauggugaaucaugcagaagcgagcagacugaacaucgagcggaugaaacagauuuaccagcaguugaguagguaucggggccugggucugcuugccaguguuccuuccaaccccaacggcaaugggggauucaugggauauagcgccgagaacauaccuggaugcaguagcagcggcucguguucccaagguucagguauccuacacuacgcccacggagacagccagcaaacccaccugcucaagcaagguagaagcucaaugggcacugggcucaguggcgguaaacgcccgucacaggaggaggauacucagucuaucgguccuaaagugcagagacagaguacgaacuag

SEQ ID NO: 31697 - RNA, 504 nt, Artificial Sequence
  Description of Artificial Sequence: Synthetic coding sequence
augcugccagaaaaagcccuccacggacacccucagcuuccucgcaccgucccaacucgugccgcaaugcgcgcugccggaacccuucucgccuuuugcugucugguauuaucaaccaccggcggaccuagcccugauaccuguagccaggaccugaacucaagagugaaacccggcuucccuaagacgauaaaaacuaacgauccaggcgugcugcaagcugcgcgauacagcguugagaaauucaauaacuguacuaacgacauguuuuuauuuaaggagucucggaucacucgcgcgcuggugcagauugugaagggccuaaaauauaugcuugagguagaaauugggcguacgacuugcaaaaaaaaucagcaccuccgacuggaugauugcgacuuucagacaaaccauacguugaaacagacacucucuugcuacagcgaagugugggugguucccuggcuacagcauuucgaagugccaguacuccgcugucauuag

SEQ ID NO: 31698 - RNA, 438 nt, Artificial Sequence
  Description of Artificial Sequence: Synthetic coding sequence
augcgugccgcaggaaccuuacuagcuuucuguugccucgugcucaguacuacaggcggcccuucaccagacacuugcucccaagacuugaacagucgugucaaaccaggauucccuaagaccauuaagacaaacgacccuggcguguugcaggcagcccgguauaguguggagaaauucaauaauuguacaaaugauauguuccuuuucaaagaaucucggauaaccagagcccuagugcagauagugaaaggauuaaaguacauguuggagguagaaauaggaagaaccaccuguaaaaaaaaccagcaucuuaggcucgacgauugcgauuuucaaacaaaucacacccugaagcagacacugucauguuacagugaggucuggguuguacccugguuacagcauuuugaagugccaguacuuagaugccauuag

SEQ ID NO: 31699 - RNA, 513 nt, Artificial Sequence
  Description of Artificial Sequence: Synthetic coding sequence
auguacugucaguucgcaagcuuccaauacaccugucaacccugccgcggccagagaaugcuauguacccgcgauagugagugcugcggggaucagcuuuguguuuggggccacuguacaaaaauggcaaccagggguuccaacgguaccauuugugacaaccagcgugacugccagccgggccugugcugugccuuucaacgaggucuucucuucccagucugcacaccccuuccagucgagggagaguugugucacgacccagcaagucgacugcuugaucugauaacaugggagcuggaaccagacggcgcccucgaccgcugcccaugugcaaguggacugcuuugucaaccgcauucucacucucugguguaugugugcaaacccacauuuguuggcucucgggaucaggauggggaaauucugcugccucgggaaguuccugaugaauaucucgccgccaguuggaggagaugugcccguaguuggcggacuuggagaggggcuuag

SEQ ID NO: 31700 - RNA, 1053 nt, Artificial Sequence
  Description of Artificial Sequence: Synthetic coding sequence
augcagcgccugggggccaccuugcucugccugcugcucgccgccgcugugccuacagccccagcaccagccccgaccgccacuagugcccccgugaagccaggacccgcucuuaguuauccccaggaagaagcuacauugaacgagauguuccgggagguagaggagcucauggaagacacacagcacaagcugcgcuccgccgucgaagaaauggaggccgaggaggccgccgccaaagccucgagcgagguuaaucucgcaaauuuaccgccuucauaccauaaugagaccaacacugacacaaagguggggaauaauaccauacacguucacagggaaauacacaagaucaccaauaaccagaccgggcagaugguauucagugaaaccgugauuaccagcgucggcgacgaagaagggagaaggagucacgaaugcauuauagacgaagacugcggcccaucaauguacugucaauuugccucauuccaguauaccugccagccuugucgcgggcaacguauguuaugcacaagagacagugaauguuguggcgaccagcuguguguauggggucacugcaccaagauggccacccgagguucuaauggcacuaucugugauaaccaacgagacugccagccaggauugugcugcgcuuuucaacgcggacuccuauuuccagucuguacaccgcugcccguggaaggagagcugugucacgauccggcguccagacugcuugaccuuaucacgugggaguuagagcccgauggcgcucuggacagaugcccgugcgcaagcgggcuguuaugucaaccccauagccacucuuuaguauacgugugcaaaccgaccuucgucggcucuagagaucaagacggggagauccugcugcccagagaggugccagacgaguacgaggugggcucuuuuauggaagaggugcgccaggaguuagaagaccucgaacgaucauuaacugaggagauggcacuccgugaacccgccgccgccgcugcagcccuccugggcggugaagaaauauag

SEQ ID NO: 31701 - RNA, 882 nt, Artificial Sequence
  Description of Artificial Sequence: Synthetic coding sequence
auggaagacacucaacacaaguugcgcucugcuguggaagagauggaagccgaggaagccgcugccaaagccuccucugagguuaaucucgccaaucuucccccaaguuaccacaacgagacuaacacugauacuaagguugguaauaauacaauccacguucauagagagauccacaaaaucaccaacaaccagaccggacagaugguguucagcgaaaccgucauuacaucaguuggagaugaggaggguaggcgcagccaugaaugcaucauagacgaagacugcggaccauccauguauugccaguucgccuccuuucaguacaccugucagccaugcaggggccagaggaugcuuuguacgcgggacucagaauguuguggagaucaacugugugucuggggacauuguacuaagauggccaccaggggaucuaacgggaccauuugcgacaaccagagagauugucagccggggcuguguugugccuuucagagagggcucuuguuccccguguguaccccacugccuguugagggggagcugugccaugaccccgcuagucgccuacuagacuuaaucacaugggaacucgagccugauggagcgcuggauagauguccuugcgcgucgggucuucugugccagccgcacucccacucacugguuuacgugugcaagcccacauucguuggcucccgagaccaggauggcgagaucuuacucccacgcgaagugccagacgaauacgaggugggcucuuucauggaagaggucaggcaggagcuggaagaccuugagaggucauuaacggaagagauggcauugcgggagccggccgccgccgcggcugcuuuacuaggcggcgaagagaucuag

SEQ ID NO: 31702 - RNA, 1053 nt, Artificial Sequence
  Description of Artificial Sequence: Synthetic coding sequence
augcagagacucggcgcaacucuucugugccuuuugcuggcugcugcugugccuacugcccccgccccugcacccaccgcgaccucagcaccggucaagcccggcccagcacugucuuacccccaagaagaagccacccugaaugaaauguuccgcgaagucgaggagcucauggaggauacucagcauaagcugcggagugccguugaagaaauggaggcagaagaagccgcagccaaggccagcagugagguuaaccuugccaaucuccccccuucuuaucacaacgagaccaauacagauaccaaaguggggaauaacaccauucauguucaucgagaaauucacaaaauuacuaacaaccaaaccgggcagaugguguuuagcgaaaccgucauuaccagcgucggagaugaggaaggcagacguucacacgaauguauuauugacgaagacugcggaccuucuauguauugccaauucgcaaguuuucaguacacgugccagccgugucggggacagaggaugcuguguacccgugauucugagugcuguggggaccaguuaugcguauggggucauugcacaaagauggcuacccggggauccaacggcacaauuugugauaaccagcgggacugccagcccggacuguguugcgcauuucagaggggcuuauuguuucccgucuguacaccccuuccuguggaaggcgaacucugccaugauccugccucucggcugcuggaccugauuacuugggaacucgagccagacggagcacuggacaggugucccugugccuccgguuuacuuugucagccucacagccauagccuugucuaugucugcaaacccacauucgugggcucccgagaucaagauggcgagauacugcugccccgcgagguaccagacgaguacgaaguugggucuuuuauggaggaagugcgucaggaacucgaagaucucgaaaggucccugacugaggaaauggcuuugagggagccugccgcugccgcugcagcgcucuugggaggagaggagauuuag

SEQ ID NO: 31703 - RNA, 969 nt, Artificial Sequence
  Description of Artificial Sequence: Synthetic coding sequence
augcaacggcugggcgcaacucuccucugucuccugcuggcagcugcuguaccuaccgcuccagccccagccccaacugcaacaagugccccuguuaaacccggccccgcccucaguuacccccaggaagaggcuacauugaaugaaauguuccgggaggucgaggaacugauggaagacacccagcacaaauugcggagcgcaguggaagaaauggaagcagaggaggcugcagccaaagcuagcagugaggucaauuuggcaaaccuuccacccagcuaucacaacgagaccaacaccgacacaaagguggguaauaacacuauucauguccaccgagagauccauaaagaaugcauuauugacgaggacuguggcccaucuauguauugucaauucgccuccuuucaauacacaugccaacccugccgggggcagaggaugcuaugcacucgugauagugaauguuguggagaucagcucuguguguggggacacugcaccaagauggccaccagagggucaaacggcacaaucugugacaaucagcgcgacugccagccuggacuguguugugcauuucagagaggccuccuuuuucccguuugcacgccacucccuguugagggagaacugugucacgaucccgcaagucgacuucuggaucucaucacuugggagcuugagccagauggagcccucgacagaugucccugcgccucaggcuuguuaugccaaccccacucucauucuuuaguguaugucugcaaacccacguucguugggucccgcgaccaggauggcgaaauuuugcugccgcgggaaguccccgaugaguacgaaguaggaucuuucauggaggaaguccgacaggaacuugaggaucuggaacggucccugacugaggagauggcacugcgagaaccagcugccgcugcugcugcccuucuggggggagaggaaaucuag

SEQ ID NO: 31704 - RNA, 708 nt, Artificial Sequence
  Description of Artificial Sequence: Synthetic coding sequence
augcaacgacucggugcuacucuccuaugccugcuccuggccgccgccgugcccacugcuccggcaccugcgcccaccgcaaccucugcgccgguuaagccaggaccugcacugaguuauccccaggaagaggccacuuugaaugagauguuccgcgaaguugaagaacugauggaagauacccagcauaagcugagauccgcuguggaggaaauggaagccgaggaagcugcugcuaaggcuagcucagaagugaaucuugccaaccugccucccagcuaucauaaugagacuaacaccgauaccaagguuggaaacaauaccauucacguacacagggagauccacaagauaaccaacaaucagaccggacagaugguuuuuucugaaaccgugaucacgucugugggugacgaagaaggacgacgcucucacgagugcaucaucgacgaggacugcgggccaucaauguauugucaguucgcuuccuuucaguauaccugccagccuugccgcggacaacggaugcuaugcaccagagacagcgaauguuguggcgaccagcucuguguuuggggacacugcacuaagauggcaacuagaggauccaacgguacaauuugugauaaucaaagagacugccaaccuggacugugcugcgccuuccagaggggauuacuguuuccagugugcacgccacugccauag

SEQ ID NO: 31705 - RNA, 972 nt, Artificial Sequence
  Description of Artificial Sequence: Synthetic coding sequence
auggacccggggaaggacaaagagggugugccccagcccucaggaccucccgccagaaaaaaguucguuaucccacucgaugaggacgaagucccuccaggcguugccaaacccuuauucagaucgacacagagccuucccacuguggauacuuccgcacaagcggcaccucagaccuacgccgaguacgcaaucucccagccacuggaaggagcuggagccacuugcccuacaggaucagagccccuugcuggggaaacaccaaaucaggcacugaagccuggcgccaaaucgaauagcaucauugugucacccaggcaacgcggcaaccccgugcugaaauuuguacgcaacguccccugggaguuuggagauguaauaccagauuacguccucgggcagagcacaugcgcacucuuucucucccugcgguaccacaaccugcacccugacuauauccauggccgucuccagucacucggcaagaacuucgccuuacgaguguuacuugugcaaguggauguuaaagacccucagcaggcacuuaaggaacuggcaaagauguguauucuugcagacugcacacucauucucgcauggucuccugaggaagccggcagauaccuagagacuuauaaagcuuacgagcagaaacccgccgaucugcucauggagaaacuggaacaggauuucgugagccgcgugaccgaguguuugacaacugugaaaagcgucaacaagacugauagccagacacugcuuacuacauuuggauccuuagaacagcugaucgcagcgucuagagaagacuuggcacucuguccaggacucggcccacagaaagucagagcccucgguaagaacccccguuccuggggaaaggaacgagcgcccaacaagcauaaccuacgaccucaguccuuuaaggugaaaaaagagccaaaaacacgacauuccggguuccgccuguag

SEQ ID NO: 31706 - RNA, 384 nt, Artificial Sequence
  Description of Artificial Sequence: Synthetic coding sequence
augcagcagcccuucaacuaccccuauccccaaaucuauuggguagacucaucugccuccucuccaugggcccccccaggcaccguauugccgugcccuaccuccguacccagacggccagggcagcgacgaccgccaccaccaccuccuccuccaccucuccccccgccaccucccccacccccacuuccacccuuaccucuaccaccucucaaaaagcgcggaaaccauagcaccggauugugccucuuaguaauguucuuuaugguuuuaguugcacuggugggucugggauuaggcauguuccagcucuuucaccugcagaaggaacuugcagaacuccgagaagccaccccuguccauccauugaaaaaacgaucauag

SEQ ID NO: 31707 - RNA, 846 nt, Artificial Sequence
  Description of Artificial Sequence: Synthetic coding sequence
augcagcagccguucaacuacccguauccgcaaauuuacuggguugacagcucagcaucuagccccugggccccuccuggaaccguucucccuuguccgaccucugugccacggagaccuggucaaagaaggcccccuccuccaccucccccacccccucugccuccgccgccaccuccucccccuuugccuccuuuaccacuuccaccacugaaaaaacgagggaaccauucuacuggccugugcuuguuggucauguucuuuauggugcugguggcucuuguugggcugggccuaggaauguuccaauuguuccauuuacagaaggaacuggcugaacugcgagagaguacuucccaaaugcacacugcaaguagcuuggagaagcaaauuggacaccccucaccccccccagagaagaaagagcucagaaagguugcccaccugacuggcaagagcaacucaaggaguaugccgcuugaaugggaggauacguacgggauaguucuguuaucaggagugaaauacaaaaagggcgggcuugugaucaaugaaaccggucuguacuucgucuauagcaaaguguacuucagaggccagucaugcaacaaccugccucugucccacaaaguauauaugaggaauaguaaguacccccaggaccuggucaugauggaggggaaaaugaugucuuacuguacuacuggacagaugugggccagauccucuuaccuuggggccgucuucaaccucaccucagccgaccaucuuuauguuaaugucucagaacuuaguuuagugaauuuugaggagucucagaccuucuucggccuguacaagcuguag

SEQ ID NO: 31708 - RNA, 585 nt, Artificial Sequence
  Description of Artificial Sequence: Synthetic coding sequence
augcacaaguggauccugacuuggauccuucccacuuuguuauaucggagcugcuuccacauuauuugucuggucgguaccaucucccuugcaugcaacgacaugaccccugaacagauggcaaccaacgugaacugcucuagccccgagagacauaccagaucauaugauuacauggaggggggcgauauccgcgugcgacgccuguuuugcagaacccagugguaccugagaaucgacaaacggggaaaaguaaaagguacucaagagaugaagaauaauuacaauaucauggagauacgaacaguggcagucggcauagucgcuauaaagggaguggaguccgaauucuauuuagccaugaacaaggagggcaaguuguaugccaaaaaggaguguaaugaagacuguaacuuuaaggagcuaauucucgaaaaccacuacaauaccuacgcuagcgcaaaauggacucauaauggaggggaaauguucguugccuuaaaucaaaaaggcauuccugucagggguaaaaaaacaaagaaggaacagaaaacugcucacuuccugccuauggcaauaacuuag

SEQ ID NO: 31709 - RNA, 585 nt, Artificial Sequence
  Description of Artificial Sequence: Synthetic coding sequence
augcauaaauggauccucacuuggauucuuccgacucuccucuauagaucuugcuuccacauuaucugucuaguggggacaaucagucuugccugcaacgacaugacccccgagcaaauggcaaccaacgugaauuguucuucaccugaaaggcacacccguaguuacgacuacauggagggaggagauauaagaguacgccggcuguuuuguagaacucagugguauuugcgcauugauaagagaggaaaggugaagggaacucaggagaugaaaaauaacuauaauauuauggagauacggacuguugccgugggaaucgucgcgauaaagggaguagagagcgaauuuuaccuugcaaugaauaaagagggaaagcuguaugccaagaaggaguguaacgaagacuguaauuuuaaggaacuuauuuuggagaaccacuacaacacauacgccucugccaaguggacacauaacgggggagaaauguuuguggcucuuaaucagaaggguaucccugucagagggaagaaaacaaaaaaggaacagaaaacggcccacuuccucccgauggcuauuacuuag

SEQ ID NO: 31710 - RNA, 7164 nt, Artificial Sequence
  Description of Artificial Sequence: Synthetic coding sequence
auguugcguggcccuggcccuggcuugcugcuccuggcuguccagugcuugggcacagccgugcccaguaccggcgccagcaaguccaaaagacaagcccagcagauggugcagccccagucucccguggccgucucacaaucgaagccuggcugcuacgauaacggcaagcacuaucagauaaaccagcagugggagagaacguaccugggaaacgcccuggucugcaccugcuacggugguagcaggggauucaacugcgaaucgaagccggaggccgaggaaacuugcuuugacaaauacaccggcaacacguaccgcgucggagauacuuaugagcgaccuaaggacucaaugaucugggauugcaccugcaucggagccgggagggggcgaauuucauguacgauugcaaaccgcugucacgaggguggucagucuuauaagauuggcgacacauggcgacguccucacgagaccggcggcuacaugcuggaaugcgugugcuugggcaacgggaagggggaauggacuugcaagccaauugccgagaaauguuuugaccacgcagccgggaccagcuacguaguaggggagacaugggaaaagccauaucagggcuggaugauggucgacuguacaugucugggcgaaggaucaggacgcaucacuugcacgucccggaaucgcuguaaugaccaggacacccggacguccuaucgaaucggcgauacuuggucgaagaaggauaacagggggaaccugcuucaguguauuuguacaggaaacggucgcggcgaguggaaaugcgagagacacacguccguccagaccacauccagcggcucagguccguucacagacguuagggccgcugucuaccagccucaaccucacccacagcccccgcccuauggacacuguguuacagauucaggggugguguacagcgucgggaugcaguggcugaaaacucaaggaaauaaacaaaugcuguguaccugucucgguaacggcgucucuugccaggaaacggccgugacccagaccuaugguggcaauaguaauggggaaccuugcgucuuacccuucaccuauaaugggcggacuuuuuacucuuguaccaccgaaggacgucaggauggccauuugugguguagcacaacguccaacuaugagcaggaucagaaguacucauuuugcacugaccacaccguauuaguccagacccgggggggcaacucuaacggcgcacucugccauuuuccauucuuauacaacaaccauaauuacaccgacugcaccuccgagggccgcagagauaauaugaaguggugcggaacuacucagaacuaugaugcagaccagaaguucggauuuugccccauggcugcccaugaggaaaucugcaccaccaaugagggggucauguauaggaucggcgaucagugggacaaacagcaugauauggggcacaugaugcggugcacauguguugggaacggaaggggcgaguggacauguauugccuauagucagcugcgggaccaguguauaguggacgacauaacuuauaacguuaaugacaccuuccauaaacgacaugaggaaggacacaugcucaacuguacauguuucggccagggacguggacguuggaagugcgacccugucgaucagugccaggacucagagacugggacuuucuaucagaucggcgacucaugggaaaaauacguccacggggucagauaucaaugcuacugcuacgggagagggaucggagaguggcacugccagccucuccagaccuaucccucauccagugggccuguggagguuuuuaucaccgaaacccccagucagcccaacucucacccgauccaguggaacgccccacaacccucccacaucucgaaauacauccugcguuggcgccccaagaacuccguaggacgguggaaagaagccacuauuccaggccaccuuaacuccuacaccaucaagggacuuaagccaggaguaguguaugagggccagcugaucaguauucagcaauacgggcaccaagaaguuacaagguuugauuuuacaacuaccucuaccucaacaccaguuaccagcaauacagucaccggagagaccacaccuuucuccccacugguggcuaccucugagucugugacagaaauaacagcaucaucauuuguuguguccugggugagugccucagacacugugaguggguuccgcguggaauacgagcucucugaggagggagaugagccacaauaccuggaucugcccagcacggcaacaucagucaauauuccggauuugcugccagggcggaaguauauugucaauguguaccagauuuccgaagacggcgagcagagccugauacucuccacuagccagaccacagccccagacgcaccgccggacacaacugucgaucagguggacgauacuuccaucgucgugcguuggucccguccccaggcaccuaucaccggcuacagaaucguguauagcccgucagucgaagguucauccaccgagcugaaccugccggagaccgcgaauaguguuacacucuccgaccuacagcccggaguccaguacaauaucacaaucuaugcaguagaagaaaaccaggaaaguacuccagucgucauucaacaggaaacaacgggaaccccgcgguccgacaccgugccaucaccacgagaccuucaguucgucgaaguuacagauguuaaggucacaaucauguggacaccaccagaaagcgccgucacaggauacagagucgacgucaucccaguuaauuuaccuggagaacacggucagcgacugccuauuagcaggaauaccuuugcugagguuaccggccuaagccccggcgugacuuauuacuucaaaguguuugcugucucccauggaagggaguccaagccauuaaccgcccagcagacgacuaaacuggacgccccgacgaaucuccaguucgugaacgaaacugauuccaccguucucgugagauggacuccuccccgagcacaaaucacaggauacaggcucacagucggccucacccggagagggcagccucggcaauauaaugugggcccuucugugucuaaauauccacugcguaaucugcagcccgccuccgaguauaccgucucccuaguugcuauuaaaggaaaucaggaaagcccuaaggccaccggcguuuucaccacauugcagccagggucaucaaucccgccuuauaauaccgaagugaccgagacaacuaucgucaucacuuggaccccagcaccuagaaucggguucaagcucggcgugcgccccagucagggcggcgaggcccccagggaagugacaucggacagcgggagcaucguggugucaggucugacuccaggcguggaauacguguacacuauucagguccuaagggacggacaggagagagacgcucccauagugaacaaggugguaacaccccugaguccucccaccaacuuacaccucgaagcuaauccggauaccggcguucugacagugucuugggaacgcagcaccacucccgacaucacaggauacagaaucaccaccaccccuacaaacggucagcaggggaacucucucgaggaaguugugcaugccgaucaaucuagcuguacguucgacaaucugagcccaggacuugaauacaauguauccguguauacagucaaggaugauaaggagucaguaccuauuagcgacaccaucaucccagaggucccccaacugacugaucugagcuuugucgacaucaccgauagcuccauaggcuugagguggaccccacuaaauuccucaacuaucauaggguaccggaucaccgugguggcugcaggcgagggaauucccaucuuugaagauuuuguugacuccagcgugggcuacuacaccgugaccggucuggagcccggcaucgacuacgauaucucugugauuacccugauuaaugggggcgagucagccccgaccacauugacucaacagacagcuguucccccuccaacugaccuucgguucuuuucugauauuaccgcgaacucuuuuacagugcauuggaucgcgccucgggccacaaucaccggcuacagaaucagacaucacccagaacacuucucaggucggccccgggaagacagaguuccucacagcagaaacucuaucacacugacuaaccugacuccagggacggaauauguggugucgaucguggcccucaaugggcgggaagagagucccuuacugaucgggcagcaaaguacagugagcgaugugccaagggaccucgagguggucgcggcgacaccuacuagcuuauugauuucaugggaugcuccugcugugacuguacgguacuaucgcaucacauacggcgaaaccggcgguaacagcccggugcaagaauucaccguacccggcucaaaaagcaccgcuacgauauccggccugaaaccaggcguggacuacacaauuaccguauacgcagugaccggacggggugauagcccagcaagcuccaagccuauuucaaucaacuaucgaacagagauugauaaacccucccagaugcaaguuaccgaugugcaggacaacuccaucagugugaagugguugcccucauccucaccaguuaccggauaccgcgucacuacaaccccaaaaaacgguccaggcccaacaaaaacuaagacggcggggccagaccagacagagaugaccauugaaggauuacagcccaccguugaauacgucgugucaguguaugcacaaaauccaagcggcgaaucucagccuuugguccaaacagcggugacaaauaucgauaggcccaagggccuugccuucacggacguggacguagauucuauuaaaaucgcgugggagagcccccagggccagguuucaagauaucgcgugacauauagcucuccugaggacggaauacaugaacucuucccugcccccgacggugaggaggacaccgccgagcuccaaggcuuacggcccgggagcgaauacaccguaagcgucguggccuuacaugaugacauggaaucgcagccacuaaucggaacccaaucuacugccauuccagcgccaacagaccugaaguuuacacagguuacucccacaagcuuguccgcucaguggacaccaccuaaugugcagcucaccggguaccgagucagaguuacacccaaggaaaaaacuggacccaugaaggaaauaaaccuggcuccugacagcagcucgguaguggucagcggucugauggucgccaccaaauacgaggucucuguuuaugccuuaaaagacacauugacuaguaggccggcucaagguguugugacgacacuggaaaaugugagucccccucgcagggcgagaguuacggacgccacagaaaccacuaucacgaucaguuggcgcacgaagaccgagacaaucacuggauuucagguggacgccgugccugcuaacggccaaacuccgauacagcgcacuauuaagccagauguccgguccuauaccauuacuggauugcagccugggacagacuacaagaucuaccucuacacacugaacgauaacgcuaggagcucccccguggucaucgaugccagcacugcgauugaugcacccucuaaucugcgcuuucucgcaaccacccccaauagccugcuuguuuccuggcaaccgccccgcgccagaaucaccggcuauauuauuaaguaugagaaacccggaucucccccucgcgaaguggucccccguccacguccgggcguuacugaggcaacuauaaccggucuggaaccgggaaccgaguacaccauauaugucauagcauugaagaauaaccagaaaucggagccccugauugggcgcaagaagacagaugagcugccgcaguuagugacccugccccacccuaaucugcacgggccagaaauacuggauguccccucaacgguccagaaaacuccuuuugucacacaccccggauaugauacuggaaacgggauucaguuacccggcacaucagggcagcagccuucagucggacagcagaugaucuucgaggagcauggauuuagacgcaccaccccgccaacuaccgccaccccaauucgccauaggccacgcccauacccccccaacgugggggaggagauucagaucggacauauuccccgagaggacguagauuaucaccucuacccccauggaccuggauugaacccaaacgccucaaccggucaggaggcuuugagccaaacuacuauuucaugggcuccguuucaagauacaagugaauacauuauuucuugccacccagucgggacagacgaagagccccugcaguuccgggugccugguacauccaccuccgccacacugaccggccucacaaggggcgccaccuauaaugugaucgucgaggcucugaaagaccagcagaggcacaaagugcgggaggaaguugugacuguggggaauagcguaaaugaagggcuuaaucagccuacugacgacuccugcuucgacccauauacuguuucucacuacgccgugggcgaugagugggagcguaugucagaaaguggcuucaagcugcuuugucaaugucucgguuucggaagcggucacuucaggugcgauucaagcagguggugucaugauaacggggugaauuacaaaaucggggagaagugggacaggcagggcgagaacggacagaugaugucuuguacaugcuuagggaaugggaaaggugaguucaagugcgacccccacgaggcgacuugcuacgaugacgggaagaccuaccaugucggugagcaguggcagaaagaguaucugggagcuaucuguuccuguaccuguuucggagggcagcgcggauggcgaugugauaacugucgcaggccuggaggcgaaccuuccccagaggguacuacgggucaaaguuacaaccaauauagucaaagguaucaccaacgaaccaauacgaauguuaauugccccauagaauguuuuaugccccuggacgugcaggcagauagagaggauagucgagaguag

SEQ ID NO: 31711 - RNA, 7341 nt, Artificial Sequence
  Description of Artificial Sequence: Synthetic coding sequence
augcugagggggccaggaccuggcuugcuccuauuggccgugcagugcuugggcaccgcuguucccucgacuggagccagcaaaagcaagaggcaagcacagcagaugguacagccccagucuccaguagcugugagucagagcaagcccgggugcuaugacaauggcaaacacuaccaaaucaaucagcagugggaacgaaccuaucuggguaacgcucuugucugcaccuguuauggaggaucccgaggcuucaacugugagagcaaaccggaggcugaagagacgugcuucgacaaguacacuggcaauaccuauaggguuggagauacauacgagagaccgaaggacucaaugauaugggacuguacauguaucggcgccggccgcgggcgcaucuccuguacaauagccaacagaugccaugagggcggucagaguuacaagauuggcgacaccuggcggcggccucaugaaaccggugguuacaugcuggagugcgugugucuuggcaacggcaagggcgaguggacuuguaaaccuaucgcugagaagugcuuugaccaugcugcuggaaccuccuaugucgugggagagacaugggaaaagcccuaccagggauggaugaugguggauuguacuugccucggagaggguagcggccggauaacuuguacuuccaggaaucggugcaaugaccaggauaccagaacaucuuaucgaauuggcgauaccugguccaagaaggacaaucgagguaacuuguugcaauguauuugcacaggcaauggaagaggcgaauggaagugugagagacauaccuccguccagacaaccucuaguggauccggacccuuuaccgacgugagagccgcugucuaucagccccaaccccauccacagccaccaccuuauggacacugcguuaccgauagcggagugguuuauuccgugggcaugcaauggcugaaaacccaggggaacaaacagaugcuguguacauguuuaggaaauggagucaguugccaggaaaccgcggucacacaaaccuauggaggaaauucaaauggcgagccuugugugcugccuuucacuuauaauggaaggaccuuuuacagcuguaccacugagggccgccaggacgggcaccucugguguucaacaacuagcaacuacgagcaggaucaaaaguauagcuucugcaccgaucauaccgugcuagugcaaacucgaggaggaaacucuaacggagcacucugccauuuucccuucuuguauaacaaccauaauuacacugauugcacauccgaaggcagacgcgauaauaugaaaugguguggcaccacucagaauuaugaugcagaucaaaaauucggcuucugcccuauggccgcacacgaagagaucugcacaacaaaugaaggagucauguaucguaucggagaccagugggauaaacagcacgauauggggcacaugaugcgcugcaccugugucgguaauggucgcggggaauggacauguauugcauacucucagcuccgagaccaguguauaguggaugauauuacuuauaaugucaaugacacauuccacaagagacaugaggaagggcauaugcucaacugcacguguuuuggccaagggagagguagauggaaaugugaucccguagaucagugccaagauagugagaccggcaccuucuaucagauuggggacagcugggaaaaauacgugcacggcguuagauaccagugcuauuguuacgggagaggaauaggagaauggcacugucagccucugcagacguauccuucaucaagugggccuguggagguguucaucacggaaacuccaagccaaccuaacucacaucccauucaauggaaugccccucaaccaagccacauuucuaaauauauccuuagauggagacccaagaacucuguggggcgauggaaagaagcgacaauccccggacacuugaacuccuauacaaucaagggccugaaaccaggcgucguuuacgagggccaguuaaucagcauucagcaguacgggcaccaggaggucacacgguucgacuucacgaccacguccacaucaacacccguuacuucaaacacagugacgggggagaccacuccauucucucccuuaguagccacuuccgaaagcguuacagagaucacagcgagcagcuucguggugucgugggucucugcauccgacacgguguccggguucaggguggaauacgaacuuuccgaggaaggcgacgaaccucaauauuuggacuuacccucuacagcaacaucaguaaacaucccugaccuguugccugggaggaaguauaucgucaauguguaucaaauuagcgaggacggugaacagagucucauccuguccacaucacagaccaccgcucccgaugccccucccgacacuaccgucgaucagguggaugacaccaguauuguagugcgguggucccggccacaggcaccgauuacuggcuaucggauugucuacuccccuuccguagaggggucgagcaccgaguugaacuuaccugagacggcuaacagcgugacacucucagauuugcagcccggcgugcaguacaacauuaccauuuaugccguggaggagaaucaggagucaacgcccguggugauacagcaagagacaaccggaacuccgcggagugauacgguccccucuccccgggaccuacaguucgucgaggugacugacgugaaaguuacaauuauguggacgccuccggaauccgcagugaccgguuaccggguugacgugauccccgugaaccuccccggugagcauggacagagguugcccauuucucguaacacauucgcagaagucacagggcuuagcccuggggucacauacuacuucaagguguuugcaguaagucaugguagggaaucaaagccucugaccgcccagcagaccacaaagcucgaugcaccaaccaaccuacaguucgucaacgaaaccgauuccacugucuuagugcgauggacaccacccagggcccagaucaccggcuaucgguuaaccguuggccucacgagacgcggacagccaaggcaguauaacgucggucccagcguuaguaaauauccccuccggaaccuucagccggcaagcgaauauacuguuuccuuagucgcuaucaagggcaaucaagagagcccaaaggccaccggaguguuuaccacacuccagccgggaucaagcaucccaccuuacaauaccgagguaacagagaccacuauugucauuaccuggacacccgcaccaaggaucgguuuuaagcucggggugcgccccagccaggguggggaggcaccuagggaagugacaucugacucugggagcauuguagucuccggacuuaccccugggguggaauacguuuauacuauccaaguguuacgagauggccaggagcgggacgcccccaucguuaacaaagucgucaccccgcuuucccccccaacuaaucugcacuuggaggccaauccggauacaggagugcugacugugagcugggagagaagcacuacacccgacauuaccggauaccgcaucacuacuacaccuaccaacggacagcagggcaauucacucgaggaagugguacaugcagaucaaucauccugcacguucgauaaccugucuccuggcuuagaguacaaugucucuguguacaccgugaaagacgacaaagagagcgucccuauuagcgacacuauaaucccugagguuccgcaauugaccgaucugaguuucguggacaucaccgacucuuccauaggguugcgcuggacuccacuaaacaguucaaccauuauaggauaccggauuacaguggucgcagcaggugagggaauuccaauuuuugaagauuuuguggacucgucggugggauauuacaccgugaccggccuugagccagguauagacuaugauaucucuguuauaacgcugaucaauggcggcgagucugccccaacaacucuaacacaacagaccgcugugccuccgccaacagaccugcguuuuacaaauaucgggccugacaccaugcggguuacuugggcccccccgcccucuaucgaccuaacaaauuuucuggugagguauagccccguuaagaacgaagaagacguggccgagcuuuccauuucuccaagcgauaacgccguggugcuuaccaaccuacugccugggaccgaauacguagugucaguguccagcguuuaugaacaacacgaaucuacuccgcuuagagggcgccaaaaaacuggccuagauucgccuacaggcaucgacuuuagugauauaaccgcaaacaguuuuacugugcacuggauugccccgagagcuacgauuaccggcuaccggauacggcaccaucccgaacacuucucaggaagaccccgugaggaucgagugccucacucacgcaauagcauuacccugaccaaccugacuccuggcaccgaguacguggugucaauaguugcuuugaacgggagggaagaaagcccccuauuaaucggucagcaaucaacagucagugaugugccgcgggaccuggagguugucgcagccacaccuacuucgcugcuuaucucuugggacgcgccugccgugacggugagguauuacagaaucacauacggagaaacaggcggaaauagucccguucaagaauucaccgugcccgggucuaaaucaacggcuacuauuucaggccugaaacccggcguggauuauacgauaacgguguacgcugucacaggacgcggcgauucccccgcauccucuaaaccaaucucuaucaacuacaggaccgagaucgacaagcccagccagaugcaggucacugauguucaggauaacaguaucuccgugaaguggcugccaucaucaucucccgucacugguuaucgcguuaccacgaccccaaaaaauggcccagggccaaccaaaaccaagacagcggguccagaucagaccgagaugaccaucgaaggccugcagccaaccguggaauacguggucaguguguacgcacagaaccccuccggggaaagucaaccacugguccaaacugcaguaacuaauaucgacaggcccaagggacuggcauuuacugacguggauguagauuccaucaaaaucgcgugggagucuccccaaggccaggugaguagguacagggucaccuauuccucaccugaagacgguauccacgaacuuuuccccgcccccgauggcgaagaggacaccgcugaacuccaaggucugagaccugggucugaauacaccgugagcguaguugcucuccaugaugacauggaaucccagccacuuaucggaacucaaagcacggcaaucccagccccuacugauuugaaauuuacucaaguuaccccuacuaguuuaagcgcacaguggacgcccccuaacguccaguugacaggcuauaggguucgcguaacacccaaagagaagacuggacccaugaaggagaucaaccucgcucccgauagcuccucugucguggucucaggauugauggucgcuacaaaguacgaggucagugucuaugcucuuaaagauacccugacaagcaggccugcacaggggguugugaccacguuagagaaugucuccccucccaggcgagcacgagucaccgacgcaacugagacaaccaucacuaucagcuggcguacaaaaacagaaacaaucaccgguuuccaggucgacgcuguccccgccaauggccagaccccuauccagagaacuauuaaacccgaugugcgcagcuauacuaucacuggucugcagccuggcaccgacuacaagaucuaccuguacacacuuaaugacaaugcgagguccucccccguaguuaucgaugcuagcacugcuauugaugccccuaguaaccuuagguuucuugcuaccacccccaacagccuccuggucucuuggcagcccccccgggcccguauuacugguuauaucauuaaguacgagaaaccgggcucuccccccagagaggugguuccgaggccccggccugguguaacugaagccacuaucacaggacuagaacccggaaccgaauacaccauauauguaaucgcccugaagaacaaucagaaauccgaaccacuuauuggucggaaaaaaacugaugagcucccccaguuggucacucugccucacccuaacuuacacggaccugagauacuggaugugccaucuacgguccagaaaaccccauuugugacccacccgggcuacgacacagguaaugggauucaauuacccgggacuucgggccagcagcccucaguaggccaacagaugaucuucgaggagcacggguuucgcaggaccacuccuccuacaacagcuacacccaucagacauaggccccggcccuauccccccaaugucgggcaggaggcuuuaucacaaaccacgauaucuugggcucccuuucaggacacgucugaguacauuauuagcugccauccagugggcaccgaugaggaaccacuccaguuucgagugccaggaaccagcacaagcgcuacauugacuggccucacacgcggcgcgaccuacaacgugauuguggaagcccucaaagaccagcagcgucauaaggugcgcgaggagguggugacuguuggaaauagugucaaugagggacuaaaucaaccuaccgacgacaguuguuucgauccuuauacggucagccauuacgccgugggggacgaaugggagcgaaugucagaaagcggcuuuaagcuccugugucaaugucugggcuuuggcagcggccauuucagaugugauagcagccgguggugccacgacaauggcgugaauuacaagaucggcgaaaagugggacaggcagggcgagaacggucagaugauguccugcaccugccugggcaaugggaagggcgaguuuaaaugcgauccucaugaggcaacauguuacgaugaugguaagacuuaucacgugggcgaacaauggcagaaagaguaccugggugcuaucugcucaugcaccugcuuuggcggccagaggggauggcggugugauaauuguaggagaccaggcggagagccuucaccagagggcacaacugggcagucauacaaucaguauucucagcguuaucaucagcgaaccaauacaaauguuaauugcccuaucgaauguuucaugccccuggaugugcaggccgaucgugaggauucacgcgaguag

SEQ ID NO: 31712 - RNA, 7068 nt, Artificial Sequence
  Description of Artificial Sequence: Synthetic coding sequence
augcuccggggcccaggucccggacugcugcugcuggcagugcagugucuugggacagccguuccuucaaccggggcuuccaaguccaaacggcaggcacagcagauggugcaaccccagagcccugucgcaguaucacagagcaagccugggugcuacgacaacgguaaacauuaucagauaaaccagcagugggaacgaaccuacuugggcaaugcacuugucuguacguguuacggaggcagccgcgguuucaacugugagucaaaacccgaggcggaagagacauguuucgacaaauauacaggcaacacauacagagugggggauacuuacgagcgaccaaaggacuccaugaucugggacugcacgugcaucggcgcagggcgcgggaggauuucauguacaaucgcaaaucgcugccacgagggcggccagagcuauaagaucggagauaccuggcggcggccacacgagacaggaggcuacaugcuggaaugcgucugucugggaaauggcaaaggagaguggacuugcaagcccaucgccgaaaagugcuucgaccaugccgcagggacauccuaugugguaggcgagacuugggagaagccuuaucagggauggaugaugguugacuguaccugucugggcgaaggaucagggaggaucacaugcacuagccgcaaucgauguaaugaucaggauacccgcacgagcuauagaauaggggacacauggucgaagaaagacaaucgagggaaccuccugcaauguauuuguacaggcaacggacgcggugaauggaaaugugagagacauacuagcguccagacgacuagcagcggaaguggcccauuuacagaugugcgggcugcaguuuaucaaccucagccacacccucaaccuccuccauacgggcacugugugacugacagcggggugguguauagugucgggaugcaguggcuuaagacccagggcaauaagcaaaugcugugcacgugcuugggaaacggggugagcugccaagaaacagccgugacccagacguaugggggaaacucuaauggugagccuugcgugcuuccauucaccuacaacggaagaacauuuuauucuuguaccaccgagggccgccaagacgggcaucucuggugcuccacuacuagcaacuaugagcaggaccagaaguauaguuuuugcacagaucacaccguacuuguucaaaccaggggcggaaauaguaacggggcucugugccauuuccccuuucuuuacaacaaucacaacuauacugauuguacuuccgaaggacgcagggacaauaugaaaugguguggcacuacccaaaacuacgaugccgaucagaaauuuggcuuuuguccaauggccgcacacgaagagauuuguacaaccaacgagggcgugauguaucguaucggugaccaaugggacaagcaacacgacaugggccauaugaugagguguaccugcgugggcaauggccgcggagaguggaccuguauugcuuacucccagcuaagggaucagugcauaguugaugacauuacuuauaacguuaaugauacuuuucacaaacggcacgaagaaggccacaugcuuaacuguacuugcuuuggacagggacgugguagguggaaaugcgacccagucgaucaaugccaggacagcgaaaccggaacguucuaucagaucggugauuccugggagaaguacguccauggggugcgguaccaaugcuacuguuaugguaggggaaucggggaguggcauugccagccccuucagacuuauccaagcagcuccggaccgguggaaguuuucauuacagagacccccucgcagccuaacucgcacccaauucaguggaacgcgccucagcccucccacaucagcaaguauauccugcgcuggcgaccuaagaacucaguagggagguggaaagaagcuaccauaccaggacaccucaauaguuauacaaucaaaggacucaaaccuggagucgucuaugaaggccaguugauuucaauccagcaguacggacaccaggagguaacuagauuugauuuuaccaccacuuccacauccacaccagucacuagcaauacuguaaccggcgagaccaccccuuuuagccccuuggucgcuaccagugaaucuguuacagagaucacugcuucaaguuucguggucagcugggugucugcauccgacaccgucuccggauuuagagucgaauaugaguugagcgaggagggcgaugagccacaauacuuggaccugccuagcaccgcuaccucugucaacaucccagauuuacugccaggacguaaauacauuguaaacguguaccagaucucagaggacggugaacaaucguuaauucuuuccacuucccaaacaaccgcaccugacgcgccacccgacacgacaguggaccagguggaugauaccagcauagugguccgaugguccagaccgcaggcgccaaucaccggcuaucguauaguguacaguccuuccguagaaggcuccucgacugagcucaaccugccagagacggcaaacagugugacccuaagcgaccugcagccuggugugcaguauaauaucacuauuuaugcuguggaagaaaaccaagagagcacccccguagugauucagcaagagacaacugggaccccucgcagcgauacaguacccagcccucgagaccuucaguuuguugagguuaccgaugugaaaguuacaaucauguggaccccccccgagagugcaguuacugguuauagggucgaugugaucccugugaaucuuccuggggagcauggacagaggcucccgauaagcaggaacacauuugcugaagugacuggacuaagcccgggcgugacuuauuacuucaaaguuuuugcagugagccauggacgagaaagcaagccucuaacagcccaacagacuacaaaguuggaugcccccaccaaucugcaguuugucaacgaaaccgacuccacugugcuggugagguggaccccccccagggcccaaauuacuggguaucguuuaaccguugguuuaacgagacggggacagccgcgccaguauaaugugggaccaucuguguccaaguaucccuugagaaauuuacaaccagcgagugaguacaccgucucccugguggcaauuaagggcaaccaagaaucccccaaagcgaccggagucuucaccacgcugcagccaggcucgagcauucccccauauaauacugagguuacagaaacaacaauugugauuaccuggacccccgcaccaagaaucggguuuaagcugggcguaaggcccagccaggguggagaagcuccccgagaagucaccagugauucgggaucuauaguugucucgggauugacaccuggaguugaguauguauauacaauucagguccuuagagacgggcaagaacgggacgccccaauugucaauaaagugguaacuccguugagucccccaacgaauuugcaccuggaggcaaaucccgauaccggagugcugacugugucaugggaaagauccacaacuccagacaucacuggcuauagaauuacuacuacucccacaaauggccagcagggaaacucacuagaggagguuguucacgcugaccagagcucauguacguuugacaaccuuaguccaggccuggaguauaaugugagcguguauaccguuaaggaugauaaagaaagcgucccuaucucugacacuauuauccccgcugucccucccccaacagaccugagguucaccaauauuggcccagauaccaugcgcguuacuugggcaccaccuccuuccauugaccugacaaacuuuuuggugagauauagcccuguuaagaacgaggaagauguggcagagcugucuauuuccccauccgacaaugcugugguuuugaccaaccuucugcccggcacugaguacguaguuuccguuucuuccguguacgagcagcacgagucgacuccccugagggggagacagaagacgggacuggacucuccuacaggaauugauuucagcgauaucaccgcaaacagcuucacagugcacuggaucgccccacgggcuaccaucacuggcuaucggauccggcaccacccggagcauuucucaggccgaccuagggaggaucggguuccccacaguagaaacucuauuacauugacaaaccuuacccccgggacagaauauguagugucuauuguggcacugaauggccgcgaagaguccccacugcuaauuggacaacaguccaccguuucugauguaccccgggacuuagaggugguggccgccacaccuaccucacugcugaucuccugggacgcaccugcagugacaguuagauauuaucgcauuaccuacggugagaccgggggaaacagcccaguucaggaguucacggugccggggaguaaauccaccgcaaccauuucaggucugaagcccgggguggauuacacuaucacagucuacgcaguuacuggccgcggugacagucccgcaagcaguaaacccaucucaaucaauuaccgaaccgagauagacaagcccagccagaugcaggugaccgacgugcaggacaauaguauuaguguuaaauggcuuccuaguagcucaccugucaccggcuauaggguuacaaccaccccuaagaacgguccugggcccacaaagaccaagacagcugggccagaucagacugagaugacgaucgagggacuccagccuaccguggaauauguuguguccguauacgcacagaacccaaguggagagucucagccuuuggugcagaccgcaguaaccaacauagaucggcccaaaggcuuggcauuuacagacguggacgucgauucaaucaagauugcgugggaaaguccucagggacagguuucacguuaccgcgugaccuauaguaguccagaagacgguauucacgagcuuuucccagcuccggauggggaagaagauacagccgaacuccaaggguuacggccagggagugaauacacuguaagcgugguagcccuccaugacgacauggagucgcagccucucaucggaacgcagucuaccgccauaccugcccccacagaccugaaauuuacccaggugacuccaaccucucuaucugcgcaguggacuccuccaaacguccaguuaacugguuauaggguaaggguuacuccaaaagagaagacagggccaaugaaagagaucaaccuagccccugauucuucuucugucguugucaguggccugaugguugcgacuaaguaugaagugagugucuaugcccuuaaagauacucucacgagccggccagcacagggcguaguaacuacacucgagaauguuucaccaccucgucgcgcacgcgucacagacgcaacugagacgacaauuacuauaucauggagaacaaagacagagaccaucaccggguuccaggucgaugccguaccagccaacggucaaacuccuauccaacggaccaucaaacccgauguccgcucuuauacaaucaccggacugcagccuggaacugauuauaagauuuaccuguauacccugaacgauaaugcccggaguucccccguagucaucgacgcuaguaccgccauugacgcuccaaguaaucuacgguuucuagcgacgacaccaaauucccugcuggugagcuggcagccuccccgggcacggauuacuggauacauuauuaaguaugagaaaccaggcucuccacccagggagguugugccacgcccaaggcccggcguuacggaagccacgaucacuggucuggagcccgggacagaguauaccauauacgugaucgcacucaaaaacaaccagaaguccgaaccucucauuggccgcaaaaaaaccgaugaacugccacaacuaguuacuuugccccaccccaaucugcacggucccgagauucuggaugugcccuccacagugcagaaaacacccuucgugacacauccaggcuaugauacuggcaacggcauccagcugcccgggaccagugggcagcagccuuccgucgggcagcagaugauuuucgaagagcacggcuucagaagaacaacucccccuacgacagcgaccccuauucgucaucgaccaagaccuuacccaccaaauguaggccaggaggcccuuucccagacuacaaucagcugggcccccuuucaggauaccuccgaauacauuauaucaugccaccccgugggcaccgacgaggagccccuccaguuuagggucccuggaaccaguacaucagcuacucugacaggauugacccgcggagcaacguacaacgugaucguggaggcauugaaggaccagcaaaggcacaaggugagagaggagguagugacggucggaaacucuguuaaugagggucugaaccaacccacugaugauuccugcuucgauccauacaccgugucacacuacgcugugggagaugaaugggaaagaaugagcgaauccgguuucaaauuacuaugccagugucuggguuucgguucugggcauuuccgaugugauucuagcagguggugucacgacaauggagugaacuacaaaaucggagaaaagugggaucggcagggagagaacggccagaugaugagcuguacuugucuuggcaacggaaagggugaguucaagugcgacccacacgaggcgacuugcuacgacgauggcaagacauaccacguaggagagcaguggcagaaggaauaucugggcgcaauuuguucuugcacaugcuucggcggccagaggggauggcggugcgauaacuguaggaggccaggcggggagcccucacccgaggggacgacaggucaguccuacaaucaguauucucagagguaccaccagagaacuaacacuaaugugaacugucccauugagugcuucaugccccuggacgugcaggccgacagggaagacagccgcgaguag

SEQ ID NO: 31713 - RNA, 6555 nt, Artificial Sequence
  Description of Artificial Sequence: Synthetic coding sequence
augcugcggggccccgguccuggcuuguugcucuuggccgugcaaugucucgggacagcaguaccaucuacaggugccuccaagucuaagcgccaggcucagcagauggugcagccgcagaguccuguugccgugucccaaucgaaaccaggcugcuaugacaacggcaagcacuaucaaaucaaccaacagugggagcggaccuaccugggcaacgcacuagugugcacaugcuacggagguuccagaggguucaacugugagucuaaacccgaagcugaagaaacgugcuucgacaaguacacugguaauaccuauagagugggugauaccuaugaacgacccaaagauucuaugaucugggauuguaccugcaucggagccgggaggggccguauaucuuguacuaucgccaaccguugccacgagggaggucaaagcuacaagauaggggacacauggcggaggccacaugagacagguggauacaugcucgagugugugugccuggguaacgggaagggcgaguggaccugcaagccaaucgcagagaaguguuuugaccacgcugcuggcacaagcuaugugguaggagagacaugggagaagccauaccaaggcuggaugaugguugacuguacgugccuaggcgaaggcuccggucguauuaccuguaccaguagaaaucggugcaaugaccaagauacccgcacaucuuaucgcauuggggauacguggucuaaaaaggauaauagggguaacuuacuucaauguaucugcaccggcaacggccgcggcgaguggaagugugaacgacacaccucagugcagacuaccagcucuggaucuggacccuucaccgacguacgcgcugccguauaccagccacaaccucauccucagccuccccccuaugggcauugugugacagacucagguguaguguacagcguggggaugcaguggcucaaaacccaggggaacaagcagaugcugugcaccugccuggggaacggcguguccugucaggaaacagcagugacacagacauaugguggcaacucuaacggugagccauguguguuaccuuuuaccuacaacggacgaacguuuuauuccuguaccacugagggcaggcaagacggccaucucugguguaguaccacuucaaauuacgaacaagaucaaaaauacaguuuuugcacggaccacacugugcuuguccagacacggggcgggaauaguaacggggccuugugccacuuucccuuucucuauaacaaucacaacuauaccgacuguaccucugaaggccguagagacaacaugaagugguguggaaccacacagaauuacgacgcagaucagaaguucgguuucuguccaauggccgcucacgaagagaucuguacaacaaacgagggcguuauguaccgaauuggggaucaaugggauaaacagcacgauaugggacacaugaugcgguguacaugcguuggcaacggaaggggcgaguggacauguaucgccuacucacagcuuagggaccagugcaucguagacgauauuacguacaaugucaacgauacuuuccauaagcgccaugaagaggggcacaugcugaauuguacuugcuucggccagggacgcggucgauggaagugugaccccguggaccaaugccaagauuccgagacugggacauucuaccagauuggcgauagcugggagaaauacgugcauggugugcgauaucagugcuacugcuaugggcguggcaucggcgaguggcauugccagccucugcagaccuacccguccagcuccgggccaguggaaguguuuauuacagagacucccagucaaccaaauagccacccaauucaauggaaugcaccucaacccagucacauuaguaaguacaucuuaagguggcgucccaaaaacuccguuggacgauggaaggaggccaccauccccggccaccugaacagcuacaccauaaagggccugaaacccgguguaguguacgaaggccagcucauauccauacagcaguauggacaccaagaagugacgcgguuugacuuuacaacaacuuccacgucuacccccgucacuuccaacacugugacuggagaaacgaccccauuuucacccuuggucgccaccagugagucugugacagagauuacagcuuccucauucgugguuucuugggugagugccuccgacacuguuuccgguuuccggguugaauaugaacugucagaggaaggugacgagccccaguaucuagauuugcccucaaccgcaaccucugugaauaucccugaucuuuugcccggacggaaauauauuguaaacguguaccaaauaucagaagauggagagcaaagccugauuuugucgaccucccaaacgaccgcacccgacgcucccccagacacuaccguggaucagguggaugauacuucaauaguuguccgauggucccggccucaagcccccaucaccgguuaucguauaguuuacucaccuagugucgaagguucuucaacagaacucaaucugccagaaacggcgaauucggugacccugucugaccuucaaccgggagugcaguacaacauuaccauauacgccguggaggagaaucaggagagcacaccaguaguuauccagcaggaaaccacaggcacuccuaggucugauaccguaccauccccucgagaucuacaguucguagaaguuaccgacgugaaggugaccaucauguggacaccgccagagagcgccgugacgggcuauagaguggacgucauccccgugaauuugcccggagaacacggccagcgguugcccauuucgaggaacacauuugcugaggucacuggacuguccccuggggugacguauuauuucaagguguucgcugugucucaugggagggaauccaagccucugacugcccagcaaacuacuaaauuagacgcuccuacuaacuugcaguuugucaaugaaacugacagcaccgugcuggugcgauggacaccuccacgugcucagauuaccggguaucgguuaacaguaggacucacccgccgcggucaaccacgccaguauaauguugguccaucuguaaguaaguaccccuuaagaaaccuacagccugccucagaguauaccgucucccucgucgcuaucaaagggaaucaagagucccccaaggcaaccggaguguucaccacauugcagccaggcuccucuaucccacccuauaacacagaaguuacugaaacaacuauaguaauaacuuggaccccugcgccacgcauuggcuuuaagcuggggguaagacccagucagggaggggaagcaccuagggaagugaccagugacucaggcuccauagucguguccgggcuuacucccggaguagaguacguuuacacuauacaggugcucagagacggacaggaacgagaugcaccgauaguaaauaaggucgucacuccucuuuccccucccacaaaccuccaccucgaggcuaauccagauacugguguccuuaccgucagcugggagagaagcaccaccccugacaucacagguuaucggaucaccacaacucccacuaacggacagcagggcaauagucuggaggaggucguucaugcggaccagucuucuugcacguucgacaaucugagcccuggccucgaauacaauguuaguguguauacagugaaggacgacaaagagagcgugcccaucucagauaccaucauccccgccgugccaccacccacugaccugagauuuacaaacaucggucccgauaccaugcggguaacuugggcgcccccaccgagcaucgaccuaacuaauuuccucgugagguacuccccugucaagaacgaggaggacguggcugaacugaguaucuccccgagugacaacgccguggucuugaccaaccugcuaccuggcacggaguacguggugucugucucuagcguuuacgagcaacacgagagcacuccuuugcgaggccggcagaagacaggccucgacucaccgacuggcauugauuuuagcgauauuacagccaacagcuucaccgugcacuggauugccccccgggccacuauuacaggauaccgcaucagacaccauccagaacacuucucggguaggccccgcgaggaccggguaccccacucaagaaauucaaucacccuuaccaacuuaacucccggcacugaguauguugugaguauuguugcucucaacgggcgcgaggaaucuccccuccucaucggccagcaguccacaguaagcgacgugccacgcgacuuagaaguggucgcagccacuccgacaucacucuuaauuuccugggaugcuccugcggugacagugagauacuauagaauuaccuacggcgagaccgguggaaauagccccguacaggaguucacagugccuggguccaaaucaacagcuacuaucuccggccucaaacccggaguugacuauaccaucaccguguaugccgugacugggcggggcgauucaccggcaucaagcaaaccuaucuccaucaacuaccgcaccgaaaucgauaaaccgagccagaugcaagugaccgacgugcaggacaauuccaucagugugaaguggcugccuucgaguagcccugucacagguuaucgcguaaccaccacucccaaaaauggucccgguccaacuaaaacaaaaacagccgggccagaccagaccgaaaugacuaucgaagguuuacagccuaccgucgaauacguggugagcgucuacgcccagaauccgagcggcgagucucagccacugguucagaccgcuguuaccaacaucgacaggcccaaaggauuggcuuuuaccgacguugauguggauagcauuaagaucgcaugggagaguccacaaggccaggugaguagauaccgcgugacuuacagcuccccagaggaugggauucaugaauuauuuccagcaccugauggagaggaagacacagcggaacuucaaggccugcgaccaggaagcgaauacaccguaucuguugucgcccuucaugacgacauggagagucagccucuaaucgggacccagaguaccgcaauccccgcaccuacagaucuaaaauuuacucagguuacuccuacuucccucagcgcccaguggacuccccccaaugugcagcugacuggguaucgaguuaggguaacaccgaaggagaaaaccggaccgaugaaagagaucaaccuggcucccgacucaucguccguaguggucagcggccuuauggucgcaaccaaauacgaggucaguguguacgcauugaaggacacccucaccucaagaccagcccagggcguggugacaacgcuggagaacgucucaccccccagaagagcccgcgugacugacgccacagaaacaaccauuaccauuagcuggcggacuaaaacagagacuaucacuggcuuccagguggaugcugugcccgccaauggccagacccccauccagcgcacgauuaagccagacguucggaguuauaccauaacuggguuacagcccggaaccgauuacaagaucuaccuuuacacucugaacgacaacgcccggagcaguccaguggucaucgacgccucuacagcgaucgacgccccauccaaucuuagguuccucgcaaccacgccgaacucuuuacugguuagcuggcaacccccacgggcucgcauaacuggcuacauuaucaaguacgagaagccaggaucucccccccgcgaagucgucccgcgcccucgcccuggcgugaccgaggcuaccauuacagggcucgagccuggcaccgaauacacuauuuacgugauugccuugaagaauaaccagaaaagcgagcccuuaauaggaaggaagaagacagucaaugagggguuaaaucagcccacagaugauucuuguuucgaccccuacacaguaucccauuacgcaguuggagacgaaugggaacgaaugagugaguccggcuuuaagcuccugugccagugccucggcuuuggcucuggccacuuuaggugugauuccuccagauggugccacgauaauggagugaacuauaagaucggcgaaaagugggacaggcagggggaaaacggccagaugaugucguguaccugucucggaaauggcaaaggcgaguucaaaugcgacccgcaugaagccacauguuaugacgacgguaagacauaucaugucggagagcaauggcagaaagaauaccugggcgcaaucuguuccuguacauguuuuggcgggcagcgcggauggaggugugacaauugcaggcgaccuggaggugaaccgagcccggagggcacgacaggccaauccuauaaucaguauucucagcgcuaccaccaaaggaccaacacgaacgucaauuguccaauagaguguuucaugccgcucgacguccaggccgauagagaggauucacgcgaauag

SEQ ID NO: 31714 - RNA, 6636 nt, Artificial Sequence
  Description of Artificial Sequence: Synthetic coding sequence
augcucagaggacccggaccaggcuuacuacuccuggccguccaaugucuaggaaccgcagugccaagcacaggcgcaagcaaaagcaaaaggcaggcgcagcaaauggugcaaccccagucgccaguggccguaucacagagcaaaccgggcuguuacgacaaugguaaacauuaccagauuaaucaacagugggagcguacguaucugggcaacgcucuggugugcacaugcuauggaggcagccggggauucaacugugagaguaagcccgaagcagaagagaccuguuuugauaaauacacgggcaacaccuacagggugggcgacaccuacgagaggcccaaggacuccaugauaugggauugcaccugcaucggggccggcagggggcggauuucauguaccauugccaacaggugccaugaggggggacagucauauaagaucggggauacguggcgccguccucacgagacaggggguuacauguuagaaugcgucugucuggggaacgggaaaggagaauggaccugcaagccaaucgcugagaagugcuuugaccaugccgccggcacuucguacgucgugggcgaaacaugggaaaaaccauaccaaggauggaugauggucgauuguaccugucuuggagaaggcucaggcagaauuacguguacaagcaggaaucguugcaaugaucaagacacacggaccucguacaggauaggagauacauggaguaaaaaagacaauagggguaaccugcugcaguguauauguacgggcaauggucgcggagaguggaaaugcgagcggcacaccuccgugcagaccacuagcagugggucaggccccuucacggauguccgggcugcaguuuaccagccacaaccgcacccucagcccccucccuacgggcacugcgugacggacucuggugugguuuacucgguuggcaugcaguggcugaagacccaaggaaauaaacagaugcucuguacgugucuuggcaauggugugucuugccaagagacagcuguaacacagacauauggcggcaauagcaacggagagcccugcgugcuuccuuucaccuacaauggaaggaccuuuuauuccugcaccacugagggccgacaggacggacaccugugguguucaacgacuuccaacuacgagcaagaucagaaguacucguuuuguacagaucauacaguccugguucagacacgcggcgggaacaguaauggggccuugugccauuucccauuucucuacaauaaccacaauuacaccgacugcaccagugagggccggcgggacaacaugaaauggugcgggacgacucagaacuacgaugcggaucaaaaauucggauucugcccaauggcugcucaugaagaaauuuguaccaccaaugaaggugugauguaucguaucggggaucaaugggacaaacagcaugacaugggacacaugaugaggugcacuugugucggcaacggccgcggugaguggaccuguaucgccuauucgcagcuaagagaccaaugcauugucgacgauaucacauauaaugucaacgauacuuuucacaagcgacacgaagaaggccauaugcuuaacugcacuuguuuuggacaaggccgcgggagguggaaaugcgacccaguugaucaaugccaagacagugaaaccggcaccuucuaccagauuggugauuccugggaaaaguacgugcacggaguuagguaccagugcuauugcuaugguagaggaauaggcgaguggcauugccagccccuacaaacuuaccccuccucgucaggucccguggagguauuuauaacggagacuccgucacaaccuaauagccacccuauacaguggaaugccccccagccaucacauaucucaaaguauauucugagauggaggccaaagaauagcgugggaagguggaaggaggccacaaucccuggccauuugaacucuuauacuauaaaaggucugaaaccaggagugguguacgagggacagcuuauaagcauccaacaauauggacaccaggaggucaccagguucgacuuuacuacaaccaguacuaguaccccuguaacuucaaacacuguaaccggggaaacaacaccauuuucuccccuuguugcuacaagcgagucaguuacagaaaucaccgcaucauccuucgucgucaguugggugagcgccagcgauacaguaaguggguuccguguggaguacgaguuaucugaagagggggacgaaccccaguacuuggacuuaccuagcacagccacuagcgucaacauuccggaucuccugccagguagaaaguacauagugaacguuuaucaaauuucggaagacggggagcagucucugauucucucuacaucucaaacaacagcccccgacgcaccuccagacacuacugucgaccaggucgacgacacaucaauugugguaagauggucccgaccucaggccccuauuacuggguaucggaucguguauagcccaagcguggagggaucgagcacggagcuuaauuuaccggagaccgcaaacucagugacuuuaagcgaccuacagccaggcguccaguacaauauuacuauuuacgcuguggaagagaaccaggaaagcaccccagucgugauucaacaggagaccacuggcacacccagaagugacaccguuccgagucccagggaucugcaguucguggagguuacagacgugaaggucaccauuauguggacaccaccugagucagcgguuaccggauaucggguggacgugauccccguaaaccugcccggcgagcauggucagcggcuucccauaucacgaaauacauucgcugaggugacuggccugaguccuggcguuaccuacuauuucaaggucuuugccgucagucacggccgggaaucgaaaccucugaccgcucagcaaacuaccaaauuggacgcccccaccaaccugcaguuugucaaugagaccgacagcaccguuuuaguucgcuggacgccgccccgggcucagaucaccggcuauaggcugaccgucgggcucacccgcaggggucagccuagacaauauaacguugguccaagugugagcaaauacccccuucguaacuugcaaccugcuagcgaguacacuguaagcuuagucgcaaucaaaggcaaucaggaaucucccaaagcgaccggcguauuuacgacacugcagcccggcuccucgauucccccauacaacacugaagucacugagacgacuauagucauuacauggaccccugccccucgaauuggauucaaguugggcgugcgccccucccagggaggagaagcccccagagaggugaccucugacagcgguagcauuguggugagcggccucacgccaggcguggaauaugucuauacuauccagguguuaagggaugggcaggagagggaugcccccaucgucaauaaaguaguaacaccucuaagcccacccacgaacuuacaucucgaagcaaacccagauaccggggugcugaccguuaguugggagcggucgacuaccccagacauuaccgguuaccggaucacuacuacacccaccaauggccagcagggaaacucccuagaggagguuguucacgcugaccaguccucuugcacguuugauaaccucuccccuggccuggaguauaacguuaguguguacacagucaaggaugauaaagaaucugucccaauuucugauacuaucauucccgccgucccccccccaacugauuugagauuuacaaacauuggaccagauaccaugcgagucacaugggcuccaccuccguccauugaucucaccaauuuucuugucagauauagcccgguaaagaacgaagaggacgucgccgaguugucuauuuccccuucagauaacgccgugguucucaccaaccuucugccaggcacagaguacgugguguccgugagcagcgucuacgagcagcaugaauccaccccgcugagagggcgucaaaagacuggguuagacagcccaacaggcauugauuuuagcgauauuacugccaauuccuucacgguucacuggauugcgccuagagcaacuauuaccggguaucgcauuagacaucacccagagcauuucuccggcagaccgagggaagaucggguaccccauucccgcaauagcauaacgcuuaccaaccugacccccggcacagaguauguggucuccauugucgcccucaacggacgggaggaaaguccauugcugaucgggcagcagaguaccguguccgacguacccagagaccuugagguaguugcugcuacuccgacaucccugcugauuaguugggaugcucccgcagugacagugcgguacuaccggaucacguacggugagaccggaggaaacucuccuguccaggaguuuacggugcccggcuccaagagcaccgcuacgauuucaggacugaaacccgggguggacuauaccaucacugucuacgcuguaacaggaagaggcgauaguccugccaguucaaaaccuaucuccauuaauuacagaaccgaaauugacaagccaucacaaaugcaaguaacagacgugcaagacaauagcauaucugugaaguggcuucccucuucaucaccugugacuggguaccgcgucaccacaacucccaagaacggccccggaccuacuaaaacaaaaacugccgggcccgaccaaaccgagaugaccaucgagggacugcagcccacaguugaauaugugguuagcguauaugcacaaaaccccucgggcgagucucagccucuggugcagacugccguuaccaacaucgaccguccgaaagggcuggcuuucaccgauguggauguggacucaauaaaaauugcaugggagucuccccagggccaggugagccgguaucgcgucaccuacucuagcccagaagauggcauccacgagcuuuuucccgcaccugacggcgaggaagacaccgccgaguuacagggcuugagaccaggcagcgaguauaccguuucugugguggcacugcaugacgacauggaaucccagccgcucaucggaacucagucgacggcuauucccgcacccacagauuugaaguuuacacaggugacacccaccucacugucagcgcaguggacaccgcccaacguccagcugacaggauaucgcguuagaguuacccccaaggagaagaccggacccaugaaggagauuaaucuggccccagacagcaguuccgugguggucagcggccuuaugguggcuacuaaauaugaagugagcguguacgcgcugaaggauacucugacgucccguccggcucagggcguagugacuacuuuggaaaauguguccccuccuagacgcgcacgcguaaccgaugcuaccgaaacuaccaucaccaucaguuggagaaccaagacagagacuauuacaggcuuccaagucgaugcaguucccgcaaauggacagacaccuauucagcgcacgauuaagcccgacgugcgaucuuauacaaucacugggcugcagccugggacugauuauaagaucuacuuauacacauugaacgacaacgcaagauccucccccgucguuaucgacgcuucgacugcaauugaugcgccaucaaaucugcgauuccuugcaaccacaccuaauucccuacucgugucguggcaaccaccacgcgcacguauaacaggauauaucaucaaguacgagaaaccaggcuccccucccagagagguggucccacggccuagaccaggggucacagaagcaaccauuacaggccuggaaccaggaaccgaguauacuaucuauguaauugccuugaaaaacaaccagaaauccgagccauugauuggacggaagaaaaccgggcaggaagcucugucucagacaacaauaaguugggcucccuuucaagauaccucagaauacaucauuucuugucacccuguuggaacagaugaagagccgcugcaguuccgcguacccggcacaucaacaucggccacacugacuggccucacgcguggcgccacuuacaacguaauaguagaagcccucaaagaucagcagaggcacaagguacgugaggaagucgucacaguagguaauagcggcuggugucacgacaacggagugaauuacaagauuggggagaagugggaccgacagggagagaauggucagaugaugagcugcacaugccucggaaaugggaagggagaguucaaaugugacccgcacgaagcgacaugcuaugaugacgguaagacguaccacgucggcgagcaguggcagaaagaguaucugggagcgaucugcaguugcaccuguuuuggaggucagcguggguggcggugugacaauuguagacggccgggcggcgagcccucccccgaaggcacgacugggcagucuuauaaucaauauucccagagguaccaccagagaacgaacaccaacgucaauugcccaauagagugcuuuaugccauuggaugugcaggcagacagagaggacagccgugaauag

SEQ ID NO: 31715 - RNA, 7434 nt, Artificial Sequence
  Description of Artificial Sequence: Synthetic coding sequence
augcuucgcgggccgggacccgggcuucugcuguuagcuguccaaugccuagggaccgccgugccaucuacaggagcaagcaaaucuaagcggcaggcgcagcagauggugcagccucagucucccguugccgugucacagucuaagccgggcuguuacgacaauggcaagcacuaccagaucaaccagcaaugggaacguacuuaucugggaaacgcacucguuuguacaugcuaugggggaucccggggcuucaacugugaaucuaaacccgaagcagaagagacaugcuuugauaaauacaccggaaauacauacagagucggcgauacuuacgagcgccccaaggauucuaugauuugggacuguacgugcauuggugcugggcgcggacggaucagcugcaccaucgccaaccgcugucaugaggguggacagagcuacaaaauaggggacaccuggcggcggccccaugaaacuggcggcuacaugcuugaaugcgucugcuuggggaauggcaagggagaauggacaugcaagccgauagcagagaaaugcuucgaucaugcagcugggaccagcuacguggucggcgaaacuugggagaagcccuaucagggcuggaugaugguggacuguacaugucucggugaggggagugguagaauuaccugcacuagccgaaacaggugcaacgaucaagacacaagaacaagcuaucgcaucggugauacauggucuaagaaagauaaccgggggaaucugcuccagugcaucuguaccggaaacggacggggcgaauggaaaugugaacgccacacuaguguacagacaacauccucggguucggggccuuuuacugacgugagagcugccguguaccagccccagccacacccucagccccccccuuacggccacugugugaccgauagugguguaguuuauucuguuggcaugcagugguuaaagacacagggcaauaaacagauguugugcacaugccuggggaacggggugucuugccaagagacugcagugacccagaccuauggcggcaacucuaacggcgagcccugcguacugcccuuuaccuauaacgggagaacauucuauuccugcacaacugaaggccgacaagauggucaccuguggugcagcaccacauccaacuaugagcaagaccaaaaguacuccuuuuguacggaucauaccguccuaguccaaacacgagguggaaacaguaauggcgcucucugccacuuuccauucuuauacaacaaccauaacuauacugacuguaccucugaggggaggcgugauaauaugaaauggugcgggacgacucaaaauuaugaugccgaucagaaauuuggguuuuguccaauggccgcucaugaagaaaucuguaccacuaaugaaggcgugauguaucggauuggagaucaaugggacaagcaacaugauaugggccacaugaugcgauguacaugcgugggcaauggccgcggcgaauggacaugcaucgccuacucacaacugcgcgaccaaugcauuguugacgauaucacguacaaugucaacgacacauuccauaagaggcacgaagagggucauaugcuuaacuguaccuguuucggccagggaaggggcagguggaagugcgauccuguggaucaaugccaagacuccgaaaccggcacauucuaucagaucggagacucaugggaaaaguacgugcacgguguaagguaucaguguuauugcuauggccgcggaaucggggaauggcauugucagccccuucaaacuuacccuucgucauccggccccguggagguguucauuacugagaccccgucccagccuaacucucauccgauccaguggaacgccccgcagcccagccacaucuccaaguacauauuacgauggaggccaaagaacuccguaggcagauggaaagaggcuacaaucccuggccaucugaacagcuauacgauuaaaggccucaagccaggcgugguguacgagggccagcuaauuuccauccaacaauacggccaccaagaagugacacgauucgauuuuacaacuacuagcacuagcacaccugucacauccaacacgguuaccggcgaaaccacuccuuucaguccucugguggccacauccgagucuguaaccgaaaucaccgccagcucuuuuguuguaucuuggguaagcgccucggacacuguguccggauuucgcguggaauaugagcucucugaagaaggcgaugagccccaguaccuagaccugccuucuacggcgacaucggugaauauuccagauuugcuccccggcaggaaguauaucgugaacguguaucaaauuagcgaggauggcgaacagucauugauucuaagcacaucacagacuacugccccugacgccccacccgauaccaccguugaccagguggacgacacgaguauugugguccgguggucccgcccucaggccccaauuaccgguuaccgcaucguauauagcccaucgguggaagggucuuccacagaacugaaucugccugagacugccaacagugugacccuuucugaucuccagccuggcguucaguauaacauaacaaucuacgccguggaagagaaccaggaauccacacccguggugauccagcaggagaccaccgggacuccuagauccgauaccgugcccuccccccgggaccugcaguuugucgaaguaacagaugugaaggugacuauaauguggacccccccugaaagugccgucacaggauaucgagucgaugugauacccgugaaucugccaggcgaacacggacaaaggcugcccauuagucguaauacuuuugcggaggugaccggacugucucccggcgugaccuacuacuucaagguguucgcagugucccacggaagagagucuaagccacugacagcacagcagacgaccaagcuggacgcucccacaaaccuccaauucguuaacgaaaccgauucuaccgugcucguacgauggacccccccccgcgcacaaauuaccggguacagacugacggugggcuuaacucgcaggggacagccaaggcaguacaacguggggccuucuguaagcaaauacccacuacgcaaucuacaaccagcauccgaguauacgguaagucugguagcgaucaaagggaaccaggaaagccccaaagcuaccgggguuuucacuacacugcagccgggcuccucuauuccacccuacaacacagagguuacagaaaccacaaucgugauuaccuggaccccugccccucgcauuggcuucaaacuuggcgugaggcccagccaaggcggggaagcuccuagggaagugaccucagacuccggcucuaucgugguuuccgggcucacaccaggcguggaguacguauauacuauccagguguuacgggauggccaggagagagaugcaccaaucgugaauaaagugguuacuccucucucuccaccuaccaaccuucaucuggaagcuaacccagauacaggcguucucaccgugucaugggagcggagcacuacgccggauauaacaggcuacagaauuacuaccacucccaccaaugggcaacaaggcaauucccuggaggagguugugcaugccgaucaauccaguuguacguuugauaaccugagcccugggcucgaauacaaugugaguguguacacggucaaagacgauaaggaguccguuccaauaagugacaccauuauuccugagguaccgcaguugacugaucuguccuucguugauauaacagacuccuccauuggacuccgcuggacuccucucaauucuucgacuaucauaggauauaggauuacggucgucgcagcgggcgaagguaucccaaucuucgaagacuuuguugauagcagcgugggauacuauacagugacaggacuugaaccugggauugauuacgacauuuccgucaucacucucaucaauggcggcgaaagcgcaccuacuacccuuacucaacagacugcugugcccccaccuacagaucuaagguucacuaacaucggacccgacacaaugcgcguuaccugggcaccaccucccucuaucgaucucacuaacuuccuugugagguacagucccgugaaaaaugaagaagacguggccgagcugaguaucucuccuuccgauaacgcggugguacucacuaacuuacugccagguaccgaguaugugguuucugucaguuccguauacgaacaacaugagagcacaccccugcgcggccgucaaaagaccggccuggauuccccaacggggauugauuucucagacauaacggcgaauuccuucaccgugcauuggauagcucccagagcaaccaucacaggauaccguaucagacaccauccggagcauuuuaguggccggccacgagaggauagagugccccauucaaggaacucuaucacucugacuaauuugacgccagguaccgaguacguagugucuaucgucgcucuuaacggaagagaggaguccccuuugcugaucggacaacaaagcacagucucagaugucccuagggaccuggaggucguugcggcuacgccuacgucguuauugaucucaugggacgccccggcggugacugucagauacuauaggauuacuuacggagagacuggggguaauaguccuguucaagaguucacugucccuggcucuaagucuaccgcuacuauaagcggauugaagcccgggguugacuacaccaucacaguuuacgccgugacaggaagaggugauucuccggccucauccaagccaauaucuaucaauuacaggacagagaucgacaaaccaagccagaugcaagucacagaugugcaggauaacucuauuucaguuaaaugguugcccucgucuucaccuguuacaggguauagggugacaacuacuccuaagaacggaccaggcccuaccaagacgaaaaccgcgggaccagaucagacggagaugacaaucgaggggcugcagccaacuguugaguacguggugagcguuuacgcgcaaaacccaucaggugagucacagccacuggugcagacagcugugacuaacaucgaccgccccaaaggccuugcauuuacagacguggacguggacagcaucaagaucgcuugggagagcccacaaggacagguuucuagauauagagugacauacucuuccccagaggauggaauccacgagcuguuucccgcaccagacggagaggaagauaccgcugagcugcaggggcugcguccuggcagugaauacacagucagcguggucgcccuccaugacgauauggaaagucagccccugauugguacacaguccacggcgauucccgccccuaccgaucucaaguucacucaggugacuccuacaucucuguccgcgcaguggacuccuccaaauguucagcuuaccggauaccggguaaggguuacacccaaggagaagaccggacccaugaaggaaauuaaccucgcuccugauucaagcagcguggucguuuccggccucauggucgcuaccaaguaugaggugaguguguacgcucugaaagauacccucaccucuaggcccgcccagggcguggugacgacccuggaaaacguuaguccaccccggcgcgcacgcgugacugaugcgaccgaaacaacaauaacuaucuccuggagaacgaagaccgaaacgauuacaggauuucagguggaugcagucccagcuaauggucagacuccgauacagcgcacaauuaaacccgacgugcgcagcuacacuaucaccggucuccaacccgggaccgacuacaaaauuuaucuguauacucuuaacgauaacgcccggagcucuccagucgugaucgaugcguccacugcuauagacgcccccuccaaccuuagauuucuugcuacaacaccuaacagccuacuagugucguggcagccuccucgagcacgcauuaccggauacauuauuaaauacgagaaaccuggcucuccuccccgggaaguugugccgcgaccaagacccggcgugaccgaggccacgauuaccggucucgaaccggguaccgaguacacuauuuaugugauugcuuuaaaaaacaaccagaagagcgagccucugaucggccggaagaaaacagaugaauuaccccaacucgugacccugccacaucccaaccuccaugggcccgagauucuugacguccccaguacaguccagaagaccccguucguaacacaucccgguuaugacaccggcaauggaauacagcugccagggacaagugggcagcagccaucugugggucagcagaugaucuucgaggagcauggcuuccggaggacgacuccgccuaccacagccacuccuauccggcaucggccuagaccauacccaccuaacgugggggaagaaauacagauuggccacaucccucgugaggaugucgacuaucaucuguacccgcauggacccgggcuaaacccaaacgcaucaacuggacaagaagcacugagccagaccacaauuagcugggcuccauuccaagacacuagcgaauauauuaucuccugccacccagucgggaccgaugaggaaccuuugcaguucagagugccaggcaccagcaccuccgcuacucugacuggguuaacccggggcgcuaccuacaaugugauuguugaggcacugaaggaccaacagaggcacaaaguucgcgaggaggucguuacgguuggcaauagugucaaugaaggacuuaaccaaccuaccgacgacucguguuucgacccauauaccgucucacacuaugccgugggagaugagugggaaagaauguccgagucaggauuuaagcugcucugccaaugcuugggcuucgguucggggcauuuuaggugcgauaguucuagauggugccacgacaaugggguuaauuacaaaauaggggaaaagugggauagacagggagagaaugggcagaugaugagcugcacaugccugggaaaugggaaaggggaguuuaaaugugacccacacgaagccacguguuaugaugacggcaagacauaccacguuggagagcaguggcagaaagaguaccugggcgccauuuguaguuguacauguuuugggggacaacguggauggcgcugugauaauuguagaagaccaggaggcgagccuagcccagagggcacuaccggacagucuuauaaucaguauagucagagauaccaccagaggacuaauacuaacgucaauugcccgauugaaugcuuuaugcccuuggacguacaggccgacagggaggauucaagggaauag

SEQ ID NO: 31716 - RNA, 6891 nt, Artificial Sequence
  Description of Artificial Sequence: Synthetic coding sequence
auguuaagagggccuggaccugggcugcuccuguuggcugugcagugccuggggaccgccgucccuagcacgggcgccucaaagagcaagaggcaagcucagcagaugguacaaccacaguccccugucgcaguaucccagaguaagcccggaugcuacgauaacgggaaacacuaccaaaucaaccagcagugggagaggaccuaccucggaaacgcacuggucugcacaugcuacgggggaaguaggggcuucaacugugagagcaaaccggaagccgaggagacguguuucgauaaauauacaggcaacacauaccgcgucggagacaccuaugaacgcccaaaggacucuaugaucugggacuguacuuguaucggagcgggcagagggaggauaagcugcacuaucgcuaaccggugccaugagggcggucagucuuacaagauuggcgacacguggcggagaccucacgagacuggggguuacaugcucgagugugucugucugggaaacggcaaaggugaauggaccugcaaaccuaucgccgaaaaaugcuuugaccaugccgcagguaccucauauguggucggugagacgugggaaaagccuuaucaaggauggaugaugguagauuguaccugucuuggcgaagguucugggaggauuacuugcacuucacgcaacagaugcaaugaccaggacacaagaacaaguuaucgcaucggagacacguggagcaaaaaggacaaucgcggaaacuugcugcaguguaucugcacgggcaauggccgcggugaauggaaaugcgaacggcauaccagcguacaaaccaccucaucggggagcggcccuuucacagacguacgggccgcaguguaucagccucagccccauccccagccaccuccguauggucacugcguuaccgauagcgggguggucuacuccguagggaugcaguggcugaagacccagggcaacaaacagaugcucuguacuugccuagggaauggcguuucgugccaggagacagcagugacgcagacuuacggugggaacagcaacggagagccguguguccuucccuucacauacaaugggaggaccuucuacaguuguaccacggaagggagacaggauggccaccugugguguagcacuaccuccaauuaugagcaagaucagaaauauaguuuuugcaccgaccacaccgucuugguccagacacgcggcgguaauucaaauggagcccugugccauuuccccuuucucuacaauaaccacaauuauacagacuguacaucugagggucggcgagacaacaugaaauggugcggcacgacgcagaacuaugaugcugaucagaaguuuggauuuugucccauggcggcacaugaggaaaucugcacaacuaacgagggugugauguacagaaucggcgaccagugggauaagcagcacgauaugggccacaugaugcgcuguacuugcguaggcaauggacggggagaauggaccugcaucgcguauucacaacuccgcgaccaauguauuguggacgacaucacauacaacgugaaugauacauuucauaagaggcaugaggagggucacaugcugaacuguaccuguuuuggacagggccgugggcgcuggaaaugcgaucccguggaccagugucaggacuccgagaccgggacauuuuaucagaucggugacagcugggaaaaguacguccacggaguaagauaucaaugcuacuguuacgggagagguauuggcgaguggcacugucagcccuugcagacauacccuucaucuagcgguccuguggaaguguucauuacagagacgcccucccaacccaacucucacccuauccaauggaacgccccucagccuucccauaucagcaaguacauucugcgguggagaccuaagaauaguguagggcgguggaaagaagccaccauucccggacaccugaauucauacacaauuaagggucugaagcccgguguuguguacgaaggucaacuuauuucuauccaacaguacggucaucaggaagucacccgguuugacuucacuaccacaucaaccuccacuccggugaccucuaacacugugacuggagaaaccacaccuuuuucuccccugguugccacaucugaaucagucacagagauaacagcaucaagcuuuguggugagcuggguguccgcuagugacacuguuucaggcuuucggguggaguacgaacuguccgaagaaggagacgagccacaguaucuggaccugccgucgacagcuaccucugugaauauccccgaccuucuaccaggccguaaauauauuguuaacguguaccagaucagugaggacggugagcagucccuuaucuuaucuacaucgcaaaccacagcacccgaugccccccccgauacuaccguagaucagguggaugacacgagcauugugguacguuggucuagaccccaggcaccaauuaccggauaccgcaucguauacucuccaagugucgaaggcagcagcaccgagcucaaucuuccagaaacugccaacaguguaacccugagugaccugcaaccggguguucaguacaauauaacgaucuacgcaguugaggagaaucaagagagcacaccaguggugauccagcaggagacaacaggcacccccagaucagacaccgugccaagcccacgggaccugcaguuuguggaagugaccgacgugaaagugaccaucauguggacucccccagagucagcaguaacuggcuaucgagucgacgucauacccguuaaucugccuggcgagcacggccagagacucccuaucucacgcaacaccuuugcugagguaacgggacuguccccuggcgucacauacuacuuuaagguguucgccgugucccacgggagagagagcaaaccccucacggcucagcaaacuacuaaacuggacgcuccaacgaaccuucaguucgucaacgaaaccgacucuacuguccugguuagauggacccccccccgggcccaaauaaccggguaucggcugaccgucggucugacucgacgcggacaacccagacaguauaacgucgggccgagugugucuaaguaucccuuacgcaaucuccagcccgccucagaguauacagucaguuuagucgcaauuaaaggcaaccaggagucccccaaagcaacgggaguguucacaacacugcaacccggcucuuccaucccucccuacaacaccgaggugacggagaccaccaucgugauaacauggacuccugcacccaggaucggcuucaaacucgggguccgacccucgcaaggaggagaggccccuagagaagucacuagcgacaguggcucuaucgugguuuccggccugacuccggguguggaguauguauacacaauacagguauuacgagacggccaggaaagggacgcacccaucgucaacaaagugguaacccccuuguccccaccuaccaaucugcacuuggaggcuaauccggacacaggcguccuuacagucagcugggagcgguccacaacgcccgacaucacgggauaucggauuacuaccacuccuacgaacggccagcagggaaacucacuagaggaggugguucaugccgaccagagcucaugcacguucgacaaccuuagucccggacuugaauacaacguguccguauacacagugaaggaugacaaggaaagcgugcccauuagugauacaauaauucccgcuguuccaccaccaacagaccugagauucacuaacaucggcccugacaccaugcgggucaccugggcucccccccccuccauugaucugaccaauuuccugguacgauacucccccguaaaaaaugaggaggacguggcugaacuaucaauuucccccucagauaacgcaguagugcucacuaaucuguuaccgggcacagaguauguuguaucaguuagcaguguuuacgaacagcaugaaucuacgccgcucagggggcgacagaagaccggccuugauucccccacugggauugauuucucagacauaacagccaauucauuuacaguacacuggaucgcgccaagagcaacgaucaccggauaucggauucgucaccacccagaacacuuuagcgggcgaccccgggaagauagaguuccacacaguaggaacagcauuacccugacaaaucuuaccccuggaacagaguaugugguauccaucguugcacugaacgggcgagaagagucgccucugcuaaucgggcagcagucuacagucagcgaugugccucgugaccuggaaguuguggccgcuacuccuaccucccuccugaucuccugggaugccccagcugugacuguacguuacuaccgaaucaccuauggugaaacaggagguaacucucccgugcaagaauucaccgugcccgggucuaaaagcacagcaacgauaucgggucucaaaccaggcguggauuauacgauaacuguguaugcagucacaggccgaggugacagcccugccuccucuaagcccaucaguauuaacuaccgcaccgaaaucgauaagccgagccaaaugcagguaacagaugugcaagacaacucuauuucugucaaguggcugccuucuucuuccccugucacaggauauagagugacaacaacaccuaagaacggccccgggccaacuaagacaaagacugcuggccccgaccagaccgagaugaccauugagggacugcagccgacgguagaauauguggugucaguuuaugcccagaauccuuccggagagucccagccccuuguccaaaccgccgugaccacaaucccugcccccacugauuugaaauuuacacaggugacgccaacaagucugucugcccaguggacgccgccgaauguacagcucacaggcuauaggguacgggucacaccuaaagagaaaaccggccccaugaaagaaauuaaccuugcucccgacucuucaucagucguggucagcggacuuaugguggcuacuaaauacgaggugagcgucuaugcacucaaggauacauugaccucucggcccgcucagggcgugguuacaacgcuggaaaacguguccccuccuaggagagcacgggugacugacgcaacagagaccaccaucaccauuagcuggcgaacaaaaacggaaaccauuacuggcuuucaagucgaugcugucccagcuaauggacagacuccaauccaacggacuauuaagcccgacgugcguuccuauacaauuacuggccuccaaccaggcacagacuacaaaauuuaucuguauacucucaacgacaacgcuaggagcucuccuguggucauugaugcuucuacugcuauugacgcgccuagcaaucuaagauuucuggcuacaacccccaacagucugcucgucuccuggcagcccccacgagcaagaauuacaggguacaucaucaaauaugagaagccuggaucaccuccccgcgaaguugucccccggccaaggcccgguguuaccgaagccacaauaacagguuuggagccugggacagaauacacuauuuacgucaucgcucugaaaaacaaccaaaaaagugagccuuugaucggucgaaaaaagaccgaugagcugccgcagcucgugacucucccccacccaaaccuucacgguccggagauccuagacgugccuucuacaguucaaaagaccccauuuguuacgcacccugguuacgacaccgguaacgguauccagcuaccagguacuucugggcagcaaccuuccguugggcagcagaugaucuuugaggaacauggauuucggcgaacaaccccaccuacgaccgcaaccccaauucgccauaggccacgaccauacccacccaaugucggagaggaaauucagaucggacacaucccuagggaggacgucgacuaucaccucuauccccacggcccuggucucaauccaaacgcaucaacagggcaggaagcccucucccaaacuacaaucucgugggcuccuuuccaagacacaagcgaguacauuauuagcugccaccccgugggcacugacgaagaaccuuuacaguuuagggugccaggcacaagcacaucagccacgcuaaccggccugacucgaggggccaccuauaaugucauugucgaagcauugaaggaucagcaaaggcauaaagugcgcgaggagguagugacagugggcaacagugugaaugaaggccucaaccaaccuaccgaugauucuugcuucgauccauauaccgugagccacuaugcuguaggcgacgagugggagaggaugagugagagcggguucaaacugcugugccagugucugggauucgggagcggucacuuucgcugcgauucaucuagguggugucacgauaaugggguuaauuauaagauuggcgagaagugggacagacagggggaaaauggacagaugaugagcuguaccugucucggcaacggcaagggugaauucaaaugcgauccgcaugaggcgacauguuacgaugaugguaagacauaccaugugggugagcaguggcaaaaagaauaccucggagccauuuguucgugcaccugcuucggcgggcagagaggauggagaugcgacaauugccgcagaccagguggugaacccuccccagagggcacaaccggccagagcuauaaucaguacucucagagauaccaucagcggacaaauacaaacgugaacugcccuauugagugcuucaugccccuugacgugcaggccgauagggaggauagccgcgaauag

SEQ ID NO: 31717 - RNA, 6096 nt, Artificial Sequence
  Description of Artificial Sequence: Synthetic coding sequence
augcugagagggccaggaccgggccugcuguugcucgccgugcaaugccuaggaacugccgugccauccaccggugccagcaagagcaagagacaagcccagcaaauggugcaaccccaauccccgguugccgucagccagucuaaaccggggugcuaugauaauggaaaacacuaucagaucaaccaacagugggaaagaaccuacuuaggaaaugcccuggugugcacauguuacggcgggucccggggcuuuaauugcgaaagcaaaccagaggcagaggagacaugcuucgacaaguacacagggaauacguaucgcgucggagauacauaugaacgaccaaaggacucuaugaucugggauuguacaugcauaggcgccggaaggggaaggauuucgugcacuaucgcuaaccgaugucacgagggaggccagaguuacaagaucggugacacguggaggcgaccgcacgagacaggaggcuacaugcuggaaugugugugccugggaaacggcaagggggaauggaccuguaagccuauagccgagaaauguuucgaucacgcagcuggaacguccuauguggugggcgagacaugggagaaaccuuaccagggcuggaugaugguugacuguaccugucugggagaggggucuggaaggauuacuuguacaucucguaaucgcuguaaugaucaagacacgaggacuucguacagaauuggagauaccugguccaagaaggauaaucgaggcaaccugcugcaaugcauuugcacugggaaugggcgcggcgaauggaagugcgagaggcacacuagcguucagaccacgagcaguggaucuggcccuuuuacggacguccgugcagcugucuaucagccacaaccucacccacagccuccccccuauggucacuguguuacugacuccgguguagucuauagcguaggaaugcaguggcugaaaacccagggaaauaaacagaugcugugcacuugucugggcaacggcguaucaugccaggagaccgcagugacucagaccuacggcggcaacucuaauggagagccauguguucugcccuucacauacaacggccggacuuucuauucguguacgacugaaggccgacaagacggccacuugugguguuccacaacuuccaacuacgagcaggaccaaaaauacucuuucugcacugaucauaccgugcugguccaaacuagaggaggcaauagcaacggggcccugugccauuuccccuuucuguacaacaaucacaacuacaccgacugcacaucagaggggaggagagacaacaugaaguggugugguaccacucagaacuaugaugcagaucaaaaguucggcuucuguccgauggcagcgcacgaagagauuuguacuacuaacgaaggaguuauguacaggaucggggaucagugggacaaacagcacgacaugggacacaugaugagaugcacuugugugggaaacggucggggggaauggacguguauagcauauucacaacugagggaucagugcaucguagacgacauaacauauaacgugaaugacacauuccacaagagacacgaagaaggucauauguugaacugcacguguuuugggcagggcagaggccguuggaaaugugacccugucgaucagugucaggauagcgaaacuggcaccuuuuaccagauuggagauagcugggagaaguacgugcauggaguacgcuaucaaugcuacuguuacggaaggggcaucggggaauggcauugccagccacuacagaccuacccgaguucgagcgggcccguggagguguucauuaccgagacgccaagucagccaaacagccauccuauccaauggaaugccccgcagccuagucauauuuccaaauauauucucagauggcguccaaagaauucagugggccgcuggaaggaggccacuaucccugggcauuugaacaguuauacgauuaaggggcuuaagccugguguugucuacgagggccagcuaauuucuauccagcaauauggccaucaggaaguaacgagguucgacuuuacaacaaccucuaccucaaccccugucaccaguaauaccguaacuggugagacaacaccguucucaccacucguggcaaccagugagagcgucacagagaucacagcgucuuccuuuguggucucuuggguuuccgcuagcgacacugugagcggauuuagaguggaauacgaacuuuccgaggagggagaugaaccccaguaccucgaucugccauccaccgccaccuccgugaauauccccgaccugcugcccggucgaaaauacauugugaacguguaccaaauuagugaggauggggagcaaagccucauacuguccacaucacagacgaccgcaccggacgcaccuccagacacaacaguggaucaaguagacgauaccucuauaguaguucgauggucccguccucaggccccuaucacagguuaccgcauuguuuauuccccgucagucgaggguucuuccaccgaacucaaccugcccgaaacugcuaacagugucaccuugucugaccuccagccgggaguucaguauaauaucacgauauacgccguagaagagaaucaggaaucuacuccugucgugauucagcaggagacaacaggaacgccgcggucggauacagugcccagcccucgggauuugcaguucgucgaaguuacugauguuaaggugaccauuauguggaccccccccgagagcgccguuaccggcuaucgcguugacgucauuccaguuaaucugcccggagagcauggccagcgcuugccaaucucacgcaauacuuuugccgaaguuacggguuuaucacccggagugaccuacuauuucaagguauucgccguaucgcaugggcgugagagcaagcccuugacugcccagcagaccacaaagcucgaugccccaaccaaccuccaguuugucaacgagaccgauucaacaguacucgugagguggacgccacccagggcccagauuaccggauaucgguugacuguuggccucacgcggaggggccagccccgccaguauaacgugggccccucgguuuccaaauaucccuugcgaaacuugcagccggcuucugaauacacaguuucgcucguggcaauuaaggggaaccaggagucaccaaaggcuaccggcguguucaccacccuucaaccgggcuccucuauuccaccauauaacacugaagugacagagacuaccaucgugauaacuuggacaccugccccuagaauugguuucaagcugggaguacgcccaucccaaggaggugaagccccucgcgagguuacguccgauagcgggucuauaguagucucuggucugacuccugggguggaguacguguacaccauacagguucugcgggacggacaagagcgagacgcaccaauugugaacaaggucgugaccccauuaagcccaccaaccaaccugcaccuugaggcgaauccugauaccggcguguugacuguuuccugggaacgaucaacaacacccgauauuacaggcuaucgcaucaccacgacaccgacgaauggccagcaaggcaauagccucgaagaggugguccaugcugaucaaaguagcuguaccuuugacaacuugucuccaggacucgaguauaauguuucaguguauacagugaaggacgauaaagagucuguccccaucuccgacacuauuauuccagcaguccccccuccgaccgaccugagauucaccaacaucggcccagacaccaugcgcguuacaugggcuccacccccuagcauagauuuaacuaacuuucucguccgcuacagcccaguuaaaaaugaagaagauguggccgagcuguccauuucucccucagacaacgcaguagugcuuacuaaccuguuaccgggaacugaauaugucguuucggugaguucugucuacgaacagcaugagucuaccccucuucgaggccgucaaaagacuggauuagacucaccaacaggcauugacuucucugacauuacugcuaauucuuuuacaguucauuggauugcccccagggcgacaaucacuggcuacagaauucggcaccacccugagcauuuuuccggcagaccccgggaggaucgagugccccacucucggaacucuauuacgcugaccaaccuaacaccuggaaccgaguauguggucuccaucgucgcacugaacggccgggaagaauccccccuucuuaucggucaacaaucuaccguguccgaugucccucgggaucuagaagucguugccgcuacaccaacaucacuguuaauuuccugggaugcaccagcagugaccgugcgguauuaccggauuaccuauggcgaaacuggagggaauagucccgugcaggaguuuacaguuccugguucuaagucaacugcuacaaucucaggccugaagccugggguggacuacaccauuacagucuacgccguaaccggcagaggcgauucaccggccuccagcaagccgauaagcaucaacuauagaaccgagaucgacaagccgucccagaugcaagugacagacgugcaggacaacuccauuaguguuaaguggcugccuucguccucccccguuacuggguacagggugacuacaacaccgaagaacggaccagguccaacgaagacaaagacugcugggcccgaucagacugaaaugacuaucgagggcuugcagccuacagucgaauacgugguaagcguguacgcucaaaauccaucuggugagagccaaccucucgugcaaaccgcugugaccaacauagacaggccuaaggggcucgcauuuacagaugucgacguugacagcaucaagaucgcaugggagucaccccagggacagguuucccguuaccgugugacuuacaguuccccagaggacgguauccacgaguuauucccagcccccgacggugaggaggacaccgcugaacugcaaggccugcgcccagguagugaauacacugugagcgucgucgcacugcacgacgauauggagagccaaccuuugauaggaacccagaguacggcuaucccagcacccaccgaccuuaaauuuacacagguuaccccuacaucucuguccgcucaguggacucccccaaaugugcaguugaccgguuacaggguccgaguaacccccaaagaaaagacggggccuaugaaagagauuaaucuggcuccugacucaaguaguguaguggugagcggucugaugguggcuaccaaauaugagguguccgucuaugcucugaaggacacccuaaccaguaggccggcccagggagugguuaccacccuggagaacguuagccccccccggcgggcucgggugaccgacgcuaccgagacuacgauuaccaucucuuggagaacgaagacugagacaauuacgggauuucaggucgacgcuguuccggccaauggucagacuccuauucaaagaacaauuaaaccagacguacguucuuacacuaucacgggucugcagccuggcacagauuauaagauuuaccuguacacucugaaugauaacgcccgcaguuccccuguaguaauagaugccuccaccgcaauugacgccccaucuaaucuccgguuucuggccacuacacccaauucucuccucgugucuuggcaaccacccagagcgcgaauuacaggcuacaucaucaaguacgaaaaaccagggagcccacccagagaggucgucccucgcccccggccugguguuacagaagccacuaucaccggcuuggagcccgggaccgaguauaccaucuacgucaucgcguugaagaacaaucagaagagcgaaccccuaauaggcagaaaaaagaccgggcaggaagcccuaucccaaacgacuauuagcugggcaccuuuccaagauaccucugaguacaucaucucaugccaucccgugggcaccgacgaggagccgcuucagucuaccaaggcguag

SEQ ID NO: 31718 - RNA, 6531 nt, Artificial Sequence
  Description of Artificial Sequence: Synthetic coding sequence
auguuaagggggccgggccccgggcucuuguuacuggccgugcagugucugggcacugcaguccccucuaccggcgcauccaagucaaagcggcaagcccagcagaugguccagccacagucuccaguggccgugucgcaaagcaaaccagggugcuacgacaauggcaagcacuaccagauuaaccagcagugggagcgaacauaucucgggaaugcccuggucuguaccuguuacgguggcagucgcgguuucaacugcgaguccaagccugaagccgaggaaacuugcuuugacaaguauaccggcaauacguaccgaguuggagauaccuacgaacggcccaaggacagcaugaucugggacugcacgugcaucggcgcugggcgcgggcggauuucaugcacaauugcaaauaggugucacgaagguggccagagcuauaagaucggcgacaccuggaggagaccccaugaaacuggcggcuacauguuagaauguguuugucuuggaaauggaaagggggaauggacaugcaagcccauugcggaaaaaugcuuugaucacgccgccgggacaucuuacguggugggcgaaaccugggagaagccuuaucaggguuggaugaugguggacuguaccugccugggagagggaagcggaaggauuacuugcacuagccgcaaccguugcaaugaucaggacacccgcacgucguaucggaucggcgacacuuggucuaagaaggacaauaggggcaaccuguuacagugcaucugcaccggaaauggcagaggagaauggaaaugcgagcgccauaccuccguccagacaacuucaagcggaucugggccauuuacugaugugagagcagcugucuaucaaccccagccacacccacagccaccacccuauggccauuguguuaccgacucggguguggucuacucagucggaaugcagugguugaaaacccaagguaacaaacaaaugcucugcacauguuugggcaauggcgugucuugccaagagaccgcggucacucaaacuuauggaggcaauagcaacggcgagccuugcguacuuccuuuuaccuauaauggcaggaccuuuuacucuugcacuacugaggggcggcaggacgggcaucuuuggugcucaacuaccuccaacuaugaacaagaccagaaauacagcuucugcacggaccauaccguccuuguacagaccagaggcggaaauuccaacggagcacugugccacuuuccauuccuguauaauaaccacaauuacaccgacugcaccagcgaggggagacgugauaauaugaaauggugugggacaacucagaauuaugaugcagaccagaaguucggcuucugcccaauggccgcgcaugaagaaaucuguacaaccaacgaaggcguuauguauaggaucggggaucagugggacaagcagcacgauauggggcacaugaugcgauguacuugcguuggcaauggaaggggugaauggaccuguauugcuuauucccagcugagagaccagugcauuguggaugacaucaccuacaacgugaaugacaccuuccauaaaaggcacgaagaggggcacaugcuaaacugcaccuguuuuggccaggggcguggaagauggaaaugugauccuguugaccagugucaagacagugagacagggacauuuuaucagaucggcgacagcugggagaaguauguccaugguguccgguaccaguguuacugcuacgggcgggguauuggcgaauggcauugucagccacugcagacuuaucccucgagcuccggcccaguugaggucuucauuacugagacuccgagccaacccaacagucacccuauccaguggaaugcgccucaacccucucauaucucaaaguacauucucagauggcgacccaaaaacuccguaggccgcuggaaagaagccaccauuccuggacaccugaacuccuauaccaucaagggccugaaaccuggcgucguguaugagggacaguuaauuaguauccaacaguacgggcaucaggaagugaccagauucgacuucacuacuacauccacguccacgccugugaccagcaacaccgugacuggagagaccacaccuuuuucaccucuugucgcgacuagugaguccguaacugagauuacugccaguagcuuugugguuagcugggucuccgcaagcgauacugucuccggcuuccggguggaguacgaacuaucugaggaaggugacgagccccaauaccuggaucucccuagcacggccacuagcgucaacaucccagaucuccuuccggggcgaaaauauauaguaaaugucuaccagaucagugaggauggcgagcaaucucucauucugucuaccucucaaaccaccgccccagacgcccccccugauacaacuguugaccaggucgaugacacaagcauagucgugcguuggucacgaccgcaggcuccuauaaccggauauaggaucgucuacucgccaucugucgaaggcagcuccacagaacugaaucuccccgagaccgccaauagugugacccuguccgacuugcagcccggcguucaguacaacauuacaaucuacgccguugaagagaaccaggagaguacuccagucgugauucagcaggaaacuacaggcacuccaaggagcgacaccgugccgaguccucgugaccugcaauucguggaggugaccgauguuaaggugaccaucauguggacuccaccugaauccgcugugaccggcuacagggucgaugugauuccugugaaccugccaggggaacauggacagagacuaccgauuucccguaauaccuuugcagaaguuaccggccucaguccaggcgugacauacuacuuuaagguuuuugcuguaucccacggacgggagaguaaaccccucacggcacaacagaccacuaaguuagaugccccaacaaaucuccaguuugucaacgagaccgacagcacaguucuaguccgguggacaccaccucgcgcgcaaauaacaggguaccggcucacugugggccugacaagaagaggacagccccgucaguauaauguagggccuuccgucaguaaguauccccugaggaauuuacagccagcuuccgaguauacagugucucuagucgcaauaaaaggaaaccaagagucccccaaggcuaccgggguguuuacaacacuccaaccuggcucaagcauaccuccguacaacaccgaggugacugaaacaacuaucguaauuacguggaccccugcuccacgcaucggcuucaaauugggcgugcgcccgucgcagggaggcgaggccccccgggaggugaccucugacucugggucuauugugguauccggauuaaccccuggagucgaauacguuuauacaauucaggugcuccgggacggacaagaaagagacgccccaaucguaaauaaagucguuacgccgcuguccccucccacuaauuugcaucuagaagcaaaucccgacaccggagugcugacaguuagcugggagagauccacuaccccugauauuacggguuaccggauuacuacaacgccgaccaauggacagcaaggcaauucacuggaggagguuguccaugccgaucagucgagcugcaccuucgacaaccugucaccagggcucgaguauaacgugagugucuacacuguuaaggacgacaaggaaagugugccaaucucugauacuaucauuccugccgugccccccccaacugaccugagauuuaccaacaucgguccagacaccaugagggugaccugggccccgcccccuagcauugacuuaacaaauuucuuagugagauauuccccugucaaaaacgaggaggauguggcugaacucucaauuagccccagugauaaugcaguggugcucaccaacuugcucccggggacagaguauguggucucugucucaagugucuaugagcagcaugaaaguacuccccugcgcggccggcaaaaaacuggucuggacucccccacgggcauagacuucagcgauauaacggcuaauaguuucaccgugcacuggauugccccccgcgccacgauaaccggguaucggauacggcaccaccccgagcacuuuagcggcagaccucgagaggauagagugccucauucccgcaacuccaucacauugacaaaccugaccccuggaaccgaauaugucguauccaucguggcuuugaacggucgagaggaaucuccucuacugauugggcagcagucgacuguuagugaugugcccagggaccuggagguuguggcugccacuccuacuucacuacugaucuccugggaugcuccagccgugaccgucagguauuacagaauaaccuacggagagacugggggcaauucucccguacaggaguucacugugcccgguagcaaaucuaccgcgaccaucagcggccucaagccuggcgucgacuacacaaucacgguguaugccgucaccggacguggggacucccccgcaucaagcaagccuauuuccaucaacuaucgcaccgaaaucgacaagcccucucagaugcaggucaccgauguccaagauaacaguauuagcgugaaguggcugccauccuccagcccagugacuggauauagagugaccaccacaccgaagaacgggccuggaccuacuaagacgaagacugcugggcccgaccagacagagaugacgaucgaggggcugcagccuaccgucgaguacgugguuucaguguaugcccagaauccuaguggcgagucacaaccacucguccaaaccgcgguuacgaccauaccggcacccacagacuuaaaauucacgcaggugaccccaacaucucuuuccgcccaguggacuccaccuaauguucaacuuaccggguaucgaguaagggugaccccgaaggaaaaaacgggaccaaugaaggagauaaaucuugcccccgacucgucuagcgucgucguguccgggcugaugguagcuacuaaguaugaagucuccguguacgcgcuuaaagauacuuuaacuuccaggccggcccagggaguagugacuacauuagagaaugugucuccaccuaggagagccagggugacagacgccaccgaaacgacaauuacuaucucguggcguacgaaaacagaaacaauuacgggguuucagguggaugccguaccagccaacggccagaccccgauucagagaacuaucaagcccgacgugagaaguuauaccauuacaggccugcagcccggcaccgauuauaagauuuaccuuuacacacucaacgauaacgcucggaguuccccagucgugaucgacgcuucuaccgccauugaugcaccuuccaaucuuagguuccucgcaaccacccccaacucucugcuggugaguuggcagccaccaagagcuagaauaaccggcuacaucauuaaguacgagaaaccagggucccccccccgcgagguggugcccagacccaggcccggcgucacggaggccaccaucacuggccuggaaccaggcacugaauacacaaucuaugucaucgcacugaaaaacaaccagaagagcgagccgcugaucgggaggaagaagacugggcaggaggcucucagccagaccacaauaucaugggccccguuccaagacaccucggaguacauuaucucuugucauccuguugggacggaugaagaaccuuugcaguuucgggugccaggaaccuccacuagcgcuacucugacuggucugacacgaggagcgacauacaaugucauuguggaggccuugaaggaucaacagagacacaaagucagagaggaggugguaacugugggcaauucugugaaugagggucugaaccagcccacggacgacuccuguuuugauccuuacacagugucacauuaugcuguaggugaugagugggaaagaauguccgaaucagguuucaagcugcucugccagugucucggcuuuggcagcggccauuucaggugugauucuaguagguggugucacgacaauggggugaauuauaaaauuggagaaaagugggacaggcagggagagaacggucaaaugaugaguugcaccugccuuggaaacgggaaaggcgaguuuaagugugacccacacgaagcuacauguuacgaugauggaaaaacauaucacgugggggagcaguggcagaaggaauaucucggggcuauuuguaguugcaccugcuuugggggucaacguggauggcggugugacaacugcagacgcccuggcggugagccauccccugaagggaccacgggucaaucauacaaucaguauagccaacgcuaucaccaacgaacuaacacuaacgugaacuguccaauugaguguuucaugccucuugauguacaggcggaccgcgaagacucccgagaguag

SEQ ID NO: 31719 - RNA, 7161 nt, Artificial Sequence
  Description of Artificial Sequence: Synthetic coding sequence
augcugagagggcccggaccaggccuccuccuucucgccguccagugucugggcaccgccgugcccucaacgggagccucuaaguccaaacgccaggcucagcaaauggugcagccucagagcccuguugcaguuucccaaagcaaaccagguuguuacgacaacggaaagcacuaccaaaucaaccagcagugggaacggacuuaccugggcaacgcacucguauguacaugcuaugguggaucuagaggauuuaacugcgaaucgaagccagaagcugaagagacaugcuuugauaaguauacaggcaauaccuaucgagucggcgauacguacgagagaccuaaggacagcaugaucugggacuguacuugcaucggugccggaagagggcguaucaguuguacuaucgccaauagaugccaugaaggcgggcaguccuacaagaucggagauacauggcgcagaccucacgaaacuggcggcuacaugcuggagugugucugccuugggaacgggaagggggaauggacauguaagcccaucgcagagaaauguuuugaucaugccgccgguacuucuuacgucgugggggagaccugggagaagccguaccagggguggaugauggucgacugcacaugucugggcgaaggcucuggcagaaucaccuguacuucucguaauagaugcaaugaccaggauacuagaacuuccuacagaaucggggacacuugguccaaaaaagacaaucgcggcaaccuccugcagugcauuuguacuggaaaugggcgaggggaauggaaaugcgagcggcacacuuccguucagaccaccucaagcgguucuggcccauucaccgaugugcgggccgcugucuaccagccacagccacauccgcagccuccgccuuacggccacugcguuacggacucaggugugguguacucuguuggcaugcagugguugaagacccaggggaacaagcagaugcugugcacaugccuugguaauggcgugaguugccaggaaacugccguuacccagacauauggggguaacagcaauggggaaccuugcgugcugccauucacauacaauggccgcaccuuuuacaguugcaccacagagggucggcaggauggccaccuaugguguagcaccacuuccaauuacgagcaggaccagaaauauucguucuguaccgaccauaccguccuagugcagacccgagggggcaacaguaauggagcccucugccauuucccuuuccuguacaauaaccacaacuauacugacuguacgagcgaagggcggcgagacaacaugaaguggugcggaacaacccagaauuaugacgcugaucagaaauucggauucugucccauggcugcacacgaagagaucuguacuacaaaugagggugucauguaccgaaucggagaccagugggauaaacaacacgacauggggcacaugaugagaugcacuuguguuggaaacgggaggggagaguggacuuguauugcuuauagccagcuuagagaucaauguauuguggacgauaucaccuauaauguuaacgauacauuccacaaaagacaugaggagggccacaugcucaacugcacaugcuuuggccaggggcgaggcagauggaagugcgacccaguugaccagugucaggacagugagaccgguacuuuuuaucagauuggugauaguugggagaaauauguccaugggguacgcuaccaauguuacugcuacggccgcgggaucggggaauggcauugccagccccuucagacuuaccccucuucauccggcccuguggagguguuuauuacagaaacucccucucagcccaacucccacccuauccaauggaaugccccucagccaucacauaucucuaaguacauccuucguuggagacccaaaaauagcgugggacgcuggaaggaagcgacaaucccggggcaccuuaacucuuauacgauuaagggccugaaacccggcgucguguaugaagggcaguugauaaguauccagcaauacggucaccaggagguaacacgguucgacuuuaccacaacaucuacaucuacacccgucaccagcaacacggucacaggagaaacaacccccuucuccccauugguagcuaccucagagagugugacagaaauuacagcuucauccuucgugguaaguugggucagugccucugauaccgugucugguuuucgaguggaguacgagcucagugaagagggugaugagccacaguaucuggaccugccuuccacugccaccucugugaauauacccgacuuacucccugggcggaaguauauugucaacgucuaccaaaucucugaagauggggagcagucucugauuuuaucuacuucccaaacuacggcaccugaugcaccaccagacaccacaguggaucaggucgacgacacauccaucguggugagauggucuagaccucaggcaccaauaacaggguaccgcaucguguacuccccguccguggaagguuccagcacagaauugaaucugccagaaaccgcuaauucagugacccugucagaccugcagcccggggugcaguacaacaucacaauauacgcaguagaagagaaucaagaauccacucccgucgugauucaacaagagacuaccgggacaccuagaagugacaccguuccaucuccacgugaucugcaauucguugagguaacagacgucaaaguaaccauuauguggacaccuccugagagugccgugaccggguaccggguggacguaauuccaguaaauuuacccggugagcauggacagcgucucccaaucucucguaacacuuucgcagaggugacagggcucucacccggagugaccuauuacuuuaaagucuuugcggugagccacgggagggagagcaaaccucuaacggcgcagcagacaaccaagcucgacgcccccaccaaccugcaguuugugaaugagacugacuccacagugcuuguucguuggacacccccucgcgcucaaauuacaggguauaggcucacaguuggacucacccgcaggggacagccaaggcaguacaauguaggccccucgguuucaaaguacccccugagaaaucuacagccagcuagcgaguauaccgucucccucgucgccauaaaaggcaaccaggagucucccaaagccacugggguguucaccacucuccagccgggcuccuccauuccaccguauaacaccgaaguuacugagaccacuaucgucauaaccuggaccccugccccucgcauuggcuuuaagcuaggugucaggcccucacagggcggggaagccccaagggaagugacuagugacucugggaguauuguggugagcggcuugacccccgguguggaauauguguacacaauccaggugcuccgggauggucaagaacgggacgcgccuaucguuaauaagguugugacaccacuuagcccccccacaaaucugcacuuagaggccaaucccgacacgggcgucuuaacaguaaguugggagcggagcacuacacccgauaucaccggauaccgaaucacuacgacuccuacaaauggucagcaagggaauucacuugaggaggugguucacgcugaccaauccagcuguacauucgacaaucuuucacccggacucgaauacaacguaucaguauauacuguuaaggacgacaaagagucggugccgauuucagacacuauuauccccgcugugccaccacccacagaccugcgauuuacaaacauuggacccgauaccaugcgcgugacuugggccccaccaccaagcauugaccuuaccaauuucuuaguaagguauaguccagugaagaaugaggaggacgucgccgagcuuaguauuucacccucugauaacgccguggugcucaccaaucugcugccaggaacagaauacguugucagcgugucuucgguguaugaacagcaugagucuacuccucuucgcggucggcagaagaccgggcuggacucaccuacuggcauagacuuuagcgacaucacugcaaacagcuuuacgguacauuggaucgcuccccgggcuacaauuaccggguaucgcauucgucaccacccugagcauuucucuggaagaccuagggaagaucgagugccucauuccaggaauucuauuacucugaccaaucuuacuccuggcacagaauacgugguauccaucguugcucuaaacggaagggaagaaaguccucuacuuaucggacagcaaucaacaguuucugauguuccacgagaccuggagguugucgccgcaacgccuacaagccugcugauaagcugggaugcuccggcagugacagugagguacuaccggaucaccuacggcgaaaccggagggaacucuccugugcaagaauucacggugccgggaucuaaaagcaccgccacgaucagcgggcugaaaccugggguggauuacaccaucacggucuacgcagugacaggacggggagacuccccugcuagcagcaaaccgauuucgaucaacuaucgcaccgagaucgauaaaccaucccaaaugcaggugaccgacgugcaggacaacagcauuucugugaaguggcugccgucaucuucucccgugaccggcuauagagugacgaccacaccgaagaacggcccaggaccuacaaaaaccaaaaccgccggaccagaucagacagagaugaccaucgagggccuucagccgaccguagaauacguggucagcguguacgcucaaaauccaucaggggagucacaaccacucguccagaccgccgugacgaacauagaucgaccaaaagggcuagcauuuaccgaugucgacguggauagcauuaagauugcuugggaauccccucagggccaggucagcagauacagagugaccuacagcucccccgaggacggcauccacgaacuuuuuccagcaccggacggugaagaggauacggccgaauugcagggccuccgucccgguagcgaguacaccguguccguuguugcucugcacgacgauauggagucucaaccccugauuggcacacagaguacugcaaucccugccccaacggaccuuaaguucacucaagugaccccuacuucucuuucagcacaguggacgcccccaaacgugcagcuuaccggcuauagaguacgugugacaccuaaggaaaaaacugggccuaugaaagagaucaaccuggccccagacagcaguuccguggucgucucaggccucauggucgcuacgaaguacgaaguuucggucuacgcccugaaggacacuuugacuucccgccccgcccagggagucgucacaacccuugaaaacgugagcccuccucggagggcucguguuacugaugccacagagacuacaauaaccauaagcuggcggaccaaaacagagacaauuaccggcuuucagguagacgcgguucccgcuaacgggcaaacgccuauccaaaggaccauuaagcccgacguucgauccuauacaauuaccgggcuccagccuggcacggacuauaagaucuaucuguacacucucaaugauaacgcuaggucaagcccaguugucaucgaugccagcaccgcuaucgacgcacccucaaacuugagguuccuagcuacuacuccaaauaguuugcugguguccuggcagcccccccgggcccgcauaaccggauacauuauuaaguaugagaagccuggcagcccuccgagagagguagugccccgcccccgucccggagucacagaagcuaccaucaccggacucgagccaggaaccgaauacacuauauacgugaucgcccugaaaaauaaucagaaguccgagccacucaucgggcgcaagaaaacagacgagcuuccccagcuggucacccugccgcauccgaaucuucauggucccgagauccuggaugugccgagcaccgugcagaaaacaccauuugugacccacccuggauacgauacaggaaauggaauacagcuuccugguaccucaggucaacagcccucaguuggacaacagaugaucuucgaagaacacggcuuucggcggaccaccccaccuaccacugcgacuccaauucggcaucgcccccggccguacccaccaaacgugggugaagagauccagauuggccacauuccaagggaagacguugacuaccacuuguauccucauggcccgggauuaaacccaaaugcuaguacaggccaggaagcccugucucagacaacuaucucuugggcaccauuucaagacacuagcgaauacaucaucuccugccauccugucggcacagaugaagaaccccugcaguuccgugugccagguaccagcaccucugcuacuuugaccgggcucacacguggggcaacuuacaacgugauugucgaggcacugaaggaccagcagagacacaaaguaagggaggagguggucacggucgggaacuccgugaacgaaggcuugaaucagccuaccgacgauucuugcuucgacccauauacggugucucauuacgccgugggcgaugagugggagcggauguccgagucggguuuuaaacugcugugccagugucucggguucggauccggacauuuccggugcgauucgucucgauggugccacgacaauggaguaaauuauaagaucggugaaaagugggacaggcagggggaaaaugggcagaugaugagcugcacaugccucggcaauggaaagggugaauuuaagugugauccccacgaagccacaugcuaugacgacgggaaaaccuaccaugugggagaacaguggcagaaagaguaccugggcgccaucuguagcugcacgugcuucggcggacagcggggcuggagaugcgauaauugccgaagaccuggcggagagccaucuccagaagggacuaccggccaaaguuacaaucaauacucucaaagauaucaccagaggaccaauaccaaugucaauuguccuaucgaauguuuuaugccccuggacgugcaggcugaucgcgaggauucaagagaauag

SEQ ID NO: 31720 - RNA, 6723 nt, Artificial Sequence
  Description of Artificial Sequence: Synthetic coding sequence
augcucagaggucccgggcccggacuccuccugcucgccgugcagugucuggguaccgccgugcccagcacaggggcuuccaagagcaagaggcaagcccagcaaaugguccagccccagaguccaguggcagugucucaaagcaaacccggcuguuacgacaaugggaagcacuaucagaucaaucaacaaugggagagaacauaucugggaaaugcacugguaugcaccuguuacgggggcucucguggcuuuaauugugaaagcaagccggaagcugaagagaccugcuuugacaaguacacugguaauacauauagagugggcgacaccuacgagcgcccaaaagauucuaugauaugggauugcaccuguauuggggccggacggggccgcaucucaugcacaauugcgaaucguugccaugagggcggacagucauauaaaaucggggacaccuggcgucggccacaugaaacuggcggguacaugcuggagugcgugugucugggcaauggcaagggagaguggacauguaagccuaucgcagagaaaugcuuugaccacgcugcgggcacaagcuauguggucggugagaccugggagaaaccuuaucagggguggaugaugguggauugcaccugccuaggagaggggucagggcggaucacuugcacaucccgcaaccggugcaaugaccaagauaccagaacgucuuaccgcaucggcgauacauggaguaagaaagacaauagggguaaucuucugcaaugcauuuguacaggcaaugggagaggugaguggaagugcgagagacacacaucuguacagacgacaucuucggggagcgggccuuuuaccgacgucagggcggccguguaucaaccucaaccucacccucaaccacccccuuauggucauugcgucaccgauucuggcgugguuuacucuguagggaugcaguggcugaagacccagggaaauaagcaaauguuguguaccugucugggaaaugggguguccugccaggagacagcugugacacagacauacgguggaaacucaaacggcgaaccguguguucucccuuucacuuacaauggucgcacuuucuacucaugcaccaccgagggucgccaagacggucacuugugguguucuacaacauccaauuacgaacaggaucagaaauacagcuuuugcaccgaccauacuguguuggugcagaccagaggggguaauucaaacggugcccucugucacuucccguuccuguacaacaaccauaauuacaccgauugcacauccgaggguaggagagauaacaugaaauggugcggaaccacccagaauuacgaugcggaucagaaauuuggauuuugcccuauggccgcccaugaggagaucuguacaacuaacgagggcgugauguaucguauuggggaccagugggauaagcagcaugauaugggucauaugaugaggugcacuugcgucgggaacggcaggggugaauggaccugcauugcguacucucaguugcgagaccagugcaucguggaugauauaacauacaaugugaaugacacuuuccauaaacggcacgaagagggacacaugcuuaauuguaccugcuuugggcaagggcguggucgauggaaaugugaucccguggaccaaugccaagauucugagacaggcaccuucuaccagaucggcgacagcugggagaaauacguacacggggugcgcuaucaguguuacuguuauggcagagggaucggugaguggcacugucaaccauugcaaaccuauccaucauccucugggccaguggaaguuuucauuacggaaaccccuagucagccaaacagccauccaauccaguggaaugccccccagccuucccacaucaguaaauauauacugcgcuggcgaccuaaaaacuccgucgguagguggaaagaagccacaauaccugggcaccucaauuccuauacgauaaaggggcuaaagccaggcgugguguaugagggccaacuuaucuccauccagcaauacggccaccaagagguaacaagauucgacuucacaacaacuucaaccagcaccccagugacauccaacaccgugaccggcgagacuacaccuuuuucuccauuaguagcuacaagcgaaucugugacggagauuacagccaguuccuucguggucagcuggguuagcgcgucggauacuguguccggguucagaguggaauacgaacucuccgaagaaggcgacgaaccgcaguauuuggacuuacccagcaccgccaccucgguaaacauuccugaucuuuugcccggcagaaaguacauagugaacguuuaucagaucagugaagauggagagcagagccugauccuaucaacaucccagaccacagcgcccgaugcaccuccagacaccacagucgaucaaguggacgauacaaguauaguggugcgguggucacgaccccaggccccaaucaccggauacaggauuguuuauagccccuccgucgaggguuccagcacggagcucaauuugcccgaaacagcaaacucugucacccugucagaccugcagcccggcgugcaguacaacauuaccauauacgcuguggaagaaaaccaggagaguaccccaguugugauucagcaggagacaacuggcacaccacggagugacacggugcccucccccagagaccugcaauuuguggaagucacagacgucaaagugacuaucauguggacaccuccagagucugcagugaccgguuacaggguggauguaaucccugucaaccugcccggggagcacggccaacggcucccuauuucacggaauaccuucgcggaaguaacugggcugucaccagguguaacauacuacuucaaagucuuugcugugucccauggccgagaguccaagccacucacagcacagcaaaccacaaagcuugaugcuccaaccaaucuacaguuuguuaaugaaacugacagcacagucuugguucgauggacuccacccagagcccagauuacggguuacagauugacaguaggucugacaagacgcgggcagccacgacaguacaaugucgguccuagcguuaguaaguacccauugcgcaacuuacaaccagccuccgaguauaccguuuccuuaguagcuaucaaagggaaccaggaaagccccaaagccacuggcguguucacgacacuucagccgggcagcagcauaccucccuacaacacagaagucaccgagacuacuauaguuaucacauggacucccgcuccuagaauuggauuuaagcucggagugcgcccaucccaagggggggaagcuccucgcgaaguaaccagcgacucagguagcaucguugucucuggccugaccccgggggucgaauauguguacacaauccagguuuuaagggacggucaggagcgggacgcaccgauugugaauaaggucgucaccccccuguccccacccacaaaucugcaucuugaagccaaccccgacacugguguccucacuguguccugggaaagaagcacaaccccagacauaacuggauauagaaucacaacaacccccacuaaugggcaacaggguaacucucucgaagaggugguccacgccgaccaguccaguuguacuuuugauaaccugucgcccgggcuggaguacaacguguccguuuauacugugaaggacgacaaagagucagugccaaucuccgauacuauaauucccgcagugcccccucccacugauuuaagauucaccaacauaggccccgauaccaugcgagugacuugggcacccccgccaucuaucgaccugacaaacuuccuagugcgcuacucaccuguuaagaacgaagaagaugucgcagagcugagcauuucccccagcgauaaugcaguggugcugaccaaccucuugccaggcacagaauauguugucucugucaguuccguguacgagcagcacgaaaguacuccguuacguggaagacagaagacaggccuggauucaccaaccgguaucgauuucagugauauuacugcgaacagcuucacagugcauuggaucgcaccccgagcuacaaucacgggauacagaaucagacaccacccagagcacuuuucgggccgaccccgagaggaccgggucccucauucucgcaauagcauuacccuaacaaaucuaacccccggaacugaauaugucguaucuauuguggcacugaacggucgcgaagaaucaccucugcucaucggacagcagucaacugucuccgaugugccccgcgaucuugagguaguagcugcgacaccaaccagccugcucauauccugggacgcacccgccgugacggugcguuacuaccggaucacguacggagaaaccggagguaacucucccgugcaggaauuuaccgugcccgguagcaagagcacagcuaccaucucuggacuuaagcccggcguggacuacacaauuacaguguaugccgugaccggaagaggcgauucucccgccuccucaaagccuaucagcaucaauuauagaacugagaucgauaagcccagccagaugcaagugacugaugugcaagacaacuccaucucagucaaguggcugcccucuucuucgccugugacagguuacagaguaaccacaacuccuaagaauggacccggcccaacaaaaacuaaaacugcagguccggaucaaaccgagaugaccaucgaaggccuccagcccacaguugaguauguggugagcgucuacgcacaaaacccuaguggcgaaucccaaccacucguucaaacggcugugacaacaauuccagcaccuaccgaucugaaguucacgcaggugacaccuacaucucuuucugcacaguggacuccacccaauguacagcucaccgguuaucgagugcgcgugacgcccaaagaaaaaaccggucccaugaaagagaucaaucuggcccccgacucaagcucuguaguggugucaggacucauggucgcgacgaaguacgaggugucuguauaugcuuugaaggauacgcugacaagccggccggcgcagggaguggugacaacacuggaaaacguaucgccuccgaggagagcccgggugacugaugccaccgagacaacaauuaccauuuccuggagaaccaagacagagacaauuacgggcuuccagguagacgcuguucccgccaaugggcagacgcccauccaacggacgauaaagccagacgugcggucuuacaccaucaccggacugcagccagggacagacuauaaaauuuaccucuacacccuuaaugauaacgcuagauccucuccugugguuauugaugcuuccaccgcuaucgaugcaccuuccaauuugagguuccuggcgacaacccccaacucccuguugguguccuggcagcccccacgcgcccguauaaccggguacaucaucaaauacgagaagcccggaagucccccccgggaggucgucccucguccccgccccggcgucacugaggcuacgaucacuggccuggagccugguacagaguacaccauauacguaauagcuuugaagaauaaucagaaguccgagcccuuaaucgggcggaagaaaacuguucagaagacuccguucgucacacauccaggcuacgauacuggcaaugguauucagcugcccgguacaucagggcaacagccaagugucgggcaacagaugauuuuugaagaacacggguucaggcgcacgaccccaccuaccacugcaacaccgauccggcacaggcccagaccuuauccucccaacgugggucaggaggcacugagccagaccacgauaagcugggcaccuuuccaggauaccagugaguauauaaucagcugucauccagucggcacugaugaagagccccugcaauuccgcguccccgggacaaguacaucggcaacccugaccggucugacccguggcgcaacguacaaugucaucguagaggcacugaaagaucaacagaggcauaaaguucgugaagagguggucacagucgggaauucagugaacgagggccugaaccagccaaccgacgacagcugcuuugacccuuauacugugucgcacuaugccgugggagaugaaugggaaagaaugagcgagaguggcuuuaaacuccugugucaguguuugggcuucggcuccggccacuuccggugugauaguucaagauggugucacgacaacggggucaacuacaagaucggcgaaaaaugggacaggcagggggagaacggccagaugaugagcugcaccugccuugggaaugguaaaggagaauucaaaugcgauccacaugaggcaacuugcuacgacgacggaaaaacuuaccaugugggggaacaauggcagaaggaguaccugggcgcgauuugcuccuguacgugcuuuggcggucagcgaggcuggcggugcgauaauuguaggagaccaggcggugagcccagcccagaagguacaaccgggcagagcuacaaccaauauucacagagauaccaccaaagaacuaacaccaacguuaacuguccuauugaguguuucaugccacuugaugugcaggcagauagggaagacucccgggaauag

SEQ ID NO: 31721 - RNA, 1974 nt, Artificial Sequence
  Description of Artificial Sequence: Synthetic coding sequence
augcugagggguccuggcccuggcuugcuucuccuggcugugcaaugccugggcacagcuguacccaguaccggggcuaguaagagcaagcgacaggcccaacagauggugcagccacagucucccgucgcagugagucagucuaaaccaggcuguuacgacaauggcaaacauuaucagauuaaucagcaaugggagcgcacuuaucuugggaaugcucuugucuguaccugcuauggaggcucaagaggcuuuaacugugaauccaaaccagaggccgaggagaccuguuucgacaaguacaccggaaacaccuaccgggugggggacacuuaugaacgcccuaaggauaguaugauuugggauugcaccuguaucggcgcagggagaggacggaucuccugcacuauagcgaaucggugccacgaaggcgggcagucauacaagaucggggauacuuggcgcaggccacaugagacaggugguuacaugcuggagugcgugugccucggaaacggaaagggugaguggaccugcaaacccauugccgagaaaugcuucgaccaugcggcuggcacaucauacguggugggcgagacgugggaaaagccauaccagggauggaugaugguugacugcacaugucuaggagaagggagugggcgcauuacauguacuagcaggaaucguuguaaugaccaagauacaagaacaucauaucgaauuggcgauacauggucuaaaaaagauaaccggggaaaucuccuucagugcauuuguacaggaaauggcaggggagaauggaaaugugaaagacauacaagcguacagacaacuucuaguggaucaggcccauucacggacgucagagccgcaguguaucagccccagccacauccccaaccgccgcccuauggucacugcgucaccgauucaggggugguguauuccguggggaugcaauggcugaagacgcaagguaauaaacagaugcuuugcaccugccuggggaacggagucuccugccaggaaacagcaguuacgcaaacuuacgguggaaauuccaacggagagccaugcgugcuaccuuuuaccuauaacggaaggaccuuuuacaguugcacaacugagggaagacaggauggccacuugugguguucaacaaccagcaacuaugaacaggaccagaaauacucuuuuuguaccgaccauacugugcugguccagacaagaggagguaauucuaauggggcucugugccacuuuccguuucuauacaacaaucauaacuacaccgacuguacuucugaggggagacgggacaauaugaaauggugugggaccacacagaacuaugacgcugaccagaaguucggguuuugccccauggcugcccaugaagaaaucuguacuacaaaugaggggguaauguaucggauaggagaucagugggacaaacagcaugacaugggccauaugaugcgguguacuugcgugggaaacggacggggagaguggacauguauugcguacagucagcugcgugaccaguguaucguagacgacaucacuuacaauguuaacgacacauuccacaaacgccacgaagagggacacaugcugaauuguaccuguuucggucagggcagggggagauggaagugcgauccugucgaccagugccaggacuccgaaaccgggaccuuuuaucagaucggugacucaugggagaaguacguccauggcgucagauaccaauguuacugcuacggaagggggaucggugaauggcauugccaaccuuuacaaacauaccccagcagcucggggccgguggagguauuuauaacagagacucccucacagcccaauucacauccuauucaauggaaugccccucagccaucgcauaucaguaaguacauucuuagguggcgaccagucucaauuccacccagaaacuuggguuauuag

SEQ ID NO: 31722 - RNA, 6804 nt, Artificial Sequence
  Description of Artificial Sequence: Synthetic coding sequence
augcuaagaggacccggcccuggccugcuucugcuugccgugcaguguuugggcacggcagugcccucuaccggggccaguaaaagcaagagacaggcucaacagaugguccagccucaaagccccguggcugucucacagagcaaaccagguugcuacgacaaugggaagcacuaccagaucaaccagcagugggagcgcacguaucuggggaacgcacugguauguaccugcuacggcggcagcaggggguuuaacugugaaucaaaaccugaagcagaggagacuuguuucgauaaauacaccgggaacacauacagaguuggcgacacguacgaacgccccaaggauuccaugaucugggauugcacaugcaucggggcaggcaggggaagaauuaguugcacuaucgcaaauagaugccacgaaggaggucagagcuauaaaaucggugauacauggcgaagaccacaugagacuggcggguacaugcuugaaugcguaugucuagggaacggcaagggcgaguggacaugcaaaccaaucgcugagaaaugcuuugaucacgccgcugggacaagcuauguagugggggagacaugggagaagccauaucagggauggaugaugguggacuguacauguuuaggagaagggagcggucgcaucacaugcaccuccagaaaucgcuguaaugaccaggacaccagaacuuccuacaggaucggcgacacauggagcaaaaaggauaacaggggcaaucugcugcagugcaucuguacaggcaaugggcgaggagaauggaaaugcgagcggcauacaucuguacaaacuacgucaucuggguccgggccauuuacagaugugagagcugccguguaucagccacagccgcacccucaaccccccccuuacgggcacugcgugaccgauuccgggguuguauauagcgugggaaugcaguggcuuaaaacccaaggcaacaagcagaugcuuugcacaugucucgguaauggcgucucaugccaggagacugccgugacgcagaccuacggugguaacuccaauggagaaccgugcgugcucccuuuuacauacaacgggagaacauuuuauaguuguaccaccgaaggccggcaggacgggcaccucugguguagcacaaccucuaauuaugagcaggaucagaaguauucauucugcaccgaccauacggugcucgugcagacgcgaggaggaaauucgaacggcgcccugugccacuucccuuuccucuacaacaaccacaacuauaccgauuguacuucugaggggcggagggauaacaugaaguggugugggacaacacaaaauuacgacgcggaucaaaaguucggcuucugccccauggccgcacaugaagaaaucuguacaacuaacgaaggcguaauguaccgcauaggagaccagugggauaagcagcaugauaugggacauaugaugagguguacaugcgugggcaauggccgcggcgaguggacaugcaucgcauauagucagcuuagagaccaauguauaguagaugacaucacauauaacgugaaugauacguuucacaaacgucacgaagaggggcacaugcugaauugcaccuguuucggccaaggcagagguagauggaagugcgaucccguggaccagugucaagauuccgagacuggaacguuuuaccaaauuggugacuccugggaaaaguacguucacggcguacguuaucagugcuauugcuauggccgggguauuggggaauggcacugucagccccugcagacuuaucccucuaguucaggccccguugagguuuuuaucacagaaaccccaucucaaccgaacagccauccuauucaguggaacgcuccgcagccuagccacaucucaaaauauauucugcguuggcgucccaagaauaguguugggcgcuggaaggaagcgaccauucccggucaccuuaacucguacacaauuaaagggcugaaaccaggcguuguuuacgaaggacaacugaucuccauacagcaauacggacaccaagagguaacacgauucgauuucacuacaacauccacaucgacaccagugacuucaaauacagugacaggagaaacgacgcccuuuucgcccuugguggccaccagcgagucugucaccgagauaacagccuccuccuuugucguguccugggugagcgccucggauacagugagcggcuuucguguagaauacgagcucagcgaggaaggggaugaaccccaguacuuggaucuaccuaguaccgccaccucugugaacauaccagaccuguugccagggagaaaguauaucgugaacguguaucagaucuccgaggacggcgagcaauccuugauucuguccaccagccagaccacagcccccgacgccccucccgauaccacuguggaucagguugacgacacuuccauugugguucgcuggucuaggccucaggcuccaauuaccggcuaucgcaucgucuacuccccuaguguagaaggaagcucaaccgaguugaaccuuccagaaaccgccaauaguguaaccuuaucagaucugcagccuggcguacaguauaacauuacgaucuaugccguggaagagaaccaggaauccacccccgucgucauucaacaggagacaaccggcacuccaagaagugacacugugcccaguccacgggaccuucaauucguugagguaacugacgugaagguuaccaucauguggacgccacccgagagcgccgugaccggcuaucguguggacguuauaccugugaaccugccaggcgagcacggucaaaggcuccccauaucccggaauacauuugccgaagucaccggguuaucacccggaguuaccuauuauuuuaaaguguucgccgugagccaugguagggagaguaaaccccucaccgcucagcagaccacuaaacuagaugcccccacuaaucuccaauucgugaacgaaaccgauuccaccguccucgugcgcuggacucccccucgagcucagauaaccggcuauaggcuuacuguuggauugacaaggagagggcagccccggcaguauaacguugguccuuccgugucaaaguacccacugagaaaucuccagccagccucagaguauacgguaagcuuaguggcgaucaaggggaaucaggagucaccaaaggcgaccggcgucuuuacaacauugcagcccggaaguagcauuccuccuuacaacacugaagucaccgagacaacaauugugauuacuuggacaccggcacccaggaucggauucaaauugggugugaggccuagucaggggggcgaagcaccgagagaggucacauccgacucaggaucgaucguugugagcggcuuaacaccagggguagaauacguauauaccauccaaguccucagagacggccaagagcgggacgcuccaaucgugaacaagguggucacaccccuaucuccuccgaccaaccuacaccucgaggccaaccccgacaccggggugcugaccgucuccugggagcguagcaccacccccgauauuacggguuaucgcaucaccacaacucccacgaacgggcagcagggaaacucacuugaggaaguggugcacgcugaccaaagcucuuguaccuucgauaaccuuagucccggacuugaguacaacgucaguguuuacaccguuaaagacgacaaagaaucagucccuaucucagacacuaucaucccugaggugccccagcucacagaucuguccuucgucgacauaaccgacaguucuauuggucugcgcuggacgccucugaacucaagcacuauuauuggguaucgcauaacagugguugcugcaggagagggaaucccuauuuuugaggacuucguugauuccaguguaggauacuauacugucaccggucuggaacccggaaucgauuacgauaucagugugauuacacucauuaacggaggugagucagcuccuaccacccugacucagcaaacggccgucccuccaccgacggaccuucgauucacuaauaucgggccggacacgaugagggugacgugggcaccccccccuagcaucgaucugacgaauuucuugguccgcuacaguccaguuaagaacgaggaagaugucgccgaacugaguauaucaccuucggauaaugcgguuguucuaacuaaccuccuuccugguaccgaauacgugguuucgguaagcucagucuaugagcagcacgaaucuacaccuuuacgaggucgccagaaaaccggauuagauuccccuacuggcauagacuuuuccgauaucaccgccaauaguuucacggugcacuggauagccccuagggccacgauuacuggcuacaggaucagacaccaucccgaacacuuuagcgggaggccucgggaggaucgggucccucauagccggaauagcaucacccugacuaaccugacaccugggaccgaauacguugucucuauagucgcccugaaugggcgugaggagucuccguuguugauuggccaacaaagcacugucucagaugugccucgcgaucucgaggucguagcagcaaccccaaccucucugcucauaucgugggacgcuccugcaguaacuguuagguacuaccggauuaccuacggugagaccggcgguaauucuccaguccaagaguucacagugcccggcagcaagagcacugcaacuaucucggggcucaagcccggcgucgacuauacuaucacuguauaugccgugacaggcaggggggacucaccagcuuccucuaaacccauuaguaucaacuaccgcacagaaaucgauaaacccucucaaaugcaggugacagaugugcaggacaauaguaucuccguaaaguggcucccuaguucaaguccgguaaccgguuaccgcgugaccaccacaccgaagaaugggccaggcccuaccaaaacaaagacugccggaccugaucagaccgaaaugaccaucgagggguuacagcccacugucgaguauguugugucagucuacgcucagaaccccucaggcgaaagccagccacuugugcagacugcggugaccacgauccccgcgccgaccgaccucaaauucacgcaggugaccccaaccucgcucucugcacaauggacuccacccaacguacaacugacuggguaccgcgugagaguuacuccaaaggagaaaacagggccuaugaaagagaucaaccuugccccagauuccuccagcgucgugguuucugggcucaugguugccaccaaguacgaggugucuguauacgcucuaaaggacacacuaacuuccaggccagcacaagggguugugacaacccuugagaaugugucaccucccaggcgcgcaagagucacugaugcaacagaaacaacaauuacaauauccuggaggaccaagaccgaaacaaucaccggcuuucagguggaugcugucccugcaaaugggcaaaccccaauucagcgaaccauuaaaccggacgugagauccuauacuaucaccggccuccaaccuggaacugacuacaaaauauaccuauacacucucaaugauaacgccaggucauccccaguugucauugacgcuucaacagcuauagaugcccccagcaaucuucgguuccucgcuaccacaccaaacagccuccuggugucuuggcagccuccuagagccagaaucacuggauacauuauaaaguaugaaaaacccggcagcccccccagggaaguggucccucggccuagaccuggagucaccgaagcuacgauaaccggcuuggagccgggcacagaguacaccaucuacguuaucgcacugaagaacaaccagaaauccgaaccucuuaucggaagaaagaaaaccggacaagaagccuugucucaaacgacaauaucgugggcuccuuuccaggacaccagcgaauauauuauaucaugccaccccgucggcaccgaugaagaaccacugcaauuccgcgugcccgguacgucgacauccgcaacccuuacuggucugacgcgcggggccacuuacaaugugaucgucgaagcucugaaagaccagcagaggcauaaagucagggaagaaguugugacagugggcaacagugugaaugaaggacuaaaccaacccaccgacgacaguuguuuugauccauacaccgugagccauuacgcaguuggcgacgagugggagcguaugucagagagcggguucaaacuguuaugucaaugucucggcuucgggucagggcauuuccgcugcgauuccuccagauggugccacgacaauggagugaauuacaagaucggggagaagugggaucggcagggggaaaauggccagaugauguccuguacuugucucgggaacgguaaaggcgaguuuaaaugugauccccacgaggccaccuguuacgaugaugggaagacauaucaugucggagagcaguggcagaaagaguaucuaggcgccaucuguucuuguacuugcuuuggcgggcaacgcgguuggcgcugcgauaacugcagacgaccggggggcgagccuagcccagagggaacaacaggacagucguacaaccaguauagccagcgguaccaccaaaggacuaacaccaacgucaauuguccaauugaauguuuuaugccgcuggacguucaggcugaccgagaagacucucgagaguag

SEQ ID NO: 31723 - RNA, 6798 nt, Artificial Sequence
  Description of Artificial Sequence: Synthetic coding sequence
augcugaggggcccuggacccggacuccuucuucuagcaguccagugcuugggcacagcagugccauccacuggcgcaagcaaguccaaaaggcaagcacagcagauggugcagccccagucaccugucgccgucucucagaguaagcccggauguuacgacaauggcaaacacuaucagaucaaucagcagugggaaagaaccuaucuggggaaugcacuggucugcacuuguuacggcgggucaaggggauuuaauugugaguccaaaccugaggcggaggagaccuguuucgacaaguacacagggaacacguaucgggugggagauacuuaugaaagaccaaaagauucaaugaucugggacuguacuugcauuggggccggcaggggccgaauuuccuguacaaucgcuaaccggugccaugagggcggccagagcuacaaaauuggugacaccuggaggcggccccacgagacuggggguuauaugcuagaauguguaugccuggggaauggcaaaggagaauggacguguaagccgaucgcagaaaagugcuucgaccaugcggcuggcaccucauacguuguaggggagacuugggagaaaccuuaucagggcuggaugauggucgacugcaccugucuaggugaagggagcggaagaaucacguguaccucuagaaauagaugcaaugaccaagauacucggacuagcuaucguauaggagauacuuggucuaagaaggauaaccgagggaaucuucugcaauguauauguacaggaaacgguaggggcgaguggaaaugcgagcgacacacaucuguccaaaccacaucgucaggcucaggcccauuuaccgacgugcgugccgcuguuuaccaaccccagccacauccucagccaccgccauacgggcacuguguuaccgauuccggaguuguuuauuccguaggcaugcaauggcuuaagacccagggcaauaaacagaugcuuugcacuugccucgguaauggggucucuugccaggaaacugcugucacgcagacauacggcggaaauucuaauggagaaccuugcgugcugccguuuaccuauaacgggcgcaccuucuacucuuguaccaccgaaggacgacaggacggacacuuguggugcuccacaaccucaaacuacgagcaagaucagaaguacuccuucuguacagaccacaccgugcuuguccagacacgaggaggcaacucuaacggcgcccucugccauuuuccuuuccucuauaauaaccacaauuacacagauugcacauccgaaggaaggcgcgacaacaugaaauggugugguacaacccagaauuaugaugccgaccaaaaauucgguuucugucccauggcagcacaugaggaaauaugcacaaccaaugaaggggugauguacagaauuggggaccagugggacaagcagcacgacaugggccauaugaugcgguguacuugugucggcaacgggcgcggggaauggacaugcaucgccuacucucagcugagagaccagugcaucguugacgauauuacauacaaugugaaugacacauuucauaagagacaugaagaaggacauaugcucaacugcaccugcuuuggccagggacgcgguagguggaaaugugaccccgucgaucagugucaagacucagagaccgguacauucuaccagaucggcgauagcugggagaaguacguucacggcgucagauaccaaugcuauuguuacgggcgcgggauuggggaauggcacugccagccuuuacagacauaucccagcucaucugggcccguggagguauucaucacagagaccccuucucagccuaacucucaucccauccaguggaacgccccacagcccucccacauuaguaaguauauacuccgguggaggcccaagaacagcgucggacgguggaaggaagccaccauaccuggccaccugaacucuuacaccauaaagggacugaaaccuggcgucguguacgaaggacagcuuaucagcauacagcaauaugggcaucaggaagucacucgguucgacuucacaacuacuaguacuucaacaccagucaccuccaauacuguaacaggagagacuacucccuucagcccccugguggcuacaagcgaaagugugaccgagauuacugcauccucguucguuguuucaugggucuccgcauccgacaccguguccggauuuagaguggaauaugagcuguccgaagagggcgacgagccucaguaccuugaucugccaagcacggcuaccuccgucaauaucccugaccugcucccuggcagaaaauauauugugaauguuuaccagaucagugaggauggugaacagagcuuaauacuuagcacuagccagacaaccgccccugaugcccccccagacacuaccguugaucagguggaugacacaucaaucguggugcgguggucucggccacaggccccgauaacagguuauagaaucguguacagucccucuguagagggcucuucuacagaauugaacuuaccugaaacugcgaacuccgucacucuuagcgauuugcaaccuggaguucaauacaauaucaccauuuacgcuguggaagagaaucaggaaucuacucccguggucauccaacaagagacgaccgggaccccuaggucagacacagucccaagcccacgggaucuacaauucguggaagucacugaugugaagguaacaaucauguggacuccgccagagucugcuguuacaggauaucgcguggacgugauucccgucaaccugccuggagaacaugggcagcgccuccccaucucucggaacaccuucgcggagguaacuggucucagcccggggguuacuuacuacuuuaagguguucgccgugucccacgggcgugagagcaaaccacugaccgcucaacagaccacuaagcuugaugcgcccacaaacuuacaauucguuaacgagaccgauucuaccgugcucgugcguuggacccccccgcgugcucagauaaccggcuaucgucugaccguuggacugacacgcagagggcaaccgagacaauauaauguuggaccgucggucuccaaguauccccucagaaaccuucagcccgccagugaauacaccguuucuuugguggcuauaaaggguaaucaggaaagcccuaaggccaccggcguauucacgaccuugcagccuggaaguucuauuccgcccuacaacaccgaggucacugaaacuacgaucgucauuacguggaccccggccccaagaauuggcuuuaaacuaggagugcgccccucacagggcggcgaagccccacgcgaggugaccucggauagcgguucuaucguagucucaggccuaacaccgggagucgaguacgucuauacuauucagguuuugagagacgggcaggagagagaugccccuaucgugaauaaaguagugacaccacucuccccucccaccaacuuacaucuagaggcgaacccagacaccggcgugcugacagucucuugggaaaggagcacaacaccugauauuaccggcuaccggauuacgaccacuccgacgaacggacagcaaggcaauucccuggaggagguugugcacgccgaccagucgagcugcacguuugacaaucucuccccugggcucgaauauaacgucuccgucuauacugugaaagaugacaaagaaucaguaccgauaucagauacuauuaucccugcggugccuccgccuaccgaucucagauucacuaauauugggccagauacaaugcguguaacaugggcuccuccuccauccauugaucugacaaacuuccuaguccguuacaguccaguaaagaaugaggaagacgucgccgagcugucaauuucaccuucagauaacgccgucguacugaccaaucugcugcccggcacugaauacguuguguccgucucauccguuuaugaacagcaugagagcacgccacuccguggccggcaaaaaaccggacucgauagcccaacuggcauugauuucagugacaucacugcaaacucguuuacaguucauuggauagcuccaagagcgacaaucaccggcuacaggauucggcaucaccccgagcauuuuagcggcagaccaagggaggacagaguaccucacucucgcaauucuaucacacucacgaauuugacacccgggacagaauacgugguuucuauugucgcguuaaauggucgcgaggagucuccacugcuaaucggccaacaguccacaguauccgacgugccaagagaccucgaagugguugccgcgacuccuaccucacuccugaucagcugggaugcacccgccgugaccgugcgguauuaucggauuaccuacggugagacaggcggcaauucuccugugcaggaguucacaguucccgggucuaagucaacagccacgauuucaggcuugaagccuggggucgauuauaccauuaccgucuacgccgucacaggccgaggcgacucccccgcaucgagcaaaccuauaucuauuaacuaccggacggagauugauaaaccaucucagaugcaggugacugaugugcaggauaauaguaucagcguuaaguggcuacccucuuccagccccgugaccgguuaucgagucacaacaacuccaaaaaacggaccaggacccaccaagaccaagaccgcuggcccagaucaaacagaaaugacaauagagggccugcagccuacggucgaauauguggugucggucuacgcccagaaccccagcggcgagucccagccccuugugcagacugcagucacaacuauucccgcgccaacagaucuuaaauucacacaggugacuccgacgucccucucagcccaauggacuccuccuaacgugcaacucaccggcuaucgcgugagagugacgcccaaggaaaaaacuggcccuaugaaagagauaaaccuugcucccgacaguuccaguguggucgugagcggacugauggucgccacaaaguaugaggugucuguguacgcguugaaggacacccugaccagucgcccggcacagggagucgugaccacccucgaaaacgugucgccgccccgacgagcccgagugacagacgcgaccgagaccaccaucacaauuagcuggagaacaaagacggaaacaauuacuggcuuucagguugaugcagugcccgcuaauggacagacccccauccagcguaccauaaagccugacgugcgcagcuauaccauaacagggcuucagccaggaacagacuacaagaucuaccucuauacccuaaacgauaaugcucguucuaguccgguuguaauugacgccucaacugcuauagacgcucccagcaaucuccgcuuccuggccacuacgcccaauagucugcugguuagcuggcaaccaccacgggcccggaucacuggcuacaucaucaaauaugaaaagccggggucucccccccgugagguugugccaaggccacggccuggggugaccgaagcuacuaucacuggacucgagccagguaccgaguauaccauuuaugugaucgcgcucaagaauaaccaaaagagcgaaccuuugauaggacgaaaaaagacagaugaacugccacagcucgugacccucccccauccaaaucugcauggcccagaaauacucgaugugccauccacagugcagaagaccccauucguuacccacccgggauacgauacugguaacgggauacaguugccuggaacgucaggccaacagcccucugugggacagcaaaugauauuugaagaacauggguucaggcgcaccacucccccuacuacggcuacucccauccgccacagaccuagaccuuacccuccuaacgucggccaggaagcguuaagccagacaacaauuuccugggcaccauuccaagauacuagcgaguacaucauuagcugucauccggucggaacugaugaggaacccuuacaguucagagugccugggacaucuaccuccgccacacuuaccggacucacaagaggcgccacuuacaauguaauuguggaggcuuuaaaggaucagcaaaggcauaaggugcgagaagagguuguaacagucggaaauucagugaacgaaggauugaaucaacccacagacgacucuugcuucgauccauauaccguuucccauuacgccguuggggaugagugggagcgcaugagcgaauccgguuucaagcuacucugucagugccugggguuuggcuccgggcacuuucggugcgauuccucucgguggugucacgacaacggcgucaacuauaaaaucggcgaaaagugggaccggcagggggaaaauggccagaugaugaguugcacaugucuggguaacgggaagggagaguuuaagugugauccucacgaggcaacaugcuacgaugacggcaagaccuaccacguaggggagcaguggcagaaagaauaucugggggcaaucuguagcuguaccugcuuugguggucagcggggcuggcggugcgauaauugucgacggccaggcggcgaacccucacccgaaggcacaaccgggcaguccuacaaccaguauucccagcguuaccaccagcggaccaacacaaaugugaacuguccuauugaauguuucaugccucuugaugugcaggccgauagagaagacucacgcgaguag

SEQ ID NO: 31724 - RNA, 6993 nt, Artificial Sequence
  Description of Artificial Sequence: Synthetic coding sequence
augcuccgggguccaggaccugguuugcuguuauuggccguccaguguuugggcaccgcuguuccgucaacuggcgcuuccaagucaaaacggcaggcucagcagaugguacaaccccaauccccugucgcugucucacaguccaagccugguugcuaugacaaugggaagcacuaucagauuaaucagcagugggagcguacuuaccucggcaacgcgcugguuuguaccuguuaugguggaucucggggcuucaacugugaaagcaagccagaggcggaggagacauguuuugauaaguauacgggaaacaccuaccgugugggagauacauacgaacguccaaaggauuccaugaucugggacuguacuuguaucggggccgggagggggcggaucucaugcacuaucgccaaucguugucaugaaggcggucaauccuauaaaauuggcgacacauggcgcagaccccacgagacagggggauauaugcuggagugcgucugccucggcaacggcaagggcgaauggaccuguaaaccaauugcagagaaaugcuucgaccacgcagccgguaccuccuauguggucggcgaaaccugggagaaaccauaucaaggcuggaugaugguggauuguacaugcuuaggugagggaaguggccggauaacauguaccucucguaaccggugcaacgaucaggacacccggacaaguuacagaauaggcgacacguggucaaaaaaggacaauagggguaaucuuuugcaguguauuuguacaggcaaugggaggggugaauggaagugugagagacacacaagcguccaaaccacgucaucagggucuggaccauucacugacgugcgcgcugccguuuaccagccacaaccucauccucagccuccuccauaugggcacugcgucaccgacucuggugucgucuacucggucgguaugcaauggcuuaagacacaggggaauaagcagauguuauguacuugccuggguaacggcgugagcugucaggaaacugcugugacgcagacauaugggggcaacaguaacggugagcccugcguacucccauucaccuacaacggccguacauucuacucauguacaacagagggcaggcaagauggacaucuauggugcagcacuacuaguaacuaugaacaggaucaaaaguacucuuucuguaccgaccacacggugcucguccagacucgaggcgggaacaguaauggugcccugugccacuucccuuuccuguauaacaaccauaauuacaccgauuguaccuccgaaggccggagggacaauaugaagugguguggaacuacacagaacuacgacgccgaccagaaguucggcuucugcccaauggccgcccacgaagagauauguaccacuaaugaaggcgugauguaccgaauuggagaucagugggauaagcaacacgauauggggcacaugaugagaugcacuugcgugggcaaugggcguggcgaguggacguguaucgcguacagucagcuccgggaucaguguauuguggaugauauuacauacaacgugaaugacaccuuccauaagcgccacgaagagggacauaugcugaacugcacaugcuucggccagggacgaggucgguggaagugcgauccagucgaucaaugccaggacucagaaaccgguaccuuuuaucagauaggcgacucuugggaaaaguaugugcacggcgugcgguaccagugcuauugcuacggucguggcauuggggaauggcauugccaacccuugcagacuuauccuucauccucgggucccguagaaguguuuauuacugaaaccccuagccaacccaacucucacccuauucaguggaacgccccccagcccagccauauuucaaaauacauccugcgguggcgcccgaaaaauagugucggccgcuggaaggaagcuaccaucccuggccaucugaauucuuauacgaucaaaggacuuaagccaggggucguuuacgagggacaguugauaucaauucaacaauauggucaucaagaagucacucguuuugacuucaccaccacuuccacaaguaccccggucacaucgaauaccgugacaggggagaccaccccauuuucaccucucguggcgacaucagaaucagucacugagaucacagcuaguucuuucguugucaguuggguguccgccagcgauaccgucaguggcuuucgaguggaauaugaauugagugaggaaggcgaugagccacaauaucuggaucuccccagcacagccaccucuguaaacauccccgaucuccugccagguaggaaauacaucgugaauguuuaucagauaagcgaggauggggaacagagcuuaauccugucuaccucacagaccaccgccccugaugccccuccggacaccacugucgaccaggucgaugacaccuccauugucguucguuggagccggccacaggccccuauaacaggcuaucggauugucuauuccccaucaguagaggggaguuccacagaguuaaaccuccccgaaacagcgaacucugugaccuugucugaccugcagcccgggguacaauauaauauaaccaucuacgcugucgaagaaaaucaggaguccaccccugucgugauacagcaggagacgaccgggacgccaaggucagauacugugccgaguccacgggaccugcaguuugucgaagugaccgaugugaaggucaccauaauguggacucccccggagagugccgugacagguuacagaguggauguuaucccggugaacuuaccuggugagcauggacagcgucugccaauuagucguaauaccuucgcugaggugacaggacugucgcccggggucaccuacuauuucaaggucuuugcuguuagccacgggcgagaaagcaagccucuuacugcccagcagacuaccaagcucgacgcgccuacuaaucuccaguucgugaaugagaccgacagcacaguucuggugcgguggaccccuccucgagcccagauaaccggcuaccggcucacaguggggcugacucgcaggggccaacccagacaguacaacguagguccaagcgugucuaaauacccccucagaaaccugcagccugcaucggaguauacagugucccuuguggccauuaaagguaaccaagaaucacccaaagccaccggaguauucaccacacuacagccuggcucaucuauuccuccuuauaauacugagguuaccgagaccacgauagugaucacauggaccccugccccacggaucggcuucaagcucggcguucggcccucccagggaggcgaggcuccccgcgaagugacuagugauagcggcucuaucguugugucugggcucacuccaggugucgaguacguguacaccauucagguccuccgggauggccaggagcgagaugcucccaucguuaauaagguuguuacaccccuuagcccuccuaccaaucuucacuuagaggcaaacccagauacaggagugcucaccguuuccugggagagaaguaccacuccggacaucacuggguaucggaucacuaccacuccaacgaacggccagcagggcaacucccuggaagagguggugcaugcggaccaguccuccugcaccuuugauaaccuuucuccuggguuggaguacaacguuucagucuauaccgugaaagaugacaaggagucgguucccaucuccgacacgauaauuccagcgguuccuccacccacugaucucagauucacgaacauuggaccagauaccaugcgcguuacuugggccccaccaccuaguauugaccucacgaauuuccuggugagguacuccccgguuaaaaaugaggaagacguagccgaacucuccaucucacccuccgacaacgccguaguuuugacgaaucugcugccaggcacagaauaugugguguccgugagcaguguguaugaacagcaugaaucuacuccccugaggggccggcagaaaacuggucuggauucuccuacagguaucgacuucagugacaucaccgccaacucauuuaccgugcacuggaucgcaccccgagcaaccauuaccgguuaucgcauuaggcaucacccagaacauuuuucagguaggccuagagaggauagagucccacacagcagaaacuccaucacucucaccaaucugacaccggggacugaguaugucgugagcauaguugcauuaaauggcagagaggagagcccacugcuuauuggccaacaaucuaccgucagugaugugccaagagaccuagaaguggucgcugccacuccaaccagccuguugaucaguugggaugcccccgccgucaccgugagguauuacagaauaacauacggggagaccggaggaaauucuccaguccaagaauucacaguuccuggcucuaaaaguacggcgaccauuagcggacucaagccuggcgucgacuauaccauuaccguguacgccguuaccggccggggcgauucuccugcuucgaguaaaccuauuucuauaaacuaucggacggagauagauaagcccucacagaugcaaguuaccgacguccaagacaauagcauuagugugaaguggcugccaucaucgucuccgguaacaggauaucgugugaccacaacccccaagaacggcccuggccccacaaagaccaagacugccgggccugaccagaccgaaaugacgauugagggcuugcaacccacagucgaauauguuguguccgucuacgcacagaacccaagcggagaaagucagccgcuggugcagaccgcugugacaaauaucgacagaccaaaaggccuugccuucaccgauguggacgucgauagcauaaaaaucgcuugggaaaguccucagggccaagucucucgauauagagugacauacaguuccccugaggauggcauucaugaauuguucccugcgcccgauggcgaggaggacacugcugagcugcagggacugcggccugggagcgaguacacuguuagugucgucgcacugcaugaugauauggagucgcagccacugaucggaacacagucgacugccauccccgcgccaacugaucucaaauucacucaagucacaccaacaucccugagcgcccaguggaccccccccaacgugcagcuuaccggcuaucgggucagagugacaccaaaggaaaagacaggcccaaugaaggaaauuaaucuugcuccugacagcucaagugucguuguuagcggauugauggucgccacuaaauaugaagugucugucuacgcacucaaagacaccuuaacuuccagacccgcucagggagucgugaccacccucgaaaacguuucuccuccuagacgugcacgcgugaccgacgccacagaaacuacaauaaccauauccuggcgcacgaaaacugaaacaauuaccggguuucagguugacgccgucccagcuaacggccaaaccccaauucagcggacgaucaagccagacguacgaucuuacacaaucacaggacuccagccaggaacugauuauaagaucuaccuuuacacccuuaacgacaacgccagauccucaccggucgugaucgaugcuagcaccgcaauugacgcacccucuaaucuccgcuuucuagccaccacuccuaacuccuuacugguuucuuggcaaccaccucgggccaggauuacugguuacaucaucaaauacgaaaaaccaggcucacccccccgagaagucgugccacgcccuaggcccggggugaccgaggcaacgauuacaggcuuggaaccugggaccgaguauacaaucuacgugauugcucucaaaaauaaccaaaaauccgagccauuaauagggagaaagaaaacugugcagaagacacccuucgugacgcaccccggcuacgauacugggaacggaauucaacucccaggaacuucuggccaacagcccucagugggccagcagaugauuuucgaggagcaugguuuucggcgcacaacaccuccuacgacggcaacaccuauccgccaccgcccaaggcccuauccacccaaugucggucaggaggcacugucgcaaaccacaauuagcugggccccguuccaggauaccuccgaguauaucaucucaugccaucccguggguacagacgaggaaccucuccaguuccgagugccuggaaccagcacgucugccacccuuaccggguuaacuaggggcgcaacguacaacguuaucguagaggcucugaaggaccagcaacgacauaaaguucgcgaggaaguggugaccguagguaauucggugaacgagggacucaaucagcccaccgacgauuccuguuucgaucccuauaccgucagucauuaugcuguuggggacgagugggaaagaaugucugaguccggcuuuaagcugcucugucaaugccucggauuuggaucuggacacuuccgaugugacuccagcagguggugccacgacaacggagugaacuauaaaauuggugaaaagugggaccgccaaggugaaaacggccagaugaugagcugcaccugccucgggaauggaaaaggggaauucaaaugcgacccacacgaggccacauguuacgacgacgggaaaaccuaucacgucggcgagcaguggcagaaggaauaucucggcgccaucugcucgugcaccugcuuuggugggcagaggggguggcggugcgacaacugccgaagaccagggggagagccauccccggaagguacaaccggucaauccuauaaccaguacagccagagauaccaucagagaaccaacacaaauguaaacugcccuauugagugcuucaugcccuuagacgugcaagcagacagagaagauucacgagaguag

SEQ ID NO: 31725 - RNA, 3312 nt, Artificial Sequence
  Description of Artificial Sequence: Synthetic coding sequence
cuccgguggacaccacucaacagcagcaccauuaucggguaccgcaucacaguuguggcugcuggggaagguauucccauauuugaggacuuuguggauucaucaguuggcuacuacacagugacgggacucgaacccggaaucgacuaugauaucagcgugauaacucugauuaacgguggagaauccgcaccuaccacuuuaacccaacaaacagccgucccuccaccuacugacuuaagauuuacuaacaucggcccagacacuaugagaguuaccugggccccaccaccgucaaucgauuuaacgaauuuucucguuagauauucuccggugaaaaacgaggaagacguggccgagcuguccauuaguccuagugauaacgcagucguccuaacaaaucugcugcccgggacugaauacgugguaagcguaucuagcguauacgaacagcaugagagcacaccguuacguggccggcagaagaccgggcuugauaguccuacagggaucgacuuuuccgacauuacagccaacucuuucaccgugcacuggauugccccacgggcaaccaucacaggauaucgcauucgccaccauccugagcauuuuuccggcaggccacgcgaagacagggucccccacagucggaacuccaucacccucacuaacuugaccccuggcacagaauacguggugucuauuguggcccugaacggacgagaagagucccccuugcucauagggcagcagucuacagucagcgacgucccccgagaccucgaggugguugcagcgacccccaccucacuacugauaagcugggacgcuccagcaguuaccgugcgguauuaccgcauaacauauggcgagacuggaggcaauucuccuguucaggaauuuaccguaccugggucuaaaucuacagcuacuauuucuggccugaaaccgggcguggacuauacaauuacugucuaugccguaaccgggcgcggagauucaccagcgaguuccaaacccauauccaucaacuauagaacagaaauugacaagccgucccagaugcaagucacagacgugcaggacaauagcauuagcgugaaauggcugccaucauccuccccagugaccggcuauagagucaccacaacucccaaaaacggccccgggcccacaaagacuaagacagccggaccugaucagacggaaaugaccauagaaggccuccagcccaccguagaguaugugguguccgucuacgcacaaaaucccagcggagagucccagccccugguucagaccgcagucacaaccauaccagcuccaacggaccuuaaauucacgcagguuacccccacuagccucagcgcccaauggacacccccuaaugugcaguugaccggcuacagaguaagagucacaccaaaagaaaaaaccgguccgaugaaagaaauuaaccuggcuccagauucaucgucggucguggugaguggccugaugguagccaccaaguaugagguuuccguguaugcccugaaagauacccucaccagcagaccagcgcaagguguagugacaacccucgaaaaugugucuccaccucgccgggcucggguaacggacgcaaccgaaaccaccaucacaaucucauggagaaccaaaaccgagaccaucacaggcuuccaggucgacgcagugcccgccaauggucagacuccuauucagagaaccaucaagccugacguuaggucuuacacaauaacuggacugcagccugggaccgacuauaagaucuaucuguacacgcuaaacgauaacgcccgaaguagcccagucgucauagacgccucuacagccaucgaugcuccgagcaaccugagauuucuggccaccacucccaauagccuccuugugaguuggcaacccccacgggcucggaucacgggcuacaucaucaaauacgaaaagccggggagcccccccagagaagucguuccaagacccagaccaggcguuacagaagcaacaauuacgggccucgaaccaggcacagaguacaccauuuaugugauugcccugaaaaauaaccaaaaaagugagccuuugauagggaggaaaaaaacggaugagcugccacaacuggugacccucccucauccaaaucugcaugggcccgaaauucuagacguaccaucuacugugcaaaagaccccauuugucacucacccuggcuaugacacugggaaugguauccaacugccggguacaagcggccagcagccuuccguaggucagcagaugauuuucgaggagcacggauuucggcgaaccacuccccccacuacugccacuccaauuagacauaggccaaggccuuauccgccuaacguuggugaggaaauccagaucggccacauuccucgagaagacguugauuaccaccuguacccccacggaccaggacucaacccaaacgcuuccacaggccaagaggcuuugagccagaccaccaucaguugggcaccauuucaagacaccuccgaauacaucauuagcugucaccccgucgggacugacgaggagccacuccaguuccgggucccaggcaccagcaccuccgccacucugaccggguugacuaggggcgccacuuacaacguuauaguggaggcucucaaagaucaacaacgccacaaggugcgcgaagaggucguaacgguugggaauucgguuaaugaaggguugaaucagcccaccgacgacucgugcuuugauccuuacacagugucacacuaugcagucggggacgagugggagcguauguccgaaucuggauucaaacuacuuugccaaugccucggguucggcagcggccauuucagaugcgacucuucaagauggugccacgacaauggagucaacuauaagauuggggagaaaugggacaggcagggcgagaaugggcaaaugaugaguuguaccuguuuagggaauggaaagggagaguucaagugugauccucaugaggccacuuguuacgaugacgggaaaaccuaucacgugggggagcaguggcagaaagaauaccugggcgcaauaugcucuuguaccugcuucggagggcaacggggcuggcggugcgauaacuguaggcggccuggcggugagcccaguccugagggcaccacuggccagaguuacaaccaguauagccagcgguaccaccagagaacaaacacuaaugugaacugcccgauugagugcuucaugccgcuggacguacaagcagauagagaggacagcagagaguag

SEQ ID NO: 31726 - RNA, 1062 nt, Artificial Sequence
  Description of Artificial Sequence: Synthetic coding sequence
auggagcucacugaguuacuucuuguggugaugcuguuguuaacggcgagauugacccucucaucuccagccccacccgccugcgaccuuagggugcugaguaagcuucuuagagacucccauguacuacacagccgucucucccaaugucccgaggugcauccucuuccuacaccgguccugcugccagcugucgacuucagucugggagaauggaagacucagauggaggaaacgaaagcccaggauauacucggggcugugacccuucugcuggagggagucauggccgcucgaggccagcuggggccuaccuguuuauccagccuccucggccaauuguccggacaaguaagauuauugcuuggagccuuacagagucuccuggguacacagcuaccuccacaaggccgcacuaccgcucauaaagaccccaaugcuauuuuucugucauuccagcaucuguuaagaggaaaggucagguucuugaugcucguggggggcuccacucugugcguaaggcgagcccccccuaccacagcagugccaucucggaccucccuggugcuuacccucaaugaacugccuaacagaacauccggucucuuggagacaaacuuuacugccucugcucggacaaccggaucgggacugcugaaguggcagcagggcuuucgggccaaaauucccggacuacucaaucagacaucaaggaguuuggaccaaaucccgggguaccugaaucguauacaugagcuuuuaaacggcacucggggucuguuccccggccccucucgucguacacucggcgcccccgacauaucgucuggcacgucugacacagguucccugcccccuaacuugcagccuggcuacucucccuccccgacucaccccccaaccggacaguauacccuuuucccucugccacccacacugccaacuccagugguacaacuacacccauuguugccagauccuagugcacccacccccacccccacuuccccucugcuaaacacgaguuauacacacucucagaaccuuucccaagaagguuag

SEQ ID NO: 31727 - RNA, 537 nt, Artificial Sequence
  Description of Artificial Sequence: Synthetic coding sequence
augacgguuuuagcuccagcuuggagccccaccacuuaccuacuuuugcuucuguuguuguccucuggccucucuggcacccaggauugcuccuuucagcacaguccuaucuccuccgacuucgccgucaaaauuagagagcucucagacuaccuucuccaggauuauccugugacaguugccuccaaucuccaggacgaagaacugugugggggccucuggcgacucgugcuggcucagagguggauggaaagacuuaaaacuguggccggcucaaagaugcaaggucuucuggagagaguuaauacugagauucauuucgugacaaagugcgcuuuucagccaccaccuuccugcuuaagauucguccagaccaauaucagccgcuugcugcaggaaacuucagaacagcucgucgcccucaagccuuggauaacccgccagaacuuuaguaggugcuuagaacuccagugccagcccgucgaaacaguuuuucauagaguuagccaggauggccuggaccuacugacgucuuag

SEQ ID NO: 31728 - RNA, 555 nt, Artificial Sequence
  Description of Artificial Sequence: Synthetic coding sequence
augucccggaccgcauacaccguaggggcguugcugcuccugcugggaacuuuacugcccgccgcagagggcaaaaagaaagggagccagggugccauccccccuccagacaaggcacagcauaaugacucagagcagacccagucaccucagcagcccggaagccguaacaggggacggggacagggcaggggcaccgcaaugccaggggaggagguacuagaaucaucucaggaagcucugcauguaaccgaacguaaguacuugaagcgcgacugguguaaaacccagccacuaaagcaaacuauucacgaagaggggugcaauucucgaacuaucauaaauagauuuuguuacggacaauguaauuccuuuuauauuccaagacacauucgaaaggaagaaggcagcuuccaaucuugcucguucuguaaaccaaaaaaguucaccacgaugauggugacauuaaauugcccugaacugcagccaccaacaaagaagaaaagggucacaagagucaagcagugcaggugcaucagcaucgacuuagauuag

SEQ ID NO: 31729 - RNA, 432 nt, Artificial Sequence
  Description of Artificial Sequence: Synthetic coding sequence
augucucguacggccuauacagucggcgcccuucuucugcuccuugguaccuuacucccugcggccgaaggcaaaaaaaagggcagucagggcgcuaucccuccaccagauaaggcauuacacgucacugaaaggaaguaucugaagagagauuggugcaagacccagccacucaaacagacuauacaugaagaaggaugcaauucacgcacaauuauuaauagguucuguuacggacaguguaauagcuucuauauaccacgccacaucagaaaagaggaggggaguuuccaguccugcuccuuuugcaagcccaaaaaauucacaacuaugaugguuacccugaauuguccagaacuacagccuccaacuaagaaaaagagagugacucgggugaaacagugcaggugcaucuccauugaucucgacuag

SEQ ID NO: 31730 - RNA, 432 nt, Artificial Sequence
  Description of Artificial Sequence: Synthetic coding sequence
auguccagaacggcauacacagucggggcccuccuauugcuguuaggaacccugcuccccgcugcugaaggaaagaagaagggcucucagggcgcuauaccuccacccgacaaagcgcuccaugugacggagcggaaauaccuuaagcgagauuggugcaagacccagccacuuaaacagaccauccacgaggaggguugcaauucccgcacuauuaucaaccgauuuugcuacggacaguguaacuccuucuacauaccuaggcacauucggaaagaggaaggaucuuuccaguccugcucauucuguaagcccaaaaaguucacaacaaugauggugacccucaacugucccgaacugcagccacccacaaagaagaaaagagugacucgcgugaagcaguguagaugcaucaguaucgauuuagauuag

SEQ ID NO: 31731 - RNA, 2976 nt, Artificial Sequence
  Description of Artificial Sequence: Synthetic coding sequence
augcauuccccuggagcugacgguacacaggucuccccaggagcucacuacugcaguccuacuggggcagguugcccccgccccugcgcggacacccccgggccacagccccagccuauggaucuucggguuggacagcgucccccuguggaaccgccaccagaacccacucuguuggcccugcaaaggccacaaagacugcaucaccaucucuuccuggcuggccugcaacagcagaggagcguggaaccuaugcgccuuaguauggauacaccaaugccagagcugcaaguggggccgcaagaacaggagcuucgucagcugcuccacaaagacaagagcaagagaucagcuguggcuucaagcguggugaaacagaaauuagccgaagugauauuaaagaagcagcaagccgcccuggaacggaccguccauccaaauucccccggaauuccauaccgaacacuggaaccccuggagacugagggcgcgacuagaucaaugcuaucauccuuucucccccccgugccuagccugccaucugauccccccgagcacuuccccuugagaaagaccgucucugaacccaaccugaaacugcgauacaagccaaagaaaagucucgagcgacgaaagaauccacugcuccgcaaggaaagcgcaccucccagccugaggagacggccugcugagaccuugggcgacucaucaccaaguagcucauccacccccgcaucuggauguucuucccccaacgacucugaacaugggccgaaucccauccucggaagugaagccuuacuggggcagcgccugagacugcaggagaccagcgucgcccccuuugcccugccaacgguguccuuguuaccagccauaacuuugggccugcccgcgccagcgagagcagacuccgauaggcgcacucacccuacccucgggccacgcggacccauacuugggagcccacauacuccacucuuucuuccucaugguuuggagccugaagcagguggcaccuugccgagccgucugcagccuauucugcuucucgacccgagcggcucucacgcuccccuacuuacgguccccgguuuggguccucugccauuucauuucgcacagucacugaugaccacagaaaggcucucaggcucaggucuucacuggccgcucagcagaacacgauccgaaccccugccaccaucugcuaccgcacccccuccgccgggcccuaugcagccuaggcuggagcagcugaagacacacgugcaagugaucaaaagaucugccaagccuucugagaaaccacgccuucgccagauaccgagcgccgaggaucuggagacugauggugguggccccggacaggugguggaugacggacuugagcacagagaacuggggcacggccagcccgaggcccggggccccgccccguugcagcaacacccacaagucuugcucugggaacaacagcgguuggcgggcaggcuuccucgggggagcaccggggacacaguacuccugccauuggcccaggggggccacaggccccucucaagagcucagaguucacccgccgcccccgcaucgcucagugcaccagagcccgcuucacaggcuagggugcuguccucgucagagaccccagccagaacccugccauuuacuacgggccugaucuaugacucaguaaugcugaagcaccaguguucuugcggcgauaacagccgccacccagaacacgcugggcguauacaaucaauuuggucgcgcuugcaagagagagggcuuaggagucaaugcgagugucugagaggucgcaaagccagucuggaggaacugcagucuguccauuccgaaagacauguuuuacucuacgggaccaauccccugucucgguugaagcuugauaauggcaaacuggcaggcuugcuugcccaacgaauguuugucaugcugccuuguggcggagucgguguagacacagacaccaucuggaaugaguuacacucaucaaacgcugcacgaugggccgcugguucuguuacugaucuagcuuucaagguggcauccagagaacucaagaacggcuucgcgguggugagaccaccaggccaucaugcugaccauagcacugccaugggcuucugcuucuuuaacaguguggccaucgcuugucgacagcuacaacagcaauccaaagccucuaaaauacuuauaguggauugggacguucaucacggaaacggaacacagcaaaccuucuaccaagaccccucaguguuguacaucucucuucauagacacgaugacgggaauuucuuucccggcuccggcgcaguggacgagguaggagcagggaguggggaaggauuuaacgucaacguugcuugggccggcggccuugaucccccaaugggggaucccgaauaccuggccgccuuucggauugucgugaugcccauugccagagaguuuuccccagaucugguguuagucucagcuggcuucgaugcugccgagggucacccagccccucucggagguuaccacguuuccgccaaguguuucggcuacaugacccagcaguugaugaaccucgccggcggugcagugguucuugcccuggagggagggcaugaucugacugcuauaugcgaugcgagcgaagccuguguugccgcucugcugggcaaccgggucgacccccugucggaggagggcuggaagcagaagccuaacuuaaacgccauuagaucacuggaagcaguaauucgugugcacaguaaauacugggguugcaugcaaaggcucgcaucuuguccugauagcugggugccaagggucccuggcgcugauaaggaggaaguggaggcugugacagcgcuugcaucccuaaguguugggaucuuagcagaggauagaccaagcgaacaauugguggaggaggaagagccuaugaaccuguag

SEQ ID NO: 31732 - RNA, 588 nt, Artificial Sequence
  Description of Artificial Sequence: Synthetic coding sequence
augggcaaaaucucaucucugcccacucagcuguucaaaugcugcuuuugugacuuccugaaagucaagaugcauacaaugagcaguagccacuuauucuaccuagccuugugucuguugacguucacaucaagcgcuacagcuggcccugaaacccugugcggugcugaguuaguggacgcccuucaguucguguguggggaucggggauucuauuucaauaaacccaccggcuaugguuccagcucacgucgcgcuccccagacuggcaucgucgaugaauguugcuuucggucgugugauuuaagacgccuggagauguauugugcuccacucaaacccgcuaaaagugcaagaucaguaagggcacagcggcacacagauaugccuaagacacagaaguaucagccccccuccacuaacaaaaacacuaagucucagagaagaaagggguggccaaagacccauccuggcggcgagcagaaagaggggacggaggcuagucugcagauuaggggcaaaaaaaaagaacaacggagggagaucggcagucggaacgcggagugucgaggcaaaaaaggcaaguag

SEQ ID NO: 31733 - RNA, 462 nt, Artificial Sequence
  Description of Artificial Sequence: Synthetic coding sequence
auggggaagaucucaagccuaccuacccagcuguucaaguguuguuuuugcgacuuucugaagguuaagaugcacacaauguccagcucacaccuguucuaucucgcgcucuguuuacuuacauucacaucauccgcaaccgccgggccagaaacucuuuguggugccgagcuuguugacgcccugcaguucguguguggggacagaggauucuacuucaauaaacccaccggguacggaucaagcucacgucgcgcuccucagacaggaaucguagacgagugcuguuuucgaucgugcgacuuaagacgauuggagauguacugcgcuccacucaaaccugccaaaagcgcgcggagcgugcgugcacagagacauacugacaugccuaaaacacaaaaggaggugcaccucaagaaugcaagccgaggcuccgcuggcaacaagaauuacagaauguag

SEQ ID NO: 31734 - RNA, 477 nt, Artificial Sequence
  Description of Artificial Sequence: Synthetic coding sequence
augggaaagaucaguagccuuccaacacaacuuuucaaguguuguuuuugcgacuuccuuaaagugaagaugcacacuaugucuagcucccaccucuuuuaccuggcacucugccuccugacguuuacaucaucugcaacugcuggcccagagacacuuuguggagccgaacugguggacgccuuacaguuuguuugcggggaucggggguucuacuuuaacaagccgacaggauauggaucaucauccaggcgagcuccccagacugguauuguggacgaaugcugcuucagaucaugugaucugagacgacucgaaauguacugcgccccacucaaacccgcuaaaagcgcgcgcaguguacgagcucagcgccauacagacaugcccaaaacccaaaaauaucaaccaccaaguacgaacaagaacaccaaaagucagagaaggaagggaucaacuuucgaggagcgcaaguag

SEQ ID NO: 31735 - RNA, 420 nt, Artificial Sequence
  Description of Artificial Sequence: Synthetic coding sequence
cugaaagugaaaaugcacaccaugaguaguucacaucuguuuuaccuggcccugugucuguugaccuuuaccagcagcgcuacagcgggacccgagacccucugcggcgccgaacuggucgaugcccuucaguuugugugcggggauaggggauuuuauuucaauaagccaacaggcuacggauccucaucaagaagggccccacaaacaggaauuguggacgagugcugcuuccgcagcugcgaccugagaagauuggagauguacugugcgccacuaaaacccgccaaguccgccagaagcguccgagcacaacgccacaccgacaugccaaagacccaaaaguaccaaccaccuucgacuaacaagaacaccaaaucucaaagacgaaagggaucgacauuugaggagcgcaaauag

SEQ ID NO: 31736 - RNA, 414 nt, Artificial Sequence
  Description of Artificial Sequence: Synthetic coding sequence
augaucacaccuaccgucaaaaugcacacuaugaguagcagccaucuauucuaccuugcucugugucuucucaccuucacuucgagugcuaccgccggcccggaaacuuugugcggcgccgaauuaguugacgcccuccaguuuguaugcggcgaccgaggguucuauuucaauaagccuacagguuaugguuccuccucaaggcgugcuccacagaccggcauuguggacgagugcugcuuuagguccugcgaccugaggagacucgagauguauugugccccccucaaacccgcaaaaucagccagaucaguuagagcccagcggcacaccgacaugcccaaaacccagaaagaagugcaucucaagaacgccuccaggggcucagcagggaauaagaacuaucgaauguag

SEQ ID NO: 31737 - RNA, 477 nt, Artificial Sequence
  Description of Artificial Sequence: Synthetic coding sequence
augggaaagauuaguagcuuaccgacccaguuguuuaagugcuguuucugcgauuuucucaaagucaaaaugcacaccaugucuuccucucaccuguucuaucucgcucucugucuucugacuuuuacaagcucugcaacugccggucccgaaacacuguguggugcugagcugguugaugcucuacaguuuguuuguggagaccgaggcuuuuauuucaacaaacccaccgguuacgguucaagcucaagacgggccccccagacagggaucguugacgaauguuguuuccguuccugcgauuugcgcagacuugagauguacugugccccacuuaaaccugccaaguccgcccgauccgucagggcccagcgucauacugacaugccaaagacacaaaaauaucaaccucccucuaccaauaaaaauacaaaaucucagaggagaaaaggcucuaccuucgaagagcguaaauag

SEQ ID NO: 31738 - RNA, 876 nt, Artificial Sequence
  Description of Artificial Sequence: Synthetic coding sequence
augcaaagagcacgcccaacucuuugggccgccgccuugacucuccuugugcuacugcgggggccucccguugcaagggcuggcgcgucuucagccggcuuagguccaguggugaggugugaaccuugugaugcccgcgcccuggcccaaugcgccccaccccccgcagucugcgcugaacugguccgggaaccuggcuguggauguugcuugacgugcgcacucucagaaggccagccaugcggcauauauacagaacguugcggcagcgggcucaggugucagccaucgcccgacgaggcuagaccucuccaggcacuacucgacggaagaggccugugugugaacgccucugcagucucccgccucagagcuuaccuacuccccgccccuccggcgccuggaaaugcaucugagagcgaggaagacagauccgccgggucaguugaaagccccucuguuagcagcacccaccgagugagugacccaaaguuccauccucuacauucgaagauuaucaucauaaagaagggccacgccaaagacucacagcgcuauaaaguugacuacgagucccagagcacagacacucaaaacuuuucuagcgaaaguaaaagggagacagaauauggaccgugcagacgagaaauggaagacacucuuaaucaccugaaauuuuuaaacgugcucaguccaagggggguccauauuccuaacugcgacaagaaaggguucuauaaaaagaaacagugucgaccauccaaggggaggaaaaggggauuuuguuggugugucgacaaguauggacaacccuuacccggcuauaccaccaaggguaaagaagacguacauugcuauucaaugcagucuaaguag

SEQ ID NO: 31739 - RNA, 894 nt, Artificial Sequence
  Description of Artificial Sequence: Synthetic coding sequence
augcagagggcuagacccacccucugggccgccgcccugacucugcucgucuugcuccgcggaccaccgguggcaagggcaggcgcaagcucugccggccugggaccagucguccgcugugaaccaugugacgcucgcgcguuggcccaaugcgccccaccacccgcugugugcgcugagcuggugcgcgagcccgguugcggcuguugucuaacuugcgcccugucugagggacagccgugcggcauuuauacugaacguuguggaucgggccuucgcugccagccuucccccgaugaagccaggccgcugcaggcccuccuugacggucguggccuguguguaaaugcuucugcugucucccguuugagagccuaccuacugccugccccucccgccccuggagaaccuccugcuccagguaaugcaucugaaucagaggaagauagauccgcuggauccguugagagcccuagcgugucaucuacucauagaguauccgauccgaaauuccacccucuacauucaaaaauaaucauaauuaaaaagggccacgcgaaagauucccagagauauaagguagacuaugagucccaaucuaccgauacccagaauuucucuucugaaucaaagagggagacugaguaugguccuuguaggagggaaauggaggauacucuuaaucaucuaaaguuuuuaaaugucuuaucaccucgcggcguccacaucccuaacugcgacaaaaaggguuucuauaagaaaaaacaaugcagacccucgaaggggagaaagcgcgguuucugcuggugcguggauaaguacggccagccacuccccggguacacaacgaaaggcaaggaagacguccacugcuauucaaugcaauccaaguag

SEQ ID NO: 31740 - RNA, 585 nt, Artificial Sequence
  Description of Artificial Sequence: Synthetic coding sequence
augcaacgggcucggccuuuacaggcccuccuggacggcagaggacugugcgugaaugcaagcgccguuagcagacuuagggccuaccuccuuccagcucccccugcaccgggcaaugccagcgagucggaagaagaucgaucugccgggucuguggagucgccaagugucagcucuacccauaggguuuccgaccccaaguuccacccacuacauaguaaaaucauuaucauuaagaagggucacgccaaagacucacaaagguacaaaguugacuaugagucccaaagcaccgauacacaaaauuucagcuccgaguccaaaagggagacagaauacggaccuugucggcgagaaauggaggacaccuuaaaccaucugaaguuuuugaauguauuaucgccacgggggguccauauuccuaauugugacaaaaagggcuucuacaagaagaaacaaugcaggccgucgaaaggacgaaagcgaggcuuuugcuggugcguagauaaauauggucaacccuuaccugguuacacgacuaagggcaaggaggacguucacugcuauaguaugcaguccaaauag

SEQ ID NO: 31741 - RNA, 462 nt, Artificial Sequence
  Description of Artificial Sequence: Synthetic coding sequence
ugaucugaggaggaccgaagugccgguucugucgaaaguccgucaguuagcucuacacaucguguuuccgauccaaaauuucauccuuugcacuccaaaaucaucaucaucaagaaggggcaugccaaagacagccagcgcuauaaagucgauuacgagagccaaaguacagacacucagaacuucucuuccgaauccaagcgcgaaaccgaauacggcccauguaggcgagaaauggaggauacccuaaaccauuuaaaguuucuuaacguucugaguccacgcggagugcacauucccaacugugauaagaagggcuucuauaagaaaaagcaaugucggccaagcaaaggccgcaaaagaggcuucugcugguguguagauaaguacggccaaccauugcccggguacaccacaaaaggaaaggaagauguucacugcuauagcaugcaguccaaguag

SEQ ID NO: 31742 - RNA, 432 nt, Artificial Sequence
  Description of Artificial Sequence: Synthetic coding sequence
ugagaaucaccuucuguuuccagcacccaucggguguccgacccuaaauuccauccccuccacuccaaaaucaucaucauuaagaagggacaugccaaagacucacagagauacaagguggacuaugagucccagagcaccgauacacagaauuuuucaagcgagucaaagcgggaaacagaauauggacccugucgacgggagauggaagauacguugaaucaucugaaauuccucaauguucucaguccacggggcgugcauauucccaauugugauaaaaaggguuuuuacaagaaaaaacaauguagaccaucaaaggggcgaaagaggggauucugcugguguguagacaaguacggucaaccacuccccggcuacaccacuaaaggaaaggaagacguccauugcuauagcaugcagaguaaguag

SEQ ID NO: 31743 - RNA, 792 nt, Artificial Sequence
  Description of Artificial Sequence: Synthetic coding sequence
augcagagagcccggccuacacucugggccgccugugagccaugcgacgccagagcccuugcccagugcgcuccaccccccgcuguuugugcugagcuggucagagaaccaggcuguggaugcugccucaccugugcacuuucagagggccagccgugcgggaucuacacagaacggugugggaguggccugcggugccaacccagcccugaugaagcaagaccucuucaggcccuccuggacggcaggggcuuaugugucaacgcuucagcugugucucgucuuagagccuaccugcugccagcgccacccgccccaggcaacgcaucugaaagugaagaagacagauccgccggcucugucgaaucuccaucaguuuccaguacacacagaguguccgaccccaaguuccacccccuacacucaaagaucaucauuaucaagaagggccaugccaaggacucgcagcgauauaaaguagacuacgaaucacaaucaacagauacccagaauuucuccagcgaaucaaagcgcgaaacagaguacggucccugucgccgagagauggaggacacgcugaaccauuugaaguuucucaauguccuguccccuagggggguucacaucccuaauugcgauaagaagggguucuauaagaaaaaacaguguagaccgagcaaaggccgaaagaggggcuucuguuggugcguugauaaauauggacagccguugccagguuacacaacaaaaggaaaggaagaugugcauugcuacaguaugcagaguaaguag

SEQ ID NO: 31744 - RNA, 834 nt, Artificial Sequence
  Description of Artificial Sequence: Synthetic coding sequence
augagggcccuuaggcucggcgccgaagaccagccauugccggcuuggauuccccaguuacgggcgguuuauugucgaccuauuccggcccggccagcuugccaggccgcuugucccggaugccgccgccaugccgccggagcaacacaugcccuugggagaugugccgacagugccggcgccgcaccccgagccgcggggggugcagguuggagagaacuggguggccugggaagucgaggugcacugagagccgugagacaccuucaccgagcccuucuagacggaagaggucugugcguaaaugcgucagcagugagucgucuccgagccuaccugcugccagccccucccgcucccggcaacgcuuccgagagugaagaagaccggucugccggauccguggagagcccaagugucagcuccacacaccgggugagcgauccgaaguuccacccuuugcauagcaagaucauuauaauuaaaaagggacacgcaaaggauucccaacgguacaaggucgacuacgagagccagucuaccgacacgcagaauuucuccagcgaaaguaagcgcgagacugaguauggccccugucggagggaaauggaggauacccugaaccaucugaaguuuuugaauguucugucuccgcggggugugcauauuccuaauugugauaaaaaagguuucuauaagaaaaaacagugcaggcccuccaaaggucgaaaacggggauucugcuggugcgucgacaaauaugggcagccucucccuggcuacaccacuaaaggaaaagaggacgugcauugcuauucgaugcagucgaaguag

SEQ ID NO: 31745 - RNA, 570 nt, Artificial Sequence
  Description of Artificial Sequence: Synthetic coding sequence
augcagcgcgcaaggccuaccuuaugggcggcagcacugacacugcuugauggaagagggcuuugcgccuaucugcuuccugcgcccccugccccggggaaugcuucugagucugaggaagacagaagcgcgggauccguugaaucucccagcgucagcaguacccacagagucagcgauccuaaguuccacccccuucauucuaaaauuauuaucaucaaaaaaggacaugccaaagacucccagcgguacaagguugauuaugagucacaauccacggauacccagaacuuuaguuccgagucuaaaagggaaacugaguaugggccgugcagaagagagauggaggacacucugaaucaccuuaaauuccugaacguccugucaccacgugguguucacauuccgaacugcgacaaaaaaggguucuauaagaaaaaacaaugccgaccaucuaaaggacggaagagaggcuuuugcugguguguggauaaauacggacagccacugcccggauacacaaccaaagggaaggaagacguucacugcuauucuaugcaaucuaaauag

SEQ ID NO: 31746 - RNA, 807 nt, Artificial Sequence
  Description of Artificial Sequence: Synthetic coding sequence
augcaaagggcccggccaacauuaugggcagcggcucugacucuccuuguucuucucagaggcccaccuguggcccgugccggagcuuccagcgcugggcuggguccagugguccgcagggaaccugguugcggcuguugccugacuugcgcucucucugagggacagccaugcggcauuuauacggaaagauguggauccggucuaagaugucaacccucccccgaugaagcucgcccacuccaggcccugcuggacggacggggcuugugcgugaaugcaucugccguuucuagacugcgugccuaucuccucccugcaccuccagcaccuggaaacgcuagcgagucugaagaggaucgcucugccgguucagucgaaagcccuucggugucuagcacucaccgcguuucugauccaaaguuucacccauugcauuccaagauuauuauaauuaagaaagggcaugcaaaagacagucagcguuacaaggucgacuacgagucucagaguacggauacccaaaacuucuccagugaguccaaaagggagacugaauacgguccuugccggagagaaauggaggauacuuugaaccaccugaaguuccugaacgugcuaucgccuagagggguucacauccccaauugugauaagaaaggguucuacaagaaaaaacagugccgcccauccaaggggcgcaaaaggggguuuugcuggugcguugauaaguacggacagcccuugccugguuauacuaccaaggguaaagaggacguacauugcuacucuaugcagucaaaauag

SEQ ID NO: 31747 - RNA, 2397 nt, Artificial Sequence
  Description of Artificial Sequence: Synthetic coding sequence
augaaccuccagccuauuuucuggauuggauugaucucuucagucugcugugucuuugcccaaaccgacgaaaauagaugucuaaaagcgaaugcaaagagcugcggggaguguauccaagccggaccgaacugcggauggugcacaaacucaacguuucuucaggaggguaugcccacauccgcuagaugcgacgauuuggaagcuuugaaaaaaaaagggugcccucccgaugauaucgagaacccuaggggcucaaaagacauuaaaaagaacaagaacguuaccaaucgaucuaaagggacagccgagaagcuuaagccagaagacaucacccagauccaaccacaacaacuuguccuccguuuaagguccggggaaccacagacuuucacacugaaguuuaagcgggccgaggacuaucccauugaccucuauuaccucauggaccugagcuacucuaugaaagacgaccucgagaacgucaagucacugggaacugaccuaaugaacgaaaugagacgcauuacaagugauuuuaggauaggcuucgggagcuucguugagaagacugugaugcccuacaucagcacaacaccugcuaaacugagaaacccauguacaucugaacagaauugcaccagcccguucucuuacaaaaacguguugucucugaccaauaagggagaaguguucaaugaacuggugggcaaacaacguauaagcggcaaccucgacaguccugaaggcggcuucgaugcgaucaugcaggucgccgucuguggcucacugauaggguggcgcaaugugacccgacuucuuguguuuuccacagacgcaggauuccacuucgccggagauggaaagcuuggcgguaucguucugccaaacgaugggcagugccaucuggagaacaacauguacaccaugagucauuacuaugauuacccaucuauagcccaucucgugcagaagcucucagagaauaauauccagaccauauuugccguaacagaggaguuucagcccgucuauaaagagcugaagaaccuuauucccaaguccgcgguggguaccuugucagccaacucaucuaacgugauucagcugauuauagacgcauacaacagucugucaucugagguuauucucgagaauggcaagcuaagugaaggagucacuauuuccuauaaguccuauugcaaaaaugguguaaaugguacaggcgagaauggccgcaaaugcuccaacauauccauuggcgaugagguucaguuugagauuaguaucaccagcaauaaauguccaaaaaaggacuccgacuccuucaagaucaggcccuuaggguuuaccgaagaaguggagguuauauuacaguacauuugugaaugcgagugccaguccgaggggaucccagagucucccaaaugccacgagggaaauggcacauuugagugcggcgcuugucgauguaacgagggaagagugggucgccacugugagugcuccacggaugaagucaauagcgaagacauggacgccuauugcaggaaagaaaacucaagcgaaaucuguuccaauaauggggagugugucugcggacagugcgucuguagaaagagagacaauaccaaugagaucuacagugggaaauuuugugagugugacaauuucaacugcgaucgcucuaauggcuugaucugcggcggaaacgggguauguaaguguagagucugcgaauguaauccuaauuacacaggauccgcaugcgauuguucccucgacacuaguaccugugaggccaguaacgggcaaauuuguaacggccgcggaaucugugaauguggcgugugcaaaugcaccgaccccaaguuucagggacagaccugcgagaugugucagacaugccugggugugugcgccgagcauaaagaaugugugcaguguagggcuuucaauaaaggugagaaaaaggacaccugcacccaggagugcuccuacuuuaauauuaccaaaguggaaucucgggauaagcucccacaaccugugcaacccgacccuguuagucauugcaaggaaaaggauguagaugacugcugguuuuauuuuaccuauuccguaaacggcaauaacgaaguaaugguccacgucgucgagaauccagaauguccaacaggaccugauaucauuccaaucguagccgggguuguggcaggcauaguucucauugggcucgcccuguugcugaucuggaagcugcucaugaucauccacgauagacgcgaguuugccaaguuugagaaagaaaagaugaacgccaaaugggacaccggcgagaacccgaucuacaaaagcgccgucaccacuguugucaauccuaaguaugaaggcaaauag

SEQ ID NO: 31748 - RNA, 2478 nt, Artificial Sequence
  Description of Artificial Sequence: Synthetic coding sequence
augaaucugcaaccaauauucuggaucggccuaaucuccucuguaugcugcgucuuugcucagacagacgagaacaggugccugaaagcaaacgccaagucauguggcgaauguauucaagccgggccaaauugcgguugguguacgaacucuaccuuccugcaagaggguaugccuacuucugcacgcugcgaugaccuggaggcccuaaaaaaaaaaggaugucccccugacgacaucgagaacccaagagggagcaaagauauuaagaagaauaagaacgugacuaauagaucaaagggaacagcggagaaacugaaacccgaggacauuacucaaauccagccacagcaacucguuuuacggcucagguccggggagccgcaaaccuuuacauuaaaauuuaaaagggcagaagacuauccaaucgaucuguauuaccugauggaccuguccuauuccaugaaggacgaucuggaaaacguaaaaagucucggaaccgaccugaugaaugaaaugcguagaaucaccuccgacuuccgaauuggauucggauccuuuguggaaaagacgguuaugcccuacaucagcacgaccccagcuaagcuccggaacccaugcacuucggagcaaaauuguacaaguccuuucucauacaagaacguguuauccuugaccaauaaaggggaaguguucaaugagcuggucgguaagcagagaauuagcggcaauuuggauucuccagagggcggauuugaugcuaucaugcaggucgccgucugcggaagucugauugguuggcggaaugugacgcgacucuuaguguuuaguaccgaugcuggauuccauuucgcuggggacgggaagcuuggcggaauagugcuucccaacgaugggcaaugucaucuugagaacaauauguauaccaugucucauuauuaugauuauccaucaauugcacacuugguacaaaagcucucugagaacaacauacagaccaucuucgccgugacugaagaguuucagcccguuuauaaggaacuaaagaacuugauuccuaaguccgccgucgggacacucuccgccaauuccagcaacgugauucaacuaauuaucgacgccuauaacucauuaucuucagaagugauccuggaaaacgggaagcuuucagaaggcgugacuaucucauacaagucauauugcaaaaaugguguaaauggcaccggagaaaacgggcgaaagugcuccaauaucaguauuggggaugagguucaguuugagauuucaauuaccagcaacaaaugccccaaaaaggauucagacagcuucaagaucagaccuuuaggauucacugaagagguggaagucauucugcaguacaucugcgagugcgaaugucagagcgaagggauuccugagucccccaagugccaugaagguaacggcacuuuugagugcggcgcgugucggugcaaugaggggcgcguggggaggcacugugaguguucaacagaugaggugaauuccgaggacauggaugcuuauugcaggaaggagaacucauccgagaucuguucuaauaacggggagugcgucuguggacagugcguuugcaggaaaagagacaauaccaacgaaaucuacaguggcaaguucugcgagugcgacaauuucaauugcgauaggagcaacggguugauuuguggagguaacgguguaugcaaguguagaguaugugaaugcaaucccaauuauaccggauccgccugugacuguagccucgauacaaguacuugugaagcauccaaugggcagaucugcaacgggcgagggaucugugagugcggcguguguaagugcacagaccccaaguuccaggggcaaaccugcgaaaugugucaaacgugucuggguguaugugccgaacauaaggaaugcguucaguguagagcguucaauaagggggagaaaaaggacaccugcacgcaagaauguagcuauuuuaacaucacuaaaguagagagcagagacaaacuuccucagcccguccaaccggacccuguaagucauugcaaagagaaggacguggacgauuguugguucuacuuuaccuauucagugaacgguaauaacgaggucaugguacauguugucgagaauccugaaugucccaccggcccugauaucaucccuaucguggcaggugucguggccggcaucgucuuaauaggccuggcccugcugcugaucuggaaauuauugaugaucauucacgaucgucgagaauucgccaaauucgagaaggagaagaugaacgccaagugggacaccucccugagcguugcgcagcccggugugcaguggugcgacaucaguagccuccagccacugacaucccgauuucaacaguucuccugcuuaucacuuccaucuacaugggacuaucgcgugaagauucuguucauacgugugccauag

SEQ ID NO: 31749 - RNA, 2397 nt, Artificial Sequence
  Description of Artificial Sequence: Synthetic coding sequence
augaaccuccaaccaauauuuuggaucggacugauuagcucuguuuguugcguguucgcacagaccgacgaaaauagaugucuaaaggcuaaugcaaagaguugcggagaaugcauacaagccgggccaaauugcggcuggugcaccaauucgaccuuucugcaggaagggaugcccacguccgccagaugcgaugaccuggaggcucugaagaaaaaaggcugccccccggaugacauagaaaaucccagagguucuaaagauauuaagaagaacaagaacgugaccaauaggaguaaagggacugccgaaaaguugaaaccagaggauauuacucaaauucagccgcagcagcucguucuuagacuaagaucgggggagccacagacguucacccuuaaauuuaagcgagcagaagacuacccgauugaucucuauuaucucauggacuuaagcuauagcaugaaggacgacuuggagaaugugaaaucacuuggaaccgaccugaugaacgaaaugaggcgcaucacguccgauuuccggauuggcuuugguaguuuuguagaaaaaaccgucaugcccuacaucaguaccaccccugccaaacugcgaaauccauguacaagugaacagaauuguacaucgcccuuuagcuauaagaacgugcucucucuuacaaauaagggcgaaguguucaaugaauuggugggcaagcagaggaucucugguaaucuggacucaccggaaggcggauuugaugcuaucaugcagguggccgugugcggcuccuuaaucggauggaggaacguaacuagacuccucgucuuuucuacugacgcaggcuuccauuucgccggggacggaaaacuugggggcauugugcugccgaaugauggucagugucacuuagaaaacaauauguacacuaugucucauuacuacgacuaucccagcauagcccacuuaguccaaaagcugagcgaaaacaauauucaaacgaucuucgccguuaccgaggaguuccagccgguguacaaggaacuuaaaaaucucaucccuaagagugccgugggcacucugucugccaacuccagcaacgugauucaguuaaucauugaugcauacaauagccuuagcucagaaguuauccuggagaauggaaagcugagugagggugucacuauaagcuacaaaagcuacugcaaaaauggugugaaugggacuggcgagaacggacgcaaauguuccaauauuagcaucggagacgaagugcaguuugagauuaguauuacauccaacaaauguccaaagaaggauucggacaguuucaagauccggccacucggauucaccgaagagguugagguaaucuuacaguacaucugcgagugcgagugucagagugagggcaucccagagaguccgaagugucaugaaggcaacgguacuuuugaguguggggcgugcagguguaaugagggucgagugggucgucacugcgaauguaguacagaugagguuaacucagaggacauggacgccuauugucgcaaggaaaauaguucugagauaugcagcaacaauggagaaugcgugugcggccagugcgucuguagaaaaagggacaacaccaaugagaucuauucggggaaguucugcgagugugacaauuucaauugugauagaagcaauggccugauuuguggcgguaauggcguuugcaaauguagggugugugaauguaauccuaacuacaccggcagugccugugacugcucucucgacacuucuacaugugaagcuucaaacggucagaucugcaauggaagaggcauuugugaauguggcgucugcaagugcacggaccccaaauuccagggucagacgugcgagaugugccagacaugucucggcgugugugcagagcauaaggaaugcgugcaaugccgagcauuuaauaaaggagagaaaaaagauacguguacccaagagugcucuuacuuuaauaucacuaaagucgaaaguagggauaaguugccccagccugugcagccagauccaguuagucauugcaaggaaaaggauguggaugacuguugguuuuauuucacauauagcgugaacgguaauaacgaggugauggugcacgucgucgagaacccagaaugcccuacaggaccugauaucauaccuaucgucgccggcgucguggccggaauugugcuuauaggguuggcacugcucuugauuuggaagcucuugaugauuauccacgaccggagggaauucgccaaauucgagaaagaaaagaugaaugcaaaaugggacaccggagagaacccaauuuauaaaucagcaguaacaacuguagugaauccaaaguacgaggguaaguag

SEQ ID NO: 31750 - RNA, 150 nt, Artificial Sequence
  Description of Artificial Sequence: Synthetic coding sequence
augaaucugcagccaaucuuuuggauaggacuaauuaguaguguguguugugucuucgcccaaacugacgagaacagaugucugaaagcuaaugcaaaguccuguggagaauguauucaagccggccccaacuguggauggugcacauag

SEQ ID NO: 31751 - RNA, 270 nt, Artificial Sequence
  Description of Artificial Sequence: Synthetic coding sequence
augaaucuucagccuauuuucuggauuggacugauaucaagcgugugcuguguuuucgcccagaccgaugaaaaccgaugccugaaagccaaugcgaaaucuuguggggaauguauccaggccggaccaaacugcgggugguguaccaauucaacuuucuugcaggaggggaugccaaccagcgccagaugcgacgaccuggaagcccuuaagaaaaagggaugcccacccgaugacauugagaacccaagggggagcaaagauauuuag

SEQ ID NO: 31752 - RNA, 2406 nt, Artificial Sequence
  Description of Artificial Sequence: Synthetic coding sequence
augaaccuccagccuaucuuuuggaucggacucauaucauccgugugcuguguuuuugcucaaaccgacgagaaccguugccuuaaagcaaacgcaaagucaugcggcgaguguauacaggcaggucccaacugcggauggugcacgaacaguacauuucugcaggagggcaugccaaccagcgcuagaugugaugauuuagaagcccugaagaagaaggggugcccaccagaugacaucgagaaucccaggggguccaaggauauuaagaaaaauaaaaacguuaccaaucggucuaagggcacugcugaaaaacugaagccagaggacaucacccagauccaaccacagcaacucguacugcgcuugcggucaggugagccucagaccuucacauuaaaauucaagcgagcagaagauuacccgaucgauuuauacuaccugauggaucuaaguuauucaaugaaagacgacuuagagaaugugaaaagucuggguacugaccugaugaaugagaugagaagaauuacaucugacuucaggauugguuuuggcuccuucguggaaaaaacagugaugcccuacauaaguacgaccccggccaagcucagaaacccuuguacgagcgaacagaacuguaccagccccuucucauacaaaaauguccugucuuugacaaacaagggagaaguguuuaaugaacucgucggaaaacagcguauaucggggaaucuagacucccccgaaggcggcuuugaugcaauuaugcaaguggcagucugcggaagccugauuggcuggagaaaugugacucgccucuugguuuucucaacugaugccggcuuucauuuugcaggggacggcaaguugggcggcauuguccugccuaacgacggccagugucaucuggagaacaauauguacaccaugucucauuauuaugacuaucccagcaucgcccaccuggugcaaaaacuguccgaaaauaacauacaaacgaucuucgcagugacugaggaauuucagcccgucuacaaagagcuaaagaaucucauacccaaaagugccgucgggacccugagugcaaacagcucaaacgugauccaacuuauuauugaugcuuacaacucgcugagcagcgaaguaauccucgagaacggcaaacucuccgagggagucaccauuucguauaagucuuacugcaaaaauggugucaauggcacaggggagaauggaagaaaaugcucaaacaucaguaucggugaugaggugcaguucgagaucuccauuacaucaaacaaaugccccaagaaagauucagacaguuuuaagauccggccgcuuggguucacggaggagguggaggugauccuccaauacaucugcgagugugaaugucagucagaaggaaucccugaaucucccaagugccacgagggcaauggcaccuuugaaugcggugcuugccgcugcaaugaaggacgagucggccggcauugugagugcaguacagaugaaguaaacucagaggauauggaugcuuauugucguaaggagaauucuuccgagauauguuccaacaacggagaaugugucuguggucagugcgucugccgcaagcgagacaauacaaacgaaaucuacuccggaaaguuuugcgagugcgauaauuucaacugugaucgaaguaaugguuuaauaugcggugguaauggcgucuguaagugccgagucugcgaguguaacccaaacuauaccggaucagccugugacuguagccuggauacauccacuugugaggcgagcaacggucagaucuguaaugguaggggcaucugcgaaugcgggguaugcaaauguaccgauccaaaguuucagggccagacaugugaaaugugucaaacuuguuuaggagucugcgcggagcauaaagaguguguccaaugccgugccuucaacaagggggaaaaaaaagauacaugcacccaggaguguucuuacuucaacauaacuaaagucgaguccagggacaaacuuccgcaacccguacagcccgacccuguuagccauuguaaagaaaaggacgucgacgacugcugguuuuauuuuacguacagcgucaauggcaacaacgaagucaugguccacguuguggaaaauccagagugucccacuggacccgauaucauccccauuguggcugguguggucgccggaauaguucuuaucggccuagcccuucuauuaauuuggaagcugcugaugaucauacacgauaggcgggaguucgcuaaguuugagaaagaaaaaaugaaugccaagugggauacacaggaaaauccaauuuacaagaguccaauaaauaacuuuaagaacccaaauuauggccgcaaagccggacuauag

SEQ ID NO: 31753 - RNA, 411 nt, Artificial Sequence
  Description of Artificial Sequence: Synthetic coding sequence
augaaccugcagccgaucuucuggauaggacugauuagcucugugugcugugucuucgcacagacugaugaaaaccgaugucuaaaggcgaacgcaaaguccuguggggaguguauucaggccgggccaaacuguggguggugcacuaacuccacuuuucuccaggaaggaaugccuaccagcgcgagaugcgacgaccuagaggcucugaaaaaaaaaggcugcccccccgacgauauugaaaauccacgcgguagcaaagacauuaagaaaaauaagaacguuacgaaucgaucaaaaggaaccgccgagaagcuuaaaccugaagacauuacucagauccagccacaacaacucgugcugcgccugcggaguggugagccacagacguucacacuuaaguuuaaguag

SEQ ID NO: 31754 - RNA, 378 nt, Artificial Sequence
  Description of Artificial Sequence: Synthetic coding sequence
augaaucugcagcccauauucuggaucggucuuaucagcagcguguguuguguauuugcccaaacagacgagaaccgguguuuaaaggccaaugcgaagaguuguggugaaugcauccaagcugggccaaacugugguuggugcacaaacucuacguuccugcaagaaggaaugccgacuuccgcaaggugcgacgaccuggaagcucuuaaaaagaaaggcuguccacccgacgacaucgagaauccgagaggcucuaaagauauuaaaaagaacaaaaaugugacgaacaggagcaagggcaccgccgaaaagcucaaacccgaagauauaacccaaauccagccccagcagcuuguucuuaggcuucgaucuuag

SEQ ID NO: 31755 - RNA, 492 nt, Artificial Sequence
  Description of Artificial Sequence: Synthetic coding sequence
augaauuugcagccuauuuuuuggaucgggcuaauaagcagcgugugcugcgucuucgcacagacggacgaaaacaggugccugaaagcaaacgccaagucauguggcgaguguauacaagccggaccaaacugcggguggugcacuaacagcacauuccuucaagaaggcaugccgacauccgcccggugugacgaucuggaggcucugaaaaaaaagggcuguccacccgacgacauugagaacccacgcggcucuaaggacauuaagaaaaacaagaacguaacuaauaggaguaagggaacggccgagaaacuuaaaccugaggauauaacgcaaauccagccucaacaguugguccuccgcuuacguucgggcgaaccccaaaccuuuacacucaaauucaagagagccgaagauuauccuauagaccuguauuaccuuauggaccuuucuuauucuaugaaagaugaccuggaaaacgugaaguag

SEQ ID NO: 31756 - RNA, 459 nt, Artificial Sequence
  Description of Artificial Sequence: Synthetic coding sequence
augaaucugcaaccaauauucuggauuggacuuauuuccagcgugugcugugucuucgcgcaaaccgacgaaaacaggugccugaaagccaaugccaagucguguggagagugcauccaggccggccccaauuguggauggugcacaaacagcguguccaagaccuuccugcaagaagggaugccaaccucagcuagaugugacgaccuugaagcacucaaaaagaaaggaugcccgcccgacgacaucgagaacccgcgugggucaaaagacauuaaaaagaauaaaaauguuaccaaucgcagcaaaggcacugccgaaaagcugaagcccgaagauaucacccaaauccaaccccagcagcuuguauugagacucaggagcggugagccccagacguuuacgcugaaguuuaagcgggcugaagacuauccuauugauuuguauuauuugauguag

SEQ ID NO: 31757 - RNA, 315 nt, Artificial Sequence
  Description of Artificial Sequence: Synthetic coding sequence
augaaccuucagcccauuuucuggaucggacugauuucaagcgugugcuguguguuugcccaaaccgacgaaaaucgcugucuuaaagcaaacgcuaagagcuguggagagugcauccaagccgggccuaauugugggugguguacuaauucgacuuuccuucaagagggcaugcccacaagugcaagaugugacgauuuggaggcccugaaaaaaaaggggugccccccagacgauauugaaaauccacggggguccaaagauaucaaaaagaacaagaaugugacaaaccgcucaaagggaaccgccgaguag

SEQ ID NO: 31758 - RNA, 432 nt, Artificial Sequence
  Description of Artificial Sequence: Synthetic coding sequence
augaauuugcaaccuaucuucuggauuggucugauuagcuccguguguugcgucuucgcccaaacugaugagaaucgguguuuaaaagccaaugccaagagcugcggcgaguguauccaggcugggccuaauugugggugguguaccaacucaacuuuucuucaggaagguaugcccacauccgcccguugcgaugaccuugaagcacugaagaagaaagguugcccgcccgacgacauugagaacccaaggggcagcaaagacaucaaaaaaaacaagaacguaacaaaucguuccaaagguacggccgaaaaguuaaagccugaagauauaacccagauccaaccacagcaacugguccugagauuaagaucuggugagccccagacauuuacuuugaaguucaagagggcagaagacuauccuauuuag

SEQ ID NO: 31759 - RNA, 570 nt, Artificial Sequence
  Description of Artificial Sequence: Synthetic coding sequence
auggcuagccccuucgcucugcuuaugguccugguuguuuugagcuguaaauccaguugcucuuugggcugcgaccuuccugaaacucauagccucgacaauagaaggacccugaugcuccucgcacagaugucgcggaucucucccagcuccugccuuauggacaggcacgauuuuggcuuuccucaggaagaauucgacgggaaucaauuccagaaagccccggcaaucucgguccugcaugaauuaauccagcaaaucuuuaaucuauucacuacaaaagacucgucagcagccugggaugaagaucuguuagauaaguuuugcacagaacuauaccaacaacugaaugacuuggaagcaugcgucaugcaagaggagagagucggcgagacuccuuugaugaacgccgacuccauucuagccguuaagaaguauuucagaaggauuacguuguacuuaacagaaaagaaauauaguccaugcgccugggaaguggugcgggcugagaucaugagaaguuuaucacugucuaccaaccuccaggagcgccucagacgaaaagaguag

SEQ ID NO: 31760 - RNA, 762 nt, Artificial Sequence
  Description of Artificial Sequence: Synthetic coding sequence
auguggcccccaggaagugcuucucaaccuccaccaagccccgcggccgcuacuggacugcauccugccgcccgccccgucucucuccaaugucgucugucaaugugcccggcuagguccuuacugcucguggccacucuagugcugcuggaccaccuuagccuggcccgcaaucugccaguggccaccccggaucccggcauguuucccugucuccaccauucucagaaccuuuugcgggcggugucuaacaugcugcaaaaagcaaggcaaacacuggaguuuuacccaugcaccucugaagaaaucgaccacgaggacauaacuaaagauaaaacaaguacgguggaagcuugcuuaccucuugagcugaccaagaaugaguccugcuugaacagccgcgagacgucuuuuauuacaaacggcucaugcuuagcgucacgaaaaacuagcuucaugauggcucugugccugucaucaauuuaugaggaucucaaaauguaccagguggaauuuaaaacgaugaaugcgaaacuguuaauggacccaaagcgccagauuuuccuugaucagaauaugcuggcagugaucgacgaacugaugcaggcacuuaauuucaauagcgagacggucccgcagaaaucaucccucgaggaacccgacuucuauaagacuaaaauuaaacuguguauacucuuacacgccuuuagaauacgggcugugacuauugauagggugaugagcuaccucaaugcaucuuag

SEQ ID NO: 31761 - RNA, 720 nt, Artificial Sequence
  Description of Artificial Sequence: Synthetic coding sequence
auguggccaccaggaagcgcaucccagccacccccaucucccgccgcugccacgggccuccaucccgcugcacguccggucucauugcagugcagauuaagcaugugccccgccagaucuuuauuacugguagccacccugguuuuacuagaucaccucucacuagcucgcaaucuaccgguugcuacccccgacccgggcauguuucccugcuuacaccacucccagaacuugcugcgggcaguguccaauaugcuccaaaaggcucggcaaacauuggaguuuuacccaugcacaucagaggagaucgaccaugaggauauuacuaaggacaaaacauccaccgucgaggccugucugccucuggagcugacuaaaaaugggagcuguuuagcgucuaggaagacaucuuucaugauggcauuaugucuguccagcauuuaugaggaucuuaagauguaucaaguggaauuuaaaaccaugaacgccaaacuccugauggauccuaagcgucaaauuuuccuggaucaaaauaugcuugcggugaucgaugagcuuaugcaagccuuaaacuuuaauuccgagacagucccacaaaagucgagucucgaggagcccgauuuuuauaagacuaagauaaagcuguguaucuuacuucacgccuuucgaauccgagcagucaccaucgauagaguuaugucauaccugaaugccucuuag

SEQ ID NO: 31762 - RNA, 648 nt, Artificial Sequence
  Description of Artificial Sequence: Synthetic coding sequence
auguggccccccgggucugccagccaaccgcccccaagucccgccgcagccacugggcuucacccagcugcccgucccgucucgcugcagugcaggcuguccauguguccugcccguucgcuguuacuggucgccacgcuagugcuccuggaucaccuuucccuagcuagaaaucuuccuguugcaacccccgacccaggaauguuuccaugccuacaccacucacaaaaccuauugcgugcuguguccaauaugcuacaaaagaaugagucuugccugaauagucgagaaaccucauucauuaccaauggcuccugucucgccagcagaaagacuagcuuuaugauggcacugugcuuaucaucgauuuacgaggauuuaaaaauguaccagguugaguuuaagacaaugaaugccaagcuccugauggaccccaagagacagaucuuucucgaccagaacaugcuggccguaaucgacgagcugaugcaggcucugaacuucaacuccgagaccgugccgcagaagucaucuuuggaggagcccgauuuuuacaaaacaaaaauuaaacugugcauccugcuccaugccuuccgcauccgggcugucacgaucgaccggguuaugaguuaucugaaugcaucguag

SEQ ID NO: 31763 - RNA, 582 nt, Artificial Sequence
  Description of Artificial Sequence: Synthetic coding sequence
auggcggcagaacccguggaagacaacugcaucaacuuuguggcaaugaaguuuauugauaacacacucuauuucauagcugaagacgacgagaaccuggagagcgacuacuucggcaagcuugaaucuaaacugucugugauuaggaaccugaaugaccaagugcuuuucauagaucaaggaaauaggcccuuauucgaggauaugacugauucagacugccgcgauaaugcuccacgaaccaucuucaucauaagcauguauaaagacucucagccccgagguauggcugugacuaucucuguuaagugugaaaaaaucucgacccugaguugugaaaacaaaaucaucucguucaaggaaaugaacccuccagauaacaucaaggauaccaagucugacaucaucuucuuucagcggucuguccccggccacgacaacaaaaugcaguuugaaucuucaucuuaugagggauauuuucucgcuugugaaaaggagcgagaccucuuuaaauuaauucugaaaaaagaagacgaacuuggggaccgaucuauuauguucacaguacagaaugaagacuag

SEQ ID NO: 31764 - RNA, 570 nt, Artificial Sequence
  Description of Artificial Sequence: Synthetic coding sequence
auggcagccgagccggucgaagacaacuguaucaauuucguugccaugaaguuuauagacaacacauuguauuucaucgagaaccucgaauccgacuacuuugguaagcuggaaagcaaacugagcgucauuagaaaucucaaugaccaaguccuauuuauugaucagggaaaccgcccacucuucgaggauaugacagacucagauuguagggauaacgcaccaagaacaauuuuuauuauaucuauguauaaagacagccagccuagggggauggcuguaaccaucagcgucaaaugcgagaagaucuccacauuaucaugcgaaaacaaaauuauuagcuuuaaagaaaugaacccaccagauaacaucaaggacaccaaaucugacauuauuuuuuuccagcgauccgugccuggacaugauaauaagaugcaguuugagaguucuagcuaugaggguuacuuucuugccugugagaaggaacgcgaucuguucaaauugauccugaagaaagaggaugaauuaggggauaggagcauuauguucaccguccaaaacgaggacuag

SEQ ID NO: 31765 - RNA, 582 nt, Artificial Sequence
  Description of Artificial Sequence: Synthetic coding sequence
auggcugccgaaccagucgaagacaauuguauuaauuuuguggcuaugaaauucaucgacaauacucuuuacuucaucgccgaggaugacgagaaucucgaaucugauuacuuugggaaauuagaaucuaaauugagugugaucagaaaucucaaugaucaaguguuauucaucgaucaggggaacagaccacuuuucgaagacaugaccgauagugauugucgggauaacgccccacggacaauuuucaucaucuccauguacaaagauucacaaccgaggggaauggcgguaacaauaagugugaagugugaaaagaucuccacauuaaguugugagaacaagauuaucucuuuuaaggagaugaaucccccagacaacauuaaagacacaaaaagcgacaucauuuucuuccagcgcucuguaccuggucacgacaauaagaugcaauucgagucaucauccuacgaggguuauuucuuagcuugugagaaagaacgcgauuuauuuaagcugauuuugaaaaaagaggaugaacugggcgacagauccauuauguucacgguucaaaaugaggauuag

SEQ ID NO: 31766 - RNA, 639 nt, Artificial Sequence
  Description of Artificial Sequence: Synthetic coding sequence
augaacucauucagcaccucugcauucggcccuguugccuucucccucggccugcuccucgugcugccugccgcuuuucccgcaccugugccucccggcgaagacuccaaggacguggccgcaccccaccggcaaccccugacuuccucugagcgaaucgauaaacaaauccgauauauucuugacggaaucagcgcccucagaaaagaaacuuguaauaagagcaauaugugcgaguccucaaaagaagcccuggccgaaaauaauuuaaacuugcccaagauggcagaaaaggauggcugcuuucaaucuggauucaacgaggagaccugccuuguuaaaauaauuaccggacuccuggaguucgaaguuuaucuggaguaccugcaaaaccgcuuugaaucaagcgaagaacaggccagagcugugcagaugucaaccaaggugcugauucaauuccugcagaaaaaggcgaagaaccuggaugcuaucaccaccccagauccuaccacuaacgccucacuacuaacaaaacuucaggcacagaaucaguggcuccaagauaugaccacccacuuaauccugcgcaguuuuaaagaguuuuugcaauccucuuugcgugcccuucggcaaauguag

SEQ ID NO: 31767 - RNA, 369 nt, Artificial Sequence
  Description of Artificial Sequence: Synthetic coding sequence
augugugaaagcagcaaggaggcccuggcggaaaauaacuuaaaccuccccaagauggccgagaaggauggcugcuuccaguccggcuuuaacgaagaaacauguuuggugaaaaucauuacaggauugcucgaauuugaaguuuaccucgaguaccugcagaaucgcuuugaguccuccgaggagcaggcccgggcagugcagaugaguacaaagguuuuaauucaguuuuuacagaagaaggucggagucucauccuucccccaacuaggcguuggugaagaccgacuuaaagacuccguuuuagacaauucaggaaugcagugccauuuccagaaacggagacugcacguaaauaagagaguguag

SEQ ID NO: 31768 - RNA, 639 nt, Artificial Sequence
  Description of Artificial Sequence: Synthetic coding sequence
augaacuccuucuccaccagcgcauucgggccuguugccuuuucccuuggccuccuguuaguacucccagcggccuuucccgcuccgguuccucccggcgaagauaguaaagauguggcagccccgcaccgccagccacuaacaaguucagaaaggauugacaagcagauccgguauauuuuggacggcaucucggcacuccguaaagagacaugcaauaagucaaacaugugugagucuuccaaggaggcccuugcugaaaacaauuugaaucugcccaagauggcugaaaaggaugggugcuuccaguccggauuuaacgaggagacgugucuugucaagaucauuacuggauuacucgaauucgaaguuuauuuagaauauuugcaaaaccgauucgagucgucugaagaacaagcucgggcaguacagaugagcacuaaaguuuuaauacaguuccuucaaaaaaaggcuaagaaccucgacgccauuacaacucccgacccuacaacgaaugcaagccuccugacgaaacugcaagcacagaaucaguggcuacaagacaugacuacccaucugaucuuaaggaguuuuaaagaguuuuuacaaagcucacuaagggcucuccgccaaauguag

SEQ ID NO: 31769 - RNA, 597 nt, Artificial Sequence
  Description of Artificial Sequence: Synthetic coding sequence
augaacucuuuuucuacgucagcauuuggucccguugcauuuucucugggcuuacuuuuagugcuacccgcggcuuucccugccccugucccuccuggugaagacagcaaggauguugccgcaccgcacagacaaccucugacuucauccgaacggaucgacaagcagauuagauacauucucgacggcauuagugccuuaagaaaagaaacaugcaauaaaaguaauaugugcgaaagcagcaaggaggcacuggcugaaaauaaucugaaccuucccaagauggcagagaaagaugguugcuuucagaguggauuuaacgaagaaacaugucugguuaagauuaucacaggccuccucgaauuugaaguuuaucuggaguaccugcagaacagauuugaguccuccgaagaacaggcacgugccgugcaaaugaguacuaaagugcuuauccaguuucuccaaaagaaaguaggagucucaagcuucccccaguugggagugggcgaagacagauugaaagauucagugcuggacaauucggggaugcagugccauuuccagaaacgucggcuucacgugaauaagcgcguguag

SEQ ID NO: 31770 - RNA, 759 nt, Artificial Sequence
  Description of Artificial Sequence: Synthetic coding sequence
augaacagcuucucuacgagcaaaugcagaaagagccuugcacuggaauuaccugcagccguggagcccugcgugcgugaaggcugcguggcccagggcgggcuggccggcggacagcagcaaagacaggcaccuucaugcgccguguccagcccacugagaucacugccaucaggcacgggugccuuuggcccuguagcuuuuucucucggcuuacuacugguccugcccgccgccuucccugcuccuguaccuccaggugaagacagcaaagaugucgcggcaccccacagacagccauugacuucaagugaaagaaucgacaagcaaauucgcuacauacucgacggaaucucugcccugagaaaagaaacaugcaacaagucuaacaugugcgaaucuagcaaggaagcccuggccgagaacaaccucaaccugccaaagauggcugagaaagacggcugcuuccaaaguggcuuuaaugaggaaacaugucuggugaaaaucaucacaggccugcuugaguuugaggucuacuuggaauaucugcagaacagauucgagucuucggaagaacaagccagggcaguucagaugagcaccaagguccugauacaauuccugcagaagaaggugggagucuccucauucccucaguuagguguuggcgaagaccgacugaaagacucagugcucgauaauucaggaaugcagugccauuuucagaagcggcggcuacacgugaauaagagaguguag

SEQ ID NO: 31771 - RNA, 459 nt, Artificial Sequence
  Description of Artificial Sequence: Synthetic coding sequence
augaacucauucaguacaucagccuuuggcccagucgcuuuuucucugggauugcugcuuguguuacccgccgccuuucccgcaccagucccgcccggggaggacucuaaagauguugccgcaccacacagacagccacucacgucaagcgagagaauugacaagcagauuagauacauccucgauggcauuagugcccugagaaaagagacaugcaacaagucaaacaugugcgaaagcucuaaagaggccuuggccgagaacaaccugaaucugccaaagauggcugaaaaagacggguguuuccagucagguuuuaaugaagagacuugucucgugaagauaauaaccggacugcuggaguucgaaguguauuuagaauacuugcaaaacagguuugaguccagugaagaacaggcaagagcggugcaaaugucuacuaaaguccugauucaguag

SEQ ID NO: 31772 - RNA, 1419 nt, Artificial Sequence
  Description of Artificial Sequence: Synthetic coding sequence
augacuacauguagcaggcaguuuacgucuagcagcucaaugaagggguccugcggcauugggggagguaucgggggcgguucuucucggaucaguagcguccucgccggcggcaguugcagagccccgagcacauacgggggcggccugagugugucgagcucucgauucagcagcgggggugccugugggcucggcggaggauacggcggcggauuuucuucaucauccuccuccuuuggcucuggcuucggugguggguacggggggggucugggugccggauugggcggaggcuucggcggcggguucgcugggggggacggucuccuugucgguucugagaaagugaccaugcaaaaucugaacgaucgauuggcaucauaucuggacaaggugagagcgcuugaagaagccaaugcagaccuggaaguuaaaauuagagacugguaucagcggcagcguccagcggaaaucaaagauuauagucccuacuucaaaacaaucgaggaccuuagaaacaaaauucuuaccgccacaguggacaacgcuaauguuuuguugcaaauugauaacgcucggcuggcugccgaugacuuccgcacuaaauacgagaccgaacugaaucugaggauguccguugaggcagacaucaacggcuuacggcguguccuggaugaauugacacuugcuagagccgaucuggagaugcagaucgaaucauugaaagaagaacucgcauaccuuaagaagaaucacgaggaagagaugaaugcacuuagaggccagguaggcggcgaugucaauguggaaauggaugccgcuccgggugucgacuugucccgcauucugaaugagaugagagaccaguacgaaaagauggccgaaaaaaaucggaaagacgccgaagaaugguucuuuaccaagacagaggaacucaacagggagguugcgaccaacagugaguuagugcaaaguggcaaaucugaaaucuccgagcucagacgaacuaugcagaaccuugagauugaacuccagagccaauuauccaugaaagccagucucgagaacagucuugaggagacuaagggacgcuauugcaugcaguuggcgcagauacaggagaugauuggaagcguugaggagcagcuggcccaguuaaggugugagauggagcagcagaaccaagaguacaagauacuguuggacguaaaaacucgcuuagagcaggagauugcuacuuaucggagauuauuggagggcgaggaugcacaccucucuucaucgcaguuuucuuccgguucacaguccucuagagaugugacaagcaguagucggcagauuaggacuaaggugauggacgugcacgacgggaaggugguguccacacacgagcagguacugcgaacaaaaaacuag

SEQ ID NO: 31773 - RNA, 1416 nt, Artificial Sequence
  Description of Artificial Sequence: Synthetic coding sequence
augcaccccggagugcuggccgcuuucuuguuucuuagcuggacccacugucgugcucugccucucccaucagggggagaugaggaugaucuguccgaagaggaccuccaguucgccgaacgguaucugcgcucuuauuaccaucccaccaaccuagcagguauacugaaggaaaacgccgcuucuaguaugacggaacgccucagggaaaugcagucauuuuucggacuggaaguuacagggaaacuugacgacaacacacuugacgugaugaagaagcccagaugugggguuccugauguaggugaguauaauguguucccacguacuuuaaaguggucaaaaaugaaucuaacuuaucgcaucgugaacuacacucccgauaugacgcauuccgaggucgagaaggccuuuaagaaagcauuuaaaguaugguccgacguaaccccccuuaacuucacccgccuccacgacggaaucgcagauauaaugaucagcuuuggaaucaaggaacacggagacuucuaccccuucgauggcccuucuggauuacuugcucacgccuuuccaccaggcccaaacuauggcggcgaugcacauuuugaugacgaugaaacuuggacgucuagcucuaagggauauaaccuuuuccuagucgcagcccacgaauucggccauucauuaggauuggaucacuccaaggaccccggggcguugauguucccaauuuacaccuacacugggaaaagucauuucaugcugcccgacgaugauguacaaggcauccagagccuuuaugggccuggagaugaggaccccaauccuaaacacccuaaaaccccagacaaaugcgaucccucucugagccucgaugccauuacaagccugcgcggagaaacaaugauuuucaaggacagauucuucuggaggcuacauccccaacaaguugacgcugaauuauuucucacaaagucguucuggcccgaacucccaaaucggauugaugcugccuacgagcaucccucccaugacuuaauuuucauauuuagaggacguaaauuuugggcgcucaauggauacgauauccuggagggguacccuaagaagaucagcgagcuggggcugcccaaggaggugaaaaagaucuccgccgcagugcacuuugaagauaccggaaaaacucuccuguuuaguggcaaccaggucuggagauacgaugacacaaaucacauuauggauaaagauuauccacggcuaaucgaagaggacuuccccggcaucggugacaagguugacgccguuuaugagaaaaauggguauauuuauuuuuucaauggacccauccaauucgaguauuccauuugguccaacagaaucgugcgagucaugccagcaaauaguauccugugguguuag

SEQ ID NO: 31774 - RNA, 1470 nt, Artificial Sequence
  Description of Artificial Sequence: Synthetic coding sequence
augcacccuggagugcuggccgccuucuuguuccugaguuggacccacuguagagcccuaccacugccuucggggggcgaugaggacgacuuaagcgaagaggaccuccaauucgcugagcgcuaccuucggucuuauuaucacccaacuaacuuagccgggauucucaaggaaaaugccgcauccucaaugaccgaaagacugcgcgagaugcagagcuucuucgguuuagaagugaccgggaagcuggacgauaauacccuggacgugaugaaaaaaccacgcuguggggugccagaugugggcgaguacaauguguuuccucgaacacuaaaauggagcaaaaugaacuuaacguaccgcaucgugaacuacaccccugacaugacccauagcgagguggaaaaagcuuuuaagaaggccuuuaaagugugguccgauguuaccccccugaacuucacucgucuccacgacggaauugccgauauaaugaucuccuucgguaucaaagagcauggagauuucuaucccuuugacgggcccaguggacugcuggcccacgcuuucccuccuggcccuaacuacggcggagacgcacauuucgaugaugaugagacuuggaccucaucaaguaaaggauacaaucuuuuuuuaguagccgcccaugaauuugggcacucucuaggacuagaccacagcaaagaccccggagccuugauguucccaaucuacacauauacuggcaagucgcacuucaugcugcccgacgacgauguucagggcauucagucucucuacggcccuggagacgaggacccaaaccccaaacacccaaagacucccgacaaaugcgacccuagucugucacuggacgcaaucacuucucuacguggagaaacgaugauauucaaggaccgauuuuuuuggcgacugcacccacaacagguugaugcugagcuuuuccucacuaaaagcuucuggccugaacuacccaaucggaucgacgccgcauacgaacacccuagccaugaccugaucuucauuuuccgcggccgaaaguucugggcguugaacggauaugauauccuugagggauaucccaagaaaauuagugagcucggccugcccaaagaggugaaaaaaaucuccgccgcugugcacuucgaggacaccgggaaaacccuauuauucagcggaaaucagguguggcgauaugaugauacuaaucacaucauggacaaggauuacccaagacugaucgaagaggauuuuccuggaauaggggauaaaguggaugccguguacgagaaaaaugaaucacauucagugacucaggcugguguacauugcagaaaucucucuagcuugcagcccccgccuccaggguucaaacguuuuuccugccuuagucucuggucguccugggacuauagacuuuaucucuucuuccagaggacccacaccguguag

SEQ ID NO: 31775 - RNA, 1152 nt, Artificial Sequence
  Description of Artificial Sequence: Synthetic coding sequence
augcaucccggaguguuggcagcuuuucucuucuuauccuggacacacugccgggcuuugccgcugcccagcgguggcgacgaggaugacuuaucugaagaggacuuacaguuugcagaaagauaccugaggaguuacuaccacccuacaaaccuggcuggcaucuuaaaagagaaugcugccuccucaaugacugagcgccugagggagaugcagucuuuuuuugguuuggaggugaccggaaaguuggacgacaauacauuggaugugaugaagaaaccucgcugcggaguuccagauguuggcgaguauaacguauucccaagaacccucaaguggagcaagaugaacuugaccuaucggauugugaacuacacacccgauaugacccacuccgaaguugaaaaagcauucaagaaggcuuucaagguguggagugaugugacaccucugaacuuuacucgauuacacgacggaauugccgauauuaugauauccuuuggcauuaaggaacacggagauuuuuaucccuucgauggcccuagcggacucuuggcacacgcuuuuccuccuggcccuaauuauggaggcgacgcccauuuugacgacgacgagacuuggacuagcucuuccaaggguuacaaucuuuuccugguggcggcucacgaauuuggacacucucuaggcuuagaucacucaaaggauccaggggccuuaauguuccccaucuauacauauacuggcaaaucgcacuucaugcugccugacgacgaugugcaggguauccaaaguuuauaugggccgggggaugaggaucccaacccaaagcauccaaagacucccgauaaaugugauccaucucugagccuugacgcaaucacuucacugaggggcgagacgaugauuuucaaagaucgauucuucuggcggcugcauccacagcaaguugaugcugaacucuucuugacgaaaagcuuuuggccugagcuaccuaaucguauugaugcagcauaugagcauccaucccacgaccucauuuucauauuucgaggacggaaguucugggcccugaacggauacgacauucuggagggauaucccaaaaaaaucucagagcugggucugccuaaagaggugaauaaguuacaauag

SEQ ID NO: 31776 - RNA, 1743 nt, Artificial Sequence
  Description of Artificial Sequence: Synthetic coding sequence
augccugguuggcccuggggauugcugcucaccgccgggacacuuuuugcugcccucucuccggggccucccgcuccagcugauccgugucacgacgagggaggagcaccacgagguugcgugccagggcucgucaacgccgcuuugggccgggaaguucuggccucgaguacuuguggaagacccgcuacucgggccugugacgcaucugauccuagacgagcucacaguccugcguugcugacaucuccuggcggaacugcaagcccacugugcuggcggagugaaucacuuccccgcgccccacuuaacguuacacugacagugccucuagggaaagcauucgagcucguuuuugucucucugcgguucugcagugcucccccggccucuguggcucugcucaagucacaggaccauggccguagcugggcaccucugggguuuuuuucaucgcacugugaccuggauuauggccgcuugccagcccccgcuaauggacccgcaggccccggcccagaagcacuguguuuuccagcuccacuggcucagccugauggcucuggccugcuggccuucucaaugcaagauucuagcccucccggacuugaccuggacagcucccccguucuccaggacugggucacagcgacagacgugaggguuguauuaacccgcccaucuacggccggcgauccaagagacauggaagcggucgugccuuauucuuaugcugccacugaucugcaaguaggcgguagauguaagugcaacggucacgccuccagguguuuauuagauacucagggccauuugauuugugacugcagacauggcacugaaggucccgauugcggcagauguaaaccauucuacugugaccgcccauggcagcgcgccacagcccgggagucacacgccugucuugccuguucuugcaauggacaugcccgaagaugucgguucaauauggaguuguacaggcucagcggaaggaggagcggaggagugugccugaauugccggcauaacaccgcugggcgacacugccacuacugccgagaagguuucuaccgggauccuggccgcgcacuguccgaucggcgugcuugcagagcgugugauugccauccugugggcgcugcaggaaaaacuuguaaccagacuaccggacaguguccuugcaaagacggcgugacuggacuaacaugcaacagaugcgcuccuggauuccaacaaagucggagcccuguugcuccuugugugaagacaccaauuccaggcccuacagaagacuccuccccuguucagccccaggauugcgacucgcacugcaagccugcucgaggcucauacaggauuagccugaagaaauuuugcaaaaaagacuacgcaguucaggucgcugugggggcacggggggaggccaggggugcauggacucgcuuuccugucgcuguauuggcaguguuccgauccggcgaagaacgcgcccgccgcggcuccagugcgcucugggugccggcuggagacgcagccugcggauguccacgauugcuccccggaagaagguaccuucugcugggaggaggcccgggugccgccgccggaggcgccggaggacggggaccuggacuuauugcugcacgcgguucacucguacugcccuggcgagacgccuggacaagacgguuacguaggcuucaacggcgggaaaggcggggcaggugcucugccgcuuag

SEQ ID NO: 31777 - RNA, 651 nt, Artificial Sequence
  Description of Artificial Sequence: Synthetic coding sequence
augcccggaaacuugaugucacaaaccucuagggcugugagcauuuggaaauuuccugcaaaacuuggaaaaacucacggacaccgggcacuagaggcuacugguaugaugcuuagagugcuggucggcgcugugcuuccugccauguuacuugcagcaccuccccccauuaacaaacucgcucuguuuccagauaagucagcuuggugcgaagcuaaaaacauuacucagauagugggccacuccggaugugaggccaagucgauccaaaaccgggcgugucuuggccagugcuucuccuauucuguccccaauaccuuuccccagagcacggaaucucugguucacugcgauagcugcaugcccgcccaaucuaugugggaaaucguuacccucgagugccccggccaugaggagguuccaagggucgacaagcucguagaaaaaauccuccacuguaguugccaagcuugcggaaaagagcccucucaugaagggcuuucugucuauguccaaggugaagauggacccggcagccagcccgggacccauccccauccucauccccacccacacccaggcggccagaccccugaaccugaagauccaccuggggcuccccauacugaggaagagggagcagaggauuag

SEQ ID NO: 31778 - RNA, 546 nt, Artificial Sequence
  Description of Artificial Sequence: Synthetic coding sequence
augaugcuccgcguguuagugggugccguguuacccgcuaugcuacucgcagccccuccccccaucaauaagcuggcacuguuucccgauaaauccgcauggugugaggcuaagaauauaacccagauugugggacacucaggaugugaagccaaaaguauccaaaaccgagcaugucuuggucagugcuucucuuacucugugccuaauaccuucccccagucgaccgagaguuuagugcacugcgauuccugcaugcccgcccagucuaugugggagaucgucacucucgagugccccggacaugaggagguuccucgaguggauaagcucguugaaaaaauccugcacugcagcugccaggccugcggcaaggaaccaucucaugaaggucucaguguuuacguccagggagaagacggccccggcucgcaaccugggacccacccacauccacacccacacccgcaccccgggggccagaccccugaacccgaagacccucccggcgcuccgcauacugaggaagaaggcgccgaagauuag

SEQ ID NO: 31779 - RNA, 351 nt, Artificial Sequence
  Description of Artificial Sequence: Synthetic coding sequence
augauguuaagaguccuagugggcgcagucuuacccgcaauguuacucgcugcuccaccccccaucaauaagcuugcuuuguucccugauaaauccgccuggugcgaagccaaaaacaucacccaaauugucggacacucugguugcgaagcuaagagcauucaaaauagagcaugucugggccagugcuucucuuacuccguaccaaacaccuuuccacaaucaacugaaucgcugguacauugcgauucuugcaugcccgcccaaaguaugugggaaauugucacccuggaguguccaggccacgaggaggucccccgugucgauaaacuggucgagaagauuuuguag

SEQ ID NO: 31780 - RNA, 492 nt, Artificial Sequence
  Description of Artificial Sequence: Synthetic coding sequence
augcugcgcgugcuggucggugcugugcuucccgcuaugcugcuggccgcccccccaccaauuaacaaauuggcauuguuuccggacaagucagcuuggugcgaagcaaagaauaucacacaaaucgucggucacucgggcugcgaggcaaagucaauccaaaaucgggccugucugggccaauguuucagcuacucugucccaaacacauucccucagucaaccgaaucucuugugcauugugacucauguaugccagcacaauccaugugggagaucguuacccucgagugcccuggacaugaggaagugcccaggguggauaagcuagucgaaaagauccuccauugcucuugccaggcauguggaaaggaaccaucucaugaaggccugucugucuacguucaaggcgaggauggaccggggucacagccggguacacauccacacccccacccacacccccacccagguggccagacacccgaguag

SEQ ID NO: 31781 - RNA, 354 nt, Artificial Sequence
  Description of Artificial Sequence: Synthetic coding sequence
augauguuacguguuuuagugggagcuguuuugcccgccaugcuccuggccgcuccuccgcccaucaacaagcuugcucuauuccccgauaagagcgcauggugcgaggccaaaaacauaacacaaauuguuggacacucuggaugcgaggcaaagucuauccagaacagggcuugucugggucagugcuucagcuacucgguucccaauacguuuccacagucuaccgaaagccugguccauugcgauaguugcaugccugcgcagaguaugugggaaaucgugacacuugaaugcccggggcaugaagaagugccacgaguugauaaguuagucgaaaagauccugcacuag

SEQ ID NO: 31782 - RNA, 330 nt, Artificial Sequence
  Description of Artificial Sequence: Synthetic coding sequence
augaugcucagaguucuaguuggcgcuguccucccugccaugcugcucgccgcucccccuccaauuaacaaacucgcccucuucccugauaaaucagcauggugugaggcaaagaacaucacccagaucguuggccacuccgggugugaagccaagucaauccaaaaccgugccugccuugggcagugcuuuucauacuccgugccuaauacguucccacagucgaccgaaucuuuagugcauugcgacucuugcaugccugcacaaaguaugugggagaucguuacucuugaaugcccuggccaugaagaagugccaagggucgauuag

SEQ ID NO: 31783 - RNA, 387 nt, Artificial Sequence
  Description of Artificial Sequence: Synthetic coding sequence
augaugcugcggguccucguaggagcuguucugcccgcaaugcuguuagccgccccgccacccauuaauaaacucgcccuguuucccgauaaaucagcauggugugaagccaagaauauuacccagaucgucggacacucugguugcgaggccaagucaauccagaacagagcgugucuuggccaguguuuuagcuacucugugcccaacacguuuccacagaguaccgaaucccucguucacugugacucuuguaugccagcucaguccaugugggaaauaguaacguuagaauguccuggucacgaagaagugccgagaguagauaagcuggucgaaaagauucugcacugcuccugucaagcuugcgggaaagagccuagcuag

SEQ ID NO: 31784 - RNA, 543 nt, Artificial Sequence
  Description of Artificial Sequence: Synthetic coding sequence
augcugagggugcucgucggugccgugcucccagccaugcuccucgcagccccaccaccuauaaauaaacuggcccuguucccugauaaaucugccuggugcgaggcaaaaaacauuacucagaucgugggucacagcggcugugaggcaaagucuauccaaaaccgugcuugccugggccaauguuuuuccuauagugugccuaacaccuucccacaguccaccgaaaguuuagugcauugcgauagcugcaugccugcacagucuaugugggaaauaguuacccucgaauguccgggccacgaagaagugccgagagucgauaagcugguagaaaaaauucuccauuguuccugucaggccugcgggaaggagccuagccaugagggacugucaguauacguucagggagaagacggaccuggaagccagccugguacucacccccauccccauccacacccccaucccggcgggcagacaccagagccugaggacccuccaggggcaccacacaccgaggaagagggcgcagaagacuag

SEQ ID NO: 31785 - RNA, 534 nt, Artificial Sequence
  Description of Artificial Sequence: Synthetic coding sequence
auggugcuuuugucaacauugggcauugucuuucagggagagggcccaccaauuaguucuugcgacacagguacuauggcgaauugugaacgcacuuucaucgcaauaaagccugauggcgugcaacgcggcuuagugggagagauaauuaagcgguucgaacaaaagggauuucgucuaguugggcugaaguuuaugcaggccucugaagaccuucugaaggagcacuacguugaucugaaagaucggccauucuuugcaggccuggucaaauacaugcauagcggucccgucguggcaauggugugggagggacucaaugucguaaaaaccgggagggugauguugggcgaaacaaaccccgcagauaguaagcccgggacuauccgcggagacuuuugcauccaaguggggagaaacauaauucauggcagcgacucaguggaauccgccgagaaggaaauuggccuuugguuucaccccgaagagcuuguggacuacacgucaugcgcucagaauuggaucuaugaauag

SEQ ID NO: 31786 - RNA, 429 nt, Artificial Sequence
  Description of Artificial Sequence: Synthetic coding sequence
augaaguccccucaugugcuugucuuuuugugccugcugguggcguuggugacaggaaaucucgugcaguucggcguaaugauugagaagaugacagggaaaagcgcccuccaguauaacgauuacggguguuacugcggaaucggggguagucacuggccgguggaucagacagauugguguugccacgcccacgauugcuguuaugggcgacuugaaaaacuaggaugcgagccaaaacuugaaaaauaucuguucaguguguccgagagagggauuuuuugugccggucgaacaacaugucagcgccuuaccugcgaaugugauaagagagcagcacucuguuuccgacguaacuugggaacuuauaacagaaaauaugcccacuaccccaacaaauuguguacuggcccaaccccacccugcuag

SEQ ID NO: 31787 - RNA, 636 nt, Artificial Sequence
  Description of Artificial Sequence: Synthetic coding sequence
auggccgauggagcaaaagcgaacccaaaaggauucaagaagaaaguuuuagaucguuguuucucuggguggcgcggaccacgauucggggcaucuuguccuucccguaccucccggagcucucugggcaugaagaaguuuuuuaccgucgcaauacuggccggaucuguccuuagcacagcacauggcucucucuuaaacuuaaaagccaugguggaagcaguuacaggcagaucugccauuuuaucuuucgugggauacggaugcuauuguggacuggggggacgcggccaaccaaaggacgagguugacugguguugccaugcgcacgacuguugcuaccaggaacucuuugaucagggcugccauccuuauguagaucacuacgaccauaccauugagaauaauacagagauagugugcagcgaccugaauaaaacugaaugugacaaacagacuugcaugugugacaaaaauauggugcucugucuuaugaaucagacauaccgagaggaauaccggggauuucugaacgucuauugucaagggcccaccccuaacugcucaaucuacgaaccaccccccgaagagguaacuugcucccaucagaguccugcaccucccgccccacccuag

SEQ ID NO: 31788 - RNA, 570 nt, Artificial Sequence
  Description of Artificial Sequence: Synthetic coding sequence
auggcacugcugucucggccagcucucacccugcugcuccugcugauggccgcaguggugaggugucaagaacaagcccagaccacugacuggcgggcuaccuuaaaaacaaucaggaacggagugcacaaaauugauacguacuuaaaugcugcucucgaucuucuaggcggcgaggauggauugugucaguacaaauguagugaugguagcaaaccuuuccccagguauggcuauaaaccuuccccccccaaugggugcggcagcccccuguucggcguccaccugaacaucggcauccccagucugaccaagugcugcaaucaacaugaccggugcuaugaaacuugcgguaaguccaagaacgauugcgaugaagaguuucaguauugcuuaucgaaaaucugccgcgauguccagaagacgcucggccugacccaacaugugcaagcuugugaaaccaccguugaguuacuuuuugauucugugauccaucuagguuguaaaccuuaucucgauucccagagagccgcaugucggugucauuacgaagagaagacagauuuguag

SEQ ID NO: 31789 - RNA, 213 nt, Artificial Sequence
  Description of Artificial Sequence: Synthetic coding sequence
auggcccuacugagucgccccgcccucacacuacuccugcugcucauggcugccguaguccguugccaggaacaggcccagacaaccgauuggcgcgcuacccugaagacaauaaggaacggaguccauaaaaucgauaccuaccuuaaugcagccuuagaucugcuuggcggagaagacggacucugucaauacaagugcucugaugccuag

SEQ ID NO: 31790 - RNA, 477 nt, Artificial Sequence
  Description of Artificial Sequence: Synthetic coding sequence
auggcacucgagguguugaugcuguuagccguacugauauggaccggugcugagaaccuccacgugaagaucaguuguucguuggauuggcugaugguuagcgugauuccuguggccgaaucccgaaaccuguacaucuucgccgacgaacuucaucucggaaugggcuguccagcgaaccgcauucacacguacguuuaugaauucaucuauuuggucagagauugcggaauuaggacaagaguaguuagcgaagagacccugcuguuccagaccgaacucuauuuuaccccuaggaacaucgaccacgauccucaggaaauucaccuggagugcagcacaucccgaaaaagcgucuggcucacacccguaucgaccgaaaaugagauuaagcuagacccauccccauuuauugcagauuuucagacgacagcagaggaauuaggccuucugucaagcagcccaaauuuauuauag

SEQ ID NO: 31791 - RNA, 1038 nt, Artificial Sequence
  Description of Artificial Sequence: Synthetic coding sequence
augagccuauucgguuuacugcugcuuacuagcgcuuuggcgggucagaggcagggcacccaggcugagagcaaccuuaguagcaaguuucaguuuucaaguaauaaggagcagaacggagugcaggacccccagcacgaacgaaucaucacggugagcacuaacgguaguauucacucacccagauuuccccauacuuauccucggaauaccguucucguauggaggcugguagcaguggaggagaacgucuggauccaguugacauuugacgaacgcuuugggcuggaggaccccgaagaugauaucuguaaauaugacuuugucgagguugaggaacccucugacgggacuauccugggcagauggugcggcucagguaccgugccaggcaaacagaucagcaagggaaaucagauuagaaucagguucgugucagacgaguacuuuccaagcgagcccggauuuuguauccauuacaacauuguuaugccucaguucaccgaagccguaagcccaagcguacucccaccuuccgcccucccccuggaucuccuaaacaacgccauuacugcguuuuccacacuggaggaccuuauccgguaucucgaaccugaaagguggcagcucgaucuugaagaucuguacaggccuacuuggcaacuauuaggcaaggcguuuguuuucggacgcaagucucgggugguugauuugaaccuguugaccgaagaagugagauuguauucguguaccccgcguaacuucuccguauccaucagagaggaacucaaacgaacagauacuaucuuuuggccaggaugucugcuugucaagagaugcggaggcaauugcgccuguugccuccacaacugcaacgagugucagugcgucccaagcaaaguuaccaaaaaauaccaugaggugcuacagcugagaccuaaaaccgggguaagagggcuccacaaauccuuaacagauguggcacuagagcaucaugaagaaugcgacuguguaugucgaggcucuacuggcggcuag

SEQ ID NO: 31792 - RNA, 549 nt, Artificial Sequence
  Description of Artificial Sequence: Synthetic coding sequence
augccacaauuuacagaagccguaucuccuaguguccugccacccucagcauuaccccucgaccuucucaacaaugccauuacagccuucagcacccuagaggaucuaaucagauaccuggaacccgagagauggcagcuggaccuggaagaccuguauagaccaaccuggcaacugcugggcaaggccuucgucuuuggccguaaaucaagagugguugaccugaaucuacucacugaggagguccggcuguacuccugcacacccagaaacuucagugucagcauccgagaggaauugaaacgcacagacacuauuuuuuggccagggugccugcuugucaaacggugcggggggaacugcgccugcugccugcauaauuguaaugagugccagugugugccaaguaagguuacuaagaaauaucaugaagugcuacagcuucgaccgaaaacuggcguuagaggucugcauaaaucgcugacagaugucgcacucgaacaucaugaggagugugacugugugugccgcggcucuaccggaggcuag

SEQ ID NO: 31793 - RNA, 573 nt, Artificial Sequence
  Description of Artificial Sequence: Synthetic coding sequence
augaugcaguacaccugguuacuaacgaaacaauucaccgaggccgugagccccucuguccuaccaccaagugcgcucccgcuugaccuccugaacaacgcgaucacggcguuuaguacgcuugaggaucugauccgguacuuggaaccugaaagauggcaguuggaccuugaagauuuguauagaccuacuuggcaacuccucggcaaagccuuuguuuucgggaggaagucacgcgugguggaucugaaccugcucacagaggaggugcgccuuuauucuugcacuccccgaaacuucagcgucucuauuagggaagaacuaaagagaaccgauaccauauucuggccuggaugcuugcucguuaaacgaugcggaggaaauugcgcauguugucuccacaauuguaacgaaugucagugcgugccuagcaaagugacuaagaaguaucacgagguuuugcagcugcgccccaagacaggugugagaggucuucacaagagccucaccgacguagccuuggagcaucacgaagaaugugauugcgugugcagagguucaacuggggguuag

SEQ ID NO: 31794 - RNA, 504 nt, Artificial Sequence
  Description of Artificial Sequence: Synthetic coding sequence
augagucuuuuugggcuccuucuucugacaagugcauuagcuggccagcggcagggcacccaggccgagaguaauuuaucgaguaaguuccaauucuccagcaauaaggagcagaauggagugcaggacccgcagcaugaaagaauaauuacagugucuacuaauggcucaauccacuccccucgcuuuccucacacuuacccucgaaauacaguucuuguguggagacuuguggccguugaggagaauguuuggauucagcucaccuuugaugaacgguuuggauuggaggacccagaggaugauaucuguaaauacgauuucguggaagucgaagaaccaagcgacggcacuauucuggggcgaugguguggcaguggaacagugccaggcaaacagaucuccaagggcaaucagauaaggauucgguucguaucugacgaauacuuucccagugagcccucaaaucgaggaggcaagaucauccagcuccacacauccuag

SEQ ID NO: 31795 - RNA, 636 nt, Artificial Sequence
  Description of Artificial Sequence: Synthetic coding sequence
augcguacucucgcgugucugcuccuacugggguguggguacuuggcccauguacuggcugaagaggcugagauaccaagagaagucauugagcggcuggcgcgcagccagauucacuccauccgcgauuugcagcggcuuuuagagaucgauucuguuggcucagaggacucccuagauacaucacucagagcacauggagugcacgccaccaagcaugugcccgagaaacggccccucccaauucgacguaagagaaguauugaagaggcuguuccugcugucugcaagacucguaccguaaucuaugaaauaccccggucucaggucgacccgacaagcgccaauuuccuaauuuggcccccuugcguugagguaaagagaugcacaggcuguugcaacacgucuucaguaaaaugccagcccuccagaguucaucacaggagcgugaagguagcuaaaguggaauaugucaggaagaaaccgaagcuuaaggagguccaggugagacuugaggaacauuuggaaugcgccugugccaccacuucauuaaaucccgacuaccgcgaagaggauacaggcagacccagggaguccgguaagaaaagaaagcguaaaaggcucaaaccuacauag

SEQ ID NO: 31796 - RNA, 591 nt, Artificial Sequence
  Description of Artificial Sequence: Synthetic coding sequence
augaggacucuggcaugucuguugcuucuuggcuguggcuaccuggcccacguccuagcugaggaagccgaaaucccccgcgagguaauagagcgccuggcgcguucacaaauacacucaauuagggaccuucagcggcugcucgagauugacagcgucgggucugaggauucccuugauacuucccuuagggcccacgggguucaugccaccaagcaugucccggaaaaaagaccgcuacccauucgccgcaagaggucaaucgaagaagccguacccgcaguauguaagacccguacggugauuuaugaaaucccgagaucccaggucgaucccaccagcgcuaacuuucugauauggccccccugcguugaagugaaaagguguaccggcugcuguaacacuagcucugucaaaugucagcccagcagggugcaucacagaagcgugaagguagccaaaguagaauacguuaggaagaagcccaaacuuaaggaaguucaagucagauuggaagagcaucuggaaugugcuugugccaccacaucucucaaccccgacuaucgagaagaagacaccgacgugagauag

SEQ ID NO: 31797 - RNA, 162 nt, Artificial Sequence
  Description of Artificial Sequence: Synthetic coding sequence
augcgaacacuggcuugucuucugcuccugggcugcgguuaccucgcacauguguuggcagaagaggcagagaucccuagggaaguaaucgaacggcucgcccguagccaaauccacucuauucgugaucugcagcguuuacuggaaauagauaguguauag

SEQ ID NO: 31798 - RNA, 1128 nt, Artificial Sequence
  Description of Artificial Sequence: Synthetic coding sequence
augaugaagaagaacaacuccgccaagcggggaccucaggacgggaaccagcagccugcacccccagagaaggugggguggguacggaaauuuugcggcaaagguauuuuuagagagauauggaagaacagauacguggugcucaagggcgaccagcucuauauuagugaaaaagaggugaaggaugaaaaaaauauccaagagguuuuugaucucucugacuacgagaaaugcgaagagcucagaaagucaaaauccaggagcaaaaaaaaccauagcaaguucacucuugcccacagcaagcagccaggaaacacugcaccaaaccucaucuuucuggccgugucucccgaggaaaaagaauccuggauaaaugcgcugaacagugcgauaaccagagcuaaaaauaggauucuugaugaggcgucuacuaguaccucugaugguaugcugacucuggaucuaauacaggaggaggauccuagcccugaagaacccaccaguugcgcagagaguuuucgcguugauuuggacaaaucuguugcccaauuggcaggcuccagaaggcgagccgauagcgaucgaauucagccuagcgcugaccgggcuuccucacuuagccggcccugggaaaagaccgauaaaggagccacuuauacaccccaggccccuaaaaaguugaccccuaccgagaagggcaggugcgccagccuugaggaaaucuuaagccagcgugacgccgcuagcgcuagaacccugcaauuacgggcugaagagcccccuacccccgcucuccccaauccagggcaauugucccgcauccaggacuugguggcacggaagcuggaagagacacaagagcugcucgcagagguccagggauuaggagauggcaagaggaaggcgaaggaccccccacggagucccccugauuccgagucagaacaguugcucuuggaaaccgaaaggcugcugggcgaggcgaguagcaauuggagucaagcgaagagaguucuacaggaaguucgggagcucagagaccuguacagacaaauggaucuucaaacuccagauucccaccugcgccagacaacaccccacagucaguacaggaaaucacugauguag

SEQ ID NO: 31799 - RNA, 1140 nt, Artificial Sequence
  Description of Artificial Sequence: Synthetic coding sequence
augucuagcccgucccucucggaucucggaaagcgggagccggcugccgcagcagaugaaaggggaacacaacagcgccgggcuugugcaaaugcaaccuggaacaguauucauaauggcgugauagccgucuuucagcgcaaggggcuaccugaucaagagcuuuucagccucaacgagggcguuaggcagcucuuaaaaacggagcuagguagcuuuuuuaccgaguaccuucagaaucaacugcugaccaagggcaugguaauacugcgggacaaaauuagguuuuaugagggacaaaaauugcucgauagccucgcagagaccugggauuuuuucuucuccgacgugcugcccaugcuccaggcaaucuuuuacccagugcagggcaaggagcccucaguuagacagcuugcucucuugcauuuccgcaacgcaauuacccuuucugugaaacucgaagaugcuuuggcccgcgcccaugccagggucccacccgccaucguucagaugcuucucguccugcaaggcgugcacgagucccgaggugugacagaagacuaucugcgccucgagacacuggugcaaaaagucguuagccccuaucuaggcaccuauggacugcauuccucagagggccccuuuacacauucuugcauucuggaaaaacgacugcuucgaagaagccggagcggcgaugugcuggcaaagaaucccgucgugagauccaagucuuauaacacgccucuccucaauccuguccaagaacacgaagcagaaggcgccgcagcugggggcacuagcauucgacgucacagcgucuccgaaaugacuuccugccccgagccucaggguuuuucagauccaccaggucagggcccuacagggacuuuucgcucuucaccggccccccauucuggaccaugcccuagcagguuauauccuacuacacaaccaccugagcagggacuggauccaacaagaucgucauuaccccggaguucaccagagaaucucguagaccagauuuuagaaagcgucgauagugauucugaggguauuuucauugacuuugggagaggacgcgguucuggcaugucagaccuugaagggagcggcgguagacagaguguuguguag

SEQ ID NO: 31800 - RNA, 1032 nt, Artificial Sequence
  Description of Artificial Sequence: Synthetic coding sequence
augaaagagaucaaccuguugccggaucguguguuaucuacuccuucaguucagcugguacagucuugguacgugcagagccuccucgacauuauggaguuccuagauaaagauccagaggaccaucgaacccucucgcaguuuaccgaugcacugguuaccauacggaaucgccacaaugauguugugccgacuauggcucagggggugcuagaguacaaggauacauacggcgaugauccaguguccaaucagaauauccaauacuuccuugaccgcuucuaccugaguagaaucagcaucaggaugcucaucaaucagcauacccucaucuucgacggcucaacaaauccugcucaccccaagcauauugguucuaucgaucccaacuguaacguaagugaaguuguuaaagacgccuaugacauggccaagcugcucugcgauaaauacuacauggcuagccccgaccuggaaauucaggagaucaacgcagcaaacagcaaacagccaauucauaugguuuacgugcccucgcaucuauaccacauguuguucgaacuauucaagaaugcaaugcgggcgaccguggagucgcacgaauccucuuuaauacucccccccaucaagguuauggucgcccuuggcgaagaagauuugagcauaaaaaugucugaucgagggggaggugucccacugcggaagauagagagacuguucucauacauguacagcacugcacccacgccucaaccaggaaccggaggcacaccccucgcugguuuuggauacggccucccuauuuccagacucuacgccaaauauuuccaaggggaccugcagcuguucagcauggaggguuuugggaccgacgccgugaucuaccuaaaggccuuaagcacggacucuguggaaagauugccaguguacaacaagagcgcuuggcgccacuaucaaacaauucaggaagccggagacuggugcgucccgucaacugagccgaagaacacaagcacauacagaguguccuag

SEQ ID NO: 31801 - RNA, 4785 nt, Artificial Sequence
  Description of Artificial Sequence: Synthetic coding sequence
augaaacuguauguuuuucucguuaacacuggcacgacacugaccuuugauacagagcugacaguccagaccguggcagaucucaagcaugccauccagucaaaguacaagaucgcaauccaacaucaagugcuuguagugaacggcggagaaugcauggcugcagaucggagaguauguacuuacagcgccgggacagacacuaauccuauuuuucuguuuaauaaagaaaugauccucugcgauagaccuccagcaauccccaagaccacauuuaguacugagaacgacauggaaauaaagguggaggaguccuuaaugaugcccgccguguuucacacagucgcuagucguacucaguuagcucucgaaauguaugaggucgcgaagaagcugugcucauucugugagggccugguucaugaugagcaccuacagcaccaaggaugggccgcaauaauggcaaaccucgaggacuguucaaacaguuaucaaaaguugcuguuuaaauuugagucuauauauucgaauuacuugcagagcaucgaagauauaaaacugaagcucacucauuuggguaccgcaguuagugugauggcuaagauuccacuguuggaaugucucacucgacauaguuacagagagugucugggaaggcuggacucacuuccagagcacgaggacagcgagaaggcugaaaugaaacguucaacugagcucguccuuuccccggacaugccccgaaccacuaacgagucucugcugaccucauucccuaagagcgucgaacacgugagcccagauaccgcugaugcggaaucagggaaggagauucgagaaucuugccaguccaccgugcaucaacaagaugagacuacaauagauacaaaagacggggaccugccuuuuuuuaaugugucacugcuggacuggauuaaugugcaagacaggccaaacgacguagaaucgcucgugcggaagugcuuugauuccaugucgagacuggauccgcguaucauucgaccuuuuauagccgaauguaggcagacgaucgccaaauuggacaaccagaauaugaaagcgaucaaggggcuggaagauagacuuuaugcccuagaucagaugaucgcguccugugguagacucgugaaugagcagaaggaauuagcucagggauuccuugcgaaucagaagagggcagaaaaccugaaggaugcaucagugcuaccagacuuaugucuaucucaugcuaaucaauugaugauuauguuacagaaccaucgaaagcuccuggacaucaaacagaaauguacaaccgcuaagcaggagcucgcuaacaauuugcauguuagguuaaagugguguuguuuuguuaugcugcaugcugaccaggauggcgagaaacuucaagcacugcuucgucuggucauugagcuguuagagcgggucaagaucguggaagcacucuccaccgucccccaaauguacugccuggcagucgucgaaguagugcguagaaagauguuuauuaagcacuaccgcgagugggccggagcccuggucaaagacgggaaaagacuguaugaagcugaaaagaguaagagggaauccuucggcaaacuauuucgcaaaucuuucuugagaaacagacuguuuagggggcuugacucauggccccccuccuuuugcacccaaaaaccucgaaaguucgauugugaacugccggacauuucucugaaggauuugcaauuucuccagucguuuugccccagcgaggugcagccguuccuaaggguaccacugcuaugugacuucgagccacuccaccagcacguguuggcacugcauaacuuggugaaggccgcacagucccuggacgaaaugagccagacaauuaccgaccuucugagugaacagaaagcuagcguuucccagacuucgccgcaaagcgccucuucuccgcgaauggaguccacugccgguaucacuacaacuacaagcccaagaacuccccccccuuuaacuguccaggacccgcuaugcccagcugugugcccuuuagaggagcucuccccagauuccauugacgcccauacguucgauuucgagaccaucccucacccuaauaucgagcagaccauucaucaaguaaguuuagaucuggauagucucgcugagagcccugagagcgauuucaugagcgccguuaaugaguuugugauagaggagaauuugucgagccccaauccgaucagcgacccucagucucccgagaugaugguggaaucucuguauagcucagugaucaaugcaaucgacucacggcgaaugcaggauaccaaugugugugggaaggaggauuucggcgaccauacuucacugaauguucaguuggagagauguagggugguggcccaggauucucacuucagcauccagacgauaaaagaggaucugugccacuuuagaaccuucguucagaaggagcagugcgacuucaguaacagccuuaaaugcaccgccguggagauccguaauauuaucgaaaaagucaaauguucucuagaaauuacauuaaaagaaaagcaucagaaggagcuucugucuuuaaaaaaugaguacgagggcaagcuugacggucugaucaaagagaccgaggagaaugagaauaagauuaagaaacucaagggggaguuaguuuguuuggaggagguucugcagaauaaggacaacgaauuugcacugguuaagcacgaaaaggaggcugucaucugccuucaaaaugaaaaggaucagaaauuguuggaaauggagaacaucaugcacagccagaauugcgagaucaaagaacuaaaacagucaagggagaucgugcuugaagacuuaaaaaagcugcacguggaaaacgaugagaaacuccagcugcucagagcagagcuacaaucccuggaacagucucacuugaaagaacucgaggacacccugcaggucaggcacauccaagaguucgagaaaguuaugacggaucauaggguaucgcucgaggaacugaagaaagagaaucagcagauuaucaaucagauccaagagagccaugccgaaaucauccaagaaaaggaaaagcagcugcaagaacucaaacuaaagguaucugaucugagcgacacuagaugcaaacuggaaguggaacucgccuugaaagaggcugagaccgaugagaucaagauccucuuagaggaaagcagagcgcagcaaaaagagacccugaagucucuacuggaacaggaaacagagaaccuccggaccgaaaucaguaagcucaaccagaagauccaggacaacaaugagaacuaccagguggggcucgccgagcuucgcacuuugaugacuaucgaaaaagaucaauguauuagcgaacugauuucuaggcacgaagaggaaucuaauauucuuaaggccgagcucaacaaagugaccucgcuccacaaccaagcauucgagauagagaagaaccugaaagagcagaucauugaguugcaguccaaacucgauagcgagcuguccgcacucgaaaggcaaaaggaugagaaaauuacccagcaggaggaaaaguaugaagcuaucauacagaaucuggagaaagaccgccagaagcuggucaguucccaggaacaagaccgcgagcagcugauccagaaacucaacugcgaaaaagacgaagccauucagaccgcccuuaaggaguuuaagcuggaacgagaggugguugaaaaagaauugcuugaaaaaguuaaacaccuggaaaaucagauugcaaagaguccggcuaucgacuccaccagaggagacagcuccucccugguagcggagcugcaagagaaacugcaagaggaaaaagcuaaguuucuggaacaacuggaggagcaggaaaaacggaaaaacgaagagaugcagaacguucggacuucccugaucgccgagcagcagaccaacuuuaacacgguccucacccgugaaaaaaugagaaaagaaaauaucauuaacgaucucagugauaagcugaagucaaccaugcagcagcaagaaagggacaaggacuuaaucgaaagccugucggaggauagagcucgccugcuugaagagaaaaagaaguuggaagaggagguguccaagcuuagauccucuagcuucgugccaaguccauauguggcuacagccccagaacuuuauggcgcaugugccccggagcuaccaggcgagagugaucggagugccgucgagacagccgaugaaggcagaguggacagugccauggaaacgucgaugaugaguguacaggaaaacauccacaugcugagugaagaaaaacagcggauuauguuacuggagaggacacugcaguuaaaagaagaggagaacaaaagacuaaaucaaaggcugaugucucaaagcaugucuucagugucaagucgacauagcgagaagauagcuauucgcgauuuccagguuggcgacuuagugcugaucauccuugacgagaggcaugacaauuacgugcuauucacagugagcccgaccuuguacuucuugcacuccgagucgcuuccugcauuggaucuuaagcccggcgagggcgccucuggggccagucgacgaccuugggugcuaggcaaagugauggaaaaagaguacugccaggccaagaaggcgcagaacagauucaaaguuccucuuggcacaaaauuuuaccgagucaaggccguaaguuggaauaaaaaggucuag

SEQ ID NO: 31802 - RNA, 471 nt, Artificial Sequence
  Description of Artificial Sequence: Synthetic coding sequence
auggcaccugcccgggccggguuuugcccccuucugcuccuccugcugcuugggcuguggguggcugaaauuccaguguccgccaaaccaaagggcaugacuuccucacaaugguucaagauucaacacaugcaaccaucgccucaggccuguaauagugccaugaaaaauaucaauaaacauacaaagaggugcaaagaucuuaacacauuucuccacgaacccuuuucauccguagccgccacaugccaaaccccuaagaucgccugcaagaauggcgacaaaaacugccaucagagccacggcgcagugucguugaccaugugcaagcucacuuccggcaagcacccuaauugcagauauaaggagaaacgucagaacaagagcuacguaguugcuugcaaacccccacagaagaaggacucccagcaguuucaccugguucccguccacuuagaccgcguauuguag

SEQ ID NO: 31803 - RNA, 471 nt, Artificial Sequence
  Description of Artificial Sequence: Synthetic coding sequence
auggcccccgcccgcgcuggauucugcccucugcugcuucugcuucuacuggggcugugggucgccgagauccccgugucagccaaaccuaagggaaugaccuccucucagugguuuaaaauccaacacaugcaaccaucuccccaggcaugcaacuccgccaugaaaaacauuaacaaacacacuaagcguugcaaagaucucaacacuuuccuccacgagccuuuuagcagcgucgccgcgaccugccaaacccccaagauugccuguaagaacggcgauaagaacugucaucagucccauggagccguaagccucacaaugugcaaacuuaccucaggaaagcauccuaacugccgcuacaaggagaaacgccagaacaaauccuauguuguggccuguaagcccccacagaaaaaggacucucagcaguuccauuugguuccgguccaucuugacagaguauuauag

SEQ ID NO: 31804 - RNA, 621 nt, Artificial Sequence
  Description of Artificial Sequence: Synthetic coding sequence
augcugccuccagccauucacuucuaccugcugccucuugcauguauucucaugaagaguugccuugccuucaaaaaugacgcuacugagaucuuguauucacauguggucaaacccguucccgcucacccuucaagcaacucgacccucaaccaggccaggaacggaggccgccacuuuucaaauacuggucuggaccgaaacacucgcguacagguuggcuguagagagcuacggagcacaaaguauauuucggauggacaguguaccucaaucaguccccuaaaggagcucgucugugccggagagugcuuaccacugccuguguuacccaauuggauuggcggcggauauggaacaaaauauuggucccggaggagcucucaggaauggagaugcgugaaugauaagacaaggacccagcgcauccaguugcagugccaggauggcaguacaagaaccuauaaaauaacugucguuacagcaugcaagugcaagcgguauacgcgccagcauaaugaaucuucucauaacuuugaaagcaugucucccgcgaaacccgugcagcaucacagggagaggaagcgcgcauccaaauccagcaagcauaguaugaguuag

SEQ ID NO: 31805 - RNA, 693 nt, Artificial Sequence
  Description of Artificial Sequence: Synthetic coding sequence
augcugcccccggcaauacacuucuaccugcugccucuggccugcauucucaugaagucaugccuugcguuuaaaaacgacgccacagagauccuauauucacacguggugaaaccaguuccagcgcaucccagcucuaauagcacccugaaccaggcccggaacggcggaagacacuuuucgaauaccggccuagacagaaacagaacagaaucccuuacacgacagaauuacuuuuggcuauuuccuggugccuuucucaggcaguuacaggaggcccgcguucaggucggauguagggaacuacgcagcaccaaguauaucuccgacggccaguguacauccaucucaccucuuaaagagcuugugugugccggcgagugucuuccuuuacccgugcugccaaauuggauaggggggggauacggcacaaaguacuggucccgaagaaguucccaggaauggcgaugcgugaaugacaaaacgcgcacccagaggauccaauuacagugccaagacggcaguacacgcacauacaaaaucaccguggucacagcuuguaaauguaagcgauauacgcgccaacauaaugaaucaucccacaauuuugagucaaugaguccagcgaagcccguucagcaucaccgcgaaagaaaacgagccagcaagucuucuaaacacucaauguccuag

SEQ ID NO: 31806 - RNA, 1041 nt, Artificial Sequence
  Description of Artificial Sequence: Synthetic coding sequence
auguuucucucuauuuugguggcccuguguuuauggcuccaccucgcccugggagugcggggcgcgccaugcgaagcaguuagaaucccuauguguaggcacaugcccuggaauaucacccggaugcccaaccaucuucaucauaguacccaggagaacgccaucuuggcaauugaacaauacgaggaacugguagacguuaacuguucugcaguuuugagguucuucuuaugcgcgauguacgcuccaaucuguacuuuggaguuccugcaugacccgauuaagccgugcaagagcgugugccagcgagccagggacgauugugagccccucaugaagauguauaaccacagcuggcccgagucuuuggcuugugacgaacugccagucuacgauaggggaguuugcaucagcccugaagcuauagucacggacuugccugaagacgugaaauggauugacaucacgcccgacaugaugguccaggaaagaccgcucgauguugacuguaagcgacuuucuccugaccgcuguaaauguaagaaagugaagccaacccuggcaaccuaccugucuaaaaacuacuccuaugugauucaugcuaagaucaaagcggugcagcgcaguggaugcaacgaagugacaaccgugguagauguuaaagaaauuuucaagagcuccucucccaucccuaggacacagguccccuugauuacuaauucuucuugccagugcccccacauccucccccaucaagauguguugauaauguguuacgaauggcggaguaggaugaugcuccucgagaacugucuggucgagaaauggcgugaccagcugucuaaaagaucgauucagugggaagagaggcugcaggaacagcgccggacgguucaagauaagaagaagacagcugggcgcacaagucgcucuaacccgccuaagccuaagggaaaaccgcccgcuccaaagcccgcuucaccaaaaaaaaacauuaagacucggucugcccaaaaacgcaccaaucccaaacggguguag

SEQ ID NO: 31807 - RNA, 1032 nt, Artificial Sequence
  Description of Artificial Sequence: Synthetic coding sequence
augaggguagccggcagggaagguagauuucuguccgcuggggucgcagcucgggagggaucggccauguuccugagcauuuuaguugcuuugugccuguggcugcaucucgcccugggcguaaggggggcuccaugcgaagcugugcguauuccgaugugccggcauaugccauggaacauuacucgcaugcccaaucaccuucaucauucaacacaagagaaugccauguacgcacccaucugcacccucgaauucuugcaugaccccauuaaaccuuguaagagugucugccagagggcccgggaugacugugagccuuugaugaaaauguauaaccauuccuggccagaaucacuugcaugcgacgaacugccaguguacgaccgggguguuugcaucucucccgaggccaucguuaccgaccugccagaggacgugaaguggaucgacaucaccccugacaugaugguucaagaacgcccauuagauguugacugcaaacgcuugaguccagaccgauguaaaugcaaaaaggugaaaccuacguuagcgaccuauuugagcaaaaauuacagcuacgucauccacgccaagauuaaagcggugcaaagauccggaugcaacgaagugacaacagucguugacguuaaagaaauuuuuaaaagcagcuccccgaucccccggacucaagucccacucauuacaaacagcuccugucaauguccucauauacugccccaccaggauguucugauuauguguuacgaauggaggaguagaaugaugcuguuagaaaacugucugguggaaaaguggcgcgaccaguugucgaagcgcaguauucagugggaggagcggcuccaggagcagcgcaggaccguccaggacaaaaagaagacagccggaagaacuagucguuccaacccccccaaaccaaaagggaagccucccgcaccaaaaccagcuagcccaaaaaaaaacauaaaaacucgcuccgcgcagaaaagaacaaacccgaaaagaguguag

SEQ ID NO: 31808 - RNA, 807 nt, Artificial Sequence
  Description of Artificial Sequence: Synthetic coding sequence
augccucguagcuuucuugucaaaaaacacuuuaaugccucuaagaagccgaauuauuccgaacuggauacccacacugugaucaucagcccauaucuguacgaguccuacucaaugcccgucaucccccagccugaaauuuuauccuccggcgccuauagcccuauuacuguguggaccacggccgccccauuucacgcucaacuuccaaacggucuuagcccgcucucuggauacuccuccagccugggaagagugucucccccuccuccgagcgauaccucuaguaaggaccacucuggcucugaaagccccauuagcgacgaagaagaacgacuccaauccaagcucagcgacccucacgccaucgaagcagagaaauuucagugcaaccuaugcaauaaaaccuacucgacauucuccggucucgccaaacauaaacaacuccauugcgacgcccagagccggaaaucuuuuucuugcaaauauugugacaaggaguacgucaguuugggagcacuuaagaugcacauucguacacacacacuaccaugcgucugcaagauuuguggaaaggccuuuagccggcccuggcugcuacagggccacaucagaacccauacaggagagaagccguuuucuuguccucauugcaacagagcauuugccgaucggucuaaucugagagcucauuuacagacccacucagacguaaagaaauaccaguguaagaacuguaguaaaaccuucucccggaugucacuucuucauaaacaugaggaaagcggcugcugcgucgcccauuag

SEQ ID NO: 31809 - RNA, 747 nt, Artificial Sequence
  Description of Artificial Sequence: Synthetic coding sequence
auggaaagagcgucccuuauucagaaagcaaagcucgccgagcaagccgagagauacgaggauauggccgcguucaugaaaggugccguugaaaaaggggaggaacuuucuugcgaggaacgaaacuuacugucagucgccuauaaaaacguggugggcggccagagggcggcuuggagaguguugucgucuauugaacagaagagcaacgaggaagggucugaagaaaagggaccagagguaagggaauaccgggagaaaguggaaacagagcugcaaggaguaugugauacugugcugggauugcucgauucacauuuaaucaaagaggccggggaugcagagucuaggguguucuaccugaaaaugaagggugauuacuacagguaucuagccgaaguugcaacuggagacgauaagaagcgaaucauugacuccgcaagguccgcuuaccaggaggccauggacaucagcaagaaggagaugccucccaccaauccgauccgccugggacucgcccugaauuucucaguuuuccacuaugagaucgcaaacagccccgaagaggcaauaagucuggcuaaaaccacauuugacgaggcaauggccgaccuucacacacuguccgaagauaguuacaaggacuccacucucauuaugcaacuucucagagacaaccucacccuguggacugcugacaaugccggggaggaggggggggaggccccucaggaaccacagagcuag

SEQ ID NO: 31810 - RNA, 651 nt, Artificial Sequence
  Description of Artificial Sequence: Synthetic coding sequence
auggaaagagcaucccugauccaaaaggcaaagcuggcagaacaggcagaaagauaugaagauauggcugcguucaugaaaggagcaguagaaaaaggagaggaacugagcugugaggaaagaaaccuccuuagcguagccuauaagaaugugguaggcgggcagcgagcggccuggagagugcugaguagcauagaacagaagagcaacgaggaaggaucggaggaaaaggguccagaaguaagagaguaccggguguucuaccugaaaaugaaaggugauuauuacagguaccuggccgaggucgcuaccggggacgacaagaagcggaucauugauucagcgcguucugcguaccaggaagcaauggauaucagcaagaaagagaugccgcccaccaaccccauucgccuugggcucgcccugaauuucucuguguuucacuacgagauagccaauaguccagaagaggccauuagcuuagcaaaaaccacuuuugaugaggccauggcugaccugcacacucugagcgaggacucauacaaggauuccacacugauuaugcaacuucugcgggauaaucugacacuuuggacagcugauaacgcuggugaagagggaggugaggcaccccaggagccucagaguuag

SEQ ID NO: 31811 - RNA, 12735 nt, Artificial Sequence
  Description of Artificial Sequence: Synthetic coding sequence
augaugcccgcccaguaugcuuuaacuagcucucuuguucugcugguccugcugaguacagcccgagccggcccauuuagcucuagguccaacguuacucuuccugccccuaggccaccaccccaaccuggcggucacacaguaggggcuggcgugggaagccccucuucucagcuguacgagcacacaguggaaggcggcgagaaacagguaguauuuacccacaggauuaaccugccuccuaguaccgguuguggcugucccccuggaaccgaaccaccgguucuggcaagugagguucaggcccuccgagugagguuggagaucuuagaggagcuugugaagggucucaaagaacaguguacaggcgguugcuguccugcaucugcucaggccgguaccggccagacagacgugagaacccucuguucccugcauggcguguucgaccuuucgcgcugcaccugcuccugcgagcccgggugggggggaccaacuugcagugacccgaccgaugcugaaauucccccaucaagccccccauccgcuucuggcucuugcccugaugauugcaacgaucagggucguugugugcggggaagguguguguguuucccuggauauaccggcccuaguugcggauggccuucuugucccggcgacugccagggccggggaagaugcguccagggagugugugucugccgagcuggguuuucuggacccgauuguucccagagauccuguccucgaggauguagccagagaggcaggugcgaaggagggcggugcguuugugaccccggcuacaccggcgaugauugcgguaugagaucauguccacggggcuguucacagcggggcagaugugaaaauggcaggugcgugugcaaucccggcuauacuggcgaggauuguggcguccgcucauguccccguggcuguagucaacgggggcguuguaaggacggaaggugcguuugugacccuggauauaccggagaggauuguggaaccaggagcugccccugggauuguggugaggggggccggugcgucgaugggcggugugugugcuggccgggcuauaccggcgaagauuguuccacaaggacuugcccccgcgacugccgaggccguggacgcugcgaggauggggaaugcaucugcgacacaggauacucgggcgacgacugcggcguacguuccuguccgggugauuguaaucagagagggagaugcgaggacggaaggugcguuugcuggccaggauacaccggaacugauugcggcuccagagcuugcccaagagacugucguggacgaggucggugugaaaacggagugugcgucugcaaugccggguauucaggggaagacugcggagugagaucgugccccggcgacugcagagggcgugggagaugugagaguggcagaugcauguguuggcccggcuacacaggucgggauuguggaaccagagcuugcccgggugacugccgcgguagggggcgcuguguugacggcagauguguuuguaacccuggguuuacaggggaagauugcgguucacgaagaugcccuggggauuguagggggcacggccugugugaggauggcgugugcgucugugaugcuggcuauucaggugaggacugcucuacccgaagcugucccgggggaugccgagggagggggcaguguuuggacgguaggugcgucugcgaagauggguacucaggcgaggacugcgggguccgccaaugcccaaaugauugcucccaacacggggugugccaggacgguguauguauuugcugggaaggguacgucucggaagacuguucaauuagaacuuguccaaguaacugccauggccgcgggcggugugaagaggggcguugccuaugcgacccuggguauaccggacccacaugugcgacacguaugugucccgccgauuguaggggucgugggagaugcgugcagggagugugcuuaugucaugucggcuacggcggcgaggauugcggacaggaggagccgccagcuagcgccuguccgggcgggugcgggccaagagaacugugcagagccgggcagugcgucuguguggagggauucagggggccagauugugccauccaaaccugccccggggacuguaggggacgcggggaaugccacgauggcuccugugucugcaaagaugguuacgccggcgaagacuguggggaagaaguccccacuauugaaggaaugagaaugcaucuccuggaggaaaccaccguuaggacugaguggacaccagccccaggaccaguagacgcguacgaaauucaguucauccccacuacugagggcgccuccccccccuucacugccagagugccuagcagcgcuagugccuaugaccaacguggcuuagcacccgggcaagaauaucaggugaccgugcgagcguuacggggaacaucuuggggccucccagcauccaaaacuauuacaacaaugauugaugggccacaagaccucagaguggucgcugucaccccaacaacauuagaacucggauggcuacgaccgcaggcagaaguugaccgcuuuguugugucauacguuucugcuggcaaucagcgcguucgauuagaaguuccuccugaggcugaugggacacucuuaacagaccugaugcccggcguugaguauguaguuaccgugacagcugaaagggggagagcagucucauauccagcauccguuagggcuaauacagguuccucuccguuggguuuguuggggacuacugacgaaccaccuccguccgggccaucuacaacucagggagcgcaagcacccuugcuucagcaaagaccccaggaacuuggggaacugcgcguucugggccgagacgaaacuggcagguugagggugguguggacggcccagccugauacguuugcuuacuuucagcugcgaaugaggguuccugaaggacccggcgcucacgaagaagugcuuccaggcgauguucggcaggcgcuggugccaccaccacccccagggacccccuacgagcugaguuuacacgggguuccucccgguggaaagcccucagauccaauuauuuaccaggggaucauggauaaagacgaggaaaaaccgggaaaaagcagcggaccacccaggcucggagagcugacuguaacagaucggacaucugacucucugcucuuaagguggaccgucccagaaggagaguuugauaguuuugugauccaauauaaagacagagauggacaaccacagguugucccagucgaggggccccagcgcucugccgugauuaccagucuggacccuggucgcaaauauaaguucguucuguauggguucguagggaagaagaggcauggcccauuaguggcggaagcuaaaauccuuccacaauccgacccuuccccagggacuccuccccaccuggguaaucuuuggguaacugaucccacacccgauagccuccaccugagcuggaccgugccugaaggacaguuugacacauucauggugcaguaucgagacagagauggacggccccagguugugccaguagaaggacccgagcguaguuuugucguuuccucucucgacccagaucauaaguaucgcuucacccuguucggcaucgcaaauaagaagcgguacgguccccucacugccgacggcacaaccgcaccagaacggaaagaagaaccaccgcgaccugaguuucuggagcagccccuccucggugagcucacgguaaccggcgugaccccugauagucugcggcugaguuggacuguugcacaggggccuuuugauagcuuuaugguccaguacaaagaugcucagggacagccccaagcuguccccguggccggcgacgagaaugaagugacugugccugggcuggaucccgacaggaaguacaagaugaaccucuauggucugcgcggccgacaacgcguggggcccgaaucagugguagcaaaaaccgcaccccaagaggaugucgaugaaaccccgucgccuacagaauuaggaacggaggcucccgaguccccugaagagccacugcucggugaacugacagucacuggcuccucaccugauucucugucucuguuuuggaccgugccacagggauccuuugacuccuucacuguccaguauaaggacagagacggacggccccgggcgguccggguugggggcaaggaaagcgaagucacggugggaggacuggagcccggacacaaguacaaaaugcacuuauauggucuccaugaaggccagcgagugggcccuguuagugcaguggggguuacugccccccagcaggaagaaacaccccccgcgacggaaucuccacucgaaccuaggcugggagagcuuacugugacagacgugacaccaaauagcgugggccuguccuggacaguccccgagggccaguuugacucuuucauuguccaauacaaggauaaagacggccagccacagguggugccuguagccgccgaccaacgugaggucacugucuauaauuuagagccugagagaaaauacaagaugaauauguauggccugcaugauggucagcgcauggggccuuuaucugucgucaucgugacggccccacucccuccagcuccugcaacugaggcuucaaagccaccccucgagccaaggcuuggcgagcugacggugaccgacaucacccccgauagugugggucuaagcuggacagugcccgaaggugaguucgauuccuuugucgugcaauauaaagaccgcgauggacagccacaagugguucccguggccgcagaucagagagaggugacaauaccugaucuggagccuucgcgcaaauauaaguuucugcucuucggcauacaggauggaaaacgcagaucuccuguaucuguagaggcaaaaaccguggccagaggcgacgccucccccggagcaccccccaggcugggagagcuauggguaaccgacccuacacccgacucguugcgcuuaaguuggaccguuccagagggccaguucgacagcuuuguugugcaguucaaagacaaagacgguccccaagucguuccgguugaaggucacgaaagaagugugaccgucacuccacuggacgccggccgaaaguaucgguucuuauuguacggucugcuugggaagaaacggcacggacccuugaccgcugacggcaccaccgaagcgaggucagcuauggaugacaccggcacuaaaaggccgccuaagccccgccuuggggaggaauuacagguaacuacagugacccagaacucagugggcuuguccuggaccgugcccgaaggacaguucgauuccuuugucguucaguacaaagaucgcgacggacaaccccaagucgucccaguggagggcucucuaagggaggugagugugccgggccuggaucccgcgcacagauauaaacucuuacuguacggccuucaccaugggaaacgugucggcccuauuuccgccguggcgauaacagcggggcgcgaagagacagaaacagagaccacagccccaacaccgcccgcuccggaaccucaccugggagaguuaacgguagaggaggcaacuucucacacccugcaccuauccuggauggugacugaaggcgaauucgacagcuucgagauccaguauacagauagagacgggcagcuccagaugguccggauugguggggacaggaaugacaucacauuaagcggccuggaguccgaucaccgguaucuuguaaccuuguacggcuucagugacggaaagcacguggguccaguacacguggaggcucucacagugccggaggaggaaaagccuuccgaaccuccuaccgcuacccccgaaccuccuaucaaaccuagacugggagagcucaccgugaccgacgccacacccgauucccuuucucucuccuggacuguacccgaaggccaguucgaucacuuucugguccaguauagaaauggugacggacagccuaaggcaguaagggucccaggccacgaggaaggcgucacuaucucaggccuugaaccugaccauaaguauaaaaugaaucucuaugguuuccacgguggucagcgaauggggccugucucaguagucggugugacagcagccgaggaggaaacuccuaguccaacggaaccaagcauggaggcgccggaaccagcugaggagccccugcugggcgaacucaccguaacagguuccuccccggacucacugucacuguccuggacugugccucaaggacgauucgauagcuuuaccguacaguacaaggaccgugaugggcgcccccagguggucaggguggguggcgaagagucagaagugacuguuggcggacuggagcccggccguaaauacaagaugcaucucuauggucugcacgaggggaggagaguuggcccuguuuccgcagucggcgucacagcuccugaggaggaaagcccagacgccccgcucgcuaagcugagacugggccagaugaccgugcgcgacaucacaagugacucccugagcuuguccuggacggucccagaagggcaguucgaucacuuccuggugcaguuuaagaauggagauggacagccaaaagccguucgugugcccgggcacgaggacggaguuacaaucucuggccuggagccggaucauaaguacaaaaugaaccuguacggauuucaugggggccagcggguuggcccuguuuccgccguuggacugacagcaccuggcaaggacgaggagauggcucccgccagcacggagccucccacccccgagccccccauaaagccucgucuagaggaguuaacagugacagacgcaacaccagacucccuuucacugaguuggacagugcccgagggccaguuugaucauuuucuggugcaguauaaaaacggagacgggcagccuaaagcuacccgaguaccugggcacgaggauaggguuacgauuucaggcuuagagcccgacaacaaauacaagaugaauuuguauggguuucacgggggccagaggguggggcccguguccgcuaucggcgucacggccgcggaagaagagaccccuagcccaaccgagccaaguauggaggccccugaaccccccgaggagccacugcugggcgagcugaccgugacuggcucaucccccgauagucugagucugaguuggacggucccacagggaagauuugacagcuucacaguccaguacaaggauagagacggaaggccccaagugguuagagugggaggcgaggagagcgagguuacagucggagggcucgagccugggagaaaauauaaaaugcacuuguacggucuucaugagggaagacgagucgguccaguuuccacagugggagugacagcuccgcaggaggauguggaugagacccccucaccuacagaaccgggaaccgaagcgccgggccccccagaggaaccucuucugggagaauugaccguaaccgggagcuccccagacucucuuagucuaucuuggacugucccccagggucguuucgauucauuuacaguacaauauaaggaucgggaugguaggccccaggccgugcggguugggggccaagaguccaagguaaccgugcgcggccuggaaccaggucgaaaguacaaaaugcaccuguaugggcugcaugaaggucgccgccucggcccugugagugcggucgguguaaccgaagacgaggccgaaacaacacaggccgucccaacuaugaccccagaacccccuaucaagccgcggcucggggaacugacaaugacagaugcaacccccgauagucugagccucagcuggaccgucccggagggacaauuugaccacuuuuugguucaguaccggaacggcgacgggcagcccaaggcagugagagugccaggccacgaagacggggugaccaucuccggacuggaacccgaccauaaauacaaaaugaaccuguauggcuuccauggagggcagagagugggaccuauuuccgugauuggugugacggccgccgaagaggagacucccucacccacagaguuaagcacugaggcccccgaaccccccgaggagccccuguugggugaacugaccgugaccggcucaucuccagauucacugagucugucauggacuauaccgcaggggcacuuugacaguuuuacaguacaguacaaagaucgcgacggacgaccgcaggugaugcgcguucgcggugaagaaucugaggugacgguggggggucuggaacccggacgaaaauacaaaaugcaccuuuacggguuacaugaagggcgacgaguaggaccuguaagcacugugggcgugacggccccagaagacgaggcagaaacgacccaggcuguuccuaccaccacuccugagccuccaaauaaaccuagacugggugaauuaacgguaacugaugcuacccccgacaguuuauccuugucuuggaugguuccugagggucaguuugaccacuuccuggugcaauauagaaauggggauggucagcccaaggucgucagaguuccaggucacgaagacggcgugacuauuuccggucuagagcccgaucacaaauacaagaugaaucuuuauggcuuccacggaggacagcgggucgggccuaucucagugauaggcgugacagcggccgaggaagagaccccagcuccuaccgaacccagcacugaggcacccgagcccccugaagagccacugcuuggcgagcucacagugacggguucaucaccagacucucucucccucaguuggacaauaccgcaggggagauuugacuccuucaccguacaguauaaggaccgagaugguagaccccagguugucagaguuagaggcgaggaauccgagguuaccgucggaggccuugagccaggguguaaauauaaaaugcaucucuacggucuccacgaaggacagcgcguagggccugugagcgcagugggcgucacagcaccuaaggaugaggccgaaacuacccaagcaguucccaccaugacaccagaaccgccgauuaagccucgucugggagagcugacaguaacugacgcaaccccagauucccugagucucagcuggauggucccugaggggcaauucgaccacuuuuuaguccaguaucgaaacggggauggacagccaaaggcugucagaguaccuggacaugaagauggagugacaaucagcggacuggaaccugaucacaaauacaaaaugaaccucuacggauuucauggcgggcagcgagucggucccgucagugcuaucggcgucacagaagaagagacgccgucuccuacugagccaucaaccgaggccccagaggcccccgaggagccccugcuuggcgagcugaccgucacaggauccucuccggacuccuugucuuuaaguuggacaguuccacaaggcagauucgacucauucaccguucaguacaaagaucgcgacggacagccgcagguggugcgcguacgcggugaggagagcgaggugacuguggguggccuggaaccggggaggaaguacaagaugcacuuguacggucuccacgaaggacagagagucgggccaguuuccacuguagggauaacagcaccccugccuacacccuugccagucgaacccaggcugggugaacuggccguagcugcagucacgucagauaguguuggacucaguuggacagucgcacaaggaccauuugacaguuuccuaguucaguacagggaugcgcaaggccagccccaagcgguacccguauccggugaucugcgcgcuguggcugucuccggucuugaucccgcgagaaaauacaaguuuuugcuauuugggcuucagaacgggaagaggcaugggcccgugccaguggaagcacgcacagcgccggauacuaagccaucuccuagacugggggaacugacgguuacugaugcuacgccggacucagugggacucucauggaccgucccugaaggcgaauucgauucuuucguuguucaguauaaggacaaagacggccggcuccaagugguuccuguugccgccaaccagcgagaggugacugugcagggccuggagccuagucggaaguaucgcuuccuucuguauggccugagcggacggaagcggcucgguccaaucagcgccgauaguacuacagcgccucuugaaaaagaguugcccccgcaucuaggggagcucacaguagccgaggaaacuagcucgagccugcgucuguccuggaccgucgcgcagggccccuuugauucguucgucguucaauacagagauacugacggccagcccagagcuguccccgucgcagcugaccagcgaacggugacuguggaggaucuugaaccuggcaaaaaauauaaauuucuauuguauggacuguuggggggaaaaaggcucgggcccgugucagcgcugggcaugacagcuccugaggaagauacgccugcaccugaacuggcaccagaggcuccagaacccccugaagagcccaggcuggggguucugaccgugacugacacaaccccugauagcaugcgucucagcuggucuguggcucagggucccuuugauaguuuugucgugcaguaugaagacacgaacggacagccucaggcauuacucguugauggggaccaguccaagauucucauuucugggcuggaacccucuacgccuuauagauuccuccuauacggucugcacgaggggaaacgccucggcccucugucagcugaagguaccaccggguuggcaccagcuggacagaccagcgaagaaucaaggccuaggcugucccagcugucagugaccgacgugacuacaucuagccugcggcugaauugggaggccccccccggagccuuugauuccuuccuguugcgauucggggugccuucuccuucuaccuuagagccacauccaagaccuuugcuacagcgggagcucauggugcccgggacucggcacuccgcugugcuuagagaccugcgguccggcacgcucuauucccugacucuguacgguuugcguggcccacacaaggcugacagcauccagggcaccgcucgcacucuaagucccgugcuagagaguccucgagacuugcaauucucggagauucgugaaaccuccgcaaagguuaacuggaugccaccuccuagcagggcugauucguuuaaaguaucuuaucagcucgcggauggaggagagccucagucggugcaggucgaugggcaggccaggacgcagaaacuucaggggcuuaucccgggagccagauaugagguaacaguggugagcguccggggauuugaggagucagagccccugacaggguuucucacaaccguuccugacggaccaacgcaguuacgcgcacugaauuugaccgaaggguucgcaguacuucauuggaaaccgccacagaacccuguugacacauaugaugugcagguaacugcucccggugcaccuccguugcaggccgagacaccagggagcgcuguggauuacccccuacacgaucuaguguuacauacuaacuauacagcuacagugagaggccuucggggucccaaccucaccucccccgccucaaucacauuuaccaccgggcucgaagccccaagggaccuugaggccaaggaagucacaccuagaacugcccugcugacauggacggaaccuccaguaagaccugccggguauuuauuguccuuucauaccccuggaggccagaaucaggagaucuuacugccaggcggcauuacgagucaucagcuccuggggcuuuucccaagcacaaguuauaaugccagacuucaggcaauguggggucagucucuccucccaccuguuagcaccagcuuuacuacugguggccugcgcauccccuuuccacgggacuguggggaggagaugcagaacggggcaggggccagccgcacuucaacaauuuucuuaaaugggaaucgggaacggccacuuaauguuuuuugugacauggaaacagaugggggcggcuggcucgucuuucagcgucgcauggacgggcagacugacuucuggagagauugggaagauuacgcccauggcuuugggaauaucaguggggaguucuggcucggcaacgaggcuuugcauagucuuacucaggcuggugauuacagcaugagaguggaccuacgggcuggggacgaggccguguuugcccaguaugacuccuuccauguggauucagcagcggaauacuaucggcuccaucuggagggcuaucacggaacagcaggcgacagcaugucuuaucauagcggaaguguauuuagugcuagggacagagauccaaauagccugcuuauuagcugugccguaucuuaucgcggggcauggugguaccggaauugccauuacgcuaaccugaauggauuauacggcuccacuguggaucaccaagguguuucgugguaucauuggaaaggcuuugaauucuccguccccuucacagaaaugaaacugcgccccaggaacuuccgaagcccagcaggcggaggcuag

SEQ ID NO: 31812 - RNA, 12729 nt, Artificial Sequence
  Description of Artificial Sequence: Synthetic coding sequence
augaugcccgcacaguacgcccuuacaaguucacuggugcuccuggugcugcuuucgacagcccgcgccggacccuucucaagccgaucuaacgugacccugccggcuccuaggccaccaccccagcccggcggucacaccgucggugcaggcgucggcagucccuccucucagcucuacgagcauaccgucgaagguggcgaaaaacaggucguguucacacaucgcauuaaccucccgccauccaccggcugcgggugcccaccuggcacugagccacccguccuugccuccgagguacaggcauugaggguccgccuggagauuuuggaggagcucguuaaaggauuaaaggaacagugcaccggggguuguugucccgcaucagcgcaggcaggaacaggccaaacugacguccgaacccuuugcuccuugcaugggguguucgaucuguccagguguaccuguuccugugaaccuggcuggggaggcccuacauguucagaucccacugaugcagagauucccccauccagccccccaagcgccaguggcaguuguccagacgacuguaaugaccagggacgcugcgugcgaggucggugcguguguuuuccaggauacacaggucccucguguggcuggccuaguugcccuggggacugucaggggcgcgggcgcugcgugcagggugugugcguuugccgggccggguuuagcggacccgauugcucccagcgcagcuguccuagaggcugcagccagcgcggccggugugaaggaggccguugcgugugcgacccaggauacacuggcgaugauugugggaugagauccugcccgcgcggcugcucccaaagaggcagaugcgagaauggccgaugcguaugcaauccaggauauacuggagaggacugugguguucgcagcugcccacggggcugcagucagcgaggacggugcaaagacgggaggugcguuugugauccuggcuauacaggggaagacuguggaaccagaucauguccgugggauuguggugagggcggccggugcguggauggacgcugugucugcuggccaggcuauaccggggaggauuguaguacccggacguguccaagggacugccggggacgaggucggugugaggauggugagugcaucugcgacacuggauauucgggugaugacuguggcguaaggucuuguccuggcgacugcaaccagcgggggagaugcgaggacggcagaugcguguguuggcccggcuauacuggcacggauugcggaucacgagcuugcccaagggauugccggggacgcgggcgcugugaaaauggagugugugugugcaaugcaggauauucuggagaggacuguggaguacguagcuguccuggcgacugcagaggcagaggaaggugcgaauccggcagauguauguguuggccaggcuacaccgggagggacugcgggaccagggccugcccgggugacugucggggccgggggagauguguugauggcagauguguuugcaaccccggauucacaggagaggacugugggucgcggcgcugcccaggcgauugcagagggcacggacugugcgaagauggcgugugugugugcgaugcaggguacagcggggaggauugcucuacgcguuccugccccggugguugccgcggaagagggcagugcuuggaugguagaugugugugcgaggacgguuauaguggcgaagauugcggcgugcgacagugccccaacgauuguucacagcacggaguaugccaggauggcgugugcauuugcugggaaggcuacgucagcgaggauuguuccaucagaaccugcccaaguaacugccacgguagaggccggugugaggaagggcgcugcuugugugauccgggauauacaggaccuacuugugcuacacguaugugucccgcugacuguaggggccggggacgcuguguacagggaguaugccuaugccacguaggguacggaggcgaggauugcggucaagaggaaccuccagccucagccuguccgggggggugugggccucgcgaguugugucgugcaggccaaugcguguguguggaaggcuucaggggcccugauugcgccauccagacauguccuggcgacuguaggggcagaggcgagugccacgacggaucaugcguguguaaagacggcuaugccggggaggacugcggcgaggaagucccuaccaucgagggcaugagaaugcaccuccucgaggagaccacggucaggacugaauggacgccugcacccgguccuguagacgcguacgagauccaguuuauccccacaaccgaaggugccucgccacccuuuacagcacgaguccccucaucugccagcgccuacgaucagaggggccucgccccaggacaagaguaucaaguuacagugagggcucuacggggcacauccuggggacucccagcauccaagacuaucacgacgaugaucgacggaccacaggaccuacggguuguggcggugaccccgacgacucuugaacugggcuggcucagaccucaggccgagguggaccgauuuguggugucuuacguuuccgccggaaaucagcgugucagauuagagguccccccugaggccgaugggacccugcucacggaucuuaugccgggcgucgaguacgugguuacuguuacugcugagagggguagagccguuuccuacccagcaagcguccgggcgaacaccggcaguagcccguuggggcugcucgguaccaccgacgagcccccgccuucgggcccuucaaccacccagggggcccaggcaccccuacuucagcagagaccacaagagcuuggagaauuacgugugcugggcagggaugaaacaggcaggcuccgagucguuuggaccgcccagccagauacuuucgcuuacuuucagcuucgaaugaggguucccgagggcccuggagcccaugaggagguacuacccggagaugugagacaagcccugguaccccccccuccgccuggaacgccuuaugaguuaucuuuacauggaguaccccccggugguaaaccuucugaccccauuauuuaccagggaauuauggauaaggacgaggagaagcccgggaaaaguucaggccccccuagacugggugaacuuaccguuacagauagaaccuccgacagcuugcuccugcgauggacagucccugagggggaguuugacaguuucgugauucaguacaaggauagagauggacagccucaagucgugcccguggaaggaccacagcgcagcgcggugaucaccagccuggacccagguaggaaguauaaauucguguuauacgguuucguuggcaagaaaagacacggcccacuugucgcugaggcuaaaauccugccccaaucugacccuucaccgggcacacccccgcaucuagggaaccuauggguaacagauccgacucccgacagccuccaccugagcuggaccgucccugagggccaguuugacacauuuauggugcaguaccgcgaccgugacgggcguccccagguggugcccguggaaggaccagagcgaagcuuuguuguuucuucccuggacccagaccacaaauaucgauucacacuuuuuggaauugccaacaagaagagauacggaccucuuaccgccgacggaaccaccgccccugaaaggaaggaagagccgccgagacccgaauuucuugaacagcccuuguugggggaacugacaguaacaggaguuacuccugacucccuuaggcucucauggaccguggcccaaggccccuucgauuccuucauggugcaauacaaggaugcacagggacagccacaggcagucccagucgccggggaugaaaacgaagucaccguccccggccuggauccugaccgcaaguacaagaugaaucuuuauggccuaagaggaagacagcguguggggccagaaaguguuguggcaaagacggcaccccaggaggacguagacgaaacgcccagucccacagagcucggcacggaagcuccagagagcccugaggagccccugcucggcgagcucacaguuacuggguccagcccggauucucugucuuuguucuggacgguuccccaggggagcuucgauagcuucacuguacaauacaaggauagggacggaaggccccgcgcugugagagucggcgggaaggaguccgaagucaccgugggcggacuggagccuggucacaaguauaaaaugcaccucuacggcuuacacgagggccaaagggugggcccggugucagcugucggagugaccgccccgcaacaggaagagaccccuccugcuacugagucaccacuggagccacggcuaggggagcucaccgucacugacgugaccccuaauagcgucggacugucuuggaccgugccugagggccaauuugacuccuucaucguccaauauaaggauaaagauggccagccccaggucgugccugucgccgcugaccagcgggagguaacaguguacaaucuggagccggaacggaaauauaaaaugaacauguacggccugcaugacggccagcggauggguccccucuccguggugauaguaacagcuccucugccgcccgcuccagccacagaggcuucuaaaccaccucuggaacccagacuaggcgagcugacgguuacggauaucacucccgauagcguggguuuauccuggacaguccccgagggugaauucgacaguuuugucgugcaguacaaggacagagauggccagccccaggugguuccuguugccgccgaucaacgcgagguuacuauuccagauuuggaaccgagccgaaaauacaaguuccuacucuucgguauccaggauggaaagagacgcuccccugucaguguggaggccaaaacgguggcccggggugacgccucuccuggcgccccaccucgccugggcgaacucugggugacugaucccacaccugauucccuucguuuaagcuggaccgugccugagggucaguucgauagcuucgugguucaauuuaaggauaaagaugggccccagguggucccaguagaaggccacgaaagguccgucacuguuacaccauuagaugccggucgaaaguaccgauuccugcuguauggccugcuggggaagaaacgacaugguccacuuacugcugacggaacuacggaggcccgcagcgcaauggaugauacaggcaccaaacggcccccuaagccaaggcucggugaggaacuacaagugacgacaguaacacagaauuccguuggguugucuuggacugugccagaaggacaauuugacuccuuugugguucaguacaaggauagggacggccagccccaaguaguaccaguggagggcucccugagggaaguauccgucccaggucuggauccggcacaccgcuacaaauuacuauuguacggccuacaccaugguaaaagagugggccccauuagcgcugucgcaaucaccgccgguagagaggagacagagacagaaacgacagcacccaccccccccgcgcccgaaccacaucucggcgagcuuaccguugaagaggccacuucucauacauuacaucugucuuggauggugaccgagggagaguuugauucuuuugaaauccaguacacagaucgagauggacaacuacaaauggugcgaauugggggugaucguaaugauauuacccuaagugggcuggaaucagaucaccgguaucuaguuacauuguauggguuuagcgacggcaagcacgugggcccugugcaugucgaggcucugacgguuccagaggaggagaaaccaucugaaccacccacagcgacaccggaaccaccgaucaagccgcggcugggggagcugacggucacggacgcaacacccgauucccucucccugaguuggacugugcccgaagggcaguucgaucacuuucuaguccaguaucggaauggggauggccaaccaaaggcaguccgggucccagggcacgaggagggcgugacuauuuccggacucgaaccagaccacaaauacaaaaugaauuuguacggcuuccauggggggcaaaggauggggccaguuuccgugguaggagugaccgcagccgaggaggaaaccccaagucccaccgagccuucuauggaggccccagagcccgcugaggaaccccuccugggggagcucaccgugaccggguccaguccagacagucugucucuuucuuggacaguuccacagggcagauuugacagcuuuacgguacaguacaaggauagagacggccggccucaaguggugcgcguggggggggaagagagcgagguuaccgucggaggucuggagccaggaaggaaauauaaaaugcaccucuacggacugcacgaagggaggcgggugggaccugugagcgccguuggcgugaccgcacccgaggaggagucuccggacgccccauuggcuaagcuccgcuuagggcagaugacugugcgcgacauuaccagugacucccugagcuugucguggacgguucccgaaggacaguuugaucauuuccucgugcaauuuaagaauggugacgggcaaccuaaggccguaagagugcccggccacgaggauggcguuacuauuagcgggcuggagcccgaccauaaauacaaaaugaaccucuacggauuccacgggggacagcgcgucggaccugugucggccguuggacuuacagccccaggcaaagacgaggagauggcuccagccucaacugagccacccacuccggagcccccuauuaaacccagacuggaggagcuaacugucacagacgccacgccugacucucucagccugucuuggacagugccagaggggcaauucgaccauuuucugguucaauauaagaauggagacggacagccuaaagccacacggguccccggacacgaggacagaguuacuaucagcggucuggagccagauaauaaauauaagaugaacuuauacgguuuucacggaggccagcgcgucggcccagucagugccauuggagucaccgcugccgaggaggaaaccccuagcccuacugagcccaguauggaagcgcccgagccuccagaagagccucuccugggcgaacuuacugugaccggaagcuccccugacagcuuaagccugucauggaccguuccucaggggagguucgacucauucaccguucaguacaaagauagggauggucggccacaggugguucgaguggggggcgaagagagugaagucacggugggcggacuggaaccaggcaggaaauacaagaugcaccuguacggccuucaugagggcagacgagucggacccgucaguacaguaggcguaaccgcuccucaggaggauguggaugagaccccuagcccaaccgaacccggcaccgaagcaccugguccuccggaggagccacuucucggggagcugacugugacaggcucauccccggauucucuguccuugaguuggacaguaccacagggacgauuugacucuuuuacgguacaguauaaggaucgcgacgguagaccucaggcugugcgggugggggggcaggaaaguaaggugaccgugaggggucuggagccugggcgcaaauacaaaaugcacuuguacggccuccacgagggccgcaggcuuggaccaguuagcgcugugggggugacggaggacgaagcugaaacgacucaggcuguaccuacuaugaccccagaaccuccaaucaaaccccgacuaggagaacugacaaugacagaugcaacaccugacagccuuucgcugucuuggacugucccggagggucaguuugaucacuuucugguacaguaccgcaacggcgacggccagcccaaagcagugagagucccuggccacgaggauggcgugacaaucucuggacuggaaccugaucacaaguauaagaugaaucucuacggauuccauggggggcagcgcguuggcccaaucagugugaucggcguaaccgcagcagaggaggagacacccuccccaacugagcuaagcaccgaggccccugagcccccugaagaaccccuccucggugaacuaacagugacaggcagcuccccagacucccugagccucaguuggacaaucccccagggccacuucgacucguuuaccguucaauacaaggauagggacggcaggccacaagucaugagaguuaggggugaggaaucggaaguaacugucgggggacucgagccgggccguaaauacaagaugcaucucuauggguugcacgagggacguagagugggcccagugagcaccgugggcguuacugaggacgaagccgagaccacgcaggcuguaccaacaaccaccccugagccuccgaacaaacccagacugggggagcuaacugugaccgacgcaacaccugacagucucucacucucuuggauggugcccgaggggcaguucgaucacuuucuuguucaauacaggaacggcgaugggcagcccaaaguggucagggugccuggucacgaagacgguguaacaauuagcggacucgagccagaccauaaauacaagaugaaccuguacggguuucacggcggucagagggugggccccauaagcgucaucggugugaccgccgcggaggaggagaccccagcacccacagagcccucaacagaagcccccgaaccccccgaggaaccccuccugggagagcugacuguuacgggcuccucgcccgauucacugagccuauccuggacaauuccccaaggacguuucgacucguucacaguccaguacaaggauagagauggacguccucagguuguucgaguccgcggggaagaaucggaagugacaguugggggucuggaaccuggcugcaaauauaaaaugcacuuguauggauugcacgagggacagaggguuggacccgucuccgcuguggggguuacggcgcccaaagacgaagcugaaacgacucaggcaguaccgaccaugaccccagaaccccccaucaaaccacgccucggcgaacugaccgugacagaugccacgccagacucucuuagccugagcuggauggugcccgagggucaguucgaccauuuucuagugcaauaccggaacggcgauggucagccaaaagccgugcgggugcccggccaugaagacggaguaacuaucucagguuuggaacccgaucauaaauacaagaugaaccuauacggcuuucauggaggccagcgaguggggccagugucagcaauaggcgugaccgaagaggagacacccucaccaacugaaccuucuacggaagcaccagaggcccccgaggaaccucuucugggggaauugacuguaaccggcucgucacccgacagccuuucccugagcuggacuguuccucagggaagguuugacucuuucaccgugcaauacaaagauagagacggccagccucaggugguacgcguuagaggggaagaguccgaggugacuguagguggguuggagcccggccggaaguacaagaugcaucuauacggucuucaugaaggacagagggugggccccguuucuacugucggaauaaccgcuccuuugcccacuccccucccuguugaaccuaggcugggugaauuggcaguggccgcugugacaagcgacucaguggggcucuccuggacaguggcucagggccccuuugacagcuuucugguccaguaucgggaugcccaggggcagccacaggcuguaccuguuaguggcgaccuccgggccgucgcuguguccggcuuagauccugcgcgcaaguauaaauuucuauuauuuggucuacagaauggcaaaaggcauggccccgugccaguagaagcuagaaccgcuccagacacaaaaccuucacccagauuaggagaauuaaccgugacagacgccaccccagacucuguuggucugagcuggacuguuccagagggcgaauuugauaguuucgucgugcaguauaaggacaaggacggccggcuccagguggugcccguugcggccaaccaacgugaggugacuguucaagggcucgaaccaagccgaaaguauagguuuuugcuuuauggacugagcggccgcaagcgccuagguccaauuucagccgacucuacaacugcgccacuggagaaagaauugcccccucaccugggggaacucacuguugccgaggaaaccuccuccaguuuaagguuaagcuggaccguugcccagggccccuucgauucauuuguugugcaguacagagauacagacgggcagccacgugcuguuccugucgcagcggaucagaggacggugacuguggaggaccuugaacccggcaaaaaguacaaauuccugcuguacggacugcucggggggaagcgcuugggcccaguaucugccuuaggcaugaccgcgcccgaggaagacaccccugccccugaacuggcaccagaggcucccgaaccucccgaggagccuagauuaggcguacugacgguaacagacacuacacccgacucuaugcgccucuccuggucaguggcccagggcccguuugauucuuucgugguccaguaugaagacacgaacggccagccucaggcgcuccuuguggacggugaccaaaguaagaucuugauuagcggccuggagcccaguacgcccuacagauuucuucuguauggccugcacgaaggaaaacgcuuagggccccugucagcagaagggaccacagggcuggcgcccgcagggcagaccagcgaagaaucccgcccucgguuaucacaacucuccgucacugaugugacaacaagcagucugaggcugaacugggaagcgccgccaggugccuuugacagcuuccuacuuagauuugggguccccucgcccuccacucuugagccgcauccccguccacugcugcagcgggagcuuaugguacccgggacacggcauuccgccguccuccgcgaccuucggucuggcacucuuuauagucugacuuuauacggccuuaggggcccgcacaaggcugauaguauacagggaacugcccggacauugucgcccguguuagagaguccgcgggaccuccaguucagugaaauuagagagaccagcgccaaagucaauuggaugcccccgcccucacgggccgauagcuuuaagguaucuuaucaguuggcugaugguggcgaaccccaguccgugcaggucgacggucaagcccggacccaaaaguuacagggccugaucccuggugcucgauacgaggugaccguagugaguguucgaggguuugaagagagcgagccccuuacaggguuccugacuacggucccggacgguccuacucagcugcgggcucuaaaucucacugagggauuugccgugcuucauuggaagccuccccagaauccagucgacacauaugacgugcagguuacagcacccggcgccccucccuuacaggccgagacccccgggucggcugucgauuacccccuucacgaccuggucuuacacacaaacuacaccgccacagugcggggccugcgaggcccaaaucucacuagccccgcguccauuacauuuacaaccggccuagaggcuccacgcgaucuugaagcuaaggagguaacuccacgcacugccuuacugacguggacugagccaccuguuaggccagcaggcuaccuucugucuuuucauacaccggguggccaaaaucaggagauccuccuaccgggaggcauaaccucucaucagcugcucggccuuuuccccagcacaagcuauaaugcaaggcugcaagcaaugugggggcagucauugcugcccccagugagcaccaguuucaccaccggaggcuugcguauucccuuuccaagagacugcggcgaagaaaugcaaaacggggccggggcaucgaggacaucaaccaucuucuugaauggaaauagagagcgcccacugaacgucuucugcgacauggagacugauggcggggguugguugguguuccagcgacgcauggacggccaaaccgacuucuggagagacugggaggacuacgcucacggauuugguaacaucucuggggaauucugguugggaaaugaggcucugcacucccuaacgcaggcuggcgacuacaguaugagaguggacuugcgggcaggagacgaagcgguguuugcccaguacgauucauuucacguagacuccgccgccgaguacuaccgucuacaccuugaaggguaccacggaacugccggggauaguaugaguuaucacucaggaucugucuuuucagcacgggaucgagaucccaacucauuguuaauuucuugcgccgucucuuauaggggagccuggugguaccggaacugucacuacgcgaacuugaacggucuguacggcuccaccguggaucaucagggggugucaugguaccacuggaaaggauuugaauuuucuguuccguucaccgagaugaagcugaggccgcguaauuuccgcucccccgccggcggaggauag

SEQ ID NO: 31813 - RNA, 2022 nt, Artificial Sequence
  Description of Artificial Sequence: Synthetic coding sequence
augcgauuaucauggaguguagcccagggaccuuucgacucuuuugucguccaauacgaagauacaaacggucaaccccaggcgcuucucguggauggcgaucagagcaaaauucugauuuccgggcuggagccuucuaccccauaccgguuccuucucuacggacuucacgaaggcaaacggcucggcccacugagugccgagggcaccaccggauuggccccagccgggcaaaccagugaggaaucccgcccacggcugucucaacuguccgugacugacgugacuacuucaucucugcggcucaauugggaggccccaccuggagcuuuugacucauuucugcugagauucggugugcccagcccgagcacacuggaaccccaccccagaccccugcuucagcgagaacugauggugccuggaacacgucacucagccgugcugcgcgaccugaggaguggaacauuauacucacuaacccuguauggccugcgcggaccgcauaaagcagauuccauccaggguacagcccgcacucuuucuccagugcuugaguccccccgagauuuacaauuuucagaaauucgagagacaucagccaaggucaauuggaugccuccaccgagcagagcugauagcuucaaggucagcuaccaguuggcggacgguggagagccucagaguguucagguagacgggcaagcaaggacgcagaaacuccaaggacucaucccuggcgcuagguaugaaguuaccgugguguccgugcgcggcuucgaggaguccgagccacugaccggguuccucaccacaguucccgacgggccaacacaguugagggcuuugaaccuaacagaagguuucgcagugcugcauuggaagcccccucaaaaucccguagauacauacgaugugcagguaaccgcgccaggcgcaccuccuuugcaggcugagacuccgggcucagccgucgauuauccauuacaugacuuaguguuacacaccaauuacaccgccaccgugagaggacuucgcggaccuaaccugacauccccugcaagcauaacauuuacaacuggucuggaagcuccaagggaucuugaggcgaaagaagugaccccacgaaccgcgcuguuaacuuggacggaaccgccuguaaggccagcuggcuacuuguugagcuuucauaccccaggaggccaaaaucaagaaauccucuugcccggggggaucaccagucaucaacuccucgggcuguuccccagcacaagcuacaaugcccgccuccaggcaauguggggccagagccugcucccaccuguuucgaccaguuucaccacaggaggacugaggauaccguuuccccgcgauuguggagaggagaugcaaaacggugcaggagcaucuagaacaagcacuauauuuuugaacggaaacagggaaagaccgcugaauguuuuuugcgacauggaaacagauggaggaggcuggcugguguuccagagacgcauggaugggcagacugacuucuggcgcgauugggaggacuaugcucacggcuuuggaaauaucaguggggaguucugguuagggaacgaggcauugcauagucugacacaggccggagacuauucgaugagaguggaccuucgagcuggcgacgaagccguguucgcccaguaugauagcuuccauguagauuccgccgccgaguauuacaggcuccaccuggagggcuaucauggcaccgccggugacucaaugucauaucauagcggaucaguauucuccgcgcgugaccgagacccgaacucauuacugaucucaugcgccgucaguuaccgcggcgcuuggugguaucggaauugccauuacgcuaaucuuaacgggcuguacggcucuacaguggaccaucagggggugucgugguaucacuggaagggauuugaguucuccgucccuuucacagaaaugaagcugcgaccucggaauuucaggucccccgccggcggaggauag

SEQ ID NO: 31814 - RNA, 1335 nt, Artificial Sequence
  Description of Artificial Sequence: Synthetic coding sequence
augccacgguccggggcucccaaagaacggccagccgaaccacugacacccccacccucuuauggccaucagccucagacugggucaggcgaauccucaggugcuucuggagacaaagaucaccuuuacucgacagugugcaagccccguucuccuaaaccagcugccccugcugcucccccguucucuuccucgucaggaguccuggguaccggccuuugcgagcucgauaggcugcugcaggaacucaaugcaacucaguucaauauaacugaugagauaaugagccaauuccccuccaguaagguggccucaggcgagcagaaggaggaccaguccgaggacaaaaaacgccccagcuuaccuagcagucccagcccuggcuugccgaaggcaagcgccacauccgccacccuggaguuagaccgcuugauggcuagcuugagcgauuuccgcguccagaaucacuugccagcuuccggcccaacucaaccaccaguagugagcuccacuaacgaagggaguccaagccccccugagcccaccggaaaagggagccuugauaccaugcuuggucuccugcagagcgaucugucucggcgugggguuccaacacaggcuaaagguuugugcggcuccugcaauaagccuauugcgggccaggucguaacagcguuggggcgagcguggcaucccgagcacuuuguguguggaggcuguucaacagcacuagggggcucauccuucuucgaaaaggacggcgcuccguucuguccagagugcuacuucgaacguuucaguccgagguguggauucugcaaucaacccauaaggcacaaaauggugacugcucucgggacccacuggcacccagaacauuucugcugcgugagcuguggugagccuuucggugacgagggauuucaugagcgcgagggaaggccguacugccgaagagauuuucuucagcuauucgcaccuaggugccaagguugucaagggcccauacuagacaacuacauaucugcacuaagcgcccuauggcauccugacuguuuugucugcagggagugcuuugcaccuuuuucaggcggguccuuuuucgagcacgaagggcgcccuuuaugugagaaucauuuucaugccaggagaggcucacugugugcuaccuguggcuugccaguaaccggucguugugugucagcguugggccggcgcuuccaccccgaccacuuuacuugcacauuuuguuuaagaccacuuacaaagggauccuuucaagagcgcgccgggaagccauauugucagcccugcuuccuuaagcucuucggauag

SEQ ID NO: 31815 - RNA, 1335 nt, Artificial Sequence
  Description of Artificial Sequence: Synthetic coding sequence
augccaagguccggggccccaaaagagagacccgcagagccucucacacccccucccaguuacggacaucagccccagacgggaucgggcgagucuuccggcgcuucaggagacaaggaucaccuuuacucaaccgugugcaagccacgcucaccaaaaccagcagccccagccgcaccacccuuuaguuccuccagcggcgugcucggcacgggcuugugcgaacuugaccgccugcugcaggagcucaacgcaacccaguucaacaucaccgacgagaucaugucgcaauucccguccagcaaggucgccagcggcgaacaaaaagaggaccaauccgaagauaagaagcgaccaucucuuccuaguaguccaucaccgggccugcccaaagccucagccaccucugcgacccuggaacuggaccggcuuauggcgucacuuucagacuucagaguacaaaaccaucugccugcgucugggccaacgcagcccccugucgugagcagcaccaacgaggggagcccuagucccccggaacccaccgguaagggcagccuggacaccaugcuuggacucuuacagagcgacuugucaagacgcggcguuccaacacaggcuaaaggauuguguggaaguuguaacaaaccaaucgccggacaggucgucacagcucuugggcgugcauggcaccccgaacauuucgugugcggcggaugcucaacugcccuaggcgguagcuccuucuucgaaaaggauggcgcgcccuuuugcccggaauguuacuucgagcgcuucuccccaaggugcggauuuuguaaccagcccauccgucacaaaauggugacagcacuaggcacacacuggcaccccgagcauuuuugcugcguuucguguggggagccuuuuggggaugagggauuccaugaacgcgagggaaggccguacugccgaagagauuuucuccaguuauuugcuccgcggugccaagguugucaggguccaauucuagauaauuauauauccgcuuuguccgcucuuuggcacccugauuguuuuguguguagagaauguuuugcaccuuucucuggcggcuccuucuucgagcacgagggccgcccauuaugcgagaaucacuuucacgcuaggcgcgggagccucugugcaacauguggauuaccagucacugguagaugcgugagcgcacugggaaggagguuucauccagaccauuucacuugcaccuucuguuugaggccucucacaaaaggcagcuuccaagaaagggccgggaagccauacugucaacccuguuuccuuaagcuguucggcuag

SEQ ID NO: 31816 - RNA, 1386 nt, Artificial Sequence
  Description of Artificial Sequence: Synthetic coding sequence
auggaagaucucgacgcucugcuuucugaccucgagacaacuacgagccauaugccaagauccggagcacccaaagagcggcccgccgagccucuuaccccaccuccuucuuacggacaccagccacaaaccggaagcggagaaucaaguggggcauccggagauaaagaucaccuuuauuccacaguuuguaaaccacgcagccccaagccugccgcccccgccgccccgccuuucucuaguucuaguggcguccugggaacgggguuaugcgagcuggaucgacugcuucaagaacuuaaugcgacccaguucaacauaacagaugagauuaugucacaguucccuuccuccaagguggccuccggagagcaaaaggaggaucagagcgaagacaaaaagcggccuucucucccgagcucuccaagcccaggccucccgaaagcuagcgcaacuucugccacgcucgagcuugaccgguuaauggcuagccuuagugacuuuagaguccagaaccauuugccggcaagugggccaacucagccccccgugguuucuuccaccaaugagggauccccaucccccccagaaccaacagguaaggguagucucgauacaaugcucggcuugcugcagucggaccugaguagacgcggggugcccacacaggccaagggccuguguggcuccugcaacaaacccaucgcaggucaggugguaacugcccuuggaagagccuggcauccagagcacuucgugugcggcggcuguuccacagcacucgggggcucaucauuuuuugagaaggacggcgccccauuuugcccggaguguuacuucgaacgguuuucucccaggugcggguucugcaaucagccuauuagacauaaaauggucacugcacucggcacucacuggcacccagaacacuucuguugugucuccugcggagagcccuuuggagacgaagguuuccacgagagagaagguaggccauacugcagaagggauuuuuugcaguuguuugcuccacgcugccagggaugccaaggcccuauacuagauaacuacauuucagcauugucggcccuguggcacccagauugcuuuguguguagggaaugcuucgccccuuucagcggaggaucauuuuucgagcacgagggccggccacucugugaaaaucauuuucacgcuaggcggggaagucugugcgccaccuguggacugcccguuacugggcggugcgugucagcucugggacggagauuccaccccgaucauuucaccuguaccuuuugccugaggccuuugaccaaaggaucauuucaagaacgcgcaggaaagccuuacugucagccgugcuuccuaaaacucuucggguag

SEQ ID NO: 31817 - RNA, 3075 nt, Artificial Sequence
  Description of Artificial Sequence: Synthetic coding sequence
augugugcaagaauggcugggaggacuacggcagccccccgaggucccuacgggccuugguugugccuacugguggcguuggcauuagacguuguaagaguggacugcggacaggcuccccuggaucccguuuaccugccugccgcauuggaguuacuggacgcccccgaacacuucagggugcagcaggugggccauuauccccccgcuaacagcucccuuucuucucgcagugaaacauuccugcuuuugcagccguggccacgggcucagccccuucugagagccucuuauccuccuuuugccacccagcaagucgugcccccccgagugacugagccucaccagcgccccguaccuugggacgugcgcgccgucagcguggaggccgcaguaaccccugcugaaccuuacgcgaggguucuauuucaucuuaaggggcaagacuggcccccuggaucaggaagcuuacccugcgcgagguuacacgcuacccacccugcuggaacagcgcaccaggccugccgcuuccaaccuucccucggcgccugcguaguugaacucgaauuaccaucucauugguucucacaggcuucuaccacacgcgcugagcuggccuauacucuagagcccgccgcagaagggcccgggggauguggaagcggagaagagaaugauccuggugagcaagccuugcccgugggggggguggaguugaggccagccgacccaccccaguaccaggaagucccauuagacgaggccguaacgcugagagugccugauaugccuguucgaccuggccagcuguucagcgcuacucugcuccugaggcacaacuucacagcuucccuguugacccugcgcauuaaagucaagaagggacugcacgugacugccgcucggccagcccagcccacccuauggaccgcuaagcuggaccgauuuaagggcucaaggcaccauacuacccuuauaacaugccacagggccggccugaccgaacccgauagcagcucaccauuagagcuuuccgaauuccuguggguugauuucgugguggaaaauaguacuggaggcgggguagcaguaacucguccaguuaccuggcagcucgaguaucccggacaggcucccgaggccgaaaaagacaagauggucugggaaauucuugugagcgagagggauauuagagcccugaucccacuagcuaaggcagaggaacucguuaauaccgcuccacugaccgggguaccacaacaugugccagugcgacucgugacaguggacggugggggugcgcuagucgaagugacugaacacguagguugugagagugcaaacacgcaagugcuccaagugagugaggcuugugacgcagucuuuguggcaggaaaggaaucccgaggagcgcgcggcguaagagucgacuuuugguggagacgccugcgggcuucucucagguugaccgucugggcccccuuacucccccuaaggaucgaauugacugacacuaccuuggagcaggugcguggcuggaggguaccgggcccugcagaaggcccugcugaacccgccgcugaggccucugaugaagccgaacgccgcgcacguggaugucauuugcaguaccagcgcgcaggcgugcgauuucuagcccccuucgcggcccacccacuugacgguggcaggagacugacucaucuucucgggcccgauuggcuuuuggacgugagccauuugguugcaccucaugcgaggguccucgauagccggguugccucauuagaaggcgguagagucguugugggaagagaaccaggggugaccuccaucgagguccggagcccccugucugacaguaucuuaggugaacaggcauuggcgguuacugaugauaaagugucuguccuagaacugcgggugcagccagucaugggcauuucgcucacccuuucacguggaacugcccacccuggagagguaacagcaaccugcugggcgcaguccgcucugccagccccuaaacaggaagucgcccugucccucuggcucagcuucagugaccacacuguugcgcccgccgaacuguaugauagacgggaccugggccucuccguuagugccgaagaaccuggcgccauccuucccgcagaagaacagggggcucagcugggcgugguagugucuggugcgggagccgaaggauuaccgcugcauguggcucuucauccgccugaaccauguagacgugggcgccaucgggugccccucgcuucagguacagccuggcucgggcuaccuccagcaagcacaccggcaccagcccugcccucuuccccggcuuggagcccgcccgcgacagaagcgacaaugggcggcaagagacaaguggccgggucugugggggguaacacugggguuaggggaaaguuugaacgugcugaagaggaagcacgaaaggaagaaaccgaagcccgcgaggaagaggaggaggaggaagaagagaugguacccgcaccccagcaugucacugaauuagagcuggguauguaugcacuguuggggguuuucugcguugcuaucuuuauuuuccuaguuaacggagugguguucguucucagauaucagcggaaagaacccccugacuccgccacggaccccaccagcccucagccucauaacuggguaugguuagguacggaucaagaagagcuaagcagacaauuagaccgacaaucaccugggccuccaaaaggagagggcaguuguccaugugaaucaggcggcgggggcgaggccccuacacuggcgccuggacccccaggcgggacuaccuccucgucuucuacccuagcucgcaaagaagcaggcgggaggcgaaagagagucgaguuugucaccuucgcaccagcaccucccgcacagucgccggaggagcccguuggcgcuccugccgugcagucaauccuuguggccggggaggaagacauacgcuggguuugugaagauaugggacugaaggaccccgaagaguuaaggaauuacauggaaagaauccgaggaucguccuag

SEQ ID NO: 31818 - RNA, 1368 nt, Artificial Sequence
  Description of Artificial Sequence: Synthetic coding sequence
augggccugucuacagugccagaucuguuauugccccugguucuucucgaauugcucguaggcauuuaccccagugguguaaucggccuggucccccacuuaggcgaucgggaaaagagagauuccgucugcccgcagggaaaauauauccauccacagaacaacucuauuugcugcaccaaaugccauaaaggcacauaccuguauaacgacuguccuggcccugggcaggauacagacuguagggaaugcgagaguggcagcuucacugcuagugaaaaucacuugcgucauugcuugagcuguuccaaaugcagaaaagagaugggacagguugaaaucucaucaugcacaguggaucgcgauaccgucugcgguuguagaaagaaccaauacagacauuacuggucagagaacuuguuccaauguuuuaauuguagccucugccugaacggaaccguccaccugucuugccaagagaaacagaauaccguaugcacgugccacgcuggauuuuuccugcgcgaaaaugaaugugucuccugcagcaacugcaagaagucuuuggaauguaccaagcuguguuuaccucaaauugagaauguaaagggcacugaggacucuggaacaaccguguuacuacccuuagucauuuuuuuuggucucugccuguugucucucuuauucaucgggcucauguauagguaucagcgguggaagucgaagcuguauagcauuguuugcgguaaaagcacucccgaaaaggagggagagcuagaaggcaccaccacuaaaccuuuagcacccaacccuagcuuuagcccaacuccuggauucacccccacauuaggauuuucaccugugccaucuagcaccuuuacaucaaguagcacauacaccccgggggauugcccaaauuuugcugcuccucgcagagaaguggcuccccccuaccagggagcagacccuauacuugccacggcacuggcuucggaccccauuccaaacccgcuccaaaaaugggaagacucagcccauaagccucaaucgcuagauacugaugaucccgcuacuuuguacgcagugguugagaauguaccaccuuugagguggaaggaguuugugagacgccuuggccucuccgaucacgagauugaucgucucgagcuacaaaauggccgaugccucagggaggcacaguacagcauguuggcaaccuggcggagacggacaccacggagagaagcaacacucgaauugcugggccggguccuaagggauauggaccugcugggcugcuuagaggauauagaggaggcacuguguggucccgcagcuuugcccccugcuccaucgcuuuugcgauag

SEQ ID NO: 31819 - RNA, 657 nt, Artificial Sequence
  Description of Artificial Sequence: Synthetic coding sequence
augggguugucaacggucccagacuuguugcugccacucguccuccucgaacuucuugugggcauuuacccaucugggguaauaggccuggugccccaucugggcgauagggagaagcgagacucaguaugcccccaaggaaaauacauucauccccagaauaauagcaucuguuguaccaagugccauaagggaacauaucucuauaaugauugucccgguccaggucaggauacagauugcagagaaugugaauccgguucuuucacugcuucugagaaucaucuucggcacugucuguccugcaguaagugcagaaaagagaugggccaagucgaaauuucaagcugcacaguugacagagauaccgucugcggcugucggaaaaaucaguauagacacuacuggagcgagaaccuguuucagugcuucaauuguagccugugucugaacggcacgguacaccugucaugccaggaaaagcagaacaccgugugcaccugccaugcuggcuucuuuuuacgcgaaaacgaauguguuaguuguucuaaaguguuacugugccggcccggauggaacgccguugcaagaagucgccugaccgcuacuagugccucacaaauucaagccauuuuacuccuucagccucccaaguag

SEQ ID NO: 31820 - RNA, 1386 nt, Artificial Sequence
  Description of Artificial Sequence: Synthetic coding sequence
auggcacccguugccguaugggcagcacucgcugucggcuuggaauuaugggccgccgcucacgcccucccugcccaaguagccuucaccccuuaugcaccagaacccggcucgaccugucggcugcgagaauauuacgaucagacagcccaaaugugcuguucuaaaugcagccccggucagcaugcaaagguguucuguacaaagaccucugacaccgucugcgacagcugcgaggacaguaccuauacccagcucuggaauuggguaccagaaugcuuaagcugcgguucaagauguagcagcgaucaggucgaaacccaggcguguacccgagaacagaauagaauuugcaccugccgaccuggaugguauugcgcuuuaucaaagcaagagggcugccgucugugugcaccauuaagaaagugucgcccuggauuuggcguggcucgcccggguacagagacuagugauguuguauguaaacccugcgcuccagggacuuuuagcaauacuacgaguaguacagauauaugccggccucaccagauaugcaauguggucgccauucccggcaacgccucaauggacgcgguuugcaccuccaccagccccacccgguccauggccccuggggcaguccacuugccacagccugucucaacucgcucucaacacacacagccaacacccgagccuaguacugccccaucaacaucauucuugcugccuauggguccgagcccuccggcugagggauccaccggggacuucgcgcuacccguggggcugaucgucgggguuacugcccugggacugcuuaucauuggaguugugaacugcguaauuaugacccaggucaagaagaagccucuaugccuacagcgggaggcaaaggucccgcaccuacccgcagauaaagcacgaggaacccaggggcccgagcaacagcauuugcugaucaccgcaccuucuuccucuagcagcucucucgagaguucagccucagcuuuggaucgacgcgccccgaccagaaaccagccacaggcgccuggcgucgaagccuccggugcuggagaggcacgcgcauccacugguuccagugacuccaguccuggggggcauggcacucaggugaacgugaccugcaucgugaacguuugcucaaguagugaucacagcagccaguguuccagccaagcgaguucaacuaugggagauaccgacucuucuccaucugagucuccaaaagacgagcagguuccauuuaguaaggaagaaugcgcuuucagaagccagcuagaaaccccugagacccuguugggcaguaccgaagaaaaaccuuugccucucggagugccugacgcugggaugaagccuucuuag

SEQ ID NO: 31821 - RNA, 807 nt, Artificial Sequence
  Description of Artificial Sequence: Synthetic coding sequence
auggcaccuguggcuguuugggcagcccucgcgguuggucucgaacucugggccgccgcacacgcacugccggcacaagucgccuuuacuccauaugcccccgaaccaggcaguacaugccgacuacgcgaauauuacgaucagacggcacagaugugcugcucaaaauguucuccgggacagcacgccaagguguucuguacaaagaccucugacacaguuugcgacucuugugaggacaguacauauacccaacuguggaauuggguucccgagugucuguccugcggaucccguuguucauccgaccaggucgaaacucaagccugcacccgcgagcagaaucggaucuguacaugucgcccaggcugguacugcgcccuuaguaaacaggagggcugcagauugugcgcccccuugcggaagugcagaccugguuucggaguugcccguccuggcacugagacuuccgaugucgugugcaagcccugugcccccgguacauucuccaauaccaccucuucaacugauaucugcaggccccaccagaucuguaacgugguugccauaccagggaacgccaguauggaugcagucugcacgucaacauccccaacccguucuauggcuccaggcgccguucaccugccucagccaguuuccacucguucucagcacacacagccaacccccgagccaucaacagcccccucuacuuccuuccuccugcccauggguccuagucccccagccgaggguagcacaggggauuucgcgcucccggucgucucucucuccaguagcuag

SEQ ID NO: 31822 - RNA, 468 nt, Artificial Sequence
  Description of Artificial Sequence: Synthetic coding sequence
auggcuccuguugcugucugggccgcacuggccgucggucucgagcugugggcugcagcccacgcgcuuccggcucaaguggcuuucaccccauacgccccugaaccagguuccacgugcaggcuucgagaguacuaugaccagacagcucagauguguuguuccaagugcaguccaggacagcaugcgaaaguguucugcaccaagaccagcgacaccgugugugacaguugugaggauuccaccuacacccagcuauggaacugggucccagaguguuuguccugcggcuccagauguuccucugaccagguugaaacccaggcuuguacacgagagcagaaccggaucugcacguguagaccaggaugguacugcgcccuuaguaaacaagaaggcugccggcucugugcuccucuccggaaauguaggccgggcuuuggcguggcgcgcccugaucucuccuag

SEQ ID NO: 31823 - RNA, 114 nt, Artificial Sequence
  Description of Artificial Sequence: Synthetic coding sequence
auggcacccguugcaguaugggcagcgcuggcagucggacuggaacuaugggccgcugcucacgcccugccugcccaaguggacccuggcccccucuuuccccaccccggauag

SEQ ID NO: 31824 - RNA, 1131 nt, Artificial Sequence
  Description of Artificial Sequence: Synthetic coding sequence
augguugucguggcagcagcacccaauccugccgauggaacuccgaaaguucuacuacugaguggccagccagcuucugccgccggggcuccagcgggacaggcgcuaccacugaugguaccugcacaacgcggugccagccccgaggcagccuccggcggucucccccaagcacgcaagcggcaacggcugacucaucucucucccgaagaaaaggcacugagacgcaagcugaaaaacagaguugcggcccagaccgcccgagaccgcaagaaagcaaggaugagugaauuagagcagcaagucguggaccuggaagaagagaaucagaagcuccuccucgaaaaccaacuguugagggaaaaaacccauggccucguggucgaaaaucaggaacuccgucaaaggcuuggcauggacgcccuuguggcagaggaggaggccgaggcuaaagggaacgaaguacgaccugucgccggauccgcugaaagugcugcaggcgcggggccaguggugacuccuccagagcaccuuccgauggauucggguggaaucgacucauccgacuccgaauccgauauucugcugggaauccuggacaaccuugaccccgugauguuuuucaagugccccagccccgagcccgcuagccuagaggaacugccugagguguauccagaaggcccuucaucacugcccgccucacugucccucucggucggcacgucuucugcgaaguuggaggcuaucaacgagcugauccgcuucgaccacaucuauaccaaaccauugguucuggagauucccucugaaaccgaaagucaagccaauguugucgugaagauugaagaagccccccugucuccuucugagaacgaucauccugaauuuauugugucagugaaggaggagcccgucgaagacgaucuugugcccgagcuggggaucagcaacuuauugucgagcucucauugccccaagcccuccaguugccuacuugaugccuacagcgacuguggauaugguggaucccuuuccccguuuucugauaugaguaguuuacucggugugaaccauagcugggaagauacauucgccaaugaacuuuucccccaguuaauuucagucuag

SEQ ID NO: 31825 - RNA, 1494 nt, Artificial Sequence
  Description of Artificial Sequence: Synthetic coding sequence
augaccguauuucucucuuuugcauuuuuagcagccauacuaacccauaucgguuguagcaaucaaagacgcaguccugaaaauucuggccgccgauauaacagaauucagcacggacagugugccuacaccuuuauacugccagagcacgacgguaacugccgggagucuacuacagaucaguauaacaccaacgcccuccagagggacgcgccccacguggaaccugacuucucaucucagaaacuucagcaucucgaacacgugauggagaauuacacgcaguggcuccagaaacuggagaacuauauagucgagaauaugaagagcgaaauggcccaaauccaacaaaaugccgugcaaaaccacacagccacgaugcuugagaucgguacuucccugcuuagucagacugcagagcaaacacgcaagcucacugauguggaaacccaaguccugaaucaaaccagcagacuugagauucaacuccuugagaauucacuuaguacuuacaagcuugagaagcaauugcugcaacagaccaacgagauucuaaagauucacgaaaagaauucucuccuggaacauaaaauauuggagauggagggcaagcacaaagaagaguuggauacuuuaaaagaagaaaaagagaaccugcaaggguugguuacacgucagacauacauuauucaggaauuggaaaaacagcuaaauagggccaccacaaacaacucaguccugcagaagcaacaacuggaguuaauggacacuguucauaaccugguaaaucugugcacaaaagaggucuuacugaagggaggcaaaagagaagaggagaagccuuuuagagacugcgcugaugucuaucaagcgggauuuaacaaaagcggaauauacacuaucuauaucaauaauaugccugaacccaagaaaguuuucugcaacauggaugucaacgggggcggguggacagugauacaacauagggaagauggaagucucgauuuccagcggggauggaaagaguauaaaauggguuucggcaaucccaguggcgaguacuggcuuggcaaugaauuuaucuucgcgaucacaagucagaggcaguauaugcuccggauugagcugauggauugggaaggcaacagagcguacucucaguaugacagguuucauaucgguaacgaaaagcagaauuauaggcuguaccucaaaggacacacaggcacggcuggaaaacaaucaucuuuaauucugcacggagccgauuucagcaccaaggacgccgauaaugacaacugcaugugcaaaugcgccuuaaugcucacugggggcuggugguucgacgccugcggcccaucaaauuuaaacggaauguuuuacacagcgggacagaaccauggcaagcugaaugggauuaaauggcauuauuucaagggcccuuccuacucccugcgcucaacuacuaugaugauucggccacuggacuuuuag

SEQ ID NO: 31826 - RNA, 459 nt, Artificial Sequence
  Description of Artificial Sequence: Synthetic coding sequence
accgugaguaaucugcuggagcacaaaauccucgaaauggaggggaagcauaaggaagagcuggacacgcugaaagaagagaaagagaauuugcaaggacuaguuacacgacagaccuauauuauccaagaguuagagaaacaacugaauagagcgacaaccaacaauagcguucugcaaaaacagcaguuagaacugauggacacagugcacaaucuagucaaucuguguaccaaagaagguguccugcugaagggugggaagagagaggaagagaagcccuuucgcgacugugcugacguguaccaggcaggguuuaacaaguccggcauuuauacgaucuauaucaacaauaugccugaaccuaaaaaaguguuuugcaacauggacguaaacggcggcggauggacagucauucagcaccgggaagacgguucccuggauuuucagagggguuag

SEQ ID NO: 31827 - RNA, 1497 nt, Artificial Sequence
  Description of Artificial Sequence: Synthetic coding sequence
augaccgucuuccucucuuucgcguucuuggccgcgauucuuacccauaucggcuguucuaaccagcgcagaucgcccgagaauucuggccgccguuauaaucgcauacagcauggccagugugcguacaccuuuauccucccagagcacgacggaaauugcagggagaguacuacugaccaguacaacacaaaugcauugcagagggaugccccacacgucgaaccagauuucagcucucagaaacuccagcaccucgaacaugucauggaaaacuacacucaaugguugcaaaaacuagaaaauuauauugucgaaaacaugaaaagugaaauggcucagauccagcagaaugcgguccagaaccacacugcuaccaugcuugagaucggaaccucacugcugagucaaaccgcugaacaaaccagaaagcucaccgauguggaaacccaagugcuuaaucagacaucacgccuagaaauccagcuauuagagaacaguuuaucuacuuacaaacuagaaaagcagcuacugcagcaaacaaacgaaauccuuaagauucaugagaaaaacuccuuacuggagcacaagauacucgaaauggagggaaaacauaaagaggaguuagauacacucaaagaggaaaaagaaaaccugcagggccugguuacacgacagacuuauauuauacaggaguuagaaaagcaacugaaccgugccaccaccaauaauagcgucuugcagaagcaacagcuggaacucauggacacaguccauaacuuaguuaauuuguguaccaaagaggggguguugcucaaagggggaaagagggaagaagaaaagccauucagagauugcgcugacguguaccaggcgggcuucaacaaaucuggcauauauaccaucuacauuaacaauaugcccgagcccaagaagguguuuugcaacauggacgugaacgguggaggauggaccguaauccagcaucgcgaggacggcucccuggauuuucagcgcggauggaaagaguacaaaaugggguuuggaaauccuucuggcgaguauuggcuugggaaugaauuuaucuuugcaauuaccucccaacgacaguacauguuaagaaucgaacucauggauugggagggcaauagggccuacucucaguacgacagauuccacauuggaaaugagaaacagaauuacaggcuguaccugaaaggucauacaggaacggccggcaaacaaucuucauuaauuuugcauggcgccgacuucucaacaaaagaugcugauaaugacaauugcaugugcaagugcgcccugaugcuaaccgguggguggugguuugaugccuguggccccucuaaccuuaaugguauguucuacacagccggucagaaccacggaaaacuuaauggcauuaaguggcauuacuuuaaaggaccuuccuacuccuuacgcagcacaacaaugaugaucagacccuuggacuucuag

SEQ ID NO: 31828 - RNA, 894 nt, Artificial Sequence
  Description of Artificial Sequence: Synthetic coding sequence
auggagggcaaacacaaggaggagcuagauacuuugaaagaggagaaagaaaaucugcagggacuggugacaagacagacauauauuauucaagagcuggagaagcaacuuaacagggcaacuaccaacaauucagucuuacagaaacagcaacuggaacuaauggacacaguccacaaucugguaaaccugugcaccaaggaaguguugcugaagggggggaagagagaagaggagaaaccguucagagacugcgccgauguauaccaggcaggguucaacaaaucaggcauauacacaaucuauauuaauaauaugccagagccuaaaaaaguuuuuugcaacauggaugucaacggaggggguuggacagugauacagcaucgggaagacgguucuuuagacuuccagcgaggauggaaagaguauaagaugggcuucgggaacccaaguggggaauauuggcuagggaacgaauuuauuuuugccauuacuagucagcgccaguacaugcuuaggauugagcugauggauugggaaggcaaucgggcguauucacaguaugacagguuucauauuggcaacgagaaacagaauuacagacuuuaucuaaagggacacacagguacagcgggcaaacagucaucacugauacuacauggugccgacuuuucaaccaaagaugcagacaaugacaauugcaugugcaagugcgcucugaugcugacggggggguggugguucgacgcaugugggcccucuaacuuaaacgggauguuuuauacggcaggccagaaucauggaaagcugaacgggauuaaguggcauuauuuuaagggaccuagcuauucccuacgcaguaccacaaugaugauucggccgcucgauuucuag

SEQ ID NO: 31829 - RNA, 897 nt, Artificial Sequence
  Description of Artificial Sequence: Synthetic coding sequence
auggagggcaagcacaaagaagagcucgacacccugaaggaagagaaagaaaacuuacagggccuugugaccagacagacguauauuauucaggaguuagagaaacaauuaaauagggcuacaaccaauaauucaguguuacaaaagcagcagcuugaacuuauggacaccguccauaaccuggugaauuugugcacuaaagaaggagugcuguugaagggaggaaaaagagaggaggaaaaacccuuuagagauugugcagaugucuaucaagccgguuuuaauaagucagggauuuauacuaucuacauuaacaacaugccagaaccuaaaaagguuuuuugcaacauggaugucaacgguggcggcuggaccguuauacagcaucgagaggauggauccuuggauuuucagcgaggguggaaagaguauaagaugggcuuuggaaauccaaguggggaauacugguugggaaacgaauuuaucuuugccauuacuucacaacgucaauacaugcucaggauugaauuaauggauugggagggaaauagggcuuauagucaauaugaucgcuuucacaucggcaacgagaaacagaauuaucgacucuacuuaaaaggccauaccggcacugcgggcaagcaauccagccucauucuccacggcgccgacuucucuacuaaagaugcugauaacgauaauuguauguguaaaugcgcucugaugcugacaggcgguuggugguucgaugcuugcggaccaagcaaucugaaugguauguuuuauacugccggacaaaaccauggaaaguugaacggcauuaaauggcauuacuucaagggcccauccuacagccugagauccacuacuaugaugauccgccccuuggacuucuag

SEQ ID NO: 31830 - RNA, 720 nt, Artificial Sequence
  Description of Artificial Sequence: Synthetic coding sequence
auggcucacgcagguagaaccggcuacgacaaccgcgaaauuguuaugaaguacauccacuauaaacugagucagcguggcuacgaaugggaugccggggacguuggcgcggcuccaccuggcgccgcccccgcucccggaaucuucagcagccagcccggccacacuccucauccagccgcuuccagagacccuguggcaagaaccucuccucugcagacuccagccgcuccaggcgcagcugccgggccggccuuguccccugucccccccgugguucauuuaacucuucggcaagccggagaugauuuuucaagaagauacagacgggauuuugcagagaugagcagccaauugcacuuaaccccauucacggccaggggcagauuugcuacagugguagaagaguuguuccgagacggcguuaacuggggaaggauugucgcauucuucgaguucgguggagugaugugcguugaauccguuaaucgugaaaugucaccccucguagacaauaucgcucuguggaugaccgaauacuugaauagacaucugcacaccuggauucaggauaacgggggaugggacgccuuuguggaguuguacggaccaagcaugcgccccuuauuugacuuuagcuggcugagccuuaaaacuuugcugucauuagcccucgucggcgccugcaucacccucggagcuuauuuaggccauaaauag

SEQ ID NO: 31831 - RNA, 720 nt, Artificial Sequence
  Description of Artificial Sequence: Synthetic coding sequence
auggcacaugcaggacggaccggcuacgacaaucgagaaauuguuaugaaauauauucacuauaaacugagccagagaggauaugaaugggacgcuggcgacguuggcgcugcucccccuggcgcugcuccugcuccagggauuuuuuccucccaaccgggucauacuccacaucccgcagcaucacgcgaucccguagcucguacuuccccacugcagacgcccgccgcccccggcgccgccgcggggcccgcccucagcccugugcccccaguaguucaccucacgcuccgccaggcgggcgacgauuucucacgacgcuacaggcgggacuuugcagagaugaguagccaauuacacuugacgccguuuaccgcaagaggaagguuugcgacaguuguggaagaacuguucagagauggggugaacugggggaggaucguggcguuuuuugaguucggaggagugaugugcguggaaagcgucaaucgggagaugagcccucucguagacaauauugccuuguggaugacugaauaccucaacaggcaucuacauacauggauucaggacaaugggggcugggacgcuuuuguugagcuauacgggccuucaaugagacccuuguucgacuuuucauggcuuucgcuuaagacacuccucagccucgcacuggucggggccugcauaacuuuaggagccuauuuggggcacaaguag

SEQ ID NO: 31832 - RNA, 618 nt, Artificial Sequence
  Description of Artificial Sequence: Synthetic coding sequence
auggcacacgcagguagaaccggguaugacaaccgagaaauaguuaugaaauacauacauuauaaguugucccaaagagguuacgaaugggacgcgggagauguaggagccgcaccuccaggcgcugcaccagcuccggguauuuuuucuagucagccaggucauacaccacauccugccgcaucuagagaucccgucgcacguaccuccccccuccagacccccgcugccccaggcgccgcugccggcccugcucucucccccguuccuccagucguucaucucacacugagacaggcaggcgaugacuuuagccgcagguacagaagagauuucgcagaaaugagcagccagcuucaucucaccccguuuacugcucgggggagauuugcaacugucguugaggaacuguuuagagauggugugaauuggggcagaaucguggccuuuuucgaguuuggaggcguaauguguguggagagcgugaaccgcgagaugagcccacugguggacaauauagccuuguggaugaccgaauaccugaauaggcaucuccauacuuggauucaggauaauggugggugggugggagcguuaggggacguuucucuuggguag

SEQ ID NO: 31833 - RNA, 939 nt, Artificial Sequence
  Description of Artificial Sequence: Synthetic coding sequence
auggcuaagguuuucuccuuuauacuugugacaaccgcacuuacuaugggccgugagaucucagcccuggaggauugugcgcaagaacaaaugagacugcgugcccaggucaggcugcuagagacaaggguaaaacaacagcaggugaagauuaagcaacuucuccaagaaaacgaaguucaauucuuagauaagggcgaugaaaacacaguuauugaccuaggaucuaaaaggcaauacgcugacuguuccgaaaucuucaacgacggauacaagcuuucuggauucuauaagaucaaaccacuccagaguccagccgaauuuucuguuuacugcgauaugagugauggaggcggauggaccguaauacagcgcagauccgacgggagcgagaauuucaaccgcggcuggaaggacuacgagaauggauucggaaauuuuguccagaagcacggagaauacuggcucggcaauaagaaccugcauuuccugacuacacaagaagauuauacucugaaaauugauuuagccgauuuugagaaaaauucucgguacgcccaguauaagaauuucaaggugggggaugagaagaauuucuacgaacugaauaucggcgaguauagcgguaccgcaggcgauucucuggcuggaaacuuucaccccgaaguucaguggugggcgucacaucaacggaugaaauuuucuacuugggauagggaucacgacaauuacgagggaaacugugcagaggaggaucaaucuggauggugguucaaccggugccauucugcgaaccuuaauggcguuuauuacuccggcccauacacugcgaaaacagauaaugguaucgugugguauacguggcacggguggugguauucucuuaaaaguguagugaugaaaauaaggcccaacgacuucauccccaacguaaucuag

SEQ ID NO: 31834 - RNA, 702 nt, Artificial Sequence
  Description of Artificial Sequence: Synthetic coding sequence
augagucagucuaaucgcgaacuugugguggacuuucugucuuacaaacugucccagaagggcuacuccuggucccaauucagcgauguggaagagaacagaacagaagcacccgaagggacugaguccgagauggagaccccuucggcuauuaaugguaauccuucuuggcauuuggccgauucaccugcugucaauggcgcuacaggacacuccuccucucucgaugcccgugaggugauuccaauggccgcaguuaaacaggcucuccgagaagcgggagacgaguucgaacuacgguaccggagagcuuuuucugaucugacuucacaguugcauauuacgccaggcacagcuuaccagucuuuugagcaaguuguaaaugaauuguucagagauggcguaaacuggggaagaaucguagccuuuuuuucauuugguggcgcucugugcgucgaaagcguugacaaggaaaugcaagugcuugugucucgaauugcagccuggauggcuacauaccuuaaugaccaccucgaaccauggauucaggagaauggcgguugggauacauuuguugaacuauacgggaauaacgccgcugccgaaucgcggaaggggcaggagcgauuuaaccggugguuccucacaggaaugacuguugccgggguuguguuacuggggucacuauucucucgaaaauag

SEQ ID NO: 31835 - RNA, 513 nt, Artificial Sequence
  Description of Artificial Sequence: Synthetic coding sequence
augagucagucuaaucgagaacuugucguugacuucuugagcuauaaacuuagucagaaggguuacuccuggagucaauucagcgacgucgaagagaauagaaccgaggcaccugaaggcacagaaagcgagauggaaacucccucugccauaaaugggaaccccucuuggcaucuggcggacucaccagcaguuaauggcgccacuggccauuccucaucccuagaugcacgggaaguuauuccaauggccgccguaaaacaagcuuugagggaagcaggagaugaguuugaauuacgcuaucgaagagcauuuagcgaucucacgagucaacuccacauuacacccggaacugccuaucaaaguuucgaacaggacaccuucguagagcuguaugggaacaaugcugcugccgaaucucguaagggacaggaacgcuucaauagaugguuuuugaccggaaugaccgucgcgggaguaguccuacuagggucauuguuuagcagaaaauag

SEQ ID NO: 31836 - RNA, 702 nt, Artificial Sequence
  Description of Artificial Sequence: Synthetic coding sequence
augucgcaaucaaaccgcgaacugguuguugacuuucucaguuacaagcugucgcagaaagguuacaguuggagccaguuuucagauguugaggagaaccggacagaggccccagaaggcaccgagagcgagauggaaacccccucggcuauuaauggcaacccauccuggcaccuagccgauucacccgcggucaacggcgcuaccggacacucuucuucucuugaugcucgugaagucauuccuauggcggcagucaagcaagcucuccgugaagccggagacgaauuugaacuuagguaccgaagagcguucagcgaucuaaccagucagcuccauaucaccccuggcacagccuaucagucauucgaacagguugucaacgaacucuuuagggacggcgucaauugggggcggauaguggccuucuucaguuucgggggugcacucuguguggaauccguggacaaagaaaugcagguucuaguuagccgcaucgccgcguggauggcaaccuaccuuaaugaccaccuagagccguggauacaagagaacggaggaugggacaccuucguagaacuguaugggaauaaugcggccgccgaaagucgaaagggccaggagcgguuuaacaggugguucuugacaggcaugaccguggcgggugucguucuacugggcagccuguucucuagaaaguag

SEQ ID NO: 31837 - RNA, 567 nt, Artificial Sequence
  Description of Artificial Sequence: Synthetic coding sequence
augagccagaguaaucgggagcugguaguugacuuucuguccuacaaacugagucagaaaggguauuccuggucacaauuuucugacguggaggagaauagaacugaagccccagaagguaccgagucugagauggagacaccgagcgcuaucaacggcaacccuagcuggcaccuggcagauucacccgccgucaacggagcuaccggucauagcucuaguuuggaugcacgagagguuauucccauggcugccgugaaacaggccuuacgcgaagcaggcgaugaguuugaacugcgcuauaggagggccuucucggaccugacaagucaacuucacauuacuccgggcaccgcuuaccagaguuucgaacagguuguuaaugaacuauucagagauggaguaaauuggggaagaaucgucgcuuucuucucauucgggggggcauuguguguggaaagcgucgacaaagagaugcaggugcuagucucgagaaucgcugcguggauggcgacuuaccugaaugaccaccuggaaccuuggauacaagagaacggcggcugguag

SEQ ID NO: 31838 - RNA, 702 nt, Artificial Sequence
  Description of Artificial Sequence: Synthetic coding sequence
augucacaguccaaucgagagcuggucguggauuuuuuaucauauaaauugagccagaaaggcuacucuuggucucaguucucagacguugaagaaaauagaacagaggcacccgaaggcacagaaucugagauggagaccccaagugcuaucaacggcaacccaagcuggcauuuagcugacucucccgccguuaacggcgccacgggucacaguaguaguuuggacgcgcgcgaaguaauaccaauggccgcggugaaacaggcacugagggaggcaggggacgaguuugaauugcgguaucgccgugcguuuuccgacuuaacuagccagcuucacauuaccccagguacagcuuaucagucauuugaacaaguagucaaugaauuguuucgggacggcguuaauugggggagaaucguggccuuuuucagcuuuggaggggcccuaugcguggaaaguguugauaaagaaaugcaaguccuagugagucggaucgcggccuggauggcaacguaccugaacgaucaucucgagccuuggauucaggagaaugggggaugggauaccuuuguggaacuguacggcaacaaugcagccgcagaaucuaggaagggacaggagcguuuuaaucgcugguuucuaacggggaugacaguugcuggcgugguguuacucggaucccucuucucacggaaauag

SEQ ID NO: 31839 - RNA, 567 nt, Artificial Sequence
  Description of Artificial Sequence: Synthetic coding sequence
augucccaguccaauagggagcucgucgucgacuuccucucuuacaaacugucccagaaaggauacuccuggucucaguucagcgauguagaggaaaauagaaccgaggccccagaagguacugagagugaaauggagacccccagugcaauuaauggaaauccuucauggcaccuggcagauucaccagcugugaacggagcgacggggcacaguucuucuuuagacgcucgagaaguuauuccaauggcagcaguuaaacaagcgcuuagggaggcaggggacgaguucgagcucagguacaggagggcuuucucagaucucacaucucaguugcauaucacacccgggaccgcauaccaaagcuuugaacaaguagucaaugagcucuuccgcgacggaguuaacuggggccgcauuguggccuuuuuuucauucgggggugcgcugugcguggaaucaguggauaaggagaugcagguacucguuuccagaaucgccgcuuggauggcuacauaucuaaaugaucaccuagaaccuuggauccaggaaaacggggguugguag

SEQ ID NO: 31840 - RNA, 147 nt, Artificial Sequence; identical to SEQ ID NO: 31659
  Description of Artificial Sequence: Synthetic coding sequence

SEQ ID NO: 31841 - RNA, 546 nt, Artificial Sequence
  Description of Artificial Sequence: Synthetic coding sequence
augagucaaagcaauagagaacuggucguggauuuccugaguuauaaguuaucgcaaaaaggcuauaguuggucacaauuuucagacguugaagaaaauaggacugaggcccccgagggaacagaaagcgaaauggagacuccauccgcaaucaauggaaacccgucguggcaccuugccgauucgccugccgugaauggggccaccgggcauucaucuagccuggacgcuagagaagucaucccaauggcugccguaaagcaagcauugagggaggccggcgacgaauucgagcuaagguauagaagagccuuuagugaccuuacaucacagcugcauaucaccccagguacugccuaccaaucuuucgagcaggugguuaacgaacuuuuuagagacggugugaauuggggucggauaguggccuucuuuucguuuggaggcgcacucugcguugagucagucgacaaggagaugcaaguccuagugucuagaauugccgcauggauggcuacauaccugaaugaucaccucgaaccaugguag

SEQ ID NO: 31842 - RNA, 618 nt, Artificial Sequence
  Description of Artificial Sequence: Synthetic coding sequence
augucacagucuaauagggaauuagugguagacuuucucagcuauaagcucucacagaaaggcuauucuuggagucaguucucagacgucgaagaaaaccggacagaggcacccgaaggaaccgaaucagagauggagacucccagugcgaucaacggcaauccaucauggcaccucgcagacaguccggccgugaacggggcuacgggucauuccaguucucuggacgcgcgugaggucauuccaauggccgcugucaaacaagcccuccgagaggcuggagaugaauucgaguugcgauacaggagggcauucagcgauuugaccagucagcuacacauuacccccggaacugccuaccagucguucgaacaaguggugaaugaacucuucagagacggcguaaacuggggccgcaucguggcauuuuucagcuuuggaggugcucugugcguugaguccguggauaaggaaaugcagguucuuguaagucguauugcugcauggauggcuaccuaccuuaacgaccacuuagagccuuggauucaggaaaacggcgguugggacaccuuuguggaauuauacggaaauaaugcugccgccgagaguagaaaguag

SEQ ID NO: 31843 - RNA, 567 nt, Artificial Sequence
  Description of Artificial Sequence: Synthetic coding sequence
augagccaguccaaucgcgaacucguagucgauuuccuguccuauaagcucucacagaaaggcuauagcuggagccaauuuucggauguagaagagaaucgaaccgaagcaccugagggcacagagagugaaauggagacucccucagcuaucaauggcaacccuuccuggcauuuagcagauagcccugccgugaacggggcuaccggccauucaagcucacuagaugcaagagaggugauuccaauggccgcgguuaaacaggcgcugcgcgaagcuggugacgaauuugaguuacguuauagacgagcauucagcgaucuuaccucccaacugcacauuacuccagggacugcauaucagucauuugaacaggugguuaacgagcuauuccgcgauggcgugaacugggggagaauugucgcuuuuuuuucauuuggcggugcucuguguguggaaucaguugacaaagaaaugcaaguucugguuagccggaucgccgcguggauggcuaccuacuuaaacgaucaccucgaacccuggauacaagagaacggaggcugguag

SEQ ID NO: 31844 - RNA, 2613 nt, Artificial Sequence
  Description of Artificial Sequence: Synthetic coding sequence
augaaccacuugaaugugcucgcuaaggcucuauaugauaauguggccgagucacccgaugaacugucuuuucgaaagggcgacaucaugacagugcuugaacaggauacccaaggacuagauggauggugguuaugcucucugcacgggcgucaggggauuguucccgggaauagguugaaaauccucguuggcauguacgauaaaaagccugccgguccagggccaggaccuccugcaacuccugcgcagccgcaaccaggccugcaugcaccugcccccccagcuucccaguauaccccaaugcucccaaacacauaucaaccccaaccagauagugucuaucuaguuccuacucccuccaaggcucagcaaggccuguaccagguuccgggcccaucuccacaauuccaaagcccuccagccaaacaaaccucaaccuuuaguaaacagaccccccaccacccauuucccucccccgccacugaucuguaucaggugccuccuggcccgggaggccccgcccaagacaucuaucaagugccucccucugcugguaugggacacgacaucuaccaggugccaccaucaauggauacucgaaguugggagggcacuaaaccaccagcaaagguggucgugccuacaagaguaggacaggguuauguguaugaggcagcccagcccgagcaagaugaguacgauauaccacgucaccuucuggccccagguccacaggacauauacgacguaccuccagucagaggccuguuaccaucccaauacggccaggaagucuaugacacccccccuauggcgguuaaaggccccaacgggcgugaccccuuauuggaaguuuaugauguaccucccucaguggaaaagggccucccuccgucaaaccaucacgcuguguaugacgugccucccagcguguccaaagauguccccgaugggccacugcugcgggaggaaacuuaugacguucccccggcauuugcuaaagccaaaccauuugauccugcuagaaccccccucgugcucgcugcucccccucccgacucccccccagccgaggauguguaugaugugccgcccccagccccagaucuguaugacguuccaccugggcugcgccgaccuggaccagggacccuguacgacguuccgcgcgaacgagugcuccccccggaggucgccgacgggggaguggucgacaguggaguguacgccguaccaccuccugccgagcgggaagccccugccgagggaaaaagacuuagcgcaucuucaacgggcucuacacguagcucacagucugccaguuccuuagaaguugcaggccccggucgggagcccuuggagcuugagguggcugucgaagcucuggcccgauugcaacagggaguguccgccacuguggcucaucugcucgaccuugcugguuccgccggagccaccggcucguggagaagccccuccgaaccccaggaaccauuagugcaagauuuacaagcagcuguggccgcugugcagagcgccgugcaugaacuccuggaguucgcucggagugccguugguaacgccgcucacaccucagauagagcccuccacgccaaacugucacggcaauuacagaagauggaggacguccaccagacgcuuguagcccacggccaagcacucgacgcuggacggggugguuccggggcuacuuuggaagaucuggacagacucguugccugcaguagggcaguaccugaagaugcuaaacaacuugccagcuuucugcacggcaacgcaagccuacuauucagacggacuaaagcuacagcaccaggcccggagggagguggaacucuccauccuaauccgacugacaaaacuuccucaauucaaucuagaccacugccuucucccccuaaguuuacaucucaggauagucccgauggucaguacgagaauagcgaaggagguuggauggaggauuacgauuaugugcaccugcagggcaaggaagaauucgagaagacccagaaagagcugcuggagaaaggaaguaucacccgacaagguaagagucaguuagaacugcagcagcuuaaacaauuugaaagacucgagcaggaaguaucccgacccauugaccacgaccuagccaacuggacaccugcucagccccucgcuccuggacggaccggaggccuagggcccagugaccgacaguuguugcuuuuuuaccuggaacagugugaagcaaaccugacaacucucaccaacgcgguggaugcauuuuucacagcaguggcaacuaaucagcccccaaaaaucuucguggcacacagcaaauuuguaaucuugagcgcacacaaguuggucuuuaucggcgacacccuuucuagacaagcuaaagccgcagacgugaggagccaaguuacccacuauucaaaucuucugugugaucugcuacgcgguaucgucgccacaaccaaggcagccgcccuucaguacccgagcccuagcgcagcucaggauaugguggaacgaguaaaggaguugggccauucuacacaacaguuccgacggguguugggucagcucgcugcugccuag

SEQ ID NO: 31845 - RNA, 1563 nt, Artificial Sequence
  Description of Artificial Sequence: Synthetic coding sequence
auggaaggcggaccugccguguguugucaagauccuagggcggaacugguggagaggguagcggcgauugacgugacacaccuagaagaggcugacggugguccagaaccaacacguaauggcguagauccaccaccuagggcacgggcugcuagugugauuccgggcucaacuucaagauugcugcccgcuaggcccagccuuagugcucgcaaguuaagucuacaggaaagacccgcaggcucauaccuggaagcucaagcggggccuuacgcuacaggaccggccucgcauauuuccccccgcgcauggagaagaccuaccauagaaagccaccauguugcgauauccgaugccgaggacugcguccaguugaaucaauacaagcuccagagugaaauugggaaaggcgccuacgguguggugagacuggcuuauaacgagagcgaagauaggcacuacgcuaugaaaguucucucuaaaaagaagcugcucaaacaguauggauuccccagaagaccuccgccacgggguucccaggccgcccagggagggcccgcuaagcaacuccugccgcuggaaaggguuuaucaggagaucgccauacuuaagaaacucgaucacguaaauguggugaaacuuauugaaguccuugaugauccugcggaagauaaccuguaccucgccuugcaaaaucaggcccaaaacauccaguuggacucaaccaauauagcuaaaccccauucccugcuucccuccgagcagcaggacagcggaucgacuugggcugccagaucugucuucgaucuccugaggaagggaccagucauggaaguaccaugcgacaagccauuuagcgaagagcaggcccgucuguaccugagagaugucauauuggggcuugaguaccuacacugucagaaaauuguucaccgagauauuaagccaaguaaccuccuccucggggaugaugggcacguaaaaauugcagauuucggcgucucaaaucaauucgaagguaacgaugcucagcucuccucaacagccgguacuccugcuuucauggcgccugaggccauaucagacaguggacaaucauucuccggaaaagcucuggaugucugggcuaccggcgugaccuuguauuguuucguguacggaaaaugccccuuuauagacgacuucauacuggcuuugcacagaaaaauaaaaaaugaacccgugguauucccugaagaacccgaaaucagcgaagaacuuaaagauuugauccuuaaaaugcuggauaagaacccugagacuaggaucggugucccugauaucaaguugcauccuugggucaccaaaaacggagaagagccacugcccagugaagaggagcacugcucugucguggagguaacggaagaggagguuaaaaauucagugagauuaaucccauccuggaccacagucauucuagucaaguccaugcugcgaaagaggucuuucgguaaucccuucgaaccacaggcucgaagggaagaaagaucuaugucugcaccuggcaaucugcucguauag

SEQ ID NO: 31846 - RNA, 1020 nt, Artificial Sequence
  Description of Artificial Sequence: Synthetic coding sequence
auguggcaauugugggccagucugugcugcuugcugguguuggcaaacgcucgauccaggccauccuuccacccucuuucagacgagcucgugaauuacgucaauaagagaaacacaacuuggcaggccggacacaauuuuuauaacguagacauguccuaucugaagagacuaugcggaacauuccucggaggaccuaaacccccccagcgugugauguucacagaagaccuuaaauugcccgcgucauucgaugcccgcgagcaguggccucaguguccaaccauaaaggaaaucagagaucaggggagcugcggcaguugcugggcauucggagccguagaggcuauuucggaccgcaucugcauucauaccaacgcacacguauccguggaaguaagcgccgaagaucuccucacguguugcggguccauguguggagacggauguaacggaggguacccugccgaagccuggaacuuuuggacucgaaaggggcugguaagcgguggucuguacgagagccaugucgggugucggcccuauucaaucccaccuugcgagcaccaugucaacgguucccguccaccauguaccggagagggcgacacuccaaaguguaguaagaucugugaacccggguacucuccaacuuauaagcaggauaagcauuaugguuacaauagcuacagcguaaguaauucggagaaggacaucauggccgagaucuacaaaaauggcccgguggaaggcgcguuuaguguguacucagauuuuuuacucuauaaauccggcguauaucagcacguuaccggcgaaaugaugggggggcaugcaauccggauccugggauggggcguagaaaacggaacuccguacugguugguggcgaauagcuggaauacagacuggggugauaaugguuuuuuuaaaauccuucgggggcaggaccacugugguauugaaucagaagugguggccggaauuccaagaacggaucaauauugggagaagauuuag

SEQ ID NO: 31847 - RNA, 1020 nt, Artificial Sequence
  Description of Artificial Sequence: Synthetic coding sequence
auguggcaacucugggccucucuuugcugucugcugguccucgccaacgcuaggucuagaccuucauuucauccucugucagaugaauuaguaaacuacgugaauaagcgaaacaccacuuggcaagcuggacacaacuucuacaauguugacaugagcuaccuuaaacggcucuguggcacauuucuaggcgguccgaagccaccacagcgcguuauguucaccgaagaccucaaguugcccgccuccuucgaugcccgcgaacaguggccgcaguguccaaccauuaaggaaauccgcgaucagggauccuguggauccuguugggcauucggcgcuguggaggcaaucucagauagaauuuguauucauacuaaugcccacguaucagucgagguaucugcugaggaucucuuaaccuguuguggaagcauguguggagacgggugcaacggcgguuacccagcagaagccuggaauuucuggaccagaaagggacucgucucaggcggacucuaugagagccacgucggauguagaccauauuccauuccuccuugcgaacaucacgugaacggcagccggccgccaugcacuggcgaaggggacacacccaaaugcucaaagauuugugaaccuggauacucacccacauauaaacaagacaagcacuacggcuacaacaguuauucugugucuaacucagaaaaagauaucauggcugagaucuauaagaauggaccgguggaaggcgccuuuucaguguacagugacuuccucuuauacaaguccggaguguaucagcacgugacuggcgaaaugaugggugggcaugcuauucgaauccucggcuggggcguagaaaacggcacacccuauuggcuggucgccaauucuuggaacacagauuggggcgauaauggcuucuuuaaaauacuccguggacaagaccauuguggcauagaaucagaggucgucgcuggaaucccuagaacagaucaguauugggagaagauuuag

SEQ ID NO: 31848 - RNA, 333 nt, Artificial Sequence
  Description of Artificial Sequence: Synthetic coding sequence
auguggcaacuuugggcuucauuaugcugucuucuaguucuggcuaaugcgcgcucccgcccuuccuuccauccucuguccgacgagcuggugaacuacgucaauaagcgcaacacuacauggcaggccggacacaacuucuauaauguagauaugaguuaccuaaagagacucugcggaaccuuuuugggcggaccaaagccuccacaacgcguaauguuuacugaggaucugaaguuaccugccuccuucgacgcacgcgaacaguggccacagugcccuaccaucaaagaaaucagagaucaggguucuugugguagcuguuggcuuuag

SEQ ID NO: 31849 - RNA, 1020 nt, Artificial Sequence
  Description of Artificial Sequence: Synthetic coding sequence
auguggcaguuaugggccagucuuuguugccugcugguucuggcaaaugcucgaucucgaccaagcuuucaccccuugucagaugaacucgugaauuacguaaauaagaggaauacaacauggcaggccggucauaauuuuuacaauguggauaugagcuaucugaagcgauugugugguacguuccucggcggacccaagccaccacaaagagugauguuuacugaggauuuaaaacugcccgccucauucgaugcaagggagcaguggccccagugcccaaccauuaaggagauacgcgaucaagguucauguggcagcugcugggccuuuggcgcuguugaagcgaucucagauagaauuugcauccauacuaaugcccacgucagcguagagguaagugcugaagaucugcuuaccuguugcggcagcaugugcggagacgguugcaauggaggcuaucccgccgaagcuuggaauuucuggacucggaaaggacugguuucuggcgguuuauacgagucucaugucgguugccguccauauucaaucccccccugugagcaccacgucaacggaagcaggccacccugcacuggagagggagauacgccuaaauguucgaagauuugcgaacccggcuacucgccuacauacaaacaagacaagcauuacggguauaauaguuauagugugucuaauagcgagaaagauauuauggccgaaaucuacaagaaugggccagucgaaggcgccuuuagcguguacucugacuuucuccuauauaaaagcggcguguaccaacacgugacuggcgagaugaugggaggacaugcaauccgaauacuugguuggggaguugagaacggaacaccauacugguuaguggcaaacaguuggaauacagauuggggagacaauggauucuuuaaaauucuuagggggcaggaucauuguggcaucgaguccgaagugguagcaggcaucccaagaacagaucaauacugggagaagaucuag

SEQ ID NO: 31850 - RNA, 1020 nt, Artificial Sequence
  Description of Artificial Sequence: Synthetic coding sequence
auguggcaguuaugggccucacugugcugucuccuggugcuugcaaacgcuagaagcagaccauccuuucacccauugucagacgaacuuguuaacuaugugaacaagagaaauacaacuuggcaggccggccacaacuucuauaaugucgacaugaguuaccuuaaaagacuauguggaacauucuuaggcggcccuaagccuccacaacguguaauguucaccgaggaccucaagcuaccagcuuccuucgaugccagagaacaguggccccagugccccacgauuaaggagauuagagaccaagguaguuguggaaguugcugggccuuuggggcaguggaagcaauuagcgaucgcauuugcauacacacuaaugcccacguaagcguugaagucucagcugaagaccuacuuacuugcuguggcagcauguguggcgauggcugcaauggaggcuaccccgcugaggcuuggaacuuuuggaccagaaagggccuggugagcggcggguuguacgaaucgcauguaggcugcaggcccuauaguaucccgccuugugaacaccaugugaacgggaguaggccacccuguacaggggaaggggacacaccuaaaugcuccaagaucugugaaccuggguacagccccaccuacaaacaagacaagcacuacggcuacaauucauacagugugagcaacuccgagaaagacauuauggccgagaucuauaagaauggaccaguagagggugcuuucagcguguauucggauuucuugcuguauaaaucaggaguauaucaacacguuaccggcgaaaugauggggggucaugccauaagaauacucggauggggcguggagaacggaacaccuuacugguugguugcuaacucuuggaauacggauuggggugacaauggauuuuuuaagauacuuagagggcaggaucauugcggcauugaaagugagguuguagcggguauucccagaaccgaucaguauugggagaagauauag

SEQ ID NO: 31851 - RNA, 1020 nt, Artificial Sequence
  Description of Artificial Sequence: Synthetic coding sequence
auguggcagcucugggcaagucuguguugccuucuuguccuagccaacgcccgcucccgaccuuccuuucauccgcucagcgacgaauugguaaacuacguuaacaagcggaacacaaccuggcaggccgggcacaauuuuuacaauguggauaugucuuaccuuaagaggcuaugcggaaccuuccuuggcggccccaaacccccucagagagucauguuuaccgaggaucuuaagcuccccgccucuuuugaugcccgcgaacaguggccucaauguccuacaaucaaggagauccgcgaucagggauccugcgguuccuguugggccuucggagcuguggaggccaucucugaccguauuuguauucacaccaacgcccacgucaguguggagguaucagcagaggaccugcuaacauguugcgguagcaugugcggggacggauguaauggagguuacccagcugaggcauggaauuuuuggacacguaaagggcugguuaguggcggcuuguacgaaucgcacguuggaugccggccguauaguauaccccccugugagcaccacguaaauggaaguagaccucccuguacgggugagggagauaccccuaaauguuccaaaauuugcgaaccaggcuacaguccaacuuauaaacaagacaagcauuacggcuacaauagcuacagcguuucgaacuccgagaaagacauuauggcggaaauauauaagaacggaccaguugagggcgcuuucucaguauacuccgacuuccuucucuacaaauccggaguauaucagcaugugaccggugaaaugaugggcgggcacgcaaucagaauucuugggugggggguggagaacgggacaccauauuggcuaguugcaaauucuuggaacacagacuggggggauaauggauucuuuaagauacuaagaggucaggaucauugcgguauagagagcgaggugguggcugguauuccacggacugaccaauacugggagaagauuuag

SEQ ID NO: 31852 - RNA, 1020 nt, Artificial Sequence
  Description of Artificial Sequence: Synthetic coding sequence
auguggcaguuaugggcuagucucuguugucugcugguccuggcgaacgcucgcucccggccuucguuccacccuuuaagcgacgagcuuguuaacuacgugaauaaacggaauaccaccuggcaggccggccacaauuuuuauaacgucgacaugagcuaccugaaaagauugugcgguacauuucuuggcggcccgaagcccccucagaggguuauguucacggaagaucugaaacugcccgccagcuuugacgcccgcgaacaauggccucaguguccuacuaucaaagagauucgggaucagggcucuugugguaguuguugggcuuucggugcgguggaagcuaucucugauagaauuuguauccauaccaaugcucaugucuccguggaaguaucagccgaagaccugcuuacuugcugcgggagcaugugcggagacgguuguaacgguggcuacccagccgaggcauggaauuuuuggacaagaaagggguuagucagugguggacuauacgagagucaugugggcuguagacccuacuccauaccccccugcgaacaccacgugaauggaagccgcccuccauguacgggagaaggagacacucccaaauguaguaaaaucugcgagcccggcuacagucccacauacaagcaggauaaacacuacggcuauaacucauauucugucuccaacucugagaaagauaucauggcggagaucuacaaaaauggaccuguggagggagcauucagcguguauagcgacuuccuucuuuauaagaguggcguauaccagcacgugaccggggaaaugauggggggacaugccauucggauacuggguugggguguggagaacggaacaccauacuggcuaguugcaaacucguggaacaccgauuggggcgauaaugguuuuuucaaaauucugcgaggccaggaucacugcgggaucgaaucagaaguuguggcggggauuccaaggacagaucaguacugggaaaaaaucuag

SEQ ID NO: 31853 - RNA, 1020 nt, Artificial Sequence
  Description of Artificial Sequence: Synthetic coding sequence
auguggcagcucugggccucucucugcugccugcuggugcucgccaaugccaggaguagacccuccuuccauccucuguccgacgaacuggugaacuacgugaacaaacggaacacaacauggcaagcagggcauaauuucuacaaugucgauaugucauaucugaaacggcucugugggacauuucuuggaggacccaaaccaccacagcgggucauguucaccgaagaccucaaacugccagcuuccuuugacgcacgagaacaguggccccaauguccgacuauuaaagaaauaagagaccagggguccugcgggaguuguugggcauucggcgccgucgaagcuauuagugauaggauuuguauucauacgaaugcacacgugagcguggaagucagcgcugaagaucuucugacauguugcgguucaaugugcggugauggguguaauggaggcuacccagccgaagcuuggaauuuuuggacucguaaaggacugguuucuggcggauuauacgaaucucaugucggcugccgaccuuauaguaucccuccuugugagcaccauguaaacgggagccguccucccuguacgggagagggcgauaccccuaaguguucgaaaaucugugagccuggguacucccccacauacaaacaggacaagcauuaugguuauaacucauacagcgucagcaauagcgagaaagauauuauggcugaaauuuauaagaacggccccguggagggcgcauuuucaguauauagcgacuuucuguuauacaaaucugguguguaucagcaugugacaggcgagaugaugggcggucaugcgaucagaauucuggguuggggcguggagaauggcacuccauacuggcuaguagccaacucguggaacacugauuggggggacaacggguuuuuuaaaauccuuagaggacaggaccauuguggcauagaguccgagguaguugcaggaauacccaggacagaccaauauugggaaaagauauag

SEQ ID NO: 31854 - RNA, 1020 nt, Artificial Sequence
  Description of Artificial Sequence: Synthetic coding sequence
auguggcagcuuugggccucucucugcugccucuugguacucgcuaacgcccgcucucgccccucuuuucacccccugucugacgaauuaguuaauuaugucaauaaaaggaauaccaccuggcaggcagggcacaacuuuuacaaugucgacauguccuacuugaagagauugugcggaaccuuccugggagguccuaaaccaccacagcgcgugauguuuacugaagauuugaaauuaccagcauccuucgacgcccgagagcaauggccacagugcccgacgauuaaggaaauucgcgaucaggguucuugcgguagcugcugggcguucggugccguagaagcuauuucggacagaauuugcauucauacaaaugcccacguuucuguggaggucagugcggaggauuuacuaaccuguugcggcucgauguguggagacgguugcaauggcgguuacccagcagaggcauggaauuuuuggacuagaaagggcuuggucaguggugggcuguacgagucccacguggguuguagaccuuacagcauaccacccugugaacaccacguuaaugggagcagaccuccuugcaccggagagggagacaccccaaaauguucgaaaauuugugaacccgguuauucaccuaccuacaaacaggauaaacauuacggcuacaauucuuacucugucuccaauucugaaaaggacauuauggccgaaaucuacaaaaacggacccguggagggagccuucagcgucuacagugauuuucuccuuuacaaguccggcgucuaucaacacgucaccggagaaaugauggguggacacgcuauccgcauacucgguuggggaguagaaaaugguacaccguauugguuggucgccaacucauggaacacggauuggggcgacaaugguuuuuuuaagauauuaagagggcaggaucauugcgguauagaaucagaggugguugccggcauaccgagaacggaucaguauugggaaaagauuuag

SEQ ID NO: 31855 - RNA, 831 nt, Artificial Sequence
  Description of Artificial Sequence: Synthetic coding sequence
auggauaugaaucggagagccucuugucuuuugccagaccuuugcggacagggaugggguuggaggcuguucccugcuaguugcgccuaccugggaagugugccguggaggguguggggauuaggaggucuuuuagccccauuagccgccgcugguggaggaucuacaaguggucuuggacaucuagguagcacgcaguggagcggugaacucguugugcugcuuucugaggucuucauuagaggaugccuguucuccugcaauggaggcuacccugccgaggccuggaauuuuuggacccgcaagggccugguuucaggaggccuuuacgaaucucacguugguugccgacccuacucuaucccacccugcgagcaccaugucaauggcuccagaccccccugcaccggugaaggcgauacuccaaaaugcucaaaaaucugugaaccaggauacagccccacguacaaacaggacaagcauuaugguuacaauaguuauucaguuucuaacuccgaaaaagauauuauggcagaaaucuacaaaaaugguccuguugaaggagcauuuagcguuuacagcgacuuccuacuuuauaaaucuggaguuuaccagcaugugacaggggagaugaugggcggccacgcgaucaggauucuagggugggggguggagaacgguacuccauacugguuaguugcuaacucauggaacacagacuggggggauaacgguuucuucaagauuuuaagaggccaggaucauugcgggaucgagucagaggucguugcugggauaccgaggaccgaucaguauugggagaagauuuag

SEQ ID NO: 31856 - RNA, 738 nt, Artificial Sequence
  Description of Artificial Sequence: Synthetic coding sequence
augccaggugcaggaccauuaucuauuccaugcagaaugaguugggccuucggggcaguagaagccauuuccgacagaauuuguauucacacuaacgcccaugugagcguagagguuucugcagaggacuugcugacuuguuguggaucgauguguggugacggauguaacggcggcuacccugcugaggcauggaacuucuggacccgaaaaggauugguaucuggaggccuguacgaaagucacgucgguugucggccguacucgauaccaccuugugagcaucacguaaacggaucucgucccccuuguacuggagaaggcgacacccccaaguguuccaaaauaugugagccaggcuauaguccuacauauaagcaggauaaacacuauggauacaauuccuauagcgucaguaacucagagaaagauauuauggcagaaaucuauaagaacggccccguggaaggcgcuuuuucaguauacuccgauuuuuugcuguacaaaagcggcguuuaccagcaugucacuggcgagaugaugggaggccaugcaauacgaauacugggauggggcguagaaaauggaaccccauacuggcuuguggcuaacagcuggaacacagacuggggggauaacggauucuuuaaaauucugagaggucaggaucacugcggaauagagagugaagugguugcuggcauuccaaggacggaucaguacugggagaagauuuag

SEQ ID NO: 31857 - RNA, 1002 nt, Artificial Sequence
  Description of Artificial Sequence: Synthetic coding sequence
augaauccaacucugauccuggcugcuuuuugcuuaggaaucgccuccgcuacacucaccuucgaucacagcuuggaagcacaguggacuaaauggaaagcaaugcacaauagacucuaugggaugaacgaagaaggcuggaggagagcugucugggagaaaaacaugaaaaugaucgagcuucacaaccaagaauacagggaagguaagcacaguuucacuauggcaaugaacgcuuuuggcgauaugacuagcgaggaauuucggcagguuaugaacggauuccagaacaggaagcccaggaagggcaagguguuccaagagccacuguuuuacgaagcaccuagaagcguggacuggagagagaaagguuacguuacaccagugaagaaucaaggacagugcggcaguuguugggcauuuucugcuacuggcgcccucgaagggcagauguuuagaaaaacuggucgauuaaucaguuugagcgaacaaaaccugguugauugcagcggaccucagggcaaugaaggauguaauggaggacuuauggacuaugccuuccaguaugugcaagauaacgggggcuuagauucugaggagucuuauccuuacgaggccacagaagaaaguugcaaguacaauccaaaguauaguguagcaaaugacaccggguuuguggauaucccaaaacaggaaaaggcauuaaugaaagcgguggcaacggucgggccaauaucuguagccauagacgccgggcacgaaucauuccucuuuuauaaggaaggcaucuauuucgaaccugauuguucauccgaagauauggaucacgguguccuuguggugggguacggcuuugagagcacggagucggauaacaauaaauacuggcuaguuaaaaauagcuggggagaggagugggggaugggaggguacgugaaaauggccaaagauaggaggaaccauuguggcaucgccagugcagcaaguuauccaacuguuuag

SEQ ID NO: 31858 - RNA, 678 nt, Artificial Sequence
  Description of Artificial Sequence: Synthetic coding sequence
augaauccaacccugauauuagccgcuuuuugccucggaauugcaagcgccacucuaacguucgaucauucuuuggaggcccaauggacaaaguggaaagcuaugcacaaucgucuguacggcaugaaugaggaaggcuggaggcgagccgugugggaaaagaacaugaaaaugauugaauuacacaaccaggaauacagagaaggaaaacacagcuuuacaauggcgaugaacgcuuucggagacaugacaagugaagaauuuagacaggugaugaaugguuuccagaauagaaaacccagaaaggguaagguguuccaggagccucuguucuaugaggccccucguucaguagacuggagagagaagggcuacgucaccccuguaaaaaaucagggacaguguggaaguugcugggcuuucagcgccacuggagcucucgagggucagauguucaggaagacggguaggcucauaucucucagcgaacagaaucuaguugauugcucgggcccucagggaaaugaaggaugcaauggcggacucauggacuaugcauuucaguacguacaggauaacgguggcuuagacagugaggaguccuauccauacgaagcuacaguuuccggcgccccuugucaccauaguucuucugcuuuuggacgguggacacuauag

SEQ ID NO: 31859 - RNA, 1002 nt, Artificial Sequence
  Description of Artificial Sequence: Synthetic coding sequence
augaacccuacucugauacucgccgccuuuugcuuagggauugccagcgcuacacucaccuuugaccacucucucgaagcacaguggacuaaguggaaagcaaugcacaauagacuguaugggaugaaugaagagggauggcgucgggcugucugggagaaaaacaugaagaugaucgagcuucacaaccaggaauauagagagggcaagcauagcuuuacuauggcuaugaacgcauucggcgauaugaccagcgaagaauucagacagguuaugaacgguuuccagaaucgcaagcccaggaaggggaagguguuccaggaaccccuuuuuuaugaggcaccuagaagcguggacuggagggaaaaaggcuaugugaccccaguuaaaaaucaggggcaaugcgggucauguugggcauucuccgcaacuggggcgcucgaggggcaaauguuucgcaaaaccgggcgcuuaaucucacucucugagcaaaaccuuguagauugcucgggaccucaggggaaugaagggugcaacggcggacugauggacuacgccuuucaguaugugcaggauaacgggggacucgacagcgaggaguccuacccauaugaggcuacugaagaaagcugcaaguauaacccaaaauauagcguggccaaugacacaggcuucguugauauccccaagcaggaaaaagcgcuaaugaaggccguggcuacuguuggaccuaucucuguugccauugaugcuggucacgaaagcuuccuauuuuacaaagaggggaucuacuuugaacccgauuguucuucugaagacauggaucacgguguccugguggucggguacggguucgagagcaccgagagcgacaacaauaaauauugguuggugaagaauaguuggggugaagaauggggcauggguggauauguuaagauggcaaaggaccgaaggaaucauugcggcauagcuucugcagcaagcuauccuacuguguag

SEQ ID NO: 31860 - RNA, 120 nt, Artificial Sequence; identical to SEQ ID NO: 31679
  Description of Artificial Sequence: Synthetic coding sequence

SEQ ID NO: 31861 - RNA, 2544 nt, Artificial Sequence
  Description of Artificial Sequence: Synthetic coding sequence
augcaucugcucgggccauggcuguuacuacugguucuggaguauuuagcuuucucugauucuuccaagugggucuucgagcacccagaaacgcuguacgcuugggagggcgcuugcguguggaucccaugcacuuacagggcauuagacggcgaccuggagagcuucauucuguuucauaauccggaguacaacaagaauaccucuaaguuugauggaaccagauuauaugagucuacaaaggauggaaaagugcccagcgaacagaaacggguucaguuccucggggauaagaacaaaaauuguacauugucgauccaucccgugcaccuuaacgauuccggacaacucggucuacgcauggagaguaaaacagaaaaguggauggagcggauacaucuuaacgucuccgaaagaccuuuucccccccauauccaacuuccuccggaaauccaggagagccaggagguaacauugacaugucuucuuaauuuuuccuguuaugguuaccccauccagcuucagugguuacucgaaggcgugccaaugagacaagcagcagugacuuccaccucucugacaauuaagucugucuuuacccgauccgaacugaaguuuuccccccaauggucucaucacggcaaaaucgucacuugccagcugcaagaugcagacggaaaauuucucuccaaugauacaguacaguuaaacgucaaacauacuccaaagcuugaaauuaaggugacacccagcgaugcuaucguucgagagggcgacagugugaccaugacaugcgaggucagcucuuccaacccagaauauacaacggugucuuggcugaaggaugggaccucccucaagaaacagaauacuuuuacgcugaauuuaagagaggugaccaaagaucagucggggaaguauugcugccaagugucuaaugacgucggacccggucgcucagaagagguuuuccuucaagugcaguacgcgccagagccgagcacagugcagauucuacacagcccugcuguugaagggucucaggucgaguuuuuguguaugucccucgcuaauccucucccaacuaacuacacaugguaucacaacgguaaagagaugcaaggacgcaccgaggaaaaaguccacaucccuaagauccugcccuggcacgcggguacauauagcuguguugcugagaacauucuaggcaccggacaacgcgggccuggagcugaacucgauguacaguauccuccgaaaaaggugacgacagugauccagaauccaaugccaauacgugagggagauacaguaaccuugucauguaacuauaauagcuccaaccccuccguuacucgauacgaguggaaaccucauggcgcuugggaggagccaaguuugggcgugcuuaaaauccagaacguaggaugggauaauacuacgaucgccugcgcagccuguaauucuuggugcagcugggcaucucccguugcucugaacgugcaguacgcaccuagagaugugagggucagaaaaauuaagccacugucagaaauccauagugggaauagcgucucgcugcaaugcgauuuuaguuccucccauccuaaagaagugcaguucuucugggaaaaaaauggccgucuccuugguaaagaaucucagcuaaacuucgauucuaucagccccgaagacgccggauccuacucuugcugggucaauaacuccauuggccagacugcuucuaaagccuggacccuggaaguuuuauacgccccccgucgacuccgagugucuaugagucccggcgaucaagugauggaagguaaaucugcaacccuuacuugcgagucugacgcaaacccaccggugucacacuauacaugguucgauuggaacaaucagagcuuaccauaccacagccagaaacugcgucucgaacccguaaaggugcaacacuccggugcuuacuggugucaagggaccaauucuguaggcaaaggaagaucccccuuguccaccuuaacugucuauuacucaccagagaccauuggccgacgugucgcuguuggccuagggucaugccuggcuauucugauauuggcuauauguggccucaaacugcagcggcgguggaagcgaacccagagccagcagggccuccaggaaaauuccucuggucagucauucuucguuaggaauaagaaaguacggcgcgcuccucucucagaaggaccacauucuuuaggcuguuacaacccuaugauggaagaugguaucucauacacaacacugagguuuccagagaugaacaucccccgaaccggagaugcugaauccuccgagaugcagcgaccacccccagauugugaugacacuguaaccuacucugcccugcauaagagacaaguuggcgauuaugaaaaugugauaccagacuuucccgaggacgaagguauucacuacucugagcucauccaauucggcgugggcgaaagaccacaggcacaggaaaauguagauuacgugauccuuaaacauuag

SEQ ID NO: 31862 - RNA, 1377 nt, Artificial Sequence
  Description of Artificial Sequence: Synthetic coding sequence
augaaccguggagugcccuuuagacaccugcuucucguucugcagcuugcccucuugccugccgcaacccaagguaagaaagucguacuuggcaagaaaggcgacacagucgaauuaaccuguacggcuucacagaaaaaaucuauucaauuucacuggaaaaauaguaaucagaucaaaauacuagggaaccagggcucuuucuuaaccaagggccccucuaaacugaaugaccgagccgacaguaggagaucacugugggaucaggggaauuuuccucuaaucauaaagaauuugaagauugaagacucggacaccuauaucugcgaggucgaggaucagaaagaggaggugcagcugcugguguucggucuuaccgcuaacucagauacccacuuacuucaaggucaaagccuaacgcuaacucuggaaucaccgcccggaagcuccccuagcguccagugccguucuccucgaggcaagaacauccagggggggaaaacgcuaagugugucucagcuggaacugcaggacagcgggacguggacuugcacaguucuucaaaaucaaaaaaagguugaguuuaagaucgauauagucgugcucgcauuucaaaaggcaucuucaauuguuuauaaaaaggaaggagaacagguggaguucaguuuuccguuggcauucaccguugaaaaacucaccgggaguggagaacugugguggcaggccgagcgcgcgucaaguaguaaaaguuggaucacauucgaccucaaaaacaaggaagucagcgucaagcgagucacccaggacccuaaacugcaaauggguaagaagcucccucugcaccugacccugccccaggcccucccccaauacgcaggcucagguaaucugacacuugcuuuagaggcaaagacaggcaagcuucaucaggaagucaaccucguugugaugagggcuacccagcugcaaaaaaaccucacuugcgaggugugggggcccacaagcccgaaacugaugcugucacuuaaacucgaaaacaaggaagcgaaggucagcaaacgcgaaaaagcgguaugggugcucaaucccgaggcuggaauguggcagugccugcuuagcgacuccggacaagugcuucuggaaucuaacauuaaagugcuccccacuuggucuacgccuguacaacccauggcccucauuguccuaggcgguguagccggauuauugcuauuuauuggcuuggguauuuucuucugugugagauguagacauagacgccgacaggcagaaagaaugucgcagauuaagagacuguugucugagaaaaaaacgugccagugcccucaucgguuccagaagacgugcuccccaaucuag

SEQ ID NO: 31863 - RNA, 276 nt, Artificial Sequence; identical to SEQ ID NO: 31682
  Description of Artificial Sequence: Synthetic coding sequence

SEQ ID NO: 31864 - RNA, 276 nt, Artificial Sequence; identical to SEQ ID NO: 31683
  Description of Artificial Sequence: Synthetic coding sequence

SEQ ID NO: 31865 - RNA, 270 nt, Artificial Sequence; identical to SEQ ID NO: 31684
  Description of Artificial Sequence: Synthetic coding sequence

SEQ ID NO: 31866 - RNA, 360 nt, Artificial Sequence
  Description of Artificial Sequence: Synthetic coding sequence
augaaugcuaagguaguggugguccucguccuggugcuaacagcucugugucucucagauggcaagccagugucccucucuuaccgcuguccuuguagauucuuugagagccacguagcucgagcuaaugugaaacaccuuaaaauccugaacacccccaauugugcucuucagaucgucgcccgacuaaagaauaauaaccgccaggugugcaucgacccuaaauugaaauggauucaggaauacuuagaaaaggcgcucaauaaaggucgucgggaggagaaagugggcaaaaaagagaagauagguaagaaaaaaagacagaaaaaaagaaaggccgcacagaagagaaagaacuag

SEQ ID NO: 31867 - RNA, 282 nt, Artificial Sequence; identical to SEQ ID NO: 31686
  Description of Artificial Sequence: Synthetic coding sequence

SEQ ID NO: 31868 - RNA, 423 nt, Artificial Sequence
  Description of Artificial Sequence: Synthetic coding sequence
augaacgcuaagguuguugugguccucguucuuguucuaaccgcccuuugucucucagaugguaagccuguuucccuuaguuaccgcuguccauguagauucuuugagucccauguagcccgagccaacgucaaacaucugaaaauacuuaacaccccaaacugcgcccuucagauaguugcuagacuuaagaauaauaaucgccaaguuuguauugauccaaagcugaaauggauacaagaauaucucgagaaagcccucaauaaucucaucagcgcggcaccugcuggaaagcguguuaucgcaggcgcccgcgcacuccaucccuccccuccccgcgcauguccaaccgcccgggcacuuugcgaaauaagguuauggcccccaccagaguggucuuggcccucacccggcgacguuuag

SEQ ID NO: 31869 - RNA, 273 nt, Artificial Sequence; identical to SEQ ID NO: 31688
  Description of Artificial Sequence: Synthetic coding sequence

SEQ ID NO: 31870 - RNA, 4101 nt, Artificial Sequence
  Description of Artificial Sequence: Synthetic coding sequence
augcucagcuuugucgacacacgcacccugcuguuacucgcagucacacuaugccuugcaacuugucaaucgcuacaggaggaaacaguaagaaaggggccugccggugauaggggaccaaggggggaacgcggaccaccggguccuccaggcagagauggugaagacgggccuacaggaccucccggcccaccaggcccucccgguccuccuggacucggcgggaauuucgcagcccaguacgauggcaaagguguuggccucggaccggggcccaugggcuugaugggaccuagaggcccgcccggagccgccggggccccaggcccucagggauuucaagggccagccggcgaaccaggagaaccuggccagaccgguccugccggagcaagaggaccugcggguccccccggcaaggcaggagaagacgggcaccccggcaaaccuggacggccaggagagcgcggcgucgucggcccccaaggugcgcgcggauuccccggaacacccggacugcccggguuuaaaggcaucagaggacauaacggguuagauggccugaaaggccagcccggagccccuggcguuaaaggcgagccaggagcuccuggcgaaaaugggacaccgggacagacaggcgcucgaggcuuaccaggugaaagggguaggguuggcgcucccgggccggcaggagcccggggaucugacggaucagugggaccagucgggccagccggcccuauuggaagugcuggaccaccuggcuucccaggugcucccggcccaaagggagaaauuggcgccgugggaaacgccggaccugcuggacccgccggaccccggggugagguuggacuucccggccugucaggaccuguggguccuccuggcaauccuggagcuaauggccucaccggcgcgaaaggugcggcagggcuucccggcguggccggcgccccuggccugccaggcccucgcggaauccccgggcccguuggagcggcaggagccaccggcgcucgcggacucgucggagagccgggcccagcuggaaguaaaggagaaagugggaauaaaggagagcccgggagugcgggcccacaaggcccccccgggcccucaggcgaagaaggaaagcgcgggcccaacggagaagcuggauccgcaggaccacccggccccccuggccugagaggaucaccuggaaguaggggacugcccggggcagacgggcgcgcaggcgugauggguccuccaggaaguagaggagcuucaggacccgcgggugugcggggaccaaauggugacgcuggaagacccggggaaccaggcuuaaugggaccucggggguugccuggcucccccgggaacauuggcccugccggcaaggagggaccagugggcuugccuggaauagacggucgucccggaccaaucggaccagcaggugcacgcggagagcccggaaacaucggguuccccggacccaagggacccacuggggauccagguaagaacggcgacaagggacacgcuggcuuggccggagcacgcggagcaccagguccggauggcaacaacggcgcacaggguccaccagggccucagggcgugcagggaggaaaaggagaacaggggccgccagguccucccggauuucagggacucccaggccccucgggaccagcuggagagguuggcaaacccggugaaagaggacuucacggcgaauuuggcuuacccgguccugcgggcccccgcggagaacgggggccuccuggugaaaguggagcagcaggcccuacugggccgauaggaagucguggcccgagcggcccuccgggaccagauggaaauaagggcgaaccuggaguugugggugccguugguacugccgguccauccggaccaagugggcuaccuggcgagcguggagccgcaggcaucccuggaggcaaaggagagaagggcgaacccggccugcgaggugaaauugggaaucccggccgagacggcgcaagaggugcccccggagccgugggugcgccuggaccagcaggggcgaccggggauagaggagaagcaggugcggccgggcccgccgggcccgccgggccaagaggaucaccaggagaaagaggcgaaguaggccccgcaggaccgaauggguucgcugggccagcaggagcugcgggucagccuggcgcaaagggcgagcgcggcgcuaaggggccaaaaggagagaacggggucguuggaccaaccggaccaguuggcgcagcuggaccugccggaccgaauggaccacccggacccgcaggcagucggggcgauggcggccccccaggaaugaccggcuuuccuggagccgcagguagaacagguccaccuggcccaagcgggauaucaggaccaccugggccaccggggcccgcuggcaaggagggccuuaggggcccacgaggagaccagggcccgguaggacgcaccggagaggugggagcuguuggccccccggguuucgcgggggagaaaggaccauccggagaagccggcacagcuggaccacccgggacccccgguccucagggacugcugggagcucccggcauucucggccuaccugggucuagaggagaaagaggauugcccggaguugcaggcgcugucggcgagcccggcccccuggguauagcuggaccucccggagcccgcgguccgccaggcgcagucggauccccaggggugaauggggcucccggagaggcuggacgggaugggaauccagggaacgacggaccgccaggucgugauggacagccuggucacaagggggaacgcgguuaucccgggaauaucggaccagugggggccgccggagcucccgggccucaugggccagucggcccugcugguaaacacggcaaccgaggagagacaggaccuuccggcccagucggcccggccggugcugugggaccucgcggaccuucaggcccacaaggaaucagaggggacaagggggaaccaggugagaagggcccuagggguuugcccggacugaaaggccacaauggccuccagggacugccuggcauagccggacaucauggugaucaaggggccccagguagcguagguccugccgguccaagaggccccgcuggcccuuccggaccugcuggcaaggaugggcgcaccggacacccaggaacuguggggccagccgguauuaggggaccucaaggacaucaggguccugccggcccccccggaccucccggcccgcccggcccgccuggaguuuccggaggaggauaugauuucggcuacgacggggauuucuaccgcgcggaccagccuaggagcgcacccagccugaggcccaaggacuacgagguugacgcaacucuaaaaagccugaauaaccagaucgagacuuuguuaacaccagaggggagccgcaaaaacccugccaggacauguagagauuugagacugagucacccagaaugguccuccgguuacuacuggaucgauccaaaccaggguugcacaauggaugccaucaaaguguacugcgacuuuucuacaggggaaacuuguaucagagcacagcccgaaaauauaccugcaaaaaauugguaccggucauccaaagauaagaaacacgugugguuaggugaaacaaucaacgcugggagccaguuugaguauaacguagagggcgugacuagcaaagagauggcuacgcagcuggccuucaugagacuccuugcuaauuaugcuucgcagaacaucacauaucacuguaaaaauuccauugccuauauggaugaggaaacuggaaaccugaaaaaagcugucauccuacaagguaguaaugaugucgagcuuguggcagaaggaaauucaagauucaccuacacugugcuuguagacggaugcaguaaaaaaacaaacgaauggggaaagacaaucaucgaguacaaaacaaacaagcccagcagacucccuuuucuggacauugccccccucgacauuggcggggcagaccaggaauuuuuugucgauaucggaccuguguguuucaaauag

SEQ ID NO: 31871 - RNA, 4104 nt, Artificial Sequence
  Description of Artificial Sequence: Synthetic coding sequence
augcuuagcuuuguggauacaagaacccuucuucuccuugcugugacauuaugucuagcgaccugucaaugcacacugggaggacagacccucucaaaguuuccccccuaccugcacauagagcggucugagcagggccccccuggaccccccggucgcgacggcgaggauggucccaccggcccccccggcccucccggcccuccuggcccucccggacugggugguaacuucgccgcacaguaugacgguaaaggcgugggccucggaccaggaccaaugggauuaaugggcccuagaggccccccaggagccgcuggagcccccggaccucaaggauuucagggcccugcaggagaaccgggagagcccgggcagacuggcccugcaggcgcaagagggccugcaggaccuccuggaaaagcaggcgaagauggccaucccggaaagcccggccgcccaggcgagcguggaguggugggaccucagggcgccagaggauuucccggaacucccggccuuccuggcuuuaaagggauaagagggcauaauggcuuagauggacucaaagggcagccuggcgcccccggcgugaagggugaaccgggugcuccaggcgagaacggcacuccuggccagaccggagcacgggggcucccuggcgaacgaggaaggguuggagcgccgggcccagcgggugcccgcggauccgauggcucaguugggccaguugggccagcuggaccaauaggaagugcaggcccccccggauuuccuggcgcccccggacccaagggggaaauuggcgcuguuggcaaugcaggacccgcggguccagccggcccuaggggcgaaguaggcuuaccaggacuguccggcccagucggaccgccagguaauccuggagccaauggccugacaggcgcaaaaggagcagcuggacucccaggcguggccggagcuccugggcuaccuggaccccgcgggauacccggcccugugggcgcugcuggugcaacuggcgcacgaggucuggugggcgaaccgggaccugcagguucaaagggggagucuggaaacaagggggagccuggaagcgcagggccucagggcccaccgggaccgucaggugaggaaggaaagcgagggccaaauggagaggcuggcucagcggggccaccuggaccccccggucugagggggagcccuggaucaagggggcuccccggggcagauggucgcgcagguguaaugggaccaccugggagcagaggcgccucagguccagcuggaguccgcggaccaaacggugaugcuggccgcccaggcgaaccagggcucaugggaccucggggcuugccaggaagccccggaaauaucggaccggcuggcaaggagggaccaguaggcuuaccaggaauagauggcagaccaggcccuauuggcccugcuggagcacggggagagcccggcaacauaggguucccagggccaaaggggccaacuggugauccaggcaaaaauggcgauaaaggacacgcugggcuggcgggagcaaggggagccccuggaccugauggaaauaacggggcacaagggcccccagggccacagggagugcagggcgggaaaggagaacaggguccaccaggcccacccggauuccagggccugccaggaccuagcgguccagcuggugaagugggcaaaccuggggaacgcggguuacacggagaguuuggucugcccgguccugcugguccuagaggcgagcguggccccccuggggagucuggcgcagcugggcccacaggaccaauuggaaguagagggcccuccggaccaccuggucccgauggaaacaaaggagagcccgguguggugggagcagugggaacugccgguccgucagguccgucugggcuaccgggagagagaggagccgccggaauccccggaggaaaaggggaaaaaggugagccugggcugaggggggagauugguaacccaggccgcgacggcgcccgcggcgccccaggagcaguuggcgccccagggcccgccggugcuacaggugauaggggagaagcuggcgcggcuggucccgcugguccugccgggccccgagggucgccaggggaacggggagaagugggacccgccggccccaacgguuucgccgggcccgcuggcgcugcuggacagcccggagcgaagggagaacgaggggccaagggaccaaaaggcgagaacggaguugucggaccuaccggaccagugggcgcugcgggucccgccgggccaaacggaccaccaggcccagcuggcucccggggggacggagggccaccaggaaugacaggcuucccuggugcagcagguagaaccgggccaccuggccccucugguaucuccggaccccccggccccccaggccccgcuggcaaagagggcuugcgcgguccgaggggcgaucagggacccguugguaggaccggggaaguuggcgcugugggccccccggguuucgcaggggagaagggaccaaguggcgaggccggaacagcuggaccucccgggacacccggcccacaaggucugcuuggugccccuggcaucuuaggccugcccgguucacgaggggagcgagggcugcccggaguugccggcgcugugggugagccaggccccuuggguaucgcaggcccgcccggagccaggggaccgccuggcgcugugggcagcccuggcgugaauggagcccccggcgaagcaggccgggauggaaacccagggaacgauggacccccggguagagacggccaaccaggccacaaaggggagaggggauaccccgggaacaucggaccugucggagccgcuggagccccggguccacacggcccugugggaccagcagggaagcacggcaaucggggggaaacagggccuucgggaccugucggaccagcuggagcaguggggccgcgcggacccucaggaccccaaggaauuagaggagauaaaggagaaccuggagaaaagggcccaagaggauugccuggacugaaaggacacaacggucuccaaggacucccaggaauagcagggcaccacggagaucagggcgcccccggcagcgucgguccugcaggaccccgagggccagcuggaccauccgggccagccgguaaggacggccgcacugggcacccagggacuguggggcccgccgggauacggggcccacaaggccaccaagggcccgccgguccaccaggccccccagggccacccggaccaccaggaguguccggaggcggcuacgacuuugguuacgacggcgauuuuuaccgugccgaccagccccguucugcccccaguuugcgaccuaaggacuacgagguggacgcaacucucaaaagccuuaauaaucagaucgaaacacugcugaccccugaaggaucacgcaagaacccugcaagaaccugucgggaccugagacuuucacacccagaauggagcucaggcuacuacuggaucgauccaaaucagggcugcacuauggaugcgauuaagguguacugugacuuuagcacaggcgagacuugcaucagggcccagcccgaaaauauccccgcuaaaaacugguaucggagcuccaaagauaagaaacacgucugguugggcgaaacuauuaacgcaggcucccaguuugaauacaacgucgaaggcgucacauccaaggagauggccacgcagcuggcauuuaugagacuauuagccaacuacgcaucacaaaauaucacauaucauuguaagaacagcauagcguacauggacgaagaaacuggcaacuugaagaaagccgugauucuacagggaagcaaugaugucgaacugguggccgaaggaaauucaagguucaccuauacaguacugguugacgggugcagcaagaagacaaaugagugggguaagaccaucauagaauauaaaaccaacaaaccuagccgacucccauuccuggacaucgcaccuuuggauauuggcggugcagaucaagaauucuucguggacaucgggccgguguguuuuaaguag

SEQ ID NO: 31872 - RNA, 5304 nt, Artificial Sequence
  Description of Artificial Sequence: Synthetic coding sequence
auggagccuuggucuagcagguggaaaacuaaacgguggcuaugggauuucacagugacaacccuggcucugaccuuucuguuucaggcaagagaaguacgaggagccgcaccggucgacgucuuaaaggcccuggacuuucauaacucaccagaaggcaucuccaaaaccacgggguucuguacuaaucggaaaaacucuaaagguucugauaccgcuuaucgagugucgaaacaagcccagcucucagccccgaccaaacaguuguuuccaggcggcaccuuuccagaggauuucucaauacuguuuaccguuaagccaaagaagggcauccaguccuuucugcuguccauauacaaugaacacggcauccaacaaauuggaguggaggugggaaggagcccuguauuccucuucgaagaccauacugguaagcccgcuccagaagauuacccucucuuuagaaccgugaauaucgccgacgggaaauggcauaggguggcuauaagcguggagaagaagaccgugacgaugaucguugacugcaaaaaaaagacaaccaagccccuggaccgaagugagcgcgcgauuguggauacaaauggaauaacaguguuugguacgaggauccuugaugaagaaguguuugaaggagauauccagcaauuccugaucaccggggacccuaaagcagccuacgauuacugugaacacuacagccccgacugcgacuccucggcuccuaaggcagcccaggcucaagagccucaaaucgacgaagcaaauauuguggacgacuuccaagaauacaauuaugguaccauggagucuuaucagaccgaagcgccccgccaugucagugguacaaaugaacccaauccuguugaggagauauuuaccgaggaauaccuuacaggagaagacuaugauucccaaagaaagaauuccgaggacacacucuaugaaaauaaggaaaucgauggcagggacucagaccuccucguggauggcgacuugggcgaguaugauuucuacgaauacaaagaguaugaagacaaaccuacauccccacccaaugaagaguuuggcccaggcgugccugcugaaacagacauuacugaaacaucaauuaacggacacggagcauacggagaaaaaggacaaaagggagagccugcggugguggaaccugggaugcucguggaaggcccaccuggacccgcggggccugcgggaaucaugggacccccuggccuucaagguccaacaggaccccccggggauccaggcgaucgggggccgccgggccggccaggcuuaccaggugcggacggucucccaggaccccccggaacuauguuaaugcuuccguuccgcuaugguggagaugguucgaaagggcccacaaucucagcccaagaagcacaggcacaagcuauccuacaacaggccaggaucgcucuuagaggaccgcccggcccaaugggcuugacggggaggcccggcccagugggugggccaggcaguucuggggccaaaggggaaagcggagacccuggaccacaagggccuagaggugugcaggguccgccaggcccaacugguaaacccgggaagcgcggaaggccuggggccgacgggggccgcgggaugccaggcgagccuggggcuaagggcgauagagguuuugacgguuugccaggauugccaggcgauaaaggacauaggggagagagaggcccucagggaccuccaggaccaccgggcgaugacggaaugagaggcgaggacggcgagaucgggccgcguggccugcccggagaggcugguccucggggccugcuuggcccacgcgguacccccggcgcuccaggucagcccggcauggcuggcguggacggaccucccggucccaaagggaauaugggaccucagggcgagcccggacccccaggacagcagggcaauccaggcccccagggacugccaggaccccaaggaccgauuggucccccaggggagaaaggaccacaggggaagccaggccuugccggauuaccuggagcugacggacccccgggucauccaggaaaagaaggucagaguggugagaagggugcucucgguccucccggaccccaaggucccauuggcuacccaggaccgagaggcguuaaaggugcugacggcgugagaggccugaagggaagcaaaggggagaaaggcgaggauggguuuccaggauucaaaggugauaugggucucaagggagacaggggugagguaggccagaucggccccagaggggaggauggaccugagggacccaaaggcagagcaggaccaacaggggaccccgggccaucaggacaggcaggcgagaagggaaagcuaggugugccagguuuaccuggauaccccgguaggcaggggccuaagggcucaaccggcuuuccuggcuuccccggcgcaaauggcgaaaaaggagcaagaggcguggccggcaaaccgggacccagaggccagagaggaccaacaggcccucggggcaguagaggcgcgcguggaccaaccggcaaacccggaccuaaaggaacuucuggcggggauggccccccgggccccccaggagaaagaggaccucaaggcccucagggcccgguuggauucccuggaccuaagggccccccaggaccacccgguaaagauggacugcccggacacccagggcagcgaggcgaaacaggauuucagggaaagacaggcccaccagggccagguggcgucguugguccacagggaccuacaggugaaacgggcccuauuggugagaggggacauccagggccaccgggaccccccggggagcagggccugccgggagcagcaggcaaggaaggcgcgaagggggacccuggaccccagggaauaagcggaaaggacgggccggccggauugcgcggauucccgggugagagaggacugcccggugcgcagggggcuccaggacucaagggcggagaaggaccccaggggcccccaggccccgugggaucaccaggagagcgugguagcgcggggaccgccgguccuauuggcuuacccggaaggccugguccucagggaccaccggguccugcaggcgagaagggggccccuggagagaaggguccacaaggaccagccgggagagacggagugcaaggaccagucgggcucccaggaccugcaggccccgccggaucuccaggagaggauggcgacaaaggcgagaucggagaaccggggcagaaaggcagcaaaggugauaaaggugaaaauggacccccagguccaccaggauugcagggcccugugggugccccggggaucgcagggggagacggugaacccggcccuagaggacagcagggaauguucgggcagaaaggggacgaaggcgcucguggauucccgggucccccaggcccuauaggacugcaggggcuucccgguccaccaggcgagaagggugaaaacggagauguagguccuaugggaccaccuggcccacccggcccuagaggaccacaaggacccaauggcgccgacggaccacagggccccccggggagcgucggcucagucgguggcgugggggagaagggcgaaccgggcgaagcaggcaacccuggaccaccaggagaggcggggguggguggccccaaaggagaaagaggcgagaagggagaggccggcccucccggagcggcagggccaccgggcgcaaaaggaccuccuggcgaugacggaccuaaaggcaauccuggacccguuggauucccaggcgacccuggaccucccggugagccggguccugccggccaggaugguguggggggagauaagggggaagacggcgauccaggacagccuggacccccaggcccgucgggggaggcuggaccaccaggacccccuggcaagcggggaccuccuggcgccgccggggcugaaggaagacagggcgaaaagggcgcgaagggcgaagcaggagcagaggguccuccagggaagaccgggccuguugguccacaaggacccgccggcaagccaggaccugaaggccuccguggcauucccggaccagucggugagcagggccucccuggugccgcaggacaggacggcccucccggcccaauggggcccccaggacugccaggacugaagggugacccugggagcaaaggugagaagggccaccccggacuuaucggccugauuggaccuccaggcgaacaaggcgaaaagggcgauagagguuuacccggaacucaaggcucgccgggugccaaaggcgacggagguaucccagggccagcggggccucucggcccaccaggaccuccgggcuuaccuggcccucaaggaccuaaaggcaauaaaggaaguaccgggccagcaggccagaagggagacagcggauugcccggcccucccggcucuccagguccaccuggcgaaguaauccagccucucccaauccucagcagcaaaaagacaagaagacacaccgaaggcaugcaggcugaugccgaugacaauauuuuagacuacucagaugggauggaagaaaucuucggcucacugaauagccucaaacaggacauugagcacaugaaauuuccaaugggaacccagaccaauccugcuagaaccuguaaagauuugcaauuaagccauccugauuuuccugacggcgaauauuggauugacccuaaucaggguuguucaggggacucauuuaaaguguauugcaauuucacaaguggcggugaaacauguauuuauccagauaaaaagucugaaggcgugaggaucucuuccuggccuaaagagaagccuggaucuugguucagugaguucaagcguggcaaguuguuguccuaccuggauguugaaggcaacaguauaaauauggugcagaugacauuccucaaauuguugaccgccucugcccggcagaauuucacauaccacugucaucaguccgcugcuugguaugacgucagcucuggcagcuacgacaaggcauugcguuuccucgggaguaacgacgaagagauguccuacgauaacaauccguucaucaaaaccuuauacgacggcugugcuucaagaaagggauacgagaaaacagugaucgaaaucaacacacccaagauagaucaagugccuauaguagaugugaugaucaaugauuucggcgaucagaaucagaaauuuggguuugagguugggccagucugcuuucugggguag

SEQ ID NO: 31873 - RNA, 5457 nt, Artificial Sequence
  Description of Artificial Sequence: Synthetic coding sequence
auggagcccuggucuuccagauggaaaacuaaaagauggcucugggauuuuacugugacuacacucgcucucacauuccuuuuucaggcccgagaaguccgcggggcugcccccgucgauguacuuaaggcccuggauuuccauaauucuccagaaggaauuaguaagaccacgggcuuuugcaccaaccgaaagaacucaaaaggcagugacaccgcuuauagagugucaaaacaagcacaacugagcgcaccgacuaaacagcuuuucccaggagggacuuucccagaagauuucucaauacuauucaccgugaaaccuaaaaaggguauacaaucauuucugcuauccauuuacaaugagcaugggauccaacaaauuggaguggagguggggcguucacccguguuccuguucgaagaucacacuggaaagccagcuccagaagauuacccccuuuuccguacuguuaacauugcugacggcaaguggcaccggguugcuaucucugucgagaaaaaaacugugacaaugaucguugauuguaaaaaaaagaccacaaagccacucgaucggucugagagagcaauagucgauacgaauggaauaaccgucuuuggaacuaggauucuugacgaagaagucuuugaaggcgacauucaacaguuccucauuacuggggacccuaaggccgccuacgauuauugcgaacacuauuccccugacugcgacucaucugcuccuaaagccgcucaggcccaggaaccucaaauugacgaaaaaaaaaaguccaauuucaagaagaagaugcgaaccguggcgacaaaguccaaggaaaagaguaagaaguucaccccaccaaagucugagaaguucuccagcaagaagaaaaagucauaucaagcauccgccaaggcaaagcuaggugucaaagcuaauauugucgacgauuuucaagaguauaacuauggaacuauggaguccuaccagaccgaagcaccucgccaugugaguggaaccaacgaaccuaaucccguggaagaaaucuuuacagaggaguaucucacuggagaagauuaugauucgcagcgcaaaaacuccgaagacacucucuacgaaaacaaagaaaucgacggucgggacagcgaccugcucgucgauggagaccucggggaauaugacuuuuacgaguacaaagaguaugaggacaaaccgacaucgccccccaacgaagaauuuggaccagggguaccggcugagacggacaucacagaaacuucgauuaauggccacggggccuacggggagaagggacagaaaggggaaccagcuguugucgagccagggauguuaguggagggcccuccagguccagccggaccggcuggcauuaugggucccccaggucugcaggggcccacaggaccaccgggagacccaggagacagaggaccgccagggcggccgggauugccaggggcagacggacugcccggacccccaggaacgaugcugaugcucccuuuucgguauggaggagauggcucaaaaggaccuacaauuagugcacaggaggcucaggcucaggcaauucuccagcaggcgaggaucgcccugcggggaccuccaggcccuaugggacugaccgguaggccuggcccugugggaggacccgguagcuccggugccaagggggaaagcggugauccaggaccucaagggccucgcgguguucaaggcccacccggcccaacagggaaaccuggaaagcgagggcggccaggggcggacgguggacguggaaugccaggagagccuggcgccaagggcgauagaggcuucgacggccuuccggggcugccaggggacaagggacauagaggcgagcgcggaccgcaggggcccccgggaccaccaggagaugacggcaugcguggugaagauggcgagaucgggccacgcggauugccgggugaggcugggccacggggccuucuugguccuaggggaacuccaggugcaccagggcaaccagggauggcaggugucgauggaccccccggcccuaaggguaacaugggaccucaaggggaacccgguccaccggggcagcaggggaaccccgguccacagggcuugccagggccgcagggaccgaucggcccaccuggggagaaagggccacaaggcaaaccaggccuggccggguuaccaggcgcugauggacccccaggucauccgggcaaagaaggccaaucaggagagaaaggggcucugggccccccaggaccacagggaccaauaggauauccaggaccacgaggagugaaaggugcggacggaguccgcggccugaaagguucgaaaggcgagaagggcgaggauggauuuccagguuuuaaaggcgacauggggcugaagggcgaucgaggcgaggugggccaaaucgguccaagaggcgaggaugggcccgagggucccaagggaagggcuggaccaacaggggauccaggaccauccgggcaggccggagaaaagggcaaguugggggugcccggguugccaggauacccagggcggcaaggaccuaagggaucgacaggguucccgggcuuucccggagccaauggcgagaaaggagcacgcggaguggcaggcaaaccaggcccaagaggccagcgcggaccuaccggaccaagaggcagucgcggagcucggggacccacaggcaagcccgguccaaagggaaccucggguggagauggcccaccaggaccuccgggugaacgcggaccgcaggggccccagggcccaguaggguuuccuggaccuaaagggccucccggccccccuggcaaagacggccucccaggacaccccgggcagaggggggagacaggcuuucagggcaagaccggaccaccuggaccaggcggcguggugggcccacaaggacccacgggagagacgggcccaaucggagaacggggccauccaggucccccaggcccccccggggaacagggacucccaggcgcagcggggaaagaaggagccaaaggcgaccccgguccacaaggcauaucugggaaagauggacccgcugguuugcgaggcuuuccuggcgaaagaggguugccaggugcccaaggagccccugggcugaaagggggagaggguccccagggcccaccagggccagucgggaguccuggagagagaggcagcgcaggaaccgccggacccauuggacugccuggccggcccggaccgcagggcccuccaggucccgccggcgagaagggggcaccaggggagaagggcccucaaggaccugcuggacgagacggggugcagggcccugucggacugcccggucccgccggaccagcgggaagccccggggaagauggagauaaaggugagauuggggaacccggccagaaggggaguaaaggcgacaagggggagaacggcccccccggcccucccggacugcagggaccagugggagcuccgggcauugcaggcggcgacggugagccugguccacgcggucaacaagggauguuuggacagaaaggagaugaaggcgcacgagguuuucccggcccaccaggacccaucggccugcaagguuugccaggaccaccuggggagaagggcgagaacggcgaugucggaccuauggguccaccugggccacccgggccucggggcccccagggccccaauggugccgacgguccgcaggguccaccugguucaguaggcagugucgguggugugggagagaaaggcgaacccggagaagcagggaacccugguccaccaggcgaagcaggagugggugguccgaaaggcgagaggggcgagaagggugaagcagggccaccuggcgcagcuggcccccccggcgccaaaggucccccuggagacgacggcccaaaaggcaacccaggcccggugggauuccccggagacccagguccucccggugaacccggcccugcuggccaagauggaguggggggggauaagggcgaagauggcgaucccggccaaccuggccccccaggacccuccggggaggccggaccaccggggcccccaggcaagagaggccccccuggugcugcuggcgcugaaggacggcagggagaaaagggagccaagggagaagccggagcagaagggcccccaggaaagacgggaccugucggaccccaaggaccugcagguaagccgggaccugagggccugagaggcauucccgggcccgugggggagcagggacucccuggagccgcaggacaggacggaccaccaggacccauggggcccccgggccugccugggcugaagggcgacccugggagcaaaggggagaaaggccauccugggcugaucggauugauugggccccccggagagcagggcgagaagggcgauaggggauuaccgggcacccaggggucuccaggagccaaaggagauggggguauuccaggucccgccggcccacuugguccgccaggcccaccaggccugccaggcccacagggccccaaggguaauaagggcucaacagggccagcuggucagaagggagacuccgguuuaccuggccccccaggcucacccggcccccccggagaggugauucagccccuucccauacucagcucgaagaagacucgcaggcauaccgaagguaugcaggccgacgccgacgacaacauucuagauuacuccgacggcauggaagaaauuuucgggucguuaaauaguuugaaacaagacauugagcauaugaaguuuccuaugggcacucagacaaauccagccagaacuugcaaggacuuacagcugagucaccccgacuuccccgacggcgaauacuggauugaccccaaccaaggaugcuccggugauaguuucaaaguguauugcaacuucaccagcggcggcgaaacauguauuuauccagauaagaaaagcgaaggcgugcguauuaguucauggcccaaagagaaacccggauccugguuuucggaauuuaaacggggaaagcuccugucuuauuuagacguugaaggcaauaguauuaacauggugcaaaugacauuucugaaacuuuuaaccgcaagugcucgacagaacuuuacuuaucacugucaccagucugccgccugguaugacguuucuuccggauccuacgauaaagcgcugcgcuuuuugggcaguaaugacgaagaaaugagcuaugacaacaauccauucauuaaaacccuuuacgacggaugugccucucgcaagggcuacgagaaaacugugauagagaucaacacgccuaagaucgaccaggucccaaucguggacguaaugauuaacgauuuuggagaucaaaaucagaaguuuggauucgaagucgggcccguguguuucuugggguag

SEQ ID NO: 31874 - RNA, 3081 nt, Artificial Sequence
  Description of Artificial Sequence: Synthetic coding sequence
auggucagugaagugucacgggaucugaaggugaagagagaaaagcuggucaagcuggcacaggagggcaaaauggcacugaaggaccccaagguagaacaggcacaacuagaaacacagguauuacagguuaaacaggaaaagcgcgaaaauuuggaguuccaggacuaccaggacauccaggaagauaagguucagcgcauuucugaugugauaggaagcacgggauuccccggcuuucccggagcuaacggggagaagggagcaagaggcguggcaggaaagcccgguccgcgaggucagaggggaccuacaggaccuagggggagucggggagcgcggggacccacggggaaaccagguccaaaagguacaagugggggcgacgggccucccggaccgccaggggagcggggaccacaagggccacaaggacccguggguuuuccuggaccaaaggggccacccggaccccccggcaaggacggacuccccggucacccaggucagaggggcgaaacaggauuccaggggaagacaggaccccccgguccaggcggaguagugggaccgcaggggccuacaggggagacagguccaaucggcgagcgcggacaccccgggccccccggacccccaggcgaacaaggacugccaggugccgccggcaaggagggagccaaaggugacccaggcccucaggggaucucaggcaaagauggucccgcugguuugaggggauuccccggcgaacgcggacuacccggagcccagggugccccaggucugaaaggcggggaagggccacaaggaccccccggcccuguggguucccccggugagagagguucagccgggacagcuggcccaauuggccuacccggccgccccggaccccagggucccccaggucccgcgggcgaaaagggcgcuccaggagaaaaagguccucagggccccgccgggcgagacggaguacaaggacccgugggucucccaggacccgcaggaccagcuggcagcccaggagaagacggagauaaaggcgaaauaggggagccaggccagaagggaucuaaaggcgauaagggcgagaacggacccccagggccuccaggacugcagggucccguuggcgcucccggaauagcagguggggacggugaaccgggaccgcgcggucagcaggguauguucggucagaaaggagaugagggugcucgaggauuuccgggcccaccgggccccaucggucugcaagggcugcccggaccucccggggagaaaggcgagaauggcgacgucgggccaaugggaccccccgggcccccggguccccgaggcccacaggggcccaacggagcugacgggccucaggguccaccggguucuguggggagcguaggcggaguuggcgagaaaggggagccaggcgaagcugggaaccccggaccaccgggggaagcagggguaggaggcccgaagggagaaaggggugaaaaaggggaagcugguccuccaggagccgcuggaccacccggggcgaagggaccacccggcgacgauggaccaaaagguaacccagggcccgugggguuccccggcgacccuggcccuccaggcgaaccggguccugcaggccaggacggaguaggaggugauaagggagaggacggugacccaggacaaccuggacccccuggaccuucgggggaagcaggaccaccgggaccacccgguaaaagaggaccaccaggugcagcuggcgccgaaggcaggcagggugagaaaggcgcuaaaggagaagcaggggcagagggcccuccagguaagacaggaccugugggaccccagggcccggccggcaaaccaggcccagaaggacuccggggaauaccagggcccgugggugagcagggccuuccgggagcagcaggccaggacggaccaccaggaccuauggguccuccaggacuacccggccucaaaggggacccaggcucaaagggcgaaaaaggccauccaggcuuaauaggauugaucggccccccaggugaacagggugaaaaaggggaccgaggacucccgggcacgcagggcagcccuggagcgaagggggacggggguauaccaggcccggcaggcccacugggacccccgggaccuccaggacucccagguccgcaaggcccaaaaggaaacaaagggucgaccggcccagcgggacagaagggcgacaguggccucccaggucccccuggcucaccaggaccccccggcgaaguuauccaaccauugcccauacugaguucaaagaagaccaggagacacacugagggcaugcaagcugacgcugacgacaauauacuagacuauucugacgguauggaggaaauauuugggagcuugaauucucugaagcaagauauugaacacaugaaauuucccauggggacgcaaaccaaccccgcuagaacgugcaaagaccugcaacugucacaucccgauuucccagacggagaguauuggauagauccaaaccagggcugcuccggagauagcuucaaggucuauugcaauuuuacuuccgggggggagacuuguaucuacccugacaaaaaaucugaaggagugcgaauauccagcuggccuaaagaaaaaccuggaucuugguucuccgaguuuaaacgaggaaaacuccuuuccuaccuagauguggagggcaacuccauuaacauggugcaaaugaccuucuuaaagcuuuuaacagcaucagcccgucagaauuucacuuaucauugucaccaguccgcagcuugguacgauguuuccagcgguucuuacgacaaggcauuacgcuuucuugguagcaaugacgaagaaaugagcuacgauaauaaucccuucaucaagacacuguacgacggaugcgcaucgcggaagggcuaugagaaaacaguuauugagaucaauacuccuaaaauugaccaagugcccauaguugauguuaugauuaaugacuucggggaucagaaccaaaaauuuggauucgagguggggccagugugcuuuuuggguuag

SEQ ID NO: 31875 - RNA, 5421 nt, Artificial Sequence
  Description of Artificial Sequence: Synthetic coding sequence
auggagcccugguccucucgauggaaaacaaagagauggcucugggauuuuacagugacgacguuggcccuuacuuucuuauuccaggcucgagaagucagaggugccgcuccaguagacguucuuaaagcgcucgauuuccacaacuccccugagggcauuagcaagacaacgggcuucugcaccaaccgcaagaauuccaaaggguccgacaccgcuuaccgagucucaaaacaagcccagcugagcgcuccuaccaaacaacucuucccagggggcacguuuccggaggauuucucaauucuguucacaguuaaacccaagaaaggcauacaguccuuccugcugagcauuuacaaugaacacgguauucaacagaucggaguugaagugggaagaucuccuguguuucuguucgaggaccacaccggaaaaccugcacccgaggacuacccccucuuuaggacuguuaauaucgccgauggcaaauggcacaggguagcuaucagcguggaaaagaagaccguuacuaugaucguugauugcaaaaagaaaaccacgaagccccucgauaggagcgagagagccauagucgacacgaacggaauuaccgucuuuggcaccagaauccuagacgaagagguguuugagggugacauccagcaguuucucauuacaggggauccaaaggccgcauaugacuacugugaacacuacagcccagauugugacucuucagcccccaaagcggcccaggcccaggaaccgcaaaucgaugaauacgcgccggaggauauuaucgaauaugauuaugaguauggagaggccgaguacaaagaagccgagagcgucaccgaagguccaacugucaccgaagaaacuauugcacagacagaggccaauauuguggacgacuuucaggaguauaauuacggaacgauggagucguaucagacggaagcaccacgacacguuuccggaaccaaugaaccaaaucccguagaagaaaucuuuacugaagaauaucugaccggagaagacuaugauucacagcgcaagaacuccgaagacacauuauaugagaauaaagagaucgacggccgcgauucugaucuuuuaguggacggcgaccugggagaauaugacuucuacgaguauaaggaguacgaggacaagccgacaucacccccaaacgaagaauucggaccaggcguaccugcagaaaccgauauuacggagacaucaaucaauggccauggugcuuauggagaaaagggccaaaagggggagcccgcuguaguugaaccugguaugcugguggaggggccuccuggaccagccggaccagccggcaucaugggcccuccaggcuugcaaggccccacaggaccucccggcgaccccggagaccguggaccucccggccggccaggacuuccgggugcugaugggcucccagguccacccgggacuaugcuuauguugccauuuagauauggaggagacggcucaaagggcccaacuaucucugcucaggaagcccaggcacaggccauucuacagcaggcaagaauugcccuaagggguccuccuggcccaauggggcugacaggacggcccggccccgugggcggacccggcaguuccggcgccaagggggaaagcggagacccagggccacagggaccgcggggaguucaggggccaccaggaccaaccggaaagccagggaagcgggguagaccaggggcggauggaggaagggggaugccuggagaacccggggcgaagggcgaucgcggcuucgacggauuacccgguuuaccuggggacaaaggacaccggggagagcgcggcccacaaggacccccaggaccuccaggagacgauggcaugcggggagaagauggcgaaauaggaccaagagggcuccccggcgaggccggcccuagaggacuucuugggcccaggggaacccccggggcuccuggacagccuggaauggcaggaguggauggccccccagggccaaaggguaacaugggaccacagggugagcccggccccccaggucagcaggggaacccuggcccgcaaggacugccuggcccacagggcccaaucgggcccccaggggaaaaagguccacagggcaagccagggcuugccggauuaccuggcgcggacgggcccccgggacacccaggaaaagaaggacagaguggagagaaaggcgcguugggcccaccuggcccacagggccccaucggguaucccggcccccgagguguuaaaggggccgauggugugagaggacuuaaggguaguaaaggagaaaagggcgaagaugguuucccuggauuuaaaggcgacauggggcugaagggugaucggggggaggucgggcaaauaggcccgcggggugaggaugggccagagggaccaaaggggcgagcagggcccaccggagacccgggaccaucuggacaggcaggggagaagggcaaguugggaguacccggccucccagguuauccaggacgacagggaccaaaggggagcaccggcuuuccuggcuuuccaggagccaauggcgaaaagggggccagaggugucgcggguaagccaggccccagaggccagcgggguccaacaggcccuaggggguccagaggcgcaagaggaccgacggggaagcccggcccgaaggggacaaguggaggcgacgggcccccagguccccccggagagcgcgggccccaaggaccacagggcccugucggcuuuccuggccccaagggaccacccggccccccgggaaaagacggccuccccggccaccccggucagcgaggagaaacgggauuccaggggaagacaggaccgccuggucccgguggugucgucggcccucaggggcccacuggagaaacuggaccgaucggagagcguggccacccggggccccccggcccacccggagagcaggggcugccaggugcggcuggaaaagaaggugcuaagggagacccagguccacaagggauuucagggaaggacggaccagcugggcuccguggcuucccaggagaaaggggucuuccaggggcucagggcgcuccaggccuaaaggggggcgaaggaccgcagggaccccccggaccagucgggucgccuggugaacgcgguuccgccgguacagcuggcccgauaggccugccaggaagaccaggcccccagggcccacccgggccagccggcgagaagggugcccccggggaaaagggaccucagggacccgcaggcagagauggagugcaggggccugucggacugcccggacccgccggcccagccgggucacccggugaagacggagauaagggcgaaauuggagagccaggccaaaaggguagcaagggagauaagggagaaaacgggccgccggggccuccagggcugcaggggccaguaggugcacccgguauugcugggggagauggggaacccggaccucggggacagcaggguauguuuggacaaaagggugaugagggcgcccgcggcuucccagggccaccggguccaaucggguugcaaggacucccuggaccaccgggagaaaagggggaaaacggugauguaggccccaugggaccgccagggcccccuggaccaagagguccccaggguccuaacggcgcggaugggccacagggaccuccggggaguguagguagugugggcggcgugggggagaagggggagccuggugaagcuggcaaucccgggccaccuggugaagcaggagucggggggccgaagggagagaggggugaaaagggcgaagcuggaccacccggggccgcgggcccgcccggcgcuaaaggaccaccaggggaugauggccccaagggcaauccaggcccagugggcuuucccggcgauccaggcccucccggggaaccaggcccugcuggacaggauggagucggaggugacaaaggagaagauggagauccagggcagcccgggccuccgggaccuucuggugaggcaggcccucccggcccgccagguaaaagaggaccccccggcgcugcaggggcggagggaagacagggcgaaaaaggagcuaagggcgaggccggugcugaggggccacccggaaaaaccggcccuguagguccgcagggaccagccggcaaaccuggcccugaagggcugcgaggcaucccgggaccggucggcgagcaggggcugcccggggcggcaggacaggacggcccaccagggccuaugggacccccggggcucccuggccucaaaggcgacccaggcagcaaaggagagaaaggacaucccggguuaaucgggcucaucggaccucccggagaacagggugagaagggggaccgggggcucccaggcacacaaggcagucccggugcaaaaggagauggcgguauaccaggcccugccggaccucucggccccccugguccuccugggcugccuggaccccaagggccuaaaggaaacaagggauccacaggaccugcaggacagaagggagacucugggcucccaggcccccccggcagucccggaccacccggcgaagucauccagccucuucccauuuuaucuuccaaaaagacacggcgccacacggaaggcaugcaggcggacgcagacgauaacauucuggacuauuccgacgguauggaagagauuuucgggagccuaaacucucucaagcaggauaucgagcacaugaaguucccaaugggcacacaaacuaauccugcuaggaccugcaaggaccugcagcugucccaccccgauuuuccagauggcgaguauuggauugacccaaaucagggcugcagcggcgacucauuuaaaguauacugcaacuuuacaucugguggugaaacauguauuuacccggauaaaaaguccgagggaguucgcauuuccucuuggcccaaagaaaaaccugguucuugguuuucagaauuuaagcgcggcaagcucuuauccuaucucgacguggagggaaacucaauaaauaugguccagaugacuuuccucaaacuguugacagccuccgccaggcaaaacuuuaccuaccauugccaccagucugccgccugguacgacguauccagcggaucuuacgacaaagccuuacguuucuugggcucuaacgaugaagagaugagcuacgacaauaacccauucaucaaaacacuguaugacggaugcgcgagcagaaagggcuacgaaaagaccgucauugagaucaauacaccaaaaauugaccaaguaccaaucgucgacguaaugaucaacgacuuuggggaccagaaccaaaaguucggauucgaaguagggccuguauguuuccucggcuag

SEQ ID NO: 31876 - RNA, 5073 nt, Artificial Sequence
  Description of Artificial Sequence: Synthetic coding sequence
auggaaccauggucuagccgguggaagacaaaaagauggcugugggacuucacuguuacaacccucgcccuaacuuuuuuauuucaagcgagagagguaaggggcgccgcaccaguagacguucucaaggcucucgacuuucacaacaguccagaaggcaucucaaagacgacgggcuucuguacaaaccgaaaaaauagcaaaggcucagauacggcguaccgagucaguaagcaggcucaauugucagcucccaccaaacaguuauuucccgggggcacauuuccagaagauuuuagcauucucuucaccgucaagcccaagaagggaauccagaguuucuugcugagcauuuacaaugaacacgggauccaacagauaggggucgaagucgguaggucucccguuuuucuuuucgaggaucacacugguaaaccugcaccugaagacuauccauuauuucggaccguuaacaucgcugauggaaaauggcaccgcguagcaaucagcguugagaagaagacggucacaaugaucguugacugcaagaaaaaaacgacuaagccacuggacagaagcgagagggccaucguugauacaaacgguauuaccguuuucgggaccaggauacuagacgaagaggucuuugaaggcgacauacaacaguuucuuaucacuggugaccccaaggcagcauacgacuacugcgaacacuauagcccugacugcgauuccuccgcgccuaaagccgcccaggcccaggagccacagaucgaugaauaugccccagaggauauaauugaguacgacuaugaguauggcgaggccgaauauaaagaggccgaaagcgugacagaaggccccacaguaacagaagagacaaucgcccagacagaaaucaacggacacggcgcuuacggcgagaagggucagaaaggggaaccugcugucguggagcccgguauguuaguggaaggaccaccagguccugcaggcccugcaggcauaaugggacccccuggauuacaaggaccgacggguccacccggcgaccccggagauaggggaccuccuggaagaccugggcugcccggcgccgauggacuaccggguccaccaggcacaaugcuuaugcugccauuucgguacggcggggaugggagcaaaggaccaaccaucagcgcccaagaagcacaggcccaagcaauccuccagcaagcccggauugcccuaaggggaccacccggacccaugggacuuaccgggagaccaggccccgucggagguccuggcucuaguggcgcgaaaggugagaguggugaccccggcccgcaggggccucggggcguccagggcccuccaggacccacagggaagccgggaaagcgcggacggccuggcgcugauggcgggaggggcaugccuggcgagcccggagccaagggggauaggggauuugacgguuuaccaggacugccaggugacaagggacacaggggcgagcgggggccucagggcccacccggaccccccggggacgacggcaugcgaggcgaggacggagaaauaggaccuagaggauugccuggcgaagcaggaccuagaggacuccucgguccuagaggaaccccaggagccccaggccaacccgguauggcaggaguugauggcccuccugggccaaaggggaauaugggcccacagggggagcccggcccuccuggccagcaaggcaaccccgguccucagggucugcccggaccccagggucccauuggcccaccgggggagaaaggaccucaaggaaaaccuggguuggcgggcuugccuggugcugauggcccgccaggacaucccggaaaggagggucaaucuggggaaaaaggcgcucuggggccuccugggccacagggacccaucggcuaccccggccccaggggugucaagggagcggacggaguaaggggccuuaaaggcagcaagggugaaaaaggggaagauggauucccuggcuuuaaaggagauaugggacugaaaggggaccggggagaaguuggacagaucgggccaaggggagaagaugguccagaggguccgaaggguagagccggaccuacgggagacccuggcccuagcggucaggcgggggagaaggggaaauuagguguuccaggauugccuggguauccaggacggcaagguccgaaaggcaguaccggguuuccuggguucccuggagccaauggcgagaagggcgcuagagggguggcggggaagccugggccaagaggacagcgaggcccuacaggcccccgcggaaguagaggggcacgugguccaacgggaaaaccaggaccuaagggaacuaguggcggggacgggccaccaggaccaccaggggagagaggaccccaggguccacaagggccagucggcuuucccggcccuaaaggaccgcccggaccucccggcaaggauggccuaccuggucacccugggcagaggggggaaaccggguuucagggcaagaccggaccaccuggucccgguggcguugugggaccucagggaccaacgggggaaacugggccaaucggggagaggggccaccccggaccuccaggcccgccaggugaacaaggauuaccaggggcugcggggaaggaaggagcaaagggagauccagggccacaaggaaucaguggaaaggaugggccugccggacuucgaggauucccuggcgagagaggucugccuggggcucaaggcgcuccggguuugaaagguggagagggaccacagggucccccgggacccgucgggucuccuggugaaagggggagcgcuggaaccgcggguccaaucggcuugccuggucgaccuggcccucaaggaccuccuggcccugcgggcgaaaagggugcgcccggugagaagggaccacaggggccugcugggagagauggggugcagggccccguggggcuccccgguccugcugggccggccgggagucccggugaagauggcgauaaaggugaaauuggugaacccggacagaaaggaaguaaaggcgauaagggugaaaauggcccuccuggaccuccugggcugcagggaccagucggugcaccugggauugcagguggggauggcgagccugguccucgggggcagcaggguauguuuggccaaaagggagaugagggugccagaggauuccccggacccccuggacccauaggacuucaaggguuaccagggcccccuggagagaaaggagaaaauggcgacgugggcccgaugggcccgccgggucccccuggaccacggggcccccagggcccaaacggagcugaugggccacaaggcccccccgggucugugggaagcgucggaggugugggagaaaaaggagagccaggugaagccgggaacccagggccgcccggcgaagcuggugugggagggccgaagggcgagagaggcgagaagggagaagcaggacccccuggagcagccggacccccuggcgccaaggggccuccuggcgaugauggcccuaaaggaaaccccggcccagugggauucccaggagacccuggaccucccggagagccagggccggcuggucaggaugguguugggggagauaagggcgaagacggggauccaggacaacccggacccccuggccccucuggcgaggcagggcccccggguccacccggcaagcgaggcccgcccggugccgcaggagcagagggcagacagggagagaagggagcaaagggcgaagcgggggcggaaggcccaccaggaaagacuggaccaguggggccucagggaccagcuggaaaaccuggcccagaaggcuuaagggguauccccgggccggucggagaacaggggcuaccgggcgcagcuggacaagacgggccacccgggccuaugggcccuccaggucugccuggccucaagggagauccugggucuaaaggugaaaaagggcaucccggccucaucggucucauaggcccccccggggaacagggugaaaaaggcgaccggggucuuccuggaacacagggcaguccaggcgcaaagggggacggaggaaucccaggcccagcaggcccacuugguccuccagguccuccgggcuuaccgggcccccaggggcccaagggaaauaaaggcaguacgggccccgccggacagaagggcgauagcggguugccuggacccccuggcucuccaggacccccuggggaaguaauacagccacugccaauccucagcuccaaaaaaacuagaaggcacacagaagggaugcaggcagacgcagaugauaauauucuggauuacucugauggcauggaggaaaucuucggaucacuaaacucccuuaaacaggauaucgagcauaugaaauucccaaugggcacccagacaaacccugcucgcaccuguaaagacuugcaacucucucacccggacuuucccgauggcgaguacuggauagacccuaaucaaggauguucuggugacuccuucaagguuuacugcaauuuuaccucuggcggcgaaacauguaucuacccugacaagaagucugaggggguacggauuagcuccuggccaaaagagaagcccggcucuugguucagugaauucaaacgcggcaagcuccuuucuuacuuagaugucgagggcaauaguauuaauauggugcaaaugacuuucuugaagcuguuaacagccagcgcccgacagaacuuuacauaucacugucaccagagugccgccugguaugacguuagcuccggcagcuacgacaaggcgcuccgauuccucggcucgaaugacgaagagauguccuaugauaacaacccuuucaucaagacccuauacgauggcugugccucuaggaagggauacgagaagaccgugauugaaauaaacacgccaaagauagaccaagugcccauaguugacguaaugaucaacgacuuuggugaccagaaucagaaauuuggguucgaggucgguccaguaugcuuccucggauag

SEQ ID NO: 31877 - RNA, 1761 nt, Artificial Sequence
  Description of Artificial Sequence: Synthetic coding sequence
augggaguuaacgcaguucacugguucaggaagggucuucggcuccaugacaaucccgcacuuaaggaaugcauacagggugcugacaccauccgcugcgucuacaucuuggaccccugguuugcaggcagcaguaacgugggcauaaauagguggagguuucuccuucaguguuuggaggauuuggacgccaaucuuaggaagcugaauucuagacuguucguaauacggggucaaccagcagacguauucccccgauuauuuaaggaauggaacaucacaaaacuaaguauugaauacgacucagagcccuucggaaaggagcgcgacgccgccaucaaaaagcucgcuaccgaggcagguguggaaguaauugugcgaaucagccauacauuauacgacuuggauaagauuauagagcuuaacggaggccagccaccucuaacauauaagcgauuucagacacugauaagcaaaauggagccccucgagauuccggucgagaccauaacaagcgaaguaauagaaaaguguaccacuccccugucugaugaccacgacgaaaaguacggagugcccucccucgaggaacugggguuugacacugauggacuauccuccgccgucuggccgggaggcgaaacugaagcccugacuaggcuggaaagacacuuagaacgcaaggccuggguagcgaacuuugagagaccucggaugaacgccaauucacugcuggcauccccaacuggacugaguccguacuugcgguucggcugccucagcuguagacuguuuuauuucaagcucacugaucuguacaagaaagucaagaaaaacucuucccccccacuaagccuguauggacagcuacuguggcgcgaauuuuuuuacaccgcugccacuaacaacccucguuucgauaaaauggaagggaauccaauaugcgugcagaucccuugggauaaaaauccagaagcacuugcuaagugggccgagggucgaacaggguuuccguggauugacgcaauaaugacccagcugcgacaagaaggauggauacaccaccucgccaggcaugcaguugcauguuuuuugacaagaggcgacuuguggauaucuugggaggagggaaugaagguguuugaagaguuguuacuagaugccgauuggagcaucaacgccggauccuggauguggcugaguugcuccuccuucuuccaacaguuuuuccacuguuauugccccguuggcuuuggaagacgcaccgacccgaacggagacuacaucagacgcuauuuaccuguccuacggggcuuuccggccaaguauaucuaugauccauggaacgcaccugaaggaauucaaaaagucgcuaagugccuuaucggagugaacuacccuaaacccauggugaaucaugcagaagccucccgacucaacaucgagcggaugaaacagaucuaucagcagcugagucgguauaggggccuuggacugcucgcaaguguuccauccaauccaaauggaaacggcggcuuuaugggguacucagccgagaacauccccggaugcucaucaucaggaaguuguagccagggcaguggcauacuccauuaugcacacggagacagucagcagacccaccuucugaaacaagggcgaaguagcauggggaccggauuauccggugguaagaggcccucucaggaggaggacacccagucaaucgggccuaaagugcagcgccagucuaccaauuag

SEQ ID NO: 31878 - RNA, 504 nt, Artificial Sequence
  Description of Artificial Sequence: Synthetic coding sequence
auguugcccgagaaggccuuacauggacacccgcaacugccaagaacagugccuacacgagcugcuaugcgugccgcugggacacuacucgcauuuugcugcuugguucugucgacuaccggggguccuucacccgauacuuguucacaggaucugaauucacgaguaaaacccggauucccaaaaacuauuaagacuaacgauccuggcguccuacaagccgcccgauacucugucgaaaaauucaacaauugcacaaacgacauguuucucuuuaaggagagucgcaucacuagagcucucgugcagauugugaaggggcugaaguacaugcuggagguggaaauuggccggacaacaugcaagaagaaccaacauuuacgccuagacgacugugauuuucaaacuaaccacacccuuaaacagacguuguccugcuauucugagguauggguagugcccuggcugcaacauuucgagguaccuguguuacgcugucacuag

SEQ ID NO: 31879 - RNA, 438 nt, Artificial Sequence
  Description of Artificial Sequence: Synthetic coding sequence
augcgugccgcaggaaccuuacuagcuuucuguugccucgugcucaguacuacaggcggcccuucaccagacacuugcucccaagacuugaacagucgugucaaaccaggauucccuaagaccauuaagacaaacgacccuggcguguugcaggcagcccgguauaguguggagaaauucaauaauuguacaaaugauauguuccuuuucaaagaaucucggauaaccagagcccuagugcagauagugaaaggauuaaaguacauguuggagguagaaauaggaagaaccaccuguaaaaaaaaccagcaccuucggcuagaugauugugauuuucagacaaaccacacccugaagcagacgcuguccuguuauagcgagguuuggguuguucccuggcugcagcacuucgagguccccguccuaagaugccacuag

SEQ ID NO: 31880 - RNA, 513 nt, Artificial Sequence; identical to SEQ ID NO: 31699
  Description of Artificial Sequence: Synthetic coding sequence

SEQ ID NO: 31881 - RNA, 1053 nt, Artificial Sequence
  Description of Artificial Sequence: Synthetic coding sequence
augcagagauugggggccacccugcuaugucuccuguuggcugcugccguaccuacugcucccgcccccgcucccaccgcaacuucagcccccguuaaaccugggcccgcccugucuuauccccaagaggaggcaacucugaaugagauguuucgggaagucgaagaacucauggaagacacacagcacaagcuuagaucagcuguggaggaaauggaagccgaagaagccgccgcgaaggcuucaucugaagugaaucuugccaacuuaccuccguccuaucacaacgaaacaaacacagauacaaaaguggguaauaauacuauacacgugcaccgagaaauccacaaaaucacgaauaaccaaaccggccagaugguauucuccgaaacaguaaucacaucagugggugacgaggagggacgccgaagucacgaaugcauaaucgaugaggauuguggacccagcauguauugccaauuugcaaguuuucaguauaccugccagccaugcagagggcaaagaaugcucuguacuagggacucagagugcugcggagaucaacuuugcgugugggggcacuguacaaagauggcaacgcgcggaagcaacggaacgauuugcgacaaccaacgagauugccaacccggccuuuguugcgcauuucagcgaggcuugcucuucccggucuguaccccacuucccguggaaggggaguugugucaugaucccgccucccggcuuuuagaccugaucacaugggaacuggagccugacggggcccuggauagauguccaugcgcauccggcuuauugugucagccacauucucacagucuaguguacgugugcaaaccaacauuugugggaagccgcgaucaagauggcgagauccuucuuccaagagaaguccccgacgaguaugaaguaggaucauucauggaggaagugcgccaagaguuagaggaucucgagcggagcuugaccgaggagauggcacugagagagccagcagccgccgcagccgcccugcuuggaggagaggaaaucuag

SEQ ID NO: 31882 - RNA, 882 nt, Artificial Sequence
  Description of Artificial Sequence: Synthetic coding sequence
auggaggauacacaacauaaacucaggagcgcaguggaggagauggaagcugaagaagcagcugcgaaagccuccagugaagugaaccuggcuaauuugccuccaucauaucauaacgagacuaacacugauacuaagguugggaauaauacuauccauguacaucgagagauacauaaaauuacaaauaaucaaacaggacagauggucuucagcgaaacuguaauuacgagcgucggggacgaggagggucgccgaucacacgagugcauuauugaugaggacugcggcccgucuauguacugucaauucgcuuccuuccaauacacuugccagccuugucgcgggcagcggauguuaugcacaagagacucugaaugcuguggggaccaacucugcgucuggggccacugcacuaagauggccacaagaggaagcaauggaacgauaugugauaaccaaagggauugucagccaggucuguguugugccuuccagcggggacuccuguuuccggucuguacuccucuuccggucgaaggagagcucugccaugauccagccucucgacucuuagacuugauuaccugggaauuagaaccugacggagcccuggauaggugcccaugugcaagcggacuccuaugucaaccccauucacauucucuuguguacguaugcaagccuaccuuugucggaucccgggaccaggauggugaaauauugcuacccagggagguccccgacgaauaugaagugggaucauuuauggaagaggugcggcaagaacuagaggaucucgagcgaagcuugacugaagagauggcacuucgagaacccgccgcugccgcagcagcacuccuggggggugaggaaaucuag

SEQ ID NO: 31883 - RNA, 1053 nt, Artificial Sequence
  Description of Artificial Sequence: Synthetic coding sequence
augcaacggcugggggccacucuuuuaugucuacuucucgccgccgcaguccccaccgcccccgccccugcccccaccgcuaccagcgccccagugaaaccaggccccgcccuaagcuacccccaagaggaggcuacucuaaacgagauguuccgggagguggaagaacucauggaggauacacaacacaaacugagaagcgcugucgaagagauggaggcugaggaagcagcagccaaggcguccagcgaagugaaccuggcgaaucuaccucccuccuaucauaaugagaccaacaccgauaccaaaguggggaauaacaccauucauguucaucgagaaauucacaaaauuacuaacaaccaaaccgggcagaugguguuuagcgaaaccgucauuaccagcgucggagaugaggaaggcagacguucacacgaauguauuauugacgaagacugcggaccuucuauguauugccaauucgcaaguuuucaguacacgugccagccgugucggggacagaggaugcuguguacccgugauucugagugcuguggggaccaguuaugcguauggggucauugcacaaagauggcuaccagaggaagcaacgguaccauuugugacaaccagagggacugccagccaggccuguguugugccuuucagagaggacuucuguuucccguguguacaccccuaccuguggaaggagaauuaugccacgacccugcuagucgccuucuugacuugaucacgugggaauuagagccggauggagcccuggaucgaugcccuugugcuagugggcuccuaugucagccucauucgcacucgcuuguguauguguguaagcccaccuucguagggagccgggaccaggacggggaaaucuugcugccacgcgaaguccccgaugaguaugaagucggaucuuuuauggaggaaguaaggcaggaacuggaggaucuggaacgaucacuuacagaggaaauggcucuccgagaacccgcugccgccgcugcugcauuacugggaggagaagaaaucuag

SEQ ID NO: 31884 - RNA, 969 nt, Artificial Sequence
  Description of Artificial Sequence: Synthetic coding sequence
augcagcgucugggcgcuacacuccugugucuguuacucgccgcggcggugccgacagcaccagcgccugcaccuacugccacaucugccccugugaagccgggccccgcauugucauacccacaagaagaggcuacccuuaaugagauguucagagaggucgaagaacuaauggaagacacacaacacaaauuaagauccgcaguggaagagauggaggccgaagaggcagcugccaaagccagcagcgagguuaaucuagccaaucugcccccgucguaccauaacgagaccaacacugauaccaaaguaggaaacaauacaauucacguccaccgcgaaauccauaaggaaugcaucauugacgaagauugcggaccaucuauguauugccaguuugcuagcuuucaauauaccugucagccuugucgcgggcaacgcaugcugugcaccagagacucugaguguuguggagaucaauuguguguguggggucacugcacuaagauggcaacccgcgggucgaauggcacuauuugcgacaaccagagggacugccagccaggacugugcugcgcauuucaacgcggacuccuguucccaguauguacaccccuuccuguagaaggagaacugugucacgacccugcaucacgacugcuggaccugaucacuugggaguuggaaccagacggagcccuggaucggugcccgugcgccucuggacugcugugccaaccccauucacauucccucguguacguguguaaaccaaccuucguggguucacgugaucaagauggcgaaauacugcucccccgggaagucccugaugaauacgaagucgggaguuuuauggaggaagugcgucaggaacuggaggaucucgaacguagucuaaccgaggaaauggcauuacgugaaccagcugcugcugcagccgcauuauugggcggcgaagagaucuag

SEQ ID NO: 31885 - RNA, 708 nt, Artificial Sequence
  Description of Artificial Sequence: Synthetic coding sequence
augcagcggcuuggcgccacucuccuaugccugcugcuggccgcagcuguaccaaccgcucccgcucccgcuccaaccgccacaagcgcaccugugaaacccggaccggcccugucauauccacaagaagaggccacucugaacgagauguuccgcgaagucgaggaacugauggaagacacacaacauaagcuccgcucugcuguugaggaaauggaggcugaggaagccgcagcaaaagccucaucugaagugaaccuagcgaaucugccgccuucuuaccacaaugaaacgaacaccgauacgaagguggggaauaacaccauucacgugcaucgagaaauucauaaaauuaccaauaaccagacuggccaaaugguguucuccgagacuguuauuacauccguuggggaugaggagggcagaagaucccacgaguguaucauugaugaagacuguggcccaucuauguauugccaguucgcuucuuuccaauauaccugucagccauguagaggacagcggaugcucugcacgagggacuccgaguguuguggcgaucaacucugcgugugggggcacuguaccaagauggcaacccguggcaguaauggaacgauuugugauaaucagagagacugccagccagggcuaugcugcgcuuuccaacgaggcuuacuuuuucccguguguacaccacuccccuag

SEQ ID NO: 31886 - RNA, 972 nt, Artificial Sequence
  Description of Artificial Sequence: Synthetic coding sequence
auggaucccgguaaagacaaagaaggugucccucagccuagcggaccaccugcucgcaaaaaguucgucaucccucucgaugaagacgaagucccacccggcguugcaaaaccccucuucagauccacccagucacuaccuacaguggauacaucggcccaagcugcuccucaaaccuaugcugaguacgccaucagccagcccuuggaaggggcgggcgcuacuugcccaacuggcuccgagccucucgcaggcgaaacucccaaccaagccuuaaagccuggagcuaaauccaacuccauaaucguguccccucgccagcgugggaacccggugcuaaaguucguucguaacgucccuugggaguuuggcgacgucauuccggacuacguucucggccagucaacgugugcccuuuuccucucccucagguaucauaaccuacaucccgacuauauccauggcagacuacaauccuuaggaaaaaauuucgcccuucgcgugcuucugguccaaguugauguaaaagauccccagcaggcccuuaaggaacuugcaaagaugugcauccuggcugauugcaccuugauucuugccuggucuccugaggaagccggcagauaccuagagacuuauaaagcuuacgagcagaaacccgccgaucugcucauggagaaacuggaacaggauuucgugagccgcgugaccgaguguuugacaacugugaaaagcgucaacaagacugauagccagacacugcuuacuacauuuggauccuuagaacagcugaucgcagcgucuagagaagacuuggcacucuguccaggacucggcccacagaaagucagagcccucgguaagaacccccguuccuggggaaaggaacgagcgcccaacaagcauaacuugcggccucagucauucaagguaaaaaaagaacccaaaacucgucacuccggcuuuagacuuuag

SEQ ID NO: 31887 - RNA, 384 nt, Artificial Sequence; identical to SEQ ID NO: 31706
  Description of Artificial Sequence: Synthetic coding sequence

SEQ ID NO: 31888 - RNA, 846 nt, Artificial Sequence
  Description of Artificial Sequence: Synthetic coding sequence
augcagcaacccuuuaauuaccccuauccacaaaucuacugggucgauucuagcgcuaguuccccuugggccccacccggaaccguccucccuuguccuaccucugugccacgccggccuggacaacgucgaccccccccgcccccuccgcccccgccacugccuccuccaccgccgccucccccguuaccuccccugccucugccaccucugaagaaacgugggaaucacuccacuggccuuugccuccugguuauguuuuuuauggugcuagucgcccuuguggggcuagguuugggaauguuccagcuuuuccacuugcagaaagaguuagcagagcucagagaauccacaagccagaugcauacagcuucaucccuggagaagcagauagggcacccaucaccuccacccgaaaagaaggagcuuaggaaaguugcccaucugaccgguaagucaaauucccggagcaugccacucgagugggaggacacauacggaaucguguugcugucuggugucaaauacaagaagggcgggcuaguaauaaaugagacgggucuuuacuucguauauuccaaaguuuacuuccgaggccaaagcuguaauaaccuuccacugucucacaaaguuuauaugcgcaauucuaaauauccucaggaucuggugaugauggaggggaaaaugauguccuacugcacuacuggucaaaugugggcgcgauccucuuaccucggagcuguguucaaucugacuagcgcugaccaucuguauguuaacgucucugaacugucacuugugaauuuugaagagucucagaccuuuuuuggccucuauaaacuuuag

SEQ ID NO: 31889 - RNA, 585 nt, Artificial Sequence
  Description of Artificial Sequence: Synthetic coding sequence
augcacaaguggauccugacauggauucuacccacccuacuguaucgaaguugcuuucauauuauuugucucgucggcacaaucagccucgccuguaacgauaugacuccugagcagauggccacaaauguuaauuguagcucucccgaaagacacacgcgauccuacgacuacauggaggggggugauauucggguacgaagacucuuuugcagaacacagugguauuugcguaucgacaaacggggaaaggucaagggcacccaggaaaugaaaaauaauuacaauaucauggaaauucgaacaguggcagucggcauagucgcuauaaagggaguggaguccgaauucuauuuagccaugaacaaggagggcaaguuguaugccaaaaaggaguguaaugaagacuguaacuuuaaggagcuaauucucgaaaaccacuacaauaccuacgcuagcgcaaaauggacucauaauggaggggaaauguucguugccuuaaaucaaaaaggcauuccugucagggguaaaaaaacaaagaaggaacagaaaacugcucacuuccugccuauggcaauaacuuag

SEQ ID NO: 31890 - RNA, 585 nt, Artificial Sequence
  Description of Artificial Sequence: Synthetic coding sequence
augcauaaauggauauuaacuuggauucugccuacccuucuguauagaagcuguuuucacaucaucugccucguuggcacuauuucucuggcuuguaacgauaugacaccugaacaaauggcuaccaacguuaauugcaguucaccugaacgucacacacgauccuacgauuacauggagggcggagacaucagggugagacgucuguucuguagaacccagugguaccugagaauugacaagcgcgggaaagugaagggcacccaagaaaugaagaauaauuauaacauuauggagauuaggacugucgcugugggaauuguggcuaucaaagggguggagagcgaauuuuaucuggccaugaauaaagaaggcaaacuauacgcaaaaaaagaguguaaugaggauugcaauuuuaaggagcuuauucuggagaaucauuacaacaccuacgcuuccgcaaaauggacccacaacggaggggagauguucguugccuuaaaucagaaggguauaccuguucgggggaaaaagacgaagaaagagcagaagacagcucauuuccugccaauggcuauaacuuag

SEQ ID NO: 31891 - RNA, 7164 nt, Artificial Sequence
  Description of Artificial Sequence: Synthetic coding sequence
augcuaagagguccaggaccuggccuauugcuguuagcgguccaaugccuggggaccgcaguucccaguaccggcgcguccaaguccaagcgacaagcacagcagauggugcagccccaaucucccguugcagugucacagaguaagcccggaugcuaugauaacggcaaacacuaucagaucaaccagcagugggagcgcacauaccucgggaacgcauuaguaugcacuugcuauggaggcagucgcggguucaauugcgagucaaagccagaggcagaggagaccuguuuugauaaauacaccggaaacaccuauagagucggggauaccuacgagaggccgaaagauucuaugaucugggacuguacuugcauaggggcugggaggggucguaucucauguaccaucgccaauagaugccaugagggggggcagaguuacaaaaucggggacacuuggcggaggccacaugagaccggaggauacaugcuggagugcgucuguuugggaaaugguaaaggagaguggacuuguaaaccuaucgccgaaaaguguuuugaucaugccgcgggaacuucuuacgugguuggagagacaugggagaaaccauaccagggcuggaugaugguggacugcacuugucuaggagagggaucugggcggauuacuuguacaagcaggaaucgguguaaugaucaggauaccaggaccaguuaccggaucggggauacgugguccaagaaggauaacagaggaaaccucuuacaauguaucuguacagggaaugguaggggggaauggaaaugugagcggcauacuagcgugcagacgacuucaucuggcuccggacccuucacagacguucgagccgccgucuaccaaccacaaccgcacccucaaccaccccccuaugggcacugcgucaccgacagcggcgucguauacucagugggcaugcaaugguugaaaacgcagggcaacaaacagauguuauguacaugucuaggcaacggcgugucaugucaggagacagccgugacccaaacuuacggcgggaacagcaacggagagccaugcguccuucccuucacuuauaacggcaggacuuuuuacagcugcacuacagagggacggcaggauggccaccuuuggugcucgaccaccucuaacuacgagcaggaucagaaauauaguuucugcaccgaccauacagucuuagugcaaaccaggggggguaacagcaacggcgcacugugccacuuuccguuuuuauacaauaaucauaauuacacagauugcacuucggagggaaggcgcgacaauaugaaauggugcgguaccacacagaauuacgaugccgaccagaaauucggauuuugucccauggccgcgcacgaggagauauguacuacaaacgaaggaguaauguaucgcauaggagaucagugggauaagcagcacgacauggggcacaugaugagauguacauguguuggcaacggacgcggugaguggacauguaucgcuuauagccaacugagagaccaauguauuguggaugacauuacguacaauguaaacgauacuuuucauaaaagacacgaagaaggccacauguugaauuguacuuguuucggccagggccggggaagauggaagugugacccgguggaccaaugccaagacagugagacaggcaccuucuaccaaauuggugauagcugggagaaauauguccauggagugagauaucaguguuauuguuacgggaggggaauaggcgaguggcacugccagccacugcagacauacccuuccucaucaggaccaguggaaguauucauaaccgaaacaccaagccagcccaauagccauccaauucaguggaaugccccacagccaucacauauuuccaaguacauccugcgauggcggccuaaaaauagcgucggcagauggaaggaagcuacaaucccuggacauuugaauaguuauaccaucaaaggcuugaagccaggcgucguuuaugaaggacaacuuauaucuauccagcaguauggccaccaagaagucacccgguuugacuuuaccacuaccucuacaagcacaccggugaccagcaacacagugacaggcgaaaccacuccauucucaccucucguugcaacuuccgagagcguuacagaaaucacagcaucuuccuucgucguuucuuggguuuccgcuucagacacugucucaggcuuucgcgucgaguacgaacugagugaggagggagaugaaccccaguaucucgacuuaccauccacugcuacgucagucaacauccccgaucuccuacccggccguaaguauauuguuaacguguaucaaaucagcgaggauggcgaacagucucucauccucagcacuucccagacgacagcacccgaugccccaccggauaccaccguagaucagguagaugacacaucaaucguugugagguggucacgaccgcaagccccuauuacggguuacagaauuguguacucacccucuguagaagggucuagcaccgaacugaaccugccagaaaccgcaaacagcgugacucuuucggaucugcaaccuggagugcaguacaauaucaccauuuacgccguagaagagaaucaggaaucaaccccagucguaauucagcaagaaaccaccgguaccccgcgguccgacaccgugccaucaccacgagaccuucaguucgucgaaguuacagauguuaaggucacaaucauguggacaccaccagaaagcgccgucacaggauacagagucgacgucaucccaguuaauuuaccuggagaacacggucagcgacugccuauuagcaggaauaccuuugcugagguuaccggccuaagccccggcgugacuuauuacuucaaaguguuugcugucucccauggaagggaguccaagccauuaaccgcccagcagacgacuaaacuggacgccccgaccaaccuccaauucgucaaugagaccgauucuacaguacuggucagauggacacccccucgugcccagauuaccggauaucgccucacugucggccugacucggcgggggcagcccagacaguacaacgugggccccuccguaaguaaguacccucucaggaaccugcaaccugcauccgaguauaccgugucccugguggccauuaagggaaaucaggaguccccuaaagcuacaggcguuuucacaacacuacaaccugggucuuccaucccucccuauaacacagagguaaccgaaaccacaaucgugaucacuuggacgcccgccccccgcauugguuucaaguuaggagugagaccuagccaaggcggggaagcuccgcgagaaguuacuucugacagcgggucuauaguaguuucuggcuugacuccaggcguggaguauguuuauaccauucagguccugcgcgaugggcaagaacgagacgcuccaauagugaauaaaguugucaccccccugucuccccccacaaaucuucaucucgaggccaauccugacacagguguauugacggucagcugggaaaggucuacaacaccagacaucaccggcuauagaauuaccaccacccccacuaauggacagcagggcaauagcuuagaagaaguuguucaugcagaucagagcucuugcacauucgacaacuuaaguccaggccuggaauacaaugugucugucuauacggugaaggacgacaaagagagcguuccaauaucugacaccauuauccccgaagucccgcaacugacagaccuuaguuucguugacauuaccgacagcucuauuggacugcgcuggacuccccugaacucauccacaauuauugguuaucgaaucaccgucguggcugcuggagaagggauuccuauuuucgaggacuucguagauuccucugucggauacuauacaguuaccggcuuggagccuggaaucgacuacgauauuagugucauuacguuaaucaauggcggagaaagugccccuaccacgcucacucaacagaccgccguacccccacccaccgauuuacguuucuucucagacaucacagcaaauucuuuuacaguucacuggaucgcacccagagcgaccauuacuggcuaucgaauuaggcaccaucccgaacauuuuucaggacgcccucgagaagaccgcguuccccauagucgaaacagcaucacgcucacaaaucugacucccggcacugaauauguggucagcauaguggcccucaauggcagggaagaauccccacuucuaauuggucaacaaucuacggucucagacguuccacgagaucucgaggucguggcugcgaccccaaccagccuucucaucucuugggaugccccggccgugacuguccgauacuacagaauuacuuacggagaaaccggaggcaauuccccuguucaagaguucaccguacccggaagcaaaucuacagcaacuauuagcggccugaaacccggcgucgauuacacuaucacagucuacgcaguuacaggacggggggacagcccggcaucuucaaaacccauuagcaucaacuauagaaccgaaauugacaaaccaucccagaugcaaguuacagacguucaagauaauucaaucagcguuaaauggcugccaucauccagcccagucacaggcuacagagugacuacaacucccaaaaauggacccgguccgaccaaaacgaaaacugccggcccagaccagacugagaugaccauugaaggccuacaaccaacagucgaauacgucgucagcguguaugcucagaauccgucaggagagucgcaaccccuugugcagacagcaguuaccaacauugauaggcccaaaggcuuagccuuuaccgacguggacguagacucgaucaagaucgccugggaaucaccucagggacaaguuucucgguaccgugucaccuauaguucaccggaagauggcauccaugagcuguucccagccccugacggagaggaggacacagcagaauuacagggauugcggccuggaagcgaguauacaguguccguuguugcacuucacgaugauauggagucucaaccccucauugguacucaguccaccgccauacccgccccgaccgaucuuaaauuuacacaggucacaccgaccucacuguccgcucaauggaccccuccaaauguccagcugaccggguacaggguacgaguuacgccuaaagaaaagacagggccuaugaaggaaaucaaucuggcuccagacucaagcaguguuguagucaguggacuaaugguagcuaccaaguacgaagucuccguuuacgcuuugaaagacacgcucaccucacgaccggcccagggggucguaacgacucuugagaauguuaguccacccaggagagcucgggugacagaugcuacagagacuacgaucacaauaucuuggagaacaaaaacagaaaccauuaccggcuuucaggucgaugcuguuccagccaacgggcagacuccuauucaacgcacuaucaagcccgauguacgcagcuauacaauuacaggacuucagccagguaccgacuacaagauauaucuguauacacugaacgauaacgcacgcagcuccccuguugugauagacgcuagcaccgcaaucgacgcccccagcaaccugagauuccucgccacuacgcccaacagccuauuaguuagcuggcaaccaccucgagcuagaauuacggguuacauaaucaaauacgagaagccagguucuccaccucgcgaaguugucccccgaccuagaccuggagugacagaagcuaccauaacuggccuggagcccggcaccgaguauacaauuuacgugauugcccugaagaacaaucaaaaauccgaacccuugaucgguagaaagaagaccgaugaacuuccgcagcuagugacucucccacaccccaauuugcaugggcccgagauucuggacguucccucuacaguucaaaagacaccguucguuacucaucccgguuacgacaccggaaauggaauccaguuacccggcaccucuggccaacaacccagcguaggacagcagaugaucuuugaagagcacggcuuucgaagaaccacaccuccuaccaccgccacaccuauacgacauagacccaggcccuaccccccuaacgugggugaagagauucaaauuggccacauccccagagaagacguggauuaucaccucuauccacauggaccaggcuugaaccccaacgccagcaccgggcaggaagcccucagccaaacaaccaucucaugggcccccuuccaggauacgucagaauacauaaucucaugccacccuguugguacugacgaagagccccugcaauuccgcgugccaggcacuuccacuagugccacgcugacuggacucaccaggggggcgaccuauaacguuaucgucgaagcacucaaagaucagcagagacacaaagugagggaagaaguagucacagugggaaauuccguuaacgaaggacugaaucagccuacagacgacucaugcuucgauccauacacugugagccauuacgcagugggagacgaaugggaaagaauguccgagagcggcuuuaagcuucugugucagugccucgguuuugguuccggucauuucagaugcgauagcaguagauggugccacgacaaugggguuaacuacaaaaucggagaaaaaugggacagacagggagagaacggccagaugaugucauguacaugccucgggaaugguaagggcgaauucaaaugcgauccucaugaggccacaugcuaugacgacgguaaaacuuaccaugugggcgaacaguggcagaaggaguauuuaggagcaauaugcucuugcacuuguuucggcggucaacgagguuggagaugugacaacugcaggcguccuggcggugaaccuagccccgagggcacuaccggccaaagcuacaaucaguacucacagagguaccaucagagaacuaacaccaauguaaauuguccgauugaguguuuuaugccccuugacgugcaggcagauagagaagacucaagagaguag

SEQ ID NO: 31892 - RNA, 7341 nt, Artificial Sequence
  Description of Artificial Sequence: Synthetic coding sequence
augcugagaggacccgggccgggucuccuacuccucgccguccagugucugggcacugccguaccuagcacuggugccucaaaaucuaaacgccaggcgcagcaaaugguacaaccacagagucccguggcagugucucaaaguaaaccagguuguuacgauaaugggaaacacuaccaaauaaaucagcagugggagcgaaccuacuugggaaaugcuuuaguuugcacguguuacggcggaagcagaggguuuaauugugagagcaaacccgaagcggaagaaacaugcuuugauaaguacaccgggaauacuuauagagucggcgauaccuaugagagaccuaaggacaguaugaucugggauugcacauguauuggugccggaagaggccggauaagcuguacaauugcuaacaggugucacgaagguggacagaguuauaaaaucggcgauacauggcgcagaccacaugaaacaggggguuacaugcucgaaugugugugcuuagggaacgggaagggggaauggacauguaaacccauagcagagaaauguuucgaccacgccgccgggaccucauaugucgugggggaaacuugggagaagccguaccaaggauggaugaugguggacuguacuuguuuaggagaagguuccggacgaaucacuugcacaucucggaauagauguaaugaucaagauacuagaaccucuuauagaaucggggacacguggaguaagaaggauaaccgcggcaaccuccugcagugcaucugcacagguaauggucgcggagaguggaaaugugaacgccauaccucugugcagacaacuucgagugggagcggaccuuuuacugaugucagggcugcuguguaccagccccagccacacccccaaccuccacccuaugggcauugcguuaccgauuccggagugguuuauagcgucggaaugcaauggcugaaaacacaggguaauaagcagaugcucugcacuuguuugggaaauggggugagcugucaggaaaccgcuguaacacagacguacggggggaauucaaacggcgaaccauguguguuaccguucacguacaauggaaggacauucuacucgugcacuacagaagggcggcaggaugggcaccuuugguguuccacgacuagcaauuaugaacaggaccagaaguacagcuuuugcacugaucacaccguacucgugcagacucgaggaggaaauucgaauggagcucucugccacuuuccauuucuguauaauaaccauaauuacaccgauuguacgagcgaaggccgcagagauaauaugaaauggugcgguacuacacagaauuacgacgccgaccaaaaauucgguuucugccccauggcagcccaugaagagauauguaccacgaacgagggcgucauguacagaauuggugaccaaugggacaagcaacaugacaugggccacaugaugcgcuguacuugcgugggaaacgguaggggugaauggacuuguauagcuuacucacaacugagagaccaguguauagucgacgacauuacauacaacgugaacgacacuuuccacaaacgccacgaggaggggcauaugcugaacuguacuugcuuuggacagggccgcggacguuggaaaugcgacccagucgaucagugccaagacagcgaaacgggaaccuucuaccagaucggggacucaugggagaaguauguucauggagugcguuaucaguguuacuguuauggccgggggaucggugaguggcacugccaaccuuuacagacuuacccuaguuccagcggaccugucgaaguauucauaacagagacuccgucccagcccaauucccaccccauacaguggaacgcuccccagccgucacacaucuccaaauacauccuuagauggaggcccaaaaauagcguugguagauggaaagaagcaaccaucccuggccaucuuaauaguuauacgaucaagggcuuaaagccuggagucguuuacgaaggucagcuaauuagcauccaacaguauggucaucaggagguuaccagauuugauuuuacaacuacgucuacuuccaccccugucacgaguaacacugucacuggcgaaacuaccccuuuuaguccacucguagcaacauccgagucugugaccgagaucaccgccaguuccuuugugguuagcuggguguccgcguccgauacagugucuggauuccgaguggaguacgagcucuccgaggagggagaugaaccacaguaucucgaucugccuagcaccgccacuucuguuaauauccccgaucugcuuccaggacgaaaguauauugucaaugucuaccaaaucuccgaggauggcgagcagucccuuauucuguccacuucccagaccacagcccccgaugcuccucccgacaccacaguugaucaaguugaugauacgagcauuguugugagaugguccagaccucaagcgcccauuacgggguaucgcauuguuuauagcccaucugucgaagguuccagcacagaacuuaaccugccagagaccgccaauucaguuacucuuagugaucugcagccaggcguucaguacaacauuacaaucuaugccguggaggagaaucaggagucgaccccugucguaauacagcaggaaaccacaggcacaccccgaucagauacaguaccuucuccucgugauuuacaguuuguggaagugacggacguaaaggucacaaucauguggaccccaccagagagugcagucacaggcuauagaguggaugucaucccgguaaacuuaccaggcgagcacggucagcgccuccccauuucuagaaauacguucgcggaggugacaggucuguccccagggguaacauacuauuucaagguauuugccgugagccauggacgagaaagcaaaccccuuaccgcccagcagacgaccaagcuggacgcccccacuaaucuccaguuuguuaacgagacagacucaaccguacugguaagguggacacccccacgagcccagauuacaggcuauagacucacuguugguuugacuagaagaggacagccacggcaauacaacgugggacccucugucuccaaauauccgcuucgaaauuuacagcccgcauccgaguacaccgugagccucguggcaauaaagggcaaucaggagucgccaaaagcaacgggaguauuuaccacccuccaaccaggcaguuccauccccccauacaacacugaagucaccgagacaacuauagucaucaccuggacaccagcgccgcgaauaggcuucaaauugggaguucguccuucucaaggcggugaagcuccuagggagguaacaucugacucuggauccauagucguuuccggacucacaccuggaguggaauauguguauacaauccagguacuaagggacggccaagagcgcgacgccccaaucguuaacaaagugguuaccccacuauccccucccaccaauuugcaucucgaggcaaauccagacaccggcguccugaccguuagcugggaaagaagcacaacucccgauaucacuggcuacagaaucacgaccacccccaccaauggacaacagggcaauucauuggaagaagugguucacgccgaccagaguaguugcacuuucgauaauuuguccccaggacuggaauacaauguaucaguguauaccgugaaggacgacaaggagagcguuccaaucucagacacaaucauaccagaggugccgcaacuuacagaccugucauucguugauaucacagacucuagcaucggacugagauggacacccuugaacucaucuacaauuauuggcuacaggauuaccguuguggcugcuggagaagggauccccaucuucgaagauuucguagacucuuccguugguuacuacacaguuacaggacuggaaccaggcauagacuaugacaucucaguuaucacacuuauaaaugguggagaguccgcaccuacuacccugacucagcagaccgccguuccuccccccaccgaccuucguuucaccaacaucggccccgacacgaugcgcguuaccugggcuccuccaccaucaauugaccugacaaauuuucuaguaagauacucuccggugaagaaugaagaagauguugcagaacucuccauaucccccucggacaaugccguuguacugacaaaucuccugccuggaacggaguaugucgugucggugucaaguguguaugaacagcacgaaagcacgccccucagaggaagacagaagaccggauuagacucaccaacuggaauagauuuuagcgauaucaccgcaaacagcuucacugugcacuggauugcgcccagggccaccaucacuggauaccggaucagacaccacccggagcacuucucuggucgcccgagagaagaccguguaccccauucucggaauucaaucacccuuacuaaucuaacacccgguaccgaauaugucgucaguauugucgcacugaacgggcgugaggagaguccucugcugauagggcaacagagcaccguuagcgauguccccagggacuuagaaguuguugcugccacaccuacaucuuugcucauuucuugggaugcuccugccgugacaguucgcuauuacagaaucacauauggagagacaggaggaaacucaccaguacaggaauuuacagugccugguucuaaaaguaccgccacgaucucuggacugaagccaggaguggacuacacaaucacagucuacgcagucaccggcaggggugauucuccagcaaguuccaagccuaucagcaucaacuauagaacagagaucgacaagcccagccaaaugcaggucacugacguacaagacaacagcaucaguguaaaaugguuaccgucaucuaguccagucaccggcuacagggucacaacuacaccuaaaaacggccccggcccuacgaagacuaagacugcaggcccagaccagacagagaugaccauugagggacugcaaccuacgguugaauaugugguuagcguauaugcccagaacccuuccggcgaaucucaaccuuuaguccaaaccgcagugaccaacaucgacagacccaaaggccuggcguucacugacgucgauguagauuccauaaaaauugcgugggaauccccacaaggccaagucuccagauacagaguaacauacucuagucccgaagacgggauucaugaacuuuucccggcccccgacggcgaagaggacacugcagagcuccagggguuaagacccgguagcgaauacaccgugucuguagucgcacugcacgacgauauggagagucaaccacuuauaggaacccaaucaacagcaauacccgcacccacagaccuuaaauuuacacaagugacaccaaccucuuugagcgcccaauggaccccccccaauguucaguugacaggcuaucgugucagggucacacccaaggagaagacaggaccgaugaaagagauuaaccuggcuccagacuccucgucugugguuguaaguggccugaugguggcaaccaaguacgaggucucuguguaugcacugaaagacacccuaacaucucggccagcccaagguguuguuaccacucuggagaacguaucaccaccuagaagagcaagagugacagaugcaacugaaaccaccaucacaauaucuuggagaaccaaaaccgaaacuauuacaggguuccagguggaugccguaccagcuaacggccagaccccaauucagcgaaccaucaaacccgauguaagaucguacaccauuacuggccugcagccagggacagacuauaagaucuacuuguacacuuuaaaugauaaugcccgguccucaccugugguaauagaugcaagcaccgcuaucgaugcaccaucaaaucugagauuccuggcuaccaccccuaacagccugcuaguuuccuggcagccaccacgcgcucgaaucacaggguacauaauaaaguaugaaaaaccgggaucaccucccagagagguugugccccgaccccggcccggcgugacagaagcgacaauuacuggccuggaacccgguaccgaauacacaauuuacgucauagcacucaagaauaaucagaaguccgaaccccuuauaggacgaaaaaagacugacgaguugccacaguugguuacccucccucacccgaaccuccauggcccugaaauuuuggacguucccagcacaguacagaaaacgccauuuguuacccacccuggcuacgauacagguaauggcauucaguuacccggcacguccggccagcagccaagcgucggccaacaaaugaucuucgaggagcauggguucagacgaacuacgccccccacuaccgcuaccccuauccgccauagaccucgcccuuaccccccuaacguuggucaagaggcucucucucagaccacaauuucgugggcuccguuucaggauacauccgaauauauuaucucuugccacccggucggaacagaugaagagccacuccaauucagagugcccggaacaagcaccucagcaaccuuaacaggacucacgagaggugcaacuuacaacgugaucguugaggcucugaaggaucagcagagacauaaagugagggaagaggucguuacgguggggaacaguguuaaugaggggcucaaccagccuaccgacgauuccuguuuugacccauauaccguuagccauuacgcagucggggacgaaugggagaggauguccgagucuggauuuaaguuacuaugccagugucuggguuucggaucaggccauuuccgaugugacagcucaagauggugccaugacaacggggugaauuauaaaaucggcgagaagugggaccggcagggagagaauggacagaugaugaguuguacaugccugggaaacgguaagggggaauuuaagugcgauccccacgaagcgacaugcuacgaugacggcaaaacauaucaugugggggagcaauggcaaaaggaguacuuaggcgcuauuugcaguuguacaugcuucggaggucagcggggguggagaugcgauaacugucguagacccgggggagaaccuucucccgaaggcaccacaggacaguccuacaaucaauacagucaacgcuaccaucaaagaacuaacaccaacguuaauugcccuauagaauguuucaugccccuggacgugcaggccgaccgcgaggacagucgcgaauag

SEQ ID NO: 31893 - RNA, 7068 nt, Artificial Sequence
  Description of Artificial Sequence: Synthetic coding sequence
augcugcgaggacccgggccgggccuguuacuccucgcugugcaaugucugggaacugcagugcccuccacaggcgcuucuaaaaguaaaaggcaagcucagcagaugguccagccacagucaccuguagccguuucacagaguaagccuggauguuacgauaacgggaagcacuaucagaucaaucaacagugggagaggacauacuuggggaacgcacuugucuguacauguuauggcgggucccggggauuuaauugugagaguaaacccgaagccgaggaaacguguuuugauaaguauacaggaaauacauauaggguuggagauacguacgaaaggccaaaggauagcaugauuugggacuguacaugcauuggagcuggacgagggcgaaucucaugcacuauagcaaacagaugucacgagggagggcagucuuauaaaauaggugacacauggagaaggccacacgagacgggcggauauaugcuugaaugugugugccugggcaacgguaagggcgaguggacuugcaaaccuauugccgaaaaguguuucgaucacgcagcagguaccagcuacgucgugggagagacuugggaaaaacccuaccaaggauggaugaugguagacuguacgugccugggagagggcucuggccguaucacauguaccagccgaaauagauguaaugaccaggacacucgaacuuccuaccgcaucggcgauacuuggucuaagaaagacaaucgggggaaucuguuacaguguaucuguaccggaaaugggcggggggaauggaaaugugaaagacauacaagcgugcagacaacguccucaggaucugggccuuuuaccgacguucgcgcagccguguaccaaccucaaccucauccucagcccccacccuaugggcauuguguaacagacagcggaguugucuauucaguaggaaugcaguggcuaaaaacgcagggaaacaagcagaugcuuugcacuugucucggaaacggaguguccugucaggagacagccgugacccaaacguauggagggaauagcaauggcgagccuuguguuuuaccuuucacuuauaauggacggacuuucuacucauguacaaccgagggcaggcaggacggacaccucuggugcaguacgaccuccaauuacgaacaggaucagaaguauaguuuuuguacagaucacacaguacucgugcagacacggggcggaaauucuaacggcgcauugugucacuucccuuuucuuuauaauaaucacaacuauacagauugcacauccgagggccgacgugauaauaugaagugguguggcacaacucaaaauuaugacgcugaccagaaguucgguuuuugcccaauggcagcacacgaagagauauguacuacgaaugaggggguuauguaccggauuggggaccagugggauaaacagcaugacaugggccacaugaugagaugcaccugcgugggaaacggacguggcgaguggacauguauagcauauagccaguuaagggaucaguguauuguggacgacauaaccuauaacguaaacgacacauuccacaagcgacaugaggaaggccauaugcugaauuguacguguuuugggcaggggaggggccgguggaaaugugauccugucgaccaaugucaagacagcgaaacuggcacguuuuaucagaucggcgauaguugggagaaauacguucacgggguuagauaucaaugcuacugcuauggcagaggcaucggagaguggcacugucagccccuucagacuuauccaagcagcuccggaccgguggaaguuuucauuacagagacccccucgcagccuaacucgcacccaauucaguggaacgcgccucagcccucccacaucagcaaguauauccugcgcuggcgaccuaagaacucaguagggagguggaaagaagcuaccauaccaggacaccucaauaguuauacaaucaaaggacucaaaccuggagucgucuaugaaggccaguugauuucaauccagcaguacggacaccaggagguaacuagauuugauuuuaccaccacuagcacgaguacccccgugaccuccaacacagucacaggugagacaaccccuuuuucuccauugguggccaccucagaaaguguuacugagaucacugcaucuagcuuuguggucagcugggucagcgcgucugacaccgugucaggauuccguguggaauacgaacuaagcgaggaaggagaugaaccccaguaccuggaccuccccucuacagcgacaucagucaauauucccgaucuguuaccugggcguaaguacauugucaacgucuaccaaauuucagaagauggcgaacagagccugaucuugucaaccucccagaccacagcuccagacgcuccgcccgacacaaccguggaucaaguugacgauaccaguaucguaguuagauggagccgaccucaggcgccaauuaccggauauaggauaguguauucuccuuccguugaaggaucuuccacagaacugaaucugccagagaccgcuaacucagugacccugucugaccuucagccaggaguccaauauaacaucacaauuuacgcagucgaagaaaaccaagagucuaccccuguggugauacagcaggaaacaaccgguacaccccguagugacacagugccaagccccagagaccuacaauucguggaggucacugacguuaaggugacuauuauguggacaccacccgaaucggccgugaccggcuaccguguugauguaaucccagugaaucuucccggugaacacggacagagacuuccuaucucaaggaacacauuugccgaggugaccggauuaagccccggggucaccuauuauuucaagguguuugcaguuagccauggaagagaaucaaagccccugacagcucagcagaccacuaagcuugaugccccaaccaauuugcaguuugugaaugaaacugauagcaccguucuuguucgauggacucccccuagagcacagauuacaggguauaggcucaccguuggauuaacacggagaggccagccccgucaguauaacguuggcccgucugucucuaaguacccucugcgcaacuuacagcccgcaucugaauacacugugucucucguggcuauuaagggcaaccaagaaagccccaaggcaacaggcguuuucacaacccugcaaccagguaguagcauuccucccuacaauaccgaaguaacggagaccaccaucgugaucaccuggacaccugcuccccggauaggcuucaaacucggcgucagaccaucacaagggggugaagcaccaagggaaguaacgagcgacucugguucuaucguagucucuggccucacaccuggcguggaauacguauacaccauccagguccuacgggauggacaagagcgcgacgccccuauuguuaacaaaguggucacuccauugucuccuccaacaaaccugcaccucgaggcuaauccagauacagggguacucaccgugagcugggaacgcaguaccacacccgauaucacugguuaccggaucacaacaacgccuacgaauggacagcagggcaauagccuugaggaagucgugcacgccgaccaaagcagcugcacuuucgauaaucugucuccaggccucgaauacaacgucucugucuauacuguuaaagaugauaaagagagugugccaauauccgauaccaucauaccugccgugccaccacccacagaccuucguuucacaaauauugggccugacaccaugcgagucaccugggccccacccccaaguauagaucuuacaaacuuucuaguacguuauuccccagugaaaaaugaagaggaugucgccgaacuguccauaucuccaucugacaaugcagugguucugaccaaucuguugccagguacagaauacguggucagcgugagcagugucuacgagcagcacgaauccacuccacugagaggcaggcagaagacuggacuggacucaccgaccgggauugacuuuuccgacauaacagccaacucauuuaccgugcauuggauugcaccgagagccaccauuaccggcuauagaauucgccaccacccugaacacuuuuccggccggccacgcgaagaccgagucccucauucacgaaacuccaucaccuuaacaaaccuuacccccggaaccgaguacguugucuccaucguugcgcugaauggaagggaagagucuccccuucugauaggccagcagucuacaguuucugacguuccccgugaccuggaagugguggccgcuacacccacaagccuguugauaucgugggaugccccagcagucacgguuagauacuaccgcauuacauacggcgagaccggcgggaauaguccaguccaagaguuuaccgucccaggcucgaaaagcacugccaccaucuccggacuaaagccagguguugacuauacuauuacgguguacgcggugacaggccggggcgacuccccagcaagcucaaagcccaucagcaucaauuauaggacagagauugacaaaccuucccagaugcaaguuacagauguccaggauaauagcauaucugucaaguggcucccuuccaguucucccgucacuggcuacagagucaccacuacgccaaagaauggucccggccccacaaaaaccaagacagcaggaccagaccagaccgaaaugaccaucgaagggcuccagcccaccguggaguauguaguuuccguguacgcccaaaauccaucaggcgagucccagccacuuguucagacagccguuacuaauauugacagaccuaagggcuuggcauuuacugauguugacgucgauucuauuaagaucgcuugggaaucuccacagggucagguaucaagauacagagucaccuauagcagucccgaggauggaauucaugaacuuuuccccgcccccgacggggaggaagacacagccgaacuacagggccucaggccgggaagcgaauacacuguuuccguggucgcuuugcacgacgauauggaaagccagccccucaucggaacacaaagcacagccauuccagcucccaccgaucucaaguuuacacaggugacuccaaccucucuuagcgcucaauggacaccucccaacguccaguugaccggguacagggucagagugaccccaaaagaaaagaccggccccaugaaagaaaucaaucuggcucccgauucaaguaguguaguggucucuggucucaugguagcgaccaaguacgaagucuccguuuacgcccuuaaggauacacucacaagccgaccagcccagggagucguuacaacccucgaaaacguuucuccaccccgacgugcaagagugacagacgccaccgagacaaccauuacaauauccuggcgcacgaagacagagacuaucacaggcuuucagguugacgcuguccccgccaacgggcaaacgccgauucagagaacuaucaagccugauguaagaucauauacaaucacaggacuucagcccggcaccgacuacaaaaucuaccucuacacgcucaaugauaaugcuagauccucuccagucguaauagaugccucaaccgccaucgacgccccuuccaacuuacgguuccuggcuacaacuccaaauagccugcuggucucuuggcagccaccacgcgcuagaauuacagguuacauuaucaaauacgaaaagccuggaaguccacccagagaaguugucccaagaccucggccuggcgugacugaagcuacaauaacuggacuggaacccggcaccgaguauaccauauauguaauugcccugaaaaacaaucaaaaaagcgagccccugauuggacgcaagaagaccgacgagcucccucagcuggugacccugccucaccccaaccugcacggaccagaaauucuagaugugccuucaaccguccagaagacuccuuuugucacccacccaggcuaugauacaggaaacgguauccagcucccaggcacaaguggccagcagccauccguaggacagcaaaugauuuuugaggagcacggcuuucgaagaacuacgccccccaccaccgccaccccuauuaggcaccgcccuagaccuuaucccccuaacgucggacaggaagcguugucucagacuacaaucucuugggccccguuucaagauaccagugaguauauuauuuccugccaucccguuggaaccgaugaggagccacuucaguuuaggguaccagguacaucgacuuccgccacuuuaacaggguuaacucgcggugccaccuacaauguaaucguugaggcacuuaaggaucagcagcggcacaaggucagagaggaaguggugacuguugggaacagugugaacgaaggauuaaaucaaccaacugacgauagcuguuucgacccauacacaguaagucacuacgccgucggugaugagugggagagaaugucagagucugguuuuaagcugcugugccaaugucuuggauucggauccggucacuuucggugcgacuccagcagauggugucaugacaacggggugaauuauaagauaggggaaaagugggauagacagggagagaacggccagaugaugagcuguaccugucucggaaauggcaaaggcgaguuuaagugcgacccacacgaggccacuugcuacgaugacggcaaaacguaucacguuggagagcaauggcagaaggaauauuugggugcaauauguagcuguacauguuucggagggcaaagaggauggagaugugacaacugucgcagacccgggggcgagccaucuccugaaggcacaacuggccagaguuacaaucaauauucgcagcgcuaucaucaaagaacaaauaccaauguuaacugucccauugaaugcuucaugccacuugacgugcaggccgacagggaagauucaagggaguag

SEQ ID NO: 31894 - RNA, 6555 nt, Artificial Sequence
  Description of Artificial Sequence: Synthetic coding sequence
auguugagggggccuggccccggucucuuguugcuugccguucaguguuuagggacugccgugccaaguaccggagcauccaagucuaaacgucaggcccagcagauggugcaaccccaaucaccagucgcgguaucucaaaguaagcccggcugcuacgacaacggaaagcauuaucagauuaaccagcaaugggaaagaacuuaccuuggcaaugcauuagugugcaccugcuauggaggguccagaggauuuaacugugagagcaagccagaagcugaagaaaccugcuucgacaaguauacuggaaacaccuaucgggugggcgacacauaugagcgcccaaaagauucuaugauaugggauuguaccuguauuggagccggaagaggccggaucaguugcacgauagccaaucguugucaugaaggcggacagucauauaagauuggugauacuuggagaagaccucacgagaccgguggcuauaugcuggaaugugucugucuggguaauggaaagggagaguggacuuguaaaccuauagcugagaaaugcuucgaccacgcugcaggaaccaguuacguugugggcgagaccugggagaagccguaucaaggguggaugaugguagacuguacaugccuaggggaaggcucaggaagaauaacaugcacaagcaggaaucggugcaaugaccaggauacucgaaccucauacagaauaggcgacacguggaguaaaaaagauaauagagguaaucuacugcaauguaucuguacugguaauggucgcggagaauggaaaugcgaaagacauaccucagugcagaccaccucaaguggaagcggcccuuucaccgacgugcgcgcugcaguguaccagccacagccccauccucagccccccccuuauggacacugcgugaccgauuccggcguggucuauucaguagguaugcaguggcugaaaacccagggcaauaagcagaugcuguguacaugccuugggaauggcguuucaugucaggagacugccgugacucaaacuuauggcgguaacucuaauggcgaaccgugcgugcucccuuucacuuacaaugggagaaccuucuauucuuguaccacugaaggacgucaagaugggcaccucuggugcaguacuacuagcaauuaugaacaggaucaaaaauacaguuucugcacagaccacacggugcucguacaaacgcggggagguaacagcaauggugcacuaugucauuuucccuuccucuacaacaaccacaauuacacugacuguaccuccgaaggaagacgggacaauaugaaauggugcgggacgacacagaauuacgacgcagaccagaaguuuggauucuguccaauggcagcucaugaagaaauaugcacaacaaacgaggguguuauguacagaaucggagaucagugggacaaacaacaugauaugggccacaugaugagauguaccugugugggaaaugggaggggugaauggacauguauugccuacagccaguugagagaccaguguaucguggacgacauuacguauaaugugaaugacaccuuccacaaacggcacgaagaagggcauaugcuaaauuguaccuguuucggccagggaagagggagguggaaaugcgauccuguagaccagugccaggauagcgagacagggacauucuaucagauuggggacuccugggaaaaauacguucaugggguuagguaucaauguuacuguuauggaagaggaaucggggaauggcacugucagccucugcagaccuacccuuccuccucugggccagucgaggucuucaucacagagacaccaagccagccuaacagccaccccauccaauggaaugccccacaacccagucauauuucaaaauacauccugagauggcguccgaagaauagugucgguagauggaaagaggcuacaauaccugggcaccugaauagcuacacaauuaaaggucuaaaacccgggguuguuuaugaaggccaacucaucaguauucagcaguacggucaccaggaaguaacuagauuugacuuuacuacaacuucaaccaguaccccaguaaccaguaauacgguaacaggcgagaccacuccuuucagcccucuuguggccaccagcgagucaguuacugagaucacugccucuagcuucguggugucuuggguuucagcauccgacacagugucuggauuuagagucgaauaugagcugagcgaagaaggcgacgagccacaguaccuggaccucccuucaaccgccaccucugugaauauuccugaucuucuuccuggucguaaauacauugugaacgucuaccagauaagcgaggacggcgaacagucccucauucuuuccacuucacagaccaccgcuccugaugcaccacccgacacuaccguugaccagguugaugacacuuccauaguuguccgauggucacgcccucaggcaccuaucaccggguaccgcauaguguauagccccucuguugaaggaaguuccacugaacugaaucugccagagacagccaacuccgugacucucuccgaucugcagccgggcgugcaauauaacaucaccaucuacgcaguugaggaaaaccaggaaucuacucccguugugauucaacaggagacaacuggcacuccgcgaagugauaccguucccucaccuagggaccugcaauucguugaagucacagacguuaaagugacgaucauguggaccccgccugaaucugcagucacaggauaucguguggacgugauaccagugaauuugcccggagaacauggacagcgccuaccgaucucuaggaacacuuucgccgaaguaacuggucuuagccccggugugacguacuauuucaaaguguuugccguuucucacggcagagagucuaaaccccucacugcgcagcaaacaacuaaacucgaugcgccuacuaacuugcaguuugucaaugaaacugacagcaccgugcuggugcgauggacaccuccacgugcucagauuaccggguaucgguuaacaguaggacucacccgccgcggucaaccacgccaguauaauguugguccaucuguaaguaaguaccccuuaagaaaccuacagccugccucagaguauaccgucucccucgucgcuaucaaagggaaucaagagucccccaaggcaaccggaguguucaccacauugcagccaggcuccucuaucccacccuauaacacagaaguuacugaaaccacgauuguuauuaccuggaccccugccccaagaaucggcuucaaacucggcguucguccuagucaggguggagaggcaccccgugaggucacaucagauucggggaguaucgucguaaguggauugacaccggggguggaguacguauauacuauucaggugcugcgggauggucaggagagagaugccccgauugucaauaaaguugugacaccccuaagcccucccacgaacuugcauuuggaagcuaaccccgacacaggugugcugaccguguccugggaaagauccaccaccccugacauuacuggauauagaaucaccacgacaccaaccaaugggcaacaaggaaauucgcucgaagaaguggugcacgccgaccaaucuagcugcacauucgauaacuugaguccaggccuugaauauaacguguccguguauacuguuaaggacgacaaagaaagcgugccaauuuccgauacaaucaucccagccgugcccccucccacggacuuaagguuuaccaauaucggcccugacaccaugcgcguuacuugggcaccacccccauccauugaucugacaaauuucuuagugcgauauucacccgucaagaacgaggaagacguggcagaguugucaaucuccccuucagacaaugccguuguacucaccaaccucuuaccagguaccgaauacguagugagcguguccucuguguacgaacagcacgagucuacgccucucagagguaggcagaaaacaggccuugauucgccaacugguauugacuuuucggauaucacugcuaacuccuucaccguccauuggaucgcuccuagggccaccauuacuggcuaucgaauccgucaccacccugagcauuucuccggcagacccagagaggaccgggugccacacagucgaaauuccaucacgcuaacgaauuuaacuccagguaccgaauauguugugaguaucguagcccuaaacggaagggaagaauccccauuacuuaucggccagcagaguaccgucagugauguaccucgugaucuugaggucguggcugcuacaccaacgucccuguugaucucuugggacgcucccgccgugaccgugcgguacuaucgaauuacauauggagagaccggcggcaacucucccguccaggaguuuaccguaccaggaucaaagucaacagccacgauauccggacugaagcccggaguagauuacaccauaacaguuuaugccguuacaggacguggagacucuccggcuucuagcaaaccuaucuccaucaacuauagaacagaaaucgacaagccuucccagaugcaggugaccgacguccaggacaacucuauaucugucaaguggcuuccgucaaguagucccguuaccggcuauagaguuacaacuaccccaaagaacggccccgguccuaccaaaaccaaaacagccgggccugaccagacagagaugacgaucgaaggacuccagccaacuguagaguacguugugucggucuacgcucagaaucccuccggagaaagccagccacugguucaaacugcuguuacaaauaucgaccgccccaaaggccuggcuuucacagacguggacgucgauucuauaaaaaucgcuugggaaaguccucagggccaggugucccgcuaucgaguuaccuacaguucucccgaggauggcauccaugaacuguuccccgcaccagacggagaggaagauacagcugaacuucaagggcucagaccaggauccgaguacacagucagcguuguggcacugcaugaugauauggaaagccagccucucauaggaacccagucaacagcuauucccgcuccaacugaccucaaguuuacacaggugaccccaaccucccugagcgcccaguggacaccacccaacguacaguuaaccggcuaccgcguaaggguuacacccaaagagaagaccggaccuaugaaagagauuaauuuggccccagacuccagcuccguaguggucaguggguuaaugguggcaacgaaguaugagguguccguguaugcccugaaagauacucucaccuccagaccagcccagggaguugugacgacucuggaaaacgucuccccuccacguagggcaaggguuacugaugccaccgagacaacuauuaccauaaguuggcgcaccaaaaccgaaacaaucaccgguuuccagguggacgcuguccccgcaaaugggcaaacuccaauccaaagaacuauuaagccugacgucaggagcuauaccaucacuggacuccagccaggaaccgauuacaagauuuaccuguauacccuuaacgauaaugcacgcucaucacccguggugaucgacgcaagcacugcuaucgaugcucccucuaaccuccgauuccucgcuacuacccccaacagccugcugguuucuuggcagccccccagagccagaauuacuggauauauuauuaaguaugagaagcccggaucucccccacgcgaagucgucccacgaccgagaccuggcguuacugaggcaacuauuacaggccuggaaccaggcacagaauacaccauauacgugauugccuugaagaauaaucaaaaguccgagccacugauuggaaggaagaaaacgguuaaugaaggccugaaccaaccuacagacgauucaugcuuugauccuuacacuguuucccacuacgccguaggggacgaaugggagcgcaugagcgaaaguggcuucaaacuuuuaugucagugccugggauucggauccggccauuucagaugcgacucaucucgcuggugccacgauaauggagugaauuauaagauuggggaaaaaugggauagacagggugagaaugggcaaaugaugagcuguacauguuugggcaauggaaaaggcgaguucaaaugcgauccucacgaagccacauguuaugaugauggcaagacguaccacgucggugaacaguggcaaaaggaguaucugggcgcuaucugcuccugcaccugcuuuggagggcagcgaggguggaggugcgauaacuguagaagacccggaggugaacccucaccugaaggaaccacgggccaguccuacaaccaguauucucagcgguaccaucagaggaccaauaccaacgucaauugccccaucgaauguuuuaugccccuugaugugcaggcagacagagaagacucucgcgaauag

SEQ ID NO: 31895 - RNA, 6636 nt, Artificial Sequence
  Description of Artificial Sequence: Synthetic coding sequence
augcuccgcgggccaggcccaggguugcuccugcuugccguucagugucugggcaccgcgguuccgucaacaggggcuagcaaaucaaagagacaggcacagcaaaugguccaaccccaaucgccaguggccgugagucaaaguaagccgggauguuaugacaacggcaaacacuaucagauaaaccagcagugggaaagaacuuaucuggguaacgcacucgucuguacaugcuaugggggaucacguggauuuaauugugaaucuaaacccgaagcagaagaaacuuguuucgacaaguacacagggaacaccuauagaguaggcgacacauaugaaagaccaaaggauucuaugaucugggauuguaccugcauaggcgcagggcgcggaaggauaucauguacgauugcuaacagaugccacgagggggggcagaguuauaaaauuggggauacauggagaagaccgcacgaaaccggaggguacauguuagaguguguguguuuggguaacgggaagggggaguggaccugcaaaccaaucgcugaaaagugcuucgaccacgccgccgggaccucguacguaguuggcgagaccugggaaaagccuuaccagggauggaugauggucgacuguacaugucugggagaggggucagggcggauuaccuguacuucucgaaacagauguaaugaucaagauacacgaacaaguuaucgcaucggagacacuuggagcaagaaggacaacagaggaaacuuacuacagugcauaugcacuggcaauggaagaggggaauggaagugcgaacgacacacuaguguccagacuacaucauccgggucaggaccguucacagaugugcgugcugccguguaccaaccacagccucauccacagccucccccuuacggucacugcgugacugacuccggcgucguguauucuguuggcaugcaauggcuaaagacucaaggcaauaaacaaaugcucugcaccugcuugggaaauggcgugucaugucaggagacagcagugacacaaacauauggcgguaacucgaauggagaaccuugugugcuucccuucacauacaacggccgaacauuuuacucaugcaccaccgaaggcaggcaggacggccaccugugguguagcacuacaaguaauuaugaacaggaccaaaaguauucauucuguacagaucacacagugcuugugcagaccagaggaggaaauucuaacggcgcuuugugucauuucccauuucucuauaacaaucacaacuacaccgauugcacuucugaagguagacgggacaauaugaaaugguguggaacuacccagaauuacgacgcugaccagaaguuuggguuuugcccuauggcugcccaugaggagauuuguaccacuaaugaaggcgugauguaccgcauaggagaucaaugggacaaacaacaugauaugggacacaugaugagguguacuugugugggaaacggcagaggcgaguggaccuguauagccuauagucaacuacgcgaccaguguaucguggaugacaucaccuacaaugugaacgauaccuuucacaagcggcacgaggaaggacacauguugaacuguacauguuuuggucagggaagaggaagguggaaaugcgaccccguggaucagugucaagacuccgaaaccggcacguucuaucagaucggggacucuugggaaaaguauguacacggcgugagauaucaauguuauugcuacggcaggggaaucggugaguggcacugucagccucugcaaacauacccuuccucaucuggaccagucgagguuuucaucaccgagacacccagucagccuaacagccacccuauucaauggaaugcuccucagccaucacacaucuccaaauacauccugcgauggaggccuaaaaauuccguagggcgauggaaggaagcaacaauuccagggcaucuuaauagcuauacaaucaaaggccuuaaacccggagugguauaugaaggacagcuuauuucaauccagcaguacgggcaucaggaagugacacgguuugauuucaccacaaccucuacaucuaccccagugaccucuaauaccguuaccggugaaacaaccccuuuuuccccucuagucgcgacaucugaaagugucacagaaaucacugccuccucuuucgucguguccugggucucagcuucugacacgguguccggauuucguguugaauaugaacuuucagaggaaggugacgagccucaguaucuagaccuuccuucuaccgccacaagcgugaauaucccugaucuuuuaccagguagaaaguacauuguaaauguuuaucagaucuccgaagauggcgaacagucacucaucuuaucaaccucccagaccacagcacccgacgcgccaccagacacgacuguggaccaagucgacgacacuucuauuguugugagauggaguagaccucaggccccuauuaccggcuaucgcauuguuuauucaccuuccguugaagguagcucuaccgagcuuaaucugccagagacagcgaauuccguuaccuuguccgaccugcagcccggugugcaguacaacauuaccaucuaugccguggaggaaaaccaggagagcacacccgugguaauccagcaagagacgaccggcacccccagaucugacaccguucccucgccucgggaccugcaauucguagaagugacugaugucaaggugacuauaauguggaccccuccugaaagugccguaacuggguacagagucgacgugauccccguaaaccugccuggcgaacaugggcagagauugccuaucucuagaaauaccuuugccgaagugacuggacuuucaccgggcgugacauacuacuucaagguuuucgcaguaagccacggaagggaaucgaaaccauuaacugcucagcagacaaccaaguuggacgcccccaccaaccugcaguuuguaaacgagacggacuccaccgugcuuguuagauggacaccuccaagagcccaaaucacuggcuauaggcucaccgucggucucacucggcgaggacagccuagacaguacaaugucggccccuccguaagcaaguauccucugcgcaaucuccagccagcguccgaauacacugucucucuuguggcaauuaagggcaaucaggaauccccaaaggcuacuggggucuucaccaccuuacaacccgggucaucgauaccccccuacaacacugaagucaccgagacuacaauagugaucacguggacaccugccccaagaauaggcuuuaagcucggcgugcgccccucccaaggaggcgaggccccaagagaggucacauccgacucuggaucgauugucgugucugggcugaccccuggagucgaguacgucuauacuauacaggucuuaagagacggucaagaaagggaugccccaaucgugaauaaggucgugacaccucugagcccccccacuaaucuacaucuugaggcaaauccugacacaggcgugcugaccguuucaugggagcgauccacaacuccagacauaaccggcuaccguauuacaacgaccccuaccaacggucagcagggcaauucgcuagaggaagugguucacgcagaucagucuuccuguaccuuugauaaccuaagcccaggacuugaguauaaugucaguguauauacagugaaagaugauaaggaaagcgucccgauaagugacacaaucauccccgccgucccgccgcccacagaucugagauuuacuaauaucggucccgacaccaugcgcguuacuugggcuccacccccaucgauugaccugacuaauuuuuuggugagguauucuccaguaaagaacgaagaggacgucgccgaacuguccaucagcccaagugauaacgcuguagugcuuacgaaucugcugccaggcacugaauaugugguuucugugagcuccguguaugagcaacaugaaucaaccccucugagaggccgacagaaaacugggcucgacucccccacaggcauugacuucagugauauaacugccaauucuuucaccgugcacuggaucgccccgcgcgccacuaucaccggcuauagaaucagacaucacccugagcacuucuccggucguccccgcgaagaccgcgugccucacagucgcaauaguauuacauuaacuaaucucacacccgguacagaguacguggucuccauuguugcccugaauggacgggaggaauccccuuugcuaauuggccagcagagcacuguuucagaugugccacgagaucuggagguggucgcagcaaccccaacaaguuuauugauauccugggacgcaccugcggugaccgugagguacuaccgaauaacguacggagagaccggaggaaauucgccaguucaagaguuuacggugcccggcaguaaaagcaccgcuacgauuucaggacugaaacccgggguggacuauaccaucacugucuacgcuguaacaggaagaggcgauaguccugccaguucaaaaccuaucuccauuaauuacagaaccgaaauugacaagccaucacaaaugcaaguaacagacgugcaagacaauagcauaucugugaaguggcuucccucuucaucaccugugacuggguaccgcgucaccacaacucccaagaacggccccggaccuacuaaaacaaaaacugccgggcccgaccaaaccgagaugaccaucgagggcuugcagccgacugucgaauaugucguuuccguauaugcucagaauccaagcggggagagucaaccguugguucagacagccguuaccaauaucgauaggcccaaaggacucgcuuuuacugauguugauguggacuccauuaagauugccugggagagcccacaagggcaagugucgcgguauagagugacuuauagcaguccagaagacgguauacacgaacuuuuuccagcaccggauggagaggaggauacagccgagcuccagggucucaggcccgggucugaauacaccgugagcgugguugcccugcacgacgauauggaaucucagccucuuauaggaacccagucgaccgcuaucccagcaccuaccgaccugaaauucacccaggucacgccuaccucauuaagcgcccaauggacuccacccaacguacagcuuaccggauaccgcgugcgugugacaccaaaagagaagaccggcccaaugaaggagaucaaucuugcaccugacagcucaaguguggugguaucuggucugaugguggcuacaaaauaugaaguuucaguuuacgcuuugaaggacacccugacguccaggccagcccaaggcguggucacgacacucgaaaaugugagucccccccggagagcuagggugacagacgcuacugagaccacaaucacaauuucauggcggacaaaaacagagacaauuacuggcuuccaaguagaugcaguccccgcaaaugggcagacccccauccaaagaacaauaaaaccugacgugcgcagcuauaccaucaccggacuccagccugguacagauuacaagauuuaccucuauacucuuaaugacaacgcacguuccaguccuguaguuauugacgcgagcacugcaauagacgcucccuccaaucugcgcuuucuugcaacuacaccuaacucucuucucgucucauggcagccuccaagggccagaauuaccggcuauauuauuaaauacgagaaaccugggucaccaccaagagaagucgugccucgaccccgaccuggggugacagaggcaacuauuacaggucuggaaccuggaacagaguacaccauuuacgucauagcucuuaaaaacaaccagaaaagugaacccuugauaggacgaaagaaaaccggucaggaagcccucucucagacuacuaucuccugggcucccuuucaggauacaagcgaguauauuaucucaugucaucccgugggaaccgaugaggagccgcuucaauucagagugccuggaaccuccacuagugcgacgcuuaccggccuuacccgaggagcaaccuauaauguaauaguagaagcacugaaagaccagcagagacauaaggugagggaagagguagugacgguaggaaauucagguuggugucacgacaauggggugaauuacaaaauuggcgagaaaugggacaggcagggggagaauggccagaugaugagcuguaccugccuggguaaugggaagggcgaauuuaaaugugacccucacgaggcgacauguuacgaugacggcaaaacauaucaugugggcgaacaguggcagaaagaauaccugggcgcaaucuguaguugcacgugcuuugggggucagcgaggguggagaugcgacaauugcagacgaccagggggagaaccuagucccgagggaacgacugggcaguccuacaaucaguauagccaaagguaccaccagagaacaaacacuaacguuaauugccccaucgaauguuucaugccccucgauguucaagcugauagagaggauucaagggaguag

SEQ ID NO: 31896 - RNA, 7434 nt, Artificial Sequence
  Description of Artificial Sequence: Synthetic coding sequence
auguugcgggggccagguccagggcuuuuacugcuggccgugcagugcuugggcacagccgucccuuccaccggagcaucuaagagcaaaagacaggcccagcagauggugcaaccacaaucuccaguggcaguaucacagucuaaacccgguuguuacgacaauggcaagcauuaucaaauaaaucaacagugggaaagaacuuaccugggcaacgcguuagucugcacaugcuacggggggaguagggguuuuaacugugagucuaaacccgaagcugaggaaacauguuucgacaaguacacagggaacaccuaucgagugggagauacuuacgaacggcccaaagauaguaugauuugggacugcacauguaucggugccggccgggggcgaauuucuugcacgauugcuaauagaugccaugaaggagggcaaaguuauaagauuggagauaccuggagacgaccacaugaaaccggcggguacauguuggaaugcguaugcuugggcaacggaaaaggugaauggacguguaagcccaucgccgaaaaaugcuucgaccaugcugcuggaacaaguuacgugguaggggaaacaugggaaaaaccuuaccaggguuggaugaugguggauuguacuuguuuaggugaagguaguggccgcauaacauguacaucucggaaucgcugcaaugaccaagauacaagaaccucuuaucguauuggugauacuuggagcaagaaagauaacagggguaaccuccuccagugcauuuguacaggaaauggacggggagaauggaagugcgagaggcauacuucuguacagacaacuaguagcgggucugggccauuuacggacguuagagccgcuguuuaucagccccagccucacccacaaccaccaccuuaugggcauugcguaacagacucuggggucguuuauucagucggcaugcaguggcucaaaacucagggcaauaagcaaaugcucuguacgugucuuggaaaugggguguccugccaagagaccgccgucacucagacauacgguggcaauucuaacggcgagccaugcguacuuccauuuaccuacaauggacgaaccuucuacucgugcaccacugaagguaggcaagauggucaccuguggugcagcacaacaagcaauuacgaacaagaucaaaaguauucauuuuguacggaucauaccguccuaguccaaacacgagguggaaacaguaauggcgcucucugccacuuuccauucuuauacaacaaccauaacuauacugacuguaccucugaggggaggcgugauaauaugaaauggugcgggacgacucaaaauuaugaugccgaucagaaauuuggguuuuguccaauggccgcucaugaagaaaucuguaccacuaaugaaggcgugauguaucggauuggagaucaaugggacaagcaacaugauaugggccacaugaugcgauguacaugcgugggcaauggccguggcgaauggaccuguauugcauauucgcaauugagagaccagugcauaguggacgauauuacuuauaaugugaacgauacauuucauaagcgccaugaagaaggacacaugcuaaacuguaccuguuuuggucaggggagagggagauggaaaugcgauccaguagaccaaugccaggauucagagacgggcacauuuuaucagaucggcgacagcugggaaaaauacgugcaugggguaagauaccaguguuauuguuacgggagagggaucggggaauggcauugccagccucugcagacauacccuagcaguagcgggcccguugaaguuuucaucaccgagacccccucacagccgaauagucaucccauucaguggaacgccccccagccaagccacauuuccaaauauauucugagauggcgacccaaaaacucggugggacgguggaaagaggcaaccauucccggacaucugaacagcuauacuauaaaaggucuuaaaccaggagucguauacgagggacaguuaaucaguauccaacaguacggacaucaggaagugacgcgguucgauuucaccacuacaucuaccagcacccccgugaccucuaacaccguuacaggagagaccacuccuuucaguccguugguggcuaccuccgaauccguuaccgaaaucacagcuucaucauucgucguguccuggguguccgcauccgauacagugucuggauuucgcguagaauacgagcuaucugaagagggugaugagccacaauauuuagaccugccaucuacugcgaccuccgugaauauacccgaccuccugcccgguaggaaguacaucgugaacguuuaucagauaucugaagauggcgaacagucccucauauuaagcacgucucaaacgaccgcucccgacgcaccuccugacaccaccgucgaccaaguggaugacaccucaauugugguuaggugguccaggccucaggcaccuaucacaggcuauaggauuguauauagccccucaguggagggaucauccacggaacuaaaucuaccugaaaccgcuaauagugugacacucagugaucuccagccaggcguccaguauaacaucaccauuuaugccgucgaggaaaaucaagaauccacgcccguugucauucaacaggaaaccacaggaacuccuagauccgauaccgugcccuccccccgggaccugcaguuugucgaaguaacagaugugaaggugacuauaauguggacccccccugaaagugccgucacaggauaucgagucgaugugauacccgugaaucugccaggcgaacacggacaaaggcugcccauuagucguaauacuuuugcggaggugaccggacugucucccggcgugaccuacuacuucaagguguucgcagugucccacggaagagagucuaagccacugacagcacagcagacgaccaagcuggacgcucccacaaaccuucaguuugugaaugaaaccgacucuacaguucuaguucgguggacacccccuagagcccagaucaccggauauagauugacuguuggccugacuagaagaggccagccgagacaauacaaugugggcccuagcgucaguaaauacccucucagaaaucugcagccagcaucagaguacacugugucucuuguggcuaucaaaggaaaccaggagucccccaaagcuaccggugucuuuacaacucuccaacccggauccaguauuccucccuauaacacugaaguaacugaaaccacuaucguuauuacauggacacccgcaccgaggaucggguucaaacugggcgucagacccucucagggaggcgaagcaccacgggaggugaccucugacucagguucuauuguugugagugggcuaacuccaggaguagaguacguuuauaccauacagguguuaagagauggccaggaaagggacgccccaaucgugaacaaagucgugacgccucuguccccaccuacuaauuuacaccuagaggccaacccggacacaggcguccucacuguuaguugggaacgcagcacuacacccgacauuacagguuauagaaucaccaccacucccaccaauggccaacagggaaacagucuugaagaagucgugcacgcagaucagagcagcuguacauuugauaacuugagccccgggcuggaauauaacguuucuguguauaccgucaaggaugauaaggaauccgugccaauaagcgacacaaucauuccagaagugccucaacuuaccgaccugucuuucguggacauuaccgacucaucuauuggccuccgauggacuccauuaaacucauccacuaucaucggcuaccggauuaccguaguugcagcuggugaaggaauuccuaucuuugaggauuuuguagauucuucagugggauacuauacugucaccggccucgagccgggcaucgacuaugacaucuccgugauuacgcuuauuaauggaggcgaaagcgcucccacuacauugacccagcaaaccgccgucccaccgcccaccgacuuacgauucacuaauauagguccugauacgaugcggguuaccugggcuccccccccaucaaucgaucugacuaacuuucuaguacgguacucuccagugaaaaaugaagaagacgucgccgaacuuucgauuagcccaucggacaaugcugugguccugacuaacuugcugcccggaacagaguauguugugucagucucaagugucuaugaacaacaugaguccacgccucugagaggacgucagaagaccggccuggauagccccacuggaaucgacuucuccgacauaacugcuaauuccuuuacugugcacuggauugcuccccgcgccacuauuacaggguauagaauuagacaucauccugagcauuucucuggacguccccgggaagauagggugccccauucccgcaacaguauaacacugacaaaccuaacccccgggaccgaguacguugucucuaucguggcgcuuaacgggcgcgaggaaagcccacugcuaaucggucagcagaguacagugucagacguaccccgagaccuggaaguagucgcugcaacucccaccucccuguuaauuucgugggacgccccagcagugaccgugcgcuacuacagaauuacuuacggagaaacagggggaaacaguccagugcaagaauucaccguccccggcucgaaguccacggccaccauaagcggacugaaacccggggucgauuacacaauaaccguauacgccguaaccgggagaggugacucaccagcaucaagcaagccaauuucaauuaauuaccgaaccgaaauagacaaaccuucccagaugcaggucaccgaugugcaggauaauaguauaaguguuaaguggcugcccaguuccucccccguuacgggcuacagaguuacaacuaccccaaagaacgguccuggaccuacaaagaccaaaaccgccggcccagaccagaccgagaugaccaucgaaggccuucaaccgaccguggaguaugucgucagcguauacgcccagaaccccuccggcgaaucccagccucucguucaaacagcgguaaccaacauugaccgaccuaagggacuggcauuuacggauguggacguagacaguauuaaaaucgcaugggaaucuccccagggacaagugagccgguauaggguuacauauucuaguccagaagacggcauucacgagcuguuuccggcaccagauggcgaggaagacacagccgagcuccagggucuccggccagguuccgaguauacagugagcguggucgcccugcaugacgauauggaaagccagcccuuaauaggcacccaaucuacagcaaucccagcaccuacagaucugaaguuuacucaggugacacccacaucacugucagcucaauggacuccgccuaacguccagcugacuggcuaccgcguuagaguaaccccaaaggagaagacaggaccaaugaaggagaucaaucuagcgccggacagcucuucuguuguugugucuggucugauggucgcuaccaaauaugagguuucaguauacgccuugaaagauacuuugacaucaagaccugcccagggggucgugaccaccuuggaaaauguuaguccaccuaggcgggcccgagugaccgacgcuaccgaaacaaccauuaccaucucuuggagaacgaaaacugaaacaauuacuggcuuccagguggacgcugugcccgcuaacggccaaacuccaauccaaagaacuaucaaaccagauguuagaaguuauacaauuacaggucuccagccaggaaccgacuacaaaauuuaccucuacacacugaacgacaacgcgcguaguagcccggucgugaucgaugccagcaccgccauugacgcccccucuaaucuccgguuuuuggccacuacaccgaacucucuacuugucuccuggcagccgccgcgcgcgcgaauaacagguuauaucauaaaguaugagaaacccggaucccccccacgagagguugugccaagaccuagacccgguguaacugaagcaacuaucacaggacuugaaccggggacugaauacaccaucuauguuauugcucucaagaauaaccagaaaucagagccgcugaucggacgcaagaagacugaugaacugccacagcucgucacgcugccccauccuaauuuacauggacccgagauucuagacgugccuuccacugugcaaaagacgccauucguaacgcacccaggcuacgacaccggcaacggaauucaacugccugguacgucagggcagcaaccaagugucgggcagcaaaugaucuuugaagagcacggcuucagaaggacaacuccuccaaccaccgccacaccuauucgucauagaccuagaccuuauccuccuaacgucggcgaggaaauucagaucggucacaucccaagagaagacguggacuaucaucuguauccgcacggcccaggacucaaccccaacgcaucuaccggccaagaagcucucagccagacgacuauuucaugggcuccuuuccaggauacgucugaguacaucauuagcugucaccccguuggaacagacgaagaaccucuccaguuucgagugccuggcacaaguacuucggccacccugacagggcugacaagaggagcgaccuacaacguuaucguggaagcucucaaggaucagcagaggcauaaggucagagaagaaguggugacuguugggaacagugugaacgaaggccugaaccagccuacagaugacagcuguuuugaccccuauacggucucccauuaugcgguuggagaugagugggagagaaugucugagagcggguucaagcuccucugucagugccuuggauucggauccggccauuuuaggugugauaguucuagauggugucaugauaacggagugaacuauaagauuggagaaaagugggaucggcagggagagaaugggcaaaugauguccuguacuugcuuagggaacgggaaaggcgaauucaaaugugacccucacgaagcaacauguuaugaugauggaaagaccuaccacgugggcgaacaauggcagaaggaguaucucggugccaucugcucuugcacuugcuuuggaggacaaagaggguggagaugcgacaauugcaggagacccggcggagaacccagccccgaagggacuacuggucagaguuauaaucaguacagucagcgcuaccaccagaggacaaacacuaacguaaacugcccuauagaauguuucaugccccuggacguacaagccgaccgcgaagacagucgcgaguag

SEQ ID NO: 31897 - RNA, 6891 nt, Artificial Sequence
  Description of Artificial Sequence: Synthetic coding sequence
augcugcgcgggccaggcccuggauuacugcugcuggccgugcagugucugggaacagcugucccauccaccggcgcuucgaaaucuaagcgacaggcgcagcagauggugcaaccucaaucuccugucgccgugucacaaucaaagccugguugcuaugauaacggaaagcacuaucagauaaaucaacagugggaaagaacauauuugggcaaugcuuuggugugcacuuguuacggaggaucccgcggauuuaacugcgaguccaaaccagaggccgaggagacauguuuugauaaauacaccgggaauacuuacaggguaggagauacuuaugaacgucccaaagacucuaugaucugggacugcacaugcauuggcgccggaagaggacgaauuucuugcacuauugcgaacagaugccaugagggggggcagaguuauaagaucggagauacuuggcgccggccccacgaaacaggggguuacaugcuagaaugcgucuguuuggguaacggaaagggcgaauggacaugcaaaccuauagccgaaaaauguuuugaucacgccgccggaaccagcuacguagugggcgaaacaugggagaagccauaucagggauggaugaugguggauuguacuugucucggagaagguucuggccggaucaccugcaccagucgcaacagauguaaugaccaagauacaagaacaucauaccggaucggggauacuuggagcaaaaaggacaacagagguaaucugcuacagugcaucugcacaggaaauggacggggcgaguggaaaugugagaggcacacuucagugcagaccacaagcucaggaucugggcccuuuacagaugugcgugcagcuguuuaccagccucagccucacccucagccaccaccuuacggccacuguguaaccgauucugguguuguguauucggugggcaugcagugguugaaaacucagggcaauaagcagaugcuauguacaugucugggaaacgggguuaguugucaggaaacagccgucacccagaccuaugguggaaauucaaacggggagccuugcguacuaccauucacuuauaacggcagaacauuuuacucuugcacaacggaaggccgccaagaugggcaucucugguguuccacaaccaguaacuaugagcaagaccagaaguauagcuucuguacagaccauacgguguugguucaaacccgcggcggcaauagcaacggugcccucugccacuuuccauuccucuacaauaaucacaacuauaccgacugcacaucagaagggcggcgggauaauaugaaauggugcgguacuacgcaaaacuacgacgcagaucagaaguucggguucugcccuauggcagcgcaugaagagauauguaccacaaacgagggcgugauguauagaauaggcgaucaaugggacaaacaacaugacaugggccauaugaugagaugcaccuguguuggcaauggccggggagaguggaccugcauagcauacucccagcucagagaccaauguauuguagaugauauaacauauaaugugaaugauacauuccauaagaggcaugaggaaggccauaugcucaauuguaccuguuucgggcagggaagggggagauggaaaugcgaccccguugaucaaugucaggacagcgaaacgggcaccuuuuaucagauuggggauucaugggagaaauacgugcauggcguacguuaccagugcuauuguuacgggaggggcauaggcgaauggcacugucaaccucuccagacauacccuucaucuuccgggccaguggaaguguucaucacagagacaccuagucagccuaauagucacccgauacaauggaaugcaccccaaccuucccacaucuccaaguacauacuccguuggaggccuaagaacucaguuggccgcuggaaggaagccacaaucccaggacacuugaauuccuacacuauuaaaggccucaaaccaggcguggucuacgaagggcaguugauuucaauacaacaguacggccaccaggaaguuaccagauuugauuuuacuacuacgagcacuagcacacccgugacaucuaacacggucaccggugaaacuacccccuucucuccccugguggcuacuagcgaguccgucacggagaucacagcaucaucuuucgucguuucuugggucagugcaucagauacaguuaguggguuucguguugaauacgaguuaucugaagaaggcgaugaaccucaguaccucgaccucccauccacagccacaagcgugaacauccccgaucugcuacccggccggaaguauaucgugaacguuuaccagauuagcgaggauggugaacagucgcuuaucuuaucuacaucgcaaaccacagcacccgaugccccccccgauacuaccguagaucagguggaugacacgagcauugugguacguuggucuagaccccaggcaccaauuaccggauaccgcaucguauacucuccaagugucgaaggcagcagcaccgagcucaaucuuccagaaacugccaacaguguaacccugagugaccugcaaccggguguucaguacaauauaacgaucuacgcaguugaggagaaucaagagagcacaccaguggugauccagcaggagacaacaggcaccccccguucugacacggucccuucucccagagaccugcaguuuguugaggucaccgauguuaagguaaccauaauguggacuccaccugaaucugccgugacgggcuaucguguugacgugauuccaguuaaucuaccgggagaacacggacagaggcugcccauaucaaggaacacuuucgccgaagugaccggacuaagcccaggcgugacuuauuauuucaaaguuuuugcaguuucccacggucgagaguccaaaccauugacagcccagcaaacuacgaagcuggacgcccccaccaaccuccaguucgugaaugaaacugauucuaccgugcugguaagauggacuccaccacgcgcucagaucacagguuacaggcugaccgugggauugacaaggagaggccaacccagacaguacaauguaggcccuucaguuucaaaauacccacugaggaacuuacagccggcaagugaguacaccguaagucucguggcaauuaaaggcaaccaggaaucccccaaagcaacaggaguguucacaacccugcagcccggauccuccauuccucccuacaacaccgaaguaacagaaacaacaaucguaaucacuuggacacccgccccucgaauaggcuucaagcugggcgugcgacccucucagggcggcgaagccccccgugaggugaccucagauucugguucuaucguagugagcggacugacuccgggcgucgaauaugucuacacuauccagguccuccgagauggccaagagcgagaugcuccgaucgugaauaaggugguuacuccccugucuccgccgacaaaucuucaccuugaggccaauccugacacaggagugcuuaccgugagcugggaaaggagcaccacccccgauauuacaggauacagaauaaccacaacacccacaaaugggcagcagggcaacucuuuagaagaaguagugcaugccgaccagagcucuugcacuuucgauaaccucucuccuggccuggaauacaaugugucuguguauacuguuaaagacgacaaggaaucuguuccgauuagugauaccauuaucccagcuguucccccccccacugaccugcgcuuuacuaacaucgggcccgacacuaugcgcguaacaugggcgccaccucccuccauagauuugacaaacuuucugguucgcuauuccccggugaaaaaugaagaagacgucgccgaguugucaauaucuccuucugacaaugcuguaguccucacaaacuuacucccuggaaccgaauauguggucagcgucaguagcguguacgagcagcaugaaaguaccccuuuacgcggcaggcaaaagaccggcuuagacucaccaacugguauugauuucagugauaucacugcaaacuccuucacuguacauuggaucgcucccagagcgacuaucacaggauauaggauccggcaucacccugagcacuuuuccggacggccacgggaagacagagugccucacucaagaaacaguauuacacugacgaacuugacccccggaacagaauaugucguaucgaucguggcccugaauggaagagaggagucaccauugcucauagggcagcaaucuacagugagugauguucccagagaucucgaaguuguggcagcuacaccuacuucucuuuugaucuccugggaugcccccgccgugacgguucgcuacuaccggauaacuuacggagaaacaggaggcaauagcccuguccaggaauuuaccgugccagguagcaagaguaccgcuacgaucaguggguuaaaacccggcguggauuacacaaucacaguuuaugcagucaccggcagaggggacucaccugcuuccagcaaaccaaucagcauuaauuaccggacggagauugacaagccaucacaaaugcaggugaccgauguucaagacaauuccaucaguguuaagugguugccuuccagcuccccagugacaggcuacagaguuacaacaacucccaagaacgguccagggcccaccaaaaccaaaacugcaggcccagaucagaccgaaaugaccaucgagggacuccaacccacaguugaguacguugucuccguuuacgcucaaaacccauccggcgaaucacaaccccuaguccaaacugcugugaccaccauucccgcgccgacugaccuuaaauucacacaagucaccccaacgucgcucucugcacaguggacgccuccuaacguacagcugacugguuacagagugaggguuacaccaaaggaaaagaccggacccaugaaagagaucaauuuggcuccugacaguuccucugugguggugucgggucugaugguggcuaccaaauaugagguuagcguguacgcccucaaggacacacugacuucccggccagcucagggcgugguuacgacuuuggaaaauguauccccacccagacgugcacgugugacugacgcgacagagaccaccaucaccaucagcuggcgaacuaaaaccgaaacaaucacaggcuuucagguagacgccgugcccgcuaacggacagacacccauucaacguacaaucaaacccgaugugagaucauauaccaucaccggucuccaaccaggaaccgauuacaagaucuaccuuuacacacucaacgauaaugcacguaguuccccggucguuauagaugcaaguaccgcaaucgacgccccaucuaaucuccgguuccucgccacuaccccuaacucccugcucguguccuggcagccaccacgcgcgagaauuaccggauacauuaucaaguaugagaaaccgggcucaccaccaagagaaguagugccccggccacgcccuggaguuacugaagcaacaaucacaggcuuggaacccggcacggaauacacuauuuacguuaucgcacucaagaauaaccagaaaucagaaccucuuauugguagaaagaagaccgacgaacugccacagcucgugacucugccgcaucccaaccuccacggucccgagauucuggaugugccuucuaccguccagaagacacccuuuguuacacaucccggcuacgacacagggaaugguauccaacugccagggacaucuggccagcaaccaucagugggccagcagaugauauucgaagaacauggauucagacguacaacuccacccacuacugccacucccaucagacaucgaccaaggcccuauccucccaauguuggcgaagagauucaaaucggucauaucccaagagaggaugucgacuaucaccuauacccucacggaccaggccuaaauccuaacgcuagcaccggacaggaggcccugucccagacaacaauuagcugggcacccuuccaagauacuucugaauauaucaucucaugucaucccguugggacugaugaggagccguuacaauuucgcguucccgggacauccaccagcgcaacucugacggggcuaacaaggggagcaaccuacaauguuauugucgaggcauuaaaggaccagcagagacacaaagugcgcgaagagguggucacagugggcaacuccgucaaugagggucucaaucagccgaccgacgacucauguuuugauccuuauacaguuagucacuacgcugugggggaugagugggaaaggaugagugaaagcggcuuuaagcuacuaugucaaugccuaggauuuggaucugggcacuucagaugugauaguucacgcuggugucacgauaacgggguaaauuauaagauuggggaaaagugggauagacagggggagaauggacagaugaugucauguacguguuuaggaaacggaaagggcgaauucaaaugugacccccacgaagcaaccugcuacgaugacggaaaaaccuaccacgugggagaacaauggcaaaaagaguauuuaggcgcaaucugcucauguacuuguuuuggcggccagcgggguuggcguugugacaacugucgccguccagggggcgaacccucaccugaagguaccacuggccaguccuauaaccaguauagccagagauaccaccagcgcacaaauaccaauguuaacugcccuauugaauguuuuaugccacuagacguacaggcugauagagaggacagccgagaguag

SEQ ID NO: 31898 - RNA, 6096 nt, Artificial Sequence
  Description of Artificial Sequence: Synthetic coding sequence
augcuccgcggaccuggaccugggcuccuguuacuggccguccagugccuaggcaccgccgucccgucuaccggcgcguccaaguccaaaaggcaagcccagcagauggugcagccacagucgcccguugccgugucucaaucuaagccaggcugcuaugauaauggaaaacacuaucagaucaaucaacaaugggaaagaaccuaccuuggcaacgcucugguguguaccuguuacggggggucuagaggguuuaauugugagucuaagccugaggcagaagaaaccugcuuugauaaauauacaggaaauacuuacagggugggagacacguacgagcgccccaaagacucaaugauuugggauuguacuugcauuggagccgggagaggcagaaucucauguacuaucgcaaacaggugucacgaaggagggcagaguuacaagaucggcgacacauggagacgcccucacgagacaggagguuacaugcuggaaugugugugucugggaaauggaaagggcgaauggacuuguaaacccaucgccgaaaagugcuucgaucacgccgcgggcacuagcuacguagucggugaaacuugggaaaaaccauaucaagguuggaugauggucgauuguacgugcuuaggcgaaggcagugguaggauuacauguaccucaagaaaucgcugcaaugaccaggauacacguacuucauaccgcaucggggacacauggucaaagaaggauaaccggggaaaccugcugcaauguauauguaccgggaaugguagaggagaguggaaaugugaacggcauaccagcguacagaccacaucauccgguagcggaccuuuuaccgacgugcgagccgcuguauaccaaccacaaccucauccucagcccccaccauauggccacugcgugacugauuccgguguaguguauagugucggaaugcaguggcugaagacucaagggaauaaacaaaugcuguguacaugcuuggguaacggagugagcugucaggaaaccgcagugacacaaaccuauggcggcaauucuaauggcgagcccugcgugcucccauucacauauaaugggcgaaccuucuauagcuguacuaccgagggcagacaggacgggcaucucugguguagcacaacuucuaauuaugagcaggaucagaaguauaguuuuuguaccgaucacaccgugcuagugcagacaagggggggcaauuccaacggggcacugugucacuuuccguuucucuacaauaaccauaauuacacagauugcaccuccgaaggaagacgcgacaacaugaaauggugcggcacaacccaaaauuaugacgccgaucaaaaauucggauuuugcccgauggcugcacacgaagaaaucugcaccacuaacgagggcgucauguacagaauuggugaccaaugggauaagcaacacgacaugggccauaugaugagaugcacuuguguugggaauggacgcggagaauggacuuguaucgccuauagccaauugagggaucaauguaucguugaugacaucacauacaacguaaaugauacguuucauaaaagacacgaagagggccacauguuaaauuguacuuguuuuggacagggaaggggaagauggaaaugcgauccaguugaccaaugccaggacuccgagacgggcaccuucuaccagaucggcgacucuugggagaaauauguacacggcgucagauaucaaugcuacugcuauggccgaggcauuggggaguggcauugucagccccugcaaaccuacccauccuccagcggaccagucgaaguauuuaucaccgaaaccccaucucagccuaacagucaccccauccaguggaacgcuccccagccuagucauaucuccaaauacauucugcgauggcgaccuaaaaacagcguagggagauggaaggaggccacaauuccagggcaccuuaauuccuauacaauuaaaggccugaaacccggaguaguguacgaaggacaacugaucucaauccagcaguacgggcaccaagaggugacacgcuuugacuuuacuacaacuuccacuuccacccccguuacuuccaauacuguaacuggcgagacgaccccauuuagcccacuuguggccaccucagagagcgugaccgaaaucaccgcaucuuccuucgugguaagcuggguguccgccagugacacugugucagguuuuagaguggaauaugagcucagcgaagaaggugaugaaccacaguauuuagaucuucccuccacagcaacauccgucaauauccccgaccuccugccuggcagaaaguauaucgugaauguguaucaaaucagugaagauggagagcagucacuaauucuuucuacaucacagacgacugcuccugaugcucccccagauacaacgguggaucaggucgacgauacuagcauuguaguacgguggucuagaccccaggccccaauuacuggcuaccguaucguauauucacccagcguugaaggaucuucaacagaacucaaucuuccagagaccgcuaacaguguaacccucuccgaccuucagcccggcguucaguauaauauuacaauuuaugccgucgaagaaaaucaagaguccacacccgucguuauucagcaggaaacuaccgguaccccucgaucggauacuguuccuagcccacgagaucuucaauuuguagaggugacagacguuaaagucacuaucauguggaccccuccagaaagcgcagugaccgguuacagaguggacguuaucccugucaacuugccaggagaacauggccagaggcuuccuauuuccagaaauacuuucgccgaggugaccggucugaguccaggcguuacauauuauuuuaaagucuuugccguuucccauggccgcgaaagcaagccacugacagcacagcaaacaacgaaacuggacgcaccgacaaaucuccaguuugugaaugagacagauagcaccgugcugguuagauggacaccuccgcgggcacagauuaccggauaccggcugaccgucggcuuaacacgacguggacagccucgccaguauaauguuggaccauccgucucaaaauauccguugcgaaaccugcagccagcaucagaauauacugugucccucguagccaucaagggaaaucaggaaucaccuaaagccacaggcguauuuaccacccuccaacccggcaguucgauuccaccuuacaauaccgaagugaccgaaacuacaauuguuaucacuuggacuccugcuccacggaucgguuuuaagcugggugugcggcccucccaaggaggugaggcuccacgcgaggucacaucagacucuggcuccaucguggugucggguuuaacuccaggcguggaauauguguacacaauccaaguacucagagacggccaagagagagaugccccuauugugaauaaaguggugacaccacuaagccccccgacaaaucuucaucuggaggccaaccccgauaccggaguauuaacaguuagcugggaaaggucgaccacacccgacauaaccggguacagaaucacaacaacgccaaccaauggccaacaaggaaauucucuggaagagguuguucacgcagaucagagcagcuguacuuucgacaaucugagucccgggcuggaguauaacguuucaguuuacacagugaaggaugauaaggagucuguccccaucucugauacuauuaucccugccguuccuccuccuacugaccuccgcuucaccaacaucgguccugauacaaugcgcgucaccugggcccccccgcccuccaucgaccuaacaaacuuuuuagugcgauacuccccugugaaaaaugaggaggacguugcugaguuaaguaucagcccaagcgacaaugcaguuguuuugacaaaccugcucccaggcaccgaauauguugugucuguuucguccguguacgaacaacaugaaucgacccccuugagaggacgccagaagacaggccuggacagcccuacaggcauugauuuuucugauaucaccgcuaacuccuucaccguccauuggauugccccuagagcgacuauuaccggcuaucggauucgccaucaccccgaacacuucagcggccgaccuagagaggaccgcgugccccauuccagaaacucuauuacucucacuaaccugacgccuggcacugaguauguugugucuauagucgcccuuaauggacgcgaagagucaccucucuuaauaggacagcagucuacggugagcgauguuccccgugaucuggaggugguggcagcaacgccuacauccuugcuuaucuccugggaugcuccagccgugaccgucagauacuacagaaucacauacggagaaacaggaggaaauucucccguucaggaauuuacugugcccggaaguaaaucgaccgcaaccaucuccggauuaaaaccugggguugacuacacaaucacagucuacgccgugacuggaagaggcgacucccccgcuagcuccaaacccaucucgauaaacuauaggaccgagauugacaagccaucacagaugcaagugacagacguucaggauaauuccaucucaguuaaguggcugccuuccuccagccccgugaccggcuaccgggugacuacgacuccuaagaacggcccagguccuacuaaaaccaaaaccgcaggccccgaccaaacggaaaugaccauugaggggcugcagccgaccgucgaauaugugguaagcguguaugcgcaaaauccauccggagagagccagccacucguucagacagccgugacaaacaucgaucgcccuaaaggucuagcauucacugauguggacguggacaguauaaagaucgccugggagucuccacaagggcaagucagccgauauagagugaccuacucaagucccgaagaugguauccaugagcuguuuccagccccugauggggaagaagacacugcugagcugcaaggcuuacguccagguagcgaauacacaguuucugucgucgcacuccaugacgauauggagucucaaccccugauugguacgcagaguacggccauuccugccccuacagaccugaaauuuacacaagucacacccaccucgcugucagcucaauggacaccuccgaacgugcagcuuacuggauaccgcguacggguuacaccgaaggagaaaaccgggccuaugaaagaaauuaaucuugcucccgauuccuccucagugguaguuagcggucugauggucgccacaaaguaugaggucagcguguacgcacugaaagauaccuuaacuucccgccccgcacagggcgucgucacaacucuugaaaauguguccccacccaggcgcgcccgaguuaccgaugccacagagaccaccaucaccaucucauggcggacuaagacagaaaccauuacaggcuuccagguugaugccgugccagcaaauggacaaaccccaauccagaggaccauuaagccagaugugagaucauacacaauaacuggacuucagccagggacugacuacaagauuuaucuauacacauugaaugauaaugcaagaaguagcccggugguuauugacgcuagcacagccauugacgcccccucaaaucuuagguucuuagcaacaaccccaaacagccucuuagugagcuggcagcccccaagagcuagaauuacuggcuacauuaucaaguaugaaaaaccuggaucccccccucgagaggucgugccucgaccuaggccuggugugacggaagcuacuaucacagggcuggagcccggaacagaauacaccauauacgugaucgccuugaaaaacaaccagaagucggaacccuuaauagggagaaagaagaccgggcaggaagcacuuagucagacuacuaucagcugggcacccuuccaggacaccucagaauacauaauuucaugccacccggucggaacugaugaagaacccuuacaaagcacaaaagcuuag

SEQ ID NO: 31899 - RNA, 6531 nt, Artificial Sequence
  Description of Artificial Sequence: Synthetic coding sequence
auguuaagaggacccgggccaggccuacuccugcuggcagugcaaugccucggcacugcagucccauccacuggagccuccaagucaaagcgccaggcacaacagaugguacagccccaauccccaguggcaguuucgcaaaguaaaccagguugcuaugacaauggaaagcacuaccagaucaaccagcaaugggagcggaccuaucuuggcaacgcccucgucuguacaugcuauggcggaagcagggguuuuaauugugaguccaagccugaggcugaagagacauguuuugauaaguauacugggaauacguacaggguuggugauaccuacgaaagaccaaaggauagcaugauaugggacuguacaugcauaggagcggggagaggcaggaucucauguaccauugcaaauagaugccacgaaggcgggcagaguuauaaaauaggggacacuuggcgacggccacaugaaacuggaggcuacaugcuggaauguguguguuuaggaaauggcaaaggagaauggacguguaagcccauagcagaaaaguguuuugaucacgccgcagguacaaguuaugugguuggagagacaugggagaagccauaucaaggcuggaugaugguggacuguaccuguuugggugagggaucagguagaaucacuuguacaucacguaacagaugcaaugaucaggacacgagaacaaguuauaggauaggcgacaccuggucaaaaaaagauaacagaggcaauuuacuccaaugcauaugcaccgguaaugggaggggggaauggaaaugugagagacacacuaguguucaaacaacaagcucuggcagcggccccuucacagauguacgggccgcugucuaccagccacagccccacccucagccccccccauaugggcacugugucacugacagcggcgugguguauagcgucggaaugcaaugguugaaaacccaagggaacaaacagauguuauguacuugcuuaggaaauggugugucaugucaggaaacugcugugacacagacauacgguggaaacucuaauggcgaaccgugcguguugcccuuuacuuacaacgguaggaccuucuauucuugcacgacagagggaagacaggacggacauuuguggugcucuacaacaucuaacuacgaacaggaccagaaguauucuuuuuguaccgaucauaccgucuuaguccagacucgaggggggaacaguaauggugcucugugucauuuccccuuccuuuacaauaaucauaacuacaccgacugcacauccgaggggaggcgggauaacaugaaauggugcggaaccacacaaaacuacgaugcagaccaaaaguuuggcuuuuguccaauggcugcacaugaagaaaucuguacaacaaaugaaggagugauguauagaaucggggaucagugggauaagcagcaugacaugggacauaugaugcgaugcacaugcgugggaaauggccggggggaauggaccuguaucgccuauagccagcucagagaccaaugcauugucgacgauauuacuuacaacguaaaugauaccuuucacaagagacaugaggaagggcauaugcugaacuguacauguuuugggcaggguagggggagguggaaaugugauccaguagaccagugccaagacuccgaaaccggcacguucuaucagauuggggacuccugggaaaaguacguacauggcgugcgcuaucaguguuacuguuacggcagagggauaggggaguggcauugccaaccacugcagaccuacccgucaucuucugggccaguggaggucuuuauaacagaaacaccaucccaaccaaauucucacccuauacaguggaaugcgccccagccuucacacaucucaaaauacauccugcgauggagaccaaaaaauagcguaggaagauggaaagaagcgaccauccccggccaccugaauucuuacacuaucaaaggucugaaacccgggguggucuaugaaggacaauuaaucucaauucagcaguauggacaccaggaaguuacaagauuugauuuuacuacgacaagcacuuccacaccagucacaagcaauacagucaccggcgagacgaccccuuucagccccuuagucgccacaagugaauccgucacagagauaaccgcuuccucauuugucguuucgugggucagcgcaucggauacggucucuggcuuuagaguggaauacgagcuguccgaggagggagacgaaccacaauaucuggaucucccuaguacugccaccuccguuaacaucccugaccuguuacccggccguaaguacaucguuaauguguaucagauuuccgaggauggagagcagucuuugauccuuagcaccucacagacuacagcaccagacgcaccacccgauacaacaguugaccagguagacgacacaagcaucguuguccgguggaguagaccucaagccccaaucaccggauauagaauuguguacucaccaagcguggaaggcuccagcaccgaacugaaccucccagagacugcuaauagcgugacccucucagaccugcagccaggcgugcaauacaauauuaccauuuacgccgucgaagagaaucaggagucuacaccaguaguaauccaacaggagacaacaggcacaccacgaucagacaccgugccuuccccuagagacuugcaauuuguugaaguaacagacguuaaagucaccaucauguggacuccucccgaaucagcgguuacuggauauagaguggacgugauaccugugaacuugccuggcgagcauggccagcggcugccgauuagccgcaauacuuucgccgaagugacuggacuuuccccuggcguuacauacuauuucaagguguucgccgugucucaugguagggagucuaagccgcuuaccgcccagcagaccacuaaacuggacgccccuacgaaccuccaguuugugaacgaaacggacaguaccgucuuaguaagauggacaccuccccgcgcccagauuaccggcuaucggcugacugugggccuaaccagaagaggacagccucgccaguauaacguuggacccucuguuagcaaauauccccugcgcaaucugcagccugcuucugaauacacugucucacugguugcuaucaagggaaaccaagaaucccccaaggcuacaggcguuuuuaccacucuccaaccuggaagcagcaucccccccuauaauaccgaagugacagagaccacaauugugauaacauggaccccggccccacgaauuggguucaaacucggcguccgaccaagccaggguggcgaggcuccaagagaggugacaucagacuccgguucaaucguuguuucagggcucaccccugguguggaauaugucuauacgauccaaguauugcgggacggccaagagcgcgacgccccgaucgucaauaaaguugugaccccauuguccccacccacgaaucuccaucuggaagccaaucccgacacagguguucuuacuguaucuugggagcggucuacaaccccugacauuacaggcuacaggauuacuacuaccccgaccaacggucagcaaggcaacucucuugaggaggugguccacgcugaucagaguucaugcacauucgauaacuuauccccaggccuggaauauaacguauccgucuauacugucaaagacgacaaagagucggugccaauaucagacacuaucauucccgcagugcccccuccuacagaccugagauuuacuaauaucggcccagauacaaugagagucacaugggcaccucccccaucuaucgaccugaccaauuuccuaguuagguacuccccagugaagaaugaggaagacguugcugaacuaucaauuucccccucugauaacgcuguuguccugaccaaucugcucccuggaaccgaauauguugugucuguuuccucaguguaugaacaacacgaguccacuccacuacgcggccgucagaagacaggccuagacagucccacuggcauugacuucucugacauuacagcuaauagcuuuaccguccauuggauugccccacgcgcuacaauuacaggauacaggauuagacaccauccugagcauuuuucuggcaggccccgggaagaucgagugccucauagcaggaacagcaucacccuaacaaaucugacgcccggcaccgaguauguugucucaauuguugcccucaaugguagagaagagucgccucucuuaaucggacaacaguccacaguauccgacguuccucgggaccuugaaguuguggccgcaacuccgacaucucugcugauaucaugggacgcuccggccguuaccguucguuauuaucgcauaacuuacggcgagacaggagggaacucaccugugcaagaguuuacugugccuggauccaagucaaccgcuaccaucucugggcucaaaccuggaguugauuauaccaucacaguuuacgcuguuaccggacguggcgacagucccgcuucuaguaagccuauuucuauaaauuacagaaccgagaucgacaaacccucacaaaugcaagugaccgaugugcaagauaacucaaucuccgucaaauggcugcccaguuccagcccugugacaggcuacagagugacuacaacaccaaagaauggacccggcccgaccaagacaaaaacagcgggaccugaccaaaccgaaaugacaaucgaaggucuacagccuaccguugaauauguggugaguguauaugcucagaacccaucaggcgagucccaaccacuggugcagacggccguaacaacaauaccugcaccuacagaucuaaaguucacccaggugacccccacgucccugagcgcccaguggacccccccuaaugugcagcucacuggauauagagugcguguuacccccaaggaaaagacaggaccuaugaaagagauaaaucuggcccccgacuccucaagcguuguaguuuccggacuuauggucgccaccaaauacgaggugucaguuuacgcccuuaaagauacacuuacuagcagaccagcccagggagucguaaccacacuggaaaauguuaguccgccacgacgagcucgagugacagacgcuaccgaaacaacaaucaccaucucauggagaacgaaaaccgaaacuauaacuggcuuucagguggaugcggugccugcuaauggacagacacccauccagcguacaaucaagccugacgugcgaaguuacaccauuacuggccuucaaccugggaccgauuacaaaaucuaucuguacacacuuaacgauaacgcccgcuccagccccguuguuauugaugcaucuaccgcuaucgacgcccccagcaaccuacgcuuucuagcaacaacacccaauagccuguuaguuucuuggcagcccccaagagcccggauuaccgguuacauuauuaaauaugagaagcccgggagcccuccucgcgaaguugugccucggccacgaccaggagugaccgaagcuaccaucacaggccucgagccuggcaccgaguacacaaucuacgucauugcccugaaaaacaaucaaaagagugaaccucucauugggcgcaagaaaacaggccaggaagccuuaucucagacaaccaucuccugggccccauuucaagauacauccgaguacaucauuucuugccaccccgugggaaccgacgaggagccuuugcaauuuagaguaccggggacguccacaagugcgacccugaccggacugaccagaggagccaccuacaaugugauagucgaagcguuaaaagaucagcagcgccacaaaguuagagaagaagucguaacugucggaaauucugugaaugaggguuuaaaccagccgacagacgauucgugcuucgacccauauacagugucccauuacgccgugggggacgaaugggagaggaugagugagagugguuuuaagcugcugugucagugucugggauuugguagcggacacuuuaggugugauagcagcagauggugucaugauaacggcguaaauuacaagauaggcgaaaaaugggauaggcaaggagagaacggacaaaugaugagcuguacgugucugggaaauggcaagggcgaguucaaaugcgauccacaugaggcgacuuguuacgacgacggcaagacauaucacgugggugaacaauggcagaaagaguaccuaggggccauuuguucuugcacauguuuuggaggccaaaggggcuggagaugcgauaacugucgccgccccggaggcgaaccuucccccgaggguaccacaggucagaguuauaaucaguauagucagcgcuaccaucaaagaaccaauaccaacgucaacugcccuauagaauguuuuaugccucucgauguacaggcugacagggaagacucacgggaguag

SEQ ID NO: 31900 - RNA, 7161 nt, Artificial Sequence
  Description of Artificial Sequence: Synthetic coding sequence
augcugagagggcccggaccaggccuccuccuucucgccguccagugucugggcaccgccgugcccucaacgggagccucuaaguccaaacgccaggcucagcaaauggugcagccucagagcccuguugcaguuucccaaagcaaaccagguuguuacgacaacggaaagcacuaccaaaucaaccagcagugggaacggacuuaccugggcaacgcacucguauguacaugcuaugguggaucuagaggauuuaacugcgaaucgaagccagaagcugaagagacaugcuuugauaaguauacugggaauacuuacagaguuggagauacguaugaacgcccuaaggacucuaugaucugggauugcaccugcauuggagcuggaagaggccgcaucagcuguaccauagcuaaccgcugucaugagggcggccagucguauaagaucggagauacguggagacgcccacacgaaacugguggauauaugcuggagugugucugucuggggaacggaaaaggggaguggacauguaagccaauagccgagaaaugcuucgaccacgccgcagguacuucguauguuguaggcgaaacuugggagaagccauaccagggauggaugaugguugacuguacgugcuuaggugagggcaguggccgaauaaccuguacaagccgaaacaggugcaacgaccaggacacucguacuaguuauaggauuggugauacauggagcaaaaaagauaaccggggcaaccuccugcaauguaucuguacaggcaacggacguggcgaguggaaaugugagagacauacuagcgugcagaccaccaguagcgguuccggcccauuuacugacguaagagcagccguguaucagccccagccccacccccagcccccgccguauggucacugcguuaccgauuccgguguaguguauucaguugggaugcaauggcuaaaaacacaagggaauaagcagauguuauguacaugccugggcaauggagugucuugucaagaaaccgccgugacccagacuuacggcgguaacucaaauggugaaccuugcgugcugccauucacuuauaaugggaggacguuuuacagcugcacuaccgagggacgucaggauggacauuuauggugcucuacaacaaguaauuacgaacaggaucagaaguauagcuuuuguacagaccacaccguacugguucagacaaggggggggaauagcaacggggcacucugccacuuucccuuccucuauaauaaccauaauuauacugauugcacaagcgagggcaggcgagacaauaugaaauggugcggcaccacacagaacuacgaugcugaucagaaauuugguuuuugcccaauggcugcacacgaggaaaucuguaccacuaaugagggaguuauguauagaaucggggaccagugggacaagcaacaugauaugggccacaugaugagguguacuugcgucgggaauggacgcggugaauggaccugcaucgccuacucccaguugcgugaucaaugcauugucgacgacauuacuuacaacgucaacgauaccuuccacaaaagacacgaagaagggcauaugcuuaauuguacuugcuuuggucagggaaggggaagguggaagugugaucccguggaucagugucaagauagcgaaaccggaaccuuuuaucaaaucggagauucuugggaaaaauacgugcacggaguaagguaccagugcuacugcuauggcaggggaaucggcgaauggcauugccaacccuuacagacauaccccucuucaucaggccccgucgaagucuucaucaccgaaacgcccagucagccuaauucucacccaauccaguggaaugccccccagccaucacauaucucaaaguauauccugcgcuggaggccuaaaaacagcguuggccgcuggaaggaagccaccauaccaggacaccucaauucguauacaauuaaaggcuugaaaccuggugucgucuacgaggggcagcucaucucaauucagcaauauggccaucaggaaguaacucgguucgauuucaccacgaccucaacaucaacaccuguaacgucaaauaccgugacuggcgaaacaaccccauucagcccccuaguggccacuagcgaguccgugacugaaauuaccgcaagcagcuuuguagugagcuggguguccgcgucagauaccguuagcggauuuagagucgaguacgaacucucagaagaaggugacgaaccccaguaucuggaccuccccucuacugcuacauccgugaacauucccgaccuccugccuggaagaaaauacauagucaacguguaucagauaagugaggacggugagcagagcuugauuuuaucuacaagucaaaccaccgccccugacgcaccccccgacacaacuguggaucaagucgacgauacuagcauuguugugagauggagcaggccacaggcuccuauuacuggcuacagaaucguauacucgccuagcguugagggauccuccacagaacuuaaucuaccggaaacugccaauaguguaacauuauccgaucugcagccuggcgugcaguacaauaucaccaucuaugccguagaggagaaucaggaaagcacaccaguggugauucagcaggaaacaaccggcacuccccguuccgauaccguccccagccccagagaucuacaauuuguugagguuaccgacguuaaagugaccauuauguggacaccaccagagucagccgucacuggcuaccgcguggacgugaucccuguaaaccucccaggcgaacacggacagaggcuucccaucucucgaaacacauuugcugaggugaccggccuuagccccggggucaccuacuauuucaaaguauucgccguaagccacgggagagagagcaaaccccugacugcccaacaaaccaccaaauuggaugcaccuacaaaucuucaauucgugaacgagaccgacucaaccguuuuaguacgcuggacuccuccccgcgcacagauuaccggguacagacugacaguugggcucacuaggaggggccagccuagacaauauaauguggggccaaguguguccaaauaucccuuaagaaaccugcaaccggcuucagaguacaccgugucauuaguugcuauaaagggcaaccaggaaucaccuaaggcaaccggaguauucacuacccugcagccaggcucuuccauuccucccuacaauacagaagugaccgaaaccacaauagugauuacauggaccccagcuccaagaauagguuucaaguugggagucaggcccagccagggaggcgaagcaccccgagaagugacaucugauucuggcucaaucgucguuucaggucugacucccggcguggaguacgucuacaccauucagguauuacgcgacggacaggaacgcgacgcuccaauuguaaacaagguaguuacgccacuaucaccgccuacuaaccugcaucucgaagccaauccugauaccggcgugcugacuguguccugggaaagaaguacaacgcccgacauuacaggauaucgaaucaccaccacucccacgaacggacagcaaggaaauaguuuagaagaaguggugcacgccgaucaauccucaugcacuuucgauaaccugaguccuggacuggaguacaaugucucugucuacacugucaaggacgauaaagaaucaguuccaauuucagacaccauaauccccgcugugccaccccccacugacuugcgauuuacuaacauuggccccgauacaaugagggucacaugggcuccaccccccagcauugaucugaccaauuuccucguuagauacucacccguaaagaacgaggaagacgucgccgagcugucaauuuccccauccgauaacgcugucguucugaccaaucuauuacccggaaccgaauauguggucagcgugucuuccgucuacgagcagcaugagucuacaccucugagaggcaggcagaagaccggcuuagacuccccgaccggcaucgauuuuagcgacauaacggcuaauucauucacuguacacuggauugcaccaagagcaaccaucaccggcuaccgcauaaggcaccaccccgaacacuuuaguggacguccaagggaagacagggugccccacucucgcaauagcaucacacugacuaaucugacaccggggacugaauacgucgugucuauaguggcgcuaaauggucgagaagagaguccauuacucauaggacagcaaucaacagucagcgacguuccccgagaucucgaagugguagccgcuacucccaccucccuguugaucuccugggacgcuccggcuguuacagugcgcuacuacaggauuaccuauggggaaacaggagggaacagcccaguucaagaguucaccguaccaggaagcaagucaacugccaccauaagugggcugaaaccgggagucgacuauacaaucacagucuaugccguuaccggccgaggcgauucuccagcuuccuccaagccgaucaguauuaacuauaggacagaaauugacaaaccaucucagaugcagguuacagaugugcaggacaauucaauaagcgugaaauggcuuccuucauccucuccugugacaggcuacagaguuacaacuacuccuaaaaacggaccaggcccuacuaaaacuaagaccgccggaccagaucagaccgagaugaccaucgagggacuucaaccaacagucgaguacguugugucaguguaugcccagaacccaaguggggaaagucaaccacuuguccagacagccgugacuaauauugaucgccccaaaggucucgcuuuuacugauguggauguggauucaaucaaaauugcaugggaauccccccaagggcaggugucuagauaucgggucacauacucgucccccgaagacggcauucaugaacuuuuuccagcuccagacggugaggaggacaccgccgaacuucagggccuccgcccagggucagaguauacugugagcgucgucgcccuccacgaugauauggaaucucaaccacuuauaggaacccagagcaccgccauuccagcccccaccgaccucaaguucacacaaguaaccccuacuagucugucugcccaauggacuccuccuaauguccagcugacaggauaucgugugcgaguuacgcccaaagagaagacuggaccuaugaaggaaaucaaucuggccccugauucuucuagugugguagucagcggacugaugguggcuacuaaguacgaagugagcgucuaugcccugaaggacacacuaacaucaaggccggcucagggcguagucacuacacuagaaaacguauccccuccucgccgagcaagagugacagaugcaacagaaacaacuaucacaaucuccuggcggacaaagacugaaaccaucaccggauuccaggucgaugccgugcccgcgaacggccagacgccuauucaacggacuauuaagccagacgugcgcagcuauaccauaaccggccugcagccuggaacagauuacaagauuuaccucuacacacucaacgauaaugcaagaucuucuccuguggucaucgaugcgagcacagcaauugaugccccaucaaaucugcgcuuccuggcgacgacaccaaauucccugcuagucaguuggcaaccuccacgagcccgcaucacaggauauaucauuaaguacgagaagcccgguucuccucccagagaggugguaccuagaccucggccuggcgucacagaagcaaccauuacaggccucgagccggggacagaauacaccaucuacgugaucgcccuuaagaauaaccagaagagugaaccccuuaucggccguaagaagacugaugaacucccgcaguuggucacccucccccaucccaaucugcauggaccagagauucuagaugugcccucgacuguucaaaaaacucccuuuguuacccauccgggauaugacacuggaaauggcauccagcugccaggcaccuccggccagcagcccagcgugggacaacagaugaucuuugaagaacauggcuuccgucggacaacgccuccuaccaccgcaaccccuauucgccauagaccaagacccuaccccccuaacgugggcgaggagauccaaaucggccauaucccaagagaggacguggauuaccaccuguauccccauggacccggccucaauccuaacgccagcacagggcaagaagcacuuucacagacaacgaucucuugggcuccuuuucaggacacaagcgaauacauuauaagcugccaucccguggguacagaugaagaaccccuccaguuucguguaccugguaccucaacaagcgcuacucugacuggucugacuaggggggccacuuacaacgugauuguggaagccuugaaagaucagcagcgacacaaggugagagaggaaguuguuacagucgggaauagcgugaaugaagguuugaaccagccuacugacgacuccuguuucgauccuuacacggugucacauuaugcugucggagaugagugggaaaggaugagcgagucgggauuuaagcuacuaugccagugccucgguuuugggucaggacauuuccgcugcgauucaagucguuggugccacgacaaugggguaaauuauaagaucggcgaaaaaugggacaggcagggcgagaauggacagaugaugagcuguacuugcuuaggaaacgguaaaggcgaguucaagugugauccacaugaagcaacgugcuacgaugacgguaaaaccuaucaugugggggagcaauggcaaaaagaauaccuaggagcuaucugcaguuguacuugcuuuggcgggcaacguggauggagaugcgacaauugcagaagaccaggcggcgagcccuccccagaaggcaccacaggucaguccuacaaucaguacucgcagcguuaccaucagagaacaaauacuaacguuaacugcccaauugagugcuucaugccacucgaugugcaggccgacagagaggacagucgggaauag

SEQ ID NO: 31901 - RNA, 6723 nt, Artificial Sequence
  Description of Artificial Sequence: Synthetic coding sequence
augcugcgggggccuggucccggccuccuucuccuagcaguucaaugccucgguacagcgguaccuaguacaggcgcgucaaaaucaaagagacaagcccaacagaugguccagccucagucuccugucgccgucucccaaucaaagccaggguguuacgacaaugggaagcauuaccaaaucaaccagcagugggagagaaccuaucuaggaaaugcucuugugugcacauguuacggaggaucacggggcuuuaauugugagagcaaaccugaagccgaagaaacuugcuucgacaaguacaccggcaauaccuauagaguuggagauacauaugaaaggccaaaagauuccaugaucugggauuguacauguaucggagccggucgcggaagaauuuccugcaccauugcuaauagaugucacgagggcgggcagucguauaagauuggcgauacauggcggagaccucacgagacaggcggauauaugcuggaaugcguuuguuugggcaacggaaaaggagaauggaccuguaagccuauugcugaaaaauguuuugaccaugcugccggaacuucauacguagucggggaaaccugggagaagccuuaccaaggguggaugauggucgacuguacuugucucggagaagguagugguaggauuacuuguacaucuaggaaccggugcaaugaccaggacacuaggacuuccuaucgcauaggggacacguggaguaagaaggauaacagagggaaucuguuacaaugcaucugcacuggaaacggucgaggagaguggaagugugaaagacacaccagcgugcagaccacuucaagcgggucgggccccuuuacugauguuagagcugccguguaccagccacagccacacccgcagccgccacccuacgggcacuguguuacagauuccggcgucguauauucaguuggcaugcagugguuaaaaacgcaggguaauaaacaaaugcucugcacuugucucgguaacggaguuucuugccaggaaaccgccgucacucaaacauauggagguaacucgaacggggagccuugugugcugcccuucacuuacaauggucgaacguucuacagcugcaccacggaaggcaggcaagauggccaccuauggugcucaacaacauccaauuacgagcaggaucaaaaguacucuuucuguaccgaucauaccguccuaguacagacaagaggcggaaacucaaacggcgcccugugccauuuuccuuuccuuuacaacaaccauaacuacacagacugcacaagcgaggggaggcgcgacaauaugaaguggugcggcacaacacagaacuacgacgccgaucagaaguuuggauuuuguccaauggcagcucacgaggaaaucuguacgaccaacgaaggagugauguaucgaaucggugaccaaugggacaaacagcaugacauggggcacaugaugagauguaccugcguggggaacgguagaggcgaauggacuugcauugcauacucacagcuccgggaccaaugcaucguggacgacauaacauacaaugugaaugacaccuuccacaaaaggcacgaggaagggcacaugcuaaacugcaccuguuucggacaaggacgugguagauggaaaugugacccaguggaccagugccaagacagcgagacuggaaccuuuuaucagaucggcgacucaugggagaaguacguccauggcgugcgauaucagugcuauuguuauggccgugggauuggugaauggcauugccagccacugcagacauauccgucuaguucagggccaguagaaguuuucaucacagagacuccaagccaaccaaauucccauccgauccaauggaaugcuccucagccuucucacauuucuaaauauauuuuacgauggaggccaaagaauagcgugggcagauggaaggaagcuacaaucccaggacaucuuaacagcuacacuauuaagggccugaagccaggcgucguauaugaagggcagcugaucagcauacaacaguacggacaccaagaagugacuagguuugacuucacaacgaccuccacuucuacuccagucaccucgaacaccgugaccggugagaccaccccauuuaguccccucguggcaaccuccgagucugugaccgagauuaccgcauccucuuucgugguaaguugggugagcgccuccgacacaguguccgguuuuaggguugaguaugagcuuagugaagaaggcgaugagccacaguaccuggaccuucccucuacugcuaccucuguaaauaucccugaucugcuucccggacgaaaguauauugugaaugucuaucaaauaagcgaagauggcgaacagucgcugauccugagcaccucccaaacaaccgcccccgaugcaccuccugacacgacuguugaccagguggacgacacuucuaucgucgugcgcuggagccgcccccaagcccccaucacaggauaccgcauuguuuauucucccagcgucgaagguuccagcacggaacuuaaccuucccgagaccgccaacuccgucacgcugagcgaucugcagccaggaguccaauauaauaucacuaucuaugcaguugaggaaaaccaggaaucgaccccaguaguuauucagcaagaaacaacaggaacucccagauccgacaccguacccagcccuagggauuuacaauuugucgaggucacagacguaaaaguuacaauaauguggacgccaccugagagcgcagugaccgguuacagggucgacguaauucccguuaaucugcccggugaacacggccagcgccugcccaucucccguaacacauucgcugaagugaccgguuuaagccccggcgugacuuacuauuuuaaaguguucgccgugucacacggaagggaaucaaagcccuuaacugcacaacagacuaccaaguuagacgcaccuaccaaucuacaguuuguuaaugaaacugacagcacagucuugguucgauggacuccacccagagcccagauuacggguuacagauugacaguaggucugacaagacgcgggcagccacgacaguacaaugucgguccuagcguuaguaaguacccauugcgcaacuuacaaccagccuccgaguauaccguuuccuuaguagcuaucaaagggaaccaggaaagccccaaagccacuggcguguucacgacacuucagccgggcagcagcauaccucccuacaacacagaagucaccgagaccacuauuguuaucacauggacccccgcgccacgcaucggauucaagcucggcguacggcccagucaaggaggagaggcaccacgagaagugacaucagacuccggcuccauugucguguccggucuuacaccugggguggaguacguguauaccauccagguccugcgugacggacaagagagagaugcgccgauagucaauaaaguuguaaccccacugucuccaccaaccaauuuacaucuggaggcuaacccggacaccggagugcucacagugucaugggaacgcagcacaacgcccgacaucaccggauacagaauuacgacaacccccaccaacggacaacagggcaacagccuagaagagguugugcacgcggaccagucuagcuguacauuugauaaccugucacccggacucgaauauaauguuagcgucuauacugucaaagacgauaaagagucuguccccauuagugauacaaucauuccagccgucccuccuccaacugacuugcgcuuuaccaauaucggaccagacaccaugcguguuacgugggcuccuccaccaucuauugacuuaacuaauuuucuggugagguacucacccgugaaaaacgaggaagauguagcagaauuauccaucagccccucagacaaugccgugguguuaaccaacuugcucccaggcaccgaauacguagugagugugagcucaguguacgagcagcaugaauccacuccacuucgaggcaggcagaaaacuggucuggauucuccuaccgguauugauuuuucugauauaaccgcuaacucauuuacuguacacuggauagccccucgcgccacaauuacaggcuaccggaucagacaccacccagaacacuuuuccggcaggccucgcgaggacagagugccacacucccggaacucuaucacccuuaccaaccuuacccccggcaccgaguacguggucagcaucguugcccucaacgggagagaggaaucuccucuccugaucggacaacagucuacugucucagacguuccucgggauuuggaagugguagccgcaacaccgaccucccugcuuaucucuugggaugcuccugccgucacaguccgcuauuaucgaauuacuuacggggaaacuggaggcaauucgcccgugcaagaauuuaccguaccuggcuccaaaucuacagccacuauaagcggucucaaaccuggagucgacuacacgaucacggucuacgccgugacagggagaggcgauaguccagcuucauccaagcccauuucuauaaauuaucgcacagagaucgacaagccuucacagaugcaagugacagauguccaggacaacucuaucagugucaaauggcugccaucuagcuccccaguuacaggguaucgcguuacaacaaccccuaagaacggcccaggccccacuaagacuaagacagcaggccccgaucagacagaaaugacaauugagggccuccagcccacuguugaauauguaguaagugucuaugcucaaaauccaagcggggagucacaaccuuuaguccaaacugcaguuacuaccaucccugccccaacugaucugaaauucacacaaguuacaccuaccaguuugagugcccaguggaccccaccuaacgugcagcugacuggauacagaguucgagugacaccuaaggagaaaaccgggcccaugaaagagaucaaucuggcuccugacucaucuucugucguugucuccggauugaugguugccaccaaguacgaaguuuccguguaugcuuugaaggauacauugacuucccggccugcccaaggagucgugacuacccuagaaaacgugucccccccgagacgagcccgcgugacggacgcuaccgaaacaaccaucacaauuaguuggcgcaccaagaccgagaccauuaccggauuccagguggacgcggucccagccaacggacagacacccauucagcgcacaaucaaaccagacguaagaagcuauacaaucacuggacuacaaccuggaaccgauuauaaaaucuaucucuauacauuaaacgauaacgcuagguccucacccguugugauagacgcuaguaccgcgauugaugccccaagcaauuuaagguuuuuagccacuacuccaaauagucugcucgucagcuggcaacccccucgcgcccgcaucacuggauauauuauaaaauacgaaaagccaggaucuccgcccagggaggucgugccccguccccgaccuggcgucacugaggcaaccauaaccggccuugaacccgggacagaauacacuaucuacgugaucgcucucaaaaauaaccaaaaaagcgagccccuuauugggagaaagaaaacagugcaaaagacuccauuugugacacacccgggauacgacacugguaacgggauacagcuccccgguacaaguggacagcaaccuaguguggggcaacaaaugaucuucgaggaacauggguucagacgcaccaccccuccaacaacagcaacacccaucagacauaggccgagaccauauccucccaacgucggccaggaggcccugucacaaacuacuaucagcugggcuccuuuccaggauacuucagaauacaucaucuccugucauccugucggcacggaugaagaaccucugcaguuucgaguuccgggaacguccacaagugccacacuaaccggucugacacgcggagcuaccuauaaugugauuguggaagcucugaaggaccagcagagacacaaggugagagaggaaguggugacagucggaaauagcguuaaugagggguuaaaccagccuacagaugacaguugcuucgacccauacaccgugagucacuacgccgugggugaugagugggagcggaugagcgaaucuggauucaaacugcucugccagugcuuagguuucgggucaggacauuuuaggugcgauucgagcagauggugucaugauaauggggugaacuacaaaaucggggaaaaaugggacagacagggagagaacgggcagaugauguccugcaccugcuuagggaaugggaaaggcgaguuuaaaugcgacccgcacgaggcgacauguuacgaugacggcaagaccuaccacgugggagaacaguggcaaaaggaauaccucggcgcuauaugcagcuguacaugcuuugggggccagcgaggguggcgcugcgacaauugcagaaggcccggaggugaaccaagcccagaaggaacaacuggacaaaguuauaaccaguacagccagcguuaucaucaaagaaccaacacaaacgugaauuguccuaucgaauguuucaugccgcucgacguccaggccgaccgcgaagacaguagggaguag

SEQ ID NO: 31902 - RNA, 1974 nt, Artificial Sequence
  Description of Artificial Sequence: Synthetic coding sequence
augcugaggggaccgggcccuggccuccuguuauuagccguacaaugucugggcacagccguuccuagcacgggagcaucaaagucuaagcgccaggcacaacaaaugguccagccccagucucccgucgccgucucccaguccaaaccaggaugcuaugacaauggaaaacacuaucagaucaaccagcagugggaacggacauaccugggcaaugcccucgucugcaccuguuauggagguucuaggggcuucaauugugaaucuaagccugaggcggaggaaaccugcuucgauaaauauacugggaauacauaccgcgugggggacacauacgaacgaccaaaggacagcaugaucugggauuguacuugcaucggagccggucgcggcagaauaucauguacuauugccaaucggugccaugaaggaggccaaucuuauaaaauuggcgauacauggagaagaccucacgagacugggggguacaugcuugagugcgugugccugggaaauggaaagggcgaauggacuuguaaaccgaucgcggaaaaaugcuuugaucacgccgcagggacaucuuaugugguuggagagaccugggaaaagccauaccagggauggaugaugguugacugcacaugucuaggagaagggagugggcgcauuacauguacuagcaggaaucguuguaaugaccaagauacaagaacaucauaucgaauuggcgauacauggucuaaaaaagauaaccggggaaaucuccuucagugcauuuguacaggaaauggcaggggagaauggaaaugugaaagacauacaagcguacagacaacuucuaguggaucaggcccauucacggacgucagagccgcaguguaucagccccagccacauccccaacccccucccuacgggcauugugugacggacagcgggguggucuacagcguggggaugcaguggcucaagacacaaggaaauaagcagauguuaugcacuugucucggcaauggaguaucaugccaggaaacugcggugacacagacuuauggcgguaauuccaacggugaaccaugcguauugccauuuacauacaacggacguacuuuuuacucguguacaacugaaggccgccaggacgggcaccugugguguagcacuacaagcaauuacgaacaagaucagaaguacuccuuuuguacugaucacaccguucugguccaaacaagaggagguaacucaaacggagcauugugccacuuuccauucuuguauaacaaucacaacuauaccgacuguacuucugagggcaggagggacaauaugaagugguguggaacuacucagaacuacgaugcagaucagaaauucgguuucuguccuauggcugcccaugaggaaauuugcacaacuaaugaaggcgucauguacagaauuggagaucaaugggacaaacagcacgauaugggucauaugaugcgcuguacguguguuggaaacggacguggcgaguggaccuguauugcauauucucagcucagggaucaguguauagucgaugauaucacauacaaugugaacgauaccuuucacaagagacacgaggagggacauaugcucaacuguaccugcuuuggccagggcaggggccgguggaagugcgaccccguggaucagugccaggacucagagacuggaacguuuuaccagaucggcgacagcugggagaaauacgugcauggcguaagauaucaauguuauuguuaugguaggggaauuggugaguggcacugccaaccccugcaaacauacccauccucauccggaccaguggaaguguuuauuaccgagacccccagccagccaaauagucacccuauccaguggaacgccccucaaccuagccauauuuccaaguacauucucagauggcgccccgugucuauucccccacggaaccuaggcuacuag

SEQ ID NO: 31903 - RNA, 6804 nt, Artificial Sequence
  Description of Artificial Sequence: Synthetic coding sequence
auguuaagaggccccggcccuggccuacuccuucuggcgguucaauguuuggggacugccgugcccaguacaggcgcaucaaaaucgaagcgacaagcccagcagauggugcagccacagucccccguugccgucucucaaagcaaacccgguugcuaugacaacggaaagcauuaucagauuaaccaacagugggaacgcacguaccucgguaaugcucuggugugcaccuguuacggaggguccagagguuucaacugugaaagcaaaccugaggcugaagagacuugcuucgauaaguauaccggaaauacguauagagugggugauacauaugagagaccuaaagacagcaugauuugggauuguaccugcauuggugccgggcggggucggauaucauguaccauugcaaacagaugccacgaagguggacagaguuauaaaauaggcgacaccuggaggcggccacacgaaacugggggguauaugcuggaaugcguuugccugggaaacggaaaaggggaauggacuugcaagccgauagccgagaaauguuuugaccaugcugccggaacuuccuauguugucggcgagacuugggagaaaccauaucaaggcuggaugaugguggacuguacuugccucggcgagggcuccggucgaauuaccuguacaucccgcaaccgauguaaugaucaagacacgcgcacuucauacagaauuggugacaccugguccaagaaagacaaccggggaaauuuacugcagugcaucugcacaggaaacggacgaggcgaauggaaaugcgaaaggcacaccuccguucagacuacaaguucagggagcggcccuuuuacagacguacgcgcugcugucuaccagccacagccccauccccaaccaccuccuuacggacauugcgugaccgacaguggcgugguauacuccgucgguaugcaguggcugaagacucaaggaaauaaacaaauguuaugcacgugccuuggaaauggcguauccugccaggaaacugcagugacccagaccuauggagggaacucaaacggugagccuugcguucuaccauucaccuacaauggacggacauucuacucuuguaccacagagggacgacaggacggccacuuaugguguagcaccacuagcaacuacgaacaggaccaaaaguacaguuucugcacagaucacaccguacucguucagacccggggagguaauagcaacggcgcccugugucacuucccuuucuuguauaacaaucauaacuacacugacugcaccagugagggccgccgcgauaauaugaaauggugcgguacaacucagaauuaugacgccgaucagaaauucggauucugcccaauggcagcacacgaggagauuuguaccacaaacgaagggguaauguaucgcauuggagaucagugggacaagcaacacgauaugggccacaugaugagguguacuugcgucgggaaugggcgcggugaauggacguguauagcguacucgcagcuucgggaucaaugcauuguugacgauaucaccuauaacguaaaugauacuuuucacaagagacaugaggaggggcacauguugaacugcacuugcuucggucagggccgcggcagauggaagugugauccuguggaucagugucaggacucagagaccggaacauucuaucaaauuggggauucaugggagaaguaugugcacggcgugagauaucagugcuauuguuacgggagaggaaucggugaauggcacugucagccucugcagacuuauccaucuagcuccggucccguugaaguuuucaucacugagacgccaucccaacccaacucucacccuauucaguggaacgcaccccaacccucccauaucuccaaauacaucuuaagauggaggccuaaaaacucagucgggcgcuggaaagaagccaccauaccaggacauuugaacagcuauacaaucaagggccucaaacccggcgucgucuaugaaggccaacuuauuuccauucagcaguacggucaccaggaagugacgcgcuucgacuucacaacuacuucuacaaguacacccguuacguccaacacugucacuggcgaaacgacacccuucaguccucugguagcaaccucugaaagugucacagagauuaccgccucaucauucguagugucauggguaagcgcaucagacaccguuucaggcuuucggguugaguaugagcuguccgaggaaggugaugaaccccaguaccuggaccucccaagcacagccacuaguguuaauauaccggacuuacuuccugggcgcaaauacauaguaaacgucuaucagaucagcgaggauggggaacagucccuuauucuauccaccucacagacaacggccccagacgcccccccugacacuacuguggaccaggucgacgacaccuccaucgucguccguuggucccgcccacaggcuccaauuacaggcuaucgcauugucuauagcccaagcguggaggggagcucaacugaauuaaauuuacccgaaacugccaacagcguuacacuguccgaccuccaacccggcguacaauauaacauuacuauuuaugccgucgaggaaaaccaagaauccaccccuguggucauccagcaagaaacuacuggcaccccuaggucagacaccguaccaucgcccagggacuugcaguuuguugaggugacugauguaaaaguuacaauuauguggacuccucccgaaucagcagugaccggguaucgugucgaugucauuccagugaaucugccuggcgaacauggucaacgccuacccaucaguagaaacaccuucgcagagguuacuggccugucccccggcgugacguacuauuuuaaggucuuugcugugucacacggccgcgaaucaaagccccucacagcccagcaaacaacaaaacuggacgccccaacaaaucugcaauuugucaacgagacugacucaaccguccucguuagguggaccccaccucgcgcucaaauuacuggauaucgccugaccguaggacugacccgaaggggucagcccagacaguauaacgucgguccguccgugucaaaauauccucugagaaaucuccaaccugccagcgaguacaccguuucccucgucgcuauuaaaggcaaucaggaaagcccuaaagccaccggcgucuuuaccacucugcagccaggaagcucuauccccccguauaacaccgaagugaccgaaacaacgaucgugaucaccuggacaccagcccccagaaucgguuucaaacuuggcguaagaccuucccagggcggcgaagccccucgcgaaguuaccagugacucggguaguaucguaguauccggucuuacacccggagucgaguacguuuacacaauccagguacucagagacggucaggaacgggaugcuccaaucgugaacaaaguggugacuccucugagcccuccaacuaaccugcaccucgaggcgaacccagauacaggcgugcucaccgucucgugggagagaaguacgacucccgauaucacaggcuaucggaucacgaccacuccgacuaacggccagcaaggcaauagcuuagaggaaguuguucacgccgaccagucuucuugcacuuuugauaaucuaucccccggccucgaauacaaugucuccgucuauacagugaaggacgacaaagagucugucccuauuuccgacacuauaauucccgaggucccccaguugaccgaucugucuuuuguugacauuacugacuccucgauuggccuccguuggacaccccugaacucauccacaaucauugguuaccggauaacaguuguugccgcaggugaaggcauucccauauuugaagauuucgucgacucuuccguuggauauuauacugucacuggacuggagccagggauagacuaugacaucagugugaucacccuuauaaacggcggggaaucagcacccacaacucugacgcaacagacugcaguccccccucccaccgaccucagauucaccaauaucgggcccgauacuaugcguguuacgugggcuccaccaccaaguaucgaccuuacaaauuuccucguccgguauucaccagucaaaaacgaagaagacguggccgaauugagcauuucaccguccgacaacgcagucguacucacuaaccuccuccccggaaccgaauaugugguaucuguguccucaguuuacgaacagcacgaaagcacaccacuacgcggccgacaaaaaacgggccuggacucucccacugggauugacuuuucugacaucaccgccaacagcuuuaccguucauuggaucgcuccaagagcuacaaucacaggauauaggauaaggcaucauccagagcacuucuccggcaggccacgcgaggauagggucccgcauucucgaaacaguaucacucugacuaaucugacuccaggcacagaguauguagugagcaucguagcucugaauggaagagaagaguccccauuacugaucgggcagcagucaacagucucagauguuccccgcgacuuggagguagucgccgccacucccaccagucuacucauuucaugggaugcacccgccgugaccgugcgguacuacagaaucaccuacggagagaccggaggaaauagcccaguccaagaauucacagugccugguuccaaaagcaccgcaacuaucagcggucugaaacccggagucgacuacaccauaacugucuaugcugugacuggacguggagauagcccugccucuaguaaacccauuagcauuaacuaccgaacugaaauugauaaacccagucagaugcaaguaacugacguccaagacaacucaaucagcgugaaaugguugccaaguagcucuccagugacaggcuaccgcguuacaacuacacccaagaacggaccuggaccuaccaaaacgaagacagccggaccagaucagacagaaaugacaauagaaggucugcagcccacaguugaguaugucgucuccgucuaugcacagaaccccucaggagagucccagccccugguucagacagcaguaacaacgauaccugcaccuacggauuugaaauuuacucagguuacgcccacaucuuuaagcgcucaauggacaccucccaaugugcaacucaccggauaucgugugcgggugacaccaaaggagaagacagggcccaugaaggagaucaaucucgcaccagacuccucuucuguuguuguuuccgguuugauggucgccacuaaguacgaagugaguguguaugcucucaaggauacgcugaccucaaggccagcccaaggggucgugacuacacuugaaaaugucagcccgccuagaagggccagaguaacugacgccaccgaaacgaccaucacgauuuccuggagaacuaaaacagaaacuaucacuggcuuucaaguugaugcagugccagcaaaugggcagacaccuauacaacgcacaaucaaacccgaugugagaucuuacacaauuacuggccuucagccugggacagauuacaagauuuaccuuuacacccugaacgauaaugcaagguccaguccagucgugauugaugcgucaacagccauugacgcuccaucuaaucugcgauuucuggcaacaacuccgaacucccuguuagucagcuggcagcccccacgcgcucgaaucacuggauauauuauuaaguaugaaaaaccugggagccccccuagagaaguggucccacgaccucgcccgggcguuacggaagccacuaucacuggcuuagaacccgguaccgaauacaccaucuacgucauugcuuuaaagaacaaucagaaaucggaaccuuuaaucgggaggaagaagaccggacaagaggcacugagucaaaccaccaucagcugggccccuuuucaggacacguccgaguacaucauuucaugccauccugugggcaccgaugaggagccgcugcaauuccgagugccaggaacuaguacgucugcuacccugaccggccugacccgaggugcgacuuacaaugugaucguagaagcgcugaaggaccagcagcgccacaaaguuagagaggaggugguuacuguggggaacucugugaacgaagguuugaaucagccgacugacgauucguguuuugauccuuauaccguaucccacuaugccguaggagaugagugggagaggaugucagagucugguuucaaacuccuaugccagugcuugggauucggcagcggacacuuucgaugugacucuucaagguggugucacgauaauggagugaacuauaagaucggugagaaaugggauaggcaaggggaaaauggacagaugaugaguugcacuugccuggguaaugguaagggugaguucaaaugcgauccucacgaggcuacauguuaugacgaugggaagaccuaucacgugggggaacaauggcagaaagaguaccugggagcgaucuguagcuguacuuguuucgggggacaacguggauggcguugcgacaacuguagacgcccggggggggaaccuagcccugagggaacuaccggacaguccuacaaucaauacagccagagauaucaucagaggacaaauacaaacguuaauugccccauagaauguuucaugccauuggacguucaggcagacagggaagauuccagagaguag

SEQ ID NO: 31904 - RNA, 6798 nt, Artificial Sequence
  Description of Artificial Sequence: Synthetic coding sequence
augcuucguggaccuggccccggccugcuuuuacuggccguucagugucucgguacagcagugcccucuaccggcgccucuaaauccaagagacaagcucagcaaauggugcaaccacagagccccguagcugugagucagucuaagccgggcugcuaugacaacggaaaacauuaccagauuaaucagcagugggagaggacuuaccuaggcaacgcauugguuuguacaugcuacgggggcagccgagguuucaacugugagaguaaaccagaagccgaggaaaccugcuuugacaaauauacuggaaacacguaccgggugggggacacauacgagaggccaaaggacagcaugauuugggauugcacaugcaucggagcuggaagaggccgcaucuccugcaccaucgccaaucguugccacgagggaggucagucuuacaaaauuggggauacauggagaaggccacacgagacgggcggauauaugcuggagugcguuugccuggguaacggaaaaggagaauggaccugcaagccaauagcugagaaaugcuucgaucacgccgccgguacuucauaugugguuggagagaccugggagaagccuuaucaaggauggaugaugguggacuguacgugucuaggcgaaggcagcggaagaaucacuuguacaagcagaaaucgguguaacgaucaggauacacgcaccagcuaccggauaggggauacuuggagcaagaaggauaauagagggaaucuacuucaauguauuuguacugguaacgggcggggggaguggaagugcgagagacauacaagcgugcagacaacauccucaggauccgggcccuuuacagaugugcgggcugcaguguaccagccccagccccacccccagccaccccccuauggacacugugucaccgauucaggcguuguguauuccguuggcaugcaguggcugaaaacucaaggaaauaaacagaugcugugcacaugucucggcaauggagugucgugucaggagaccgcugugacacaaacauacggaggaaauagcaauggcgagccauguguccugccuuuuacauacaaugggagaacauucuacucauguacuacagaagguagacaggacgggcacuuguggugcucuacgacguccaauuaugagcaagaucaaaaguauucuuucuguacugaccacacuguacugguccagacuaggggcggcaacucuaauggugcucugugccauuuuccauuuuuauacaacaaccacaauuauaccgacugcacgagcgaaggaaggagggauaauaugaaguggugcggcacgacucaaaacuacgaugcagaccagaaguucggguucuguccuauggcagcccacgaggagauuuguacaacaaaugaaggagucauguaucgaauuggggaccagugggauaaacaacaugacaugggccacaugaugagaugcacuuguguaggcaaugggcgaggcgaauggaccuguaucgccuacucucaguugcgggaucaguguauugucgaugauaucacuuacaaugugaacgacacauuccacaagaggcaugaagaaggacauauguugaauugcaccuguuuuggacaaggacgcggccgauggaaaugugaucccgucgaccaaugccaggacagcgaaacagguacauuuuaucagaucggggauaguugggagaaauacguucauggggugcgguaucagugcuacugcuacggucggggaaucggcgaauggcauugccaaccacuccaaaccuauccaaguagcagugggccuguggaaguauuuauuacugagacccccucacagcccaacucccauccaauccaguggaacgcuccucagccaucacacaucucuaaguauauucucagauggcgaccaaaaaauucuguaggccgauggaaagaagccacaauccccggacauuugaauuccuauaccauaaaaggucuaaagcccggcguugucuacgaaggacaacugaucucaauacagcaguauggacaucaagagguuacaagguuugacuuuaccacaacaucgacuuccaccccugugacaagcaauaccgugacuggcgaaacaacucccuucucacccuugguagcuacuagcgagagcgugacugagauaaccgcauccuccuucgucgugucuugggugagugccucugauaccguuaguggguuucggguagaguaugaacuuagugaggaaggagaugagccccaauauuuagaucuucccagcaccgccacguccguuaacaucccagaccuucuccccggacgcaaauauauagugaacguguaucagauuucggaggauggcgaacaaagucucauucugucgacaagucaaacaacagcccccgacgcuccccccgacacuacuguggaucagguggaugauacgucuaucguuguuagauggucuagaccacaagccccuauuaccggguaccguauuguauacucuccguccgucgaaggaucaucuaccgaacucaaccuuccugaaacugcgaacucagugacucuuucugaccugcagccgggcgugcaguacaauauaacuauuuacgcugucgaggaaaaucaggaaaguacccccgucgugauccagcaagagaccaccggaacgccuagguccgauaccgugccaucucccagagaucuucaauuugucgaggugaccgacguuaaagugacaauuauguggacuccccccgaaucagcugucacugguuacagaguggacgugauaccuguuaacuuacccggcgagcacggccagcgcuugccaauaucaaggaauacauuugcagaggugaccgguuugagucccggcguaaccuacuauuuuaagguauuugcugucucacauggccgcgagaguaagcccuuaacagcacaacagacuacaaaacucgacgcaccgacaaacuugcaauucguuaaugagacggauagcaccguuuugguucgauggaccccaccuagagcucagauuacaggauauagacugacugucggguuaacaaggagaggacagccgcgacaguacaacguugguccgagcgucagcaaauacccacugagaaaucuucagccggcgagcgaguauacugugagucuuguggcaauuaaaggcaaucaggaaucacccaaagcgacuggagucuuuacuacuuugcaaccaggaucuuccaucccgcccuacaauaccgaggugaccgaaacgacaaucgugauuaccuggaccccugcaccacggauuggauuuaaacuggggguucggccuagucagggcggagaagcaccacgcgaggugacuucugauucaggcaguauuguaguaagcgggcugacuccagguguugaauacguguauaccauucaggugcuccgugacggacaggagagagacgccccuauugucaauaaagugguuacaccauuaagccccccuacuaaucuccaccuagaagccaacccggacaccggcguguuaacagucuccugggaacgguccacaacucccgacauaaccggguauaggaucaccaccacuccaacaaauggccagcagggaaauucauuagaggaaguuguucacgcugaccaauccuccuguacuuuugacaaucugagcccuggccuggaauacaacgugucuguuuauacugugaaagacgauaaagagagcgucccaauaagcgauacaaucauuccggcugugccccccccuacagacuuacgauuuacaaacauuggccccgauacuaugcgcgucacuugggcaccaccaccuucaaucgaccugacuaauuuucucgucagguacucuccaguuaaaaaugaagaagauguggccgaauugucuaucucacccucugauaacgcuguuguucucacaaaucuccuaccugggacagaguacguggugucugugucauccgucuaugagcagcacgagucaacgccucugagagggcggcaaaagaccggacucgacucucccacagguaucgauuucucugacaucaccgccaauuccuuuacaguacauuggauugccccccgcgccaccaucaccgguuauagaaucagacaccacccugaacacuuuagcggacgccccagagaggauagagugccucacucacggaacagcauuacuuugacaaaucugacacccggaaccgaguacguggucucaauugucgcccucaauggaagagaagaaagcccacuacugauuggacaacaauccacagucuccgauguaccucgcgaccuugagguagucgcugcuacacccaccagccuuuuaauaucaugggacgcuccugcuguuaccgucagguacuaccguauaaccuauggcgagacagggggaaauagcccggugcaagaauucacugugcccggaagcaagucaacugccacuaucucuggacugaaaccagguguugauuauacuauaacaguguacgcugugacaggccguggugacucccccgcaagcucaaagccuauaucaauuaauuacagaacugagaucgacaagcccucccagaugcaggucacagacguacaagauaauagcaucucaguuaaguggcugccuuccaguucccccgugaccggcuaucgagucacaacuacccccaaaaacggccccgggcccaccaaaacaaagacggcaggcccugaccaaacagaaaugaccaucgaaggacugcaaccuacuguggaguacgucgucagugucuacgcucagaauccaaguggcgaaucacagccguuggugcagacugcagugaccacgauuccugccccaaccgaucucaaguucacucaagugacuccaaccucccucuccgcccaauggacccccccaaacguccaacuaaccgguuaccgcgugcgggugacccccaaagagaaaacugguccuaugaaggagauuaaccuugcucccgauuccucuucaguggucgugucuggacugauggucgcaacuaaguaugagguaucaguuuacgcccucaaggacacucugacuucuaggccugcacagggaguugugacuacacucgaaaacgucucuccaccccgccgcgccaggguuaccgaugcgaccgaaaccaccauuacuaucagcuggagaacuaagaccgagacaaucacuggauuccaggucgacgcagugccugcgaacggccagacaccgauucagcggaccaucaagcccgacgugcguucuuacacgauuaccggauugcagccuggcaccgacuauaaaaucuaucucuacacacugaacgauaaugcccgaaguagucccgugguuauugaugccucuacagcuauugaugccccaagcaauuugagauuucuggccacuacuccaaacucauugcucgucaguuggcagccaccuagggcaagaauaacaggauacauaaucaaauaugagaagcccggcucgcccccuagagaagucgucccuaggccccggcccggugucacagaagccaccauaacuggcuuggaaccuggcaccgaauacacuaucuaugucauugcucuuaaaaacaaucagaagagcgagccucugaucggucgcaaaaaaacagaugagcucccccaguuggugacucugccccaucccaacuugcauggaccugagauccuggacguuccgagcacuguacagaagacccccuuuguuacacauccuggcuaugacaccggaaacggcauccagcuccccggcacaucuggacaacagccaucaguaggacagcagaugaucuucgaggaacacggauuccgccgaacaacgccucccacuacugcuacacccauccgccaucgaccaagaccauauccaccgaaugugggccaggaagcacugucacagaccacuauaucaugggcuccauuccaggauaccucagaauacauaaucaguugccacccugucgggacagaugaagaaccucuucaguucagaguccccggaacuucaacgagugcaaccuugaccggacugacucguggugccacauacaacguaaucgucgaggcucugaaggaccagcagagacauaaggugcgagaggaaguggugaccgucggcaacaguguuaaugagggucugaaccagccaacugaugauucuugcuucgaucccuauacaguuagccauuacgcagugggcgacgaaugggagcguauguccgaaagcggcuuuaaacuacugugccaguguuugggguucgguagugggcauuuccgcugcgacuccucuagguggugccacgacaacggggugaauuacaagauaggcgaaaaaugggacagacaaggggagaauggacagaugaugagcugcacgugccugggcaacggaaagggagaauuuaaaugcgauccgcaugaagccacauguuacgaugacggcaagacuuaccacguuggcgaacaauggcagaaggaguauuugggagcaaucuguagcugcacauguuuuggugggcagcgagguuggcggugcgacaauuguagaagaccuggaggcgaaccaucucccgagggcacaacaggccagagcuacaaucaguacucgcaaagauaucaucagcguacuaacaccaacgucaauugcccuauagaaugcuuuaugcccuuagauguacaggcugacagggaagacagucgggaauag

SEQ ID NO: 31905 - RNA, 6993 nt, Artificial Sequence
  Description of Artificial Sequence: Synthetic coding sequence
augcugcgcgggccuggacccggccugcuuuuauuggccgugcaaugccucgguacagccgugccuucuaccggagcuucuaagucaaaaagacaagcccagcagauggugcaaccacaguccccuguagcagugagccagagcaagccagguuguuacgauaauggcaaacacuaccaaaucaaucagcaaugggaaaggacuuauuugggcaacgcucugguaugcaccuguuacgguggcucuaggggcuuuaauugugagucaaagccagaagccgaagaaaccuguuucgauaaguacacagggaauacuuauagagugggagauacuuaugagagaccuaaagacucuaugaucugggauuguaccugcauuggagcuggaaggggccggauauccuguacaaucgcuaaucggugucacgaggggggccagucuuauaaaauuggugacaccuggagacgaccucacgaaacggggggguauauguuggaaugcguuugccucggaaaugguaagggcgaguggaccugcaaacccaucgcggaaaaaugcuucgaccaugccgcaggaacuucauauguuguaggagagacaugggagaagccuuaccagggauggaugaugguggacuguacuugccuuggcgagggcaguggaaggaucaccuguacuagcaggaaucggugcaacgaccaagacacacgcacuaguuacagaauuggcgacacauggagcaaaaaggacaauagaggcaaccuccugcaaugcauuugcacagggaacgguagaggagaauggaaaugugagagacauacgucagugcagacaacaucuagugggucuggaccauuuacagaugugcgggccgccgucuaccagccacagccccacccgcagccuccaccauauggccauugcgugacagacaguggaguggucuacucugucggaaugcagugguugaagacucaagggaauaaacagauguuguguacaugucugggaaacggggucucaugccaagaaacugcagugacacagaccuauggagggaacucgaauggagagccuugugugcucccuuucaccuacaauggccgaacuuucuauaguuguacaacugagggacgccaggauggacauuuauggugcuccacaacuuccaacuacgaacaagaccagaaauauagcuuuuguacugaucacacaguacugguucagacuagggggggcaauucuaauggagcguugugucauuuuccauuccuuuauaacaaucacaauuacacggacugcacuuccgagggcaggcgagauaacaugaaauggugcggaacgacccaaaauuaugacgcagaucaaaaauuuggcuuuuguccuauggcagcacacgaggagaucugcacaaccaacgaaggcguuauguaucgaauuggcgaucagugggauaaacagcacgauaugggacauaugaugcgcuguaccugcguaggaaauggaagaggagaguggaccugcauugccuauucacaacugagagaccagugcauuguagaugauauaacuuacaacgucaaugauacuuuucauaaaagacaugaagaaggacauaugcucaacugcacauguuuuggucaggggagaggucgcuggaagugugacccuguugaucagugccaagauucugaaacugggacguucuaccagaucggcgauaguugggagaaguacguucacggcguuagguaccaguguuauugcuacggacggggcaucggcgaguggcauugucagccacuccaaaccuacccuuccucaagcgggcccgucgagguguucaucacggagacuccaucacagccuaacucccauccaauccaauggaaugccccacagccaucucauauauccaaguacauccucagauggagaccuaagaacagcguggggagguggaaagaggccacaaucccuggacaccugaacagcuauacuauuaagggauuaaagccgggugucguauaugaaggucaauuaauuucuauucaacaguaugggcaucaggaagugacacgauucgacuucacuacaaccucgacaaguaccccaguaacaagcaacaccgugaccggugaaacuacacccuucuccccuuuaguggcuacuuccgagaguguuacugagauaaccgccucuucauucguagugucuuggguuucugcaagcgauacuguaaguggauucagaguggaguacgagcugagcgaagagggagaugaaccccaauacuuggaccugccuaguacagcaaccucugugaauauucccgaccuucuccccggcaggaaguacauaguuaacguuuaccaaauuagcgaagauggagagcaaucccugauccugagcaccucccagacgaccgcaccagacgcaccgccagauacuaccguagaucaaguagacgauacauccaucguggugaggugguccagaccccaggcaccaaucacagguuauagaaucguguacucuccauccguggaaggcagcucuaccgagcuuaauuuaccugagaccgcaaacucuguuacucuguccgaccugcaaccgggugugcaauauaauauuacuauuuacgcaguugaggagaaccaggaauccacccccguaguuauccaacaggagacgacaggcacacccaggagugacacagugcccagcccacgugauuugcaguuuguugaagugacagauguuaaaguuaccauuauguggacuccuccagagagcgccguaacaggguaccgaguugacguaauacccgugaacuugccaggugagcauggccagcgguugccuauuucaaggaacacauucgcagaagucacuggcuugagccccggcgucacuuauuauuucaaaguauucgccgugagucaugggcgggaaucuaaaccucugaccgcccaacagaccaccaaauuagaugcaccaaccaaccugcaauuuguuaacgagaccgacaguacuguauuaguucgcuggacuccuccucgcgcucaaaucaccggauaucgucuuaccguggggcugacaagacgagggcagccaagacaauauaacgucggaccuagcgucaguaaguauccgcugaggaaccuucaacccgccucugaauacaccgugucauugguggcuauuaaaggaaaccaggaaucuccaaaagcaacaggcguguuuacuacucugcaaccggggucaagcauaccgcccuacaacaccgaagugaccgaaaccacaaucgugaucacauggacacccgcuccucgaaucggauuuaagcuuggcgugaggcccucucagggcggugaggcuccgagggaaguaacuagcgacagcggcagcaucgugguguccggacugacccccggaguagaguauguauauacaauccaagugcuaagagacggccaggaacgagacgcuccaauagugaacaaaguugucaccccucucucaccuccgaccaaucuucaucuggaagccaacccagacacaggcgugcuuaccgugucuugggaaagguccacaaccccugacauuacaggcuauagaauaacuacgaccccaaccaacggccaacaggggaacucucucgaagaaguagugcaugcagaucagucuucuugcacuuuugauaaucucucucccggccuggaguacaauguaagugucuacacagugaaagacgauaaagaaagcguaccuaucagcgauacuauuauaccugcagucccuccaccaacugaccuccgauuuaccaauauaggcccggauaccaugcgcgucacuugggcuccaccuccgaguauagauuugacuaacuuccuggugcgguacagcccaguuaaaaacgaagaggacguggccgaguuauccauuucuccuagugauaaugcugugguacuuacaaaccucuugccuggaacggaguaugugguaagcguuuccuccguguacgagcagcacgagagcacaccccugagaggccggcagaagacaggucuugacucccccacuggaaucgauuuuagcgacauaacugccaacuccuuuacuguucauuggaucgcaccccgagcaacuaucaccggcuaucgaauuaggcaucaccccgaacauuucagcggccguccaagagaagaccgagugccucauucacguaacagcaucacauugacaaaccuaacccccggcaccgaguacguagugucuaucguugcucuaaacggccgcgaggagaguccacuguugaucggacagcagucuacgguuucugaugugccucgugaccuugaagugguagcggcuacuccgaccucgcuucugauuuccugggacgcuccugccguuacgguccgcuauuacaggauaacuuacggcgagacggguggaaacuccccuguacaagaauuuacaguuccaggcaguaaaagcaccgcuaccauuaguggccugaaaccaggaguggauuauacuauaaccguuuacgcugucacaggucgcggcgauucacccgccucgagcaagcccaucuccauuaacuaccgcacagagauagacaagccgucccaaaugcaaguuacugauguucaggauaauaguauuuccgugaaguggcuucccucgucuucccccgucacaggcuauagaguuacuaccacaccaaaaaauggcccgggaccgacuaagacaaaaaccgccggcccugaccaaaccgaaaugacaauugaaggccuucagccuacaguggaguaugugguguccguuuaugcgcagaacccuaguggagaaucucaaccucucguccagacagcuguuacgaauauugauaggcccaagggccuggcuuuuacggaugucgacgucgacagcauuaaaauugccugggagucaccucagggacaaguuagcagauauagggucacauacucaucccccgaagauggaauccaugaauuguuuccagcucccgacggugaagaagauacugccgaguuacagggccuccguccaggaagcgaauauaccgugagugucgucgcacugcaugaugauauggagucgcagccacugaucggaacacagucgacugccauccccgcgccaacugaucucaaauucacucaagucacaccaacaucccugagcgcccaguggaccccccccaacgugcagcuuaccggcuaucgggucagagugacaccaaaggaaaagacaggcccaaugaaggaaauuaaucuugcuccugacagcucaagugucguuguuagcggauugauggucgccacuaaauaugaagugucugucuacgcacucaaagacaccuuaacuuccagacccgcucagggagucgugaccacccucgaaaacguuucuccuccuagacgugcacgcgugaccgacgccacagaaacuacaauaaccauauccuggcgcacgaaaacugaaacaauuaccggguuucagguugacgccgucccagcuaacggccaaaccccaauucagcggacgaucaagccagacguacgaucuuacacaaucacaggacuccagccaggaacugauuauaagaucuaccuuuacacccuuaacgacaacgccagauccucaccggucgugaucgaugcuagcacagcaauugacgccccaucuaacuugagauuucucgcaacgacuccuaacucccugcugguguccuggcagccuccaagagccagaauaacaggguacaucaucaaguacgaaaaaccugguagucccccccgcgaaguuguaccccgcccuaggccuggcgucaccgaagccaccauuacuggauuggaaccuggaacugaguacaccaucuauguaauagcccucaagaauaaccagaaaucugagccacuaauugggaggaaaaagacuguccagaagaccccuuuuguaacccacccuggauaugauacaggcaauggaauucagcuucccggaacgucagggcagcagcccucaguuggccagcaaaugauauucgaagaacauggauucagacguaccaccccucccaccacugccacaccuauucgccacagaccucggccauaucccccaaaugugggccaagaagcccugucgcaaacuacuauuucaugggcacccuuucaagacaccucggaauauauuauuuccugucacccaguugguaccgaugaagagccucugcaguuucgcgugccaggaaccucgacaucagcaacgcuaacugguuugaccagaggagcaacauacaaugugauaguggaggcacuuaaagaccagcaacgucacaaggucagagaagaagucguaaccguaggcaauagcguuaacgagggucugaaccagccaacugacgauaguugcuuugauccauauacaguuagccauuacgcagugggagaugagugggaacguaugagcgaaaguggcuuuaaauugcuuugucagugccucgguuuuggaagcgggcauuuucggugugauucaucucguuggugccacgacaacgggguuaacuauaagaucggcgagaagugggaucggcagggagagaacggacaaaugaugaguugcacaugccuaggcaacggcaaaggugaguucaagugcgauccucacgaggcuacgugcuaugaugacggaaaaacauaucacguaggagagcaauggcaaaaggaauaucugggggcuauauguaguugcacguguuucggcgggcagcggggguggcggugcgauaacugcaggaggccaggaggggaacccucaccagaggggacaaccggacagaguuauaaccaauacagucagcgguaucaccaaagaaccaauacgaauguaaauugucccauagaauguuucaugccauuggauguucaagcagaccgagaagacagccgggaguag

SEQ ID NO: 31906 - RNA, 3312 nt, Artificial Sequence
  Description of Artificial Sequence: Synthetic coding sequence
cugcguuggaccccccucaauaguaguacaaucauuggcuauagaaucaccguggucgcugccggagagggcauucccauauuugaggacuucguugacucuucagucggauacuacacugugacagggcuugaaccagguauugacuaugauauaagcgucauuacucugaucaauggcggagaaagugcccccacaacucucacccagcagacggcugugcccccaccaacagaccugagauuuaccaauaucgguccugacacaaugcgcguuacuugggcaccuccaccuuccaucgaccuaaccaacuuuuuggucagguauagucccgugaaaaaugaggaagacguggcugagcuuucgauuuccccuagugauaacgcagucguccuaacaaaucucuuaccaggcaccgaguaugucgucagcguuaguagcguuuacgagcagcaugagagcaccccccuccgagggcgccaaaagacaggguuggacucaccaaccggaauugacuuuagcgauauaacagcaaacucuuuuaccguccauuggaucgcaccaagagcaacgauuaccggcuacaggauucgccaucacccugaacacuuuuccgggcgaccaagggaagaucgcgugccccauucucggaacaguauaacacucacaaaucuuacuccagggaccgaauacgucgucaguauuguagcccuuaauggacgcgaagaguccccccuacugaucggccaacagucaaccguaucggacgugccacgugaccucgaagucguagcugccacaccuaccucccugcugauuucuugggacgcgcccgcaguuaccgugcgauacuaucgcaucaccuauggggaaacaggcggcaauucgccaguccaggaguucaccgugcccggcagcaagucuacagcaacuauaucuggccugaaacccggugucgacuauacuauuacugucuaugcggugacaggaaggggugauucgccagcaagcucuaaaccuauuucaauaaauuaucgcacagaaaucgauaaaccuagccagaugcaggucaccgacguccaggacaauucaaucucaguaaaguggcuccccuccuccagccccgucaccggcuaccgagugaccacaacuccuaaaaacggacccggaccgacaaagaccaaaacagcuggccccgaucagacagagaugaccauagagggacugcaacccacaguugaauacgugguuucaguauaugcccagaaucccagcggggagagccagccccucgugcaaacugcagugacaacuaucccagccccuaccgaucuuaaauucacccagguuacaccuacuucacucuccgcgcaauggacaccaccuaaugugcagcucaccgguuauagaguucgagugacaccuaaggagaagacaggcccaaugaaggaaaucaauuuggcacccgauuccuccucaguagucgucuccggcuugauggucgcaaccaaguacgaggucuccguauacgccuuaaaggacacccugaccucaaggccugcccagggcguuguaacaaccuuggagaacguaagccccccucgcagagcccgugugaccgaugcgaccgaaaccacaauaacaauuaguuggaggacaaagacagagacgauaacaggcuuccaaguugaugccguuccugccaauggacaaacccccauccagcguacaaucaaacccgacgucagaagcuauacaaucaccggccugcagcccggaacagacuacaagaucuaccuguacacccugaaugacaacgccagaucaucuccaguugugauugaugccuccacagccaucgacgcccccucuaauuugagauuucucgcaaccaccccaaauucgcugcuuguuagcuggcagcccccccgagcucgaaucacuggauacaucauuaaguacgaaaagccagguuccccgccucgugaaguuguuccuaggccccguccaggcguuacugaggccacuaucaccggacucgaacccggcaccgaauacacaaucuacgucauagcgcugaaaaauaaccagaaaagcgagccacuuauuggccggaagaaaacagacgaacuaccacaacucgugacccugccacauccgaaccuacacggaccugagauucuugaugugccuagcacuguccagaagacccccuuuguuacacacccagguuacgauacgggaaacggcauccaacugccgggcaccuccggucagcagccaucaguggggcaacaaaugaucuuugaggaacacggcuuuaggcgaaccaccccacccaccacagccaccccaauaagacauagaccccguccuuaccccccgaacgugggcgaagagauccaaauuggccauaucccucgggaagacgucgauuaccaccucuacccacacgguccagggcugaauccuaacgcuagcaccggccaggaggcccuaucccagacaacaauuucaugggcuccguuccaagauaccagcgaguacauuauuucuugccauccaguugggacagacgaagagccauugcaauucagagugccuggaacuucaaccagugcuacccucacaggacuuacccguggagcuacauacaacgucauagucgaggcccuuaaagaucagcaaagacauaagguccgcgaagaaguggugaccgugggcaacuccguuaacgagggacucaaccagccaaccgacgacucuugcuucgauccuuauaccgucucacacuacgccgucggagacgaaugggagagaaugucugaauccggguucaagcugcuaugccaaugucugggauuuggaagcggccacuuucgaugugacagcagcagguggugucacgauaauggcguuaauuauaagauaggagaaaaaugggaccgccagggcgagaacggccagaugaugaguugcacaugucugggaaacggcaagggagaauucaaaugcgacccacacgaggccacauguuaugacgacggcaaaaccuaccaugucggagaacaauggcaaaaagaguaucuuggagcuaucuguucuugcaccugcuucggagggcagagaggguggcgaugcgauaauugccguagaccugggggagaaccgucgcccgaaggcaccaccggacagagcuauaaucaauauucucagcguuaccaucaacggaccaauaccaacgugaacuguccuauugaaugcuucaugccacuggacgugcaggcagacagagaagacaguagagaguag

SEQ ID NO: 31907 - RNA, 1062 nt, Artificial Sequence
  Description of Artificial Sequence: Synthetic coding sequence
auggaacuuaccgaacugcuacuaguaguaauguuacuucugaccgcuaggcuuacucugucauccccagccccccccgccugugaucugaggguccuuuccaaacuccuccgggauagucacgugcugcacagucgacucucccagugcccagaagugcauccccugccuacucccguucuccuucccgccguggauuucucccugggagaauggaagacccagauggaggagacuaaagcccaagacauccugggugccguaacucugcuguuagaaggggugauggccgcgagagggcagcugggucccacuuguuugaguagucuguuaggucagcugagcggucaaguccgucugcuacugggcgcucuccagagucuucuaggcacccaacuaccaccucaaggacgcacaacugcucacaaagauccuaaugcaauuuuucucucauuucaacaccuccuucgggggaagguuagguuucuuaugcucgucggcggcagcacccugugcgugagaagagcgccaccuacgaccgcugucccuucgaggacaucccuuguauuaacccugaacgaauuaccuaaccggacuagcgggcugcuugaaaccaacuucacagcaucugcuagaacuacuggguccgggcugcugaaauggcaacaaggcuuccgcgccaagauuccuggccuguuaaaucaaaccucccgcucccucgaccagaucccuggcuacuugaaccgcauucacgaacuguuaaacggcacuagaggccuguuccccggaccuucacgcagaaccuuaggagccccugauaucuccucaggcacuuccgauacuggcucgcucccaccuaauuuacaaccgggcuacuccccaagccccacacacccaccuaccggccaauacacucuuuuuccacugccuccaacgcuccccacuccugucgugcagcuucaccccuuauuacccgaccccucugcucccacuccuacccccacaagcccccugcucaauaccuccuauacacauucucagaaucucagccaggaaggcuag

SEQ ID NO: 31908 - RNA, 537 nt, Artificial Sequence
  Description of Artificial Sequence: Synthetic coding sequence
augaccguucucgccccagcuugguccccuaccacuuacuuauugcugcuacugcugcucagcuccggauuaagcgggacccaagacugcucguuccaacauagucccauuucuucugacuucgcugugaagauucgcgaacuaagugauuaucuccugcaggauuaucccgugacuguggccagcaacuuacaggaugaagaacugugcggaggacuguggagauuaguucuggcacaaagauggauggaacggcuuaagacaguggccggaucuaaaaugcagggcuugcuugaaaggguaaauacugagauccauuucgucacaaaaugugcuuuccagccuccccccucaugucuucgcuucgugcaaacaaacaucaguagacuccuccaggagaccagcgaacagcuaguggcccugaaacccuggauaacccgccagaacuuuucccgcugccucgagcuacagugucaacccgucgagacaguguuccaucgagucagucaggacggccuugaucuacucaccagcuag

SEQ ID NO: 31909 - RNA, 555 nt, Artificial Sequence
  Description of Artificial Sequence: Synthetic coding sequence
augagcagaacagccuauacagugggagcacuucuuuuacuccugggaacacuguugccagccgccgaaggcaaaaaaaaagguagucagggggccaucccaccacccgacaaagcucagcacaaugacuccgaacaaacccagagcccccaacagccuggauccagaaaucgagggagaggacagggacggggaacagcaaugccaggggaagagguccuggaauccagucaggaagccuugcauguuacugagcgcaaauauuuaaagcgugacuggugcaaaacacagccuuugaagcaaaccauccaugaggagggcuguaauagccgaaccauaauuaaccgcuuuugcuauggacaaugcaauuccuuuuacauuccacgacauauccggaaagaagaagggucguuucagucuugcagcuuuuguaaaccaaaaaaguuuaccacuaugauggugacucugaacugccccgagcuucaaccaccaacuaagaagaagcgagugacccgcguaaagcagugccgauguauuucgauagaccuggacuag

SEQ ID NO: 31910 - RNA, 432 nt, Artificial Sequence; identical to SEQ ID NO: 31729
  Description of Artificial Sequence: Synthetic coding sequence

SEQ ID NO: 31911 - RNA, 432 nt, Artificial Sequence
  Description of Artificial Sequence: Synthetic coding sequence
augucacgcacagcauauacagugggagcuuugcugcuccugcuggguacucugcuucccgccgcagaaggcaaaaagaagggaucccaaggcgcuauacccccccccgacaaggcccuacaugugacugaacgcaaauauuugaagagggacuggugcaaaacacagccguugaaacaaacaauacacgaggagggcugcaacucccgcaccauuaucaacagauuuugcuacggccagugcaacucuuucuacauucccaggcauauacggaaggaagaagguucuuuucaaucuugcuccuucuguaaaccuaagaaauuuacaacuaugaugguuaccuuaaauugccccgaacugcagccaccaaccaagaagaagcgugucacaaggguuaaacaaugucgcuguaucucuauugauuuagacuag

SEQ ID NO: 31912 - RNA, 2976 nt, Artificial Sequence
  Description of Artificial Sequence: Synthetic coding sequence
augcacagcccuggagccgacggcacccaaguaagucccggcgcccacuacuguaguccaacuggagccgguuguccuagaccaugcgcugacaccccagggccucagccccagcccauggaccugcgaguuggucagagaccucccguugaaccccccccagaaccuacgcugcucgcucuucagcggccucagagacuccaccaccaucuguuccuggcgggacuccaacaacagcgcagcguggaaccuaugagacucuccauggauaccccuaugcccgagcugcaggucggcccacaggagcaggaacuuagacaacuccugcacaaagacaaaagcaagaggagcgccguagcaagcagugugguuaagcagaaguuagccgaagucauccucaaaaagcagcaggccgccuuggagcgcacgguucacccuaacucucccggaauucccuauaggacauuggagccucucgaaaccgagggggcaaccagaagcaugcugaguaguuuucuccccccaguucccagccucccuuccgauccaccagaacauuucccauuacgaaagacugucuccgaacccaaccuaaaguugcguuacaagcccaaaaagagucucgagcgaagaaagaacccucugcuucgcaaagagagcgccccuccuucccugaggcggagaccugcugaaacacugggagauucuagcccuuccucauccaguaccccggccuccggcuguucuucccccaacgacagugaacacgggccaaauccgauucuggguucugaagccuuacugggccagagguugcgacugcaggagaccaguguugccccauucgcucugccuaccguuagucuguuaccugcuauaacuuuaggauugccagcgccagccagggccgauucagaccgccgcacccaucccacccucgggccccgcgggccaauacugggcucuccacauaccccccuguuucuaccacacggccucgagccugaagccggaggaacucuuccuuccagacuacagccuauucugcuuuuagacccuagcggcucacaugccccacuuuugacaguucccggucuuggcccucugccauuucacuucgcgcagagucuuaugacaaccgagagguugagcgguaguggccuccacuggccuuugaguagaacuaggagcgaaccauugccucccagcgccacagcaccgcccccaccaggacccaugcaaccacgauuagagcagcugaaaacacaugugcaggugauaaaaagaagcgcaaagcccuccgagaaaccuagauuaaggcaaauuccaagugcagaggaucucgaaacagaugggggcggcccaggacagguuguggacgauggguuagagcaccgagaacuugggcauggacagcccgaagcccgcggccccgcuccuuugcagcagcacccucagguucuucuaugggagcagcagcgacucgccggaagacugccucgaggcucuaccggcgacacagugcuacucccucuggcccaaggaggucaucggccacugucacgcgcucaguccagccccgcugcccccgcuucccuuagugccccggagcccgccagucaggcucgcguccuguccucuuccgaaacuccugcccgcacucuccccuucaccacaggccugaucuaugacaguguuauguugaaacaccaguguucaugcggagacaacucacggcacccugaacacgcugggcggauccaaucuaucuggagcaggcuucaggagagggggcugagaucacaaugcgaaugucugaggggacgaaaagcaagucuggaggagcugcagagugugcauagugagagacacguguuacuauacggaaccaacccucugagcaggcuuaaacuggauaauggcaaacuggcaggccuucuagcccaacgaauguuuguaaugcuaccuuguggcgguguuggaguggauacagauaccauuuggaacgaacuucauagcagcaacgcagcacggugggcugcaggauccgucaccgaccuugcauucaagguggccagccgggagcugaagaaugguuucgccgucguccgcccucccggccaccacgcagaccauuccacugccaugggauucugcuucuuuaacucaguagccauugcuugcagacaauugcagcaacagucgaaagcuuccaaaauacuaauugucgacugggaugugcaucacggcaacgguacccagcagacauuuuaccaagauccgucaguacucuacaucucucugcaccgccacgaugauggaaauuuuuucccuggaucaggggccguugacgaggucggcgcuggcuccggggaagguuucaaugugaaugucgccugggccggagggcucgauccucccaugggagaucccgaguaccuagcagcauuuagaauagucguuaugccaauugcccgcgaauuuucccccgaccuagucuuggugucagccgguuucgaugccgccgaaggucacccugccccuuuagggggguaccauguaagcgcgaaauguuuugguuacaugacgcaacaguugaugaaccuugccggaggagccgugguucucgccuuagagggaggccacgaccugaccgcgaucugugaugccucugaagcuugugucgcagcauugcugggaaauaggguugacccuuuaagugaagaaggcuggaagcaaaaacccaacuugaaugccauaagguccuuggaggccgucauacggguucauaguaaguacuggggcugcaugcagagacuagccaguugccccgacucuuggguucccaggguuccuggugcggacaaagaggaagucgaagccgugaccgcccucgccucgcugagcguagggauuuuagccgaagacagaccaucagaacagcugguugaggaggaggagccgaugaacuuauag

SEQ ID NO: 31913 - RNA, 588 nt, Artificial Sequence
  Description of Artificial Sequence: Synthetic coding sequence
augggaaaaaucucaucuuuaccaacacagcucuuuaaauguuguuucugugauuuccucaaggugaagaugcauacaauguccucaucacaucuguuuuaucuggcacuuugccucuugacuuuuaccucuagcgccaccgccggucccgagacacucugcggcgcagagcucguugacgcccugcaguuuguuuguggagauagaggauuuuauuucaauaaacccaccggguacgguuccucuuccagacgggccccucagacaggcauuguugacgaauguuguuuuagaagcugcgaucugaggagauuggaaauguacugcgcgccccuuaagccugccaaauccgcaagaagcgucagggcccagaggcacaccgauaugccuaagacccagaaguaucagccaccuagcacaaacaagaacaccaaaagccaacgaaggaagggcuggccaaaaacccauccaggcggcgaacaaaaagaggguacagaggcguccuuacagaucagagggaagaagaaggaacaacgccgugaaauuggaucaaggaacgcagaaugucgcggaaaaaaagguaaauag

SEQ ID NO: 31914 - RNA, 462 nt, Artificial Sequence
  Description of Artificial Sequence: Synthetic coding sequence
augggaaaaauuucuucuuugccaacacagcuguuuaaauguuguuuuugugauuuucugaaagucaaaaugcacacuaugagcuccagccaucucuuuuaucuugcucucugccuccugacuuuuacuucguccgcaaccgccgggccugagacucugugcggagccgaacucgucgaugcccuccaguucguuugcggagauagaggauuuuacuucaauaaaccaaccggguauggcagcaguucuaggcgcgccccccagacaggcaucguggacgaguguuguuucagauccugugaccugcggcgacucgaaauguacugcgccccacuuaaaccagccaaguccgcccgaagcgucagagcucaaagacacacagauaugccuaagacccagaaggaaguucaccugaagaaugcaucccgggguagcgcggggaacaaaaacuacaggauguag

SEQ ID NO: 31915 - RNA, 477 nt, Artificial Sequence
  Description of Artificial Sequence: Synthetic coding sequence
auggggaaaaucaguagcuugccaacccaacuuuucaaguguuguuuuugugacuuucuuaaggugaaaaugcacaccaugucaucuagccaccuguucuaucuugcccuuugucuucucacauucaccaguuccgcaacagccgggccugagacauuguguggggcugaacuagucgacgcccuccaguucgucuguggcgaccguggauucuacuucaauaagccgacaggauauggcucauccuccaggcgcgcuccgcaaacagguaucguggacgaaugcugcuuuagaucgugcgaucugagaaggcuggagauguauugcgccccauugaaacccgcuaaaucagcgagaagcgugcgugcccagagacauacagacaugccuaaaacacagaaguaucagcccccuagcacgaauaagaauacaaaaucucagcgucgaaaaggaagcacuuuugaggagagaaaguag

SEQ ID NO: 31916 - RNA, 420 nt, Artificial Sequence
  Description of Artificial Sequence: Synthetic coding sequence
cugaaggugaaaaugcacacuaugucauccagccaucuguucuaccucgcgcucugccuauugacuuucacauccagugccacugccggacccgagacccucuguggugccgaacugguggacgccuugcaguuuguguguggcgaucggggcuucuacuucaauaagccgacgggcuauggcuccuccagcaggcgugcuccucaaaccggaaucguagaugagugcugcuuccgaucaugcgacuuacgaaggcuagagauguacugcgccccauuaaaaccggccaaguccgcacggucagucagggcccaacgccacaccgauaugccuaaaacacagaaguaccaacccccuaguacuaacaagaauacaaagucccagcguagaaaaggaaguacauuugaagaacggaaguag

SEQ ID NO: 31917 - RNA, 414 nt, Artificial Sequence
  Description of Artificial Sequence: Synthetic coding sequence
augaucaccccaacuguaaagaugcacacgauguccagcucacaccuguucuacuuggcccuaugucuuuuaaccuuuaccuccagcgccacagcugggccagaaacacuguguggcgccgaguuggucgaugcccugcaguuugucuguggcgauaggggauuuuauuucaauaagccuaccggauacggguccaguucaagacgcgcaccacagaccggaaucguggaugaauguugcuuccgcuccugcgaccuacguagacucgagauguacugcgccccucuaaagcccgccaagucagcuagguccguucgcgcacagagacacaccgauaugcccaagacacaaaaggagguacaucucaagaacgccucucgggggucugccggaaacaaaaauuacagaauguag

SEQ ID NO: 31918 - RNA, 477 nt, Artificial Sequence
  Description of Artificial Sequence: Synthetic coding sequence
augggaaagauuaguagcuuaccgacccaguuguuuaagugcuguuucugcgauuuucucaaagucaaaaugcacaccaugucuuccucucaccuguucuaucucgcucucugucuucugacuuuuacaagcucugcaacugccggucccgaaacacuguguggugcugagcugguugaugcucuacaguuuguuuguggagaccgaggcuuuuauuucaacaaacccaccgguuacgguucaagcucaagacgggccccccagacagggaucguugacgaauguuguuuccguuccugcgaccugcgacgacuggagauguacugugcaccucucaagccggcuaaguccgcucgaucaguacgcgcccagagacauacagacaugccaaaaacccaaaaauaccagccgccuuccacuaacaagaacaccaagagccaacggaggaaaggaucuacuuucgaggagagaaaauag

SEQ ID NO: 31919 - RNA, 876 nt, Artificial Sequence
  Description of Artificial Sequence: Synthetic coding sequence
augcaaagagcuagaccuacucugugggccgccgcccuaacucuccugguguugcugcgcggcccccccguggcuagagcuggagccagcuccgccggcuugggaccuguggucaggugugaacccugugacgcucgugccuuagcccagugcgcacccccuccagccgugugugcagaguugguuagagagccuggaugcggcuguugucuuaccugugcccuuagcgaaggacagccuuguggaaucuauacggaacgguguggcaguggacugcgcugccagccaucucccgacgaggccagaccuuugcaggcacugcuugauggccguggccugugcgugaaugcaucugcuguaucgagauuacgcgcauaccuucuucccgccccacccgccccaggaaacgccuccgaguccgaagaagauagaucagcugguagcguggagucuccaucaguguccucuacacaucgagucagcgacccaaaguuucauccacuucacucuaaaaucauuaucaucaaaaaggggcacgccaaagacagccagcgguacaaggucgauuaugaaucucaaucaacagauacccagaacuucucaagcgagucuaagagagagacugaauacggcccaugcagacgagagauggaagacacuuugaaucaccucaaguuccuuaaugucuugucccccagaggcguacauaucccgaacugugauaaaaagggcuucuauaaaaaaaaacaaugccgcccaagcaaaggucgcaaaaggggguucuguuggugcguagacaaguauggccagccacugcccggauauaccacuaaagggaaagaggacguccauugcuauucuaugcagucuaaauag

SEQ ID NO: 31920 - RNA, 894 nt, Artificial Sequence
  Description of Artificial Sequence: Synthetic coding sequence
augcaaagggcacguccuacccucugggcagcugcucuuacccugcugguacucuuacggggaccucccguggcuagagcgggcgccucauccgccgguuugggaccagugguccguugcgagccaugugacgcaagagcccuugcucagugugcgcccccuccggccgugugcgcugaauuaguuagagaaccugguugcggauguugucuaacuugcgcauugucugagggccaacccugcggaauuuauacagaacgcuguggaagugggcucagaugccagccaagucccgaugaggccaggccgcugcaggcccuccuugacggucguggccuguguguaaaugcuucugcugucucccguuugagagccuaccuacugccugccccucccgccccuggagaaccuccugcuccagguaaugcaucugaaucagaggaagauagauccgcuggauccguugagagcccuagcgugucaucuacucauagaguauccgauccgaaauuccacccucuacauucaaaaauaaucauaauuaaaaagggccacgcgaaagauucccagagauauaagguagacuaugagucccaaucuacagacacucaaaauuuuagcucagaauccaaaagggaaacagaguacggcccaugcaggcgggagauggaagacacgcucaaucaccucaaguuccucaacgugcugucuccccgaggcguucauauuccaaauugugauaaaaagggauuuuacaagaagaaacagugcaggccauccaaagggcgcaagagaggguucuguuggugcguggacaaauaugggcagccacucccgggcuauaccacaaaaggaaaagaagacguucacuguuauaguaugcaguccaaauag

SEQ ID NO: 31921 - RNA, 585 nt, Artificial Sequence
  Description of Artificial Sequence: Synthetic coding sequence
augcaacgcgcuagaccucugcaagcacuguuggauggucggggccuaugcgucaaugccuccgccguaucacgccugagagccuaucuacugcccgcuccacccgcacccggcaacgccucugaaagugaggaagaucggucagccgggagcguggaauccccaucuguuucgucaacccaucguguuuccgaucccaaguuucauccgcugcacuccaagauuaucauuauaaaaaagggccacgcuaaagacucccagcgguacaaaguugacuacgagagccagagcaccgacacgcagaacuuuaguucugagagcaagcgggagacggaauacggaccauguagaagagagauggaagauacccucaaccaccugaaguuuuuaaaugugcuauccccccgcggcguucauauccccaacugugauaaaaagggcuuuuacaaaaaaaaacaaugucgacccucuaaagggcgaaaacggggcuucuguugguguguugacaaguauggccagccacuucccggcuacacgaccaaggggaaggaagauguucacuguuauucaaugcaguccaaguag

SEQ ID NO: 31922 - RNA, 462 nt, Artificial Sequence
  Description of Artificial Sequence: Synthetic coding sequence
uaaagcgaagaggauagaagcgccggcagcguugaaucucccucagucagcagcacccaccgcgucuccgauccaaaguuucauccacugcauucuaagauaaucauuauaaagaagggucacgcuaaggacucgcagagauauaaaguggauuacgaaucacaaaguacugauacacaaaacuucuccucagaguccaagcgggagacagaguauggcccaugccgccgcgaaauggaagacacauuaaaccacuugaaauucuugaacguguugucuccucguggaguucauauaccuaauugugauaaaaagggguuuuacaaaaagaagcagugucgaccaucaaagggaagaaaacgcgguuuuugcugguguguggauaaguacggacagccucuuccugguuauacgacaaaggguaaagaagauguacauuguuacuccaugcaguccaaguag

SEQ ID NO: 31923 - RNA, 432 nt, Artificial Sequence
  Description of Artificial Sequence: Synthetic coding sequence
uaggagucacccagugugaguaguacacauagaguuucagaucccaaguuucauccacuccauuccaagaucauuaucaucaaaaaggggcaugcuaaagacagucagcgguacaaaguggauuacgaaucccagucuacugauacucagaacuucagcucugaaucgaaaagagagaccgaauacgggcccuguagaagagaaauggaagacacgcuaaaccaccugaaauuccucaauguccugucuccucgaggaguccauauuccgaauugcgauaaaaagggcuuuuacaagaaaaagcaauguaggccaagcaagggaagaaaaagggguuuuugcuggugcguggauaaauauggacagccgcugcccggguacacaacaaaaggaaaggaagaugugcauugcuacucgaugcaauccaaguag

SEQ ID NO: 31924 - RNA, 792 nt, Artificial Sequence
  Description of Artificial Sequence: Synthetic coding sequence
augcaaagagcccgcccuacauuaugggccgccugugaaccgugugacgcacgugcauuggcccaaugugcgccucccccugcgguuugcgcagaauuaguacgggagcccggaugcggaugcugucugacuugugccuugagcgaaggacagcccugcgguauuuauaccgaacggugcggauccggguugagaugccagccaagucccgacgaagcccggccccuucaagcccugcuggauggacgcggacugugcguuaacgcauccgcugugagucggcugagagcuuauuuauugccagcgccacccgccccaggcaacgcaucugaaagugaagaagacagauccgccggcucugucgaaucuccaucaguuuccaguacacacagaguguccgaccccaaguuccacccccuacacucaaagaucaucauuaucaagaagggccaugccaaggacucgcagcgauauaaaguagacuacgaaucacaaucaacagauacccagaauuucuccagcgaaucaaagcgcgaaacagaguacggucccugucgccgagagauggaggacacgcugaaccauuugaaguuucucaaugucuuaucaccccgaggaguacacauaccuaacugugacaagaaaggauuuuacaaaaaaaaacaguguaggccaucaaagggacggaaaagaggcuucugcuggugcgucgauaaguacggucagccccugccaggguacacuaccaaaggaaaagaggauguucacuguuauucaaugcagucaaaauag

SEQ ID NO: 31925 - RNA, 834 nt, Artificial Sequence
  Description of Artificial Sequence: Synthetic coding sequence
augagggcccuuaggcucggcgccgaagaccagccauugccggcuuggauuccccaguuacgggcgguuuauugucgaccuauuccggcccggccagcuugccaggccgcuugucccggaugccgccgccaugccgccggagcaacacaugcccuugggagaugugccgacagugccggcgccgcaccccgagccgcggggggugcagguuggagagaacuggguggccugggaagucgaggugcacugagagccgugagacaccuucaccgagcccuucuagacggaagaggucugugcgugaacgcgucggcugugucccggcucagagcguaccuacugccagcaccaccagcccccggcaacgccagugagucugaagaggaucggucagccggauccguggaauccccaucagugucauccacccaccgugugucagauccaaaauuccacccauugcauucaaaaauaauuauuaucaagaaggggcaugcaaaggauucucaaagauauaaggucgauuacgagagccagagcaccgacacucaaaacuuuucgucugaaaguaagcgggagacagaguacggaccuugcagacgcgagauggaggacacacugaaucauuugaaauuucuuaacgugcuuagcccucgaggcgugcauauuccaaauugugauaagaagggguucuacaaaaaaaaacagugcagacccucuaaaggcaggaagaggggcuuuuguuggugcgucgauaaguauggucaaccacuccccggcuauaccacuaaggguaaggaggauguacauugcuacagcaugcagagcaaguag

SEQ ID NO: 31926 - RNA, 570 nt, Artificial Sequence
  Description of Artificial Sequence: Synthetic coding sequence
augcagagagcccgaccaacccugugggccgcugccuugaccuugcuggauggccgcgggcugugcgcuuauuuacucccggcacccccugccccaggcaaugcuuccgaaucagaggaggacagauccgcuggcucuguggagucuccaucaguauccuccacccaccggguuucggacccaaaauuccauccacuacacaguaagauuauaaucaucaagaagggacacgcaaaggacagucagagauauaaagucgauuacgaaagccaguccaccgacacacagaauuuuucauccgagucuaaaagggaaacugaguaugggccgugcagaagagagauggaggacacucugaaucaccuuaaauuccugaacguccugucaccacgugguguucacauuccgaacugcgacaaaaaaggguucuauaagaaaaaacaaugccgaccaucuaaaggacggaagagaggcuuuugcugguguguggauaaauacggacagccacugcccggauacacaaccaaagggaaggaagacguucacugcuauucuaugcaaucuaaauag

SEQ ID NO: 31927 - RNA, 807 nt, Artificial Sequence
  Description of Artificial Sequence: Synthetic coding sequence
augcaaagggcccggccaacauuaugggcagcggcucugacucuccuuguucuucucagaggcccaccuguggcccgugccggagcuuccagcgcugggcuggguccagugguccgcagggaaccugguugcggcuguugccugacuugcgcucucucugagggacagccaugcggcauuuauacggaaagauguggauccggucuaagaugucaacccucccccgaugaagcucgcccacuccaggcccugcuggacggacggggcuugugcgugaaugcaucugccguuucuagacugagagccuauuugcugccagccccccccgcacccggcaaugcaucagaaucagaagaagacagauccgccgguagcguagaaucucccucgguuagcuccacccacagaguuucagacccuaaguuccauccccugcacagcaaaauuaucauuauuaagaaaggacaugcuaaggacucucagcgcuauaagguugauuacgagagccaguccaccgauacucaaaacuuuaguuccgagagcaagagagaaaccgaguauggaccaugcaggcgugagauggaggauacauuaaaccaucugaaauuucuuaauguucugagcccacgugguguacauaucccaaauugcgauaagaaaggguucuacaagaaaaagcagugucggccgaguaaggggagaaagcggggauucuguugguguguggauaaauacggacagccauugcccggauauacgaccaaagguaaggaggaugugcacugcuacagcaugcaaaguaaguag

SEQ ID NO: 31928 - RNA, 2397 nt, Artificial Sequence
  Description of Artificial Sequence: Synthetic coding sequence
augaaucuacagccaauauucuggaucggcuugauauccagcguuuguugcguguucgcccaaaccgaugaaaaucgcugucugaaggcaaaugcgaaaaguugcggagaauguauucaggcugggccgaacuguggcugguguacaaauagcacauucuuacaggaaggaaugccaacaucugccaggugcgacgacuuagaagcacucaagaagaaaggcugcccaccagacgauauugagaacccuagaggcaguaaagacaucaagaagaauaagaacgugaccaacagaaguaaaggaacugcagaaaaacugaaaccagaagauaucacucaaauucagccucaacaacuuguucugcgucuuagaucaggggaaccucagaccuucacucuuaaauuuaagagagcagaggacuauccaaucgaccuguauuaccugauggaucuaagcuacucaaugaaagacgaucuggagaacgugaagucuuuagggacagaccugaugaaugagaugcgccgcauuacuucugauuuucguaucggcuuuggcucauucguugaaaaaacaguuaugccuuacauuucuacuacgccagcuaaauuacggaaucccugcacuuccgagcagaacugcacaucuccuuucagcuacaaaaacguguuaagcuugaccaauaagggcgagguguuuaacgaacuggugggaaagcaaagaauaucuggcaaccuggauucccccgaggguggcuucgaugccauaaugcaaguggcuguguguggaagcuugaucggcuggcgcaaugucacacgcuuguugguguucuccacagacgcugguuuccacuucgcuggcgauggcaaauuagguggaaucguccugccaaacgauggucagugccauuuagagaauaauauguacaccaugucgcacuacuacgauuaccccuccaucgcccaccugguccagaagcuaagugaaaacaauauccaaacuauuuucgccguaaccgaggaguuccaaccaguuuacaaggagcugaaaaauuuaaucccuaaguccgccgucgggacccuuuccgcuaacaguagcaacguaauucaguugauuaucgacgcguauaauagucugucgucugaagucauacuagagaacgggaaguuaagugaaggcguuacaauuaguuauaaauccuacugcaagaauggaguaaaugggaccggugaaaauggaagaaaauguaguaacauuucaaucggugacgaggugcaguucgaaauaagcauaacaucaaacaagugcccaaagaaggacagugacucuuuuaagauuagaccacugggcuucaccgaagagguugaggugauccugcaauacauuugcgagugcgagugccaaucugaaggaauuccugaaucccccaagugucaugaagggaacgguacauucgaauguggugccugucgguguaaugaagggcggguugguaggcauugugagugcaguacagacgagguaaauagugaagauauggaugcuuacuguaggaaagagaacagcagcgaaauuuguuccaauaauggugagugcguuugcggacaguguguuuguaggaaaagagacaauacaaaugagauuuauucgggcaaguucugcgaaugugacaacuuuaacugugaucgaagcaacggauuaaucuguggagggaacggggucugcaaauguagggugugugaguguaauccaaacuacaccgguuccgccugcgauuguagucuugacacauccaccugcgaggccuccaacggucagauauguaaugguagaggcaucugcgaauguggaguuuguaaguguacugauccaaaauuccagggccagacgugcgagaugugccagacgugccugggcgugugugcagaacauaaggagugugugcagugcagggcauucaauaaaggagagaaaaaagacacguguacccaggaguguuccuauuuuaauauuacgaaaguugaaucccgggauaaacugccccagcccgugcagcccgaccccguuucccacuguaaagagaaagauguagacgacuguugguuuuauuuuacauacagugucaauggaaacaacgaaguuauggugcacguuguugaaaauccggaaugcccaacagguccagacaucaucccuauagucgcgggagucguggccggaaucgugcucaucggcuuggcacuuuuguugaucuggaagcugcugaugaucauucaugaucggagagaauuugccaaauuugaaaaggaaaaaaugaaugcuaaaugggauacuggagagaacccgauauacaaguccgcggucacuaccgucgugaauccaaaauaugaagggaaauag

SEQ ID NO: 31929 - RNA, 2478 nt, Artificial Sequence
  Description of Artificial Sequence: Synthetic coding sequence
augaaucuucaaccuauauuuuggaucggacugaucagcucugugugcuguguauuugcccaaaccgaugagaauagguguuuaaaggcuaaugcgaagaguugcggagaauguauucaggcaggcccaaacugcggauggugcacaaacuccacauuccugcaagaaggaaugccuacuucagcuagaugugacgaccuugaagcucugaagaaaaagggaugucccccugaugauauugagaacccgcggggcaguaaggauauuaagaagaacaagaacgucacaaaccgcucuaaggguaccgccgagaaacugaagccggaggauauuacacaaauccagccacaacaguuaguacugagauuaagauccggcgaaccacaaacauuuacuuugaaguuuaaaagagccgaggauuaucccauagaccuguacuaccuuauggaucuuagcuacucgaugaaagaugauuuggagaauguuaaaucacugggcacagaccuaaugaaugagaugaggcggauuacaagcgacuuuaggauaggcuuuggcagcuucguggagaagaccgugaugccauacauaucuaccacuccugccaagcugagaaauccgugcaccucugagcagaauuguaccucaccuuuuucuuauaagaaugugcugagccuaaccaauaagggagaaguguuuaaugagcuggugggcaagcaacggauuagcgguaauuuagauucacccgaggggggauuugaugccauuaugcaaguagccguguguggaucccugaucggcuggcguaauguaacaagacuucuaguguucucaacagacgcaggcuuccauuucgccggcgauggaaaacucggaggcauuguuuugccuaacgauggacaaugucaucuugagaacaauauguauaccaugucucauuauuaugauuauccaucaauugcacacuugguacaaaagcucucugagaacaacauacagaccaucuucgccgugacugaagaguuucagcccguuuauaaggaacuaaagaacuugauuccuaaguccgccgucgggacacucuccgccaauuccagcaacgugauucaacuaauuaucgacgccuauaacucauuaucuucagaagugauccuggaaaacgggaagcuuucagaaggcgugacuaucucauacaagucauauuguaaaaauggggugaauggaacuggggagaacggccguaaauguagcaauauuagcauuggagacgagguucaauuugagaucucaaucacuucaaauaagugccccaagaaggauucagauaguuuuaagauuagaccacuuggauuuaccgaagaaguggaggucauucugcaauauaucugcgaaugugagugccagucagaaggaauaccugagucccccaagugccacgagggaaacggaacuuucgagugcggagcuuguagauguaaugaagggcgagugggcagacacugcgaauguaguacugacgaggugaauuccgaggacauggaugccuauugccgaaaggaaaacucuagugaaauuuguagcaauaauggagaguguguguguggccagugcgugugcagaaaacgagauaauacaaaugaaaucuacuccggcaaauucugugagugugauaacuucaacugugacagaaguaacggccugauuuguggagguaauggcguguguaagugcaggguuugcgaguguaauccgaacuacaccgggagugccugugacugcuccuuagacacaucuaccugcgaagcaagcaauggacagauuugcaaugggcgaggaauaugugaauguggaguguguaaguguaccgauccaaaauuccagggccagacaugugaaaugugucagacaugcuuaggcgugugugcugagcacaaggagugcgugcaaugcagggcuuuuaacaaaggugagaagaaggauacaugcacccaggaguguucauacuucaauauuacaaagguggagucaagagauaaguugccgcaacccguccagcccgaucccgucucccacuguaaggagaaagauguggacgacugcugguuuuauuucacauauucagucaacgggaacaaugaggucaugguacacguggucgagaauccugaguguccaacaggaccugauauaauaccaauuguagcgggaguggucgcagggaucguccugaucggccuagcacugcuccuaaucuggaaacugcugaugauuauucacgaccgaagagaauucgcaaaauucgaaaaggaaaagaugaaugcuaaaugggacaccucuuuauccguugcacaaccuggaguacaguggugugauauaaguucccuccaaccauugacaagucgguuccagcaguucucuugccuuuccuuaccuagcaccugggacuaccgaguuaagauccuauuuauccgcgugccuuag

SEQ ID NO: 31930 - RNA, 2397 nt, Artificial Sequence
  Description of Artificial Sequence: Synthetic coding sequence
augaaccugcagccuaucuuuuggaucggacugauaucuucaguguguugcgucuucgcccagaccgacgagaaccgcugucuuaaggccaacgcuaaaucaugcggcgaauguauacaagcuggaccuaacuguggcugguguaccaacuccacauuccugcaggaaggaaugccaacaucagcuaggugugacgaucuugaagcacucaaaaagaaaggaugcccaccagaugauauagagaacccccgggggaguaaggacaucaaaaagaacaagaacgucacuaauagaucuaaagguaccgcagagaaguugaaaccagaagauauaacacaaauccagccacagcaacuagucuugaggcucaggagcggugaaccccaaaccuuuacacuuaaauucaaacgugccgaagacuaucccauugaccuuuacuaucugauggaccuguccuauuccaugaaagacgaccuagagaacgucaaaucacugggcacggaucuuaugaacgagaugcgcaggaucaccucugacuucagaaucggauucgggucauucguggagaagaccgugaugcccuacauuucgaccacaccagcaaaauuacgaaauccaugcacgagcgaacagaauugcaccaguccauucuccuacaaaaaugugcuuucacuuacaaauaagggcgagguuuucaacgagcuagugggaaaacaaagaaucucaggcaaucucgacuccccagaaggcggauuugacgccauuaugcagguggccguguguggcucgcugauuggauggcggaaugucacucgccuccuagucuucucaacagaugcggguuuucacuuugccggagacgggaagcuuggggguaucgugcuuccgaaugauggccaaugucauuuggaaaauaacauguauacaaugucacacuacuaugauuaccccucuauagcacaccugguucagaagcuguccgaaaacaacauccagacuaucuucgcagucacugaagaguuccagcccguuuauaaagaauugaagaaucugauacccaagagcgccguggguacuuuguccgccaacuccucuaacgucauucaguugauaaucgaugcuuacaauucacugucaagcgaggugauucuggaaaacggaaaacuaagugagggcguuacaaucucuuauaaaucuuacuguaagaacggcgucaauggaaccggcgagaaugggcgaaaguguuccaacauuucuaucggcgacgaagugcaguucgaaauaagcauuacuagcaauaagugucccaagaaagacucagacucuuuuaaaauuaggccccuaggguucacugaggaaguugaggucauacugcaauauauuugugagugcgaaugccaguccgaaggcauucccgaauccccaaaaugucaugaaggaaaugggacuuucgagugcggagcaugccgcugcaaugaaggcagaguuggcagacacugugagugcuccaccgaugaagugaauagugaggacauggacgccuauugccguaaggaaaacucuucagaaauuuguaguaacaauggcgagugugugugcgggcagugugugugucguaaaagagauaacacgaaugaaaucuacagcggcaaauuuugcgagugugacaacuuuaacugcgaucguucaaacggcuugauuugcgggggaaauggggucuguaagugcagagugugcgaaugcaauccuaacuacacaggaucugcuugugauugcucucucgauacuaguacaugugaggcuucaaacggucagauauguaacgggcgugggaucugugaaugcggcguuuguaaguguacugauccuaaauuccagggccaaacaugugaaaugugccagacgugucuagggguaugugcagaacauaaggaaugugugcaauguagggcauucaacaaaggugaaaaaaaagauacaugcacgcaggaaugcaguuauuucaacaucaccaaaguggaauccagagacaaauuaccacagccaguccaaccagauccaguuucucauuguaaagagaaggacgucgacgacugcugguuuuauuucacauauagcgugaacgguaauaacgaggugauggugcacgucgucgagaacccagaaugcccuacaggaccugauaucauaccuaucgucgccggcgucguggccggaauugugcuuauaggguuggcacugcucuugauuuggaagcucuugaugauuauccacgaccggagggaauucgccaaauucgagaaagaaaagaugaaugcaaaaugggacaccggagagaacccaauuuauaaaucagcaguaacaacuguagugaauccaaaguacgaggguaaguag

SEQ ID NO: 31931 - RNA, 150 nt, Artificial Sequence; identical to SEQ ID NO: 31750
  Description of Artificial Sequence: Synthetic coding sequence

SEQ ID NO: 31932 - RNA, 270 nt, Artificial Sequence; identical to SEQ ID NO: 31751
  Description of Artificial Sequence: Synthetic coding sequence

SEQ ID NO: 31933 - RNA, 2406 nt, Artificial Sequence
  Description of Artificial Sequence: Synthetic coding sequence
augaaccuccaaccaaucuucuggaucggccugauuucuucaguguguugcgucuuugcccaaacagacgagaaucggugucucaaagccaacgcuaagagcugcggagaguguauccaggcugguccuaauugcggauggugcacgaacucaaccuuucuucaggaaggaaugccuacuucagcccgaugugaugaccuagaagcuuuaaaaaagaagggcugccccccagacgacauugaaaauccccgaggaucuaaggacaucaagaagaacaaaaaugugaccaauaggucgaagggaacagccgaaaagcuuaagccugaggauauaacccagauucaaccccaacagcuugugcugcgccugaggagcggagaaccccagaccuucacccuaaaguuuaaacgcgcugaggauuacccaauugaucuuuauuaucuuauggacuugaguuacucuaugaaggacgaccuggaaaacgucaagagccugggaacggaccugaugaaugagaugcgccgcauuacuuccgacuucagaauuggguucgguucauucguggagaaaaccguuaugcccuacaucagcacuacaccagcuaagcuuaggaacccaugcacaagugaacagaacuguacaagcccuuuuagcuauaagaauguucuaucucugaccaacaagggagaggucuuuaacgaacuggucggcaagcagcguaucucaggcaaucuugauuccccugaaggcggauuugacgccauuaugcaagucgcuguguguggcucacuuaucggauggcguaaugugacccgacugcugguguucaguacagaugccgguuuucacuucgcuggcgaugggaaacuuggaggaaucgugcucccuaacgacgggcagugucaccuggagaacaauauguacaccaugucacacuacuaugacuaucccucuauagcccaucuugugcagaaauugagcgaaaacaauauucagacaaucuucgcuguuacagaagaauuucagccuguguauaaggaauuaaaaaaccuuauccccaagagugccguaggaacccucagcgcaaacaguucaaacguuauucaacuuauuauugaugcauauaauucacucuccucugaagucauacucgagaacggaaaacugagcgaaggagugaccauuagcuauaaaagcuacugcaagaacggagugaacggaacaggcgagaauggccgcaagugcuccaacauaagcauaggcgacgagguacaauucgagauuagcauaacuucuaacaaguguccuaaaaaggacuccgacucuuucaaaaucagaccucuuggcuucaccgaagaagucgaaguaauacuacaguacauuugcgagugcgaaugccagagcgaagguaucccggagucaccaaaaugucacgagggaaacggaacguuugaauguggggccugccguugcaaugagggacgagugggaagacacugugaauguagcacagaugaagugaauucugaagacauggaugcauacugcaggaaggaaaacucuagcgaaaucuguaguaacaacggcgaaugcguguguggacaaugugucuguagaaaaagggacaauacaaaugagauuuauagcggaaaauuuugcgaaugcgauaacuuuaacugcgaucgcucaaauggccugaucugcggcggcaauggcguaugcaagugcagaguuugcgaauguaacccaaacuacaccggguccgcgugcgacugcucacucgacaccagcaccugcgaagcuuccaauggacagaucugcaacgguaggggaaucugcgagugcggagugugcaaaugcacagauccaaaauuccaagggcaaaccugcgagaugugucaaaccugcuuaggagugugugccgagcauaaggagugcguacaauguagagccuucaauaaaggugaaaagaaagacacuuguacccaagaaugcucauauuuuaacauuaccaagguagaaaguagggauaaacuaccacaaccuguucaaccugaccccgugucucacuguaaagaaaaggacguggaugacugcugguuuuacuucaccuauagcguuaaugggaacaaugagguaaugguccacguaguagaaaacccagaguguccaacaggcccagauaucauccccauuguggcaggcgugguggccgguauaguucugaucggcuuggcccuuuuacuuauuuggaaacuucugaugauuauccacgaccgccgggaauuugcaaaguuugagaaagagaagaugaaugcuaagugggacacucaagaaaauccuaucuauaaguccccgauuaacaauuucaaaaaccccaauuacggaagaaaagcaggacuguag

SEQ ID NO: 31934 - RNA, 411 nt, Artificial Sequence
  Description of Artificial Sequence: Synthetic coding sequence
augaaccugcagccgaucuucuggauaggacugauuagcucugugugcugugucuucgcacagacugaugaaaaccgaugucuaaaggcgaacgcaaaguccuguggggaguguauucaggccgggccaaacuguggguggugcacuaacuccacuuuucuccaggaaggaaugccuaccagcgcgagaugcgacgaccuagaggcucugaaaaaaaaaggcugcccccccgacgauauugaaaauccacgcgguagcaaagacauuaagaaaaauaagaacguuacgaaucgaucaaaaggaacagcugaaaaacugaagcccgaagauaucacccagauucaaccccaacagcuugugcugagacugagaaguggcgaaccacagaccuuuacucugaaauucaaauag

SEQ ID NO: 31935 - RNA, 378 nt, Artificial Sequence
  Description of Artificial Sequence: Synthetic coding sequence
augaaccuacaaccaaucuuuuggauaggacuaaucuccagcgugugcuguguguucgcccagaccgaugagaacaggugccuuaaagccaaugcaaagagcugcggagagugcauucaagcuggacccaacugugggugguguacuaauuccacuuuccugcaggaaggcaugcccacuagcgcuagaugcgacgauuuagaagcacuuaagaaaaaagguugcccucccgaugacaucgagaacccuagaggcuccaaagacaucaaaaaaaacaagaacgugacgaacaggucgaaggguacugcggaaaaacuuaaacccgaggacauuacccagauccagccccaacagcuuguguuaagacuccggucauag

SEQ ID NO: 31936 - RNA, 492 nt, Artificial Sequence
  Description of Artificial Sequence: Synthetic coding sequence
augaaucuacagccgauauucuggauuggccucauaaguagcgugugcugcguguucgcccagacggaugagaauaggugcuuaaaagccaaugcuaagaguuguggggaaugcauucaggcugggcccaacuguggaugguguaccaacucuaccuucuugcaggaggguaugcccaccagugcccgaugugaugauuuagaagcauugaagaaaaaaggaugcccgcccgaugacauagaaaaccccaggggauccaaagacauuaaaaagaacaaaaacgugacaaaucggagcaagggaacugcagaaaaacuuaagccugaggauauaacccaaauucagccccaacaacuaguccuacgccugcgcucgggagaaccccaaacauuuacacucaaauucaagcgagcugaagauuaucccauugaucucuacuaccugauggaucugagcuauucuaugaaggaugauuuagagaacgugaaguag

SEQ ID NO: 31937 - RNA, 459 nt, Artificial Sequence
  Description of Artificial Sequence: Synthetic coding sequence
augaaucugcaaccaauauucuggauuggacuuauuuccagcgugugcugugucuucgcgcaaaccgacgaaaacaggugccugaaagccaaugccaagucguguggagagugcauccaggccggccccaauuguggauggugcacaaacagcguguccaagaccuuccugcaagaagggaugccaaccucagcuagaugugacgaccuugaagcacucaaaaagaaaggaugcccgcccgacgacaucgagaacccgcgugggucaaaagacauuaaaaagaauaaaaauguuaccaaucgcuccaaagguaccgcagagaaacuaaagccggaggacauuacacaaauucagccucagcagcuuguguuacgacuccgcagcggcgagccccagaccuuuacccucaaauucaaacgcgccgaggacuaucccauagaucuguacuauuuaauguag

SEQ ID NO: 31938 - RNA, 315 nt, Artificial Sequence
  Description of Artificial Sequence: Synthetic coding sequence
augaaccuucagcccauuuucuggaucggacugauuucaagcgugugcuguguguuugcccaaaccgacgaaaaucgcugucuuaaagcaaacgcuaagagcuguggagagugcauccaagccgggccuaauugugggugguguacuaauucgacuuuccuucaagagggcaugcccacaagugcaagaugugacgauuuggaggcccugaaaaaaaaggggugccccccagacgauauugaaaauccacggggguccaaagauaucaaaaagaacaagaaugugacaaaccgcucaaagggcacagcggaauag

SEQ ID NO: 31939 - RNA, 432 nt, Artificial Sequence
  Description of Artificial Sequence: Synthetic coding sequence
augaaccugcagccaaucuuuuggaucggauugaucucuaguguguguugcgucuuugcccagacagaugagaaucggugccugaaagcgaacgcuaagagcuguggcgaauguauacaggcaggacccaacugcggaugguguacgaauuccacauuccugcaagaaggcaugccuacaagugcucggugcgacgaucuagaggcccucaagaagaagggaugcccgccugacgauaucgagaauccccgcggauccaaggacaucaagaaaaacaagaacguuaccaaucgaucgaagggcacggcagagaaacuaaaaccggaggauaucacacaaauucagccucaacagcuaguccugagacucaggucaggagaaccucaaacauuuacccugaaauuuaaacgcgcugaggauuauccaaucuag

SEQ ID NO: 31940 - RNA, 570 nt, Artificial Sequence
  Description of Artificial Sequence: Synthetic coding sequence
auggcuucuccauuugcccuuuuaaugguccucgucguucucucguguaagucuucauguucucuuggcugugaccugccagagacccacagucucgacaaucgacguacccugaugcugcuggcucagaugaguagaauuucccccagcuccugccugauggaccgccacgauuuuggauucccucaggaagaauucgacgguaaucaauuccagaaagcuccagcaauaagcguccuccacgagcugauccagcagaucuuuaaccuauuuacuacuaaggauuccagcgcagcuugggacgaagaucuuuuagacaaauucugcacagaacuguaucagcagcuuaaugauuuggaagcaugugucaugcaagaagaaagaguaggagagaccccccugaugaacgccgacucaauccuggccgugaaaaaauauuuccggcggaucacccucuacuuaacugagaaaaaguacucacccugugccugggaagucguucgggccgagaucaugcgcuccuuaucucuaucuacaaaucuccaggaacgccuccggcgcaaggaauag

SEQ ID NO: 31941 - RNA, 762 nt, Artificial Sequence
  Description of Artificial Sequence: Synthetic coding sequence
auguggccuccuggaagcgcgucccaaccaccuccuucccccgcagccgcuaccggacugcaccccgcggcucgaccagugucccugcaaugucgccuuagcaugugcccugcucgaucccuccuccucguugcaacauugguacuguuggaccaccugucccuggcccgaaauuugccuguugcgacucccgauccugguauguucccaugucuucaccacagucagaaccugcugcgcgcugucucgaacaugcuccaaaaagccaggcaaacucucgaauuuuaucccuguacaagcgaagaaaucgaccacgaggacauaacuaaagauaaaacaaguacgguggaagcuugcuuaccucuugagcugaccaagaaugaguccugcuugaacagccgcgagacgucuuuuauuacaaacggcucaugcuuagcgucacgaaaaacuagcuucaugauggcucugugccugucaucaauuuaugaggaucucaaaauguaccagguggaauuuaaaacgaugaaugcgaaacuguuaauggacccaaagcgccagauuuuccuugaucagaauaugcuggcagugaucgacgaacugaugcaggcgcuuaauuucaacagcgaaaccgucccgcagaaaucaucccuagaagagccagauuuuuacaaaacuaaaauuaagcuguguauccuccuccacgccuuucggauacgggccguaacuauugaucgaguuaugucauaccucaacgcgagcuag

SEQ ID NO: 31942 - RNA, 720 nt, Artificial Sequence
  Description of Artificial Sequence: Synthetic coding sequence
auguggcccccuggaagcgcuucccagccaccaccaucuccggcugccgccacuggauugcacccugccgcucgaccaguuucgcuccaaugucgccuguccauguguccugcucgaagccuccugcuaguggcaacucuggugcugcucgaucaccugucucuugcccguaaucugccaguggcuacuccugaucccggcauguuucccugccuccaccauagccaaaacuugcuucgcgcaguguccaauaugcuccagaaggcucgacagacccucgaguucuaucccuguacuuccgaagaaaucgaucaugaagacaucaccaaggacaaaaccaguaccguagaagccugcuuaccauuagaauuaacaaagaaugggucaugucucgccuccagaaagacuucauucaugauggcacuuugccuguccagcaucuaugaggaucugaagauguaccagguggaauucaagacuaugaacgcaaaguugcugauggauccuaaaagacagaucuucuuggaccagaacaugcucgcagugauagaugaacugaugcaagcccugaacuuuaacuccgaaaccgugccucagaagucuucccuugaagagccagauuucuauaagaccaagauuaaacuauguauccugcugcacgccuuccggauuagagccgucacuauugaccgcgugaugagcuaccuuaacgccuccuag

SEQ ID NO: 31943 - RNA, 648 nt, Artificial Sequence
  Description of Artificial Sequence: Synthetic coding sequence
auguggccacccgggagcgcgagucagccaccccccuccccagcagcugcaacuggccuccaccccgcugcccgcccagugucccugcagugcagacuuucaauguguccugcccgaucccucuugcuggucgcuacccugguacugcuugaucaucugucccuagcccguaaucuuccugucgccacaccggaucccggaauguuuccuugccugcaucacagucagaaccuucugcgugccguaagcaauauguugcagaaaaacgagucuugucuuaacaguagagagacuucuuuuauaacgaacgguagcugccucgccucucgcaagacaucauucaugauggcccugugccuuaguucaaucuacgaggaccuuaagauguaucagguagaauuuaaaacgaugaacgccaaacuguuaauggauccgaagcgucagauuuuucuggaccagaacauguuagcgguuauugaugagcucaugcaagcccuaaauuucaacagcgaaacagugccucaaaaaagcagccuagaggagccagauuucuauaaaacaaaaaucaaauuaugcauccugcuacacgcuuucagaaucagagcuguaaccaucgauagagucaugaguuaucugaacgcguccuag

SEQ ID NO: 31944 - RNA, 582 nt, Artificial Sequence
  Description of Artificial Sequence: Synthetic coding sequence
auggcggcagaacccguggaagacaacugcaucaacuuuguggcaaugaaguuuauugauaacacacucuauuucauagcugaagacgacgagaaccuggagagcgacuacuucggcaagcuugaaucuaaacugucugugauuaggaaccugaaugaccaagugcuuuucauagaucaaggaaauaggcccuuauucgaggauaugacugauucagacugccgcgauaaugcuccacgaaccaucuucaucauaagcauguauaaagacucucagccccgagguauggcugugacuaucucagucaaaugugagaagauuucgacccucagcugugaaaauaagauaaucaguuucaaggaaaugaauccgccugacaauauuaaagacaccaagagugauaucaucuuuuuccagcgaagcguaccaggccacgacaauaaaaugcaauucgagagcucuaguuaugagggauacuuucucgccugugaaaaagaacgggauuuauuuaaacucauucuuaaaaaagaagacgaacucggggaucggucuaucauguuuaccgugcagaacgaggacuag

SEQ ID NO: 31945 - RNA, 570 nt, Artificial Sequence
  Description of Artificial Sequence: Synthetic coding sequence
auggcugccgaacccguggaggauaacuguauaaacuuuguggcaaugaaauucaucgacaauacgcuguauuuuaucgaaaaccucgagagcgacuauuuuggaaaacuggagucaaaacuauccguaaucaggaacuugaaugaccaggugcuguucauugaccagggaaaucggcccuuauucgaagacaugacagauuccgacugucgagauaacgccccacgcacuaucuuuaucaucaguauguauaaagauucucagcccagaggcauggccguuacaauuuccgucaagugcgagaagauuucaacccuuagcugcgagaauaaaauaauuucuuucaaagaaaugaaccccccagacaacauaaaggacacuaaauccgauauuauauuuuuucagaggagcguucccggucacgauaauaaaaugcaguucgaaucaucuaguuacgaggguuacuuucuagcgugugagaaggaacgcgacuuguucaaacugauuuugaagaaagaggacgagcuaggcgacagauccaucauguucacaguccaaaacgaagacuag

SEQ ID NO: 31946 - RNA, 582 nt, Artificial Sequence
  Description of Artificial Sequence: Synthetic coding sequence
auggcagccgagcccguagaagacaacuguauuaauuuuguagccaugaaauuuauugauaacacuuuguauuuuauugccgaagaugacgagaauuuggaaagugacuacuucggaaaguuagaaagcaagcugagugugauccgcaaucucaacgaccaggucuuauucaucgaccagggcaaucguccauuauucgaagauaugaccgacucggacuguagggacaacgcaccucgaacuauuuucauaaucucaauguacaaagauucccagccccgagggauggcuguaacuaucagugugaagugugaaaagauuucuacccugucuugugagaauaaaauuauuagcuuuaaagagaugaauccacccgacaauauuaaagauacuaaaagcgacauaauuuucuuucagcgaagcgugcccggccacgauaauaaaaugcaguucgaaagcagcagcuacgaaggauacuuucuugccugcgaaaaagaacgugaucuguucaaguugauucuaaagaaggaggacgagcugggcgaccgauccaucauguucacggugcaaaaugaggacuag

SEQ ID NO: 31947 - RNA, 639 nt, Artificial Sequence
  Description of Artificial Sequence: Synthetic coding sequence
augaacucguuuucuacuuccgccuuuggacccguggcuuucagucugggccuccugcuuguacugcccgccgcuuuucccgcaccggucccaccaggcgaagauucaaaggacguggcagccccacauagacagccccuaaccucaagcgagaggauugauaagcagauuagguacauccuggauggaauuucugcauugagaaaagagacuuguaauaagaguaauaugugugaauccucuaaagaagcccucgccgagaauaacuuaaaucucccuaagauggcagagaaagauggaugcuuucagucgggauuuaaugaagaaaccugucugguaaagaucaucacugggcuguuggaguucgaaguuuacuuagaguauuuacagaaccguuucgaaucuucagaggaacaggccagagccgugcagauguccacgaaagugcuuauucaauuucugcagaaaaaagccaaaaaccucgacgcaaucacuacacccgauccuacaacaaacgcaucccuccugacaaagcuccaggcgcagaaccaguggcugcaagauaugacuacucaucucaucuuacgcucuuuuaaagaauuucuccaaucuuccuuacgagccuugcgucagauguag

SEQ ID NO: 31948 - RNA, 369 nt, Artificial Sequence
  Description of Artificial Sequence: Synthetic coding sequence
augugugaaagcagcaaggaggcccuggcggaaaauaacuuaaaccuccccaagauggccgagaaggauggcugcuuccaguccggcuuuaacgaagaaacauguuuggugaaaaucauuacaggauugcucgaauuugaaguuuaccucgaguaccugcagaaucgcuuugaguccuccgaggagcaggcccgggcagugcagaugaguacaaagguuuuaauucaguuuuuacagaagaaggucggagucucauccuucccccaacuaggcguuggugaagaccgacuuaaagacuccgucuuggacaacucagggaugcagugccacuuucaaaagcgcagauuacacgugaauaagcgaguuuag

SEQ ID NO: 31949 - RNA, 639 nt, Artificial Sequence
  Description of Artificial Sequence: Synthetic coding sequence
augaauucauuuucuaccucagcuuuuggaccgguggcuuucagccucggcuuacugcuagugcucccagcugcuuucccggcacccgugccuccuggagaggacucaaaggacgucgcugcaccccacagacaaccucucacuucaagcgagcgcauagacaaacagaucagauacauucuggaugguaucagcgcauugagaaaagaaacaugcaacaagucaaauaugugugagagcucuaaagaagcucuagccgaaaauaaccugaaucucccuaagauggccgaaaaggacgguugcuuccaguccggauuuaacgaggagacgugucuugucaagaucauuacuggauuacucgaauucgaaguuuauuuagaauauuugcaaaaccgauucgagucgucugaagaacaagcucgggcaguacagaugagcacuaaaguuuuaauacaguuccuucaaaaaaaggcuaagaaccucgacgccauuacaacucccgacccuacaacgaaugcaagccuccugacgaaacugcaagcacagaaucaguggcuacaagacaugacuacccaucugaucuuaaggaguuuuaaagaguuccuccaaucuagccuacgcgcacucagacaaauguag

SEQ ID NO: 31950 - RNA, 597 nt, Artificial Sequence
  Description of Artificial Sequence: Synthetic coding sequence
augaauagcuuuucuacuucugccuuugggccaguggcuuuuaguuugggucuacuguuaguguuaccugccgcuuucccagccccuguaccucccggugaggauagcaaagauguggccgcaccucauaggcaaccucuaacuuccucugagagaauugacaagcaaauaagauacauccuagacggaaucagcgcgcugagaaaagaaaccuguaacaagucgaacaugugugagagcagcaaagaagcucuggcugagaauaaucugaauuuacccaaaauggcggagaaagauggauguuuccaaagcggcuucaaugaagaaacuuguuuggucaaaauaaucacuggauugcucgaguucgaaguauaccuggaauaucugcaaaaucgauucgaaucaagcgaggagcaggcaagggccguccagaugagcacaaaaguguugauccaguuccugcagaagaaggugggcgucagcucuuuuccccaacuuggcgugggugaggaccgccugaaagauagcguucuggauaacagcggcaugcaaugccacuuccaaaagcgccgacugcacguaaauaaaagaguuuag

SEQ ID NO: 31951 - RNA, 759 nt, Artificial Sequence
  Description of Artificial Sequence: Synthetic coding sequence
augaacucuuucuccaccagcaaaugcagaaaaucucuugcucuggaacugccugccgcgguugagccaugcguacgggaagguugcgucgcacaagggggucuagcgggugggcaacaacagagacaggccccuucaugcgcuguaagcaguccucugcgcucucuaccuuccggaaccggcgcauuugguccuguagccuuuagccucggccuacugcugguuuugcccgccgccuuucccgccccagucccaccuggagaagauucuaaagaugucgcagccccucaccgacagccccugaccucuucagagaggaucgacaagcagauucgcuauauccuggacggaaucucagcacuacgaaaagaaacguguaauaaauccaacaugugcgagagcucaaaggaggccuuagccgaaaauaaucugaaccuaccaaaaauggcugagaaggacggauguuuccaauccggcuuuaaugaagaaacaugucuggugaagauaaucacagggcugcuagaauucgaaguguaucuggaguaccuucaaaaccgauuugaauccucagaagaacaggcccgagcaguacagaugagcacaaaggugcugauucaauuccuacagaagaaggucggugugaguucuuucccccagcucggcguuggcgaggauagacugaaagacagcguguuggauaauaguggaaugcaaugucacuuccaaaagcggcgacugcauguuaauaaacggguguag

SEQ ID NO: 31952 - RNA, 459 nt, Artificial Sequence
  Description of Artificial Sequence: Synthetic coding sequence
augaauucauucucaacuagcgcguuuggcccaguggccuucagccucggccuguuauuaguacugcccgcagcuuuccccgccccuguuccuccaggagaggacuccaaggaugucgcagccccccaucgucagccccugacuucuagugaaagaauugauaagcagauccgguauauucuggauggcauauccgcccuuagaaaagagaccuguaauaagaguaauaugugcgaaaguagcaaggaagcccucgcagagaacaauuugaaccucccaaagauggcugagaaagaugguuguuuucagucuggcuucaaugaggagaccugccuagugaaaauuauuaccggccuucuugaguucgaaguuuaccuugaauaucuacaaaaccgauucgagucaagugaagaacaggcuagggcuguacagaugucaaccaaggugcuuauacaauag

SEQ ID NO: 31953 - RNA, 1419 nt, Artificial Sequence
  Description of Artificial Sequence: Synthetic coding sequence
augacaacuugcucuagacaguuuacaaguagcucuucuaugaagggaucauguggcauaggaggcgggauugguggagggucuagucggaucagcuccguccuugcaggagggaguugucgcgcaccuaguacuuacggaggcggucuguccgugagcagcaguagauucaguagcgggggggccuguggacucggaggcggauacgggggggguuuuucaagcagcucaagcucauucgggagcggcuuuggggggggguauggaggaggccugggcgccgggcuggguggaggauuugggggaggcuuugccggcggugacgguuuacuggucggcuccgaaaaagucaccaugcaaaaucuaaaugaucgacuugcaaguuaccuagacaagguacgcgcacuugaagaggcgaacgcggacuuagaggucaagauuagggacugguaucagcggcaaagaccagcggaaauuaaggauuacucaccuuauuuuaaaacaauagaagaucuuaggaacaaaauucugacagccacgguagauaacgcuaacgugcugcuccagauugacaaugcaagacuggcagccgacgacuuccgcacgaaguaugaaacagaacuuaaccugcggauguccguugaggcugauauaaacggccuuagacgcguacuugaugagcugacauuagcacgcgcagauuuggagaugcagauugaaagcuugaaggaagaacuggccuaccugaagaagaaucacgaggaggagaugaacgcgcugaggggccagguggggggggaugugaacguggagauggacgccgcuccuggggucgaccugagcaggauucugaacgagaugagagaccaauacgagaaaauggcugaaaaaaacaggaaggacgccgaagaaugguucuuuacuaagacggaggaacugaaccgggaaguugcgaccaacucagaacuaguucagagcggaaagagcgagaucucagaacuucgccgcacaaugcagaauuuagaaaucgagcugcagucccagcugaguaugaaagcaucacuugaaaauucuuuggaggagaccaaggguagauacuguaugcaacuggcacaaauccaggagaugaucgggagcgucgaggagcaacuggcucagcuuagaugugagauggaacaacagaaccaggaguauaagauccucuuagauguuaagacgaggcucgaacaagaaaucgccaccuacagacgccuccucgaaggggaggacgcgcaccuuucuagcagccaguuuuccucagguucccagagcucaagagauguuacuaguucuuccagacaaauuagaacaaaagucauggacguucacgacgggaagguagucucaacgcacgagcaggugcugcgaacuaaaaauuag

SEQ ID NO: 31954 - RNA, 1416 nt, Artificial Sequence
  Description of Artificial Sequence: Synthetic coding sequence
augcacccugguguacuugccgccuuccuguuccucuccuggacucauugccgggcacuaccuuugccuucuggaggugacgaagaugaccuauccgaagaagaucugcaguucgcugagcgguacuuaagauccuauuaccaccccaccaaucucgccgguauccugaaggagaacgccgccucgucuaugacggaacgucuacgcgaaaugcaaucguucuucgggcucgaaguaaccgguaagcuggacgacaauacucucgaugucaugaaaaagccuaggugugggguaccagacguaggcgaauauaacguguuuccaagaacccuuaagugguccaagaugaauuuaaccuaccggauagucaauuauacuccugauaugacgcacucggaagucgagaaagccuucaaaaaagcauucaaaguauggagugacgucaccccucuuaacuucacccgcuuacaugauggaauagcugauauuaugauuucuuuuggaauaaaggaacauggggauuuuuauccauucgacggacccucugggcuacuagcucaugcguuucccccagggcccaacuacggaggugaugcgcacuucgaugaugacgagaccuggacaaguucaucaaagggauauaaucuguuuuuaguugcggcccaugaguucggccacucacucggacuugaccauucuaaggaucccggcgcuuugauguuucccaucuauacauacacagguaagucccauuucauguugccugaugaugacguacagggcauucaaagucuguauggucccggagacgaagaucccaaccccaaacaccccaagaccccggacaaaugugacccaagcuuguccuuagacgccauuacaagccugcgcggcgagacuaugaucuucaaggaccgcuucuucuggcggcugcacccccaacagguggacgcugaauuguuccuuacaaaguccuuuuggccagaacuaccaaaccggauugacgcagcuuaugaacacccuagccaugaucuuaucuuuauauucagaggaaggaaauucugggcgcuuaauggcuaugauauccuugagggcuacccaaaaaaaauaagcgagcuggggcuccccaaagaggucaagaaaauuucagcugcgguacauuuugaggauacuggcaagacacuccuguuuaguggaaaucaagucuggagauaugacgauacaaaucauauaauggauaaggauuauccccgccugaucgaggaagacuuuccagggauuggggauaagguugaugcaguuuaugagaaaaauggauacauuuacuuuuuuaacgggccaauacaauucgaguacagcauauggucuaauagaaucgugagagugaugccugcuaauucuauccugugguguuag

SEQ ID NO: 31955 - RNA, 1470 nt, Artificial Sequence
  Description of Artificial Sequence: Synthetic coding sequence
augcaucccggcgugcuugcugccuuccuuuuccuaagcuggacucauugccgcgcucuuccguuaccaucugggggcgaugaagacgaccuaagugaggaagaucugcaauucgccgaaagauaucucaggaguuacuaccacccaaccaaccuagcagggauacugaaggagaaugccgccucaaguaugaccgagagacugagagagaugcagucuuucuuuggacuagaagugacugguaaguuagaugacaauacguuggacgugaugaagaaaccacgcuguggcguacccgaugugggugaguauaacguguuucccagaacacucaaauggucuaaaaugaaucucaccuauaggauagugaauuauaccccagacaugacacauuccgagguugaaaaggcauuuaagaaagcauuuaaaguuuggagugacgucaccccacucaacuucaccagacugcacgacggcaucgcagauauaaugauuucuuuuggaauaaaggaacauggcgauuuuuacccauucgacggcccuaguggcuugcucgcucaugccuuuccuccuggcccgaauuacggcggcgacgcucauuuugacgacgacgaaaccuggacuaguagcucaaagggguauaaccuguuucuuguggcugcacacgaauuugggcacagucucgguuuggaccauuccaaggauccuggcgcauuaauguuuccuauuuacacguauaccgggaaaagccauuuuauguuaccagaugacgaugugcaagguauucagagucucuauggacccggcgacgaagauccuaauccuaaacaucccaaaacaccagauaaaugugaucccucgcuuucucuugacgccaucaccagccucagaggcgaaacaaugaucuucaaggacagauuuuuuuggcgucuccauccacaacaggucgacgccgaacucuuccugacaaaaagcuucuggcccgaacugcccaacagaauugacgccgcuuaugagcauccuucacaugaucucauuuucauuuuccgaggcagaaaguucugggcacucaacgguuaugacauccucgaggguuacccgaagaagauuuccgagcuuggacucccaaaagagguaaaaaagauaucugccgcaguacauuuugaagauacuggcaagacucuccuguucucugguaaucaaguuuggcgcuaugacgacaccaaccauaucauggauaaagacuacccacggcucaucgaagaggauuucccuggaaucggagauaaaguggacgccgucuaugaaaagaacgaaagccacuccgugacacaggccggagugcauugccgaaaucugagcucacugcagcccccuccaccaggauuuaaacgcuucagcugucugucgcucuggagcagcugggacuaccgcuuguaccuguuuuuucagcggacccauacaguuuag

SEQ ID NO: 31956 - RNA, 1152 nt, Artificial Sequence
  Description of Artificial Sequence: Synthetic coding sequence
augcacccaggcguguuggccgccuuccuguuucugucuuggacacauugucgugcccuaccucuccccuccggcggcgaugaggaugaccugagugaggaggaucuacaguucgcagaaagguacuuaagaucauacuaucauccuacgaaccucgcgggaaucuugaaagagaaugcugccuccuccaugacggagcgacugcgcgagaugcagaguuuuuucggccucgaagucaccggaaaacuggacgauaacacauuggacguaaugaaaaaaccuagaugcggcguuccagacgucggcgaguacaauguuuuuccuagaacccuuaaauggaguaagaugaaccuuacuuacagaauugucaacuacacacccgauaugacacacucagaaguggaaaaagcuuucaaaaaggccuuuaaagucuggucagacguaaccccuuuaaacuucacccggcugcacgaugguauugcggauaucaugauaagcuucgguaucaaggaacacggagauuuuuauccuuucgauggcccuagcggacugcucgcccacgccuucccuccuggucccaauuacgggggcgaugcacauuucgacgaugacgagacuuggacauccucuucaaaaggcuauaaccuguuccugguagcugcacacgaauuuggacacucacucggacuagaccauucaaaagacccuggcgcucuaauguuucccauauauaccuauacaggcaaaagucauuuuaugcugccagacgacgauguccaggggauucagucacuauaugggccaggggaugaagauccaaauccaaaacacccuaagacuccggacaagugugacccuucacucucccucgacgccaucacgagucuuagaggagaaaccaugauauucaaagacagguuuuuuuggcggcugcacccucagcaaguggaugcugagcucuuccuaacuaaaaguuuuuggccagagcugccuaauagaauugacgccgcguacgaacacccuagccaugaucugaucuuuauuuucaggggaagaaaauucugggcacuuaacggcuacgauauacuggagggauacccuaagaagaucagcgaacucggacuaccgaaagagguuaauaaacugcaguag

SEQ ID NO: 31957 - RNA, 1743 nt, Artificial Sequence
  Description of Artificial Sequence: Synthetic coding sequence
augccaggauggccauggggccuguuacuaacagcaggcacacuguucgcagcucuuucaccagguccuccugcgccugccgauccuugccacgaugaggguggagccccuagaggaugugugccaggccuggucaacgccgcucugggccgcgagguccucgccucuuccacuugugggcgcccagccacacgugcuugcgacgcaucugauccaagacgugcacauucccccgcacuccugacuucaccagggggcacagcguccccccuguguuggaggucugaaagcuugccacgugcuccguugaacgucacguugaccguaccuuugggcaaggccuuugaacucguuuucguaucguugcgcuuuugcucagccccuccggcgucaguugcucugcuaaagucccaggaucauggaagaucuugggccccucuaggauuuuuuucgucccauugcgacuuagacuauggccgucuccccgcaccagcaaauggccccgccggcccagggcccgaagcucuguguuuuccggcuccccuggcccagcccgacgguuccggacuccucgccuucucgaugcaggacagcucgcccccaggccucgaccuugacucgagucccguauuacaagacuggguaacagcgacagaugugcguguaguccugacgcggccaaguacagcuggcgacccaagggauauggaggcaguggugcccuacaguuaugcugcuaccgacuugcaagugggggguagaugcaaaugcaacggccacgcuagcagaugucuccucgauacccaagggcaucugauaugugacugccgccaugggacggagggacccgauuguggcagguguaagcccuucuacugcgaccgaccuuggcaacgugcaaccgcaagggagagccaugcaugcuuggccugcucuugcaacggccacgcucggcgcugccgcuucaacauggagcuuuaucgauuaaguggaaggagguccggcggggugugccucaacugcagacacaauacggcuggccggcauugccacuauuguagagaaggauucuaucgcgauccugggagagcuuuguccgaccgucgcgcuugccgcgcuugugauugucacccaguaggggccgcaggcaaaacaugcaaucagaccaccggucaguguccauguaaggauggcgugacuggccugacuuguaaucggugcgccccgggauuucagcaaagccgauccccaguggccccgugugugaagaccccaauaccaggaccaaccgaagacaguucgcccguccaaccccaagauugugauagccauuguaagcccgcacgggguucuuaucguaucucacugaagaaauuuugcaagaaagacuacgccguccaggucgcagugggggcucguggggaagcucggggugccuggacacgcuuuccuguagccgugcuggccgucuuucguucaggcgaggaacgugcccggaggggcuccucagcucuguggguuccagcuggcgaugccgcaugugggugcccacgacuucugcccggaagaagguaccuguuguuagggggaggcccgggggcugcugcugguggggcuggagggagggggcccggucuaaucgcagccagggguucauugguccugccguggcgcgaugcauggacccggcggcuuagaaggcuucaaaggcgugaaagaaggggacgguguagcgcagccuag

SEQ ID NO: 31958 - RNA, 651 nt, Artificial Sequence
  Description of Artificial Sequence: Synthetic coding sequence
augccugggaaccugaugagucaaacgucaagagcggugaguauauggaaguuccccgccaaauuggguaaaacucacggccaucgcgcccuagaggcgacugguaugaugcugcguguguuggugggagccguuuugccagcaaugcuuuuggcagcuccaccccccauaaauaaacuggcacuauuucccgauaaaucagcguggugcgaggccaagaauauuacacagaucguggggcauagcggaugugaagcaaaaaguauucaaaaucgcgccugcuugggccaaugcuucaguuauaguguucccaauaccuuuccccagagcaccgaaucccucgugcacugugacaguugcaugccggcacaaucaaugugggaaauugugacccucgagugucccggccaugaagaagugcccagaguggacaagcucguugagaagauucuacacugcucuugucaggcuuguggcaaagaaccaucacacgaaggguuaucugucuaugugcaaggugaagacgggcccggcucucagcccggcacucauccccacccacacccccacccccacccugguggucagaccccugaaccugaggaccccccuggugcaccacauaccgaagaagaaggcgccgaagacuag

SEQ ID NO: 31959 - RNA, 546 nt, Artificial Sequence
  Description of Artificial Sequence: Synthetic coding sequence
augaugcuccggguccuagugggcgcaguucucccagccaugcuucuugcagccccaccccccauaaauaaacuagcccucuucccagacaagucagcuuggugcgaggcaaagaacaucacucaaauaguuggccacucugggugcgaagccaagagcauccaaaacagagcuugccucggccagugcuuuucauauucuguuccuaauacuuucccacagucaacagagucacucguucauugugacaguuguaugcccgcacagucgaugugggaaaucgucacccuggaaugcccuggacaugaagaggucccacguguugacaaacucgucgaaaagauauugcauugcuccugccaagcgugcggcaaggaacccagucacgagggcuugaguguauacgugcagggagaagauggccccgguucucagccagggacccacccacauccucauccccacccacacccaggcggacaaaccccugagcccgaagacccucccggagcuccccauaccgaagaagaaggcgcagaagacuag

SEQ ID NO: 31960 - RNA, 351 nt, Artificial Sequence
  Description of Artificial Sequence: Synthetic coding sequence
augauguuaagaguccuagugggcgcagucuuacccgcaauguuacucgcugcuccaccccccaucaauaagcuugcuuuguucccugauaaauccgccuggugcgaagccaaaaacaucacccaaauugucggacacucugguugcgaagcuaagagcauucaaaauagagcaugucugggccagugcuucucuuacuccguaccaaacaccuuuccacaaucaacugaaucgcugguacauugcgauucuugcaugcccgcccaaaguaugugggaaauugucacccuggaguguccagggcacgaagagguaccgagaguggauaaguugguggagaagauccuuuag

SEQ ID NO: 31961 - RNA, 492 nt, Artificial Sequence
  Description of Artificial Sequence: Synthetic coding sequence
auguuacggguauuagucggggccguccugccugccaugcuccuggccgccccaccuccuauaaauaagcucgcacuuuucccugauaagagugcuuggugugaagcuaaaaauaucacacaaauaguaggccacuccggcugugaggcaaaauccauccagaacagggcuugucucggccaguguuucucuuacagcgucccuaauacguucccucagucaaccgagucucuggugcacugugacucaugcaugccagcgcaauccaugugggaaauuguuacccuagaguguccuggucacgaggaggugccuagaguggacaaacugguugagaagauucuucacuguuccugccaggcuugcggaaaggaaccaagucacgaaggauuguccguauaugugcaaggugaagauggaccugggagccaacccggaacucacccucauccacauccccacccccauccaggaggacaaacgcccgaauag

SEQ ID NO: 31962 - RNA, 354 nt, Artificial Sequence
  Description of Artificial Sequence: Synthetic coding sequence
augaugcugagaguucucgugggcgcgguuuugcccgcuaugcugcucgcugccccccccccuauuaacaaacuugcacuuuuccccgauaaaucugcguggugcgaagcuaagaauauuacacaaauuguaggccacagugggugugaagcuaaauccauccaaaaucgugcauguuugggccaaugcuucagcuauaguguuccaaacacuuucccacaaucuaccgaaucccucgugcauugugacuccuguaugcccgcacaauccaugugggaaaucguaacacuggagugucccggccacgaagaaguuccgaggguggacaaacugguugaaaagauuuugcauuag

SEQ ID NO: 31963 - RNA, 330 nt, Artificial Sequence
  Description of Artificial Sequence: Synthetic coding sequence
augaugcucagaguucuaguuggcgcuguccucccugccaugcugcucgccgcucccccuccaauuaacaaacucgcccucuucccugauaaaucagcauggugugaggcaaagaacaucacccagaucguuggccacuccgggugugaagccaagucaauccaaaaccgugccugccuugggcagugcuuuucauacuccgugccuaauacguucccacagucgaccgaaucuuuagugcauugcgacucuugcaugccugcacaaaguaugugggagaucguuacucuugaaugcccuggacaugaagaaguaccacgcgucgacuag

SEQ ID NO: 31964 - RNA, 387 nt, Artificial Sequence
  Description of Artificial Sequence: Synthetic coding sequence
augaugcuccgcgugcucguuggcgccguguugccugccaugcugcuugccgccccccccccaaucaauaaauuagcccucuuuccagacaaauccgccuggugugaagcuaagaacaucacucagauaguaggacacucuggcugcgaggccaaguccauucagaaucgcgcaugccugggacaauguuucuccuauucagucccaaacacauucccccaguccacagaauccuuggugcauugugauucauguaugccugcucagucuaugugggagaucgugacgcucgaaugcccgggacacgaagaggugcccaggguggauaaguuaguugaaaaaaucuugcacugcaguugccaagcuuguggaaaggaacccaguuag

SEQ ID NO: 31965 - RNA, 543 nt, Artificial Sequence
  Description of Artificial Sequence: Synthetic coding sequence
augcugagaguccuggugggugcugugcugcccgcuaugcuucuggcugcuccuccuccgaucaauaagcucgcauuauucccagacaaauccgcuuggugcgaagccaagaauauaacccagaucguuggccacuccggaugcgaagcuaaauccauccagaaucgugccugccugggccaguguuucuccuauagcguccccaauacuuuuccgcagucaaccgaaucgcugguucauugugacaguuguaugccugcacagucaaugugggaaauugugacacucgaaugcccaggacacgaagaagugccgagagucgauaagcugguagaaaaaauucuccauuguuccugucaggccugcgggaaggagccuagccaugagggacugucaguauacguucagggagaagacggaccuggaagccagccugguacucacccccauccccauccacacccccaucccggcgggcagacaccagagccugaggacccuccaggggcaccacacaccgaggaagagggcgcagaagacuag

SEQ ID NO: 31966 - RNA, 534 nt, Artificial Sequence
  Description of Artificial Sequence: Synthetic coding sequence
augguucugcugaguacacuggggauuguauuucaaggcgaggguccccccaucucuucaugcgacacaggaacaauggcaaauugugaacggaccuucauagcaaucaagccugauggcgugcagcgcggacugguaggggaaauuaucaagcgguuugagcagaaaggguucagacuagugggacugaaguucaugcaagcuucugaggauuuguuaaaggagcacuauguugaccuuaaagaccggcccuucuucgccggcuugguaaaauacaugcauuccggcccggugguggcgauggugugggaggguuuaaaugugguaaaaaccgggagagucauguuaggcgaaacaaaucccgccgauagcaaaccaggaacuaucagaggagauuucugcauucaaguggguagaaacauuauccaugguagcgauagcguggaaagugccgagaaggagaucggucuaugguuccacccugaagagcuugucgacuauacgaguugcgcgcaaaauuggaucuaugaauag

SEQ ID NO: 31967 - RNA, 429 nt, Artificial Sequence
  Description of Artificial Sequence: Synthetic coding sequence
augaaguccccucaugugcuugucuuuuugugccugcugguggcguuggugacaggaaaucucgugcaguucggcguaaugauugagaagaugacagggaaaagcgcccuccaguauaacgauuacggguguuacugcggaaucggggguagucacuggccgguggaucagacagauugguguugccacgcccacgauugcuguuaugggcgacuugaaaaacuaggaugcgagccaaaacuugaaaaauaucuguucaguguguccgagagagggauuuuuugugccggucgaacaacaugccaaagacugacaugcgaaugcgauaaaagagccgcccugugcuuccguaggaaccugggaaccuauaaccgcaaauacgcccacuacccuaacaagcuguguaccggacccacccccccuugcuag

SEQ ID NO: 31968 - RNA, 636 nt, Artificial Sequence
  Description of Artificial Sequence: Synthetic coding sequence
auggccgauggagcaaaagcgaacccaaaaggauucaagaagaaaguuuuagaucguuguuucucuggguggcgcggaccacgauucggggcaucuuguccuucccguaccucccggagcucucugggcaugaagaaguuuuuuaccgucgcaauacuggccggaucuguccuuagcacagcacauggcucucucuuaaacuuaaaagccaugguggaagcaguuacaggcagaucugccauuuuaucuuucgugggauacggaugcuauuguggacuggggggacgcggccaaccaaaggaugaaguugauuggugcugucacgcgcaugauuguugcuaccaagagcuguuugaccagggcugccacccauacgucgaccauuacgaccacacuauagagaacaauacagaaaucgucugcucugacuuaaacaaaacagaaugcgacaagcagacuugcaugugugauaaaaacaugguacuuugccucaugaaucaaacauauagggaagaguaucgcggauuccucaacguguauugccagggcccuacaccgaacuguaguauuuacgaaccuccacccgaagaaguuaccugcucccaccaaucgcccgccccucccgccccaccuuag

SEQ ID NO: 31969 - RNA, 570 nt, Artificial Sequence
  Description of Artificial Sequence: Synthetic coding sequence
auggcuuuguugucucgccccgcucuuacccugcugcugcuguuaauggccgcuguggugcgaugucaggagcaggcccagacuacagauuggagagccacuuuaaagaccauucgcaauggggugcacaaaauugacaccuacuuaaacgcagcacuggaucuccucggcggggaagacggacuuugccaguacaagugcagcgacgggucaaaaccauuuccucgauacggcuacaaacccuccccccccaacggcugcgguucaccacuguucggaguccaccuuaacauaggcauccccagucuuaccaaauguugcaaucaacaugaccgaugcuaugaaacuugugggaagagcaaaaacgacugugaugaggaguuucaauacugucucucgaaaauuugcagggacguucagaagacccugggccucacccaacacguacaagcaugugagacuacagucgaacuucucuuugauuccgucauucaccuggggugcaagccuuaucucgacagccaacgagcagccugccgaugucacuaugaggaaaaaacagaucuguag

SEQ ID NO: 31970 - RNA, 213 nt, Artificial Sequence; identical to SEQ ID NO: 31789
  Description of Artificial Sequence: Synthetic coding sequence

SEQ ID NO: 31971 - RNA, 477 nt, Artificial Sequence
  Description of Artificial Sequence: Synthetic coding sequence
auggcacucgagguguugaugcuguuagccguacugauauggaccggugcugagaaccuccacgugaagaucaguuguucguuggauuggcugaugguuagcgugauuccuguggccgaaucccgaaaccuguacaucuucgccgacgaacuucaucucggaaugggcuguccagcgaaccgcauucacacguacguuuaugaauucaucuauuuggucagagauugcggaauuaggacaagaguaguuagcgaagagacccugcuguuccagaccgaacucuauuuuaccccuaggaacaucgaccaugacccacaggaaauccaccuagaguguucaaccucucgcaaauccgucuggcuaacucccgugucuacagaaaaugagauuaagcuagacccauccccuuucauagccgauuuucagaccaccgccgaggaacuuggccucuuauccuccucuccgaaucuuuuguag

SEQ ID NO: 31972 - RNA, 1038 nt, Artificial Sequence
  Description of Artificial Sequence: Synthetic coding sequence
augagccuuuuuggacuguugcuucuuaccagcgcuuuggccgggcaaagacagggaacgcaagccgagucaaaucugaguucaaaguuucaauucaguuccaauaaagaacagaacggcguccaggauccccagcaugaacgaaucauuacagugaguacgaacgguucaauccacucaccucgcuuuccucacacauacccucgcaacacaguucuuguauggcgacuaguggcgguugaggaaaauguguggauucagcuaaccuucgaugaacgauuuggacuagaggaccccgaggaugacauuugcaaauacgacuucgucgagguugaagaaccaagcgauggcacaauccugggucggugguguggaaguggaacggucccugguaagcaaaucucaaaaggaaaucagauuagaauccguuuuguuucugaugaguauuucccuagugaaccuggguuuugcauccacuacaauaucgucaugccccaauucacugaagcagugucacccucagugcucccccccuccgcucucccccucgaucuucuaaauaaugccauuaccgcauucucgacccuagaagaccugaucagauaccucgaacccgaaagauggcaguuggaccuagaagaccuguacagaccgaccuggcagcuccugggaaaagcguuugucuucggacggaaaucccgcgucgucgaucugaaccuccucaccgaagaggugagacuguauuccuguaccccaaggaacuuuagcgucaguauucgcgaagaauugaagcguacugauaccauuuucuggccuggaugccugcuuguaaagcgcuguggaggaaauugugcauguugcuugcauaacugcaaugagugccagugcgugccuucaaagguaaccaagaaguaucacgaaguguugcaguuacggccuaagacagguguuagaggacuucauaagagccuuacagacguggcauuggagcaucacgaggagugugauugcguuugucguggaaguacaggaggcuag

SEQ ID NO: 31973 - RNA, 549 nt, Artificial Sequence
  Description of Artificial Sequence: Synthetic coding sequence
augccacaguuuacugaggcugucucuccuucuguacugccccccuccgcgcuuccccuggaucuccuaaauaacgccauuacagccuucaguacucuggaagaccugauucgcuaucuugaaccugaacgguggcagcuggaucucgaagaccuguaccgcccaacuuggcagcucuugggcaaggcuuuuguuuuuggucguaaaucucggguuguagaccucaaccugcugaccgaagaaguucgacucuauucuuguacucccagaaacuucucugucagcauucgcgaagagcucaaacggacagacaccaucuucuggccugggugucuacucgucaagagaugcggaggaaauugugcgugcugccuucacaacugcaacgaaugccaguguguacccuccaaggugacuaagaaauaucaugaaguguugcagcugcguccuaagacuggaguucggggucuccacaagucucucaccgaugucgcucuugagcaucacgaagaaugugacugcguuugcagagggucaacuggaggauag

SEQ ID NO: 31974 - RNA, 573 nt, Artificial Sequence
  Description of Artificial Sequence: Synthetic coding sequence
augaugcaguauacauggcuguuaacgaaacaguucaccgaggcugucucucccuccgucuugccucccagcgcauuaccccuggacuugcucaacaacgcaaucacagcuuucucaacccuggaagaucugauccgauacuuggaaccggagagguggcagcuggauuuagaagaccuguaccgacccacauggcaauuauugggaaaggcauuuguauuuggccgcaagucccgugugguagaucucaaucuacucaccgaagaagucaggcuguauagcuguacuccccgcaauuuuucaguuagcauuagggaggaauuaaagagaaccgauacaauauuuuggccuggaugccuacuggugaagcguugugguggaaauugugccuguugucugcacaacuguaaugaaugucagugcgucccuucaaaagugaccaagaaguaccaugaaguccugcaguuaagaccuaagaccggcgucaggggccugcauaagucacugaccgacguggcuuuagagcaucacgaagagugcgauugugugugccggggauccacugguggcuag

SEQ ID NO: 31975 - RNA, 504 nt, Artificial Sequence
  Description of Artificial Sequence: Synthetic coding sequence
auguccuuauucggucuccugcuccuaacuucggcucuugcaggccaacgacagggaacacaggccgaguccaaccucaguucaaaauuucaguucaguagcaacaaagaacagaauggugugcaggacccucaacacgaacguaucauaacagucucuacaaaugggucuauacauuccccuagauucccccauacuuacccaagaaacacugugcuugucuggcgucugguggccguggaagagaacgucuggauccagcugacauuugacgagcgguuugguuuggaagacccagaggaugacaucuguaaguaugacuucguggaggucgaagagcccagcgacgguacgauucuaggcagauggugcggcagcggcacaguuccagguaaacaaauuuccaaggguaaucaaauaagaauuagauuugucucagacgaguacuucccgagugaaccaaguaaccguggagggaagaucauucagcugcauaccagcuag

SEQ ID NO: 31976 - RNA, 636 nt, Artificial Sequence
  Description of Artificial Sequence: Synthetic coding sequence
augagaacgcuugccugccuccugcucuugggaugcggguaucuagcccacguacucgcugaggaagcugaaaucccccgagaaguaauugaacgacuggcucggucacaaauccauagcauacgcgaccuucaacgccugcuggagauugacucuguuggcagcgaagauagucuggauacuucccucagggcccacggcguacacgcuacuaaacacgugccagagaagaggccucuccccaucaggcguaagagauccaucgaggaagcagucccugcuguauguaaaacaagaacugucauuuacgaaauccccagaucucagguugaucccaccucugcaaauuuccugaucuggccaccuugcguugaaguaaaaagauguaccggcugcuguaauaccucauccgugaaaugucaaccaagcagaguacaccaucgcucaguuaagguggcaaagguagaauacguuagaaagaaacccaaguuaaaggaggugcaaguccgccuugaggaacaccuggagugcgcaugcgccacaaccucacuuaaucccgauuaccgcgaagaagacaccggccgcccccgcgagagcggcaaaaaaagaaaaagaaaaagauuaaagccuacuuag

SEQ ID NO: 31977 - RNA, 591 nt, Artificial Sequence
  Description of Artificial Sequence: Synthetic coding sequence
augcgaacacucgcuugucuuuuauugcuuggauguggauaccuggcccaugugcucgcagaagaagccgagaucccaagagagguaauugagagauuagcccgcagccaaauccauaguauucgggaccuucagcgccuucuggagauugacuccguagguuccgaggacucuuuggacacuucccuccgcgcccauggugugcacgccaccaagcacgucccggaaaaacgaccacuccccauucgacgcaagcgaucaaucgaagaggcaguuccagccguuugcaaaacucggacagugauuuaugaaaucccgagaucccaggucgaucccaccagcgcuaacuuucugauauggccccccugcguugaagugaaaagguguaccggcugcuguaacacuagcucugucaaaugucagcccagcagggugcaucacagaagcgugaagguagccaaaguagaauacguuaggaagaagcccaaacuuaaggaaguucaagucagauuggaagagcaucuggaaugugcuugugccaccacaucucucaaccccgacuaucgagaagaagacaccgacgugagauag

SEQ ID NO: 31978 - RNA, 162 nt, Artificial Sequence; identical to SEQ ID NO: 31797
  Description of Artificial Sequence: Synthetic coding sequence

SEQ ID NO: 31979 - RNA, 1128 nt, Artificial Sequence
  Description of Artificial Sequence: Synthetic coding sequence
augaugaaaaagaacaacagugcgaaacgcggaccucaggacggaaaccagcagccagcacccccagagaaaguggguugggugcgcaaguucugcggcaaaggaaucuuucgggagaucuggaaaaaucguuauguggugcugaagggagaucaguuguauaucuccgagaaagaaguuaaggacgagaagaacauccaggagguauuugaccuguccgauuacgaaaaaugcgaagaauuaagaaagucaaagucccguaguaagaagaaucauucaaaguucacacucgcccacucgaaacaaccagguaacaccgcuccaaaucuuaucuuccucgcugugucucccgaagaaaaggaauccuggaucaacgcccugaacagcgcaauaaccagggccaaaaaccgaauccuugaugaagccuccaccucuaccucugaugguauguugacguuggaucucauccaagaggaggacccaaguccugaggagccgaccucaugugcugagagcuuucguguggaucuagacaaaucuguagcccaauuagccgggaguaggagaagagcugauuccgaucgcauucagccaucagcagacagggccucaucccucuccaggcccugggaaaaaacagacaagggugcuacguacacuccucaagccccuaaaaaacugacccccacggaaaagggacguugugcaucccuggaggagauucuuucccagcgcgacgccgcaucagcucgaacccuucaacuucgagccgaggagccuccuaccccagcccucccaaaucccggucagcucucuaggauccaagaccucguagcccguaaacuggaggagacacaagagcugcucgcagaaguccaaggacugggugauggaaaacgcaaagccaaagauccuccccgcucccccccagacagcgaaagcgaacagcuccuucucgaaaccgagcgccugcugggugaagccaguagcaacuggucccaggccaaacgcguccuucaggaagucagagaacuacgagaucuuuaucgacagauggacuugcaaacacccgauucucaccucagacagaccacuccgcacucucaauaccggaagagcuugauguag

SEQ ID NO: 31980 - RNA, 1140 nt, Artificial Sequence
  Description of Artificial Sequence: Synthetic coding sequence
augaguagccccagccuguccgacuugggaaagagagaaccagcugcggcugccgaugagagggggacucagcaaaggcgugccugugccaacgcuaccuggaacucgauacauaauggcgucauugcagucuuucagagaaagggcuuaccagaccaggaguuauuuuccuuaaacgagggaguccgccagcuucugaagacugaacuuggcucauuuuucaccgaauaccuucagaaccaauuauugaccaaagguaugguaauucugagagacaagauccgguuuuacgagggacagaagcugcuugauucucuggcugaaacuugggauuuuuuuuucucugacguucuacccaugcugcaggccaucuuuuauccaguccaggggaaggagcccuccguacggcagcuugcacugcuccacuuccgcaacgcuaucaccuuauccguaaaguuagaggaugcccuugcacgggcccacgcacgaguaccucccgcaauugugcaaauguuacugguucugcaggggguucacgagagcagagguguaacugaagacuauuuacgucuggagacucuagugcaaaaggugguaagcccguaucuaggaaccuacggccuccauagcuccgaaggcccauucacccauucuugcauacuugaaaagagauuguuacggagaucgcgcucaggcgacguucuggcuaagaauccaguggugcguagcaagaguuauaauacucccuuguuaaauccaguccaagaacaugaggccgagggagcagccgcaggagguacuucgaucaggcgccacuccgugucagagaugacaagcugcccugaaccccaaggguuuuccgauccgccaggccagggccccacagggacauuuaggucuucaccggccccccauucuggaccaugcccuagcagguuauauccuacuacacaaccaccugagcagggacuggauccaacaagaucgucauuaccccggaguucaccagagaaucucguagaccagauuuuagaaagcgucgauagugauucugaggguauuuucauugacuuugggagaggacgcgguucuggcaugucagaccuugaagggagcggcgguagacagaguguuguguag

SEQ ID NO: 31981 - RNA, 1032 nt, Artificial Sequence
  Description of Artificial Sequence: Synthetic coding sequence
augaaagagaucaaccuguugccggaucguguguuaucuacuccuucaguucagcugguacagucuugguacgugcagagccuccucgacauuauggaguuccuagauaaagauccagaggaccaucgaacccucucgcaguuuaccgaugcacugguuaccauacggaaucgccacaaugauguugugccgacuauggcucagggggugcuagaguacaaggauacauacggcgaugauccaguguccaaucagaauauccaauacuuccuugaccgcuucuaccugaguagaaucagcauacguaugcucaucaaucagcacacucuaaucuucgauggauccaccaaucccgcacacccaaaacacaucggcucuauugacccaaacuguaaugugucagagguggugaaagaugcauaugauauggcaaagcugcugugcgacaaauacuauauggcuaguccagauuuagagauacaggagaucaacgccgccaauucuaaacaaccaauucauaugguguaugugccaagucaucuuuaucacaugcuguucgaguuguuuaagaacgcuaugagagccacagucgagagucaugagaguagccugauucuuccuccaaucaagguuaugguggcacuuggcgaagaagaccucagcauuaaaaugagcgauagaggaggaggcgucccgcugagaaaaaucgagcggcuguuuuccuauauguauucgacagccccuacaccacagccaggcacaggagguaccccuuuggcaggcuucgguuauggccuucccaucagcagacuguacgcaaaauauuuccagggagaccugcaguuauucaguauggaaggguucggcacagacgccguaauuuaccuaaaagcccugagcaccgauagcgucgagaggcugccugucuacaauaaauccgccuggcggcacuaccagacuauccaggaagccggagauuggugcgucccaucgacugaacccaaaaauacuuccaccuauagagugucauag

SEQ ID NO: 31982 - RNA, 4785 nt, Artificial Sequence
  Description of Artificial Sequence: Synthetic coding sequence
augaaacucuacguguuccugguuaauaccgggaccacucugacuuucgacaccgagcuaacuguucaaaccgucgccgaucuuaaacaugcuauucaauccaaauacaaaauugccauucagcaucaaguccuugugguuaacggaggagaauguauggcugcagaccgacgugugugcacauauucagcuggcaccgauacuaauccuauuuuccuuuucaauaaagagaugauccugugugaucgacccccugccaucccaaaaaccacuuucucuaccgaaaaugauauggagaucaagguugaagagucccugaugaugcccgcaguuuuccauaccguggcuagcaggacccaacuggcuuuagaaauguaugagguggccaagaagcucuguuccuuuugugagggauuggugcacgaugaacacuugcaacaccaagggugggccgccauuauggcuaauuuagaggacuguucaaauuccuaccaaaaacugcuuuuuaaauuugaguccauuuauagcaauuaccuucagucuauugaggauauuaaacugaaacuuacucaucuuggcacagccgucaguguuauggcaaaaauuccccuucuagaauguuugacuagacauuccuacagagagugucuaggacgauuagauucccuuccggagcacgaagauucugaaaaggcagagaugaaaagaagcacggaacucguacuguccccugacaugccacggaccacaaacgaaucccuccucacaucuuuccccaaaucugucgaacaugucagccccgacacggcugacgcugagaguggaaaggaaaucagagagaguugccagucuacaguacaccagcaggaugagaccaccauagauacgaaagacggagaccuuccuuuuuuuaaugugucccuuuuagacuggaucaacgugcaggaccgaccgaaugacgucgaaagccugguuaggaaaugcuucgauuccaugucuagguuggauccccgaauuauccggccauuuauugcagagugccgacagacgaucgcaaaguuagacaaucagaacaugaaagcaauuaaaggccucgaggaccggcuguaugcccuggaucagaugauagcuuccuguggucgccuaguuaacgaacaaaaagagcuggcucagggauuccucgcaaaccagaagcgggcugaaaaccugaaagaugcgucaguucugccagacuuaugccuuucgcacgcuaaccagcuuaugaucaugcuucagaaccacagaaaguuauuagacauaaagcagaaaugcacaacagcaaagcaagaguuggcaaauaaccuccacguuagacuaaaguggugcugcuucgugaugcugcacgcugaucaggacggggaaaaguuacaggcccuccuuagauuggugauugagcuccuugaaaggguuaaaauuguagaggcacuuucuaccgugccacagauguacugccucgcuguugucgaaguggucaggcggaagauguucauuaagcauuaccgggagugggccggcgcccucguaaaggacgggaaaagacuguacgaagccgagaaaucuaaacgcgagagcuuuggcaaacucuucaggaaaucuuuucucaggaaucgacuguuucguggacuggacaguuggccaccauccuucugcacccagaaaccacguaaauucgauugugaacuuccagacauaucacucaaagaccuacaauuucugcaaaguuucugccccucagagguccaaccuuuccuccgggucccacuuuugugugacuucgaaccucugcaccagcauguucuagcacuacauaauuuggucaaagcugcccaaucucucgacgagaugucacagacaauaacugaucugcuuucugaacaaaaggcaagcgugucgcagacuucuccccaguccgccucuagccccaggauggaguccacagcuggcauuacaacuacaacuucacccagaaccccaccaccuuugacuguucaagauccccucugcccugcggucugcccccuugaagaacugucuccggacucaaucgacgcucacaccuucgauuucgaaacuauuccccacccaaacaucgagcagacaauccaccagguaagucuagaccucgacucucuggccgaaucucccgaauccgauuuuaugucagccgugaacgaauuugugauagaagagaaccuaucuucccccaacccaauuagcgacccccagagcccugagaugaugguggaguccuuguacagcucagucauuaaugcuaucgauucccgcagaaugcaggauaccaaugugugcgguaaagaagacuucggggaucacaccucacugaacgugcagcuggagcguugccgcguuguggcccaggacagccacuuuucuauucaaacuauuaaggaggacuugugccacuuccgaaccuucguacagaaagaacagugcgacuuuuccaacucccugaagugcacagccguggagauuaggaacaucauagaaaaaguaaagugcucgcucgagauuacccuaaaggaaaaacaucagaaagagcugcugagcuuaaagaacgaauaugagggcaaacuggacggacucauuaaggaaaccgaggaaaaugaaaauaagauuaaaaaauugaagggcgaacucguuugccucgaagaagugcuacagaacaaagacaaugaauuugcccuggugaaacaugaaaaagaggccguuaucugccugcagaacgaaaaggaucaaaaacugcuggagauggagaacauuaugcauucccaaaauugugaaaucaaggaacucaaacagucucgggagaucgugcuugaggaucugaagaaauugcacguugagaacgaugaaaaauuacagcuucuucgagccgagcuucaaagccucgagcagagccaccucaaagaacuggaagauacucuacaagugagacauauucaggaguuugagaaagugaugacugaucauagagucucauuagaggagcuuaaaaaagaaaaccaacagauuaucaaucagauccaggaaucucaugcugagauaauucaggaaaaagaaaagcaacugcaagaacugaaguugaaagucagcgaccucagugacacaagaugcaaauuagagguggaauuggccuuaaaggaagcagagacagaugagauuaaaauccuucuagaggagucuagagcccagcagaaagagacucucaagagcuugcuggaacaagaaaccgagaacuugaggaccgagaucaguaagcucaaucagaagauucaggauaacaacgagaauuaccaggucgggcuagcggaguugcgaacgcugaugaccaucgagaaagaccagugcauuuccgagcuuauauccagacaugaagaagagaguaacauuuugaaggccgaauuaaauaagguaacgucuuugcacaaccaagcauuugaaaucgaaaagaaucugaaagaacagauuauagaacugcaauccaaacuagauagcgaacucuccgcccuagagagacagaaagaugagaaaaucacucagcaggaggagaaauacgaagccauuauacagaaccuggaaaaggacaggcagaaacuggugagcucccaggaacaggaucgcgagcaacugauccagaaacugaacugcgaaaaggacgaagccauccagacugccuuaaaagaguucaaacuugaacgugaagugguggaaaaagaguugcuggaaaagguaaaacauuuggaaaaucagaucgcaaaaucccccgcuauagacagcacucgaggagauuccucaucacuugucgcugaacuccaagaaaaacuucaggaagagaaggccaaguuucuggagcaacuugaagaacaagagaaaaggaaaaaugaggagaugcaaaaugucagaaccucucucauagcagaacaacagacgaacuuuaauacuguacucacuagagagaagaugcguaaggagaauauuauuaacgaucuguccgauaagcugaagucuacaaugcagcagcaggaaagggacaaagauuuaauagagagcuugucugaggaccgggccagguuacuagaggagaaaaagaaacuugaagaagagguauccaagcugagaaguagcuccuucguaccuagcccuuauguggccacggccccugaacuuuacggggcaugugcccccgaacucccaggcgaauccgaucgcucugcaguagaaaccgccgaugagggccgggucgacucagcaauggaaacuucuaugauguccgugcaggaaaacauucacaugcuguccgaggaaaaacaaaggauuaugcuccucgagagaacacugcaguuaaaggaagaagagaauaaaaggcuuaaccagcgccucaugagucaaucuaugucgucaguguccagcagacauagcgaaaaaauagcuauccgcgauuuccaagugggagaucuaguccugauaauucuugacgaaagacacgacaacuacguccucuucacagugucgccuacccuuuauuuucugcauagcgaaucccuccccgcccuagaucuuaagccaggcgaaggugccagcggggccagcaggcgucccuggguucugggcaaagugauggaaaaggaauacugucaggccaaaaaggcacagaauagauuuaaaguuccgcuggguaccaaauuuuaccguguuaaagcuguaagcuggaacaaaaaaguuuag

SEQ ID NO: 31983 - RNA, 471 nt, Artificial Sequence
  Description of Artificial Sequence: Synthetic coding sequence
auggcccccgcgcgcgcuggcuuuuguccccugcugcugcugcuccuacuaggauuaugggucgcagagauucccguuuccgcaaagccuaaagggaugaccucaagccaaugguuuaagauacagcacaugcagcccuccccgcaggccuguaacagcgcuaugaagaauauuaacaaacacacuaaaaggugcaaagaucuuaacacuuuccuccacgagccauuuucgucugucgcugcaaccugccaaacucccaagaucgcauguaagaauggagauaaaaauugucaccagucucauggggcagucucacucacaaugugcaaguuaacaagcggcaagcacccaaacuguagauacaaagaaaaaaggcagaauaaaucuuaugucgucgccuguaagccaccgcaaaaaaaggacucacagcaguuccaccucgucccggugcaucuugaucgcguccuguag

SEQ ID NO: 31984 - RNA, 471 nt, Artificial Sequence
  Description of Artificial Sequence: Synthetic coding sequence
auggcccccgcccgcgcuggauucugcccucugcugcuucugcuucuacuggggcugugggucgccgagauccccgugucagccaaaccuaagggaaugaccuccucucagugguuuaaaauccaacacaugcaaccaucuccccaggcaugcaacuccgccaugaaaaacauuaacaaacacacuaagcguugcaaagaucucaacacuuuccuccacgagccuuuuagcagcgucgccgcgaccugccaaacccccaagauugccuguaagaacggcgauaagaacugucaucagucccacggagcaguaagccuuacaauguguaagcucacaucaggaaagcauccaaauugccguuauaaggaaaaacggcagaacaaaucuuacgucguagccuguaagccuccucagaagaaagacucccaacaauuccaccugguaccaguccaucucgauaggguauuguag

SEQ ID NO: 31985 - RNA, 621 nt, Artificial Sequence
  Description of Artificial Sequence: Synthetic coding sequence
auguuaccccccgccauccacuucuaccuucugccgcuugccugcauccugaugaagucuugccuugcuuuuaaaaacgaugccacggagauacucuauucccacguagugaaacccgugcccgcucacccuaguagcaacuccacacuuaaccaggccagaaacggcggccgucacuuuucuaauacgggccuugacagaaauacuagaguucaggucggcuguagggagcugcgcagcacaaaauauaucucugacggacagugcaccucaaucucaccauuaaaagagcuugugugcgccggcgaaugucugccccugcccgugcugccuaauuggaucgguggcggguauggaacaaaguauuggucucggaggucaucacaggaauggcgaugcguuaacgacaagacaaggacccagagaauucagcuccagugucaagacggcucaacccgaaccuacaagauaaccgucgugacugcuugcaaguguaagagguauacucggcagcacaacgaaaguagucacaauuuugaaucaaugucaccagcgaaaccuguucagcaucaucgcgaaagaaagagggcuaguaagaguaguaagcacagcaugaguuag

SEQ ID NO: 31986 - RNA, 693 nt, Artificial Sequence
  Description of Artificial Sequence: Synthetic coding sequence
auguugccuccggcuauacauuucuaucuccucccacucgcauguauauugaugaagaguugccuggcguuuaagaaugaugccacagagauucuguauucucacguuguuaaaccuguucccgcacacccaagcucuaauucuacacucaaccaggccaggaauggcggcaggcacuucucaaauaccggucuagaccggaaccguaccgaaagccuuacucgacaaaauuauuucugguuauuucccggagcuuuucuccgccaacugcaggaggccaggguacaaguugguugcagagagcugaggucaacgaaauauaucucggacggacaauguacuaguauaaguccccuuaaagaguugguuugugcaggggagugccugccacucccgguccugccgaacuggauaggaggagguuacgggacgaaauauuggagccgccgaagcagucaagaguggaggugcgucaacgauaaaacgcgaacccaaagaauacagcuccagugccaagauggaucuacaagaaccuacaagauaacaguuguuacugcuugcaagugcaaaagauacacacgucaacauaaugagagcucccacaauuuugaaucuaugucuccagcuaaacccgugcaacaucaccgcgagcgaaaacgcgccucuaaguccuccaaacauucuauguccuag

SEQ ID NO: 31987 - RNA, 1041 nt, Artificial Sequence
  Description of Artificial Sequence: Synthetic coding sequence
auguuucucucaauccuuguggcccugugccugugguuacaucuugcucuuggcguucggggugcacccugugaggcaguaaggauuccuauguguagacauaugccauggaauaucacaagaaugcccaaucacuuacaucacucaacccaggagaacgccauccucgcgaucgagcaguaugaagagcugguggacgucaacuguucggcuguucuacgcuucuucuuaugugccauguaugcccccaucugcacccuggaauuccuccacgauccuaucaaacccuguaaaagcgucugccagcgugcuagagacgauugcgaaccccuaaugaagauguauaaccauuccuggcccgagucccucgccugcgaugagcugcccguguacgacagaggagucugcauuagucccgaggccaucgugaccgacuugccggaagacgucaaguggaucgauauuacuccagauaugauggugcaggaacguccccuggaugucgauuguaagcgccuuucucccgacagaugcaaguguaaaaaagucaagcccacuuuagccacuuacuuaucgaagaauuacagcuauguuauacaugccaagauaaaggcugugcagcgcucuggguguaacgaggugacuacaguuguugaugugaaagaaaucuucaagaguucuuccccuaucccuagaacccaggugccacucauuacgaacuccucaugucagugcccucacauacuuccacaucaggacgugcuaauuaugugcuaugaauggcgaucgagaaugaugcugcuggaaaacuguuuagucgagaaauggcgcgaucagcuguccaaacggucgauucaaugggaagaaagauugcaagaacaacgaaggaccgugcaggacaagaagaaaacugccggccggacaagccgaucuaaucccccuaaaccuaaaggcaagccacccgcccccaagcccgccagccccaaaaaaaauauuaagacaagaucugcccagaagcguacaaauccaaagagaguguag

SEQ ID NO: 31988 - RNA, 1032 nt, Artificial Sequence
  Description of Artificial Sequence: Synthetic coding sequence
augcgggucgcaggaagggaggggagauuccuuucugcagguguggcagcuagagagggcagcgcaauguuccugucuauuuuaguugcgcucugcuuguggcuucaucucgcccuggggguuagaggcgcacccugugaagcagucagaaucccuaugugcagacauaugccauggaacauuaccagaaugcccaaccacuuacaccauuccacucaggagaacgcaauguaugccccgauuuguacguuggaguuucugcacgauccaaucaaacccuguaagucagugugccagcgggcccgagaugauugugaaccgcuaaugaaaauguacaaccacuccuggccagaaaguuuagccugcgaugagcugccuguguaugaucgcggcgugugcauuagucccgaggccaucgugacugauuuaccggaagauguuaaauggauagauauuacucccgacaugauggugcaggagcgcccgcuggacguagauugcaaaagacucucgccugaccgguguaaaugcaagaaagugaagccuacacucgccacauaccucuccaagaauuacagcuacguaauccacgcuaaaaucaaggcggugcagagaagcgggugcaaugagguuacaaccgugguugacgucaaggagauauucaaguccucgagcccuauuccucgaacccaggucccccuuauuacuaauagcaguugccaauguccccauauccuuccccaucaagauguucugauuaugugcuacgaauggcgauccaggaugauguuguuagaaaacugccugguggagaaauggagggaucagcuauccaaacgcucuauacagugggaagagagguugcaggaacagagaagaacagugcaggauaagaaaaaaaccgccggccgcaccucuagaaguaauccaccuaagcccaaagggaagccaccagcaccaaagccagcaaguccaaaaaaaaauaucaaaacuagaucagcccaaaaacguaccaauccaaaacgcgucuag

SEQ ID NO: 31989 - RNA, 807 nt, Artificial Sequence
  Description of Artificial Sequence: Synthetic coding sequence
augccacgaagcuuucuggugaaaaaacauuuuaacgcuagcaaaaaaccuaauuauucugagcucgauacccacaccgucaucauuuccccuuaccuguaugaguccuacaguaugccugugauaccucagcccgaaauccuguccuccggagccuacucacccaucacugucuggaccacggccgcaccuuuccacgcccaacucccaaacggucugagcccacucucaggauacucaucuucacuugggcgaguguccccccccccccccagcgauacuucuuccaaggaccacuccggcucugaaagccccauuagcgacgaagaagaacgacuccaauccaagcucagcgacccucacgccaucgaagcagagaaauuucagugcaaccuaugcaauaaaaccuacucgacauucuccggucucgccaaacauaaacaacuccauugcgacgcccagagccggaaaucuuuuucuugcaaauauugugacaaggaguacgucaguuugggagcacuuaagaugcacauucguacacacacacuaccaugcgucugcaagauuuguggaaaggccuuuagccggcccuggcugcuacagggccauaucagaacucauacuggcgaaaaacccuuuucuuguccccauuguaaucgggcauuugcagauaggucuaauuugagagcccauuuacagacccacucugacgugaagaaguaucaguguaagaacugcucaaaaaccuucucucggaugucacuccuccacaaacaugaagagagugguuguuguguugcacacuag

SEQ ID NO: 31990 - RNA, 747 nt, Artificial Sequence
  Description of Artificial Sequence: Synthetic coding sequence
auggagcgggcaucccucauucaaaaagccaaguuggcugaacaagcggaaagauacgaggacauggccgccuuuaugaaaggugcaguugaaaaaggagaagagcugucaugugaggagaggaacuugcugucaguggcuuauaagaauguggugggcggacaaagagcagccuggagaguucugagcuccaucgagcaaaagaguaacgaagaggggagcgaggagaagggucccgaaguuagggaguauagagaaaaaguggagaccgagcuacagggagugugcgacacaguuuuggguuugcucgauagccaccucauaaaggaagcaggcgaugcagaaagcaggguguucuaucuuaagaugaagggagacuauuacagguauuuggcagaagucgcaacuggggacgacaagaagaggaucauugauucugcacgcagcgcuuaccaagaggcaauggauauaaguaaaaaagaaaugcccccaacaaauccuaucagacugggucuugcucugaacuucagugucuuccacuacgagauagcaaacuccccagaagaagccaucucccuggcaaagaccacuuucgacgaggcaauggcagaucuucacacacucagcgaagauagcuacaaagacucaacauuaaucaugcagcuuuuacgcgauaaccuuacauuauggaccgccgacaaugccggggaagaggggggagaggcuccacaagagccacaaucguag

SEQ ID NO: 31991 - RNA, 651 nt, Artificial Sequence
  Description of Artificial Sequence: Synthetic coding sequence
auggagagggcuagucuuauccaaaaggcaaagcuggcagaacaggcagaaagauaugaggacauggcugcguucaugaagggugccguggagaagggggaggaacugaguugcgaggagaggaaucuucugucugucgcuuauaaaaauguggugggggggcagcgggcagcauggcggguacucagcuccauagaacaaaagagcaaugaggagggaagugaggagaaagggcccgagguaagagaauacagaguauuuuacuugaagaugaagggggacuacuacagauauuuggcagaggucgcaacuggggacgacaagaagcgcauaaucgauagcgcucgauccgccuaccaagaagcgauggacaucucaaaaaaggagaugccccccacaaauccuaucagacucggucuggcccugaauuuuuccgucuuucacuacgagaucgccaauagcccugaggaagcuauaucucucgcaaagacgacuuucgaugaagccauggcagaccuucauacacucucugaagauaguuauaaagauucuaccuugaucaugcagcuauugcgcgacaaucucacuuuauggacugccgauaaugcaggagaagagggaggagaagccccacaggagccccagucauag

SEQ ID NO: 31992 - RNA, 12735 nt, Artificial Sequence
  Description of Artificial Sequence: Synthetic coding sequence
augaugcccgcccaauaugcucucacaucgagccuagugcuccucguucuguugucaacugccagagcuggacccuucucuucccgauccaaugucacuuugccagcgccuagaccccccccgcagccaggaggccacacagucggcgccggcgugggaagcccaucaagccaauuguacgaacauacgguugagggaggugagaagcagguaguguucacucaccgcaucaauuuaccuccuuccaccgggugcgggugcccucccggaacugagccaccaguccucgcuucagaaguucaggcucuuagaguccggcucgagauucuggaggaacucguaaaaggguuaaaagaacaaugcacaggggguugcuguccagccucugcucaagcuggcacgggccaaaccgacgugcggacccucuguucacuucaugggguauuugaucugucucgcugcaccugcucuugcgagcccggcuggggcggcccuacauguuccgauccuaccgaugcugagauccccccguccucuccuccuagugcuucugguagcuguccagaugauugcaacgaucaaggacguugugugcggggacguugcguuuguuucccaggauauacuggccccuccugugguuggccuuccugccccggcgauugucagggacgagggcgauguguucagggugugugugucugcagggcaggguucucuggacccgacugcagucagagaucuuguccgaggggauguucacagagagggaggugugagggcgguagaugcgugugcgauccaggcuacacuggcgaugauugugggaugcguaguugcccuagaggcugcucacagagaggcaggugugagaaugggcgaugcgugugcaaucccggguacacuggcgaggauugcggcgugagaucaugccccagagguugcucucaaagggggagaugcaaggauggacgcugcgugugugauccuggauauaccggagaagauugcgguacgcggaguugcccaugggauugcggcgaggggggucgauguguugauggacgaugugugugcuggccuggauauacuggggaagacuguagcacuaggaccugcccucgggauugccggggccggggccgaugugaagauggcgaaugcaucugugauacugguuauaguggugaugauugcggcguacguuccuguccgggugauuguaaucagagagggagaugcgaggacggaaggugcguuugcuggccaggauacaccggaacugauugcggcuccagagcuugcccaagagacugucguggacgaggucggugugaaaacggagugugcgucugcaaugccggguauucaggggaagacugcggagugagaucgugccccggcgacugcagagggcgugggagaugugagaguggcagaugcauguguuggcccggcuacacaggucgggauuguggaaccagagcuugcccgggugacugucgggggcgcggccgcugugucgauggccgaugcguauguaauccgggauuuacaggggaagauuguggcagucggagaugcccaggugauugcaggggucauggacugugcgaggauggcguguguguaugcgacgcaggguauagcggggaagauuguaguacaagaucgugcccuggcgguuguagagggagggggcagugccuggauggcaggugcgugugcgaggauggcuacaguggcgaggacugcggaguacggcagugucccaacgauugcagucaacauggggucugccaggacggagucugcauuuguugggagggguacguguccgaggauuguucuauuagaaccugcccaucaaauugccacgggaggggccguugcgaagaaggccgcuguuugugcgaccccggauacacaggaccgacuugugcaacacguaugugucccgccgacugccggggccggggacgcugugugcaagggguguguuugugccacgugggcuacgggggagaggauugcggucaggaagagccucccgccucagcauguccagguggaugcgguccacgggaguugugccgcgcagggcagugugucugcgucgagggauuuagggggcccgauugcgccauacaaacgugucccggggauugccguggccgaggugagugccacgauggguccugcguuugcaaggacggauacgcuggagaggauugcggcgaagagguuccaacgaucgagggcaugagaaugcaccuguuagaggaaacaacaguacgcacagaguggaccccugcacccggcccagucgacgcuuacgagauccaauuuaucccuacaacagaaggggcuucuccaccauuuaccgcucgggugccaucuagcgcuagugccuaugaccaacguggcuuagcacccgggcaagaauaucaggugaccgugcgagcguuacggggaacaucuuggggccucccagcauccaaaacuauuacaacaaugauugaugggccacaagaccucagaguggucgcugucaccccaacaacauuagaacucggauggcuacgaccgcaggcagaaguugaccgcuuuguugugucauacguuucugcuggcaaucagcgcguucgauuagaaguuccuccugaggcugaugggacacucuuaacagaccugaugcccggcguugaguauguugugaccgugacugcagaaagaggucgagccguaucauauccagcgagugugagagcuaacacaggaucaucaccucugggccugcucgggacaacagaugaaccuccuccauccggccccagcaccacacagggugcccaggcucccuuacugcagcagagaccccaggagcuaggugaacucagagucuuaggcagggaugaaaccgguagauuacgcgugguuuggacugcucagccugauacguuugccuacuuucaauugcgaaugagagugccugagggcccuggcgcccacgaggagguucuuccaggggacguucgccaggcucugguuccacccccaccaccaggcaccccguaugagcuuucacuccauggcgucccacccggaggcaagccaucugaccccaucauauaccagggcauuauggacaaagacgaagagaagccaggcaaauccucaggcccuccccgccugggagaacugaccguuacugacagaacuagcgauucccugcuccuuagauggaccgugcccgagggagaguuugacagcuucguaauccaguacaaggaccgugacggacagccccaaguaguccccguagagggaccccaaaggagugcuguuauaacaucgcucgacccuggaaggaaguauaaguuuguccucuauggcuuugugggaaagaagcgccacggcccucuggucgccgaagcuaagauccugccccaguccgacccuuccccaggcacaccuccccaccucggcaaccugugggugacagacccuacccccgacucacuccaccucuccuggacugugccagagggacaguuugacaccuucaugguucaguacagagauagagacggcaggccccagguggugcccguugaagguccagaacggagcuucguggugucuagucucgauccagaccacaaguacagauucacccuguucggcauugccaacaagaagagauauggcccauuaacugccgacggaacaaccgccccggaaaggaaggaggagccucccagaccugaguuucuugaacaaccccugcucggcgaguuaacagugacaggaguuaccccagauucuuugcgcuugucauggacaguagcacaaggcccuuucgauagcuuuaugguacaguauaaagacgcucaaggccagccccaggccguuccugucgcuggggaugagaacgagguaacagugcccggacuggacccugaucggaaauacaaaaugaaccucuauggucugcgugggaggcagcgcguagguccagaaagcgucguggcuaaaaccgcaccucaggaagacguagaugagacuccuucccccacugaacuugggacugaggcuccagaaucaccugaagaaccucuguugggagaguugacagugaccgguuccuccccggacucgcuaucucuguucuggacggugccgcagggauccuuugauucuuucacagugcaguacaaggaucgagacggaagaccuagggccguuagggugggcgguaaggagucagaagugaccgucggaggacuggaacccggccacaaauauaagaugcaccuguauggccugcacgaaggacagagaguugguccaguguccgcaguuggagucaccgccccgcagcaggaagaaaccccaccagccaccgaaucccccuuggaaccaagacugggugaacucaccguaaccgaugucacccccaacagcgucggguuaagcuggaccgugccugaaggccaauuugauucauuuaucgugcaauauaaagacaaagacggacagccacaggugguccccguagcagcggaccagagggaaguaaccguguauaacuuagaaccagagcgaaaauacaagaugaacauguacggacuacaugacggccagaggaugggaccauuaagugucguaauugugacagcuccucugccuccagcgccggccacugaggcaaguaaaccaccacuggaaccacgacugggggagcucaccgugacagacauuacacccgauagcgucggucucucauggacgguacccgaaggggaguucgauaguuuuguggugcaguauaaagauagggauggccaaccacagguagugccaguugccgccgaccagcgcgaagugacaaucccagaccuugaaccuagcaggaaguauaaguuucuucuguuuggaauucaggacggaaagagaagauccccuguuuccguggaagcuaagacuguggcucgcggcgaugccucgccaggagcgccuccccgguugggggaauuguggguuacagauccuacuccugauagccugagacuauccuggacagugccugaaggccaguucgauaguuuuguagugcaguucaaagauaaagaugggccccaaguggucccuguagaagggcacgagagaagcguuaccgucacaccacuggacgcugggcggaaauacagauuccuguuauauggacuucuugggaaaaaacggcacggaccccugacggcggauggcacuacugaggcgagaagcgcuauggacgauaccggaaccaaaagacccccuaaacccagacucggagaggagcugcaagugaccacgguuacgcagaacucgguaggucuguccuggacggugccagagggacaguucgauaguuuuguggugcaguacaaagaccgagacggacagccccaggucgugcccgucgaaggcagccuuagggaagugucugugccaggauuggauccagcccauagauacaaacuccuccuguacgggcuccaccauggcaagaggguaggccccauuucugccguagcaaucacugcaggacgcgaagagacagaaaccgagaccacagccccuacuccccccgcccccgagccucauuuaggagaguuaacuguggaggaagcuacaagccauaccuuacacuugucauggauggugacagagggugaauucgauuccuuugaaauccaguauacagauagggaugggcagcuccagaugguacgcauugggggugaccggaaugacaucacacucuccggcuuagagagugaccacagauaccuggugacacuauacggcuucucagauggcaaacacgucggaccaguccacgucgaagcccugacaguucccgaagaggagaaaccuagugagccuccuaccgccacuccagaaccaccaaucaaaccuagacuuggcgagcugaccgugacagaugcaacuccugacucacuaucgcugagcuggacgguacccgaaggacaauuugaucauuucuuggugcaguaccgaaauggugaugggcagccuaaagccgugcgugugcccggacacgaggagggggugaccauuaguggauuggagccagaccauaaauauaaaaugaaccuauacggauuucacgggggacagaggaugggaccagugaguguggugggcgucacggcugcugaagaagaaacuccuagcccuaccgaaccgucuauggaggcgcccgagcccgcagaagaaccacugcugggagaacuuacugugacagggaguucacccgauucucucucacucuccuggaccgugccacaaggaagguuugauucuuuuacagugcaauacaaagaucgagacgguaggccucaggucgugaggguugguggggaagaguccgaggugacuguuggaggacuagagcccggccguaaguacaaaaugcauuuauacggauugcacgagggacgucgcgugggaccuguguccgccguugggguuacggcacccgaggaagaaucuccggaugcaccacuggccaaacugagacucggucaaaugaccguccgcgauauaaccagcgacucccucucacugagcuggacaguccccgagggccaguucgaccauuuucuggugcaauuuaagaacggugacgggcagcccaaggccguccgcgugcccggccaugaagacggcgugaccauuagcggcuuggagccggaccacaaguauaaaaugaaucuguaugguuuucacggcggccaaagagucggaccuguaucugcagugggguugacggcgcccgguaaagaugaggagauggcaccggcuagcaccgaaccaccaacccccgagcccccuauaaaaccacggcuugaagaacuuaccgugacagacgcuacacccgacucucucagucugucuuggaccgugccugaaggacaguuugaucauuuccucgugcaauacaagaauggugacggacagccuaaggcuacacguguaccaggucacgaagaucgaguuacuaucuccgggcuagaaccagauaacaaauacaaaaugaaccuguauggguuccacggaggacagaggguuggaccaguuucugccaucgguguuacagcugcagaagaagaaacaccaagcccuacagaacccucuauggaagcaccagagccaccagaggagccacuccugggagagcugacuguaaccgguucaaguccugauagccuuagucuuuccuggaccgugccucagggcagauucgauuccuucacaguacaauacaaggauagagauggcagaccucaggucgugaggguaggaggagaagaaucagaagucacagucgguggucuggaacccgggaggaaauauaaaaugcauuuauacggucugcaugaggguaggagaguuggucccgugagcacugucggugugacagccccccaggaagaugucgacgagacaccaaguccuacagaacccgguaccgaagcccccggaccccccgaagagcccuuguuaggcgagcuuacagugaccggcucaucuccggauucucucagccugucauggacugugccgcagggaagguuugacucguucacagugcaauauaaggaucgggauggacgaccucaggcugugcggguggggggccaggagucuaaagugaccgugcgcggccuggaacccgggaggaaauauaaaaugcaucuuuacggccugcacgaaggcagacgccugggacccguuagugcugugggaguaacugaagaugaagccgagacuacacaggcggugcccacuaugacuccugaaccacccauaaaacccaggcuaggugaacuuaccaugaccgacgcuacacccgacucacuuucucuuagcuggaccgugccagaagggcaguuugaccacuuccucgugcaguaccggaacggcgacggacaaccuaaggcaguaagaguucccgggcaugaggacggagucacaaucucagggcucgagcccgaccacaaauauaagaugaaucuuuauggcuuccaugggggacagcgcgugggacccauaagcgugaucggaguaacugcugccgaggaagagacuccaucuccgaccgagcuuucaacagaagccccagagccuccagaggagcccuugcuaggcgagcuuacugugacugguagcagcccugacucuuuaaguuuguccuggacuauuccacagggccacuucgacucuuuuaccguucaguacaaggacagagauggcagaccacaggugaugagagugagaggggaggagagcgaagucaccguuggaggguuggagccgggaaggaaauauaaaaugcaucucuacggauugcacgaggggagacgcgucggaccugugucaacagugggaguuaccgccccagaagacgaagcagagaccacucaagcuguuccuacuacaacccccgaaccaccuaauaaaccacgccucggcgagcucacagugacggacgccaccccagauucucuaucccucagcuggauggucccagaaggccaguucgaccacuuccuaguucaauaccguaauggagauggccagccgaaagucguucgcguuccugggcaugaagauggugugaccauuaguggacuggaaccggaucacaaguauaagaugaauuuguacgguuuucauggaggccaacgaguuggaccaauuagugugaucggugugacagccgccgaagaggagacaccagccccaaccgaacccucaaccgaggccccugagccccccgaggaaccucuguuaggcgagcucacugugacugggagcagucccgauagcuugagucuuucuuggacaauaccucagggccgguuugacagcuuuaccgugcaauacaaagacagagacggccggccccaggugguuagaguuaggggggaggaauccgaggugaccgugggaggacucgaaccugguugcaaguauaaaaugcaccucuauggacuucaugagggacagcgcgugggaccuguaucggcagugggugucacagccccaaaagacgaggcugaaacgacacaggcagucccaacaaugacaccagagccacccauaaagccucggcugggggagcuuacuguuacggacgcuacaccugauucacuuaguuuauccuggaugguaccugaagggcaauucgaccacuucuuaguccaauaucggaauggagacgggcagccaaaggcuguaagagugccaggucaugaagacggaguuacuauuuccggccuggaacccgaucacaaguauaaaaugaaucucuacggauuucacggggggcaaaggguugggccugucuccgccauagggguuacugaggaagaaaccccaucaccuacugaaccauccaccgaagcaccugaagcuccugaggaacccuuauuaggcgagcucacagugaccggauccucuccagauucucucucacucucuuggaccguaccacagggacgauucgauuccuuuacggugcaauacaaggaucgggacggucagccucagguaguacgggugcguggcgaggaaucugaagucaccgugggaggcuuggaaccuggaagaaaguauaagaugcaccuuuacggccuucacgaaggccagaggguugggccuguguccacuguuggaauaacagcuccacugcccacuccauugcccguggagccaagacugggagaacuggcuguagcugccgugaccagcgauucugugggucugagcuggacugucgcccagggcccguuugauagcuuuuuaguacaauaccgggaugcucaggggcagccucaagcgguacccgucagcggugaccucagggccguggcaguaagcggccuggauccugcccgcaaguacaaauuucuccuuuucggacugcaaaauggaaagcggcaugggcccguuccuguggaagccagaacugcacccgauacaaaacccuccccucgccucggagaacucacaguaacugacgcaacacccgauucugugggccucagcuggaccgucccugaaggggaguuugacucauuuguagugcaauauaaggauaaggauggcagauugcaggugguacccgucgcugccaaccaaagagaggucaccguacagggcuuagagcccagccgcaaauaccgguuuuugcuuuauggcuugucgggacguaagcgacucggaccuaucucugcugauagcaccaccgccccccuagaaaaagaguugccuccccaccuaggagaguugacuguagccgaagaaaccucaucaucccucagauuauccuggacaguggcucaaggaccuuucgacucguucguuguucaguaccgagacacggauggccaaccacgcgcugugccuguugcagcggaccagcgcaccguuaccguggaagaucuugaaccuggcaagaaguauaaauuucugcucuauggccugcuaggagggaagagauuaggcccugucagcgcacugggcaugacugcuccagaggaagacacaccagcaccggaacuggccccugaggcaccggagccaccagaagaacccaggcugggcguccugaccgugaccgauacuacuccagacucuaugcggcuuucuugguccguugcucaaggaccauuugacuccuucguggugcaguacgaggacacaaaugggcagccucaagcucugcucguggacggagaucagagcaagauucugauaagcggccuagagccaucaacuccauacagguuccuguuguacggacugcaugaaggaaagcggcucggaccccuguccgcagaggguaccacaggacuggcuccugcugggcagacauccgaagagagucggccccgucuaucucagcugucuguuaccgacguaaccaccucuucccucagacugaacugggaggccccaccuggcgcuuuugauucuuuucuccucagauucggaguuccgucuccuagcacccuugaaccccacccacguccucuccuccagcgggaacugaugguccccgggacaagacauagcgccgugcugagagaccugcguagugguacauuauacucuuugacacuguauggucuucgcgguccacacaaggcugacucuauucaaggcacugcucgaacauuauccccuguuuuggaaaguccccgagaucuccaauucucagagauucgugaaaccuccgcuaaagucaauuggaugccuccaccaucuagagcagacuccuucaagguuucuuaucagcucgccgacggaggugaaccucaaucagugcaggucgauggacaggcaaggacccaaaagcuucaggggcugaucccaggagcgcgauacgaggucaccguugucagcgugcguggauuugaggagucagagccucuuacuggauuucuuacaacagugccagauggcccuacucagcuucgcgcccuaaaucuuaccgaaggcuuugcuguauugcacuggaagcccccacaaaacccagucgacaccuaugacguucagguuaccgcucccggcgcaccaccucuucaggcagagaccccugggagcgccguggacuacccucugcacgaucugguucugcacacuaauuauacggcgacagugcgcggccugcgcggaccuaaucugacuucuccagcuuccauuacuuuuaccaccgggcuugaagcuccacgcgaccuugaggcuaaggaagucacacccagaaccgcucuuuugacauggaccgaacccccaguccggccugccggcuaccuucuaucauuccacacccccgguggucagaaccaagagauuuuacugccuggaggaaucaccucccaucaacugcugggccucuuucccucaaccucguacaaugcucggcuucaggcuaugugggggcagagccuucucccacccgugaguacuagcuuuaccacaggcgggcuaaggaucccauuuccccgugacugcggagaagaaaugcagaauggugccggagccucuagaaccucaacaauuuuuuuaaacgguaaucgcgaacggccccuuaauguuuuuugugacauggaaacagacggcggagguuggcuuguauuccaaagacggauggacgggcagacugauuuuuggagagacugggaagacuacgcacauggcuuugguaacaucaguggggaguuuugguuagguaacgaagcgcugcacucacugacucaggcaggggacuacagcaugaggguggaucuucgagccggugaugaagccguuuuugcacaguaugacucauuccacguggacucggccgcagaauacuacaggcugcaucuggagggauaccacgggacugccggcgacucaaugucauaccauaguggcucuguguuuagcgcccgggacagggauccgaacucgcuguuaauuucgugugcuguaaguuauaggggcgcauggugguaccggaauugucacuacgcgaacuuaaacggguuguacggaucaacaguggaucaccaaggagucaguugguaucauuggaagggauucgaguuuucaguuccguucaccgagaugaaacugcggccccguaauuuuaggaguccagcaggcggagguuag

SEQ ID NO: 31993 - RNA, 12729 nt, Artificial Sequence
  Description of Artificial Sequence: Synthetic coding sequence
augaugccggcucaguaugcacucaccuccaguuuaguguuguugguuuuauuaucuaccgcuagagccggaccuuucuccagcagaagcaacguuacccugccugcaccucggccuccuccucagccaggaggucacaccgugggggccgguguggguucacccucaucacagcuguaugagcacaccguggagggcggggaaaagcagguuguguuuacucacaggauuaaccucccaccaagcacgggguguggaugccccccaggaaccgaaccgcccguguuagcuagcgaaguucaagcucugagggugagacuagaaauucuagaggaacuggugaagggacucaaagaacaaugcaccggagguugcugcccagcuagcgcacaggcugguacuggccaaacugacguuaggacgcucugcucacuccacgggguuuuugaucuguccagauguacguguucgugugagcccggcugggguggaccuacaugcucugaccccacugaugcggaaaucccaccuucguccccaccaucggcuucaggcucuuguccugacgauugcaacgaucagggaaggugugugcguggccgcuguguuuguuuuccgggguauacgggcccuucauguggguggccuuccugcccaggugauugccaaggccgcgggaggugcgugcaggggguguguguguguagggccggguucucgggaccugauugcagccagcguuccuguccgcggggcuguagccagagaggucggugcgaaggaggaaggugugugugcgauccugguuauaccggagaugauugugguaugcggucgugcccucgaggauguagccagcgagggagaugcgaaaaugguaggugugugugcaauccagguuauacaggcgaggauuguggggugcggaguuguccucgcgggugcagccaacgggguagguguaaggauggaagaugugugugcgaucccggcuacacuggagaggauugugggacucguagcugcccaugggauugcggcgaagggggcagauguguggacgggagaugugucuguuggccgggcuacacaggagaagacugcagcaccaggacgugcccacgggacugucgaggccgcggaagaugcgaggauggggagugcauuugcgauaccggguacuccggggacgauugcggcguucgaagcugcccaggugacuguaaucaaagagggcgcugcgaagacggaagaugcguaugcuggccuggguauacaggaacagauugcgggagucgagcaugcccucgcgauuguagaggccguggaaggugugaaaauggggucuguguguguaaugcgggauauucuggcgaggacugcggcguccgaaguugccccggugacugucgagggagaggcaggugcgaaucaggcagguguaugugcuggcccggguauacuggacgggacuguggcacaagggcgugcccgggugacugucgaggacguggucgcuguguagaugggagauguguauguaacccagguuucaccggcgaggauugugggucuaggagguguccuggcgauugccggggacauggccuuugcgaggacggugugugugugugcgaugccggcuacucuggugaggacugcagcacccgaagcugccccggggguugcagaggaaggggucagugccuggaugggaggugcguaugugaggacggguauuccggggaggauugcggggucagacaaugccccaacgacugcucacagcaugggguuugccaggacgggguguguaucuguugggaagguuacguuagcgaggacugcucaauucgaacuugcccaucuaacugucaugguagaggucguugugaagaaggccggugccugugugaucccggauauacagguccgacuugcgcgacucgaauguguccagccgacugucgggggcgaggccguuguguccagggggugugucuaugccacgugggguacggcggagaggauuguggacaggaagaaccaccagcuagcgcuugcccaggaggcuguggaccacgugaacuguguagagccggucagugugucuguguugaagguuuccgagggccagauugcgcuauucagaccugcccuggggacugccggggccgaggcgaaugucaugaugggagcugcgugugcaaggauggcuacgccggggaagauugcggugaggaaguuccuacaauugaagggaugagaaugcacuuacuggaagaaacgacaguucgcacagaguggacuccugcacccggcccaguggaugccuacgagauccaguuuauacccacgacugaaggagcaucgccuccauuuacagcccgagucccauccucugcgucagccuacgaucagcgaggucuggcuccuggacaagaauaucaagugaccguucgggcgcugagggggacuuccuggggacuccccgcuucuaaaacuaucaccacgaugauugaugggccacaggaucugcgagugguggcugucacaccgacaaccuuagaauuaggguggcuaagaccccaggcagaaguggaccgcuucguaguuucuuacguaucugcugguaaucaaagaguacguuuggagguuccuccagaagcugacggaacccuuuugaccgacuuaaugccagggguugaguauguuguaaccguuacugcugaaagagguagggcagucuccuacccagcaucaguacgcgcuaauacuggaagcagccccuuaggccuccuagguacuaccgacgagccaccaccgagcggacccagcacgacccagggugcacaggcgccacuguuacaacagaggccacaggaacucggcgaacugagggugcugggacgagacgagacuggcagacugagagucguguggacggcccagccugauacauuugcauauuuccagcugagaaugagggucccagaaggcccuggagcccaugaggagguacuacccggagaugugagacaagcccugguaccccccccuccgccuggaacgccuuaugaguuaucuuuacauggaguaccccccggugguaaaccuucugaccccauuauuuaccagggaauuauggauaaggacgaggagaagcccgggaaaaguucaggccccccuagacugggugaacuuaccguuacagauagaaccuccgacagcuugcuccugcgauggacagucccugagggggaguuugacaguuucgugauucaguacaaggauagagauggucagccacaggucgugccaguggaaggcccucaacguagcgcugugauuacuucucuggacccaggacgaaaauauaaguucguacuuuaugguuucgugggaaaaaaaaggcacgggccccucgucgcagaagcaaagauacuaccgcaaucugacccuagucccgggacucccccucaccucgguaaccuguggguaacugauccaacccccgauucacuucaccugucuuggaccguucccgagggacaguucgauaccuuuauggugcaguacagggacagagauggccggccccagguaguccccguggagggaccagaacgaucuuucgugguaaguagccuggauccugaucauaaauaccguuucacccuguucggaaucgccaauaaaaagcguuacggcccuuuaacugcugacgggacaaccgcccccgagaggaaggaggagccacccagaccagaguuccuggaacaaccacugcuuggcgaacucacugucacaggugucacucccgauucucugcggcuuuccuggacuguggcccaaggcccuuucgacucuuucaugguacaguauaaagaugcacaaggccaaccgcaagcaguuccuguagcgggcgaugagaacgaggugacaguuccuggacuagacccagauagaaaguacaagaugaaccuauacggauugaggggacgucagagaguugguccagaauccguuguagcgaagaccgccccacaagaggacguggacgaaacccccaguccuaccgaacuggggacagaggccccagaaagucccgaagagccgcuccuaggagagcuuaccgugaccgguagcagcccagacucccuuuccuuguucuggacagugccccaagguaguuuugacucuuucacuguucaauacaaggauagagacggaagaccacgcgcugugagagucggagguaaggagucugaaguuacuguuggaggucuugaaccaggacauaaauauaagaugcaucuguauggccuccacgaaggucagaggguggggccugucucugcuguaggaguaaccgcuccacaacaagaggagacucccccugcuacagaaucuccguuggagccgaggcugggugaacugacugugaccgacgugaccccuaacucagugggccuuucuuggacugugccugagggccaauuugauucuuucauuguucaguauaaggacaaggacggucaaccacaagucgugccuguagcggcugaccagcgugaagugacaguuuauaaccuagagccagagaggaaauacaagaugaacauguacggguugcaugacggccaacgaaugggcccucugucagucguuauaguuacugccccgcugccacccgccccugcuacugaagcaaguaaaccuccgcuggagccuagacuuggagaacuaacaguaaccgauaucacuccugauucaguaggcuuaucuuggacaguaccugaaggcgaguuugauaguuuugucguccaguauaaagauagagacggacaaccucaagucgugccuguagccgcugaccagagagaggugacaauaccggaccucgagcccucccgcaaauauaaguucuuacucuucggcauccaagacggcaagcgccggucccccguguccguggaagcaaagaccguggcgagaggagacgcuuccccuggggcuccaccacgccugggcgaacucuggguuaccgaucccaccccugacagccuacggcugagcuggacugugccggaagggcaauuugacuccuucguaguacaguuuaaagacaaagacggaccucaggucgugcccgucgaaggucacgagagaucugugaccgugacuccacuugaugcuggacggaaguacagauuuuuguuguacgggcugcucgggaagaaaagacauggcccacugacggccgauggaaccacagaggccagauccgcuauggaugacacagggacgaaacggcccccuaaaccuagguuaggagaagaacuccaaguuacuacugugacccagaacaguguuggccuaucauggacggugccggagggacaauuugacuccuuugugguucaguacaaggauagggacggccagccccaaguaguaccaguggagggcucccugagggaaguauccgucccaggucuggauccggcacaccgcuacaaauuacuauuguacggccuacaccaugguaaaagagugggccccauuagcgcugucgcaaucaccgccgguagagaggagacagagacagaaacgacagcacccaccccccccgcgcccgaaccacaucucggcgagcuuaccguugaagaggccacuucucauacauuacaucugucuuggaugguaacagaaggagaauuugacuccuuugagauucaauauacugaccgagauggacaauugcaaauggugagaauuggcggggaucgcaacgacauuacacugaguggacuggagucugaucaccgcuaccuggugacucucuauggguucagcgacggcaagcacgugggccccguacacguugaggcacuaaccguccccgaagaagagaaaccauccgaaccuccuacagcuacgccggaaccucccauuaaaccuagacucggggagcucacugugacugacgccacuccagauagccugucacugucguggaccguaccagagggacaauuugaucacuuccucguucaguaccgcaacggugacggccagccuaaggccguucgcguacccgggcacgaagaaggugucacuauuucuggacuggagccugaucauaaauauaagaugaauuuguauggauuucacggcggacaacgaaugggcccugugagcguggucggcgugacugcugcugaagaagagacacccucgccaacggaaccgucaauggaggccccugagcccgccgaagaaccucuauuaggagaauuaaccguuacagguagcucuccugacucauuaagucucucuuggacagucccccagggaagguuugauaguuucaccgugcaguacaaggaccgugacgggcgaccccaggucgucagggugggaggcgaagagagugaaguuacggucggaggauuagagcccggaaggaaauacaaaaugcaucuguauggguugcacgaggguaggcgggugggaccagucagcgcugugggcguuacagcacccgaagaggaaaguccagacgcuccccuggcaaagcucagacuuggucagaugacuguccgcgauaucaccagcgauucuuuaucucucucauggaccgugcccgagggccaauucgaucacuuucuggugcaauuuaaaaacggcgacggccagcccaaagcugugagagugcccggccacgaggacggcgugacuaucucuggccuggaaccagaucacaaauacaaaaugaaccuguacgguuuccauggagggcagcggguuggaccaguuagugccgugggccugaccgcacccggaaaggacgaggagauggcuccagcuucuaccgaaccaccuacccccgaaccucccaucaaaccccgacuagaagaacugacaguaaccgacgccacuccagacagccugucucucagcuggacggugcccgagggacaauuugaucacuuucucgugcaguacaaaaauggggacggccagcccaaagcaacccgggucccuggccacgaggaccgcgugaccauuucuggguuagagcccgauaacaaguauaaaaugaaucuauacggguuucacggugggcagagaguuggaccagugucagccaucggagugacagccgcagaagaggaaacaccaucaccaacugaaccguccauggaagccccugagcccccugaagaaccucuacucggggaacugacagugaccgggaguagcccugacucacucucuuugaguuggacaguaccacaaggucguuucgacagcuucaccgugcaauacaaggauagagacgggcgcccucaagucguacggguugggggagaagaauccgaaguaacggucgggggccuggaaccaggaagaaaauauaagaugcauuuauaugggcuacacgaaggacgccgcgucggcccggugaguacagugggagugacggccccgcaagaagacguggaugagacccccagcccuacagaaccaggaacugaggccccaggaccuccagaagaaccacuguuaggugaacugaccgugaccggaagcuccccugauagcuugucucuaucauggacugucccacaaggucgcuuugauucuuuuacuguacaauacaaagacagagauggaagaccccaggcggugagaguggggggacaggaguccaaagugaccguucggggauuggaaccaggaaggaaauauaaaaugcaccuguacggauugcaugagggccgacgacucgggcccguuagcgcagugggaguaacggaggacgaggccgagaccacccaagccgucccuaccaugacuccagaaccuccaauuaagccucgcuuaggugagcucacaaugacagacgcgacaccugacucacuaucauugucuuggaccgucccugaagggcaauucgaccauuuuuuaguacaauaucgcaacggagauggccagccaaaagcuguacgaguccccggucacgaagacggcguaacaauuucuggacuggagccugaccauaaauacaaaaugaaccuguacggcuuucauggaggucaacgugucgggcccauuagcguaauuggaguuacagccgccgaagaggaaacuccauccccgacggagcucaguacugaagcacccgaaccaccagaggagccccuucugggcgaacugacugugacaggaucuagucccgacucccucucacuguccuggaccauaccacagggucauuucgauucauucacaguucaauauaaagauagagacggccggccucaggugaugagagugcgaggggaggagagcgaagucaccguugggggucuggaaccugggaggaaguauaaaaugcauuuauaugggcuucaugagggaaggagaguuggcccggugagcacaguuggcgugaccgaggacgaggccgagacaacccaggcugugccaaccacgacccccgagccacccaacaaaccuagacucggcgaacugacagucacagaugcuacgccugauucccuaucacugagcuggauggugccugaaggacaguucgaucacuuccuggugcaguacagaaauggcgacggacagccaaaagugguucgaguuccugggcacgaggacgguguaaccauuucuggacuggagcccgaucauaaguacaagaugaaccuguauggcuuucacggugggcagcgcguuggaccuauuagugugauuggugucaccgcggccgaagaggaaaccccagcaccuacugaaccaucgacugaggcuccugaacccccggaagaaccacuguuaggugaacuuaccguuacgggcucaucccccgacucacuaucucuaucuuggaccauuccccagggacgcuuugauagcuuuaccgugcaguauaaagaucgggacggacggccacagguugugcgcgugaggggagaggagucagaagucaccguagguggacucgagccuggauguaaguacaaaaugcaccuguauggccuacacgagggacagcgagugggacccgugucagcggucggcgugaccgcgccuaaagaugaggccgaaacaacacaagcuguacccacaaugaccccugaaccucccauuaaacccagacugggcgagcugacaguuaccgacgcaaccccugacucccuaagucucucuuggauggugccugaggggcaguuugaucacuuuuuggugcaguacaggaacggcgaugggcagccaaaggccguaagagucccuggucaugaagacggagucaccauuuccggacuggagccagaucacaaauacaagaugaaucuuuauggauuccacggugggcagcgaguuggccccgucagugccauuggagugacagaagaagaaaccccaagcccuaccgaaccauccaccgaagccccagaagcacccgaggaaccucugcuaggugagcugacuguuaccgguuccucccccgacucucugagucugagcuggacgguuccgcagggccguuuugauagcuuuaccgugcaguauaaagauagagauggccagccucagguuguccgaguuaggggggaagaaucugaagugacagugggcgggcuggagccuggucgaaaguacaagaugcaucuguauggacuccaugagggccaaaggguugggccaguuucuacagucggaaucacugcaccgcugccuacaccauugccuguagaaccucgucuuggcgagcuugccguugcggcuguaacuagugacucagucggccuguccuggacaguggcccagggaccauucgacucuuuucucgugcaguaccgcgaugcucagggacagccucaagcaguuccugugucaggggaccuucgcgccguggccgugucaggauuggauccggcuagaaaauacaaguucuugcuguuugggcuccagaauggaaagcggcacggacccguccccguagaagcccgcaccgcacccgauaccaagccuucgccucgacuuggcgagcugacagugacagaugccacuccggauucuguggguuugagcuggacuguucccgaaggcgaauuugacucuuucguagugcaguacaaggauaaagacgguaggcuccaaguagugccuguagccgcaaaccagagagaaguuacagugcagggacuggaacccucaagaaaauaucguuuccugcucuacggacucucgggucggaagcgucucggaccaauaucagcugauuccacaacagcuccucuugagaaagaauuaccuccccaccuuggagagcugaccguagcugaggagacaucaaguucccugcgucuaucuuggaccgucgcucagggcccauucgauaguuuuguggugcaguauagagacacggacggccagccacgcgcaguaccgguggccgcugaccagagaacagugaccguugaagaccuggaaccuggcaaaaaguacaaauuuuugcuguauggauugcuuggaggaaagaggcuggguccagucagcgcccuggguaugaccgcaccugaagaagauacaccggcgccugaauuagcaccagaagccccugaaccgccugaagagccaagacugggggugcugaccguaacggauacaaccccagauucaaugagacucuccuggagcgucgcccaaggacccuucgauagcuucgucguucaauaugaggacacaaacgggcagccucaagcauugcucgucgacggagaccagucaaaaauacugaucaguggcuuggaacccucaacuccguacagauuucucuuguauggguugcacgaaggaaaacgacucgguccccucagcgccgaaggaacaacagggcuggcccccgcaggacagaccucagaagaaucacgacccagacugucucaacuuucuguuacugacgucacgacuagcagucuucgacugaauugggaggccccaccuggcgcauuugauaguuuccuacuucgguuuggagucccuucaccuucuacucucgagccccaucccaggcccuuguuacaacgcgaacuuauggugcccggaacucgccauuccgccgugcuacgugaccuaagaucuggcacucuauauucccucacacuuuauggucugcgcggaccacacaaggcagacucuauccaaggcaccgcuagaacacugagucccgugcucgaaucucccagggauuugcaguuuucugagauucgcgaaacuucggcuaaagugaauuggaugcccccgcccucccgugcagauucauucaaagucaguuaccagcucgccgauggaggcgagccucaguccgugcaaguugauggacaagcacguacucagaagcuccaaggcuugauccccggugcccgguaugaggugacuguggucucaguucgugguuucgaggagucagaaccucugacuggauuucugacaacagugcccgacgggccaacucaauugagagcuuugaaccuuaccgaaggauucgccguccuccacuggaagccgccucagaauccgguggauacuuacgaugugcaagugacagcuccuggcgcacccccccugcaggcagaaacaccuggcucagcuguggauuacccucuccaugaucucguuuuacauaccaauuacacagcuacugugcgcggccugagggggccaaaucuuacaucacccgcuucuauuacuuucacaacagggcuggaagcuccgagggaucucgaggccaaggaggucaccccccgaaccgccuugcucacuuggaccgagccuccagugaggccugccggcuaccugcuaucuuuucauacaccuggcggacaaaaccaagagauucugcuacccggagggauuacaagccaccagcugcucggacuuuucccuaguacguccuacaacgcccggcuccaggcaauguggggucagagccuacugccacccgucucgaccagcuuuacgaccggaggacucagaauuccuuuuccucgagacugcggcgaggagaugcagaauggcgcuggggcaaguagaacaaguacgauuuucuugaauggaaaucgggaaagacccuuaaacgucuuuugcgacauggaaaccgacggaggaggaugguuaguguuccagcgacgaauggacggacaaacugacuucuggcgggacugggaagauuaugcacacggguucggaaacaucagcggcgaguuuuggcugggaaaugaagcccuccauagucucacccaagccggcgauuacagcaugcguguggauuuaagggcuggagacgaggccguauuugcucaguacgauuccuuucacguugauucagcugccgaauacuaucgacuucaccuggaagguuaucacggcacugcaggcgauaguaugagcuaccacuccggcuccguguucuccgcucgagaucgggacccuaauucucugcuuaucaguugugcugucaguuaucguggagcuuggugguaucggaauugucacuacgcuaaccugaacggccuguacgggucaacaguggaccaucagggugugucuugguaucauuggaaaggcuuugaguucaguguccccuucacagaaaugaaacugaggccuagaaauuucaggaguccagcuggcggagguuag

SEQ ID NO: 31994 - RNA, 2022 nt, Artificial Sequence
  Description of Artificial Sequence: Synthetic coding sequence
augcgacuaagcuggaguguagcucagggcccauuugacaguuucgucgugcaguaugaggauacaaauggacaaccucaggcacugcuuguagauggagaccagucuaagauacugaucucuggccuugaaccuaguacgccauauagguuucugcuuuacgggcugcacgaggggaaacgauuagguccucugagcgcggaagggaccacgggacucgcaccagccggacagacaagcgaggagagcagaccuagacuuucccagcucagcgucacagaugucacuacaagcuccuugcgucugaacugggaggcccccccuggcgcuuuugauuccuuuuugcugcgauucggcgucccaagcccuucuacauuggaaccccaccccagaccucugcugcaacgagaacucauggugccuggaacacgccacagcgccguacuucgggaccugagauccggcacacuuuauucccugacacuuuacggcuugagagggccucacaaggccgacucuauacaagguacugcacgcacacuuucacccgugcuagagagucccagggacuugcaauuuucugagauacgggaaacaucagccaaggugaacuggaugccucccccaucaagggcugacuccuuuaaggucuccuaccaauuagccgacggaggugagccacaaagcguacaaguagacggccaggcaaggacccagaagcugcagggacugauccccggugcuagguaugaggugacagugguguccguaagagguuucgaggaaucagaaccgcucacagguuuccugaccaccgucccugauggaccuacccaguuaagagcacucaacuuaacugaaggcuuugcagucuuacacuggaaaccaccccagaauccagucgacacuuacgacguucaaguuacagcgccaggggcuccaccucuucaagccgagaccccagggagcgcaguggauuauccccugcacgacuugguucugcacacaaacuacacggccacaguacgaggacugcgcggaccaaacuugacuagcccggcaagcaucaccuucacaacaggacuggaagccccuagagaccuugaagcuaaagagguaacaccacggaccgcucuacugacauggacugaaccgccugugcggccugcggguuaccugcucucauuucacaccccaggaggccagaaucaggagauacuacuucccggcggcauuacuucacaccaacugcuuggacucuuuccuucuacuuccuauaaugcgaggcugcaggcaauguggggucagucgcuguugcccccuguuaguaccucauucaccaccgguggacugagaauccccuucccacgcgauugcggugaagagaugcaaaauggggcaggugcauccaggaccuccacuauauuccucaacggcaaucgagaacggccacugaacguauuuugugacauggagaccgauggcggcggauggcuggucuuccagagaagaauggaugggcaaacugacuuuuggagggauugggaggauuacgcucacggcuuuggaaacauuaguggggaauucugguugggcaacgaggcuuuacacucuuuaacacaagcgggagacuauucaaugaggguugauuugagggcgggcgaugaagcaguauucgcucaguacgacucuuuucacguugauagcgcagcagaguacuauaggcuucaccuggagggauaccacgggacugcuggugauuccaugucuuaccacagcggaaguguauuuucagcacgggacagagauccaaacucacuauugaucaguugugcgguuucuuaucgcggagcuuggugguaccggaauugucacuacgcgaaucugaacggucucuauggaagcacuguggaucaccagggggucagcugguaccacuggaagggauuugaguucucggucccauucacugagaugaaauugcggccuagaaacuuucggagcccagcuggaggcggauag

SEQ ID NO: 31995 - RNA, 1335 nt, Artificial Sequence
  Description of Artificial Sequence: Synthetic coding sequence
augccgagauccggcgcgcccaaagaacgaccugcugaaccacugacaccacccccauccuacggucaucaaccccaaaccggguccggagaguccagcggugcgagcggcgauaaagaucaccuguauaguacuguguguaagcccagauccccuaaaccugcagcgcccgccgcgccccccuucuccucuaguagcgggguacuggguacugggcugugugaacuggaccgacugcuacaggaacuaaaugcuacacaauucaacauuacagacgaaauuaugucccaguuuccaaguaguaaaguggcgucaggugagcaaaaagaggaccaguccgaagacaaaaagcggccuagcuuaccaucuagucccaguccaggccugccuaaagcguccgccacaucagcgacacucgagcuugaccgccuaauggcgucacugucagauuuuagaguccagaaucaccucccugcuucgggccccacucagccucccgucgugucauccaccaaugaggguagcccauccccaccggaacccaccggaaagggaucacucgauacgaugcucggguuacugcagagcgauuuaagccgucgcggcgugcccacccaggcaaagggcuuguguggaucaugcaauaagccgauugcgggucagguugugacugcacuagggcgcgcuuggcauccagagcauuuuguuuguggagguuguucaacagcacugggagguuccagcuucuucgaaaaagauggcgcaccuuuuugucccgaauguuacuucgagagauucucaccucggugcggauucugcaaccaaccuauuaggcauaagauggugaccgcccuggggacgcauuggcauccugagcauuucuguugcgucucuuguggugaaccauucggggaugaaggguuucacgaacgugagggccguccauauugucgacgagacuuccugcaacuuuuugccccacgcugccagggaugucaagggccuauccuagauaacuauaucuccgcuuugucugcuuuauggcaccccgacuguuucgugugccgcgaauguuucgcccccuucucuggcgggagcuucuuugaacacgaagguagaccacuuugcgagaaccauuuucacgcacgacgcggaucucugugcgcuacgugcgggcugccugugacgggcaggugugugagcgcgcucggccgucgauuccacccugaccauuuuacauguacauucugccuccggccccugaccaaggggagcuuucaagaaagagccggaaaaccauauugucagccauguuuccuaaaacuguucggauag

SEQ ID NO: 31996 - RNA, 1335 nt, Artificial Sequence
  Description of Artificial Sequence: Synthetic coding sequence
augccucguuccggcgcacccaaggagagacccgcagaaccccucacaccacccccuucuuacggucaucaaccacagacaggaagcggagaauccagcggugcuucaggcgauaaagaccaucuuuacaguaccgucuguaaaccgcggucacccaaacccgccgccccugccgccccacccuucucuucuucuagcggaguguuaggcacgggacucugcgaacucgaccggcuguugcaagagcugaaugcuacccaguuuaacaucacagaugagauuaugagccaguucccaucguccaaaguugcauccggagaacagaaagaggaucagagcgaagauaaaaagcggccguccuugcccagcuccccuuccccuggauuacccaaggcaagcgcuacauccgcaacacuggaacuagaccgguugauggccagccugagugauuuuagaguccagaaucaccugccugcuuccggaccaacccagccccccguaguaagcagcacaaacgagggcagcccaucaccgccugaaccgaccggcaagggaucccuggacacaauguuaggcuuguugcagagugaccucucgcgaagaggcguuccaacucaggccaaaggucucugugguuccuguaacaagccuaucgcgggucaagucgucacugcuuugggacgugcauggcauccugaacacuuuguguguggcgguuguucuaccgccuuaggcgguucuucuuuuuucgagaaggauggggcuccguuuuguccggaaugcuauuuugaaagauucagcccacgcuguggcuuuugcaaucaaccuauaaggcacaagauggugaccgcucucggcacccacuggcauccugagcauuucugcugugugucauguggcgagccuuuuggggaugagggauuccaugaacgcgagggaaggccguacugccgaagagauuuucuccaguuauuugcuccgcggugccaagguugucaggguccaauucuagauaauuauauauccgcuuuguccgcucuuuggcacccugauuguuuuguguguagagaauguuuugcaccuuucucuggcggcuccuucuucgagcacgagggccgcccauuaugcgagaaucacuuucacgcuaggcgcgggagccucugugcaacauguggauuaccagucacugguagaugcguguccgcucuaggacggcgcuuccaucccgaccauuuuacaugcacauuuugccucagaccccuuaccaaaggcuccuuccaggagcgcgcgggcaagcccuacugucaaccaugcuucuugaaacucuucggcuag

SEQ ID NO: 31997 - RNA, 1386 nt, Artificial Sequence
  Description of Artificial Sequence: Synthetic coding sequence
auggaagaccuugaugcgcugcucucagaccuugaaacuacaaccucgcauaugccucguuccggggcgccuaaggaacgacccgcugaaccccugacgccuccacccuccuacggccaccaaccacagacaggcagcggcgagagcucuggugcuagcggggauaaagaccaccucuacucuacagugugcaaaccaaggaguccuaaaccagccgcuccagccgcaccucccuuuucaucauccagcggcgugcugggcacaggacugugcgaguuggaccgccuccuacaggaacucaacgcuacccaguuuaacauaacagacgagaucaugucucaguuuccgucaaguaaaguagcuaguggcgaacagaaggaagaccaauccgaagauaaaaagcgaccaucccucccuaguucuccuaguccuggccugccuaaagcaucugccaccucagcaaccuuggagcuagacagacugauggccucccugagcgacuuucgcguacagaaucacuugcccgcuagcgguccaacccagccaccuguggugucuucgacuaaugaggggagcccuucuccacccgagccaaccggaaagggcucccuggauaccaugcuggggcuccuccaguccgacuugucuagacgcggcgucccaacacaggccaagggacuguguggaucuuguaauaaacccauugcuggacaggucgucacugcuuugggcagagcuuggcaccccgaacauuucgugugcggcggauguagcaccgcacucgggggaucuucuuucuuugaaaaggacggugccccauuuugccccgaaugcuauuuugaacgcuuuucuccccgcugcggauuuuguaaccagccgauccggcauaagaugguuacggcccucggcacccacuggcauccugaacauuucugcugcguaucuuguggcgagccuuuuggugaugaagguuuucaugagagagaaggucguccuuacugcagacgggacuuucugcaacuguuugcaccgagaugccagggaugccaaggacccauuuuggacaacuacauuucagcccugucagcacuguggcauccugacugcuuuguuugcagagaaugcuucgcccccuuuagcggagguucuuuuuucgaacaugaaggccgaccacuuugugagaaucauuuccaugcccgcagaggcuccuugugugcaaccugcggguugccgguaacugguagauguguguccgcgcugggucgccgcuuucacccugaucacuucacauguacauucugcuugcgcccacugaccaaaggcagcuuucaagagcgcgcuggaaaaccguauugucagccauguuuucucaaacucuucggguag

SEQ ID NO: 31998 - RNA, 3075 nt, Artificial Sequence
  Description of Artificial Sequence: Synthetic coding sequence
augugugccagaauggccggacgaaccacugcugcuccaagagggccauauggucccugguugugucuucuuguggcauuagcucuugacguuguacgggucgauugcggccaagccccccuggaccccguauaccugccugccgcccuugagcugcuggaugccccugagcauuuuagagugcaacaagugggccauuacccuccggccaauucuucccugucuucuagaucugagacuuuucuguugcuacaaccauggccaagagcccagccccugcucagggccucuuacccaccuuucgccacccagcagguggugccuccccguguuaccgaaccgcaucagagaccuguacccugggacguccgggcaguaucaguugaagcugcaguuacaccugccgaaccauacgccagaguuuuauuccaccugaagggucaagauuggccaccugggucugggagucuuccuugcgccagacuucaugcgacacacccggcuggaaccgcacaccaggccugucguuuucagccaucacugggcgccugcgugguggagcucgagcuucccucucauugguucucccaggcauccaccacaagggcugaacucgccuacacucucgagccagccgcugagggaccgggagggugcgguagcggcgaagagaacgacccaggggagcaggccuuaccugucggagggguugaacuacgacccgcagaccccccucaguaucaggaggucccacuugaugaagccgugacccuccgcguccccgacaugcccguccgcccaggucaauuguucucugccacuuuguuguuaagacauaauuucacugcuucuuuacucacauugagaauuaaagugaagaaaggacugcacgugacugccgcuaggccagcacaacccacccuguggaccgcuaaacuugaucgcuuuaaagguucacgccaccacacuacacugauuacaugccaucgggcagggcuuacagaaccugauagcucuucuccucuggaacuaucugaauucuuauggguggacuucguaguggaaaauaguaccgggggcgggguggcuguuacuaggccaguaacguggcaacuggaauauccgggacaggccccugaggcugagaaagacaagaugguuugggaaaucuugguuucugaacgcgauaucagagcccugaucccguuggcgaaggcugaagaauuggugaacacagcaccacugaccggcgucccccaacaugugccuguaagacuaguuacaguagacggggguggggcacucgucgaggugacugagcauguaggcugcgagagcgccaauacccaagugcuucaagugucggaggcaugcgaugcuguuuuuguggccggcaaggaaagccgcggcgcacgcggaguccguguugauuuuugguggagacgucugcgcgcaagccuuaggcugacaguuugggcccccuuauuaccccuuaggaucgaauugacugacacaacacucgagcagguucgaggcuggcgugugccggggcccgcugagggcccugcagaacccgcagcagaggccagugaugaggcagaacgcagagcgcgcggcugucaccuucaguaucagagagccggagugagguuucuagcaccguucgccgcccacccucuggacggggguagacgucugacccaccuucucggaccagacuggcuucuggacguuagccaccuagucgcaccgcaugccagaguucuugacucccggguugcuucguuggaaggagguagagugguggucgguagagaaccuggcgugacguccaucgaaguucggagccccuugucugauagcauuuugggagaacaggcucucgccguuacugaugauaaaguuagcguucuugagcugcgcgugcagccugucauggguauuucccucacccugucucguggcacugcccacccaggggaagugacagcaacuugcugggcccagucugcccucccggcgcccaagcaagaagucgcacugagucuguggcuuucuuucucagaccacaccgucgccccugcagaacuguacgaccggcgagaucuaggucugucagugucagccgaagaacccggcgcaauccugccugccgaagaacagggcgcgcagcugggggucguggucaguggagccggggcagaggggcuuccauuacacgucgccuuacauccaccugagccuugucgacgcgggcggcacagggugccucuagcaucaggaacagcaugguuaggccugcccccagccagcacucccgcccccgcauugccaaguucaccggccuggucuccccccgccaccgaagcaacuaugggcgggaaaagacaaguggcagggucgguuggaggaaacacaggagugagaggaaaauucgagcgagcggaagaggaggcccgaaaagaagagaccgaggcacgggaagaagaagaggaagaggaagaagagaugguccccgcuccacagcacguuaccgaacucgagcugggcauguacgcacugcuaggaguguuuugcguugccauauucauauuucugguuaauggggugguguuugugcugcguuaccaaagaaaagagccacccgauucugcuacugaccccacauccccucaaccccacaacuggguguggcugggcacggaucaagaagaacuuagccggcagcuggaucgacagucaccaggcccgccuaagggugaaggcaguuguccuugugagucuggaggaggcggagaggccccaacccuggccccuggcccaccuggggguacaacuaguaguuccucaacucucgcacgcaaagaggccggugggaggaggaaaagaguagaguuuguuacuuuugccccugcacccccugcucagaguccagaagagccugugggagcucccgcugugcaaaguauccugguggcaggagaggaggauauuaggugggugugcgaggacauggggcucaaagauccagaagaauugcggaacuacauggaaagaauacgaggaaguagcuag

SEQ ID NO: 31999 - RNA, 1368 nt, Artificial Sequence
  Description of Artificial Sequence: Synthetic coding sequence
augggucuuagcacaguucccgaccuguugcuucccuuggugcugcuugaacuccugguagguauauaccccagcggaguuauuggccuggucccucaucucggcgaccgcgaaaagcgagauagcguguguccccagggaaaguauauccacccccagaauaauaguaucuguugcaccaagugccacaaaggaacauauuuauauaacgacugccccggaccugggcaggacacugacuguagagaaugcgaaucuggcuccuuuaccgccuccgagaaucaccugcgacacugcuugagcuguuccaaaugcagaaaagagaugggacagguugaaaucucaucaugcacaguggaucgcgauaccgucugcgguuguagaaagaaccaauacagacauuacuggucagagaacuuguuccaauguuuuaauuguagccucugccugaacggaaccguccaccugucuugccaagagaaacagaauaccguaugcacgugccacgcuggauuuuuccugcgcgaaaaugaaugugucuccugcagcaacugcaagaagucuuuggaauguaccaagcuguguuuaccucaaauugagaaugucaagggaaccgaagauucagguacaaccguucugcugccacucgugaucuucuucgggcuuugccuccuuucucugcucuucauuggguuaauguauagauaucagagguggaagagcaagcucuacucaauagucugcggcaaauccacgccagagaaagagggcgaguuagaggguaccaccacaaagccacuggcgccaaacccaaguuucagucccacacccggcuuuacaccaacacucggcuuuucucccguuccuaguagcacauucacgaguuccucuaccuauaccccuggcgacugcccaaauuucgcugccccacggcgcgaagucgccccaccauaucagggagcagacccaauccuggcuaccgcgcuugcauccgauccuauccccaacccucuucagaaaugggaagacuccgcgcacaagccccagucauuagauaccgacgacccugccacacuuuaugccgugguggagaacguaccuccuuugcgcuggaaagaauucguacgccgccuaggccugucugaccaugagauugaccgccuagaacuucagaauggacguugccugagggaggcucaguauucaaugcucgcaacguggcgcagaagaacgccucgccgagaagcaacacucgaacucuuaggacgcguguuacgcgacauggaccugcugggguguuuggaagauaucgaagaagcucugugcggacccgcugcauuaccaccugcucccucccuguuaagguag

SEQ ID NO: 32000 - RNA, 657 nt, Artificial Sequence
  Description of Artificial Sequence: Synthetic coding sequence
augggccucucgaccgugccagaucuauuauugccacugguauugcuggaacugcugguaggcaucuacccuucaggggugauaggguugguuccucacuuaggcgaccgcgaaaaaagagauuccguuuguccacaagggaaauauauccauccccaaaacaacaguauuugcugcaccaagugccauaagggaacauaccuguauaaugacuguccagguccaggccaggacacugacugccgcgaaugugaguccggaagcuuuacugccagcgagaaccaucugcgucauugucuguccuguuccaaaugucggaaggagaugggccagguggagauuucaagcugcacugucgauagagauaccguguguggcugucggaaaaaccaauaucgccacuauuggucugagaaccuuuuucagugcuuuaauugcucccugugucucaaugguaccgugcaccuauccugucaggaaaagcaaaacacaguguguaccugccaugccggauucuuucugcgcgaaaacgagugugucucauguucuaaagugcuguugugccgacccggguggaaugcuguugcccggucucgccugaccgcaaccuccgccagccagauacaagcgauucuccuuuuacaaccacccaaauag

SEQ ID NO: 32001 - RNA, 1386 nt, Artificial Sequence
  Description of Artificial Sequence: Synthetic coding sequence
auggcacccguugccguaugggcagcacucgcugucggcuuggaauuaugggccgccgcucacgcccucccugcccaaguagccuucaccccuuaugcaccagaacccggcucgaccugucggcugcgagaauauuacgaucagacagcccaaaugugcuguucuaaaugcagccccggucagcaugcaaagguguucuguacaaagaccucugacaccgucugcgacagcugcgaggacaguaccuauacccagcucuggaauuggguaccagaaugcuuaagcugcgguucaagauguuccagugaucaggucgagacgcaagcauguacucgagagcagaauagaauaugcacuugccguccagguugguacugcgcucuguccaaacaagagggaugucgcuuaugugcucccuugcgcaaaugucgcccaggauucggaguggccagacccgggaccgaaaccuccgauguugugugcaagcccugcgcuccaggcacuuucuccaacaccacuuccuccacagauauaugucggccacaucagauuuguaacguuguggcuauaccugguaacgccucaauggaugccgugugcaccuccacgagcccaacacggucgauggcuccaggcgccgugcacuuaccccagccuguuaguacccgaagccagcacacucagccaacacccgaaccaagcacggcaccuucuacauccuuccuccuuccuaugggacccucaccucccgccgagggaucuacuggcgacuucgcacugccugugggguugaucguuggagugacugcucucggacuccuuauaaucgggguggucaacugcgugauuaugacacaagucaagaagaaacccuuaugcuuacaaagagaagcuaaaguaccacacuugccagccgacaaagcaagagguacucaaggcccagaacagcagcaucugcuuauaacggcaccaaguaguucuaguuccagucucgaaaguucugcuagcgcacucgaucgccgcgcucccacaaggaaucaaccacaggcucccggaguagaagcaaguggagcaggagaggcucgcgccaguacagguuccuccgacucaagccccgggggucauggaacccaagugaaugugacgugcaucgugaacgugugcuccucuagcgaccauaguucucaaugcucaucccaggcuucuuccacaaugggcgauacagauucauccccgagugaaagcccaaaagacgagcaggucccauucaguaaagaagagugugcguucagaagccaguuggaaacgccugaaacuuugcuugguucuaccgaagagaaaccccugccacugggggucccugacgcuggaaugaaacccucuuag

SEQ ID NO: 32002 - RNA, 807 nt, Artificial Sequence
  Description of Artificial Sequence: Synthetic coding sequence
auggccccuguggccgugugggcugcucuugccguggggcuggaacugugggccgccgcacacgcucugccugcccaaguagcguuuacuccguacgccccugagcccgggucuacuugccgccucagagaguacuaugaucaaaccgcgcagauguguuguuccaaaugcucacccggccagcacgccaaggucuucugcacaaaaacaagcgacacggugugugauucuugugaggauuccaccuauacucaguuauggaauuggguuccugaaugucuauccugcggcucucgcugcucuagugaccaggucgaaacacaggcuugcacaagagaacagaacagaaucuguacgugucgaccagguugguauugugccuugucuaagcaagaaggaugucgucugugcgcgccccugaggaaaugucgcccuggauucggaguggcaagaccagguacagagacaagcgauguaguaugcaagccuugcgcucccggcacuuucagcaauacuaccaguucgacggauauaugucgcccgcaccagauaugcaacgugguugccauuccaggaaacgccucaauggaugcaguguguacaucuacaagcccuacaagaucaauggccccaggcgccgugcaccucccacaacccguguccacccgaucccagcacacccagccaacccccgagccaucuacagccccaucaacgagcuuccuuuugcccaugggccccucucccccagccgaaggauccaccggcgauuucgccuuaccagucgugagucuuucuuccaguuag

SEQ ID NO: 32003 - RNA, 468 nt, Artificial Sequence
  Description of Artificial Sequence: Synthetic coding sequence
auggcucccgucgcaguaugggccgcccuggccgucgguuuagaacucugggccgccgcacaugcccucccagcucaaguagccuucacuccauacgcucccgaacccgguagcaccugcaggcugagggaauauuacgaccagacugcccagaugugcugcagcaaguguuccccaggccagcacgcuaagguuuucugcacgaagacuucagacacugugugugauagcugugaagauuccaccuacacucagcuguggaauuggguccccgaaugucuuucuugcgggucccgauguucauccgaccaaguugagacucaggcaugcacgagagaacaaaaccguauauguacaugcagaccugguugguauugcgcacuuagcaaacaagaggguugcagacugugcgccccccuccggaagugcaggccugguuuuggagucgcgcgcccugauuuguccuag

SEQ ID NO: 32004 - RNA, 114 nt, Artificial Sequence; identical to SEQ ID NO: 31823
  Description of Artificial Sequence: Synthetic coding sequence

SEQ ID NO: 32005 - RNA, 1131 nt, Artificial Sequence
  Description of Artificial Sequence: Synthetic coding sequence
augguuguugucgccgcggcccccaaucccgcagaugguacacccaagguacugcuccuuucaggccaacccgccucugccgcaggggcacccgcaggacaggcccucccccucauggugcccgcacagagaggagccuccccagaggcagcaagcggcggacuuccucaggcuagaaaaagacagcgacucacccacuugucaccugaagaaaaagcccuucggagaaaauugaagaacagaguugcagcccagaccgccagggaccgaaagaaagcaagaaugagcgaguuggaacagcaggucgucgaucucgaagaggagaaucaaaagcuauuguuggaaaaucagcugcucagagaaaaaacucauggcuuggugguggagaaccaagaacugcgacaaagacucggcauggaugcacugguggcagaggaagaagcagaagcuaagggaaacgaagugcgacccguagccggaagcgccgagagcgcagcuggagcaggaccuguaguuaccccacccgagcaucugcccauggacuccggaggaauagacagcagcgauuccgaaagcgauauccuucuggguauccuggauaaccucgauccugucauguucuucaagugcccgucuccagaacccgcaucauuggaagagcugccggagguauacccagaaggcccaucaagucucccugcaucccuuagucucagcgucggcacgucuuccgcuaagcuugaggcaaucaacgaauuaaucagauuugaucauauuuauacuaaacccuugguccuugaaauuccuagugaaacugagucgcaggcgaacgugguugucaagauagaagaagcucccuugucccccagcgagaacgaccacccugaauucauugugagcgugaaagaggaaccuguugaagaugaucuggugccugaacugggcauaucaaauuuauuaagcagcucccauugcccuaagcccagcaguugccuccucgacgccuacuccgauugcggcuacgggggaagucuuucacccuucucggauaugagcagucuccucggcguuaaccacucaugggaagauacuuuugcgaaugaacuuuuuccacaauugaucaguguuuag

SEQ ID NO: 32006 - DNA, 1494 bp, Artificial Sequence
  Description of Artificial Sequence: Synthetic coding sequence
atgacagtattcctatcctttgcattcctagctgccatcctgacccatatcggttgcagcaatcagagacggagtccagaaaattctggtaggagatacaatcgcatccaacacggccagtgcgcttacacgttcatactccctgaacacgatggcaactgccgcgagagcacaacggaccagtacaacacaaacgcattgcagcgtgacgctccgcatgtggagccagactttagtagtcagaaactgcagcaccttgaacacgtgatggaaaactatacccagtggttacagaagttggagaattatatcgtcgagaacatgaagtccgaaatggctcaaatccagcagaatgccgtgcagaaccacactgcaacaatgcttgagataggcacaagtctgctttcccagaccgccgaacagacccgtaagctgaccgacgtcgagacacaagtactgaaccaaacctcccgacttgaaatccagctgcttgagaatagtctttcgacttacaagctggagaagcagctgttgcaacagacaaacgaaatcctaaaaatccatgagaagaactcgctgcttgagcacaagattctagaaatggaaggtaaacataaagaagaactggacacactaaaggaagaaaaggagaatctgcaagggctggtcacccgacagacttatatcatccaggaactggagaaacaactgaacagggcaaccacaaacaacagcgtcctacagaaacagcaacttgagctcatggataccgtacataacttggtcaatctatgcaccaaggagggcgtgctactgaaaggcgggaaacgggaggaagagaagccttttagggactgtgcagacgtgtatcaggcgggcttcaataagtccgggatttacacgatctatataaacaacatgcccgagccaaagaaggtattctgcaacatggatgtgaatgggggagggtggactgtcatacagcaccgcgaagatggcagcctcgattttcagaggggctggaaagagtataagatggggtttggcaatccatcaggggaatattggctgggcaacgaattcattttcgctattactagccagcgccagtacatgctgaggatcgaacttatggactgggaggggaatagagcttatagtcaatatgatcggttccacatcggaaatgagaagcagaactacaggctctatctgaagggccacaccggcacagccggcaagcagagctcactgatcctgcacggggccgatttctcgactaaggacgccgacaacgataactgtatgtgcaagtgcgccttaatgcttacgggaggatggtggtttgatgcatgcggcccctccaacctcaacggaatgttctacaccgcgggccagaatcatggcaagctgaacggtattaagtggcactactttaaagggccatcctacagtctgaggtcaacaactatgatgattaggcctctggacttt

SEQ ID NO: 32007 - DNA, 1494 bp, Artificial Sequence
  Description of Artificial Sequence: Synthetic coding sequence
atgactgtgttcctctcgtttgcgtttctggccgccatcctgacccacatcggatgctccaatcaacgtagatcgccagagaacagcggacgccggtacaatcggatccaacatggacaatgtgcctatactttcatccttccggaacatgatggaaactgtagggaatcaacgaccgatcagtacaacaccaacgccctgcaacgcgacgctcctcacgtcgaacctgacttcagctctcagaagctccagcatctggaacacgtgatggagaattacactcagtggctgcagaagctcgaaaactacatcgtggagaatatgaagtcggagatggcgcagatccaacaaaacgccgtccagaatcacactgcgactatgttggagatcggaaccagccttctctcccagactgccgaacaaacccgcaagctgaccgacgtggagactcaggttctgaaccaaacctcgcgcctcgaaatccaactgctcgaaaactccctctcaacctacaagctggaaaagcagttgcttcagcagaccaatgaaattcttaagattcatgagaagaattcgctgctggagcacaagatacttgaaatggagggaaagcacaaggaggaactggataccctgaaggaagagaaggaaaatctgcagggactcgtgactcggcagacgtacatcatccaggaacttgagaagcaacttaaccgggccactaccaacaatagcgtgctgcagaagcaacaacttgagttgatggataccgtccacaacctggtcaacctgtgcacgaaagaaggcgtcctgttgaagggaggaaaacgcgaggaagaaaaaccgttcagggattgtgctgacgtgtaccaagctggttttaacaaatccggcatttacactatttacatcaataacatgcctgaaccgaaaaaagtgttctgcaacatggacgtgaatggcggcgggtggactgtgatccaacatcgcgaagatggatccctcgatttccagaggggatggaaggagtacaagatgggattcggaaacccctcaggggaatactggctgggaaacgagtttatcttcgccatcacttcccaacggcaatacatgctcaggatcgaattgatggattgggaaggcaaccgggcgtactcgcagtacgacaggttccatatcggcaatgaaaagcaaaactatagactgtacctgaaaggacacactggcactgccggcaagcagtcgtcccttattctccacggagccgacttctccactaaagacgccgataacgacaattgcatgtgtaagtgcgcactgatgctgaccggaggttggtggtttgacgcatgcggaccatcgaatctcaatggaatgttctacaccgcgggccaaaatcatggcaaactcaacgggatcaaatggcactacttcaaaggaccatcgtactcacttcggtccaccactatgatgatcaggccgttggacttt

SEQ ID NO: 32008 - DNA, 1494 bp, Artificial Sequence
  Description of Artificial Sequence: Synthetic coding sequence
atgactgtctttctgagctttgccttcttagctgccattctcacccacataggttgctccaatcaaagacggagccctgagaacagcggccgcaggtataaccgcatccaacacgggcaatgcgcctacaccttcattctccccgagcacgatggcaactgccgcgagtcaaccacagaccagtataatacaaacgctctgcaacgagatgcaccccacgtggagcccgacttctcgagccaaaagctgcagcatctcgagcatgtgatggagaactacacacaatggttgcagaaacttgaaaactatattgtggagaatatgaagagcgagatggctcaaatccagcaaaatgccgtgcagaatcacactgccaccatgctagaaatcgggacttccctgctaagtcagactgccgaacaaacccggaagctgaccgatgtggagacccaggtgctcaatcagacaagtcggctcgaaatacaactgctcgagaattcgctgagcacctataagttggagaaacagctgctgcagcagacaaacgagattcttaagatacatgagaagaattcattacttgaacacaagatcttggaaatggaggggaagcacaaggaagaactggacacactgaaggaggagaaggaaaatctacaaggcctcgtcacacgacagacctacatcatccaggagctggagaaacagctgaaccgagctaccaccaacaatagcgttctgcagaagcagcaactggaacttatggacaccgtgcataatctcgtgaacttatgcaccaaggaaggagtcctcctcaaagggggcaagagggaggaggagaaacccttccgcgactgcgcggatgtttatcaagccggcttcaataagagcgggatctacaccatatacatcaataacatgcctgagccaaaaaaggtgttttgcaacatggacgtgaatggcggaggctggacagtcattcagcaccgcgaagacgggtccctggattttcaaaggggctggaaagagtacaagatgggtttcgggaaccctagcggtgaatattggctgggaaatgaattcattttcgccatcacaagccagcgacagtatatgctgagaatcgagttgatggattgggaggggaaccgggcatatagccaatacgatagattccatatcggaaacgagaagcaaaactaccggctctatctgaagggccatacaggaaccgccggaaagcagtccagcctcatcctgcacggtgcagacttctcaacgaaggatgccgacaatgacaactgtatgtgcaaatgcgcgctgatgctgaccggcggttggtggttcgatgcatgcggtccttccaacctcaatgggatgttctacacagctggtcaaaatcatgggaagcttaacggcatcaagtggcactattttaagggccctagctacagcctcaggagcaccacaatgatgatccgtccactggacttc

SEQ ID NO: 32009 - DNA, 1494 bp, Artificial Sequence
  Description of Artificial Sequence: Synthetic coding sequence
atgacagtctttcttagctttgcatttctcgcggctattctaacacacatcggatgcagcaaccagcgacgctcgccagaaaattccggaaggcgttacaatcgaattcaacacggtcaatgtgcttacactttcattttgccggaacatgatggaaattgtagagagtctaccacggatcaatataatactaatgcattgcagcgcgatgcaccacatgtggagcctgattttagttctcagaaacttcaacatctagagcatgtgatggaaaactacactcaatggttgcaaaaattggaaaactacattgtagagaatatgaagtcggaaatggcgcaaatccagcaaaacgctgtacagaatcatacggctactatgttagaaattgggacatcacttttgtctcagacggctgaacagacgcggaagctaactgacgttgaaacacaggtgctcaatcaaacatcgaggctcgagattcaacttttggaaaactcgttgtcaacgtacaagttagaaaaacaactcttacaacagacaaacgaaatcctcaagatccatgagaagaactcactcctggagcataagatattggaaatggagggtaaacacaaagaagaattggatacactgaaggaagaaaaggaaaacttgcaaggacttgtaacaaggcaaacctacatcattcaagagcttgaaaaacaacttaacagggcaacaaccaacaacagcgtgcttcaaaaacagcagctcgagcttatggatacagtacacaatctggtcaatctttgtacaaaggaaggcgtattgctgaagggtggcaaacgagaagaggaaaaaccatttagagactgtgccgatgtataccaggcgggattcaacaaatctggaatttatacaatctacattaacaacatgccagagccaaagaaagttttctgcaacatggacgtcaatggaggagggtggacggtaattcaacatcgtgaagatggatcgcttgatttccaacgaggttggaaagaatacaaaatgggtttcggaaatccatccggggaatattggcttggcaatgagtttatttttgccataacttcgcagcgtcaatatatgctacgcatcgaactcatggattgggaaggaaatagagcctactcacaatatgatcgctttcatattggaaatgaaaagcaaaattatcgtctttatcttaagggacatacagggactgctggtaagcaatcctctctcattctccatggcgcagattttagtactaaagatgcagataatgataattgtatgtgcaaatgtgcgctgatgctcacgggaggctggtggttcgatgcttgcggcccttctaatttgaacggaatgttttatactgctggtcagaaccacggtaaattaaacgggattaaatggcattacttcaagggaccatcatattcattgcgaagtactaccatgatgattcgacctttagacttc

SEQ ID NO: 32010 - DNA, 1494 bp, Artificial Sequence
  Description of Artificial Sequence: Synthetic coding sequence
atgaccgtgtttctgtcatttgcatttcttgcagctatcctgacgcacattggatgcagcaaccagagacggtcccccgaaaacagcggcagacgctacaacagaattcaacatggacaatgcgcgtacacctttattcttccagaacacgacggtaactgcagggaatccaccactgatcaatacaacacgaatgcactgcaaagagacgcaccacatgtggaacctgatttttcatcccagaagctgcaacatctcgaacacgtcatggaaaactatactcagtggcttcaaaaactggagaactatattgtggaaaacatgaaatccgaaatggcacagatccagcaaaacgcagtgcagaaccatactgcaactatgcttgagatcggaacgagccttctgtcacaaaccgctgaacagactagaaagctcacggacgtggaaactcaggtgctgaaccagacctcccggcttgaaattcaacttctcgagaatagcctttccacttacaaacttgagaaacagctcctccagcaaaccaacgaaatcctgaagatccatgaaaagaacagcctgcttgagcataagatactggagatggagggtaaacacaaagaagagttggatactcttaaggaggagaaagaaaacctgcagggactggtgactcgccagacctatatcatacaagaacttgaaaagcagctgaatagagcaaccacgaataacagcgtgcttcagaaacagcaactggagctgatggacaccgtgcataatcttgttaacctgtgtactaaagagggggtcctcctgaagggaggcaaaagagaggaagaaaagcctttcagggactgcgccgatgtgtatcaagccggttttaacaagtcgggaatctacaccatttacatcaacaatatgcccgagcctaagaaggtgttctgcaacatggacgtcaacggaggtgggtggaccgtcatacaacatagagaagatggctcacttgatttccaacgtggatggaaggagtacaagatgggattcggtaacccttcaggcgaatactggttgggaaatgaattcatcttcgctatcacttcgcaaagacaatacatgcttcgcatcgagctgatggattgggaaggtaatcgggcgtacagccagtacgaccggtttcatatcggcaatgaaaagcaaaactacagactctacctgaaaggacacactggaactgccggaaagcagtcctccctcattctgcatggagccgatttttccactaaggatgcagataacgacaattgtatgtgtaagtgtgcactgatgctgaccggaggttggtggtttgatgcctgcggtccaagcaatctgaacggtatgttttacacggcaggacagaatcatgggaagctgaacggcattaagtggcattacttcaagggtccatcatactcacttagaagcaccaccatgatgattcgccctttggacttc

SEQ ID NO: 32011 - DNA, 1494 bp, Artificial Sequence
  Description of Artificial Sequence: Synthetic coding sequence
atgactgtgttcctttcattcgccttcctggcagccatcctgacccatattggctgttcgaaccagcgtagatccccagaaaattccggaagaagatacaaccgcatccaacatggacaatgcgcttacaccttcatcctgccagaacacgacggaaattgccgcgagtcgacgaccgaccagtacaataccaacgccctgcaacgagatgctccgcacgtggagccggatttctcgagccaaaagttgcaacacttggagcatgttatggagaattacactcagtggctgcagaagctggaaaactacatagtggagaatatgaagtctgagatggcgcaaatccagcaaaacgctgtgcagaatcataccgccactatgctggaaatcggtacgtccttgctgtcgcagaccgccgaacagactcggaaactgactgacgtcgaaacgcaagtcctcaatcagacctcacggttggaaatacagctcttggagaactccttgtcaacctacaaacttgagaagcagctgctgcaacagaccaacgaaattctgaagattcacgaaaagaacagcttgctggagcacaaaatcctggagatggaagggaagcacaaggaggagctggacaccttgaaggaggagaaagaaaaccttcagggcctggtgactcgccagacgtacatcatccaggaactcgaaaagcaactcaatcgagcaactaccaataactcagtactgcaaaagcaacaactcgaacttatggatactgtgcataatctggtcaacctctgtactaaggagggcgtgctgctgaaaggcggtaaacgcgaagaagaaaagccctttcgggactgcgccgacgtctaccaagcgggattcaataagtcaggtatctacactatctatatcaacaacatgccggaacccaagaaggtgttctgtaacatggatgttaacggaggaggatggaccgtgatccagcaccgcgaagatgggagcttggactttcagcgggggtggaaagagtacaaaatgggtttcggaaacccatccggggagtactggctcggtaatgaattcatcttcgcgatcacctcgcaacgtcagtacatgctcaggatcgaattgatggattgggaggggaaccgcgcgtacagtcagtacgatcgattccatatcggcaacgagaagcagaattaccggctctacttgaaaggacacaccggaaccgccggaaagcagtcgtccctcatcctccacggagccgatttttcgacgaaggacgctgacaacgataattgcatgtgcaaatgcgcgctcatgctgactggcggttggtggttcgacgcctgcgggccttccaacctgaacggcatgttctataccgccggacagaaccatggcaagctgaacggaattaagtggcactactttaaaggaccgagctattcccttcgatccaccactatgatgatcaggcctctcgacttt

SEQ ID NO: 32012 - DNA, 1494 bp, Artificial Sequence
  Description of Artificial Sequence: Synthetic coding sequence
atgacggtcttcctgtcattcgcgttcttagccgcaattttgacacacattggatgcagcaaccagcgccgcagccctgaaaattccgggcgcaggtacaatcgtattcagcacggccaatgcgcctatacatttattctacccgagcacgatggcaattgccgcgaatcgaccactgaccagtataacaccaacgccctccagcgggatgcgccccatgtggagcctgacttttcgtctcagaaactccagcatctcgagcatgtgatggagaattatacacagtggttgcagaaactagagaactacattgtggagaatatgaaatccgagatggcgcagatacaacaaaatgctgtgcagaaccatactgctacgatgctggagatcggtaccagcctgctatctcagactgcagagcagacacggaaattgactgacgtggaaacgcaggtgcttaaccagacgtctagactggagatacagctgttggagaactctcttagtacatataagctggagaagcagctgctgcaacaaacaaacgaaatcctcaaaatccacgaaaagaatagccttctcgagcataaaattctggagatggaaggtaagcacaaggaggagttagatactttgaaggaagaaaaggagaacctgcagggcttggttacgaggcagacatacatcatccaggagctagagaagcagctgaatcgagcgaccaccaataacagcgtgcttcagaaacagcagctggagctgatggatactgtgcataatctggtaaacttgtgcactaaggagggtgtcctgctcaagggtggtaagagggaggaggagaagccattcagggattgcgccgacgtctaccaggcgggattcaataagtccggaatttatacgatctacatcaataatatgcctgaacctaagaaagtcttctgtaatatggatgtgaatgggggcggctggaccgtgattcagcaccgcgaggatggatctctcgattttcaaagggggtggaaagagtataagatgggtttcgggaatccatcaggcgagtactggctcggcaatgagtttattttcgccataaccagccagaggcagtatatgcttaggattgaacttatggattgggaggggaatagagcctactcccagtatgatcggttccacatcggaaatgagaaacaaaattataggttgtacttgaagggtcacacaggaaccgcagggaagcagtcatcactgatcttgcacggagcagatttttcgaccaaggacgcagacaatgacaattgtatgtgcaagtgtgcgctgatgctgactgggggctggtggttcgatgcttgcggaccgagcaacttgaacggcatgttctacacagctggacagaaccacgggaaactcaacgggatcaagtggcactattttaagggcccctcctatagcttgcgtagcaccacgatgatgattagacctctggacttc

SEQ ID NO: 32013 - DNA, 1494 bp, Artificial Sequence
  Description of Artificial Sequence: Synthetic coding sequence
atgactgtgtttctttcttttgccttcttggctgcaatcctcacccatattggctgttctaaccagagacgttctcccgaaaactctggacgaaggtacaatagaattcagcacggccagtgcgcctatacttttatcctccctgagcacgatgggaattgccgcgaaagcacgacagatcaatataacacaaatgcccttcaacgagatgcgccgcacgtagagcctgatttctcatcacagaagttgcagcacctcgaacacgtcatggagaactatacacagtggctgcagaagctagagaattatattgtggaaaacatgaaatccgagatggctcagattcagcagaacgcggtgcagaatcataccgccaccatgctggagatcggaacgtcactgctcagccaaaccgcagagcagaccagaaagctaactgatgtggaaactcaagtactgaaccagaccagccgactggagatacaactgctcgagaatagtctgagcacatataagctggagaagcagctactgcaacagacgaacgaaatcctcaagatccacgaaaaaaattccctgctggagcataagatccttgagatggagggtaaacacaaggaagaactggacaccctcaaggaggagaaggagaacctgcaggggttggtgactagacagacttatatcatacaggagttggaaaagcagctgaaccgggctaccaccaataattcagtactgcagaagcagcagctggagttaatggacaccgtgcataacctggtcaatctgtgcacaaaggagggggtgctgctgaaaggcgggaaaagagaagaagaaaagccatttagagactgcgcagatgtgtaccaagccggttttaacaagagcggtatctataccatatacatcaataatatgccggagcctaaaaaagtcttttgtaacatggacgttaatggcggagggtggacagtgatccagcaccgcgaggacggtagcttagatttccagagagggtggaaggagtataaaatggggtttgggaaccctagtggagaatactggctgggtaacgaatttatttttgcgattacaagccagaggcagtatatgctgcgcatcgaacttatggactgggagggaaaccgcgcttacagccagtatgatcggttccatattggcaatgaaaagcagaactatagactctatctcaaaggacatacgggaactgccggcaaacagtcctcccttattctccatggggctgacttttccacaaaagatgctgataacgacaattgtatgtgtaagtgcgctttgatgctgaccggcggttggtggtttgatgcttgtggaccctccaacctcaacggcatgttttacaccgcgggtcagaatcatgggaagcttaatggcatcaagtggcattactttaaaggaccaagctattctctgaggtcgacgaccatgatgatacgtcctctggacttt

SEQ ID NO: 32014 - DNA, 1494 bp, Artificial Sequence
  Description of Artificial Sequence: Synthetic coding sequence
atgacagtgtttctgtcattcgcttttctggccgcaatcttaacccacattggctgcagcaatcagaggcggagtcccgagaactccggtagacggtacaatcgcatccagcatgggcagtgcgcttatacatttatcctacccgaacacgatggtaactgccgcgagagcactactgatcagtataacacaaacgcacttcagcgcgatgcgcctcacgtggaaccggacttctcatctcaaaagctgcagcacctggagcacgtcatggagaattatacacagtggcttcaaaagctcgaaaactacatagtagagaacatgaaaagcgagatggctcagatacagcagaacgccgtacagaatcacacagccaccatgctggagatcggaacatctctgcttagtcagactgcagaacagacgcgtaaactgactgacgtggagacccaggtgctgaaccagacctctaggctggagatacagctgctggagaattctctaagcacctacaaactggaaaagcagcttttgcagcagacgaacgagatactaaagatccatgaaaagaattctttgctggaacataagattttggagatggaaggaaagcacaaggaagagctggatactcttaaagaagagaaggaaaaccttcagggactcgtcaccagacagacctatataattcaagaactggagaagcaacttaatagagccacgacaaacaactccgtactgcagaagcagcaactggagctgatggatacggtacacaatctggttaacttgtgcacaaaggagggggtcttgctgaaaggaggtaaaagagaggaggagaaacccttccgcgactgcgccgacgtctatcaggccggattcaacaagtcaggcatttacactatttatatcaacaacatgcccgagcctaagaaggtgttttgcaacatggatgttaacggagggggttggacagtcattcagcaccgcgaagacggttccttagactttcagagaggatggaaggagtataagatgggctttggtaaccctagcggcgagtattggttagggaatgagtttatattcgccatcactagccagcgacagtacatgttgaggatcgagctgatggactgggaaggaaatcgtgcatactcccaatacgaccgctttcacattggcaacgagaagcagaattaccgattgtatctgaaaggccacactgggaccgccgggaaacaatcctctttgatactacatggggccgatttctccaccaaggatgccgacaatgataattgcatgtgtaagtgcgctctcatgctcacaggcgggtggtggttcgacgcctgtggcccgtccaatctgaacgggatgttctacacagcaggacagaaccacggtaaactgaatggaatcaagtggcactactttaaggggccgagctactccctgcgcagcacaactatgatgatccggcccttggatttc

SEQ ID NO: 32015 - DNA, 1494 bp, Artificial Sequence
  Description of Artificial Sequence: Synthetic coding sequence
atgaccgtttttctgtctttcgctttcctggccgcgattctgacccacatcgggtgttctaatcagcggcggtctcctgagaattccgggaggcgctataatcggatacagcatggccagtgtgcctacacctttatcctccccgaacacgatggtaactgcagggagtccaccactgaccagtacaatacaaacgcactacagagggatgctccccacgttgagcccgatttctcttcccagaaactccaacatcttgagcacgtgatggagaactatacacaatggctccagaagttagagaattacatcgttgaaaatatgaagtcagaaatggcacagatccaacagaacgcagtgcaaaatcatacagctacgatgctggaaatagggacaagcctgctgtctcagacggccgagcagactaggaagctaactgatgtggagacgcaggtgctgaatcagacttcaagacttgaaatacagttgctcgaaaattctcttagcacctacaaactggagaagcagctgctccagcaaaccaatgaaatccttaagatccatgaaaaaaattctctcctggagcacaagatccttgagatggaggggaaacacaaagaggaactggacacgttgaaggaagagaaggagaatctgcagggtttggtgactcggcaaacgtatatcattcaggagttggagaaacagcttaatcgggccacaactaataattctgtgcttcagaaacagcaactggagctaatggatactgttcataacttagtaaatctctgcacaaaagaaggcgttctactcaagggcggtaagcgagaagaagagaagccttttcgagactgcgcggacgtgtatcaagcagggtttaacaagtccgggatatacactatctacataaataacatgcctgaaccgaagaaagtattttgtaacatggatgttaatggcggaggttggaccgttattcagcaccgtgaagacgggagtttggattttcagagaggatggaaagaatacaagatgggatttggcaacccaagcggcgagtactggctggggaatgaattcattttcgccattacatcacagaggcagtacatgctccgtattgaacttatggactgggagggaaatcgagcctattctcagtatgaccgctttcacattggcaatgagaagcaaaactaccggctctacttgaagggccacactggaaccgccgggaaacagagctctctgattctccacggagcagattttagcaccaaggacgctgataacgataattgcatgtgtaagtgcgcactaatgctgacaggaggctggtggtttgacgcctgtggccccagcaatttaaacgggatgttttataccgcaggtcaaaaccatggcaaactgaacggaataaagtggcattacttcaaaggcccctcatatagtctccgatccacgactatgatgattcggccgttggacttt

SEQ ID NO: 32016 - DNA, 1494 bp, Artificial Sequence
  Description of Artificial Sequence: Synthetic coding sequence
atgaccgtgtttctgtcgtttgcatttctcgcagcaattcttacgcatatcggttgttcaaaccaacgaaggagtcccgaaaattcaggacgtcggtacaacagaatccaacacggacaatgtgcatacacctttatactgcctgagcatgatggcaactgtagagaatctaccactgatcaatacaacactaacgctttgcagagagatgcaccacacgtggagcctgatttcagctcccagaagctgcaacaccttgagcacgtcatggagaactacacccagtggctgcagaagttggaaaactatattgtggaaaacatgaaatcggaaatggcgcaaattcagcagaacgcagtgcaaaaccatactgccacgatgcttgagattggaacctcccttctgtcccaaaccgctgaacaaacgaggaaacttaccgacgtagaaacccaagtgttgaaccagacttcacgcttggagattcaactgctggaaaattcgctttcgacttacaagctcgagaagcaactgctccaacaaactaatgaaatcctcaagatccatgagaagaatagcctcctcgagcacaaaatccttgaaatggaaggtaaacataaggaagaactggacaccctcaaggaggaaaaggagaatttgcagggcctggtaactcggcagacctacattatccaggaactggaaaagcaactcaaccgcgcgactactaataactcagtcctccagaagcagcagctggaattgatggacaccgtgcacaatttggtgaacctttgtaccaaggaaggcgtcctgctgaaaggtggaaagcgcgaagaagagaagcctttcagggattgtgccgatgtttatcaggcagggttcaataagagcggcatttacaccatctacataaacaatatgccagagcccaagaaggtgttttgcaatatggatgtgaatggcggtggttggaccgtgattcagcatcgtgaagatggatccctggatttccagagaggatggaaggaatacaaaatgggattcggcaaccccagcggagaatactggcttggcaacgaattcatattcgcaattacctcccagcgccaatacatgcttcgaattgaacttatggactgggagggcaatcgggcctatagccaatacgatcggttccatattgggaacgaaaaacagaactaccggctttacttgaaggggcacactggtaccgccggtaagcagtcgtcccttatcctgcatggtgccgactttagcaccaaggacgcggacaacgataactgcatgtgtaagtgtgccctcatgctcacgggaggatggtggtttgacgcatgcggaccatcgaacctcaacggtatgttttacactgcgggacagaatcatgggaaactcaatggaattaagtggcattactttaagggcccttcatacagcctcaggtcgactaccatgatgattagacccctggatttt

SEQ ID NO: 32017 - DNA, 1494 bp, Artificial Sequence
  Description of Artificial Sequence: Synthetic coding sequence
atgaccgtgttcctttcctttgcttttctcgccgctatcttgactcacatcggttgctccaatcaacggagaagccctgaaaatagtggccgcaggtataacagaatacaacacggccagtgcgcatacaccttcattctgccagagcatgatggcaactgtagagaatccacgacagaccagtacaataccaatgccctgcagagggatgcaccacatgttgagccggacttttcctcccagaagttgcagcatctcgaacacgtcatggagaactatactcagtggctgcagaaacttgaaaactacattgtggagaacatgaaaagtgagatggcacagatccagcagaatgcggtgcaaaaccatacagccacgatgttggagatcggcacaagcctcctttcccagacagctgagcagactcgcaaactgacagatgtggagactcaggtgctgaaccaaacgtctaggctggaaatccagttgttggaaaactccttgagcacttataagcttgaaaaacagctcctccagcagactaacgagattctcaagatccacgagaagaattctttgctggagcacaaaatcctggagatggaggggaagcacaaagaagagttggatactcttaaggaagagaaggaaaatctccaggggcttgtaacccggcagacctacatcatccaagagctcgaaaagcaactcaacagggcgacaaccaataactctgtgctgcagaagcagcaattggaactcatggacacagtgcacaacctcgtgaatttgtgcactaaagaaggggtactcctcaagggagggaaaagagaggaggagaagcctttcagagactgtgccgatgtgtaccaggcggggttcaataagagcggaatctacaccatctacattaataatatgcccgaaccaaagaaggtcttctgcaacatggacgtcaacggagggggctggaccgtcatccagcacagggaggacggctctttggacttccagcggggatggaaggagtataagatgggatttggaaatccatcaggggagtattggctcggtaacgagtttatcttcgcaattacgtcccagcgccaatatatgctgcggattgagctcatggactgggagggcaaccgcgcatactctcagtacgaccgctttcacattggcaacgagaaacaaaattataggctctatctgaaagggcacacagggacagccggaaagcagagttctctgattctgcatggcgctgacttctcaaccaaggatgccgataacgacaattgcatgtgtaagtgtgcccttatgctgactgggggctggtggtttgacgcttgcggcccctcaaacctgaatgggatgttctacactgcaggtcagaaccatggcaaattgaatggaataaaatggcactacttcaaaggaccgtcttacagcctccgctctactaccatgatgattcggccactggacttc

SEQ ID NO: 32018 - DNA, 1494 bp, Artificial Sequence
  Description of Artificial Sequence: Synthetic coding sequence
atgacagtgtttctaagcttcgcttttttggccgccatcctgacccatatcgggtgtagtaatcagaggagaagcccagaaaattccggacggagatataataggatccagcatggccagtgtgcatacacttttatcctacctgaacacgatggaaactgccgagaatcgacaaccgaccagtacaataccaacgccctgcagcgcgatgctcctcacgtcgagcctgacttcagctcccaaaagctgcaacatcttgagcatgttatggagaattacacacagtggcttcagaagctcgagaactacattgtagagaacatgaaaagtgagatggcccagatccaacagaatgcagtgcaaaatcacacagcaacaatgcttgagatcggcacctctttactttcgcagaccgcggagcagacccgtaagctaacagacgtcgaaacccaggtcctgaaccagacctcgagattagaaatacagctgttagagaatagcctgtccacctacaaattagaaaaacagctgttacagcagacaaacgagatattgaagatccacgagaaaaactcactcctcgagcataaaatactagaaatggaaggtaaacacaaggaagaattagatacgcttaaagaggagaaggaaaacctccaaggtctcgtcacacgacagacctacatcattcaggagcttgagaaacagctgaatcgggcaaccactaataatagcgtcctgcagaagcagcagcttgagctgatggacactgtccataacctggtgaatctgtgcaccaaagagggcgtcctgttaaaggggggcaagcgggaggaagagaagccattccgcgattgcgcagatgtgtatcaggccggatttaataaaagcggcatatatacaatctacattaataacatgccagagcctaaaaaagtgttttgtaacatggacgttaacgggggtgggtggacggtgatacaacatcgagaggacggttccctcgatttccaaaggggctggaaagagtataagatgggcttcgggaatccatctggggagtactggttgggcaacgagttcatctttgctatcactagccagaggcagtacatgctaaggattgagctgatggactgggagggcaacagagcatactcccagtatgataggtttcatatcgggaatgaaaaacagaattataggctttatctgaaaggacataccggaactgctggcaaacagagcagcctgatcctgcacggcgctgatttttccaccaaggatgccgataacgacaattgtatgtgcaagtgcgcattgatgttaacaggaggctggtggtttgacgcttgcgggccatcgaacctgaacggtatgttttataccgccggacagaaccatgggaaactgaatggcattaagtggcactacttcaaagggccttcgtattcactgcgctctacgaccatgatgattcggcctctggatttc

SEQ ID NO: 32019 - DNA, 1494 bp, Artificial Sequence
  Description of Artificial Sequence: Synthetic coding sequence
atgacagtcttcctgagctttgcttttctggctgcaatcctgacacacatcggatgttctaatcagagaaggtctcctgaaaactctggccgaaggtacaatcgtattcagcatggacaatgtgcttataccttcatcctccccgagcacgacgggaattgtagggagtccaccacagaccagtataacacaaacgcccttcagagggacgcgcctcacgtggagcccgacttcagcagtcagaagctccagcatctggaacatgtgatggagaactacactcagtggctgcagaagctagagaactacatagtggaaaacatgaagtcagaaatggcccaaatacaacaaaatgccgtgcagaatcacactgccaccatgctagaaatcggaacttcgctgctgtcccagactgcagaacaaaccaggaaactgactgacgtggaaactcaagttttaaaccaaactagccggctcgaaattcagctactggaaaattcactatccacctacaaattagagaaacaactgttgcagcaaaccaacgagatcttgaagattcacgagaagaattccctgttggaacacaaaatactggaaatggaggggaaacataaggaagagctcgataccctgaaggaagagaaagagaatctacagggtttggtaacgcggcagacatacatcatccaagagctggaaaagcagctgaacagagccacaactaataatagtgtgcttcagaagcagcagttggaacttatggacactgtgcacaatctggttaatctgtgtactaaggagggggtcctactcaaagggggaaagcgggaagaggagaagccattccgcgactgcgcagacgtgtaccaggccggatttaacaagtctggtatctatactatatatataaataacatgcctgagcccaagaaggtgttttgcaatatggacgtcaacggagggggctggacggtgatccagcacagagaagacggttctctggactttcagcgtgggtggaaggagtacaagatgggcttcgggaaccctagtggagagtactggctcggtaacgaattcatttttgctattaccagtcagcgtcagtacatgctgagaatagaactgatggactgggaaggaaacagagcctactcccagtatgatcggttccacataggaaacgaaaaacagaattatcggctgtacttgaaagggcacaccggtactgccggaaaacagtcctctctcattcttcacggtgccgacttctccacaaaagacgctgataacgacaattgtatgtgcaaatgtgctctgatgttaactgggggctggtggtttgacgcgtgcggtccttcaaacctcaacggtatgttctacacagctggacagaaccatggaaagctcaatggcattaagtggcattactttaaagggccctcttattctctgcgtagtacaacaatgatgattagacccctcgatttt

SEQ ID NO: 32020 - DNA, 1494 bp, Artificial Sequence
  Description of Artificial Sequence: Synthetic coding sequence
atgaccgtgttcctctcctttgcctttttggcggcaatcctcacccatattggatgctccaatcagcgccgcagccctgagaattcggggaggcgctataaccgaattcagcacggacaatgcgcgtacactttcattctgcctgagcacgacgggaactgtcgggaatccaccaccgaccagtataacaccaatgcgttgcagagagacgcaccgcatgtggagcctgacttctcatcacaaaaactgcagcacttggaacacgtcatggaaaactacactcagtggttgcaaaagctcgaaaactacatcgtggagaatatgaaatctgaaatggcccagattcagcagaatgcggtgcagaaccatactgccactatgctcgagatcgggaccagcctgctgtcgcaaactgctgagcagacccgcaaactgaccgacgtggaaacccaggtgctgaaccaaacctcacgcctggaaatccaactgctggagaactcactgtccacctacaagttggagaaacaacttcttcagcagactaatgagatcctcaagatacatgagaaaaactcactgctggagcataagatcctcgaaatggaaggaaagcataaagaggaactcgacactctgaaggaggaaaaggagaatctgcagggcctggtcacccggcagacttacatcatccaagagctcgagaagcaactgaatagggcgaccactaacaactcagtgctccagaagcagcagctcgaattgatggatactgtgcacaacctcgtgaacctttgcaccaaggaaggtgtcttgctgaagggcggcaagcgcgaagaggagaaaccattccgggattgtgccgacgtttaccaagccggattcaacaaatcaggaatctataccatatacatcaacaacatgcctgaaccgaaaaaagtgttctgtaacatggatgtcaacggaggaggctggactgtcatccagcatagagaggacggatcgctcgacttccagcggggttggaaggaatacaagatgggcttcggcaatccgtcgggtgaatactggctcggaaacgaattcatcttcgcaatcacctcacagcggcagtacatgctgagaattgaactgatggactgggaggggaaccgggcgtacagccaatacgatagatttcacatcggaaacgagaaacagaattacaggctttacctgaaggggcataccggcacggctggaaagcagtcctccctcatcctccatggagctgacttttcgacgaaggacgctgataacgataattgcatgtgcaagtgcgctctgatgttgactgggggatggtggtttgacgcatgcggtccaagcaatctcaacggcatgttctacactgccggacagaaccacggcaagctcaacggcatcaagtggcattacttcaagggaccctcatactcccttagatcaaccactatgatgatccgcccattggacttt

SEQ ID NO: 32021 - DNA, 1494 bp, Artificial Sequence
  Description of Artificial Sequence: Synthetic coding sequence
atgacggtgttcttgtcttttgcttttctggctgcgatccttacccacatagggtgtagcaatcagaggcgttcccctgagaactctgggcgacggtataacagaattcagcacggccagtgtgcatacacatttatcctgcccgaacatgacggtaattgtcgcgagtccaccaccgatcaatacaacacgaacgcactccagcgcgacgcccctcatgtagaaccagattttagctcccagaaactgcagcacctcgaacacgtcatggagaactatacacagtggctgcagaagcttgagaattacatcgtggaaaatatgaagtctgagatggctcaaatccagcaaaatgccgtacaaaaccacactgccacaatgttggagataggcacatctttacttagccaaacggcggagcagaccagaaagcttacagatgtagaaacacaggttttaaaccaaacttcacgtctggaaatccaactactagagaatagcctaagcacatataagctggagaaacagctgctccaacagactaacgagatcttaaagatccacgagaagaactctcttctggaacacaagatcctagaaatggagggcaagcacaaagaagaactggataccctcaaggaagaaaaggaaaacttgcagggcctcgttactcgccagacgtatatcatccaggaactggagaaacagctaaatcgcgccacaaccaacaacagcgtgctgcagaagcagcagctcgagttaatggatactgtacataacttggtgaacctttgcactaaggagggagtcttactaaaagggggaaagagggaggaggagaagccgttcagggattgcgcagacgtttatcaggcaggctttaataagtccggtatctacacaatttacattaacaacatgccagaacctaaaaaggtcttctgtaacatggacgtgaatggtggaggatggactgtgatccagcatcgggaagacggaagcctcgactttcagaggggatggaaagagtacaagatgggattcggtaatccatccggcgaatactggctgggcaacgagtttatcttcgccatcacctcacagaggcagtacatgcttaggatagaactgatggactgggagggaaaccgagcctactcccagtatgacaggttccacatcggaaacgaaaaacagaactaccgactttatctgaagggccacactggaactgccggaaagcagtcttccttaattctgcatggcgcagattttagcacgaaggacgctgacaacgacaactgcatgtgtaagtgcgctctgatgctcaccgggggctggtggtttgacgcctgtggaccgagcaatctgaatggtatgttctatacagctggtcagaatcatggcaaactgaatgggataaagtggcattatttcaagggaccatcatactcacttcggagtaccactatgatgataagaccgctagacttt

SEQ ID NO: 32022 - DNA, 1494 bp, Artificial Sequence
  Description of Artificial Sequence: Synthetic coding sequence
atgacagtgttccttagtttcgctttcctggccgccattctgacacatataggctgctcaaatcagcggaggtcgccagaaaatagcgggcgacggtataataggatacaacacggccagtgtgcatacaccttcatcctccctgaacatgacggaaattgccgcgagtccacaactgaccagtacaacactaacgccctgcaacgagacgccccgcatgtggagccggacttttctagccaaaaattgcagcatctggaacacgtaatggagaactacacacagtggctgcagaaacttgagaactacattgtcgagaatatgaaatcagaaatggcacagatccagcaaaatgccgtgcagaatcatacagccacgatgttggagatcgggacgtctttgctgtctcagactgccgaacagacccgcaagctgactgacgtagagacgcaggtcctcaatcagacctcgcggcttgaaatacagctcctggagaactctctcagcacctacaagctggaaaagcagctacttcagcaaaccaatgagatcttaaagattcacgagaaaaactccctgctcgaacacaagatcttggagatggaaggaaagcacaaggaagagctggacactctgaaggaggagaaggaaaatcttcagggactcgtaactcggcagacatatatcattcaggaacttgagaaacagctcaatagagcaaccactaacaactcagtgctccaaaaacagcagcttgagctgatggacaccgttcacaacttggtgaacctgtgtacaaaggagggagtgcttctaaagggtgggaaaagggaggaagagaaaccattccgcgattgtgccgatgtctaccaggctggttttaacaagtcgggtatctatacaatatatatcaacaatatgcccgaaccaaagaaagtgttctgcaacatggatgtcaacggtggtggctggacagttatacagcacagagaggacggttctctcgatttccagcgtggatggaaagagtataaaatgggcttcgggaatcccagcggcgagtattggctgggcaatgaattcatcttcgccatcacaagtcagaggcagtatatgctcagaattgagctgatggactgggaggggaacagggcatactctcaatatgaccggttccacatcggtaatgagaaacagaactatagactgtacctaaagggacataccggcacagccggaaagcagtccagtctcatactccacggggcggattttagcactaaagatgccgacaatgacaattgcatgtgcaagtgcgcactcatgctgaccggagggtggtggtttgacgcctgtggacctagtaatttaaatgggatgttctacacagcgggccagaatcacgggaagctgaacggcattaagtggcactattttaaaggcccttcctactctcttcgctccacaaccatgatgatcagacccctggacttc

SEQ ID NO: 32023 - DNA, 1494 bp, Artificial Sequence
  Description of Artificial Sequence: Synthetic coding sequence
atgaccgtgtttctgtcattcgcatttctcgctgcgatcttgacccacattggttgctcaaaccagcgccgctcccccgaaaacagcggccgccgatacaacaggattcaacacggacagtgcgcctataccttcatcctccccgaacacgacgggaactgcagagagagtaccacagaccaatacaacactaacgcgctccaacgcgacgctccacacgtggaacctgatttcagttcccagaagctgcagcacctcgaacatgttatggaaaactatacgcaatggctccagaaactggagaactatatcgtagaaaacatgaaatccgagatggctcaaattcagcagaatgccgtgcagaaccatacggcaacaatgctcgagataggcacctcccttctttctcagaccgcggagcagacaagaaaactgaccgatgtggaaacacaagttctcaaccagacttctcgtctcgagatccagctcctagaaaattccctctctacttacaaactcgaaaagcaactactgcagcagaccaatgaaattctgaaaatccacgaaaaaaactctctgctagagcataagatcctagagatggagggaaagcacaaggaggaactcgacaccttaaaagaagagaaggagaacctacagggcctcgtaactagacaaacatatattatccaagaactcgagaagcagctgaatagagccaccaccaataacagcgtgttacaaaaacaacagctggagctcatggatacagttcacaaccttgtgaatctgtgtaccaaagagggcgtcctattgaagggtgggaaacgagaagaggagaaacccttccgcgattgtgctgatgtttaccaagccggatttaataaatccggcatctatacgatatacattaataacatgccagaacctaagaaggtgttctgcaacatggatgtaaacggaggggggtggactgttatccagcacagggaggatgggagcctagactttcagcgcggatggaaagaatacaagatgggcttcgggaacccatctggcgagtattggcttggcaacgagtttatcttcgcaataacatcacagaggcagtacatgttacggatcgagctgatggactgggagggaaatagggcttacagccagtatgacagatttcacatcgggaacgaaaagcagaactaccgcctgtatctcaagggacacaccggcacagccggtaaacagtcctcactgatactgcacggggcagatttctctaccaaagacgccgacaacgataattgtatgtgtaagtgtgcccttatgctcaccggaggctggtggttcgacgcatgcggcccttctaatctgaacgggatgttttacaccgccggacagaatcacgggaaactgaacggcattaagtggcattactttaaggggccctcgtacagcctgaggtcaacaaccatgatgatcagaccactggatttt

SEQ ID NO: 32024 - DNA, 1494 bp, Artificial Sequence
  Description of Artificial Sequence: Synthetic coding sequence
atgacggtcttcctctccttcgcgtttctcgcagccatccttacccacatcggatgttcgaatcaaaggcgctcccctgagaattccggacgcaggtacaaccgcatccaacacggacaatgcgcttacacgttcattctgcctgaacacgacggcaactgccgggaaagcaccaccgaccagtacaatactaatgctttgcagcgcgacgcaccccatgtcgaaccggacttctcatcgcaaaaactgcaacatctggagcacgtgatggagaactacactcagtggctgcagaagctggaaaattacatcgtggagaatatgaaatccgaaatggctcagattcaacaaaatgcagtgcagaaccatactgccaccatgctcgaaatcggaacttctctcctgtcgcaaacggcggagcaaacccgtaagttgaccgacgtggagactcaggtgctgaatcagacttcgagactggaaattcagcttctggagaattcgctgtcgacgtacaaacttgaaaagcagcttctccagcagaccaatgagatcctgaagattcacgaaaagaactctctcctcgagcacaagatcctcgagatggaaggaaagcataaggaagaacttgataccctcaaggaggaaaaggagaatttgcagggactggtcacccgccagacctacatcatccaagaactggagaaacagctgaatagagccactaccaacaattccgtgctgcagaaacaacaactggagttgatggatactgtgcataatctcgtgaatctgtgcactaaagaaggagtcctgctcaaggggggaaaacgagaggaggaaaagcctttcagagactgcgccgatgtctaccaggctggatttaacaagtcgggtatttacactatttacatcaacaacatgccagaaccaaagaaggtgttttgcaacatggacgtcaacggtggcggctggactgtaatccaacatagggaggacggcagcctcgattttcagcgaggatggaaggagtacaagatgggcttcggtaatccatcgggggaatactggctggggaacgagtttatcttcgccatcacctcccagcgccagtatatgctgcgcattgaactgatggactgggaaggtaaccgggcttactcgcagtacgaccgcttccacataggaaatgaaaagcagaactaccggctgtacctcaaaggacacaccggaaccgcaggaaaacagtccagcctgatccttcacggagcggatttctcgaccaaggacgcagataacgacaactgcatgtgtaagtgcgctctgatgctgaccggcggttggtggttcgacgcctgcggaccctcgaatctgaacggaatgttctataccgcgggacaaaaccatggtaaactgaatggaatcaagtggcactatttcaaggggccttcttactcgttgaggtcaaccaccatgatgatcagaccgctggacttc

SEQ ID NO: 32025 - DNA, 1494 bp, Artificial Sequence
  Description of Artificial Sequence: Synthetic coding sequence
atgaccgtcttcctgtccttcgccttccttgctgccatactgacccatattggatgtagtaaccagcgccggagtcctgagaatagcggtcgacgctacaatcgaatccagcacggacagtgtgcctacactttcatcctgcctgagcacgatgggaattgcagggagagcaccactgaccaatacaatacgaatgcgctgcagagagatgccccccatgtagagcccgatttttcgtcacagaagttgcaacacttggaacatgtgatggaaaactacacccagtggctgcagaagctcgaaaattacattgttgaaaacatgaagtcggaaatggctcagattcagcagaatgcggttcagaaccacaccgcaacgatgttggagataggtacctcgctgctaagccagacagctgagcagacacgaaaactgactgatgtcgagacccaggtgttgaaccagactagccgtctggagatccagctgctggagaactccctctctacgtacaagcttgagaagcaactgttgcaacagacgaacgagattcttaaaattcacgagaagaacagcctcctggaacataagatactggaaatggagggcaaacataaggaagagcttgatacgctgaaggaggaaaaggagaacctccagggcctggtgacccgccagacctatatcatccaggagctggagaaacagctgaaccgggcaactactaataattcggttctgcagaagcaacagttggagcttatggatacagtacacaatctggtcaacctttgtaccaaggagggagttttgcttaaaggcggaaaaagagaagaagaaaagccgtttcgggattgcgccgatgtgtatcaggccggtttcaacaagtcaggcatttacacgatatatataaataatatgcccgagccgaagaaggtgttctgcaatatggatgtgaatggaggtggatggacagttattcaacaccgcgaagacggaagtctggacttccagcggggatggaaggaatacaaaatgggatttggaaatccgtcgggagaatactggttgggcaacgagttcatatttgctatcacgagtcagagacagtatatgctccgcattgaactgatggattgggagggaaatcgagcctattcgcagtatgataggtttcacatcggcaacgagaagcagaattaccgcctgtatcttaaaggtcataccggaacggctggtaagcaaagcagtcttattttacacggcgctgacttctccacaaaggatgccgacaacgataattgcatgtgcaaatgtgctctgatgttgacgggaggatggtggttcgatgcttgcggcccttcgaacctgaacggcatgttttataccgcgggccagaatcatggaaagttgaacggcatcaagtggcattacttcaaaggcccatcgtattccctgcgtagcacgacaatgatgatccgccccctagacttc

SEQ ID NO: 32026 - DNA, 1494 bp, Artificial Sequence
  Description of Artificial Sequence: Synthetic coding sequence
atgaccgtgttcctttcgtttgcatttcttgctgcgattctgacgcatatcggttgttcgaaccaacgtcggtccccggaaaattcaggcagacgatacaaccgtatacagcatggtcagtgcgcctatacgtttattctgcccgagcacgatggcaattgtagagaatcgaccaccgatcagtacaatactaatgcgctccaacgagatgcacctcatgtggaacccgatttttcgtcacaaaaacttcagcatctggaacatgtgatggagaactacacccagtggcttcaaaaacttgagaactacattgtggagaatatgaagtcagaaatggcacaaattcaacaaaacgcagtccagaaccataccgcgaccatgctcgagattggcacttcacttcttagccaaactgccgaacaaactagaaagttgactgatgtggaaacgcaggttctgaaccaaacttccagactggaaatccaactgcttgaaaacagcctctcgacctataaacttgaaaaacaactccttcaacagaccaacgaaattctgaagatccacgagaagaattcccttctcgaacataagattctcgaaatggaaggaaagcacaaagaagaactggatacccttaaagaggaaaaagaaaacttgcaaggactcgtgacccgacaaacctacattattcaagagttggaaaagcaacttaaccgtgcaaccaccaacaactcggtgttgcaaaagcagcaactggaactgatggatactgtgcataatcttgtcaacctgtgtactaaggaaggtgtgctgctgaagggcggaaagcgagaggaagaaaagccttttagagattgcgccgacgtgtaccaagccgggtttaacaaaagcggtatttacactatttacatcaacaatatgccggaaccaaaaaaggtgttctgtaacatggatgtgaacggaggtgggtggactgtgatccagcatcgagaagatgggtcgctggattttcagagaggctggaaggagtacaagatgggatttggaaacccatcgggagaatactggcttggtaacgaattcatctttgcaattaccagccagagacagtacatgctccggattgaacttatggactgggaaggaaatcgcgcttactcacagtacgatcggtttcatatcggaaatgagaagcaaaactaccgtctgtacttgaaggggcacaccgggactgcaggtaaacagagctcactgatacttcatggagcagacttttcgaccaaagatgcagataacgataattgtatgtgcaagtgtgcactcatgctgactggtggctggtggtttgacgcgtgcggcccatcgaacctcaacggaatgttctacaccgcgggtcagaatcacgggaagctgaacggaattaagtggcattactttaagggcccgagctatagccttcggtccaccaccatgatgatccgccctctcgatttc

SEQ ID NO: 32027 - DNA, 1494 bp, Artificial Sequence
  Description of Artificial Sequence: Synthetic coding sequence
atgactgtgttcctgtcattcgcgtttctggcggctattcttactcacatcggatgctccaatcaacgtcgctcgccagaaaactccggaagaagatacaacagaatccagcacggacaatgtgcatacacgtttatcctgccggaacatgatggaaattgccgcgaatcgaccaccgaccaatacaacactaatgctctgcagcgcgatgcgcctcatgtggaacctgatttctcatcgcaaaagctgcaacacttggaacatgtgatggagaattacactcagtggcttcagaaattggagaactacatcgtggaaaacatgaaatcggaaatggcacagatccaacagaatgcggtccaaaaccacactgctaccatgcttgaaatcggtacgagcctgctttcccaaacggctgaacagacccggaagctgaccgacgtcgagactcaggtgctgaaccagacttcacggctcgagattcagctgctggagaacagcctgtcgacctacaaattggagaaacaactcctgcagcaaacgaatgaaatcctgaaaattcacgaaaagaattctctgctcgagcataagattcttgagatggaaggcaagcacaaggaggagctcgacactctgaaggaagaaaaggaaaacttgcagggcctcgtgactcgtcagacctacatcatccaggaacttgaaaagcaacttaacagggcaactaccaacaactcagtgttgcagaagcaacaactggagctgatggataccgtgcataatctcgtgaatttgtgcaccaaagaaggagtgctgttgaaaggaggtaagcgagaggaggagaaaccgttccgcgactgcgccgacgtgtatcaggcaggctttaacaagagcgggatctatactatctacatcaataacatgcctgagccaaagaaagtcttttgcaatatggacgtgaacgggggtggctggactgtcattcagcatcgcgaagatggctcgttggattttcagcgggggtggaaggagtacaagatggggttcggcaacccgtccggcgaatactggcttggaaacgaattcattttcgcaatcacctcccaacgccagtacatgctgcgcatcgagctcatggattgggagggaaatcgcgcctacagccagtacgaccgctttcacatcggaaatgaaaagcagaattaccggctctacctgaagggccacaccggaaccgccggtaagcagtcgtcactgatccttcatggggcagacttctcgactaaggatgcagataacgacaattgcatgtgtaagtgcgcactgatgctgactggaggatggtggtttgatgcctgtggaccttcaaacctgaacgggatgttctacactgctggacaaaaccacggtaaactcaacggaatcaagtggcactactttaaaggaccatcttactccttgcgctccactactatgatgatcaggccgctggatttc

SEQ ID NO: 32028 - DNA, 1494 bp, Artificial Sequence
  Description of Artificial Sequence: Synthetic coding sequence
atgacagtcttcctgtcctttgcatttcttgccgctatcctgacacatatcgggtgctcgaatcagaggagaagtcccgaaaattctggacgacgctataacagaatacagcacgggcagtgcgcatatacattcatccttccagaacatgatggaaactgtagggaatcgactacagatcagtataacactaatgctctgcagagggacgccccccacgtcgaaccagatttttcatctcagaaactacagcacctcgaacatgtgatggaaaactatactcaatggctccagaaacttgagaattatatcgttgagaacatgaaaagtgagatggcacagattcagcagaatgcagtacagaaccacactgccacaatgctggaaatcgggacatccctcctttcacagacggcagaacaaactagaaaactgactgatgtcgagacacaggttctcaatcagacatcgcgacttgagatccagctattggaaaactcactgtccacttataaacttgagaaacagctgctccagcagactaatgagatcctgaaaatccacgagaaaaatagtttactggaacacaagatcctggaaatggaagggaaacataaagaagagcttgacacactgaaggaagaaaaagaaaatttacaggggctcgtgacaaggcagacatatataattcaagaactagaaaagcaattgaatagggccacaacgaataactccgttttgcagaaacaacagctggaacttatggacacagtacataacctcgttaacctatgtactaaagaaggagtactcctgaaggggggaaaacgagaagaagaaaaaccttttagagattgcgccgatgtataccaggccgggtttaacaaaagtggaatttacacaatatatataaacaatatgccagagccaaaaaaagttttctgcaacatggacgtaaacggaggaggatggacagtcatccagcaccgggaagatgggtcactagattttcagcgcgggtggaaagagtacaaaatgggattcggaaaccctagtggggaatactggctggggaatgaatttatctttgcaatcactagtcagcggcagtatatgttgcgcatagaattaatggattgggaagggaatagagcgtattcccaatatgatcgattccatatcgggaacgaaaagcagaattatcgcttgtacctgaaaggacatacagggactgccgggaaacagtcttctctgatacttcacggggccgacttctctacaaaagatgcagataacgataattgtatgtgtaaatgcgcactcatgctaacaggaggatggtggtttgatgcttgtggaccatctaacttaaacgggatgttctatacagccgggcagaatcatggaaaactgaatgggataaaatggcactactttaaaggacccagttatagtctacggtctacaacaatgatgatacggcccctcgatttt

SEQ ID NO: 32029 - DNA, 1494 bp, Artificial Sequence
  Description of Artificial Sequence: Synthetic coding sequence
atgaccgtctttttgtcctttgccttcctcgcagcaatcctgacgcatatcggctgctccaaccagagaaggtcacccgaaaactccggacggcggtacaaccgcattcagcatgggcaatgcgcatacactttcattctgccagagcatgacgggaactgtagagagtctacaactgatcagtataacacaaatgcgctgcaacgagacgctccacatgttgagccagactttagctcccagaaactgcagcatctggaacatgtgatggagaattatactcagtggctgcaaaaattggagaattacatcgtggagaacatgaaaagcgaaatggcccagattcagcagaacgctgtgcagaatcacacggccaccatgctggagattggaacgtctctgcttagtcagacggctgaacagacgcgcaagcttacggacgtagaaacccaggtcctgaaccagaccagtcgcctggaaatccagctcctggaaaattctctctccacgtataagctcgaaaagcagcttcttcaacagacaaacgaaatcctgaagatacacgagaaaaattctcttcttgaacacaagattctggagatggagggcaaacacaaggaagaactggacaccctcaaggaggagaaggaaaatctgcagggactcgtgacacgccagacttatatcattcaggaattggagaaacagctcaacagagcgaccacaaataactccgtgttgcagaagcagcagcttgaactgatggacaccgtgcacaatctggtaaacctttgtacaaaggagggcgtgctcctgaagggtggcaagagagaggaggaaaaaccttttcgcgattgcgctgacgtgtatcaggctggtttcaataagagtggtatctataccatctatattaataatatgcccgagccgaagaaggttttctgcaatatggatgtgaacggcggcggatggacagtcattcaacaccgagaggatgggagcttggattttcaaagaggttggaaagaatacaaaatgggctttggcaatcctagtggcgagtattggttggggaacgagtttatttttgcgatcacttcacagagacaatacatgctgcgcatagaactcatggactgggagggtaatcgggcatatagccagtacgacaggttccacatcggcaatgagaaacagaattacagactctatttgaaggggcacactggcacagcgggaaagcagtccagcctgatacttcatggggccgacttctccactaaggacgccgacaatgataattgcatgtgcaagtgtgccctgatgctgactggaggatggtggttcgacgcgtgcggtccttcaaacttgaacggcatgttctacaccgctgggcagaatcatggaaaactgaacgggattaaatggcactatttcaaaggtccctcctatagtttgaggtctacgacgatgatgatccgccctctggatttt

SEQ ID NO: 32030 - DNA, 1494 bp, Artificial Sequence
  Description of Artificial Sequence: Synthetic coding sequence
atgaccgtgtttctgtcttttgcatttctggcagcaatcctgacccatatcggttgttcaaatcaacgccggtcacctgagaactcaggacgccgctacaaccgtatccaacacggtcaatgcgcatacacctttatccttcctgagcatgatggtaactgtcgcgagagcaccaccgatcaatacaacaccaacgccctgcaacgggacgcaccccatgtggaacctgatttttcctcacagaaactgcagcatctggaacatgtgatggagaactacactcaatggcttcaaaaacttgaaaactacattgtcgaaaacatgaagtctgaaatggcacagatacaacagaacgcggtgcaaaaccacacggcaactatgcttgaaatcggtaccagcctcctgtcccagactgcagaacaaacgagaaaattgacggatgtcgaaacccaagtcctcaatcagaccagccgtcttgaaattcaactgctggagaattccctgtccacttacaagctggagaaacagctcttgcaacagaccaacgaaatactcaagattcacgaaaagaactccttgctcgaacataagatactggaaatggaaggaaagcataaagaagagctcgacaccctcaaggaagaaaaggaaaatcttcagggcctggtcaccagacagacctacatcatccaggaacttgagaagcagcttaaccgcgcaaccactaacaattcggtcctccagaaacaacaacttgaattgatggacaccgtgcacaacttggtgaatctttgtactaaggagggtgtgctgctcaagggaggtaagcgggaagaagagaagcccttccgggactgtgcagatgtgtaccaagcaggcttcaacaagtcaggaatttacaccatttacataaacaatatgccagaaccgaagaaggttttctgtaatatggatgtgaatggtggcgggtggaccgtcattcagcatagggaagatggatcactggactttcaaagaggctggaaggaatacaaaatgggattcggaaatccctccggtgaatattggctggggaacgagtttatctttgccattacctcccaaaggcagtatatgctgagaatagagctcatggactgggaagggaatcgggcctactcccaatacgataggtttcatatcggcaacgagaaacaaaactaccgcctctaccttaagggacacaccggtaccgcaggtaagcagtctagcctgattctccatggcgccgatttctcgactaaagatgcggacaacgataactgtatgtgtaaatgtgcactcatgctgactggaggatggtggtttgatgcctgtggacctagcaaccttaacggtatgttttacactgcaggccagaatcatggtaaacttaatggaattaagtggcactactttaaaggcccctcgtactctcttcggtccactactatgatgattagacctcttgatttt

SEQ ID NO: 32031 - DNA, 1494 bp, Artificial Sequence
  Description of Artificial Sequence: Synthetic coding sequence
atgaccgttttcttgtctttcgcatttttggctgccatattgacacacatcggatgtagtaaccagaggagaagccccgaaaacagcggccgccgctacaaccgcatccaacacggccagtgtgcttacacgttcatccttcctgagcacgacggaaattgtcgcgagtctactacagaccagtacaataccaacgccttgcagcgcgacgctccccatgtcgagccagatttctccagccagaaactgcagcacctggagcatgttatggagaactacactcagtggttgcagaagctggaaaattatatagtagagaatatgaagtcagagatggcgcagatccagcagaacgccgtgcaaaatcatacggcaacgatgctggagattggaacctccctgctttcacagacggctgagcagacaagaaagctgacggatgtggagacccaagtactgaatcagacatccaggctggagatccaacttttggagaactctctctccacgtacaagcttgagaaacaactgctccagcagacgaacgaaatcttgaagatccatgagaaaaactccttgcttgagcacaagattctggaaatggagggcaaacataaggaggagctggatacgctgaaggaggaaaaggagaatctccagggactggtgacgagacagacatacatcattcaagaactcgagaagcaactgaatagggccaccaccaataatagcgtgctgcaaaagcagcagcttgaactgatggataccgtgcataatcttgtcaatctttgtaccaaagagggagtgcttctgaagggaggaaagagggaggaggaaaagccttttcgcgattgcgctgacgtgtaccaggctggatttaataagagcggtatttataccatctacatcaacaatatgccagaacctaagaaagtattctgcaacatggatgtcaacggaggtggatggaccgttattcagcaccgcgaggatggaagtctggactttcagaggggttggaaagaatacaagatgggctttggtaaccctagtggcgagtattggctcggcaacgagtttattttcgctatcacaagtcagaggcaatatatgctgagaatcgaactcatggattgggaaggaaatagggcctactcccaatacgataggttccacatcggcaatgaaaaacaaaattacaggctgtatctgaagggccacactggcactgctggaaagcagtcatccctgattctgcacggagccgacttcagtacaaaggacgctgataatgataactgcatgtgcaagtgcgcattgatgttgaccggtggatggtggttcgacgcctgtggaccgtccaatcttaatggcatgttctatactgcaggacagaaccatggcaagctcaacggcattaaatggcactactttaagggcccatcctacagcctccgcagcaccaccatgatgatcagacctttggacttt

SEQ ID NO: 32032 - DNA, 1494 bp, Artificial Sequence
  Description of Artificial Sequence: Synthetic coding sequence
atgacagtgtttttgtccttcgcctttctggctgctatattaacgcatattggttgctccaaccagcgtcggagtcctgagaactccggtcgacggtataataggattcagcacgggcaatgcgcatatacttttatcctgccggaacacgatggtaactgcagagagtcgactaccgaccagtacaacacaaatgcactccagcgtgatgccccccacgtggagcccgacttctctagtcaaaaactacagcacctcgagcacgtaatggagaattacactcagtggctccagaaactcgagaactacatagtggagaatatgaagtcagagatggcacaaattcagcagaacgctgtgcagaaccatacagctaccatgcttgagatcgggacgagcctcctgagtcagactgctgaacagactagaaagctgacagatgtggaaacccaagtactcaaccagacatctaggttggagatccagctactggagaactctctatccacatacaaactggagaagcaattacttcagcaaacaaatgagatcctgaagattcatgagaaaaactcgttgctggagcataaaattctcgaaatggaaggcaagcacaaagaggaactggacacgctgaaagaggagaaagaaaacctccagggccttgtaacacgccagacatacatcattcaggaattggagaagcagctgaacagagccaccacaaataatagtgtgcttcagaagcaacagcttgaattgatggatactgtgcacaacttagtaaatctgtgcaccaaggaaggcgttctgctgaagggtggtaaaagggaagaagaaaagccattccgggattgtgctgacgtttatcaagccgggttcaataagtcagggatatacacaatctacatcaacaacatgcctgaaccaaagaaggtgttttgcaatatggacgtgaacggcggaggctggacagtgatacaacaccgcgaggacggatctctggatttccagcgaggttggaaggagtataaaatggggttcggaaaccccagtggggagtactggcttggcaatgaattcatcttcgccattacatcccagaggcaatatatgctgagaatagagctcatggactgggaaggaaacagagcttatagccagtacgacagatttcacataggaaacgaaaaacagaattacagattgtatctcaaggggcataccggcacagccggaaagcagagttccctgatcctgcatggggccgatttcagtacaaaagatgctgacaacgacaattgcatgtgcaagtgtgcgctgatgctgactggcgggtggtggttcgatgcatgtggaccctcaaacttgaatggtatgttttacactgccggacagaaccacgggaagctcaacggtataaaatggcattactttaagggaccttcatattcgctgagaagtaccaccatgatgattcgccccttggatttc

SEQ ID NO: 32033 - DNA, 1494 bp, Artificial Sequence
  Description of Artificial Sequence: Synthetic coding sequence
atgaccgtgttcctgagctttgcgtttctggcggcgatattgacccacatagggtgttccaatcagcgccgctccccagagaacagcggccgtcgctataatcgtatccaacacggccagtgcgcttatacgttcatactgccagagcacgacggtaactgtcgggaatccactaccgaccagtacaacaccaatgctctgcaacgggacgcgccccacgtcgaaccagacttcagtagccaaaaattacagcacctggagcacgttatggagaactacacccaatggctgcagaagctggagaactatatcgttgagaacatgaagtctgaaatggcacaaattcagcagaacgctgttcagaatcacacagcaacgatgcttgagattggtacctctttactttcccaaaccgctgagcagacgcgcaaattgaccgacgtggaaactcaagtcctgaaccaaacttcgcgcctggagatccagctgttggaaaatagcctgagcacgtataagcttgagaagcagctgcttcagcagaccaacgagattctgaagattcatgaaaagaattccctgctggagcacaaaattctggagatggaaggcaagcataaagaggagctagacacgttgaaagaggagaaggagaatctgcagggccttgtcacccgccagacctacatcattcaggaactggaaaaacagctgaacagagcgacgacaaataatagcgtgctgcaaaaacaacagttggagttgatggataccgttcataacctggtgaacttgtgtactaaggaaggtgtcctgcttaagggtggcaagcgcgaagaggagaagcctttccgcgactgcgcagatgtataccaggcaggctttaataagagcggaatctacaccatttacattaacaacatgcctgagcctaagaaggttttttgcaatatggacgtcaatggagggggatggaccgttatccagcatcgcgaggatggcagcctggactttcagcgaggttggaaagagtacaaaatggggtttggaaacccgagtggtgaatattggctgggtaacgagttcattttcgctatcacaagccagcgccaatatatgctgcgcatcgaactaatggactgggaggggaaccgcgcgtatagccaatacgatcgattccacattggcaacgaaaagcagaactaccggctgtacctgaaaggccacaccggtaccgcgggaaagcaaagctcattgatcctgcatggcgctgacttttctacgaaggatgctgacaacgataattgcatgtgcaagtgcgccctgatgctcaccggggggtggtggtttgatgcttgcggtccgagcaacctgaatggtatgttctacacggctggtcaaaatcatgggaaactgaacggtatcaaatggcattacttcaagggtccaagctatagcttgcgctctactacgatgatgatccgcccattggacttt

SEQ ID NO: 32034 - DNA, 1494 bp, Artificial Sequence
  Description of Artificial Sequence: Synthetic coding sequence
atgactgtgttccttagcttcgccttcctggcggctattctgactcatataggttgcagtaaccaaaggcgcagcccggagaacagtggcaggcggtataacaggattcagcacggacagtgtgcctatacctttatcttgcccgagcacgatggaaattgcagagagagcaccaccgaccagtacaacacaaacgctttgcagcgggacgcccctcatgtggagcctgatttcagctctcagaagttgcagcatcttgaacatgtgatggaaaactacacacagtggttgcagaagctggaaaactacatagtggaaaacatgaagagtgaaatggcccagattcagcagaacgctgttcagaaccatacagccacaatgttagagatcggcacatccttgctgtcccaaaccgccgagcagacccgcaaattaaccgatgtggagacccaggtgctcaaccagacctcgcggttggaaattcaattgctcgaaaactcgctgtcaacatacaaacttgaaaagcagctcctgcagcagaccaatgagatcctgaagatccatgagaaaaattccctgcttgagcacaagattctcgagatggagggtaagcacaaggaagagctcgacacactgaaggaggagaaagagaacttgcaggggctggtgaccaggcaaacatacatcattcaggagctcgagaaacagctgaatagagccaccaccaataactccgttttacagaagcagcagttagagctcatggacaccgtgcacaacctggtcaatctttgcaccaaggagggtgtgctgctgaaaggcggcaagagagaagaagagaaaccgtttcgcgactgcgcggatgtatatcaagctgggtttaacaagagtggaatttacaccatttacattaacaacatgccagaaccaaaaaaagttttctgtaacatggatgtcaatggggggggctggaccgtgatccagcacagggaagacggttccctggactttcagagagggtggaaggagtacaagatgggcttcggaaacccctcaggcgaatactggctagggaacgaattcatcttcgcaatcacctcgcaaagacaatatatgttgaggattgagctgatggattgggaagggaaccgggcctacagccagtacgataggtttcatattgggaatgaaaagcagaattacaggctatatctgaagggccacacaggaactgcgggaaagcagagttctctgatcttgcatggagcggacttttcaacaaaagacgcagataacgataactgtatgtgcaagtgtgctctaatgctgactggcggatggtggttcgacgcttgcgggccatcgaacctgaacggaatgttctatacagcaggccagaatcatggcaagctcaacggaataaaatggcattactttaagggcccctcatattcactgagatcaacaaccatgatgatccggccattggatttc

SEQ ID NO: 32035 - DNA, 1494 bp, Artificial Sequence
  Description of Artificial Sequence: Synthetic coding sequence
atgaccgtatttctcagtttcgccttccttgcggctatcttgacccacatcgggtgctccaatcaaagacgcagcccggagaattccggaaggcgctacaaccggatccaacatgggcagtgtgcctacaccttcattctcccggagcatgacgggaactgccgggaatccaccacggaccagtacaatacgaatgccctccagcgcgacgccccacacgtcgaacctgacttctcttcacagaagctgcagcatcttgagcatgtgatggagaactacactcaatggctgcagaagttggagaattacatcgtcgaaaacatgaaaagcgaaatggcacagattcagcagaatgcagttcagaaccacactgctacgatgctggaaattggcactagcttgctctcacagactgcagaacagacgcgcaagctgaccgatgtggaaacccaagtgctgaatcaaacctcccgcctggagatccagctcctggagaactctctctcgacctacaaactcgaaaagcaactcctgcagcaaaccaatgaaatactgaagattcacgagaaaaacagcctgctggagcacaaaattcttgagatggaaggaaaacacaaggaagaattggatactctgaaggaggaaaaggagaatcttcaaggacttgtgaccaggcaaacgtacataatccaagagcttgaaaaacaactgaacagagcgacgactaataacagtgtccttcaaaaacaacaactcgaactgatggatactgtgcataacctggtgaacctctgcactaaagaaggtgtgttgttgaagggaggaaaacgcgaggaagaaaagccgttcagggactgcgccgatgtctatcaggcgggcttcaataagtctggaatttacaccatctacatcaacaatatgccggaacctaagaaggtgttctgcaatatggatgtgaacggaggaggatggactgtcatccagcacagagaggacggatcgctggatttccagcggggctggaaggagtataagatgggctttggtaacccgtcgggagaatactggctggggaacgagttcatctttgcgatcaccagccaaagacagtatatgctccggatcgagctgatggactgggagggaaaccgtgcgtactcacagtacgatcgattccacatcgggaatgagaagcagaactaccggctgtacctgaagggccacaccggaactgccggtaagcagtcaagcctgatcttgcatggcgctgacttttcgaccaaggacgcggacaacgacaactgcatgtgtaagtgtgcactcatgttgactggcggatggtggttcgatgcttgcggcccttcaaaccttaacggcatgttttacaccgcaggtcagaatcacggtaaacttaacggtatcaaatggcactactttaagggacccagctacagcctgagaagcactactatgatgatccgcccactcgacttc

SEQ ID NO: 32036 - DNA, 1494 bp, Artificial Sequence
  Description of Artificial Sequence: Synthetic coding sequence
atgacggtgttcctgtcgttcgcctttttggcggccattctgacccacatcggatgctccaatcagcgcaggtcaccggaaaactccggcaggcgctacaatagaatccagcatggacagtgtgcatacactttcatccttccagaacatgacggtaactgccgcgagtcgaccacggatcagtacaacactaacgccctccagcgggatgctccgcacgtcgaacccgacttctcatcgcagaagctgcaacatctcgagcacgtgatggaaaactacacccagtggcttcagaaactggagaactacatagtggaaaacatgaagagcgagatggcccagatccaacaaaacgccgtgcagaaccacaccgcaaccatgttggagatcggaactagcctgctttcccaaactgccgaacagacccggaagttgactgacgtcgagactcaagtcctgaaccagaccagtcgcctcgagattcagctcctggaaaacagcctgagcacctacaagctggagaagcagctcctgcagcaaaccaacgaaatcctgaaaattcacgagaagaattccctgctggagcataaaatcctggaaatggaagggaagcataaagaagagctcgatactctcaaggaagaaaaagaaaatctccaaggactggttacccggcagacttacatcatccaagagctggaaaagcaactgaaccgagcaactactaacaattccgtgctgcagaagcagcaactcgaattgatggacactgtgcacaatctcgtcaatctctgtaccaaagaaggggtcctgctcaaaggaggcaagagggaagaggagaagccgtttcgggactgcgcggatgtgtatcaggcgggcttcaacaagtccggcatctacacgatttacatcaataatatgccagaaccgaagaaggtgttctgtaatatggacgtgaatgggggagggtggaccgtgatccaacatcgggaggacggctcgcttgacttccagcgtgggtggaaagaatacaagatgggattcggaaatccttctggcgagtactggctgggtaacgaattcatcttcgctattacctcacagcgccaatacatgttgcgcatcgagctgatggactgggaaggaaacagagcctacagccaatacgaccggttccacatcggcaacgagaagcagaactacagactctacctgaagggccacactggtaccgccggaaaacaatcctcacttatcctccacggagctgatttctcaaccaaggacgcggataatgacaactgcatgtgcaagtgcgcgctgatgttgactggaggatggtggttcgatgcttgcggaccgtcgaacctgaacggtatgttttacacggcaggtcagaatcatggcaagctcaacggaatcaagtggcactactttaaaggaccatcgtattcgctgagaagcactaccatgatgatccgccctctggatttt

SEQ ID NO: 32037 - DNA, 1494 bp, Artificial Sequence
  Description of Artificial Sequence: Synthetic coding sequence
atgactgtattcctttccttcgcctttctggctgcaattctcactcacatcggctgctccaaccaaaggaggtcaccagaaaatagtggacgtaggtacaatagaatccagcatggccagtgcgcatatacattcatactgcctgagcatgatgggaactgtagagaatctactactgaccagtacaacactaacgcacttcaacgtgacgcaccacatgtcgaacccgatttttcttcacagaaattgcaacatcttgagcatgttatggagaattacacccaatggttacagaagctggaaaactacatcgtcgaaaacatgaaatctgagatggcgcaaatccaacagaacgcagtccaaaatcatacagccactatgctcgagattggcacatccctcttgtctcaaactgctgaacaaacaagaaaacttacagacgtggaaacccaagtacttaaccaaacctcacgactagaaattcaattactcgagaactcattatccacttataaactcgagaaacaacttcttcaacagacaaatgagatcctcaaaattcatgagaaaaacagccttttggaacataagatcctcgaaatggaaggtaaacataaggaggaattggatacgctaaaagaagagaaggaaaatttacagggtctcgttacacgacagacttatattattcaagagctcgagaagcagctcaatcgagcaaccacgaacaatagtgttctccaaaaacagcaactcgagcttatggatactgtgcacaatcttgtgaacctttgcactaaggagggtgtgttgcttaagggtgggaagcgagaggaggagaaacctttccgtgactgcgcggatgtttatcaagcaggcttcaataaaagtgggatttatacgatatacataaataatatgcccgaacccaagaaagtgttctgcaatatggatgttaatggcggtggttggactgttatccagcatagagaggatgggtccctcgacttccagcggggatggaaagaatacaagatgggtttcgggaatccctctggtgagtattggctcggcaatgagtttatctttgctattacttcacagcgtcaatatatgttacgtatcgagttaatggattgggaaggaaacagggcatactcccagtatgacaggttccacattggaaatgaaaagcaaaattataggctgtatctcaagggtcataccggaacagccggtaaacagtcttcacttatcttacatggtgccgatttttccactaaagatgctgataacgataattgtatgtgtaaatgtgctctgatgctaacagggggctggtggttcgacgcatgtggacctagtaatttgaatggtatgttctataccgctggacaaaaccacgggaagcttaacggaataaaatggcattattttaagggtccttcttattcattgcgttcaactactatgatgatcaggccgcttgacttc

SEQ ID NO: 32038 - DNA, 1494 bp, Artificial Sequence
  Description of Artificial Sequence: Synthetic coding sequence
atgaccgtttttctgtccttcgcgttccttgctgccatcctgactcacatcggatgtagcaaccaacggaggtcgccagagaactcaggacgcagatacaaccgcattcagcatggtcagtgtgcttacacgtttatcctgcctgagcatgacggcaactgccgcgagtcgacgaccgatcaatacaacaccaatgccctccaacgcgacgctccccatgtggaaccggatttctcgagccagaagctgcagcatctggagcacgtgatggagaactacacccagtggctccagaaactcgaaaactatattgttgagaatatgaaaagcgaaatggcgcagatccagcaaaacgccgtgcagaatcataccgctaccatgctcgagattggcacttcgcttctgtcgcaaactgccgaacagactcgaaagctgaccgatgtggaaactcaggtgctgaatcagacctcgcggctggaaattcagctcttggaaaattcgttgtctacttacaagctggaaaagcagcttctgcaacagacgaatgagatcttgaaaatccatgaaaagaactcacttctggaacacaaaatcctcgagatggaaggaaagcacaaggaagaactggataccctcaaagaggaaaaagagaacttgcaaggtctggtgacccggcagacttacatcatccaggagcttgagaagcagctgaatagggccactactaataactccgtcctccaaaagcaacaattggaactcatggacacggtgcataatctggttaacctctgtaccaaagaaggcgtcttgctcaagggaggcaaaagggaagaagagaaaccattcagggattgcgcggacgtgtaccaggccgggttcaataagtcgggaatctacaccatctacatcaataacatgcccgagccgaagaaggtgttctgcaacatggacgtgaatggaggagggtggactgtcatccaacatcgggaggacggttcacttgatttccaaagagggtggaaggagtacaagatgggattcggaaacccgagcggggaatactggctgggtaatgagtttatcttcgcgattacttcccaaaggcaatacatgctgagaatcgaactgatggactgggagggaaatcgcgcgtattcccagtacgaccggttccatattggaaacgagaagcagaactatcggctgtacctcaagggacacactggcaccgcaggtaagcagtcatcccttatcttgcatggagcagatttctcaaccaaggatgccgataacgacaattgcatgtgtaagtgcgctctcatgctgaccggcggttggtggtttgacgcatgtggacctagcaatctgaacgggatgttttacactgcgggccaaaatcatggaaagctcaacggaatcaagtggcactacttcaagggcccgtcgtactctctgagatcgaccactatgatgatacgtcctctggacttc

SEQ ID NO: 32039 - DNA, 1494 bp, Artificial Sequence
  Description of Artificial Sequence: Synthetic coding sequence
atgaccgtgttcctcagcttcgcatttctggccgcaattctgactcatatcggctgcagcaatcagaggcgttcaccagaaaactccggtagacgctacaatcgcatccaacatggacagtgcgcatacacgttcatcctgcctgaacacgatggaaactgcagagagtcaactaccgaccagtacaacacgaacgctttgcagcgggatgcaccgcatgtggagccagacttctcatcgcaaaagctgcagcatctcgaacacgtgatggaaaactacacccagtggctgcagaagctcgagaactacatcgtggaaaacatgaaatcggaaatggcccagatccagcagaacgccgtgcagaatcataccgcgacgatgctcgagatcggtacctcgctgctgtcacagacggcggaacagacccggaaactgactgatgtggaaacgcaagtgttgaatcagacctcacgccttgaaatccagctgctcgagaattcacttagcacctacaagctggagaaacagctccttcagcaaaccaatgagatcctcaagatccacgaaaagaactcactcctggaacacaaaatcctggaaatggaaggtaagcacaaggaagagttggataccctgaaggaggaaaaggaaaacctgcagggtctggtcaccagacaaacctacatcatccaagaactcgaaaagcagcttaatcgggccactaccaacaattccgtgctgcagaagcaacagttggaacttatggatactgtccataacttggtgaatttgtgcaccaaggagggggtcctgctgaaaggaggcaagcgggaggaagaaaaaccattccgggattgcgctgatgtttaccaggcgggatttaacaagtcggggatttacactatttacatcaacaatatgcccgaaccaaagaaagtgttctgtaacatggatgtcaacggaggcggatggaccgtgattcaacaccgcgaggacggctcgctcgacttccagcggggatggaaagagtacaagatgggattcggcaatcccagcggagagtactggcttggaaatgagttcattttcgcgatcacctctcagcggcaatacatgctccggattgaactgatggactgggaaggaaaccgggcttactcgcagtacgatcgctttcacatcggaaacgaaaagcagaattacaggctgtacctgaaaggccataccggcactgccggaaaacagtcgtcgctgatcctgcacggcgctgacttctccactaaggacgcagataacgataactgtatgtgtaagtgtgccttgatgcttaccggcgggtggtggtttgatgcatgtggcccttcgaacctcaacggcatgttctacactgctgggcaaaatcacggaaaactcaacggtatcaaatggcactacttcaagggcccgtcctactcgctccgctcgaccaccatgatgatccgcccgctggacttc

SEQ ID NO: 32040 - DNA, 1494 bp, Artificial Sequence
  Description of Artificial Sequence: Synthetic coding sequence
atgacagtgttcctgtcctttgcgttcctagcagccatccttacccatattggatgttctaaccaacgcaggtctccagaaaatagcggccggaggtataacaggattcagcacgggcagtgcgcttacacttttattctccccgagcatgacggcaactgtagggaatctaccactgaccaatacaataccaatgccctgcagcgcgatgcaccgcacgtcgagcctgatttttcctcccagaaacttcagcatctggagcatgtgatggagaactacactcagtggctccaaaagctagaaaactatatcgtcgagaacatgaaaagtgagatggcacagatccagcagaatgccgttcagaatcataccgccacaatgctggagatcggaacgagcctgcttagtcagaccgcggaacagacccgaaagctgacagacgtcgaaactcaggtgcttaaccagacctccagactggagatccaattactggaaaattctttgtcaacatacaagctcgagaagcagctcctgcagcagacaaatgaaatcctgaaaatccatgaaaagaattctcttctggagcacaagattctagaaatggaaggcaagcacaaagaggagcttgatacactgaaggaggagaaggagaacctgcagggtttggttacacgacagacatatatcatacaggaactcgagaaacagctgaaccgggccaccacaaacaattcagtgttacagaaacagcagctagagctgatggacactgtacacaacctcgtgaacttatgcacaaaagaaggagtcctgctgaagggaggcaaaagagaagaagaaaagccctttagggactgtgccgatgtttaccaggccggattcaataagagcggaatttacaccatatatatcaacaacatgcccgaaccgaagaaggtgttctgcaacatggacgtcaacggcggaggttggactgtcattcaacatcgagaagacggatcgctggactttcaaagaggttggaaagagtataagatgggtttcggcaaccctagtggggagtactggttgggcaatgaattcatttttgcgattacctctcagagacagtacatgctgcgaatcgagcttatggattgggaagggaatcgtgcttatagccagtacgatcgattccatataggcaacgaaaagcagaattaccgactgtacctcaagggacacaccgggaccgccgggaaacagtcatctctgattttgcacggcgctgacttttcaacgaaagacgcagataacgataactgcatgtgcaagtgtgccctgatgctgacaggaggctggtggttcgacgcctgcggcccctcaaatctaaacgggatgttctacacagccggccagaaccatggtaagcttaatggaattaagtggcactacttcaaagggccaagttactctttgcggtcaactactatgatgatccgacccctggatttc

SEQ ID NO: 32041 - DNA, 1494 bp, Artificial Sequence
  Description of Artificial Sequence: Synthetic coding sequence
atgactgtcttcctatcatttgccttcctcgctgccatactcacacacatagggtgctccaatcagcgcaggtctccagaaaattcgggacgccgctacaatcgaatccagcacgggcagtgcgcctacacatttatcctacctgaacatgatgggaactgtcgggaatcaacaacagatcagtataacacaaacgctctccagcgcgatgcgccccacgttgaacccgatttcagttctcaaaaactccagcaccttgagcatgtaatggaaaactatacacagtggctccagaagcttgaaaactatatagtcgaaaatatgaaatcggagatggcccagatccagcagaatgctgttcagaatcatactgctacgatgctcgaaataggaacgtcactgctctctcagacagctgaacagactcgcaaactaactgatgtcgagacacaagtgctcaaccagacaagtagactcgaaatccagctgctggaaaattcactctccacttataaactggaaaaacagctactgcagcaaactaacgaaattctgaaaatccacgaaaaaaattcactgttggaacataaaatactggaaatggaaggaaaacacaaggaagaattagatactcttaaagaagaaaaagagaacttacaaggactcgtgactagacaaacttacattatccaggaacttgaaaaacagcttaacagagctacaacaaataactcagtacttcagaaacagcagttggaattaatggatacagtgcacaaccttgttaatttatgtacaaaggaaggggtgctcctaaagggggggaaacgcgaggaagaaaaacctttcagagattgcgctgatgtgtaccaagccggatttaacaaatcaggaatctatactatatatatcaacaacatgccggaacccaagaaagtgttctgcaacatggacgtcaatgggggagggtggacagtgatacagcatcgggaggatggaagtctcgacttccagagggggtggaaagaatataagatgggattcggaaacccttctggagaatattggctcgggaacgaatttatttttgcaatcacatcccagcggcagtatatgctcaggatagaactcatggattgggaagggaaccgcgcatactcccagtatgataggtttcacatcggaaatgaaaagcagaattatagactctatttaaaaggacatacaggaacagccgggaaacagtcctccttaatcctccatggagccgatttttctacaaaagacgctgataatgacaattgcatgtgtaagtgcgctctaatgttaactggggggtggtggtttgatgcctgtggaccatccaatctgaatgggatgttctacactgctgggcagaatcatggaaaactcaatgggatcaagtggcattactttaaaggacctagttatagtttgaggtctacaacaatgatgattcggcctctcgatttt

SEQ ID NO: 32042 - DNA, 1494 bp, Artificial Sequence
  Description of Artificial Sequence: Synthetic coding sequence
atgaccgtcttcctcagtttcgcttttctggcggctatcctgacacacattgggtgtagtaatcaacggcgctcccctgaaaatagcgggcggcgatataatcgcattcagcatggacagtgtgcttataccttcatcctgccagaacatgatggcaattgcagagagtcaactaccgaccagtataacactaacgcactgcagcgggatgcgcctcatgtggagccggatttttcaagtcaaaaattgcagcatctggagcacgtaatggagaattatacacagtggcttcagaaacttgaaaattacattgtagagaacatgaagagtgagatggctcagatccagcagaacgccgtccagaaccacactgccacaatgctggagatcggaacgtctctcctgtcgcagacagccgagcagacacgaaaactcacagatgtggaaactcaagtcctgaaccaaacaagcagactggagattcaattacttgagaatagtttatctacctacaaacttgagaagcaactgctgcagcagaccaatgaaatactgaagattcatgagaagaactcacttctggagcataaaattctggagatggaggggaaacacaaagaagaattggatacactgaaagaggaaaaggaaaacttgcaaggactagtgactcgacagacctacatcatccaagaactggagaagcagctcaatcgcgccaccacaaacaatagcgtgctgcaaaaacagcaactggagctaatggacaccgtgcacaatttggtaaacctgtgtactaaggaaggcgtcctgttgaagggcgggaagagggaagaagagaagcccttcagggattgtgccgacgtataccaggccggatttaacaaatctggaatttacaccatttacatcaacaacatgccggaaccgaaaaaggtcttctgtaatatggacgtgaacggaggcggttggacagtaattcagcacagagaggacggcagtttggacttccaacgcggatggaaggaatacaaaatggggtttgggaacccgtctggagagtattggctggggaatgagttcatctttgcaatcacgtcccagcggcagtacatgttgaggatcgaactgatggactgggagggcaaccgggcttattcgcagtatgacagattccacattgggaatgaaaagcagaactaccgcctgtacttgaaaggtcataccgggaccgccggaaagcagtctagtctgatattacacggagctgacttcagtaccaaggacgccgataatgataactgcatgtgcaagtgtgcactgatgctcaccgggggctggtggttcgacgcttgcggacccagcaatcttaacgggatgttctacacagccggccaaaaccacggaaagctgaacggcattaaatggcattattttaagggccctagctacagtctccgctctacaaccatgatgattcggccgctggatttt

SEQ ID NO: 32043 - DNA, 1494 bp, Artificial Sequence
  Description of Artificial Sequence: Synthetic coding sequence
atgactgtgttcctgagtttcgcctttctggccgccattctgacccacatcgggtgcagcaaccagagaaggtcccctgaaaatagcggacgcagatataacaggattcaacatgggcagtgcgcctacacatttatcctccccgaacacgacggcaattgtcgggagtccaccaccgatcagtacaacacaaacgcactccaaagagatgccccacacgtggaacctgatttttccagccaaaagctccaacacttggaacacgtaatggaaaattatacccagtggcttcagaaacttgagaactacatcgtcgagaacatgaagagcgaaatggcccaaatccagcaaaatgctgtgcagaaccacactgctactatgctcgaaattggcacaagtcttctcagccagacagctgaacaaacaagaaagctgaccgacgtggagacccaggttctgaaccaaacaagccgcttagaaatccaactgctggagaatagcctctccacatacaaactggagaaacagttgctgcagcaaaccaacgaaatcctgaaaatccacgagaagaatagcctgctggaacacaagattctggagatggaggggaagcacaaagaagaactggacacacttaaagaagaaaaggagaaccttcagggcttggttactcggcagacctacatcatccaggagctggaaaaacaactcaatcgggccactaccaacaactccgtcctccaaaagcagcagttagagctgatggacaccgtccacaacctcgtaaatctgtgcactaaggagggcgtgctcttgaagggcgggaagagagaagaagaaaaaccatttcgtgattgcgcagatgtttatcaggctggttttaacaagtccggaatttacaccatttacatcaacaacatgcctgaaccaaaaaaagtcttctgcaacatggacgttaatggaggagggtggaccgtgattcaacatagagaagacgggagcctggactttcaacgaggatggaaggagtacaagatgggttttggaaaccctagcggtgaatactggctcggaaatgagtttatttttgccataaccagccagcgtcagtacatgttgagaattgaactgatggattgggagggaaacagggcctattctcaatacgatcgcttccatatcggaaacgagaagcaaaactatcggctctacttgaaaggccataccggcacggccggcaagcagagctctctcattttgcatggagcggacttctcaaccaaagatgccgacaacgataattgcatgtgtaaatgtgccctgatgctcaccggaggctggtggttcgatgcttgtggaccctccaacttgaacggcatgttttacacagcaggacaaaaccatggtaaacttaacggaatcaagtggcactactttaagggtccatcgtacagcttgagaagcaccacaatgatgatccgccccctggatttc

SEQ ID NO: 32044 - DNA, 1494 bp, Artificial Sequence
  Description of Artificial Sequence: Synthetic coding sequence
atgaccgtctttcttagctttgcatttcttgccgcaatcctcacgcacattgggtgctccaatcagaggcgatcgcccgaaaattcaggtcggagatacaatcgcattcaacatggacagtgtgcctacacctttattctgccagaacatgacggtaactgtagggagtccaccaccgaccagtacaacacgaacgcacttcaaagggatgcacctcatgtggaacccgacttttcaagccaaaaactgcagcatctcgaacatgtgatggagaattacacccaatggctccaaaagctggaaaactacattgtggagaatatgaagtcggaaatggcacaaattcaacaaaatgcagtgcagaaccacactgctactatgttggagattggtactagcctgctctcccagactgcagaacagaccagaaagctcacggatgtcgagactcaggtgcttaaccagaccagccgactggagatccagcttcttgagaacagcctttctacctacaaacttgagaaacaacttttgcagcaaaccaacgagattctgaaaattcacgagaaaaacagcctgttggagcacaagatactggagatggaaggaaagcacaaggaggagcttgatactctgaaggaggagaaggaaaaccttcagggactggtcacccgacagacctacattattcaagaacttgagaagcagcttaatcgggcgactaccaataacagcgtgttgcaaaagcaacagcttgaactgatggacactgtgcataatctggtgaacctgtgtactaaggaaggtgtgctgcttaaagggggcaagcgcgaagaggagaagccttttcgggattgcgcagacgtgtatcaggcagggtttaacaagtcggggatttacactatctacatcaataacatgccagagccaaagaaagtgttttgtaacatggatgtgaatggaggtggatggaccgtgattcagcatagagaggacggctccctggattttcagcggggatggaaggaatacaagatgggattcggaaacccttccggggagtattggctcggcaatgaattcatatttgcgataacctcccagagacagtacatgcttcgtatcgaattgatggactgggagggcaaccgcgcatactcccaatacgatcggttccatataggaaacgaaaagcaaaactaccggctctaccttaaaggacacactggaactgcagggaaacaaagcagcttgatcttgcacggtgccgacttctccaccaaagatgccgataacgacaactgtatgtgtaagtgtgctcttatgcttaccggaggatggtggttcgatgcgtgtgggcctagcaacctcaacggcatgttctacaccgccggacagaatcatggtaaacttaacggaattaagtggcattactttaagggaccttcctactcgcttaggtcgactaccatgatgattcgtcctctggacttt

SEQ ID NO: 32045 - DNA, 1494 bp, Artificial Sequence
  Description of Artificial Sequence: Synthetic coding sequence
atgactgtgtttctgtctttcgcttttctggcagcgatcctcacccatatcggatgctccaaccagcgcaggtcccccgagaattcgggacggcggtacaacagaatccaacacggccaatgcgcctacactttcatcctgcctgaacatgatggtaactgcagagagagcaccaccgaccagtacaatactaacgctctgcagagggacgcgccacacgtcgaacccgatttttccagccagaagctgcagcacttggagcacgtcatggagaattacacgcagtggctgcagaagctggaaaactatatcgtggagaatatgaaatcggaaatggcacagatccagcagaacgcggtgcagaaccacactgctaccatgctggaaatcggcacctccttgctgtcacaaaccgccgagcaaaccagaaaacttactgacgtggaaactcaagtgctgaaccagacttcccgactcgagatccaactgctcgagaattcactgagcacttacaagctcgagaaacagcttctccagcaaactaacgaaatactgaagatccacgaaaagaactctctcctggagcacaagatccttgaaatggaagggaaacacaaggaagagctggacacgctgaaggaagaaaaagagaatctgcaaggattggtgactcgtcaaacttacatcatccaggagctcgaaaagcaactgaaccgcgctactaccaacaactctgtgctgcaaaaacagcagttggaattgatggacaccgtccataacctggtgaacctgtgcaccaaggaaggtgtgctgctgaagggcgggaagagggaagaagaaaaaccgttcagggactgtgccgatgtctaccaagcaggcttcaataagtcaggaatctacaccatttacattaacaacatgccggaacccaaaaaggtgttctgtaacatggacgtcaacggaggcgggtggacggtgatccaacaccgcgaggacgggtcactggacttccagcgagggtggaaggaatacaagatgggtttcggaaatccatcgggagaatactggctgggcaatgagttcatctttgcaatcacgtcccaacgccagtacatgttgaggatcgaactgatggattgggagggaaatcgcgcctactcccaatacgaccggttccatattggcaacgagaagcagaattatcgcctttatctgaaaggacacaccggaaccgctggaaagcagagcagcctgattcttcacggagcggatttcagcaccaaggacgccgataacgataactgtatgtgcaaatgcgcgctgatgctcactggaggatggtggttcgacgcgtgcgggccatcgaatcttaatggcatgttttacaccgccgggcagaaccacggaaaactgaacggaatcaaatggcattacttcaagggaccttcatactcgctgcgctcgactaccatgatgatccggcctcttgatttc

SEQ ID NO: 32046 - DNA, 1494 bp, Artificial Sequence
  Description of Artificial Sequence: Synthetic coding sequence
atgaccgtttttctctcctttgccttcctggcagcaattctcacccatatcgggtgctcgaaccagagacgttcgcctgaaaattcggggagacgttacaatcgcattcaacacggtcaatgcgcctacacgttcattctgcccgaacatgacggcaattgtcgggaatccactaccgatcagtacaacaccaacgccctccaacgcgatgctccccatgtagaaccggatttcagctcacaaaagctccaacatctggagcatgtgatggagaactacactcagtggctgcaaaagttggagaattacattgtggagaatatgaagtcagagatggcgcaaatccaacaaaacgccgtgcaaaatcacaccgcaaccatgctcgaaattggcacctcgcttctttcccagacggcggaacagactcgtaaactgaccgatgtggagactcaggtccttaaccagaccagccgcctggaaattcagcttctcgaaaactccctgagcacctacaaacttgagaagcaattgctgcaacagactaacgaaatcctgaagattcatgaaaagaattcactgcttgaacacaagattctggagatggagggtaagcataaagaagaactcgacacccttaaagaagaaaaggaaaaccttcaaggtcttgtgacccgccaaacttacatcatccaggaacttgaaaagcagctcaaccgtgccaccaccaataactctgtccttcagaagcaacagcttgaacttatggacacggtgcacaacctcgtgaacctttgtaccaaggaaggagtccttctcaagggaggaaagagggaagaagagaagccttttcgagattgtgcagatgtgtaccaggcaggattcaataagtcgggaatttacaccatttacatcaacaacatgccagaacctaagaaggtgttctgcaatatggatgttaacggtggtggatggaccgtgattcaacatagagaggatgggtcactggatttccaacgaggatggaaggaatacaaaatgggctttggaaacccatccggtgaatactggttgggtaacgaattcattttcgcgattacttcgcaacgccaatacatgctgagaatcgaacttatggattgggaaggaaaccgagcttactcgcagtacgacagattccacataggcaacgagaaacagaactacagactttacctcaagggacataccggaactgcaggaaagcaatcctcccttattctccatggggcagattttagcacgaaggatgcggacaatgataactgtatgtgtaagtgtgcacttatgctcaccggaggatggtggtttgacgcctgtggtccctccaaccttaatggtatgttttacactgcaggacagaaccatgggaaactcaacggcataaagtggcattactttaaaggcccgagctactcacttagatcgaccactatgatgatcagacccctggacttc

SEQ ID NO: 32047 - DNA, 1494 bp, Artificial Sequence
  Description of Artificial Sequence: Synthetic coding sequence
atgacggtttttttatcgtttgcgtttttagcggcgatactaacgcatataggttgttcgaatcaacgtcgttcgccggaaaattcgggtcgtcgatataatcgtatacaacatggtcaatgtgcgtatacgtttatattaccggaacatgatggtaattgtcgtgaatcgacgacggatcaatataatacgaatgcgttacaacgagatgcgccgcatgttgaaccggatttttcgtcgcaaaaattacaacatttagaacatgtaatggaaaattatacgcaatggttacaaaaactagaaaattatatagtagaaaatatgaaatcggaaatggcgcaaatacaacaaaatgcggtacaaaatcatacggcgacgatgctagaaataggtacgtcgctactatcgcaaacggcggaacaaacgcgtaaattaacggatgtagaaacgcaagtactaaatcaaacgtcgcgtttagaaatacaactattagaaaattcgttatcgacgtataaactagaaaaacaattactacaacaaacgaatgaaatattaaaaatacatgaaaaaaattcgttattagaacataaaatattagaaatggaaggtaaacataaagaagaactagatacgttaaaagaagaaaaagaaaatttacaaggtctagtaacgcgtcaaacgtatataatacaagaactagaaaaacaactaaatcgtgcgacgacgaataattcggttctacaaaaacaacaactagaattaatggatacggtacataatctagttaatttatgtacgaaagaaggtgttttactaaaaggtggtaaacgagaagaagaaaaaccgtttcgagattgtgcggatgtatatcaagcgggttttaataaatcgggtatatatacgatatatataaataatatgccggaaccgaaaaaagtattttgtaatatggatgtaaatggtggtggttggacggttatacaacatcgagaagatggttcgttagattttcaacgaggttggaaagaatataaaatgggttttggtaatccgtcgggtgaatattggctaggtaatgaatttatatttgcgataacgtcgcaacgtcaatatatgttacgaatagaactaatggattgggaaggtaatcgtgcgtattcgcaatatgatcgatttcatataggtaatgaaaaacaaaattatcgtttatatttaaaaggtcatacgggtacggcgggtaaacaatcgtcgctaatactacatggtgcggatttttcgacgaaagatgcggataatgataattgtatgtgtaaatgtgcgttaatgctaacgggtggttggtggtttgatgcgtgtggtccgtcgaatttaaatggtatgttttatacggcgggtcaaaatcatggtaaactaaatggtataaaatggcattattttaaaggtccgtcgtattcgttacgttcgacgacgatgatgatacgtccgctagatttt

SEQ ID NO: 32048 - DNA, 1494 bp, Artificial Sequence
  Description of Artificial Sequence: Synthetic coding sequence
atgacggtgttccttagctttgcgttcctcgctgccatattgacccacattggttgcagcaatcagcgccgatctcctgagaactcgggtcggcgttacaaccgcatacaacatggccaatgtgcatacacctttatactgcccgagcatgatggcaactgtagagagtcgactaccgaccagtataacactaatgcacttcaaagagatgccccccacgtggaacctgatttttcaagccaaaaactccagcatcttgaacatgtgatggagaactacactcaatggctgcagaagctggaaaactacattgtggaaaacatgaagtccgagatggcacaaatacagcagaacgccgttcaaaaccacactgcaactatgcttgagatcggaacctcgcttctttcacaaaccgcagagcaaactaggaagctgactgatgtggagactcaagtgcttaatcagacctcccgcctggaaatccaacttcttgaaaactcgctttccacctataagctcgaaaagcagctgctgcaacaaaccaatgagatcctgaagattcatgagaagaactcacttctggaacacaagattctggagatggaaggcaaacataaagaggagctcgacactctcaaagaggagaaggaaaacctccagggactcgtaactcggcaaacctacattattcaggaattggagaagcaactcaaccgggcaaccacgaacaacagcgtcctgcaaaagcaacagctggagctgatggatactgtccacaatctggtcaacctgtgtactaaggagggtgtgcttcttaaagggggtaagagagaagaggaaaaaccctttagagattgtgccgatgtgtaccaggcgggtttcaacaagtccggaatttacactatttacatcaacaatatgcccgaaccaaagaaagtgttttgtaatatggatgtgaacgggggtggttggaccgtcattcaacatcgcgaggatggttcgctggactttcaacgaggatggaaggagtacaagatggggttcgggaatccttctggcgagtactggctgggcaatgagttcatcttcgctatcacctcccagagacagtacatgcttcgtattgaactgatggattgggaaggaaacagagcatactcacaatacgacaggtttcatataggcaacgaaaagcagaactaccgcctctacctcaaagggcacactggtactgctggtaaacagtcatcgttgattcttcacggagccgactttagcactaaggatgcagataacgacaactgtatgtgtaaatgcgcactgatgcttactggaggatggtggtttgatgcctgtggtccatccaacctcaatggtatgttctataccgctggacaaaaccacggcaagttgaacggcataaagtggcactactttaagggaccatcatactcgcttaggagcaccaccatgatgattcgtccactggatttc

SEQ ID NO: 32049 - DNA, 1494 bp, Artificial Sequence
  Description of Artificial Sequence: Synthetic coding sequence
atgaccgtgtttctttccttcgcctttcttgcagcaatcctcactcacatcggatgttccaatcagcggcgctcgcccgagaactcaggacggagatacaatagaatccaacatggtcagtgtgcttataccttcattcttcctgagcatgatgggaactgcagagagtctaccacggatcagtacaatacgaatgcacttcaacgggatgcacctcacgtcgaaccagacttcagctctcagaaactccaacatctggagcatgtgatggaaaactatacccagtggctccagaagctcgaaaactacatcgtcgaaaacatgaaatcggaaatggcacagatacagcaaaacgcggtccaaaaccacacggcgactatgctcgaaatcggaaccagcctgctgtcacagactgctgaacaaaccagaaagttgaccgatgtggaaacccaagtgcttaaccaaacgtcacgtcttgaaattcagctcctcgaaaactccctgtcgacctacaaactcgaaaagcaactcttgcaacaaactaatgagatccttaagatacatgaaaagaactctcttctcgagcacaagattctggagatggaaggaaaacacaaagaagaactggacacccttaaggaagaaaaggaaaacctccaaggacttgtgactagacaaacctacataatccaggagcttgagaagcaactcaaccgcgccaccacgaataactctgtcctccaaaagcagcagctggagctcatggataccgtgcacaaccttgtgaatctgtgtactaaggaaggtgttctgctgaagggtggaaagagagaagaagagaagccatttcgggattgtgctgacgtgtaccaagcggggttcaacaaatcgggaatttacactatctacattaacaatatgcccgagcctaagaaggtgttttgcaacatggatgtgaacgggggtggatggaccgtcatccagcaccgagaggatggctcccttgattttcagagaggttggaaggaatacaagatggggtttggaaacccttccggcgaatactggctgggcaacgaattcatttttgcaattacctcccagcgccagtacatgctccgaattgaacttatggattgggaaggaaatcgggcatactcgcaatacgaccgctttcatatcggtaacgagaagcaaaactaccgcctttacttgaagggtcatactggaaccgccggcaaacaaagtagtctgatccttcatggagcggatttttccaccaaggacgcagacaacgacaattgtatgtgtaagtgcgcactgatgctgactggaggatggtggttcgatgcctgtgggccatcaaacctgaatggaatgttttacactgccggacagaaccacggaaaacttaatgggattaagtggcattacttcaaaggaccttcgtacagccttcggtcgactaccatgatgataagacctcttgatttc

SEQ ID NO: 32050 - DNA, 1494 bp, Artificial Sequence
  Description of Artificial Sequence: Synthetic coding sequence
atgaccgtgttcctctcattcgccttcttggccgccatccttactcacatcgggtgtagcaatcaacgccgcagtcctgagaattcgggtcgccgctacaatcggatccaacatggtcagtgtgcctacaccttcattctgccagagcacgacggcaattgcagagagtccactaccgaccaatacaatacgaatgctctccagcgtgacgccccgcacgtggagccggatttcagttcgcaaaaactccagcaccttgaacacgtaatggagaattacacccaatggcttcagaagttggagaactatatcgttgagaacatgaagtccgaaatggcacaaatccagcagaacgccgtgcagaaccacactgccaccatgttggaaattggaacgtcccttctctctcaaaccgccgaacaaacccggaaacttactgatgtggagactcaggtgctcaaccaaaccagccggctcgagatccaactccttgaaaactcgctttcaacctataagctcgagaagcagctgctgcagcaaactaatgagatcctcaaaattcacgagaagaatagcctgctcgagcataagattctggaaatggaggggaagcacaaggaggaactggatactttgaaggaagagaaagaaaatctccaggggctggtgaccagacagacctacatcatccaggagctcgaaaagcagttgaaccgggcaaccacgaacaactcggtgctgcagaagcagcagcttgaactcatggacactgttcataatcttgtgaacctctgcaccaaggagggagtcttgctgaagggtggaaagcgcgaagaagagaagcccttcagagattgtgcagacgtgtaccaggcggggtttaacaagtcagggatctacaccatttacatcaataacatgccagaaccaaagaaagtgttttgcaacatggacgtcaacggaggaggttggactgtgatccagcaccgagaagatggaagcctggacttccagcgcggctggaaagaatacaagatgggattcggaaacccctccggagaatactggctgggaaacgagtttatcttcgccatcacgtcccagcggcaatacatgcttcgcatcgaactgatggactgggaaggaaaccgcgcgtactcgcagtacgacagatttcatatcgggaacgaaaagcagaactacagactttacctgaaaggacataccggaactgcgggaaaacagtcaagcctcatactgcacggagcggacttctcgactaaagatgcggataacgataactgtatgtgcaaatgcgcccttatgctgactggtgggtggtggttcgacgcatgtggcccttcgaatctgaacggcatgttctataccgctggacagaatcacggcaaactcaacggcatcaagtggcattacttcaaaggcccgtcctactcgctgaggtccacgaccatgatgatcaggccgctggacttt

SEQ ID NO: 32051 - DNA, 1494 bp, Artificial Sequence
  Description of Artificial Sequence: Synthetic coding sequence
atgaccgttttcctatcgttcgcctttctcgctgctatcttgactcacataggttgctcaaaccagagacgatcacccgagaacagcgggcgaaggtacaataggatccagcacgggcaatgcgcttacacatttatactccctgagcatgatgggaactgccgagaatccaccacagatcaatacaacactaatgcccttcaacgggatgccccacacgttgagcccgatttttcctcccagaagctgcagcacctggagcacgttatggaaaattacactcagtggttgcaaaagctcgagaactacattgtagaaaacatgaaaagcgagatggctcaaatacagcagaacgccgtccagaatcacaccgccaccatgctcgaaattggaacatcactgctctcacagaccgcagaacagacaaggaaactcactgatgtggagactcaggttttgaatcagacttctaggctcgagatacagcttctggaaaattcccttagtacttataagttggagaaacagttgctgcagcagaccaatgagatcctgaagatacacgagaaaaatagtctgctcgaacataaaattcttgagatggagggcaaacacaaggaagagttagatacgctcaaagaggaaaaggaaaatctgcaaggcctcgtgacaagacaaacatacattattcaggagctggaaaaacaactgaatcgagcaacgacaaacaattctgtcctccaaaagcagcagctggagctcatggacaccgtacacaacttagtcaatctttgcactaaggaaggcgttctgctcaaaggtggcaaacgcgaggaggagaaacccttccgagattgtgcggacgtctaccaagctggttttaataagtcagggatttacacaatttacatcaacaatatgcccgaaccaaaaaaagtgttttgcaatatggacgtgaatgggggcggatggacagttatccagcatcgcgaagatggcagtctggatttccagcgaggatggaaggaatacaagatgggttttgggaatccctctggtgagtattggttgggcaatgaattcattttcgcaataacttcacaaaggcaatatatgctgaggatcgagttgatggactgggaagggaaccgcgcctatagccagtacgaccggtttcacatcggcaatgagaaacagaattacagactatacctcaagggccatacagggacagcaggtaagcagagttctcttattctgcatggtgcggatttctctactaaggatgccgacaatgacaattgcatgtgcaaatgtgccttgatgcttactggagggtggtggttcgacgcctgcgggccgtcaaacctcaatggaatgttctacacggccggccagaaccacggcaaactgaatgggatcaagtggcactactttaaaggtcctagctatagccttaggagtaccacgatgatgatccgtcccctggacttc

SEQ ID NO: 32052 - DNA, 1494 bp, Artificial Sequence
  Description of Artificial Sequence: Synthetic coding sequence
atgaccgtattcctttctttcgccttcctggcagctattcttacacatatcggctgcagcaatcaacggcggtctccagagaacagcgggcgccgatacaatcgcattcagcacggacaatgcgcctatacatttattttgccagaacacgacggcaattgtcgggagtcaactacagatcagtataacacgaacgcactgcagcgagatgcaccgcacgtcgagcctgacttttcatctcaaaaactgcaacacctcgagcatgtgatggaaaactatacgcagtggcttcagaagctagagaattacatcgtcgagaacatgaagagcgaaatggcccaaatccagcaaaacgctgtgcagaaccatacggcaacgatgcttgagataggaacatcgctcctgtcacagaccgctgagcaaacacgtaagctgactgatgtagagacacaggtccttaatcagacttcgaggctcgagatacaactgttggaaaattccctgtcaacctataagctggagaaacagttattgcagcaaaccaatgagatattgaagatacatgagaagaattcactgcttgagcataaaatccttgagatggaagggaaacataaagaagaacttgatactctcaaagaggaaaaagaaaatctgcaaggcttggttacccgacaaacgtatatcatccaggaactagagaagcagctcaatcgggcaaccacgaataattctgtactccaaaagcaacaactcgagttaatggatacagttcacaacctagtaaatctatgcacaaaagagggggtgttattgaagggtggcaagcgcgaggaagaaaagccgtttagagactgtgctgacgtctatcaggctggattcaacaagtctggaatttacaccatttacatcaacaatatgcccgagcctaagaaggtgttctgtaatatggatgtgaatggcgggggctggacagtgatccagcatcgcgaggatggctcactggattttcagcgaggatggaaggagtataaaatggggtttggaaacccaagtggtgaatactggctaggtaatgaatttatctttgcaatcacctcacagcgccagtacatgttgagaatcgagctgatggattgggagggcaaccgcgcttatagtcaatacgatcgattccatatcggtaatgaaaaacaaaattaccggctttacttaaaaggccacactgggaccgctggcaagcagtcgtcattgatccttcacggggcagattttagtacaaaagacgccgataatgataactgcatgtgtaagtgtgcgctcatgctcacggggggatggtggtttgacgcttgcggccccagcaatttgaacggcatgttttacacggcaggacaaaaccacggcaagctgaatggaatcaagtggcattatttcaagggtcccagttattcgttgcggtccactacgatgatgatccgtcccctggatttt

SEQ ID NO: 32053 - DNA, 1494 bp, Artificial Sequence
  Description of Artificial Sequence: Synthetic coding sequence
atgactgtgtttctctcgttcgccttcctggccgccatcttgactcatatcggatgctccaaccaacgcagatcacccgagaactccggccggcggtacaaccggatccaacacggacagtgcgcgtacaccttcatcctgccagagcacgatggtaattgtcgcgaatcgactactgaccagtacaacacgaatgccttgcagcgggatgcgcctcatgtcgaaccggacttctcgtcacagaagctccagcacctggaacacgtgatggagaactacactcagtggctgcaaaagctcgagaactacattgtggagaacatgaagtcggaaatggcgcagatccaacagaatgcggtgcagaaccacaccgccaccatgctggaaatcggcacgagcctgctctcacaaactgcggaacaaactcggaagctgaccgacgtcgagactcaggtgctgaaccagactagtcgcctggaaatccagcttctggaaaattcgctctccacttacaagctggaaaagcaacttctgcagcagaccaacgagattctgaaaatccacgaaaagaacagcctgttggagcacaagattctggaaatggaaggaaaacataaagaggaactcgacactctgaaagaggaaaaggagaatctgcaaggcctggtgacccgccagacgtacatcatccaggaactggagaagcagcttaaccgggctaccaccaacaattccgttctccagaaacagcagctggagctgatggatactgtgcataacctggtgaacctttgtactaaggaaggggtcctgctgaagggcgggaagagagaagaggaaaagccgttccgcgattgcgccgacgtgtaccaagccggatttaacaagtcaggaatctacacgatttacatcaataacatgccagaaccgaagaaggtgttctgtaatatggatgtgaatggtggaggctggaccgtgatccagcatagggaagatggaagccttgacttccagcggggctggaaggaatacaaaatgggattcggaaatccgagcggggagtactggctcggcaacgagttcattttcgccatcacttcacaacggcagtatatgctgcggatcgaactgatggattgggagggcaacagagcttactcgcagtacgacagattccatattggcaacgagaagcaaaactaccgcctgtacctgaagggtcacactggaaccgccggaaagcagtcctcactgatcctccacggagcggactttagcactaaggacgcggataatgacaactgcatgtgcaaatgcgcattgatgctcaccggaggatggtggtttgacgcatgtgggccaagcaacctgaatggcatgttctacaccgcgggacaaaatcacggaaagctcaatggaatcaaatggcactactttaaaggaccctcatactcgctccggtccaccactatgatgatccgcccactcgatttc

SEQ ID NO: 32054 - DNA, 1494 bp, Artificial Sequence
  Description of Artificial Sequence: Synthetic coding sequence
atgactgtgtttctctcattcgccttccttgcggccattctcacccacattggctgtagcaaccagcgccggtcgccagaaaactcgggccgccgctacaaccgcattcagcacggacaatgtgcctacacctttattctcccagagcacgacggtaattgccgcgagagcacgaccgaccagtacaacaccaatgcactgcaacgcgacgcaccccatgtcgagcctgacttctcgtcccagaagctgcaacacctcgaacacgtcatggaaaactacacccagtggctgcaaaagctggagaattacatcgtggagaatatgaagtctgaaatggcgcaaatccagcagaatgccgtgcagaatcacaccgctactatgttggagatcgggaccagtctgctgtcccagacggcggagcagaccaggaaattgaccgatgtggagactcaggtgcttaaccagacctcgcgcctggagatccaactgctggaaaattccctctcaacctacaagctcgaaaaacaactgctccagcagaccaacgagatcctgaagatccacgagaagaattcgctcctggagcataagatactcgaaatggaggggaagcacaaagaggagctcgataccctcaaggaggagaaagaaaacctgcaaggccttgtgacccgccaaacttacatcatccaggaactggaaaagcagctgaacagagccaccactaacaactctgtgttgcagaaacaacaactggagctgatggacactgtgcataatcttgtgaatctgtgcacgaaagagggagtgctgctcaagggtggtaagcgggaggaggaaaaaccattccgggattgcgcagacgtgtatcaggccggattcaacaaatcgggaatctacactatctacattaacaacatgcctgaaccaaagaaggtcttttgcaacatggacgtgaacggagggggatggaccgtgatccaacatcgcgaggacggaagcctggacttccagaggggatggaaggagtataagatgggcttcggaaatccgtcaggagaatactggctcggaaacgaattcatctttgccatcacttcgcagcgccagtacatgcttaggatcgaactgatggactgggagggcaatcgggcgtattcccagtatgatagattccacatcgggaacgaaaagcaaaactaccggctgtacctcaaaggacacactggaactgcaggaaaacaatcgtctctgatccttcacggcgcggacttttccaccaaggatgccgataatgacaactgcatgtgtaagtgcgctctcatgctcactgggggatggtggtttgatgcgtgcggccccagcaacttgaatggtatgttctacacggcaggacagaatcacggcaaacttaatggaatcaagtggcattacttcaagggtccttcttactccctcaggtcgaccaccatgatgattcggccgctcgacttc

SEQ ID NO: 32055 - DNA, 1494 bp, Artificial Sequence
  Description of Artificial Sequence: Synthetic coding sequence
atgactgttttcctcagtttcgcctttcttgcagctatccttacccacatagggtgtagcaaccagcgtcggtcccctgaaaattccggacgccggtataaccggatccagcacggtcagtgcgcttacacttttatcctcccagaacatgatggcaattgccgcgagtcaaccacagaccaatataacacaaacgctctgcagagggacgctccacacgtagagccagactttagttcgcagaagctgcagcatcttgagcacgtgatggaaaactacacccagtggcttcaaaaattggagaactacatagtggagaacatgaaatctgagatggcccagatacagcagaatgcggtgcagaaccataccgccactatgctcgagatcggtactagtctgttgagtcagaccgccgaacaaactcgtaaactgactgatgtggaaacccaggtgttaaatcagacctcgagacttgagatccagctcctggaaaacagtctctctacctacaaactggagaagcagctgctccagcagacaaacgaaattttgaaaattcacgaaaaaaattctttgctggagcacaagattttagaaatggaaggtaaacacaaagaggagctcgacacactgaaagaagaaaaggagaacctgcagggactggtgaccaggcaaacatacatcatccaggaactggagaaacagctgaatagggcaaccacaaacaattctgtcctacagaagcaacaattagagcttatggacaccgttcataacttagtcaacctgtgcacaaaagaaggagtgttgctcaagggtgggaagcgtgaggaagaaaagccattcagagactgcgcagacgtctaccaggccgggtttaacaaaagcggaatttatactatatacatcaataatatgccagaacccaaaaaggtcttctgcaatatggacgtgaacggagggggctggacggtcattcaacatcgcgaagatggttccctggacttccagcggggctggaaagaatacaagatgggatttggaaacccgtctggcgagtattggttggggaatgaatttattttcgcaattactagccaacgccagtacatgctaagaatcgagcttatggactgggagggtaatcgcgcctactcccagtatgatcgcttccatatcggtaacgagaagcagaactaccggctgtatctcaaggggcacacaggaaccgcagggaagcagtccagtctgatccttcacggagccgatttttccactaaggacgccgacaacgacaattgtatgtgcaagtgcgccctaatgctgactgggggatggtggttcgatgcatgtggcccttccaacctcaatggtatgttttatacggccggccaaaaccatggtaaactcaatggcattaagtggcactattttaaggggccctcatactctctgcggtcaacaactatgatgatcagaccactggatttt

SEQ ID NO: 32056 - DNA, 1494 bp, Artificial Sequence
  Description of Artificial Sequence: Synthetic coding sequence
atgacagtcttcctcagcttcgcttttctggccgcaatcttgacccacatcggatgctccaatcagcgcaggtctcccgagaattctggacgccgttacaaccgcatacagcacggtcagtgcgcctacaccttcattctgcccgagcatgatggcaactgtagggaaagtaccaccgaccaatataacacaaacgctctccagagagatgctccccatgtggagccagatttctcatcccagaaacttcagcacctggaacatgttatggagaactatactcagtggctgcagaagctggagaactacatcgtagaaaacatgaaaagtgagatggcccagatccagcagaacgccgtgcagaaccatactgccaccatgctcgaaatcggcacaagccttttgagccagaccgctgagcagactaggaaacttactgatgtcgaaacccaagttttgaatcagacctcacgccttgagattcagctccttgagaacagtttgtcaacctacaagttggagaagcaactgcttcaacagactaatgagatcctcaagattcacgagaagaacagcctgcttgagcataagatactggagatggagggtaagcataaagaggagttggacactttgaaggaggagaaggagaacctccaaggcctcgtgacacgccagacctacatcatccaggagctcgagaagcaactgaatcgtgcaactaccaacaatagcgtcttgcagaaacagcagctggaattgatggacaccgtgcacaacctggttaacctgtgtaccaaggaaggagttcttctgaaaggcggtaagcgcgaggaggagaagcccttcagagattgcgctgacgtgtatcaggcaggttttaacaagtccggaatttacaccatctacattaataatatgcccgagccaaagaaggtcttctgtaatatggacgtgaatggaggtggatggaccgttattcaacacagggaggacggttccttggactttcagaggggctggaaggaatataagatgggattcggcaatccaagtggtgaatattggctcggtaacgaatttatttttgctattacctcccagcgccagtacatgctgcgcatcgagcttatggactgggagggtaacagggcctactctcagtacgacaggtttcacatcggtaacgaaaagcagaactataggctgtacctcaaaggtcacacaggaactgcaggtaagcaaagctcactgatcctgcatggagccgacttctcaaccaaggacgcagataatgataactgcatgtgtaagtgtgccctcatgttgacaggcggatggtggttcgacgcttgcggaccctctaacctcaacggaatgttttacaccgctggacagaaccatggtaagctcaatggtatcaaatggcattacttcaagggtccttcttactcccttcgttccaccacaatgatgatccgccccctggatttt

SEQ ID NO: 32057 - DNA, 1494 bp, Artificial Sequence
  Description of Artificial Sequence: Synthetic coding sequence
atgactgttttcctgtcattcgccttcctggctgcaattctaacacacatagggtgttctaaccaacgacgtagcccggagaattcaggccggcgctataacaggatacaacacggacagtgtgcttatacgtttattctcccggaacacgatggaaactgccgggaatccacgacagaccagtataataccaacgcactgcagagagacgcaccacacgtcgaaccggatttctcatctcagaagctgcagcacctagagcatgtgatggagaattacacacaatggctacagaaactggaaaattacattgtggagaacatgaagtccgagatggcacagatccagcagaatgcggtccagaatcataccgccaccatgctggaaataggaactagtcttcttagccagactgctgagcagaccagaaaactgacagacgtcgaaacccaggttctgaatcagacctcccggctggagatccagctccttgagaactcactgagcacctacaagttggaaaagcagctgctccagcagacaaatgaaatcctgaaaattcacgagaagaactccttgcttgagcataagatcttggagatggaggggaaacataaagaggaactcgacacccttaaggaggagaaggagaatctccaaggcctagtgacacggcaaacatacattattcaggaactggagaagcagctcaacagggccaccactaacaacagcgtgctgcagaaacagcagctggaactcatggatacagtacacaacttggtcaatttgtgtactaaggaaggagtgctcctcaagggcggcaagcgggaagaggaaaagccgttccgagattgcgcagatgtctaccaggctggattcaacaaaagtggcatttatactatatatattaacaatatgcccgagccaaagaaggtcttctgtaacatggatgtgaacgggggtggatggacggtaatccagcaccgggaggatggcagcctggatttccagcgtggatggaaggaatacaaaatgggatttggcaatccctctggcgaatactggctggggaacgaatttatatttgctatcaccagtcagcgccagtatatgttgcgcattgagttgatggactgggaaggcaaccgtgcatattcccagtacgatcgatttcatataggcaacgagaagcagaactatcggctgtaccttaaaggccacactgggacagcgggaaaacaatcttcactcatattacacggagccgatttttcgaccaaggatgccgacaatgacaactgcatgtgtaagtgtgcacttatgctgacaggtggctggtggttcgacgcctgcggcccttcaaatctgaatggtatgttctatacagccggacagaatcatggcaagttgaacggaattaagtggcactatttcaaaggaccctcctatagtcttcggtcaacgactatgatgatcagacccctggatttt

SEQ ID NO: 32058 - DNA, 1494 bp, Artificial Sequence
  Description of Artificial Sequence: Synthetic coding sequence
atgactgtgttcctttcctttgcatttctggctgcaattctgactcatattggttgttcaaatcaaaggcggtcgcctgagaactcaggtcggcgctacaatagaattcagcacgggcagtgtgcatatacgttcatactgccggaacacgatgggaactgtcgggaatcgactaccgatcagtacaataccaacgccctgcaaagagatgcccctcatgtggaaccagacttttcgtcgcaaaagctgcaacatttggaacatgtgatggaaaactacacgcagtggttgcaaaagttggagaattacattgttgagaatatgaaatcagaaatggcacaaattcagcagaatgcagtgcaaaaccataccgcaaccatgcttgaaatcggtactagtcttttgtcacaaaccgcagagcagactcgcaagctgaccgatgtcgaaactcaagtactgaaccagacttccagattggagattcaacttctggaaaactcgctcagcacctataaactggagaagcagttgcttcaacagaccaacgaaatactgaagattcatgaaaagaactcgcttttggagcataagatacttgagatggaaggaaagcacaaggaggagctcgacaccctcaaggaggaaaaagaaaaccttcaaggtcttgtcacccgccagacctacataatccaagaactggaaaagcagcttaacagggccaccactaataacagcgtgttgcaaaaacaacaacttgaacttatggacactgtgcacaacctggtgaacctgtgcactaaagaaggtgtgctgctgaaaggtggaaagcgcgaagaagaaaaacccttcagggactgcgctgacgtgtaccaggccggttttaacaaaagcggtatttacactatctacatcaataacatgcccgaaccaaagaaggtcttttgcaatatggacgtcaacggcggaggatggaccgtgattcagcatcgcgaagatggatccctggactttcaaagagggtggaaggaatacaagatgggctttggtaacccatcgggagaatactggctgggaaacgaattcatttttgccatcacttcccagcgtcagtacatgctccgtattgaactgatggattgggaaggaaacagagcttactcgcaatatgacagatttcatatcggaaacgagaaacagaactacagactttacctgaaaggacataccggaaccgccggcaaacagagtagcctcattctgcatggagcagacttctcgactaaagacgcagataacgataattgtatgtgcaaatgtgcgctgatgctcaccggtgggtggtggttcgatgcttgtggcccttcaaatctgaacggaatgttctatactgcagggcagaatcacggcaagttgaacggaatcaagtggcactactttaaggggccctcctactctcttcggtccacgaccatgatgatacggcccctcgatttt

SEQ ID NO: 32059 - DNA, 1494 bp, Artificial Sequence
  Description of Artificial Sequence: Synthetic coding sequence
atgacggtattcctgtcatttgctttcctggccgccattctgacccacatcggctgctctaatcagcggagaagtcccgagaatagtggtcggcgctacaaccgtatccagcatggtcagtgtgcctataccttcatcctccctgagcacgatgggaattgcagagagagtactaccgaccaatacaatacaaacgctctgcagcgagatgcccctcacgtcgagccagacttctctagtcagaaattacaacacctggaacatgtgatggagaattatacccagtggttgcagaagttggagaattacattgtggagaatatgaaaagtgaaatggcacagatccagcagaatgctgttcagaatcacacagccacaatgcttgagatcggcaccagtctccttagccaaactgcggagcaaactcggaagcttactgacgtggaaactcaggtgcttaaccaaaccagccgtctggagattcaacttttggagaatagtctcagcacatacaagctggagaagcagctcttgcaacagactaacgagatcttaaagatccacgagaagaattctttgctcgagcacaagatcctggagatggaggggaaacacaaagaggagttggacacactgaaagaagagaaggagaacctgcaagggctagtgacccgtcagacatatatcatacaggagctggaaaagcagctcaacagagctacaaccaacaattcagtcctccagaaacagcagttggagctgatggatacagtgcacaacttggtgaacctgtgtaccaaagaaggggttttgcttaagggagggaagcgcgaggaagaaaagccattccgagattgtgcagatgtgtaccaagccggcttcaacaagtctggcatctatacaatttacataaacaacatgccagaaccaaagaaagtcttttgcaatatggatgtcaatggaggaggatggaccgtgatccagcaccgcgaggatggcagcctagacttccaacgcggctggaaagagtataagatggggttcgggaatccgtcaggcgagtactggttaggaaacgagtttatatttgccatcaccagccaacgccagtacatgctacgcatcgaactcatggattgggagggaaacagggcctattctcagtacgatcgcttccacatcggtaacgagaagcagaattatcggctctatcttaagggtcacactggtacagctggcaaacagtccagtctcatactacatggagccgacttcagtacaaaggatgcagacaatgataattgcatgtgtaaatgcgctctgatgcttaccggtggctggtggttcgatgcatgcgggcccagcaatctgaacgggatgttttacactgcaggccagaaccatggtaaactgaacgggataaagtggcactacttcaaaggtccatcctatagcctcagatccaccacaatgatgatcaggccattagacttc

SEQ ID NO: 32060 - DNA, 1494 bp, Artificial Sequence
  Description of Artificial Sequence: Synthetic coding sequence
atgactgtgttcctgagtttcgctttcctggccgcgatcctcactcacatcggctgttccaaccagcgacgctcgccggaaaacagcgggcgccgctacaacagaatccagcatggacaatgcgcctacaccttcatcctgccagaacacgacggtaactgtcgcgagtcaaccactgaccaatacaataccaatgccctccagcgcgatgcgccacacgtcgagccggacttctcgagccaaaagttgcagcatctcgagcatgtcatggagaactacacccagtggctgcagaagctggaaaactacatcgtggaaaacatgaaatcagaaatggcccaaattcagcagaacgcagtgcaaaaccacactgccactatgctggagatcggaactagcttgctctcacaaactgccgagcagacccggaagctcaccgatgtggagactcaggtgctgaaccagacctctcgcctcgagatccaactgctcgaaaacagcctgtcgacttataagctcgagaaacaactcctgcagcagaccaacgaaattctgaagatccacgaaaagaattccctcctggagcataagattctggagatggaaggaaagcataaagaggaacttgataccctgaaggaagagaaagagaacctgcagggactggtcactagacagacttacatcatccaggagctggagaagcagctgaacagagctaccacgaacaattcagtgctccagaaacagcagttggagttgatggacaccgtgcacaacctggtgaacctctgcacgaaggaaggagtgttgctgaaaggaggaaaaagagaagaagaaaaacctttccgcgactgtgcggatgtttatcaagccggtttcaataagtcgggaatttacactatctacatcaacaacatgccggaaccaaagaaggtcttttgcaatatggacgtcaacggaggtggatggaccgtcatccagcaccgcgaggacggctccctggattttcagcgcggttggaaggagtacaaaatgggatttggaaacccatctggggagtactggctgggcaatgagttcatcttcgccatcactagccagaggcagtacatgttgcggatcgaactgatggactgggagggaaaccgcgcctactcgcagtacgaccgcttccatatcgggaacgaaaagcagaactaccggttgtacctgaagggacatacgggtactgccggaaagcaatcctcgctgatcctccacggagcggacttttcaaccaaggatgctgacaatgataactgcatgtgtaaatgtgctctcatgctgacggggggttggtggtttgatgcatgtggcccatccaacctcaacggaatgttctacaccgcaggacaaaaccacggaaagctcaacggaatcaagtggcactactttaaaggaccgtcgtactcgctccgctccactaccatgatgatcagacctctggacttc

SEQ ID NO: 32061 - DNA, 1494 bp, Artificial Sequence
  Description of Artificial Sequence: Synthetic coding sequence
atgactgtcttcctgagttttgctttcctggccgcaatccttacccatatcggatgcagcaaccaacggcgcagccctgaaaacagtgggagaaggtacaaccggattcaacacggacagtgcgcatatactttcattttacccgaacatgatggcaactgccgtgaatcaaccacggatcagtataacacaaacgccctccagagggacgcccctcacgtagagccagatttttctagccagaaactccagcaccttgaacacgttatggagaactacacccagtggctgcagaagctggaaaactacatcgtcgagaatatgaagagcgaaatggcacagatccagcaaaatgctgttcaaaaccataccgcaaccatgctggagatcgggacctctttacttagccaaacggctgaacagacgcgcaagctgacagatgtcgaaacccaggtgctaaaccagacctctaggctggaaattcagcttcttgagaacagtctctcaacgtataagttagagaagcaactgctccaacaaacaaacgaaatattaaaaatacacgaaaagaacagtcttttggaacataagatactggaaatggagggtaagcacaaagaagaactggacactctgaaagaagaaaaagagaacttacagggacttgtgaccagacaaacctatatcatccaggagctcgaaaagcagctgaatagggcgacaactaacaactccgtcctccaaaaacagcaacttgaactgatggataccgtgcacaacctagtgaatctctgcaccaaggaaggcgtcctgttaaagggcggaaagagagaggaggaaaaaccctttagggattgcgctgatgtgtatcaggccggattcaacaaaagtggcatctataccatctacataaacaacatgcctgagcccaagaaggtcttttgcaacatggatgtcaacgggggcggttggactgttatccagcatagagaggatggcagcctggattttcagaggggttggaaggaatataagatgggatttgggaaccctagcggagagtactggctgggaaatgagttcatattcgcaattactagtcagcggcaatatatgttgaggatcgaattgatggactgggagggtaaccgcgcctattcccagtacgataggttccatatcggaaacgaaaagcagaactacagactctatctgaagggtcacactggcaccgcgggtaaacaaagttcccttatccttcacggagctgacttcagcactaaagacgcagacaacgataactgtatgtgcaagtgtgctctcatgctgacaggaggatggtggtttgatgcctgcgggccctctaacctcaacggcatgttctacaccgctgggcagaaccacggcaaactgaacggaatcaaatggcactactttaaggggccaagctactcccttaggagtacaactatgatgatcaggcccttagatttt

SEQ ID NO: 32062 - DNA, 1494 bp, Artificial Sequence
  Description of Artificial Sequence: Synthetic coding sequence
atgaccgttttcttatccttcgcattcttagcagcgatcctgacgcacattggttgcagtaatcagcggcggtcaccggaaaactcaggcagaagatataatagaattcagcatgggcagtgcgcgtacacttttattctcccggagcacgacggtaactgtagggaatccaccactgaccagtacaacacgaatgcattacagcgagacgccccacatgtggagccggatttttcctcgcaaaagctccagcatctcgaacatgtcatggagaattatactcaatggttacagaaactggaaaattacatagtggaaaacatgaagagcgaaatggctcagattcagcaaaacgctgtacagaatcacacagcaaccatgctggaaatcgggacgtccttactcagtcaaacggcggagcagacaagaaaactaacagatgtggagacccaggtactcaatcagacttccagactggaaattcaactgttagagaactcactctcaacatacaagctggagaagcagctacttcagcagacgaatgagattctgaaaatccacgaaaagaactcattacttgagcacaaaatacttgagatggaaggcaagcacaaggaggaactcgacacgttgaaggaggagaaagagaatcttcaggggttagttactcggcagacttacatcatccaggaactggaaaagcagcttaatcgggctacaaccaataattccgtgttacagaagcagcagctggaactcatggatactgtgcacaacttggtgaatctatgtacaaaagaaggcgtgctgcttaagggcgggaagcgtgaggaggaaaaaccttttcgggattgtgccgacgtgtatcaggctgggttcaacaaatcgggaatatacactatatacattaacaacatgcctgaaccgaagaaagtcttttgcaacatggacgtcaatggcggcgggtggactgtcattcagcatcgcgaggacgggagcctggattttcagagggggtggaaagagtataagatggggttcgggaatccgagcggggagtactggctcggaaacgagtttattttcgcaatcacctctcagagacaatatatgctgcggatagagttgatggattgggaggggaatagagcatacagccagtacgaccggtttcacattggaaatgagaaacagaactataggctctacttgaaaggacatacagggacagccggaaaacagagttcgttgattctgcatggggccgatttcagtaccaaggacgctgataatgataattgtatgtgcaagtgcgcactgatgctgaccggcgggtggtggtttgacgcgtgcggtcctagtaacctgaatggaatgttctatacagctggccagaaccacggtaagctcaacggcattaaatggcattacttcaagggaccaagctactctctgcggagcacaacaatgatgatcagacctcttgatttc

SEQ ID NO: 32063 - DNA, 1494 bp, Artificial Sequence
  Description of Artificial Sequence: Synthetic coding sequence
atgaccgtgttcctgagttttgcattcctcgccgcgatactgacgcatattggatgctccaaccagcgccgcagccccgagaactctggtcgccgatacaatcggatccagcacgggcagtgcgcctatacatttattctgcctgagcacgatggcaattgccgagagtccacaactgaccagtataacacaaatgcccttcagcgtgacgccccgcacgttgagcctgacttttcctctcagaaacttcaacacctcgagcatgtaatggagaactacacccagtggctccaaaaacttgagaactatatcgtcgagaatatgaagagcgagatggcccaaatccaacagaatgccgtgcagaatcataccgcgactatgctggagatcgggacgtccctgctctcccagaccgcagagcaaaccagaaagctcacggatgtggagacccaagtgctaaaccagaccagcaggttagagatccagcttctcgagaattctctgtcaacctataagctcgaaaagcagctgttgcaacagacgaacgaaatcttaaaaattcacgaaaaaaattctctgctcgaacataagatactagagatggaaggaaagcataaagaagaactcgacacactgaaagaggagaaagaaaaccttcaggggttggtgacacgtcagacttatattattcaggagctcgagaagcagctgaatagggctaccacaaacaattctgttctgcagaagcagcagttagagttgatggacacggtccataatttggtaaatctgtgcacaaaggagggagtattgcttaagggtggcaagagggaggaggagaaaccgtttcgggactgtgcggacgtgtaccaggccggcttcaacaaatcaggaatctatacaatctacatcaataatatgcctgaacctaagaaagtcttctgtaacatggatgttaacggcggggggtggactgtgattcagcatagagaggacgggtccctggatttccagaggggctggaaagagtataagatggggtttggcaatccaagcggagaatattggttgggcaatgaatttatatttgcaataacttcccagcggcaatatatgttgcgtatcgagctcatggattgggaggggaaccgtgcatactctcagtacgatagattccatatcgggaacgagaagcaaaattaccgcctctacctgaaaggtcatactggtaccgctgggaaacagagcagcctgattttgcatggtgcagacttcagtaccaaagatgcggataacgataactgtatgtgcaaatgcgcactgatgctcactggaggatggtggttcgacgcttgtggcccctctaaccttaacggaatgttttacacagccggccagaaccatggaaagttaaatggcatcaagtggcattacttcaaaggcccctcatactctctgagaagtaccaccatgatgatcaggcccttggatttt

SEQ ID NO: 32064 - DNA, 1494 bp, Artificial Sequence
  Description of Artificial Sequence: Synthetic coding sequence
atgacagtgtttttgtctttcgctttcctcgctgccatacttacccatatcggttgttctaatcagcgccggtctccggagaactctggtaggaggtataataggatccagcacggccagtgcgcctacaccttcatccttcctgagcatgacggtaactgtcgcgaatcaacgaccgaccagtacaatacaaacgcactccagcgcgacgcacctcatgttgagcctgacttcagttcacaaaaactacagcatctggaacatgtgatggaaaattatactcagtggctccagaagttagagaactatattgtggaaaatatgaagtccgagatggctcagatccaacagaatgctgtgcagaaccatacagccacaatgctcgagattggcaccagtctgctgagccagacagctgaacagacccggaagctcaccgatgttgagacacaggtactaaaccaaacctctaggctcgaaattcagctgttggagaacagtttgtcaacttataagctggagaagcagttgctgcaacaaaccaacgaaattctgaaaattcacgaaaaaaatagtctgctcgaacataagatcctggagatggagggcaaacacaaagaagagctcgacacattaaaggaagagaaggaaaacctccagggcctagtcaccaggcaaacctacatcatacaggagttagagaagcagctcaaccgcgccactaccaacaattcggtcctacagaagcagcagttggagctcatggatacggtgcataatctggtgaatctctgtactaaggaaggggttctattgaaaggggggaagagagaggaggaaaaacctttccgggattgtgctgacgtgtaccaggctggctttaataagtctggcatctatactatctatatcaacaatatgccggagccaaaaaaggttttttgcaatatggacgtgaatggaggcggttggaccgtgatccagcaccgagaagatggctccctagatttccagaggggctggaaggagtacaaaatggggtttggaaatccttctggggagtactggctgggaaatgagttcattttcgctattacatcgcagagacaatacatgttgcgtattgagctcatggattgggagggcaatagagcatattctcagtatgaccgctttcacattggaaatgaaaagcaaaattaccgcctttatcttaagggacacaccggtaccgcaggtaaacagtccagcctgatcttgcatggagctgactttagcactaaggatgcggacaacgataactgcatgtgcaagtgcgcccttatgcttactggcggctggtggtttgatgcatgcggcccctccaatttgaatgggatgttttacaccgccggacagaaccacgggaagctaaatggtattaaatggcactattttaaagggcccagctactctctgcgcagtacgaccatgatgatccgccccttggacttc

SEQ ID NO: 32065 - DNA, 1494 bp, Artificial Sequence
  Description of Artificial Sequence: Synthetic coding sequence
atgacggtgttcctgtcctttgcatttctcgccgcgattcttacgcatattgggtgctccaaccagagacgctcaccagaaaacagcggtagacgatacaacagaattcaacatggtcagtgtgcatacactttcatccttccagagcatgatgggaattgccgggagtctactaccgatcagtacaacaccaacgcacttcagagggacgcgcctcatgtggagccagattttagctcacaaaaactccagcatcttgagcatgtgatggaaaactacacccaatggcttcaaaagctggagaattacattgtcgaaaacatgaagtcggagatggcgcaaatccaacagaacgccgtccagaaccataccgcaaccatgctggaaatcggaacctcacttctttcgcagaccgcagagcaaactcggaaacttactgatgtggagactcaagttctcaaccaaactagcagactggaaattcagctgctcgaaaatagcctctcgacctacaaacttgagaagcaactgctccaacaaactaacgagatacttaagattcacgaaaagaattcccttcttgaacacaaaatccttgaaatggagggtaaacataaggaagaactggacaccctcaaagaggaaaaggaaaacctccaagggctcgtgactagacagacgtacataattcaagaactggagaaacagcttaaccgtgcaaccactaataactcggtgctccaaaagcagcagctggagctgatggacacggtgcacaacctggtcaatctgtgtacgaaagagggtgtgttgctgaaagggggaaagcgggaagaagaaaagcctttcagagattgcgcagatgtgtaccaagcaggctttaacaagtcgggtatttacaccatttacattaacaacatgcccgagccgaagaaggtgttttgtaatatggacgtgaacggaggcggatggactgtgattcagcatagggaagatggttcccttgattttcagcgcggatggaaggaatacaagatggggtttggtaacccaagcggggaatactggctgggaaatgagttcatatttgcaatcacctcgcagaggcaatacatgctgagaattgaactcatggactgggagggaaaccgggcatactcacaatatgatcggttccatattggaaatgagaagcaaaactacagactgtaccttaagggccacaccggaaccgccggtaaacagtcctcccttatccttcacggcgccgatttttcgactaaggatgcagataacgacaactgtatgtgtaaatgtgccctgatgcttactgggggatggtggtttgatgcatgtggacccagcaacctcaacggcatgttctacactgcaggtcaaaaccacggaaagctgaacggaattaagtggcactactttaagggcccttcttactcgctccgaagcactaccatgatgattcggcctcttgatttt

SEQ ID NO: 32066 - DNA, 1494 bp, Artificial Sequence
  Description of Artificial Sequence: Synthetic coding sequence
atgacagtctttctctcattcgcattcctggctgctattctgacccacatcggctgctccaatcagcggcggtcccctgagaactctggaaggcgctacaacaggatccagcatggtcaatgcgcttatacgttcattctacctgagcatgatgggaattgcagggagtctaccacagaccagtacaacacaaacgcactccagcgggacgccccacacgtagaacctgattttagtagccagaaactgcaacacctggaacacgtgatggaaaactacacccaatggttgcagaaactggagaactacattgtggagaatatgaaaagtgaaatggcgcagatccagcaaaacgctgttcagaaccacacagcaacaatgctcgagatcggcacaagccttttatcccaaacagctgagcagacccggaagctgactgacgtcgagacccaggtcctgaaccaaacctcccgccttgagatccaactcttggaaaactccctctcaacctataaactcgagaaacaactgctgcagcagaccaacgagatcctgaagattcatgaaaagaacagcctcttggagcacaagattctggaaatggaaggcaagcacaaggaggaactcgataccttgaaagaagaaaaggagaatcttcaggggctggtcactcggcagacttacatcatccaggaattggaaaaacagctcaatcgggcaactacgaacaattccgtgctccagaaacagcagcttgagctgatggacaccgtgcacaaccttgtgaatctctgcaccaaagagggcgttttgttgaaaggtggcaaaagagaagaagagaaaccttttcgagattgcgccgacgtttatcaggcaggcttcaataaaagcgggatttacacaatatacataaacaacatgcctgaacctaaaaaagtgttttgcaacatggacgttaacggcggagggtggactgtgatccagcaccgggaggacggcagtctggattttcagagaggttggaaggaatacaagatgggattcggcaatccctccggagaatattggcttggcaacgagtttatttttgccattaccagccagagacagtacatgctacggatcgaactgatggactgggagggtaatcgcgcgtacagtcagtacgacagattccatataggcaacgagaaacaaaattatagactgtaccttaagggacacactggcacggcggggaaacaaagctctcttatcttgcatggggccgacttctcgaccaaggatgccgacaacgacaattgcatgtgcaaatgcgccctcatgttaacgggtggctggtggttcgatgcttgcggtccctccaacctgaacgggatgttttatactgccggtcagaaccacggaaaactcaatggcattaagtggcactatttcaagggaccgagttacagccttcgctccactaccatgatgatccgtccgctggacttt

SEQ ID NO: 32067 - DNA, 1494 bp, Artificial Sequence
  Description of Artificial Sequence: Synthetic coding sequence
atgactgtatttctcagctttgcctttctggcagcgatcctgactcacatcggatgctcaaaccaacgacgcagtcccgagaatagcggccggagatacaaccggatccagcatggacaatgtgcgtacacttttatcctcccagagcacgacgggaactgtcgtgaatcaaccactgaccagtacaataccaacgccctgcaacgggatgcacctcatgtcgagccggattttagctcgcagaaactccaacacctcgaacacgtgatggagaactatacccaatggctccagaagctcgaaaactacattgtggagaacatgaagtccgaaatggcccaaatccagcagaatgcagtgcaaaatcatacggcaaccatgctggagataggcacctcgctcctgtcccaaactgcagaacagaccagaaaactcaccgatgtggaaactcaggtccttaaccagaccagtaggctggaaattcaactgctggaaaatagtctgtccacctataagttggaaaaacaattgctgcaacagactaacgaaatcttgaaaatccatgaaaagaactcccttctcgaacataagatacttgagatggaaggtaaacacaaagaagagttggacaccttgaaggaggagaaggagaaccttcaaggtcttgtgactcgccaaacgtacattattcaggagctggaaaagcaactgaaccgcgcaactaccaacaactccgtccttcagaaacaacaactggagctgatggataccgtgcataatctcgtgaatctttgcaccaaggaaggagtgctccttaagggtggcaagagagaagaagaaaagcccttcagagattgtgccgacgtttaccaggctggattcaataagtcgggaatctacaccatttacattaacaatatgcctgaacctaaaaaggttttttgtaatatggatgtcaacggaggcggttggaccgtgattcaacatcgggaagatggatcgttggactttcagagagggtggaaggaatacaagatgggctttggtaacccaagcggcgagtactggctcggcaacgaattcattttcgccattactagccaacgccagtacatgctgcgaattgaactgatggattgggaaggtaaccgcgcttatagccaatacgataggttccatatcgggaatgaaaaacagaattacaggctttacctcaagggacacacggggaccgccggaaaacaaagctcgcttatactgcatggagcagacttctcgactaaagacgcagacaatgataactgcatgtgtaagtgcgcactcatgcttaccggcggctggtggtttgacgcatgtggacctagcaaccttaacggaatgttttacaccgcgggtcagaatcatgggaagctgaacggtattaagtggcattacttcaaggggccatcctattcgctccgaagcactactatgatgatcagaccactggatttt

SEQ ID NO: 32068 - DNA, 1494 bp, Artificial Sequence
  Description of Artificial Sequence: Synthetic coding sequence
atgactgtttttctgtcgttcgcctttttggccgccatactaacgcacattggctgctccaatcagcgacgttcgccggagaattcaggcagaagatataatcgtatccaacatggccaatgtgcttacacctttatcctgcctgaacacgacgggaattgtagagagtcaacaacagaccaatataatactaacgcgcttcagcgagatgcccctcatgtcgaaccggatttttcctcacagaaattacagcaccttgagcatgtaatggagaactatacgcagtggctgcagaagcttgaaaattacatcgttgaaaatatgaaatccgaaatggcccaaattcaacaaaatgcggtgcaaaaccatacggcgacgatgcttgaaatcggcacgtctctgctgtcacagacagctgaacagacccgtaaactgacagacgtggaaacgcaagtgttaaaccagacctccagactcgaaatacaactgcttgaaaactcactttccacctataaattagagaagcaattactgcaacaaacaaacgaaattctgaaaattcatgaaaaaaactcattgctggagcacaaaattcttgaaatggaaggtaaacataaagaagaactagatacattaaaagaggagaaagaaaatcttcagggtctagtcacacgtcaaacatatattatccaagaacttgaaaaacagcttaaccgggccactacaaacaactcggttttgcaaaaacagcagttggaattaatggataccgtccataatctggtaaacctttgtacgaaagaaggggtcttactgaaaggcggcaagcgcgaagaggagaaaccgtttcgtgattgcgcggacgtctatcaagcaggctttaacaaaagcggtatatatactatttatatcaataatatgccggaaccgaagaaagtgttttgcaacatggacgtgaatggaggcggctggactgtaatccaacatcgggaggatggctcattggattttcaacgtggttggaaagaatataaaatgggctttggaaacccgagtggagaatactggttggggaacgaattcattttcgctattacgtcacagcgtcagtatatgttacggattgaattgatggactgggaaggcaacagagcgtatagccaatacgatcgttttcacataggtaatgagaaacagaactatcgtctttacctaaaaggacatacgggtactgcaggtaagcagtccagtcttatattgcatggagcggatttttctactaaagatgccgataatgataactgcatgtgcaaatgtgcccttatgcttactggcgggtggtggtttgatgcttgcggcccgtcaaacctcaatggcatgttttatacagctggacaaaatcatgggaaattgaatggaataaagtggcattatttcaagggaccgtcgtattcattgagaagtacaacaatgatgattcgtcctcttgatttc

SEQ ID NO: 32069 - DNA, 1494 bp, Artificial Sequence
  Description of Artificial Sequence: Synthetic coding sequence
atgaccgtgtttctgtcattcgcgttcctcgccgccattcttactcacatcggatgttccaaccagcggcgctccccagaaaactctggccggcgatacaaccgcatccaacacgggcaatgtgcctacacctttatcctgccggagcatgacggtaactgcagagaatccaccactgaccaatacaacaccaatgccctgcagcgcgacgcgccgcatgtggagcctgacttctcatcacagaagttgcagcatttggagcacgtcatggaaaactacacgcaatggctgcagaagctcgagaactacattgtggaaaacatgaagtcagagatggctcaaatccagcagaacgcggtgcagaaccataccgcgactatgctcgagataggaacctcgctgctctcacagactgccgagcagactaggaaactcaccgacgtggagactcaagtgctcaaccagacttcaaggctcgagatccagttgctggaaaactcgctgtcgacctacaagctggagaagcagttgctgcaacagaccaacgaaattctgaaaatccacgaaaagaattcgctgctggaacacaaaatcctggaaatggaaggaaagcataaggaagagttggatactctgaaggaggagaaggagaacctgcagggactggtgacccggcaaacctatatcatccaagagctcgaaaagcaactcaatagagcaactaccaacaattcggtcctgcagaagcagcagctggaattgatggacactgtccacaatctggtcaacctctgcaccaaagagggagtcctgcttaagggaggtaagcgagaagaggaaaagccgttccgggactgcgctgatgtgtaccaggcgggattcaataagtcgggaatctatactatctacattaacaatatgccggagccgaagaaggtattctgcaatatggatgtgaacggaggaggatggactgtgatacaacacagagaggacggtagcttggacttccagcgcggatggaaggagtacaaaatgggcttcggcaatccgtcaggggaatactggctgggcaatgagttcatatttgccatcacgtcgcagcgccaatacatgctgagaatcgaactcatggattgggaggggaaccgggcatacagccagtacgaccgctttcacatcgggaatgagaagcagaattacagactctacctcaaaggacacacgggaaccgctgggaaacagtcgtctcttatcctccacggagcagatttctccacgaaggatgccgataatgataattgcatgtgtaagtgcgctctgatgctgactggcggatggtggtttgacgcctgcggccccagcaatctgaatggaatgttctacaccgcagggcaaaaccatggaaaattgaacggcatcaaatggcactatttcaagggaccaagctactcgttgcggtcaaccactatgatgatcagaccgctcgatttt

SEQ ID NO: 32070 - DNA, 1494 bp, Artificial Sequence
  Description of Artificial Sequence: Synthetic coding sequence
atgactgtgttcctgtccttcgcctttctcgcagcgatactgacacacataggatgctccaatcagcggcgctcaccagaaaacagcggtagacggtataataggatacagcatggtcagtgtgcctacactttcatcttgcccgagcacgacggaaattgtcgcgagagtacaactgatcagtacaataccaacgccctgcagcgcgacgcaccccacgtggagcctgattttagctctcagaagctgcagcacctggaacatgtaatggagaattacacacagtggctgcagaaactcgagaactacatcgtggaaaacatgaaaagcgaaatggctcagatacagcaaaatgcagtccagaaccacacagctactatgctcgaaattggaaccagtctgctgtctcaaaccgccgaacagacccggaagctcacagacgtggagacccaagtgcttaatcagactagtcgcctggaaattcagctgctggagaacagtctgtccacatataagctcgagaagcagctcctgcagcaaacaaatgaaatcctcaaaattcacgagaagaactccctgcttgagcataaaatccttgagatggagggcaagcacaaggaggaattggacacccttaaagaggaaaaggagaacttgcagggcctggtcactagacagacatatatcatccaagagctggaaaagcagctgaacagggcaaccactaacaactcagtgctgcaaaaacaacagctggaacttatggacaccgtccataacctcgtgaatctgtgtaccaaggaaggggtcctgctcaagggcggcaagcgagaggaagaaaagccctttcgagattgcgcagatgtttatcaagctgggttcaacaaaagcgggatttacacgatttatattaataacatgcccgagcctaaaaaagtgttctgtaacatggacgtgaacgggggaggatggacggtgatccagcatcgagaggacgggagcttggattttcaaaggggatggaaagagtacaaaatggggtttggaaaccctagcggggaatactggctggggaacgagtttattttcgctattacctcacagcggcagtatatgttgagaatagaattgatggattgggagggaaatagagcttatagccagtacgataggtttcacatcggcaatgaaaagcagaattatagactctacctcaagggacacactggcactgccgggaagcagtctagcctcattctgcacggggctgatttctccactaaagacgcagacaacgacaactgcatgtgtaaatgcgccctgatgctgacaggcggatggtggttcgacgcgtgtggtccatcaaatctcaacggaatgttttacaccgccgggcaaaatcatggaaaactgaacggaatcaagtggcactacttcaagggtccgagctacagcctgagatccacgacgatgatgatcaggccactggacttt

SEQ ID NO: 32071 - DNA, 1494 bp, Artificial Sequence
  Description of Artificial Sequence: Synthetic coding sequence
atgactgtttttttgagctttgcttttctggccgccatccttacccacataggttgttccaatcagcgtcggagccctgagaatagtggccgtcgttataaccggatccaacacggccagtgcgcgtatacctttatcctgcccgagcatgatggtaattgccgagagagtacgaccgatcagtataatacgaacgctctacagcgcgacgcacctcatgtggagcccgatttttcatcccaaaaactccagcatctggagcacgttatggaaaactatacgcagtggcttcagaagctagagaactacatcgttgagaacatgaaatcagagatggcccagattcagcaaaacgccgtgcagaaccacaccgcgactatgcttgaaataggaacatccctgctctcccagactgcggaacagactcgcaagttgacagatgttgaaactcaggtgcttaatcagactagcaggcttgaaatccagttgttggagaactcgttgtccacctacaaactcgagaagcagttactacaacagactaacgaaatactcaaaatccacgagaagaatagtctgttagagcataaaatcctagagatggagggaaaacataaagaggagcttgacacattgaaggaagaaaaagagaatcttcagggactcgttactagacagacgtatattattcaggagttagaaaagcagttgaatcgcgccactaccaataactctgttttgcagaagcagcaattggaactaatggatacagtgcacaatctcgtgaatttatgtacaaaagaaggagtgctacttaaaggaggtaaacgggaggaagaaaagccttttagagactgtgctgatgtatatcaggccggcttcaacaagtccggtatttatacaatttacatcaataacatgcctgagcccaagaaggttttctgcaatatggatgttaacggaggcggctggaccgtaatccaacaccgagaggatggcagtctggactttcagagaggatggaaggagtacaagatgggatttggcaatccatccggcgaatattggctgggcaatgagttcatttttgccattacgagccagcgacagtatatgcttaggatcgaacttatggattgggagggtaacagagcatactctcagtacgaccggttccacatcggcaatgagaagcagaactatcggctgtatcttaagggacacacaggcacagctggcaaacagtcctctcttatcctgcacggcgccgatttctctactaaagatgccgacaacgacaattgtatgtgtaaatgcgccttgatgctcacaggggggtggtggttcgacgcgtgtggacccagcaacctcaatggtatgttttacaccgcaggacaaaatcacggcaaactcaacggaatcaagtggcactatttcaaagggccatcttactccctgcgctccaccactatgatgatccgtcctctagatttt

SEQ ID NO: 32072 - DNA, 1494 bp, Artificial Sequence
  Description of Artificial Sequence: Synthetic coding sequence
atgacggtgttcctgtcgttcgcattccttgccgcaattctcacccatatcgggtgctcaaaccagaggcggtcgcccgagaactcagggcgccgctacaaccgcatacagcacggacagtgtgcctacacgttcattcttccggagcacgacgggaactgtcgggagtctactacggaccagtacaacaccaacgcgttgcaacgggatgcgcctcacgtggagcccgatttctcgtcccaaaagctccaacatctcgagcacgttatggaaaactacactcagtggcttcaaaagctggagaactacatcgtcgaaaacatgaagtccgaaatggcccagattcaacaaaacgccgtccaaaaccataccgctaccatgctcgaaatcggcacctccctcttgagccagactgctgaacagacgcggaagctgaccgacgtcgagactcaggtgctgaatcaaacctccagactggaaatccaactgctggagaactccctgtccacttacaagctcgaaaaacagctcctccagcaaactaatgaaatcctgaaaattcatgagaagaattcgctccttgagcacaagatccttgagatggagggaaagcataaggaagaactggataccctgaaggaggaaaaagagaatcttcagggactcgtgactcgccaaacctacatcatccaagagcttgagaaacagttgaacagagccaccactaacaattcggtgctgcaaaagcaacagctcgaattgatggacactgtgcataatctcgtgaatctttgcaccaaggaaggagtccttctgaagggaggaaagagagaagaagaaaagccgtttcgcgattgcgccgacgtctaccaagcaggattcaataagagcggaatctatactatctatatcaataacatgccggaaccgaagaaagttttctgtaatatggatgtgaacggaggaggatggacggtcatccaacatcgcgaggacggatcacttgacttccaacgcggatggaaggagtataagatgggattcggcaatccttcaggcgaatattggctgggaaacgaattcatctttgccattacttcccagaggcagtatatgctcagaatcgaactgatggactgggaggggaaccgcgcctacagccaatacgatagatttcacatcggcaatgagaagcagaactaccgcctctacctgaagggtcatacgggaaccgcaggcaaacagagcagcctgatcctccacggtgcggactttagcactaaagacgccgacaatgataactgcatgtgcaaatgcgcactcatgctcaccggaggatggtggttcgacgcttgcggcccgagcaatttgaatggaatgttctacactgccggtcagaaccacggcaaactgaacggaatcaagtggcactacttcaagggcccatcctacagcttgagatctaccaccatgatgatcagacctctggacttc

SEQ ID NO: 32073 - DNA, 1494 bp, Artificial Sequence
  Description of Artificial Sequence: Synthetic coding sequence
atgacggtgtttctgtcttttgccttcctggcagctattttgacccatataggctgctccaaccagcggcgcagcccggagaactcgggacgcaggtataaccgcatacagcacggccaatgtgcctataccttcatcctgccagagcatgacggaaattgtcgggaatcaactaccgatcagtataacaccaatgctctgcagcgcgatgcacctcacgtggagcctgacttttctagccagaagctgcagcatttggaacatgtgatggagaactacactcagtggctgcagaaacttgagaactacattgtggaaaacatgaagagcgagatggcacagatccagcagaacgcggttcagaatcacacggccaccatgctggagattggcacatctctgctgtcccagacggctgaacaaacacgtaaacttacagacgtcgagactcaagtattaaaccagactagccgactggaaatccagctgctcgaaaacagcctcagcacttacaaactagaaaaacagctcctccagcagaccaatgaaattctgaaaattcatgaaaagaattctcttctggagcataaaatcctggagatggaggggaaacacaaagaggaattggataccctgaaagaagagaaggagaatctgcagggcctggtgacacgccagacctatatcattcaggaactggagaagcagttgaaccgcgccaccactaataactctgtccttcagaaacagcagctggaactgatggataccgtacataacttggtgaacctgtgcactaaagaaggggtgctcctcaaaggaggcaagcgggaggaggaaaagccttttcgggactgcgcggatgtttaccaagccggcttcaataagtccggaatttacaccatctatattaataatatgcccgaacctaaaaaagtgttttgcaatatggacgttaatgggggaggatggaccgtgatccaacaccgagaagatggtagtctggacttccagaggggctggaaagagtataagatggggttcgggaacccctcgggggagtattggttaggcaatgagttcatcttcgcgattaccagtcagaggcagtacatgctgcgcatcgagttgatggactgggagggcaacagagcctattcacagtatgacagatttcatatcgggaatgagaaacaaaactaccgactgtacctgaaaggtcacaccggcacagctggcaagcagagctccctgattttacacggagctgacttctcgaccaaagacgccgacaatgataattgcatgtgcaaatgtgctctgatgctcactggaggctggtggttcgacgcctgtggtccatccaacctcaatggcatgttctacactgcagggcaaaaccatgggaagttaaatggaattaagtggcactatttcaagggtccatcatatagtctgcggagcaccactatgatgatcaggccgctggatttt

SEQ ID NO: 32074 - DNA, 1494 bp, Artificial Sequence
  Description of Artificial Sequence: Synthetic coding sequence
atgactgttttcctttcattcgcctttcttgcagctattttaacccatataggatgttcgaatcaaagaaggagtcctgaaaattcaggacgtagatataatagaattcaacatggtcaatgtgcatatacttttattcttccagaacatgatggaaattgtagagaaagtacaactgaccaatataataccaatgctttacaaagagacgctccacatgttgaaccagatttttcatctcaaaaacttcaacatttagaacatgttatggaaaattatacccaatggcttcaaaagttagagaactatatagttgaaaatatgaaatcagaaatggcacagattcaacaaaatgctgttcaaaatcatacagcaacaatgttggaaataggaacttctctactctcacaaacagcagaacaaacaaggaaacttaccgacgttgaaacacaagttttaaaccaaactagtcgtttagaaattcaattattagaaaattccttaagtacttataaacttgaaaaacaattattacaacagacaaatgaaatattaaaaatacatgaaaaaaattcattattagaacataaaattcttgaaatggaaggaaaacataaagaagaattagacactttaaaagaagaaaaagaaaatttacaaggtttagttactcgacaaacatatatcattcaagagttagaaaaacaacttaatagagctacaacaaataattctgttttacaaaaacaacaattggaattaatggatacagttcataatttagttaacttatgtacaaaagaaggagttttgttaaaaggtggaaaaagagaggaagagaaaccatttagagattgtgcagacgtatatcaagcaggattcaataagtcaggaatatacactatttatatcaataatatgccagagccaaaaaaagttttttgtaatatggatgtaaacggaggtggatggacagtaattcaacatagagaagatggttctttagatttccaaagaggatggaaggaatataaaatgggattcggaaatccatcaggagaatattggttgggaaacgaatttatatttgcaattacaagtcaaagacaatatatgttaagaattgaacttatggactgggaaggaaatagagcatattcacaatatgatagatttcacattggaaatgaaaaacaaaattatcgactttatttaaaaggacatactggaactgcaggaaaacaatcttcacttattcttcatggtgctgactttagtacaaaagatgcagataatgataattgtatgtgtaagtgtgcattaatgcttacaggtggatggtggtttgatgcatgtggaccatcaaatttaaatggtatgttttacactgcaggacaaaatcatggaaaattaaatggaattaaatggcattattttaaaggtccaagttattctcttaggtctacaactatgatgattagacctttagatttt

SEQ ID NO: 32075 - DNA, 1494 bp, Artificial Sequence; identical to SEQ ID NO: 32051
  Description of Artificial Sequence: Synthetic coding sequence

SEQ ID NO: 32076 - DNA, 1494 bp, Artificial Sequence
  Description of Artificial Sequence: Synthetic coding sequence
atgaccgttttcctgtcattcgcatttctggctgctatcctcacccacatcggctgctcgaaccaaagaaggtcgccggagaactccggccgccgctacaaccggatccagcatggtcaatgcgcctacactttcatcctgccggaacacgatggaaactgccgtgaatcgaccaccgaccagtataacacgaacgctctgcagagggacgcaccgcacgtggagccggattttagcagtcagaagctccagcacctggaacatgtgatggaaaactatacccagtggctgcaaaaactcgaaaactacattgtagagaacatgaagtcggaaatggcacagatccaacagaatgctgtgcaaaatcacactgccaccatgttggaaatcggaacttccctgctgtcgcagaccgccgaacagactagaaaacttaccgacgtcgaaactcaggtcctgaatcaaacgtcacgtcttgaaatacaattgctggaaaattcactgtcgacctacaaattggaaaagcagctcctccaacagactaatgagattctcaagatccacgagaaaaactccctcctggagcacaagatccttgaaatggagggaaagcacaaggaggaactggacactctcaaggaagagaaggagaatctgcagggactggtcaccagacaaacctacatcatccaggaacttgagaagcagctcaaccgggcaactaccaataactcagtgctccaaaagcaacagcttgagctgatggataccgtccataacttggtgaacctgtgtaccaaagagggagtgctcctgaaggggggaaagagagaagaagaaaagccattcagagattgcgcagatgtgtaccaagccggcttcaacaaatcaggaatctacactatttacatcaataacatgccggaaccgaagaaagtgttttgtaacatggacgtcaacggcgggggctggaccgtgattcagcacagagaagatggttccctggatttccagcgcggatggaaggagtacaaaatgggcttcggaaaccctagcggagaatactggctgggtaacgagtttatcttcgcgatcacctcacaacgccagtacatgctgcgaattgaactgatggactgggaggggaaccgggcttactcgcagtacgaccggtttcacattggaaatgagaagcagaactaccgcctctatctgaagggacatactggaactgcaggcaaacaaagcagcctgatcctgcatggagcggatttctcaactaaggacgccgacaatgataactgcatgtgcaagtgtgctctgatgcttactggaggttggtggtttgacgcctgcggaccatcgaatctgaacggaatgttctacactgccggacaaaaccatggcaagttgaatggaatcaagtggcattactttaagggaccgtcgtacagcttgcgctccactactatgatgatccgccccttggatttc

SEQ ID NO: 32077 - DNA, 1494 bp, Artificial Sequence
  Description of Artificial Sequence: Synthetic coding sequence
atgactgtgttcttgtcattcgcgtttctggcagccattctcacccatatcgggtgttcgaaccaaagaagatcgcccgaaaatagcggtaggcgctacaaccgcattcaacacggtcagtgcgcatacactttcatcctccctgaacatgatggcaactgcagagaatccactacggaccaatacaacactaacgcactgcaacgcgatgccccccacgtcgagccagatttttcaagccaaaaacttcagcaccttgaacatgtcatggagaactacactcaatggcttcaaaagctcgaaaactatattgtcgaaaacatgaagtctgaaatggcccagattcaacaaaatgccgtccaaaaccacactgccaccatgcttgaaataggaacttccctcctttcccaaacggcagaacagacccggaagctcaccgacgtggaaactcaagtgctcaatcaaacctcacggctggaaattcaactcttggagaactccctcagcacgtacaagctggagaagcaactcctccagcaaactaacgagatcctgaaaattcatgaaaagaactcactgctggagcataagattcttgagatggagggaaagcataaggaagagctcgatacccttaaagaggaaaaggaaaatctgcagggacttgtgacgagacaaacctacatcatacaagagcttgaaaagcagctcaaccgcgcaacgactaacaactcggtgcttcagaaacaacaattggagctcatggacactgtgcataatcttgtgaatctctgtaccaaagaaggcgttcttctcaagggcggcaaacgagaggaggaaaagccatttcgggactgcgctgatgtctatcaagcagggttcaacaaaagtggaatatacaccatctacatcaataacatgccagaacctaagaaggttttttgcaatatggatgtgaatggcggtggatggaccgtgatacagcatcgcgaggatggaagtcttgactttcagagaggttggaaggaatacaagatgggattcgggaacccttcaggtgaatactggctggggaacgagttcatttttgcaatcacctcacagcgacagtatatgctgcggatcgagctgatggattgggagggaaatcgggcatattctcaatacgacagatttcacattggtaatgaaaagcagaactatagactttaccttaagggtcatactggtactgctggcaaacagtcatccctcattctccatggggctgacttttccactaaagacgcagataacgataattgtatgtgtaaatgcgcgctgatgctgactggaggatggtggtttgacgcctgtggcccttccaacttgaatggaatgttctacactgcaggacaaaaccatggtaaactcaacggaattaagtggcattactttaaaggaccaagctactccctgcgttcgactactatgatgattcgccctctggatttc

SEQ ID NO: 32078 - DNA, 1494 bp, Artificial Sequence
  Description of Artificial Sequence: Synthetic coding sequence
atgaccgtttttctgtcgttcgcgtttcttgcagcgatcctgactcatattggatgttcgaatcagaggagatcacctgagaattctggacgacgttataaccgtattcagcatggtcagtgcgcctacacttttatcctcccagaacatgatggaaactgcagggagagcaccaccgaccaatacaacaccaatgcactgcaacgggatgccccccacgtggaaccagacttttcgtcgcagaagctccaacacctggaacatgtgatggaaaactatactcaatggttgcagaaactggagaattacattgtcgaaaacatgaagtccgagatggcgcaaattcagcagaacgctgtgcagaatcatacggcaaccatgctcgaaattggaacctcactccttagccagaccgccgaacagactcggaaactcactgatgtcgaaacgcaggtcctcaaccaaaccagcagactggagattcaactgctcgagaactccctgagcacctacaagctggaaaagcagcttcttcaacaaaccaacgagattcttaagattcatgaaaagaactccctgctcgagcataagatactggaaatggaaggaaaacataaggaagaacttgacactttgaaggaggagaaggaaaatctgcaggggcttgtgactcgccaaacctacatcatccaagagctcgagaaacaactgaatcgcgctactactaacaactccgtgcttcagaagcagcagctggagcttatggacaccgtgcataacctcgtcaatctttgtaccaaagaaggagtgttgctgaagggaggtaagcgagaggaagaaaagcctttcagagattgtgcggatgtgtaccaagctggttttaacaagtcgggaatttacaccatatacataaacaacatgcctgaacccaaaaaggtgttttgcaatatggatgtcaatggcggcggatggaccgttatacagcatcgcgaggacggatcgcttgattttcagcgcggatggaaggaatacaagatgggtttcggaaaccctagtggagaatactggcttggaaacgagttcatttttgcaattacttcccaaagacaatacatgttgaggatcgaacttatggattgggagggtaatcgggcctactcacagtacgacagattccacataggaaatgaaaagcagaactacagactgtaccttaaaggccatacgggcactgcaggtaagcaatccagcctgatcctgcacggagcggatttctcgaccaaggatgcagataatgataactgtatgtgtaagtgcgccctgatgctgaccggtggttggtggttcgatgcatgtggtccaagcaacctgaacggtatgttctacaccgcaggacaaaaccatggaaagctcaacgggataaagtggcattactttaagggaccttcctactcacttagatcgactactatgatgattaggccattggatttt

SEQ ID NO: 32079 - DNA, 1494 bp, Artificial Sequence
  Description of Artificial Sequence: Synthetic coding sequence
atgacagtgttcctaagcttcgcctttcttgcggccatactgacccatataggctgtagcaaccagcgtagatcccccgaaaactcaggacggaggtataatcgcatccagcacggtcagtgcgcctatacatttattctgccagagcacgacggcaattgccgtgaaagtaccacagatcagtataacaccaatgctctacagagggacgctcctcatgtcgagccagacttcagctcgcagaaactgcaacatttggaacacgtaatggaaaattatacacagtggctacaaaagcttgaaaactatatcgtagaaaatatgaaatccgagatggcacagatccagcaaaatgccgtgcagaaccacacagcaactatgctcgaaatcgggacttccttgctgtcccagaccgcagaacagacgcgtaaattgacagacgtagagactcaggtactgaaccagacctccaggctggaaatccagttgttggaaaattcgctcagcacctataagctcgaaaagcagctgttgcagcagactaatgaaatactgaaaattcacgagaaaaattccttgcttgagcataagattttggagatggagggtaaacataaggaagaattggatacgttgaaggaggaaaaagaaaacctccagggtctggtcacccgccaaacatacatcatacaagagctcgagaagcagctcaatcgtgctaccactaacaactctgttttacaaaagcagcagctcgaattaatggacacagttcacaacctggtgaacctatgtaccaaggaaggtgtcctactgaagggtggaaagagggaggaagagaagccgtttcgcgactgcgcggatgtctatcaggccgggttcaacaaaagcgggatttacacgatctacatcaataatatgcctgagccaaagaaggttttttgcaatatggatgtgaatggaggcggctggacagtgattcaacacagagaagatggaagtctggactttcaacgagggtggaaggaatataaaatgggtttcggcaacccttccggcgaatactggctcgggaatgaattcatttttgcaatcacctcccaacgtcagtacatgttgcgcattgaactgatggactgggagggaaacagagcctactcccagtatgaccgattccacatcggcaacgaaaaacagaattatcgcctatatctcaaaggacacactggcaccgccggaaagcagtcctctctcatccttcatggtgcagacttttcaaccaaggacgctgacaacgacaattgtatgtgcaagtgtgcactgatgctgacagggggctggtggttcgatgcttgtggaccttctaacctcaatggcatgttctacaccgccggtcagaatcacgggaagcttaatggtataaaatggcattatttcaagggacccagttactcccttaggagtacgacaatgatgatcaggcccctggatttt

SEQ ID NO: 32080 - DNA, 1494 bp, Artificial Sequence
  Description of Artificial Sequence: Synthetic coding sequence
atgaccgtctttctcagctttgcctttctggcagcgatcctgacacacatcgggtgtagtaaccagcgtcgatcccccgaaaacagcggtcgacggtataatagaatccagcatggtcagtgcgcttacacttttatcctgcctgaacatgacggcaattgtagggagagcacgactgatcagtacaacaccaatgcactgcagagagacgcccctcatgtagaacccgattttagcagccagaagctacagcacctggaacacgtgatggaaaactatactcagtggctgcagaagctggaaaactatatcgtagagaacatgaaatcggaaatggcccagattcagcagaacgccgtgcagaaccacactgccactatgctcgagataggcacgtccctgctgtcccagacagccgagcaaacccgtaagctgacagatgtggaaacccaggtgcttaaccagacgtcccggctcgaaatacaacttcttgagaacagtctgtctacctacaagcttgaaaagcagcttctgcagcagaccaatgagattctaaagatccatgaaaagaattctctgctggagcacaagattttggagatggaggggaagcacaaggaggaattagataccctgaaggaggaaaaggaaaacttacaaggcttggtgacccggcaaacttatattattcaagagctggagaagcagctaaatagagcaaccaccaataatagtgttctgcaaaagcagcagctagagttaatggatactgtccataacttggttaacctgtgtactaaggagggggtgttgctgaaggggggtaaacgagaagaggagaagcctttccgggattgtgccgatgtgtaccaggcagggttcaacaagtccggcatttatactatttatatcaataacatgcccgaacctaaaaaggtgttttgtaatatggacgtgaatggcgggggctggacggtgattcagcatcgcgaagacggaagtcttgactttcaacgcgggtggaaggagtacaaaatggggtttggcaacccaagcggagagtattggctgggcaacgaatttatttttgccataacatctcagaggcagtacatgctcaggattgaactcatggactgggagggcaaccgtgcatactctcagtacgatcggtttcacataggcaacgagaagcagaattatcggctctacctgaaaggacacaccggcacggccggtaagcagagctcattgatattacatggtgctgatttcagcaccaaggacgccgataatgacaactgtatgtgcaagtgtgctctgatgctaacgggagggtggtggttcgacgcttgtggaccttccaacctcaacggcatgttctataccgctggacagaatcacggaaaactgaatgggatcaagtggcattactttaaagggccgagctattccctgaggagtactaccatgatgatccgcccgctggatttt

SEQ ID NO: 32081 - DNA, 1494 bp, Artificial Sequence
  Description of Artificial Sequence: Synthetic coding sequence
atgaccgtgtttctttccttcgcattcctcgccgcaattcttacgcatattggctgctcgaatcaacgccgctcacctgagaatagcggccggagatacaatagaattcaacatgggcaatgcgcatacaccttcatattgcctgaacatgatggcaactgcagggaatccactacggatcagtacaacaccaacgccctccagcgcgacgcacctcatgtggagcccgatttcagctcgcaaaagctccagcatcttgaacatgttatggagaattacacccagtggcttcagaagctcgaaaactacattgtggagaatatgaagagcgaaatggcccaaatccagcaaaacgcagtgcaaaaccataccgccaccatgttggagattgggactagcctcctttcacaaactgctgaacaaactcgcaaactcaccgatgttgagacgcaggtgttgaatcaaacttcacgactggaaatccagctgttggagaactcgctttcgacgtacaaactcgaaaaacagttgcttcaacagactaacgaaattcttaagatccacgaaaagaactccctcctggagcacaagatcctggaaatggaaggcaaacacaaggaagaactcgatactctgaaagaggagaaggagaaccttcaaggactggtgacccgacaaacgtacatcatccaggagctcgaaaagcaacttaacagagcaactactaataactcggtgctccaaaagcagcagttggagcttatggatactgtgcataatctggtcaacctctgtaccaaggaaggagtcctcctgaaaggcgggaaaagagaagaagagaaaccattccgtgattgtgcagatgtctaccaagccggctttaacaagagcgggatttacaccatatacattaacaatatgcctgagcctaagaaggtgttttgcaacatggacgtgaacggtgggggttggaccgtgatacagcaccgcgaagatggctcattggattttcaacgtggttggaaggaatacaaaatgggctttggcaatccgtcgggtgaatactggctgggaaacgagttcatttttgcaattacgtcgcagagacaatacatgttgcggatagaattgatggactgggaaggaaacagagcatattcgcagtacgatcggtttcacattggaaacgaaaagcagaactacagattgtatctgaaggggcataccggaactgcgggaaagcaatcgtcacttatactccatggagcagacttttcaaccaaggacgcagataacgataattgtatgtgtaaatgtgcacttatgctgaccgggggatggtggttcgatgcctgtgggccatccaacctcaatggaatgttttacaccgctggccaaaatcacgggaaacttaatggaatcaagtggcactacttcaagggcccctcgtactccctgagatcaactaccatgatgatacgcccactggacttt

SEQ ID NO: 32082 - DNA, 1494 bp, Artificial Sequence
  Description of Artificial Sequence: Synthetic coding sequence
atgaccgtgttcctctcctttgcctttcttgctgcaattttgactcacataggttgttcaaatcaacgaagatctccggaaaacagcggaaggcgctacaatagaattcagcatgggcagtgtgcctacacttttatcttgccagaacatgacggcaactgccgcgaatccactactgatcaatacaacaccaacgcccttcaacgtgatgcgccacatgtcgaacccgatttttcttcgcagaagctgcagcatctggaacacgtgatggagaactacacccagtggctccaaaaacttgaaaactatatcgtggaaaacatgaagtcagaaatggcgcaaattcaacagaacgccgtgcaaaaccataccgccactatgctggagatcggaacctcactcctctcccagaccgcagagcaaacccggaaacttactgatgtggaaacccaagtgcttaaccaaacgagcagactggagattcaactcttggaaaattcactttcaacttacaagctggaaaagcagcttcttcagcaaaccaatgagattttgaagattcatgagaaaaacagcctgcttgaacataagatcctcgaaatggaaggtaaacacaaagaagagcttgataccctcaaggaagagaaggagaaccttcaaggcctggtgactcggcagacttacattattcaggagctggagaagcaacttaatagagcaactactaacaacagcgtccttcagaagcaacagctggaactgatggatacggtccataatctggtgaacttgtgcactaaggaaggcgtgcttctcaagggcggtaagcgagaagaggaaaagccatttagagattgtgcagacgtgtaccaagcaggctttaacaaatccggaatttacaccatttacataaacaatatgcccgaacctaagaaggtgttctgcaatatggatgttaatggagggggttggaccgtcatccagcaccgtgaggacggatcgctcgactttcagcgaggatggaaggaatacaaaatgggttttggtaacccgtcgggagagtactggctgggaaacgaattcatctttgcaatcacgtcccaacgtcaatacatgctcaggattgagttgatggactgggaaggcaatcgagcatactctcagtacgataggtttcacataggtaatgagaagcagaattaccgcttgtatctgaaaggacacaccgggactgcaggtaagcaatcgtcgctcattcttcacggcgcggacttttcgactaaggacgcggataacgataattgtatgtgtaaatgcgcacttatgctgaccggcggatggtggttcgatgcatgtgggccctccaatctcaacggtatgttctatactgctggtcaaaaccacgggaaactgaacggaatcaaatggcactactttaagggaccttcttattcgcttcggtcgactactatgatgatccggccgttggatttc

SEQ ID NO: 32083 - DNA, 1494 bp, Artificial Sequence
  Description of Artificial Sequence: Synthetic coding sequence
atgaccgtctttctgtcattcgcctttctggccgccattttaacccatattgggtgctctaaccaacgcaggagtcctgagaattctggcaggaggtacaaccgaattcaacacggacagtgcgcatacacttttatcttgccagagcatgacggcaattgcagagagagcacaaccgatcagtacaatacgaacgcccttcagagagacgcccctcacgtcgaaccagacttcagttcacagaagctacagcatctggagcacgtgatggagaactacacccagtggctacagaagcttgaaaattacatcgtagaaaatatgaagtctgaaatggcacagatccaacaaaatgcagtgcagaatcacaccgccaccatgctcgaaataggtaccagtcttttaagccagacagccgaacaaactcgaaagctgaccgatgtagagacccaggtcctgaaccagaccagtagattagagatacagttactggagaacagcctatccacctacaaattagaaaagcagctgttgcaacaaacgaatgaaattctgaagatacacgaaaaaaactcactgctggaacacaaaatcctagagatggagggaaagcataaagaggaattggatacactgaaagaggaaaaggagaatcttcagggattggtgacgcgacagacctatataattcaggaacttgagaagcagctgaatagagccactacaaacaactctgtgctgcaaaagcaacagctcgagcttatggatacagtgcacaatcttgtgaacctctgtacaaaggaaggcgttttgctgaaagggggaaagagagaggaggaaaaacccttcagggattgtgccgacgtgtaccaagctggatttaacaagtccggcatctatacgatttacattaacaacatgccggagcccaaaaaagttttttgcaatatggacgtgaacggcggagggtggactgtgattcaacaccgagaggatgggtccctcgatttccagaggggctggaaggagtacaagatggggtttggcaacccctccggggaatactggttgggcaatgagttcatcttcgctattactagccaacgacaatacatgctcagaatcgaattaatggactgggaggggaaccgggcctactcccagtacgacagatttcatatcggaaacgagaaacagaactatcgactgtacctcaaaggacacactggcacagccgggaaacagtcgagccttattctccacggtgctgatttttccaccaaggacgcggacaacgataattgcatgtgcaagtgcgccctaatgctcactggtggctggtggtttgacgcatgtggcccatccaacctgaacgggatgttttataccgccgggcagaatcacggcaagctgaatggaatcaagtggcactatttcaaaggtcccagttacagcctcaggtcgactaccatgatgatccgaccactggatttc

SEQ ID NO: 32084 - DNA, 1494 bp, Artificial Sequence
  Description of Artificial Sequence: Synthetic coding sequence
atgactgtgtttctcagcttcgcatttctcgcagcgatccttactcatatcgggtgcagcaaccagagacgcagcccagagaactccgggagaaggtataatcgcatccagcacggccagtgcgcgtataccttcattcttcctgagcatgatggaaattgtcgcgaaagcaccaccgaccagtacaacacaaacgcactgcaaagagatgctccccacgtggaacctgacttcagctctcaaaagctgcaacacctggaacacgtgatggagaattacacccagtggctgcagaaactggagaactacattgtcgaaaatatgaagagtgagatggcacagatacagcaaaatgctgttcaaaatcataccgccacaatgctcgaaatcgggacatcgctcctctcgcagaccgctgagcagacccgcaagctgaccgacgtggagacccaggtgctgaatcagacatcaaggctagagatccagttgctcgagaatagtttgtccacgtataaactcgaaaagcagctgctgcaacaaaccaatgagatactcaagatacatgaaaagaattccctcctagagcacaagatcctggaaatggaaggaaaacacaaggaagagctggataccctgaaggaggagaaagaaaaccttcagggtttggtcactcggcagacatacattatacaggagctggagaagcagctcaacagggcgacaaccaacaacagtgtgttgcagaagcaacagctggaacttatggacaccgttcacaatcttgtaaacctgtgcacgaaggagggggtgctgctaaagggaggtaagcgtgaggaagagaaaccgttccgggactgtgcagatgtgtaccaagccggctttaacaagagtggcatttacacaatttacataaacaatatgcccgaacccaaaaaggtcttctgcaacatggacgtcaacggaggaggttggaccgttatccagcacagggaggatggcagccttgattttcagcgtggttggaaagaatataagatgggattcgggaacccgtcgggggagtactggctggggaatgaatttatattcgcaatcacgtcacaaaggcagtacatgctgagaattgaactgatggactgggaggggaatcgtgcttactcacagtatgacaggttccacattggcaatgagaagcaaaactaccgcttgtatctgaaaggacataccggaacggcggggaaacagtcaagtctgatattacatggcgccgacttcagcaccaaggatgcggacaatgacaactgtatgtgcaaatgtgccctcatgttaacaggcggttggtggtttgatgcctgcgggcctagcaacctcaatgggatgttctatacggccggacaaaaccacggcaaactcaatggaattaagtggcattacttcaaggggccctcctacagtctccgatcgaccaccatgatgatcagaccgttagacttt

SEQ ID NO: 32085 - DNA, 1494 bp, Artificial Sequence
  Description of Artificial Sequence: Synthetic coding sequence
atgaccgtttttctgtctttcgccttcctggctgccattcttactcatataggttgctctaaccagcgaaggtctcctgagaattctggaagaagatataaccgtattcaacatggccagtgtgcttataccttcattctgccagaacacgatggtaactgccgtgaaagcaccacagaccagtataacacaaacgcactgcagcgcgacgcccctcatgttgagccagacttctcctctcagaaactccagcacctggagcatgtcatggaaaactatactcagtggctgcagaagctggaaaattacatagtcgaaaatatgaaaagtgagatggcccagatccagcagaatgccgtgcagaaccatactgcaaccatgctagagatcggcacttccctgctgtctcagactgccgagcagactaggaaacttactgatgtggagacccaggtcttgaatcagaccagccgcctggagatccagcttctcgaaaacagtttaagcacatacaagctggagaagcagctgctccagcagaccaatgaaatactgaaaattcacgagaaaaatagtctcctggaacacaagatcctggagatggaaggtaagcataaagaggaactggataccctgaaggaagaaaaggaaaacctgcagggtctggtaacccggcaaacttatattattcaggagctggagaagcagctcaatagagccacaactaataactctgtgctacagaaacaacagcttgaactcatggataccgtgcataatctagtgaacctgtgcacaaaagagggcgtgctgctgaaaggaggaaaacgcgaagaagagaagcctttcagagactgtgccgatgtctaccaagctggatttaataaatcaggtatttacaccatctatatcaataatatgcctgaacccaagaaggttttttgcaacatggatgtgaacggcggcggctggaccgtgatccaacacagggaagacggcagcctcgatttccagcgcggctggaaggaatacaagatggggtttggtaatcccagcggagaatattggctcggaaatgaattcatattcgctattacttcccaaaggcagtatatgttaagaatcgaattaatggactgggagggcaatagagcttacagccagtatgacagatttcatattgggaatgaaaaacaaaactatcgactgtatctgaagggccacactggcaccgctggcaagcagagtagcctaattttgcatggggcagatttctctacaaaagacgcagacaatgacaactgtatgtgtaagtgcgccctgatgctgacagggggatggtggttcgacgcatgcggcccctcaaatctgaacggcatgttctatacagccggacagaaccatggcaaattaaacggcattaagtggcactactttaaagggccctcttatagcctgagatcaaccacaatgatgatcaggcctctagacttc

SEQ ID NO: 32086 - DNA, 1494 bp, Artificial Sequence
  Description of Artificial Sequence: Synthetic coding sequence
atgactgtgttcctgtccttcgctttcctcgcagcaattttaactcacataggctgttccaaccagagaaggagtccagaaaactccggacgaagatacaacaggatacagcatgggcagtgtgcttacacttttatcttgcccgaacatgatggtaattgtagggagtctacgacggatcaatacaatacaaatgccctgcagagagacgccccccacgtggagcctgacttcagttctcagaaacttcagcaccttgaacatgtgatggagaactatacgcagtggctgcaaaagttggaaaactacattgtcgagaacatgaagagcgaaatggcgcaaattcaacaaaacgcagtgcagaatcacactgctacgatgttggaaattggcacttcattactcagtcagactgccgaacagacgaggaagcttacagatgtggaaacgcaggttctcaatcagacctctcggcttgagattcagctgctcgagaattcccttagtacgtataagctggaaaagcagctccttcagcagacaaacgagattctgaagattcacgagaagaactccttgttggagcacaaaatccttgagatggagggaaagcacaaagaggagctggacacactgaaggaggagaaggagaatctgcaggggcttgtgacacgacagacatacattatccaggaacttgaaaagcagctgaatcgagctactacaaataattccgtgctacagaagcagcaactggaactcatggacactgtgcacaacttggtgaacctgtgtacgaaggaaggcgtccttttaaagggaggcaaaagagaagaggagaagccttttcgcgactgtgcagatgtatatcaggcaggctttaacaaatccggcatttacacgatctatatcaataacatgccagaacctaagaaggtgttctgcaacatggatgtcaacggcggcggctggacggttattcagcaccgggaggacggttctctcgactttcagcgcggatggaaggaatataagatgggctttggcaatcctagcggcgagtattggttgggtaacgagtttatatttgcaatcacgagccagcgtcagtacatgcttcgcatcgagctgatggactgggaagggaacagggcatatagccagtacgatcggttccacatcgggaatgaaaaacagaactacaggctgtatctcaagggacacacagggactgcaggcaagcagagttccctgatcctgcatggtgctgacttctcaaccaaggacgcggacaatgacaactgcatgtgtaagtgcgctttgatgctcacggggggctggtggttcgacgcctgtgggcctagtaacttgaacggaatgttctacaccgcaggtcagaatcacggtaaactgaacggcattaagtggcactattttaagggcccaagctattcacttcgatctactaccatgatgatcaggccactcgatttc

SEQ ID NO: 32087 - DNA, 1494 bp, Artificial Sequence
  Description of Artificial Sequence: Synthetic coding sequence
atgacggtcttcttgtcctttgccttcctcgctgcgatccttactcacattggttgctctaaccaaaggcgctcacccgagaacagtggccggcgctacaaccgcattcagcatggtcaatgcgcttacaccttcatcctaccagagcacgacggcaattgccgtgaatccaccactgaccagtataataccaacgcattgcagcgtgatgcccctcacgtggagccagactttagttcgcagaaactgcaacacctggagcacgtgatggaaaattacactcagtggttgcagaagttggagaactacattgttgagaacatgaagagtgagatggcccagattcaacagaacgcagtccagaaccacaccgctacgatgctggaaattggcactagtctgctttcccagacagctgagcagacaaggaagctgaccgacgtcgagacacaggtccttaaccagacctccaggctcgaaatccagctcctggaaaattctctgagtacctacaagcttgagaagcaactcctacagcagacaaacgagatcctcaagatccatgaaaagaattcacttttggagcataagatcctcgagatggaaggtaagcacaaggaggaactcgacacgctcaaggaagagaaggagaacctgcagggtctggttacaaggcaaacctacatcattcaggagctcgagaagcagctgaaccgagcaacaactaacaactcggtgcttcagaagcagcaactggaactgatggataccgtccataacttggttaacctttgcactaaggagggagtattgctgaagggtgggaagagagaagaggagaaaccattccgggactgtgccgacgtctatcaggcaggcttcaacaagagtggcatatacaccatctacatcaataacatgcccgaaccaaagaaggtcttctgcaatatggatgtgaatggcggcggctggaccgttattcagcaccgcgaggacggaagtctcgatttccagcggggatggaaggagtacaagatgggcttcggtaacccgtcgggcgagtactggctcggaaacgaatttatattcgccataacatcgcaaagacagtacatgctgaggatcgagttgatggattgggagggcaacagggcttatagccagtatgaccgatttcacattggtaacgaaaagcaaaactaccgtctgtatctgaaggggcacaccggcaccgctggcaagcaatcctcgcttattttacacggtgctgacttcagtaccaaagacgctgataatgacaactgcatgtgcaagtgcgccctcatgctcacaggtggatggtggttcgatgcctgcggcccaagtaaccttaacggtatgttctacacagcgggtcagaaccatggcaaacttaacggtatcaagtggcactatttcaaaggtcccagctactctcttcgttctaccactatgatgatccgccctctggacttc

SEQ ID NO: 32088 - DNA, 1494 bp, Artificial Sequence
  Description of Artificial Sequence: Synthetic coding sequence
atgacagtgtttctatcatttgcctttcttgcagccattctgacacacatcgggtgcagcaaccagaggcggtcacctgaaaactctggcagaagatacaatagaattcagcacggtcagtgtgcctacactttcattctgcccgagcacgacggaaactgtagagagtcgacaaccgatcagtataatacaaatgcccttcaacgggatgctccgcatgtggagcctgacttctcaagtcagaaactgcagcatctagagcacgttatggagaactacacccagtggttgcagaagctggagaactatattgttgagaacatgaagtccgagatggcccaaatacagcaaaacgccgttcagaatcacacggccaccatgcttgaaattggaacttctctcttgagtcagaccgcggagcagaccagaaagcttacagacgtcgagacccaggttcttaaccaaactagccgactggagatacagcttctggaaaattcattgagcacatataagctggaaaagcagctgctacagcagacaaacgaaatcctgaaaatccacgaaaagaactctctgctggaacataagattctggaaatggaagggaaacataaggaagaacttgacactttgaaagaagaaaaggaaaaccttcagggcctcgtgactcgacagacatacatcattcaagagctggaaaagcagctgaaccgggccaccacaaataactccgtgcttcagaaacaacaactggagcttatggacactgtacataaccttgtcaatctctgcaccaaggagggagtgttgctgaagggtggtaagcgcgaggaggaaaagccattcagagattgcgccgacgtttaccaggccggtttcaacaagagcgggatctacacgatctatattaacaacatgcccgagccaaaaaaggtgttctgcaatatggatgtgaacggtggcggctggaccgtgattcaacaccgagaggacggatcactggactttcaaaggggttggaaggagtacaagatggggttcggaaacccctccggggagtactggctggggaatgagttcatttttgccattacttctcaaaggcagtacatgctgagaattgagcttatggattgggaaggaaatagggcctacagccagtacgatagatttcacattggcaacgaaaagcagaactacaggctgtatctcaaggggcacaccggcacagccggaaagcaaagtagtctgattcttcacggagcagacttttctaccaaagacgccgataatgacaactgcatgtgtaagtgcgctctgatgttgactgggggatggtggttcgacgcctgcgggccctccaacctgaacggtatgttctatacggcgggacaaaaccacggaaagttgaacggcataaagtggcattacttcaaaggcccctcatattctctgcgtagtacaacaatgatgattaggccacttgatttt

SEQ ID NO: 32089 - DNA, 1494 bp, Artificial Sequence
  Description of Artificial Sequence: Synthetic coding sequence
atgactgtctttctgtcgtttgcgtttttggccgcaattcttacgcatatcggatgtagcaatcagcgcaggagccctgaaaactccggccggcggtacaacaggatccaacatggacaatgtgcctatacctttattctccctgagcatgacggtaattgtcgcgaatccaccaccgatcaatacaacacgaacgcgcttcagcgcgacgcaccccatgtggaaccggatttcagctcccagaagctccagcatcttgaacatgtgatggaaaactatactcagtggctgcaaaaactcgagaactacattgtcgagaatatgaagtccgagatggcgcaaattcagcagaacgcagttcaaaatcatactgcaacgatgcttgagattgggacttccctgctctcgcagacggccgagcaaacccggaaacttactgatgtcgaaacccaggtgctcaaccagacttctaggctcgaaattcagctgcttgagaattccctctcgacctataagctcgaaaagcagcttctccaacagaccaacgaaatcctgaagattcacgagaagaattcgctgctggaacataagattctggagatggagggcaagcacaaggaagaactggacaccctgaaagaagaaaaggaaaaccttcagggtctggtgactcggcaaacctacataatccaggagcttgaaaagcaactgaacagagcaactaccaataactcggtcctccaaaagcaacagcttgaacttatggacaccgtccataatcttgtgaacctgtgcaccaaagaaggcgtgctgcttaaaggaggcaagagagaggaagaaaagccattccgagattgtgctgacgtgtaccaagcaggatttaacaaatccgggatttacaccatctacatcaataacatgcctgagcctaagaaggtgttttgtaacatggacgttaacggaggtggttggactgtgattcaacatcgggaggacggatcgctggacttccaaagaggctggaaggaatacaagatgggatttggaaatccctcgggagaatactggcttggtaacgagtttatcttcgctataaccagccagcggcagtacatgctcaggatcgagcttatggattgggagggaaacagagcatacagccaatacgaccgcttccatatcggaaacgaaaagcagaactacaggctgtacttgaagggtcacaccgggacggcaggaaagcaaagctcattgattcttcatggtgcagacttctccaccaaggacgctgataatgataactgtatgtgtaaatgcgcccttatgcttactggtggttggtggtttgatgcctgtggtccgtcgaatctcaacgggatgttctacaccgccggacagaatcatggcaagttgaacggaatcaaatggcactacttcaaaggacctagctactcactgagatccaccaccatgatgattcgaccacttgatttt

SEQ ID NO: 32090 - DNA, 1494 bp, Artificial Sequence
  Description of Artificial Sequence: Synthetic coding sequence
atgaccgtgtttctctcgttcgcatttctggcggccatcctcacccacatcggatgctccaaccagaggcgctcgccggaaaacagcgggagaaggtacaaccggatccaacacggccagtgcgcttacactttcatccttccggaacatgacggaaactgccgggagtcgaccaccgaccagtacaacactaacgcactgcaaagagatgccccacacgtcgaacctgatttttcatcccagaaactccagcacctggaacacgtcatggagaattacacccaatggctgcagaaactcgaaaactacatcgtggagaatatgaagtcagagatggctcagatccagcaaaacgcggtgcaaaatcacactgcgaccatgttggaaatcggaaccagcttgctgtcccagacggccgaacagactaggaagctcaccgatgtcgagacgcaggtcctcaaccagacgtcacgcctcgaaatccagctcctggaaaactctctgtcgacttacaagctcgagaaacaactgcttcaacagaccaacgagatactgaagattcatgaaaagaactctctgcttgagcacaaaatcctcgagatggagggtaagcataaagaggaactcgacacgctgaaggaggaaaaagaaaatctgcaaggactcgtgactcgccagacgtacattattcaggaactggaaaagcagctgaaccgcgcgaccaccaacaattccgtcctgcagaagcagcagctcgagctcatggatactgtgcataacctcgtcaatctgtgcactaaagagggggtccttcttaagggcggaaagagggaagaagagaaaccattccgcgactgtgcggatgtgtatcaagccggtttcaacaagtcgggaatctacaccatctatatcaacaatatgcctgaacctaaaaaggtgttctgcaatatggacgtgaacggtggagggtggactgtgatccaacacagagaggacggttcgctcgattttcagcggggctggaaggagtacaagatgggattcggcaaccctagcggagagtactggctcggtaatgaattcatcttcgccatcacctcgcagaggcaatacatgctgagaattgaactgatggattgggagggcaaccgcgcatattcacaatacgacaggttccacatcggaaacgaaaaacagaactaccggctctacctgaagggtcacactggtactgcgggaaagcagagcagcctgatcttgcacggagctgatttctccactaaggacgccgacaatgataactgcatgtgtaagtgcgcactcatgctcaccggcggatggtggtttgacgcgtgcggtcctagcaacctgaacgggatgttctacactgcaggacaaaaccatggcaagctgaatggaatcaagtggcattactttaaaggacctagctacagcctccggtccactaccatgatgattcgcccgctcgacttt

SEQ ID NO: 32091 - DNA, 1494 bp, Artificial Sequence
  Description of Artificial Sequence: Synthetic coding sequence
atgaccgtctttctgtcgtttgcgtttctggcagcgatcttgactcatatcggctgttcaaaccagcgtcgatctcctgagaattcgggaagaaggtacaatcgtattcaacatggtcagtgtgcatacacctttatactgccggaacacgatggtaactgcagggagtccaccaccgatcagtacaataccaacgccctgcaacgtgatgcgccccatgtcgagcccgatttctcaagccaaaaactgcagcaccttgaacacgtgatggagaactacacccaatggctgcaaaagctcgagaattacatcgtggaaaacatgaagagcgaaatggcacaaatacaacaaaatgcagtccagaaccacactgccaccatgcttgaaataggaacctcgctgctgtcgcagaccgcagaacagacccggaagctgaccgacgtggaaacccaagtgctgaaccaaactagcagattggaaattcagcttctggagaactcgctgtctacttacaaactggaaaaacaactgcttcagcagaccaacgagatcctgaagattcatgagaagaatagccttctcgaacacaagattctcgaaatggaaggtaaacacaaggaagagttggacactttgaaggaagagaaggaaaacttgcagggactcgtcactagacagacctacattatacaagaactggaaaagcaactcaaccgcgcaaccactaacaactcagtgctccaaaagcaacagctggaactgatggatactgtccataatcttgtgaatctgtgtactaaggaaggagtgctcctcaagggaggcaagagggaggaggaaaagccatttcgcgattgtgcagatgtgtaccaggccgggtttaacaaatcgggcatctacactatttacataaacaacatgccagagcctaaaaaggtcttttgtaatatggatgtcaacgggggtgggtggactgtgattcaacacagagaggatggatccctcgatttccagcgaggttggaaggaatacaagatggggttcggaaacccctccggagagtactggctggggaatgagttcattttcgctattacgtcccaacggcaatacatgctgagaatcgaactgatggactgggagggtaacagagcatactcacaatacgaccgatttcatatcggtaacgaaaagcaaaactaccggctctacttgaaaggtcatactggtaccgcggggaagcaatcctccctgatacttcacggggcagattttagcaccaaagatgcagataacgataattgtatgtgtaagtgtgcccttatgcttactggcggttggtggtttgatgcatgtgggccaagtaacctgaacggcatgttctacaccgcaggccaaaatcatggtaaacttaacggtattaagtggcattactttaagggtccttcgtactccctccgatcgaccactatgatgatccggcccttggacttt

SEQ ID NO: 32092 - DNA, 1494 bp, Artificial Sequence
  Description of Artificial Sequence: Synthetic coding sequence
atgaccgtattcctgagctttgccttccttgctgccattctcacccatatcgggtgttcgaatcagcgccggtcacctgaaaattccggacgccgctacaataggatccagcacggacagtgtgcttacactttcatcctgcccgaacacgatggcaactgtcgggaatctactacggaccagtataacactaatgcactccaacgcgacgccccgcatgtggagccggacttcagcagccagaagctgcagcatttggaacatgtcatggaaaactacacgcagtggctgcagaaacttgaaaactacatcgtggaaaacatgaaatccgaaatggcgcaaatccaacagaatgcggtgcaaaaccatactgcaaccatgttggaaatcggaaccagcctgctttcgcagacggctgaacagactcgcaagttgactgacgttgagacgcaggtgctcaatcagaccagccgcctcgagatccagctgctcgagaactcgctgtcgacttacaagttggaaaagcagctgctgcaacaaaccaatgagatcctcaagatccatgaaaagaattcgctgctggaacataagatcctggagatggaaggcaagcataaggaagaactggacaccctgaaggaggagaaagagaacctgcaaggcctggtgaccagacagacttacatcattcaggaattggaaaaacagctgaacagggctaccacgaataactcggtgctccaaaaacagcaactggagctgatggatactgtgcataatctcgtgaacctctgtactaaggaaggcgtcctgcttaagggcggtaaaagagaggaagaaaagcccttccgggattgcgccgatgtgtaccaggcgggattcaacaagtcaggaatctacaccatctatatcaataacatgccggaaccaaaaaaggtcttttgtaacatggatgtcaacggaggaggatggactgtcattcagcacagagaggacggctcgctggacttccagaggggttggaaggagtacaaaatgggctttggaaacccttcgggagagtactggctcggcaacgagtttatctttgccatcacttcgcagcgccaatacatgctgagaatcgaattgatggactgggaggggaacagggcttacagccaatacgatcggttccatattgggaacgaaaagcagaattaccgcctgtacctgaagggacacacgggaactgccgggaagcagtccagccttatcctccacggagcggacttttcaaccaaggatgcggacaatgacaactgcatgtgcaagtgcgcgttgatgctgaccggaggatggtggttcgatgcctgtggtccgagcaacctgaacgggatgttttacaccgcaggccagaaccacggaaagctgaacggcatcaagtggcactacttcaagggacctagctactcgttgcgctccacgaccatgatgatcaggccactcgatttc

SEQ ID NO: 32093 - DNA, 783 bp, Artificial Sequence
  Description of Artificial Sequence: Synthetic coding sequence
atggagaaagtgcgccgcgaaggtgtgaaggtcatgccgaacgccatagtgcagagcgttggagtgagtagtggaaaattgctaatcaagctgaaggacggcaggaaggtggagacagaccacattgttgcagccgttggactggagccaaacgttgaactcgcaaagactggaggattagaaattgactctgattttggtggtttccgggttaatgctgaactccaggcaagatcaaatatttgggtggccggagacgccgcatgtttctacgatattaaactcggccggagacgggtcgagcaccacgatcacgccgtggtgtccgggcgcttggctggcgaaaatatgacaggcgctgcgaagccctactggcaccagtcgatgttttggagcgacctgggacctgacgttggctacgaagccataggactcgtggattcaagcctgccaacagtgggagtattcgccaaggctacagctcaggataatcctaaaagtgccactgagcaaagtggcacgggcatccggtctgagagtgaaaccgaatctgaagcctccgagatcactatccccccttccacgccggctgtacctcaggcacctgtacagggcgaagactatggtaagggggtgatattttacttgagagacaaagtggttgtggggatcgtcctctggaacatctttaatcggatgccaatagcgagaaagatcataaaggacggggagcagcacgaagaccttaatgaggtcgccaaactattcaatatccatgaggac

SEQ ID NO: 32094 - DNA, 783 bp, Artificial Sequence
  Description of Artificial Sequence: Synthetic coding sequence
atggagaaggtgcggcgggagggggttaaggtaatgcccaacgctattgtacagagcgttggtgtatcgtcaggaaagctcctgattaagttgaaagacggccgtaaggtggagacagaccacatcgttgctgctgtgggccttgagccgaacgttgaattagccaaaacaggggggctcgagattgatagcgactttggcgggttccgcgtgaacgctgaattacaggccaggagtaatatatgggtggccggagatgcggcatgcttctatgacataaaactgggtagaagacgcgtggaacatcatgatcatgccgtggttagcggccgcttagccggcgaaaatatgacgggcgcagccaagccttactggcaccagagtatgttctggtcagatctgggacccgatgtcggctacgaggcaattgggttagtagacagctccttgcccactgtcggagtgtttgccaaggctactgcccaggataatcccaaaagcgctacggagcagtcgggtactggtatcaggtcagagagcgaaacagagagcgaagcaagcgaaattacaatcccccccagtacacccgctgtcccccaggcgcctgttcagggagaggactacggaaagggcgtgattttctatctgagggacaaagtggtggtcgggatcgttctctggaacattttcaaccgcatgcccatagccaggaagattattaaagatggcgagcagcacgaggacttaaatgaagtggctaaactatttaacatacacgaggac

SEQ ID NO: 32095 - DNA, 783 bp, Artificial Sequence
  Description of Artificial Sequence: Synthetic coding sequence
atggagaaggtcagacgtgagggcgtaaaggtgatgccgaacgccattgtgcagagtgtaggcgtatcgtctggaaagctcctgattaaactgaaggacggacggaaggtggagacagaccacattgtagcggcagtcggacttgagcctaatgtggaactggctaaaacagggggcctcgagatagactctgattttggggggtttagggtaaatgctgagctgcaggcccgatccaatatttgggtggcaggtgatgcagcttgcttctatgatatcaagctgggtcgacgaagagttgagcatcacgatcacgcagtggtaagcggcaggttggccggtgagaacatgaccggagcagcgaaaccgtactggcatcagagtatgttttggagcgacctggggcccgacgtaggatacgaggccataggtcttgtcgactcctctctccctaccgtgggcgtcttcgcaaaggctaccgcccaggataaccccaaatccgccacagaacaatcagggaccggaatacgctccgagtccgaaactgaaagtgaggccagcgaaattactattcccccttctactccagctgtcccccaagcccccgtgcagggtgaggattatggaaaaggcgtcattttctatctgcgtgataaagtggtcgttggtatagttctctggaacatttttaaccgcatgccgatcgcgcgcaagatcatcaaggatggcgagcaacatgaagatcttaacgaagtagctaagttattcaatatacatgaggat

SEQ ID NO: 32096 - DNA, 783 bp, Artificial Sequence
  Description of Artificial Sequence: Synthetic coding sequence
atggagaaagtgcggcgagaaggggtgaaggtaatgccaaatgccatagtgcagtccgtgggcgtgtcctccggaaagcttctcattaagttgaaggacggcaggaaagtggaaaccgaccacatcgtggccgctgtgggcctcgaaccgaatgtcgagttggccaaaactgggggccttgaaattgacagtgatttcggcggctttcgcgtgaacgcggagctgcaggcgcgctctaacatctgggtggccggcgatgccgcatgtttttacgatatcaaacttgggcgcaggcgcgttgagcaccacgatcacgctgtcgtcagtggtcggttggccggcgaaaatatgactggcgccgccaagccctactggcatcagtctatgttctggtctgatctcggacccgacgtgggatacgaagctatcggtttggtggattcatcacttccgacagtgggcgtgtttgcgaaggcaacagcacaagacaaccctaagagtgccacggagcagtctggtacaggcattcggtccgaatcagagactgagtctgaggcatccgagatcactatacctccgagcaccccagccgtcccacaggcccctgtccagggagaggattatggaaagggcgtgatcttttatcttcgcgacaaggtggtagtggggatcgtcttgtggaacatttttaaccgaatgcccatagcaagaaagatcataaaagacggggagcaacatgaagatcttaacgaagttgcgaagctctttaatatacatgaagac

SEQ ID NO: 32097 - DNA, 783 bp, Artificial Sequence
  Description of Artificial Sequence: Synthetic coding sequence
atggaaaaggtgcgacgcgaaggagttaaggtgatgcctaacgcaattgtgcaatcggtgggagtgtcctcaggcaaactgctgattaagctgaaggatgggagaaaggtcgaaacggatcacattgtggcagcagtcgggctcgagcctaacgtggagctggcaaagactggaggcctggaaattgattccgacttcggagggtttagagtgaatgcggaactgcaagccaggtcgaacatttgggtcgcaggtgatgcagcctgcttctacgacataaaactgggacgtcgtcgggtggagcatcacgatcatgcagtggtgtccggtagacttgctggtgagaatatgactggcgcggcgaagccatactggcatcaatccatgttttggtcagacctgggacccgacgtgggctacgaagctattggactggtggattcttctcttcccacggtgggagtctttgccaaggctactgcacaagataatccaaagtcagcaactgaacagtcggggaccggcattcgctcggagagcgagacggagtcggaagcatccgaaattactataccaccttcaactcccgcagtgcctcaagcccccgtccagggtgaagattatggtaagggggtgattttctatttgcgggataaagtggtggtgggcatcgtgctctggaacatctttaacaggatgcctatcgcccgcaaaatcattaaggatggcgaacagcatgaggatctgaatgaagtggccaagttgttcaacattcatgaggat

SEQ ID NO: 32098 - DNA, 783 bp, Artificial Sequence
  Description of Artificial Sequence: Synthetic coding sequence
atggagaaagtgcgtagagagggtgttaaggtaatgccaaacgccattgtacagtccgttggagtgtcgtcaggaaaactgttaatcaaacttaaagatggacgtaaagtcgagacggatcatattgtagctgcagttggtctagaacctaatgttgaattagcaaagaccggtggcctggaaattgattctgactttggagggttcagagtgaacgcggagttacaggcccgcagcaatatttgggtcgcaggtgacgcggcttgcttttacgatattaaattgggccggaggagggtggaacaccatgatcatgcagtcgtcagcggacgtctcgcaggggaaaatatgacaggagccgctaagccatattggcatcaatcaatgttttggagtgatcttggacctgacgtcggatatgaagcaataggactagtggactcgtcgcttccaacagttggagtctttgctaaagcgacagcgcaagataatccaaagtccgctacagagcaatcaggaaccggaatacgatcagagagtgaaactgagagcgaagcatctgaaatcacaattcctccatcgacgccagcggttccacaggctccagtccagggagaggactacggaaaaggcgtaattttctacttgcgtgataaagtggttgtgggaatcgttctttggaacattttcaacagaatgccaatcgcgcgtaaaatcataaaagatggagagcaacatgaagacctcaatgaggttgcaaaattatttaatatacatgaggac

SEQ ID NO: 32099 - DNA, 783 bp, Artificial Sequence
  Description of Artificial Sequence: Synthetic coding sequence
atggagaaggtgaggagggagggggtcaaagtgatgccaaatgcaatcgtgcagagcgtgggcgttagttcaggtaaactgctgattaaactgaaagacggtcgcaaagtcgagactgatcacatcgtggcagcagtcggactggagccgaatgtggaactggccaagaccggtggtttggagatcgatagtgatttcggtggtttccgtgtgaacgcggagctgcaggctcgttccaatatttgggttgctggtgatgcagcttgtttctatgacattaaactgggacgccgccgcgtggagcaccacgaccatgcagtggtgagcggacggctggccggcgagaacatgacgggtgcggcgaaaccttactggcaccagagtatgttttggtcggatctgggtccagacgtcggctacgaagcgattggtctggtggactcctctctgccgactgttggcgtctttgcaaaagctactgcccaagacaaccccaagagcgcgacagagcaatccggcaccggtattcgttccgagtcagaaaccgaaagcgaagcaagcgaaattaccatcccaccttccacgccagcggtgccgcaagcccccgtgcagggtgaggactatggtaaaggggttattttctatttgcgcgataaagttgtcgttgggattgtgctgtggaatattttcaaccgcatgccgatagcgcgtaaaatcattaaagacggtgagcaacacgaagatctgaatgaagtggcaaagctgtttaacattcatgaagat

SEQ ID NO: 32100 - DNA, 783 bp, Artificial Sequence
  Description of Artificial Sequence: Synthetic coding sequence
atggaaaaagtcagaagggaaggtgtgaaggtcatgcctaacgcaatcgtccagtcagtgggtgtcagctcgggcaaacttctgatcaaattgaaggatggtcggaaggtagaaactgatcacatagtggcagcggtgggattggaacccaatgtcgagctggcaaagactggcggtcttgagatcgatagcgactttggaggttttcgagtgaatgcagaactgcaagcacggtccaacatttgggttgcgggagacgccgcatgcttttacgatatcaagctcggacgtcgtcgtgtggaacatcatgatcacgccgtggtgtccggcagacttgccggggagaatatgactggcgcagcaaagccttattggcaccaaagcatgttttggtcggatcttggtccggacgtgggctacgaagctattggcctggtggattcatccctcccaacggtcggggtgttcgcaaaggcaactgcacaggataatcctaagtcagccactgaacaatcgggtaccgggatccgttcggaatcggaaaccgaatccgaagcctcagaaattactattcccccatcaactccagcagtgccacaagccccagtccagggagaagattacggcaagggggttatcttttacctgcgcgataaagtcgttgtggggatcgtgctttggaacattttcaatcgtatgcctattgcgagaaagatcataaaggacggagagcagcatgaggacctcaacgaagtggcaaaactcttcaacattcacgaagat

SEQ ID NO: 32101 - DNA, 783 bp, Artificial Sequence
  Description of Artificial Sequence: Synthetic coding sequence
atggagaaggtgaggcgagagggcgtgaaagtgatgccgaatgcaattgttcagagtgttggcgtgtcttctggaaaactccttattaaacttaaggacggaaggaaagttgagaccgatcatatcgttgctgcagtgggcttggagcccaatgtggagttggcaaaaacaggggggctcgaaatcgacagcgatttcgggggcttccgggtcaacgccgagttgcaggcaagatcgaacatttgggttgccggcgacgctgcctgtttctacgatataaaacttggacgccgaagggtcgaacaccacgatcatgctgttgtgtctggacgcctggctggagaaaacatgactggggctgcaaaaccttactggcaccaatcaatgttttggtcagacttgggacccgatgtgggctacgaagctattggcctagtcgactcctcgctgccaactgtaggagtgttcgccaaggcaaccgcccaggacaaccctaagtcagcgaccgagcagagtgggacaggaatccggtcagaatcagaaaccgagtctgaggcatccgagatcaccattccccctagcacacccgcagtgccacaagcacccgtccagggagaggattacggcaagggcgttatcttttatctgcgggacaaggtggttgtggggattgtcctgtggaatatctttaaccggatgccaattgctaggaagatcatcaaggatggtgaacagcatgaagacctcaacgaggtagccaaacttttcaatatccatgaagac

SEQ ID NO: 32102 - DNA, 783 bp, Artificial Sequence
  Description of Artificial Sequence: Synthetic coding sequence
atggaaaaggtgagaagggagggagtcaaggtgatgccgaatgccatcgtgcaatctgtgggcgtctcaagcggcaagctgctgattaagctgaaggatggtcgaaaggtggaaaccgaccatattgtagccgctgtgggactggaacctaacgtcgagcttgcgaaaacgggtggacttgagatcgatagcgattttgggggattcagggtgaatgcagaattgcaagcacgcagcaacatctgggtagcgggcgatgctgcttgtttttacgatatcaagctcgggagaaggcgcgttgagcatcacgaccacgctgtggtttcaggaagattggctggagaaaacatgactggcgcagcaaagccatattggcaccaatcgatgttttggagcgatcttggacccgacgtgggttacgaggcaattggtctggtggactcctcgcttccaaccgtcggtgtgtttgcaaaagcaaccgcccaagacaatcccaagagcgctactgaacagtccggtactgggattaggtccgagtcggaaaccgagtcagaggcctcagaaattacgattccaccttccacgcctgcagttcctcaagcgcccgtccagggggaagattacggaaaaggggtgatcttctaccttcgtgacaaagtcgtggtgggaatcgtcctttggaacatctttaatcgtatgcccattgcgagaaagattatcaaggatggagaacagcatgaggaccttaacgaagttgcaaagctgttcaacatccatgaagat

SEQ ID NO: 32103 - DNA, 783 bp, Artificial Sequence
  Description of Artificial Sequence: Synthetic coding sequence
atggagaaggtccgccgcgagggcgtcaaggtgatgcctaacgcgattgtccagtccgtcggcgtctcatccggtaagctcctgattaagctgaaggacggccgcaaggttgagacggaccatatcgtcgccgctgtcggcttggagcccaacgtcgagctggcgaagacgggcggcctggagatcgacagtgatttcggcggcttccgtgtaaacgccgagctccaggcccgctccaacatctgggtcgccggcgacgccgcctgcttctatgatattaagctgggtcgccggcgggtcgagcaccacgatcacgccgttgtatccggccgtctggcaggtgaaaatatgactggcgcggctaagccatactggcatcagtctatgttctggtccgatctggggccggacgtagggtacgaagcaatcgggctggtcgacagctctttacccaccgtcggcgtctttgcaaaggctaccgcccaggacaaccccaaaagcgctaccgagcagtcgggcaccggcatccgctccgagagcgagacagagtctgaggcgtccgagattaccattccaccttctacccctgcggttcctcaggcgccggttcaaggggaggactacggcaagggcgttatcttctatttgagggacaaagttgtcgttggaattgttctgtggaacatctttaatagaatgcctatcgcccgcaagattataaaggatggcgagcagcacgaggatctcaatgaagtcgcgaagttgttcaacatccatgaagac

SEQ ID NO: 32104 - DNA, 783 bp, Artificial Sequence
  Description of Artificial Sequence: Synthetic coding sequence
atggagaaggtgcgtcgcgagggcgtcaaggtaatgccaaacgccatagtccagtccgtcggcgtaagcagcggaaaattgttgataaaattgaaggacggaagaaaagtcgagactgaccacattgtggccgctgttggtctggagcctaatgtcgaactggcaaaaactggtggactggagattgactctgacttcggaggctttagggtaaacgctgaactgcaggctcgcagcaacatctgggtagccggcgacgcagcatgcttttatgacatcaagctgggccgcaggcgcgtggaacaccatgaccacgctgttgtgtccggccgcctggcaggtgagaatatgaccggagccgctaagccatactggcaccagtcaatgttctggagcgacctgggccccgacgtcggttacgaagcaatcggtcttgtggattccagcttgccaactgtaggagtctttgctaaagctaccgcccaggacaaccctaagtctgccaccgagcagagtggtacaggcattaggagtgaaagtgagaccgagtctgaagcttctgagataaccattccaccttctactcctgcagtgcctcaagctcctgtgcaaggtgaggactacggaaaaggtgtcatcttctacttgagagataaagtcgtcgtgggaatcgtcttgtggaacatatttaacaggatgcccatagccagaaagatcataaaggacggagaacaacatgaagatctcaatgaggtcgcaaaattgttcaacatccatgaggat

SEQ ID NO: 32105 - DNA, 783 bp, Artificial Sequence
  Description of Artificial Sequence: Synthetic coding sequence
atggagaaagtgcggcgcgagggagtgaaggtcatgcccaacgcaatcgtccagtctgtcggagtgtcttcaggtaagttacttattaagcttaaagatggacggaaagtggagaccgatcacatcgtagccgccgttggacttgaacccaacgtggagctggcaaaaacgggaggcctggagatcgattctgattttggaggcttccgcgtgaatgccgagttgcaggcgcgtagcaacatatgggtagccggtgatgccgcctgtttctacgacatcaagttaggaagacgaagggtggaacatcacgatcacgctgtcgtcagtggacgcctggcgggggagaacatgaccggcgctgcgaagccatactggcaccaaagtatgttctggagtgacttggggcccgatgtgggctacgaggccattggcctggtggattccagtctgcctaccgtgggagtctttgcaaaggcgactgcccaggacaacccgaagagcgccacggagcaaagcggcaccggcatccgatcggagtcggagaccgagagcgaagcttccgagataaccataccgccctcgacccccgcggtaccgcaggcacctgttcaaggcgaggattatggcaaaggtgtcatcttctaccttcgcgataaggtggtcgtggggatagtgttgtggaacatcttcaaccgtatgccgatagcacggaaaattattaaggacggtgaacagcacgaagatcttaacgaggtggcaaagctgtttaatatccacgaggac

SEQ ID NO: 32106 - DNA, 783 bp, Artificial Sequence
  Description of Artificial Sequence: Synthetic coding sequence
atggaaaaggtgcgccgggagggggtgaaggtcatgcctaatgccatcgtccagtcagtcggagtgtcatctggcaagctcctgatcaaactgaaagatggacggaaggtggaaactgatcacattgtggctgccgtgggactggaaccaaacgtagaattggctaaaaccggaggattggaaatcgattcagacttcggaggattccgcgtaaacgcagagctccaagcacggtccaatatctgggtggcgggggacgcagcgtgcttctacgacatcaagctgggaagaaggcgggtcgagcatcatgatcatgccgtggtgtccggacgcctggccggtgaaaacatgacgggcgctgcaaagccgtactggcaccagtcgatgttctggtccgacctgggtcctgatgttggatacgaagctattgggttggtcgattcctccctgcccactgtgggagtgttcgccaaggcaaccgcccaggacaacccaaagtcggcgaccgagcaatctggtaccggcatcagatcagaaagcgaaactgagtctgaggcaagcgaaatcactatcccgccctcgaccccggcggtcccccaggctccggtgcagggagaagattacggaaagggagtcatcttctatctgcgggataaggtggtggtgggcattgtgctgtggaacatcttcaacaggatgccgatcgccagaaaaatcatcaaggacggagaacaacacgaggacctcaacgaagtggccaagctgtttaacattcacgaggat

SEQ ID NO: 32107 - DNA, 783 bp, Artificial Sequence
  Description of Artificial Sequence: Synthetic coding sequence
atggaaaaggtgagacgggaaggcgtcaaggtgatgccaaacgcgattgttcaatctgtgggggttagctccggaaagctcctgatcaagcttaaggacggccggaaggtggaaacagatcatatcgtggcggccgtaggtttggagccaaatgtggaattggctaagaccggcggtttggaaatcgattctgacttcggtggcttccgcgtaaatgccgaactgcaggcccgcagcaatatatgggtggccggggatgccgcttgcttttacgacattaagctgggccgacgccgggtggaacaccacgatcacgccgtagtgtccgggagacttgctggcgaaaacatgactggtgctgctaaaccttattggcaccaaagtatgttttggtcagacctaggccccgatgtgggctacgaggccattggtctagtggattcgtctctgcccaccgtgggtgtgttcgcaaaggccaccgctcaggataacccaaaatccgcaacagaacaaagcgggacagggattcggtctgagagcgaaactgagtccgaggcatcagagatcactatcccccccagcacacctgctgttccacaggcccctgtgcagggcgaggactacgggaagggagtgattttttatctgagggataaggtggtcgtgggcatcgtgctgtggaatatattcaatcggatgccgatagcccgtaagatcataaaggatggagagcagcatgaagatctgaatgaggtagccaaactgttcaatatacatgaggat

SEQ ID NO: 32108 - DNA, 783 bp, Artificial Sequence
  Description of Artificial Sequence: Synthetic coding sequence
atggagaaagtgaggcgtgagggggtcaaagtgatgccaaacgctatagtgcagagcgtgggagtctcttcagggaaattgctgattaagcttaaagacggaagaaaagtggaaacagaccacattgtcgcagccgttggcctcgaacctaacgtggagttggccaaaaccgggggactcgaaatcgattccgattttggaggtttccgggtcaatgcggaactgcaagcacgctctaatatctgggtggccggggacgctgcctgcttttatgacatcaaactcggacgcagacgcgtggaacatcacgatcatgccgttgtgtctggccgactggctggggagaacatgacaggcgcggctaagccatactggcatcagtccatgttttggtctgatctggggcctgatgtggggtatgaggctatcggcctggtagacagctccctgcccactgtgggcgtgtttgccaaagcaaccgcccaggataaccccaaatccgctactgagcagtcaggaaccgggatccgttcagagagtgaaacagaaagtgaggcatcggaaatcaccatacccccaagcacaccggctgtcccacaagcacctgtgcagggcgaggattatggcaaaggggtgatcttctatctgcgcgacaaagtcgtggtgggaatcgtgttgtggaacatatttaatcggatgcctattgcaaggaagataatcaaagacggagagcaacacgaggacctgaatgaggtagccaagttatttaacattcatgaagac

SEQ ID NO: 32109 - DNA, 783 bp, Artificial Sequence
  Description of Artificial Sequence: Synthetic coding sequence
atggagaaggttaggagggaaggcgtgaaggtaatgcccaacgcgattgttcagtcagtgggagtgtcttctggtaaactgctcataaaattgaaggacggcaggaaagttgagacagaccacatcgtcgccgctgtgggcctggagcccaatgtggaactcgcaaagactggtggcttggagatcgatagtgactttggtggtttccgcgtgaacgccgagttgcaagcgaggtcaaacatctgggtcgccggcgatgccgcttgcttctatgatataaaactgggtaggcgcagagttgagcaccatgaccacgcagtcgttagtggcaggctggccggcgaaaacatgacaggtgctgctaagccttactggcatcaatcaatgttctggtccgatctgggtccagatgtaggatacgaggcgattggtttggtagatagctctcttcctaccgtcggtgtctttgcaaaagccacggcacaggacaacccaaagtcagctaccgagcagtctggcacgggcatcaggtccgaatctgagacagagtccgaggcttcagaaataacgatcccaccctcaacacctgccgtgccgcaggcacctgtgcaaggtgaggactacggtaagggagtcatcttctacttgagggataaggtcgtggtaggcatcgtgctttggaatattttcaataggatgccaatcgcgaggaaaattatcaaagacggtgaacaacacgaggaccttaatgaagtcgccaagctttttaacatacacgaagac

SEQ ID NO: 32110 - DNA, 783 bp, Artificial Sequence
  Description of Artificial Sequence: Synthetic coding sequence
atggaaaaggtgcgcagggaaggtgttaaggtgatgcctaatgcgatcgtccaaagcgtgggagtgtcaagcgggaagctgctgattaagctcaaagacggccggaaggtggaaactgatcacatagtggcagctgtgggacttgaaccaaacgttgaactggccaagactggaggcctggagatcgatagcgactttggaggttttcgggtaaatgcggagttgcaagcacgttccaacatttgggtggcaggggatgccgcgtgtttttacgacattaaactcggtcgaagaagggtggaacaccatgatcacgcagtcgtctccggtcgcctggccggtgaaaacatgactggcgctgctaagccctactggcatcagtcgatgttttggtcagatctggggccagatgtcggttatgaagcaattggtcttgtggactcctcactccccacggtaggggtgtttgcaaaggcaaccgcccaagataaccccaaatcggcgaccgagcaatcgggaaccggaataagatcggagtcagaaactgaatctgaagcaagcgagattaccattcctcctagcacgccggctgtccctcaggccccagttcagggcgaagattacggtaaaggtgtgatattctacttgcgggacaaggtagtcgtgggaatcgtgttgtggaacattttcaatcggatgcctattgcaagaaagatcattaaagatggcgaacagcatgaggaccttaacgaggtggccaagctgttcaacatccatgaggac

SEQ ID NO: 32111 - DNA, 783 bp, Artificial Sequence
  Description of Artificial Sequence: Synthetic coding sequence
atggaaaaggtccggagagagggtgtgaaggtcatgcccaacgctatcgtgcagtcagtgggcgtctccagcggaaagctcctcatcaagctgaaggatggcagaaaggtggaaaccgatcacatcgtcgctgcggtcggtctggagccgaacgtggaactggccaaaactggggggttggaaatcgactccgactttggaggattcagggtcaacgctgagttgcaggcgagaagcaacatctgggtggccggagatgcggcatgcttctacgacatcaagctgggccggcgccgggtggagcaccatgaccatgccgtcgtctccggtcgcctcgccggagaaaacatgactggcgccgccaaaccttactggcatcagagcatgttctggtctgacctgggaccggacgtgggatacgaggctatcgggctggtggattcgtcactgcctaccgtcggtgtgttcgcgaaagccactgcgcaagacaatccgaagtcagctaccgagcaatccggcactggcatccgaagcgaatccgagactgaatccgaggcgtcagaaattactatcccgccgtcaactccggccgtgccgcaggcgccagtccagggggaggattacggaaagggagtcatcttctacctgagagacaaagtcgtggtggggatcgtcttgtggaacatcttcaaccggatgcctattgcgaggaagatcatcaaggacggcgaacagcacgaggatctgaacgaagtggcgaaacttttcaacatccacgaggac

SEQ ID NO: 32112 - DNA, 783 bp, Artificial Sequence
  Description of Artificial Sequence: Synthetic coding sequence
atggagaaggtacgtagagaaggagtgaaggtgatgccaaacgcaatcgttcaatccgtaggggtgagttcggggaaactgttgatcaagttgaaagatggccgcaaggtcgagacagatcatatagtcgcggccgtgggcctggagcctaacgtggaactggcgaagacagggggattggaaattgattctgattttggcggtttccgagttaatgccgaactgcaggcccggtctaatatctgggtggccggggacgcagcctgcttctacgacattaaattaggacggaggagggtggagcaccacgatcacgccgtggtctccggcaggttggcgggcgaaaacatgaccggagctgccaagccatattggcaccaaagcatgttttggagcgacttaggacccgatgtgggctacgaggccatcggcttagtggactctagtctgccgacagtgggggtttttgcaaaagcgacagctcaggataacccaaagtccgcgacggaacaatccggcaccgggattaggtctgaaagtgaaactgagagtgaagctagcgaaattacaatacccccctcgacacccgcagttccccaggcacccgtacaaggggaagattatggcaagggggtcatcttctacctgcgcgataaagtggtcgtagggatcgtactgtggaacatcttcaataggatgcccatagcgcggaaaatcatcaaagacggcgaacagcacgaggatctgaacgaagtggccaaactctttaacatccacgaagat

SEQ ID NO: 32113 - DNA, 783 bp, Artificial Sequence
  Description of Artificial Sequence: Synthetic coding sequence
atggaaaaggttcgccgggagggcgtgaaagtgatgcctaacgcgatcgtccagtccgtgggagtatcgtcggggaaactgctcatcaaattgaaggatggacgcaaggtggaaactgaccatatcgtggcagctgttggcctggagcccaacgtcgagctggcaaagacgggagggctggaaattgactcagacttcggaggtttccgcgtcaatgccgaattgcaggctaggtcgaatatctgggtggccggcgatgctgcgtgcttctacgatatcaagctgggacgccggcgtgtggaacaccacgaccatgccgtcgtctcgggtcgtctggctggagaaaacatgactggagccgccaagccgtactggcatcagtcaatgttttggtcggacctgggtccggatgtggggtacgaagcaatcggactggtggactccagcctcccgactgtgggagtctttgccaaggcaaccgcgcaagacaacccgaagtccgcaaccgaacaatccggcactggaatccgcagtgagtcggagactgaaagcgaagcctccgaaattactattccaccatcgactccagccgtgccacaagcaccggtgcagggggaggactatgggaagggggtgatcttctacttgcgggacaaagtggtcgtcggaatcgtcctgtggaatatcttcaatcgcatgcctatagcgaggaaaatcatcaaggatggagaacaacacgaagatctcaatgaagtggccaagctcttcaacatccatgaggac

SEQ ID NO: 32114 - DNA, 783 bp, Artificial Sequence
  Description of Artificial Sequence: Synthetic coding sequence
atggaaaaagtgaggcgggaaggcgtcaaagttatgccaaatgctatagtccagtccgtaggcgtgagcagcggcaaacttctgataaaacttaaagatggccggaaggtagagaccgatcacatagttgctgccgtgggcctggagcctaatgtagagctggccaagaccgggggcctggaaatcgatagcgatttcggcgggttcagggtgaatgctgagttgcaggcccgaagtaatatctgggtggccggcgacgcagcctgtttttacgatattaagctgggccgtcggcgggtagagcaccatgatcatgccgtggtgagcggtagactagccggcgagaacatgaccggcgctgcaaagccctactggcatcagtcaatgttttggtctgatctcggacctgacgtgggctatgaggccatcggcctggtggactctagcctgcccacagtgggagtgtttgctaaggcaaccgctcaagacaatcctaaaagcgccacagagcagagtggcaccggcatacgaagcgagagtgagacagagtccgaagcctctgagatcactattcctccttctaccccagcagtccctcaggcccctgtccagggtgaagactacggaaaaggcgttatattctacctgagggacaaagtggtcgtaggaatagttctgtggaatatattcaacagaatgcctatcgcaaggaagatcataaaagacggcgaacaacatgaggatctgaatgaggtcgccaagctgtttaatatacatgaagac

SEQ ID NO: 32115 - DNA, 783 bp, Artificial Sequence
  Description of Artificial Sequence: Synthetic coding sequence
atggagaaggtgcgacgagaaggggtgaaggtcatgccgaacgccattgtgcaatccgtcggagtatcctccggcaagctgttaatcaagctgaaggacggccgaaaagttgaaacggaccacattgtcgcagcagtgggattagagcctaatgtcgagcttgccaaaacagggggtctggagatcgactctgatttcggtggattccgggtaaacgcagagctgcaggcccgaagcaacatctgggtcgctggggatgccgcctgcttttacgacataaaactgggtcgtcggagagttgagcatcacgaccacgctgttgtgagcggtcgcctcgcaggcgagaatatgaccggcgccgctaagccttactggcaccagtctatgttctggtccgatttgggtccagacgtcggttatgaggctatcggattagtcgatagctccctgcctaccgtaggcgtgtttgctaaggcgaccgcccaagacaacccaaagagcgccacggagcaatctggcacagggattcggtccgaaagtgaaaccgagtccgaggcgtccgagattactattcctccctcaaccccggctgtcccacaggccccagtccagggcgaggattatggtaaaggcgtaatcttctacctgagggacaaggttgtggtcggtatagtcctttggaacatctttaacagaatgccaatcgccaggaagatcattaaggatggcgagcagcatgaagatctaaacgaggttgccaagcttttcaacattcacgaagac

SEQ ID NO: 32116 - DNA, 783 bp, Artificial Sequence
  Description of Artificial Sequence: Synthetic coding sequence
atggaaaaagttcgccgcgagggggtgaaagtgatgcctaacgccattgtacagagcgtcggcgtttctagcggaaaacttctgattaagctgaaggacggacgtaaggtcgagacagaccatatcgtcgcggcagtgggcctcgaacccaacgtggagctcgcaaagacggggggccttgaaattgacagcgatttcgggggctttcgcgtaaacgctgaattgcaggctaggtccaatatctgggttgcaggagatgcggcttgtttctatgacatcaaattgggccggagacgggtagagcaccacgaccatgcggttgtgtctggccggcttgctggggaaaacatgacaggggccgccaagccctactggcaccagtcgatgttttggtctgacctaggccccgatgtgggatatgaggcaattggactggtagacagttctctgcccaccgttggagtctttgcgaaggcaactgcacaggataatcctaaatcagccactgagcagagcggcaccggtattaggtctgaaagtgaaactgagtctgaggcctctgaaattactattcctccctctactcccgccgtccctcaggcacccgtgcagggagaagactatggaaaaggcgtaatattctatctaagggataaggttgttgtgggcattgtgctctggaacatctttaatagaatgcctatagctcggaaaattataaaagatggcgaacagcatgaggacttgaacgaggtcgccaagctgttcaatatccacgaagat

SEQ ID NO: 32117 - DNA, 783 bp, Artificial Sequence
  Description of Artificial Sequence: Synthetic coding sequence
atggagaaagtccggcgagagggagtgaaggtgatgcccaacgcaatcgtgcaatcggtcggggtttccagtgggaaactgttaattaaactcaaggatggccgaaaggtggagaccgaccacattgtggctgcggtgggcctcgagcctaacgtggaactcgctaagactggcggcttagagatcgatagcgatttcggaggattccgtgttaatgctgaactccaagcccggtccaatatttgggttgctggagacgccgcctgtttctacgacatcaagctcggaaggagacgggtggagcaccatgaccatgccgtggtttctggacgacttgccggggagaatatgacgggagccgctaaaccatattggcaccagtccatgttttggtctgacctgggcccagacgtcggatacgaggcaattgggctagtggactcatctctgcctactgtcggcgttttcgcgaaggcaaccgcacaggataaccccaagtccgccactgagcagagtgggacgggaatccgaagtgaatcggaaaccgagtcagaagcctccgagatcacaattcccccatctaccccagccgtgccacaggctccggtgcagggggaggactacgggaaaggagtcatcttctacctgagggacaaggtcgtcgtcggtattgtcctatggaacattttcaaccgaatgcctatcgcacgaaagatcataaaggatggtgaacagcacgaggatctgaacgaagtggcaaagctgttcaacatccatgaagat

SEQ ID NO: 32118 - DNA, 783 bp, Artificial Sequence
  Description of Artificial Sequence: Synthetic coding sequence
atggagaaggtccgtcgggagggtgtcaaggtgatgccaaacgctatagtacagagcgtgggggtgtcctccggcaagctgctgattaagctaaaagatgggcggaaagtggaaaccgaccacatcgtagcagccgtggggctggagccaaatgttgagttggccaagaccggcggactggagatcgacagcgatttcggcggcttcagggttaacgccgaacttcaggctaggtcaaatatatgggtagccggcgatgcagcatgcttttatgatattaaattaggacgccgaagagtggagcatcacgaccacgccgtggtgagtggccgccttgccggggagaacatgacgggagcagcgaagccctactggcaccagtccatgttttggagcgacttgggccccgatgttggttacgaggccattggcctggttgactctagtctaccaaccgtgggggtctttgctaaggccacggcgcaggacaaccccaaatcagcaacggagcagtccggcacgggaataagaagcgaatccgagactgaaagcgaggcttcagaaattaccatcccaccctccacacccgctgtgccccaagcccctgtgcagggggaagactacggcaagggcgtgatcttctaccttagggataaggtcgtggtgggcatcgtgctgtggaatatttttaatcggatgcccatagcacggaagataattaaggacggtgaacaacacgaggatctcaatgaggtagctaaactttttaatatacacgaagac

SEQ ID NO: 32119 - DNA, 783 bp, Artificial Sequence
  Description of Artificial Sequence: Synthetic coding sequence
atggaaaaagttagaagggaaggcgtgaaggtgatgccaaatgcaattgtccaatccgtgggagtgtcatcgggcaaacttcttatcaaactgaaggatggtcggaaagttgaaactgatcatatagtggcagccgtcgggcttgaacccaacgtcgaactggcgaaaaccgggggcctcgagattgactcggatttcggtggatttagagtgaacgcagaactccaggcacggtctaatatctgggtggccggcgatgcagcctgtttttacgacattaagttgggaaggcggcgcgtggagcaccatgaccacgcagtggtgtcgggccggcttgctggtgaaaacatgaccggggcagcaaagccttactggcaccagtcaatgttttggtcggatctcggccctgatgtgggatatgaggcaattggactggttgatagcagcctgccaaccgtgggggtgtttgcaaaggcaactgcacaggacaacccaaaatcagccactgaacaatccggaactgggatcaggtccgagagcgaaacggagagcgaggcatcggagatcaccatacctccttccaccccagcagtcccacaagcccccgtgcaaggggaggactacggaaaaggggtgatattctatctgagagacaaagtggtggtgggaattgtgctctggaacattttcaatagaatgccgatagcacgcaagatcataaaagatggagaacaacacgaggatctcaatgaagtggcaaagctgtttaacattcatgaagat

SEQ ID NO: 32120 - DNA, 783 bp, Artificial Sequence
  Description of Artificial Sequence: Synthetic coding sequence
atggaaaaggtgagaagggaaggagtgaaagtgatgccaaacgccattgtgcaatctgttggggtctcaagcggtaaactcctgattaaattaaaagatggacgaaaagtcgaaacggaccatatagttgccgcggtgggactagaacccaatgttgaactggccaaaacgggcggactggagatcgactcagattttggcggattcagagtcaatgccgagctgcaagcccgctcgaatatctgggtcgcgggcgacgccgcctgtttctatgacattaagctcgggcgccggagggtcgaacaccatgaccatgccgtggtctccgggcggctcgccggcgaaaacatgaccggcgctgctaaaccttactggcaccagtccatgttctggtcagacttaggtcccgatgtggggtatgaggcaattgggcttgtggatagtagcctgccgacagtaggcgtgttcgcaaaggccactgcacaagacaaccccaaaagtgctaccgagcaatctgggactggcattcggtctgagtcagagacggagtctgaagcctccgagattacaattcctcctagcacacctgctgtcccgcaggctcccgtgcagggtgaggattatggcaaaggggtaattttctatctacgagacaaagttgtggtgggcattgtgctctggaacatttttaacagaatgcccattgccagaaagattatcaaggatggcgagcagcacgaggaccttaacgaggtggcgaaactgttcaatatccatgaagac

SEQ ID NO: 32121 - DNA, 783 bp, Artificial Sequence
  Description of Artificial Sequence: Synthetic coding sequence
atggagaaggtgcggcgagaaggcgtcaaagtgatgcctaatgccatagttcagagtgtcggagtgagttcaggcaagctgctgatcaagcttaaagatgggcggaaggtggagaccgaccacatagtggctgccgtgggacttgaacccaatgttgagctggcgaagactggaggcttagaaattgactccgatttcggtgggttcagagtgaatgcggagctgcaagcccgctccaacatctgggtagcaggggacgcggcctgcttttacgatattaagcttggtcgacggcgggtggaacatcatgatcacgctgtggttagtggccggctggcgggggaaaatatgaccggcgccgccaaaccttactggcaccagagcatgttctggtcggacctggggcctgatgtcgggtacgaagctatcggcctcgtggacagttctttacccacagtgggagtgttcgcaaaggcgacggcgcaagacaatcctaagtccgccacggagcagagcgggacggggattaggtcagagtctgaaaccgaatcggaggcttccgaaattacgatcccgccctcgacacccgccgtgccacaggcaccagttcagggagaggactacggcaagggcgtgatcttttatttacgcgataaggtggttgtgggtattgtcctgtggaatatttttaatcggatgcccatcgcaaggaaaattattaaggacggcgaacagcacgaggatttgaatgaggtggccaaactcttcaacatacacgaggat

SEQ ID NO: 32122 - DNA, 783 bp, Artificial Sequence
  Description of Artificial Sequence: Synthetic coding sequence
atggagaaggtcagacgggagggcgtgaaggtaatgcctaacgcaatcgtgcagtctgtgggagtttccagcggcaaactgcttatcaaactgaaggacggcaggaaggtggagaccgaccacatcgtggcggcagtgggcctggagcctaacgtagagctggccaagaccggcggcctggagattgactctgatttcggggggtttcgcgtcaacgcagaactgcaggcccggagtaacatctgggtggcaggtgacgctgcgtgtttttatgatattaagctgggccgtcgacgggtggagcaccacgatcacgcagttgtgtcgggcaggctggctggcgagaatatgaccggcgccgcaaaaccttattggcaccaatcaatgttttggtctgatttgggcccagatgtgggctacgaggccattgggctggtagatagttctttacccacggttggagttttcgccaaggcgaccgctcaggataatcccaagtcggcaaccgagcaatcagggaccggaattcgctccgagagcgagaccgagagcgaggcttctgaaattaccatcccgccttctacgcccgctgtccctcaagcacctgtccagggcgaagactatgggaaaggagtgattttctatttgcgggataaagtggtggtggggatagtcctttggaacatatttaaccggatgcccattgctcggaagatcatcaaagatggcgagcagcacgaagatctgaacgaggtggctaaactgttcaatattcacgaggac

SEQ ID NO: 32123 - DNA, 783 bp, Artificial Sequence
  Description of Artificial Sequence: Synthetic coding sequence
atggagaaggtgcggcgcgagggcgtaaaggttatgcccaatgctatcgtacagtccgtgggcgtctcaagcgggaagctcttgattaagctgaaagacggaagaaaggtcgagacggaccatatcgtggccgcggttgggttggaacccaatgtagaactggccaaaactggcggattggaaatcgatagtgatttcggcggctttcgggtaaacgcagaactgcaggcccgcagcaatatttgggttgccggagatgccgcctgtttctatgatattaagctgggccgccgccgggtagagcatcacgatcatgccgtagttagtggcaggctggcaggcgaaaatatgactggagcagcaaagccctactggcaccagagcatgttttggtcagacctgggacctgacgttggctacgaggcaatagggctggtggactctagcctgcctacagtcggtgtgttcgcaaaagctaccgcacaggacaacccaaagtccgcaacggaacagagcgggaccggtattcggtccgagtcagagacagaaagcgaggcgagcgagatcacgatcccaccttctactcctgccgtcccacaggctccagttcagggagaggattatgggaagggcgttatattctacttgagagacaaagtggtggtgggaattgtgttgtggaacatctttaatagaatgcccattgccagaaagataatcaaggatggagagcagcatgaggacctgaatgaggtggctaagctctttaatatccacgaagac

SEQ ID NO: 32124 - DNA, 783 bp, Artificial Sequence
  Description of Artificial Sequence: Synthetic coding sequence
atggaaaaggtgaggcgggaaggagtgaaggtcatgcctaatgctatagtgcagtcagtgggtgtctcgtccggaaaacttctgattaagctgaaagacggccgaaaggtggaaaccgaccacatagtggccgcggtggggctcgaaccgaacgttgaactggcaaagactggtggattggagattgactcagatttcgggggatttagagtgaacgccgaactgcaagcacggtcaaacatttgggtggcaggagatgctgcatgtttttacgacatcaagctcggtcgtcgccgagtcgaacatcatgatcatgcagtggtttcgggccgtcttgcgggagaaaacatgaccggcgcagctaagccttactggcatcaatccatgttctggtctgatctcggaccagatgtcgggtatgaggcaattggccttgttgatagcagcctccctactgtcggagtgtttgcaaaggcaaccgcccaggacaatccaaagtcagctactgaacagagcggaaccggaatccgctcagagagcgaaacggaatccgaagcctcggagataactatcccacccagcacccctgcagtgccacaagcaccagtgcaaggggaggattacggtaagggcgttatcttctaccttcgagataaagtggtggtcggtattgttctgtggaacatctttaatcggatgcctatcgcacgcaagatcattaaagatggagagcaacatgaggacctcaacgaggtggcaaaattgtttaacatacacgaagat

SEQ ID NO: 32125 - DNA, 783 bp, Artificial Sequence
  Description of Artificial Sequence: Synthetic coding sequence
atggaaaaggtcagacgggaaggggttaaagtgatgcccaatgcaatcgtgcaatcagtgggagtgagctcaggaaaactcctgattaagctcaaagatggacggaaggtcgaaactgatcatatagtcgcagcggtgggacttgagccaaatgtggaacttgccaagaccggaggacttgagatagactccgatttcggcggttttcgggtcaacgccgaactccaggctcggtccaatatctgggtcgcgggagatgcagcatgcttttacgacattaagctgggtcgacggcgcgtcgagcatcacgatcatgcagtcgtgtcaggacgactggcaggagagaatatgactggcgcagcaaagccatattggcaccaaagcatgttttggtcagatcttgggcccgacgtggggtacgaagcgattggactggtggactcgtccttgccaactgtcggggtctttgctaaagccaccgcacaagacaatcctaagagcgcaaccgaacaaagcggaaccggtattcgttccgaatcagagactgaaagcgaggcgtctgaaatcactatacccccttcgacccctgcggtccctcaagctccagtgcagggagaagattacggcaagggagtgatcttttacctgagggataaggtggtggtgggaatcgtgctgtggaatatctttaaccggatgcctattgccagaaagatcattaaggatggggaacaacatgaggatctgaatgaagtcgcaaagctcttcaacatccatgaggac

SEQ ID NO: 32126 - DNA, 783 bp, Artificial Sequence
  Description of Artificial Sequence: Synthetic coding sequence
atggaaaaggtgagaagagaaggtgtcaaggtgatgccgaacgcgatcgtgcagtcggtgggcgtttcgtcggggaagttgctgatcaaactgaaggatggccgcaaagtggagactgatcacatcgtggccgctgtcggactcgaacctaacgtcgaactggcaaagaccggagggctggaaatcgactccgacttcggcgggtttagggtcaacgccgagttgcaggcgcgctcaaacatctgggtggccggagacgcggcctgcttctacgacattaaacttggtagacgcagagtggaacatcacgaccacgctgtggtttctggacggttggccggtgagaatatgactggagccgctaagccgtactggcatcaatccatgttctggtccgacctgggccccgacgtcggatacgaagccatcgggctcgtggatagcagccttcctactgtgggtgtgtttgccaaagccactgcacaggacaacccaaagtcggccaccgaacaatcgggcaccggcattcgctcggagtcagagactgaatcagaagcgtcggagatcacgatccctccctcgacccctgctgtgccacaagctccagtgcaaggggaggactacggtaagggagtgatcttctacctccgcgacaaggtggtggtgggaattgtcctctggaacatcttcaatcggatgccgatcgcccgaaagatcatcaaggacggcgaacaacatgaggatctcaacgaagtggccaagttgttcaatattcacgaggat

SEQ ID NO: 32127 - DNA, 783 bp, Artificial Sequence
  Description of Artificial Sequence: Synthetic coding sequence
atggagaaagtgcggcgcgagggcgtcaaggtcatgcccaacgcgatcgtccaaagcgttggagtctcctcgggaaagctgctgatcaagctcaaagatggccgaaaggtggaaaccgatcacatagtcgcagccgtgggactcgagccgaacgtagagctggcgaaaactggcggcctcgaaatcgactcggacttcggaggcttcagagtgaacgccgagttgcaagcccggtcaaatatctgggtcgccggagatgcagcgtgtttttacgatatcaaactgggccgacgcagagtcgagcaccatgaccatgcggtggttagcggccggctcgcgggagaaaacatgactggagcagctaagccgtactggcaccagtcaatgttctggtccgatctgggtccggacgtggggtatgaggcgattggactcgttgattcctccctcccaacggtcggagtgtttgccaaggcgaccgctcaggataatcctaaatccgcgactgaacaatcgggcaccgggatccggtcagaaagcgagactgaatccgaggccagcgaaatcaccatccctccctcaaccccagccgtcccgcaggcgccggtccaaggagaggactacggaaagggcgtgatcttctacctgagagacaaggtggtcgtggggatcgtcctctggaatatcttcaaccgcatgccgatcgcccgcaagatcatcaaggacggagaacaacatgaagatctgaacgaagtggctaaactgtttaacatccacgaagat

SEQ ID NO: 32128 - DNA, 783 bp, Artificial Sequence
  Description of Artificial Sequence: Synthetic coding sequence
atggagaaagtgcgaagggaaggagttaaagttatgcccaacgccatcgtgcagtcagtcggggtgtcaagtggtaaactgcttatcaaactcaaggatggacgcaaggtcgagactgatcatattgtcgctgcagtcgggctcgagcctaacgtggagctggctaaaacaggaggtctggagatagacagcgacttcggaggctttcgggtaaatgctgagctgcaagcaaggagcaacatatgggtggcgggcgacgcagcctgcttctacgatatcaaactcggtaggagacgagtggagcaccatgaccatgcagtggtgtctggacgcttggctggcgagaacatgactggtgccgccaagccctattggcaccaatccatgttttggtcagatctgggacctgacgtaggctatgaagcaattgggctggtggattccagtctcccaacagtcggcgtcttcgctaaggcgaccgctcaagacaaccctaaatctgcaactgagcaatccggaacagggatacggagcgaatccgagacggagagtgaggccagtgaaataacaattcctccatccaccccagcggtgccacaagctcccgtgcagggggaggactacggtaagggggtaatcttttacctcagagataaggtggtagttgggatagtgttgtggaatatcttcaatcgcatgccaatagcaagaaaaattataaaggatggggaacagcacgaagatctgaacgaagttgctaagctgttcaacattcatgaggat

SEQ ID NO: 32129 - DNA, 783 bp, Artificial Sequence
  Description of Artificial Sequence: Synthetic coding sequence
atggagaaagttcgccgagaaggtgtgaaagtgatgccaaatgctattgtccagtctgttggggtctcatccggaaaactgctgatcaaactgaaggacggacgaaaggtggaaacagatcatattgtggccgctgtaggcttagagccaaatgtcgaactagccaagaccggcggacttgagattgattccgacttcggaggattccgcgttaatgcagagcttcaggccagaagcaacatatgggtggccggagatgcagcctgcttctacgacatcaagctgggccgccggcgcgtcgagcaccacgatcacgcggtggtgagcggtcgcttggcaggggaaaacatgaccggtgccgcgaagccctattggcaccaatccatgttttggtctgatctgggaccagacgtcggctacgaagccataggtctggtggactcatctctccctactgtcggagtatttgccaaggcgaccgcccaagataaccccaaatctgcaactgaacaatctggaacaggtatccggagtgagtcggagaccgaatctgaggcgagcgagatcacaatcccaccttccactcccgccgtgccccaggctcctgtgcagggggaggactatgggaagggcgtgatcttctacttgcgtgacaaagtggtggtcggtatcgtgttgtggaatattttcaacaggatgcccattgcccgaaaaatcataaaggacggagagcagcacgaagatttaaacgaagttgctaagcttttcaatattcacgaagac

SEQ ID NO: 32130 - DNA, 783 bp, Artificial Sequence
  Description of Artificial Sequence: Synthetic coding sequence
atggaaaaagttagacgtgaaggagttaaagttatgcctaatgcaatagttcaatctgtaggagtttcatctggaaagttacttattaaattaaaagacggtagaaaagtagaaacagatcatattgttgcagcagtaggtcttgagcctaatgttgaacttgcaaaaactggaggattagagatagattctgatttcggtggattccgtgttaatgctgaacttcaagcaagatctaatatttgggttgcaggagatgctgcatgcttttatgacattaaattaggaagaagaagagtagaacatcatgatcatgcagttgtatcaggtagattagcaggtgaaaatatgacaggagcagctaagccttattggcatcaatcaatgttctggagtgatcttggaccagatgttggatatgaagcaattggtcttgttgactcaagtcttccaactgtcggagtttttgctaaagcaactgcacaagataatcctaagtcagcaactgagcaatctggaacaggaattagatcagagagtgaaacagaaagtgaagcatcagaaattactattccaccttcaacaccagcagttcctcaagctccagtacaaggtgaagattacggtaaaggagttattttttatttaagagataaagtagttgttggtatcgttctttggaatatctttaatagaatgccaatcgcaagaaaaattataaaagatggagaacaacatgaagatttaaatgaagtagcaaaattgtttaacattcatgaagat

SEQ ID NO: 32131 - DNA, 783 bp, Artificial Sequence
  Description of Artificial Sequence: Synthetic coding sequence
atggaaaaagtcaggagggagggcgttaaggtgatgccaaatgcgatcgtccagtcagttggggtgtcctcgggaaagctgctgataaagctgaaggatggtcgtaaagtcgagacggatcacatcgtggcagccgtaggattggaaccaaacgtagagttggcaaaaaccggcgggcttgagatcgattccgacttcgggggatttcgcgtcaacgccgaattgcaggcaaggtccaatatctgggttgcaggcgacgccgcatgtttctatgacatcaaactaggtaggcggagggtggagcaccatgatcatgcggttgtttcaggacggctagcaggtgagaatatgactggtgcagccaaaccttactggcatcagtcaatgttctggtccgacctgggtcctgatgttgggtacgaagctatcggcctcgtagatagctcactgcccacagtgggagttttcgccaaggccactgcacaggacaaccccaagagcgccactgagcaaagcggcacggggatcaggagcgaaagtgagacggaatccgaagcttcagaaatcaccatccctccttcgactcccgccgtccctcaggcccctgttcagggggaagactatggaaaaggcgttatattttatcttcgggataaggtcgtcgtcggcatcgtgctttggaatatattcaacaggatgcccatcgccaggaaaataatcaaagatggggagcaacacgaagatctgaacgaagttgcgaaactattcaacattcatgaggac

SEQ ID NO: 32132 - DNA, 783 bp, Artificial Sequence
  Description of Artificial Sequence: Synthetic coding sequence
atggaaaaagtccggagagagggcgtgaaagtgatgcctaatgcaattgtgcaatccgtgggagtgtcttccgggaaactgttgatcaagctaaaggatggaaggaaggtggaaaccgaccatatcgttgccgccgtgggactagaaccgaacgtggagctcgccaagacaggcggcctggagatcgattccgactttgggggattccgggttaacgctgagctgcaggcacggagcaatatctgggtggccggcgacgctgcctgtttctatgatatcaaattaggtcgcaggagggtggagcaccacgaccatgcggtggtgtcaggtcgacttgctggcgaaaatatgaccggcgccgctaagccatactggcaccagtctatgttttggagtgatctgggccctgatgtgggatatgaagccattgggcttgtggacagctcgctcccaactgtcggggtgttcgctaaggccacggctcaggacaaccctaaaagtgcaactgaacagtctggaacaggaatacgcagtgaatctgaaacagaatcagaggcaagcgagataactattcctccttctactcccgccgtccctcaagcacccgttcagggtgaggactatggaaagggcgtgattttctatcttcgggataaagtggtcgtgggaatcgtgttatggaacattttcaatcgcatgcctattgcacgcaagattataaaggacggcgagcaacacgaggacctcaacgaggtggcaaagcttttcaatatccacgaagat

SEQ ID NO: 32133 - DNA, 783 bp, Artificial Sequence
  Description of Artificial Sequence: Synthetic coding sequence
atggaaaaggtgaggcgggaaggtgtgaaagtgatgccgaacgcgattgtgcagtccgtgggcgtttcgtcgggcaagctgctgatcaaactcaaagacggtaggaaagtggaaactgaccacatagtggccgcagtgggtctggaacctaacgtcgaactggccaagaccggtggactggagatcgatagcgacttcgggggattccgagttaatgccgagcttcaggctcggtccaacatttgggtggccggagacgctgcctgcttctacgatatcaagttgggaagaaggcgcgtggagcaccatgaccacgcggtggtatcaggcagattggccggggagaacatgaccggagcggcgaaaccgtactggcatcagtcgatgttctggtccgacctcggaccagatgtaggatacgaggctatcggcctcgtcgactcgtctctcccgactgtcggggtctttgccaaggcaaccgcacaagacaatcccaagtccgctaccgagcaaagcggaacgggtatccggagcgaatcagagacggaaagcgaagcatcagaaatcactattcctccatccactccggcagtcccacaggctccggtgcagggtgaggactatggaaagggggtaatcttctacctcagagataaggtcgtggtgggaatcgtcctgtggaacatctttaaccgtatgcccattgctcgtaaaatcatcaaggatggcgagcaacatgaagatctgaatgaagtggccaagctgttcaatatccacgaagat

SEQ ID NO: 32134 - DNA, 783 bp, Artificial Sequence
  Description of Artificial Sequence: Synthetic coding sequence
atggagaaggtcagaagggagggagtcaaggtaatgcctaacgccattgtgcaatccgtgggggttagcagcggaaagcttctgatcaaactgaaggatggtaggaaggtagagaccgaccacatagttgctgcagttggcttggagccaaacgtggagttagccaagacggggggcctcgaaatcgatagtgattttggcggtttccgggtcaacgccgagctccaagctcgaagtaatatctgggtcgcaggcgatgccgcatgtttctatgatattaaacttggccgccggagggtagagcatcatgatcacgctgtcgtaagcggtcgcttggcgggggaaaacatgacaggggctgctaagccctactggcaccaatctatgttttggagtgacctcggcccagacgtgggatacgaggctatcgggcttgttgatagtagccttcccaccgtgggggtcttcgcgaaagcgacagcccaggataaccccaagtcagctactgagcagtccggcacaggcattcggagcgagtccgagacagagagcgaggccagcgagatcaccattcctccctctacccctgctgtccctcaagctccggtgcagggtgaagactacggtaagggagttatcttttacctcagagataaagtcgttgtcggcatcgtcctctggaacatctttaatcggatgccgatcgctaggaagatcatcaaggatggggagcaacatgaggacctgaacgaggtggccaaactctttaacatacacgaagat

SEQ ID NO: 32135 - DNA, 783 bp, Artificial Sequence
  Description of Artificial Sequence: Synthetic coding sequence
atggagaaggtgcgccgggaaggcgtcaaggtcatgcctaatgcgatcgtgcagtccgtcggagtgtcgtccggaaagctgttgatcaagctgaaggacggcagaaaggtggagactgaccacatcgtggccgccgtgggcctggaaccgaacgtggaactcgctaagacgggaggcctggagatcgacagcgacttcggcggatttcgggtgaacgcggagcttcaggcacgttctaatatctgggtggccggtgatgccgcctgcttctacgacattaagctcgggaggcggagagtggaacaccacgatcacgcggtggtgtcaggacgcctcgctggggaaaacatgactggcgcggccaagccgtactggcaccaatccatgttttggtccgatctcggtccagatgtgggctacgaagcgattggtctggtggacagcagccttccgaccgtcggcgtctttgccaaagccactgcgcaagacaatcctaagagcgccactgaacagtcgggaacgggaattagatcggaatcagagactgaatcggaagcctctgaaatcaccatcccgccctcaactccagcagtgccgcaggcgcctgtccagggcgaggactacggaaagggcgtcatcttctatctgcgggataaagtggtggttgggatcgtgctgtggaacatcttcaataggatgccaatcgcgcggaaaatcattaaggatggagaacaacacgaggaccttaatgaggtcgccaaactgttcaacattcacgaggac

SEQ ID NO: 32136 - DNA, 783 bp, Artificial Sequence
  Description of Artificial Sequence: Synthetic coding sequence
atggaaaaagtgcgccgtgaaggcgtgaaagtgatgccgaacgctattgtgcagtcagttggcgtaagttcgggaaagcttctgatcaaactgaaggacggccgcaaggttgaaacggatcacattgtagcggctgtcgggcttgaaccgaatgtagaattagccaagacaggcggcctggaaattgactctgactttggggggtttcgagtcaacgcggagctccaggcaagatcaaatatttgggtagcgggggatgccgcatgtttttatgatataaagctcggccggagaagagtggaacatcatgatcacgcagttgtaagcggcaggttggcaggagaaaatatgacgggagcagcgaaaccatattggcatcaaagcatgttctggtctgacctcggtcccgacgtcggttacgaagcaatagggttagtcgattcctctcttcctacagtcggagttttcgcgaaagctacggcacaggacaatccaaaatcagctacagaacaatcgggaacagggattcgatcagaaagtgagacagaatctgaggcttcggagatcacaatccctccttcaactccagcggtcccgcaggccccggtccagggtgaagattatgggaaaggtgtcattttttatctgcgcgataaagtggtcgtgggtatcgtcctatggaatatttttaatcgcatgcctatagcgaggaaaattattaaagatggggaacagcatgaagatcttaatgaggtcgccaaattatttaatattcacgaggat

SEQ ID NO: 32137 - DNA, 783 bp, Artificial Sequence
  Description of Artificial Sequence: Synthetic coding sequence
atggaaaaggtacgccgggagggcgttaaggtcatgccaaatgcaatcgttcaatctgtcggagttagctctggtaagctattaataaagttgaaagatggccgtaaagtggagacggatcatatcgtggccgccgtagggttggagccaaacgttgagcttgcaaaaaccggggggcttgaaatcgattctgattttggaggttttcgtgtgaacgctgagttacaggcgcgctctaacatctgggtcgccggcgacgccgcgtgcttttatgatataaagctcggccggaggcgagttgagcaccatgaccatgcagtcgtctccgggcggctggctggcgagaacatgacaggcgcggcaaaaccgtactggcatcagagcatgttttggtccgaccttggtccagacgtcggttacgaggctatcggactcgtcgattcgagcttaccaacagtcggtgtgttcgcgaaagcaacagcgcaggacaatccgaagtctgcaactgagcagtccggtacgggtattaggtcggagtcagagactgaaagtgaggctagtgagattaccatccctccttcaaccccagccgttccgcaagccccagtgcagggggaagattacggaaagggcgtcattttctatcttcgagataaggtcgttgtcggaatagttctgtggaacatctttaaccggatgcccattgcaagaaaaatcatcaaggatggagaacagcacgaggaccttaatgaggtcgcaaagcttttcaacatccatgaggac

SEQ ID NO: 32138 - DNA, 783 bp, Artificial Sequence
  Description of Artificial Sequence: Synthetic coding sequence
atggaaaaagtgcggcgtgagggtgtcaaggtgatgccaaacgcgatagtccagtcagtcggcgtgtccagcggtaaactgctcataaaactgaaggacggtcggaaggtggaaaccgatcacatcgtcgctgcagtgggacttgagcctaacgttgaacttgcgaaaaccggcgggcttgagattgattcggattttggcggctttcgggtgaacgctgaactgcaagcccgctccaacatttgggtggcaggcgacgccgcatgcttttacgacattaagctcggacggcgcagagtcgagcaccatgaccatgcagtggtcagcgggcgtctcgcaggtgaaaacatgacgggggcagcaaaaccctactggcatcaaagcatgttttggtccgatctcggtcctgatgtcggatacgaagcgattggactcgtggattcgtcgcttcctaccgtcggtgtgtttgcgaaggcaaccgcacaagataacccaaagtcagctaccgagcaatctggaaccggaattagaagcgaatcggaaactgaatcagaggccagcgaaatcactattccgccatctacccccgcagtgcctcaggccccagtgcagggggaggattacggaaaaggagtcatcttttacctgcgcgataaggtggtggtcggaatcgtcctttggaatatctttaacagaatgccaattgcaaggaagatcatcaaggatggagaacaacatgaagatcttaacgaagttgcaaagttgtttaacattcacgaagat

SEQ ID NO: 32139 - DNA, 783 bp, Artificial Sequence
  Description of Artificial Sequence: Synthetic coding sequence
atggaaaaagtgcggcgcgagggagttaaagtgatgcccaatgcgatagtgcagtccgtgggagtgagctcgggtaagctcttgatcaaactcaaggatggtagaaaagtggaaacggaccatatcgtggccgcggtgggcctggagcctaatgttgaactggcgaaaaccggagggctggagattgattcagatttcggagggttccgagtgaacgcggagctgcaggcccggtccaacatttgggtggcaggagacgcggcatgcttctatgacatcaagttgggccgccggcgtgtggagcaccacgaccacgccgtggtgtctgggaggcttgcaggggagaacatgaccggagccgctaaaccatactggcaccagagcatgttctggtcagacctcggcccagatgtgggctacgaagccatcgggttggtggactcctcactccccactgtgggagtgtttgccaaggcgacggcccaggataatccgaaatcggccactgagcaaagcggcaccggtatccggtcggagtccgaaaccgaatcggaagcctctgagatcaccatccctccctcgaccccggcggttccacaagcaccagtccaaggcgaagattacggcaagggagtgatattctacctcagggacaaagtggtcgtcggaatcgtcctgtggaacatcttcaatcgcatgccgatcgccagaaagattatcaaagacggtgaacaacatgaagatcttaatgaagtggctaagctgttcaacattcatgaagat

SEQ ID NO: 32140 - DNA, 783 bp, Artificial Sequence
  Description of Artificial Sequence: Synthetic coding sequence
atggagaaagtccgcagagaaggtgtaaaggttatgccaaacgccattgtccagagcgttggagtcagcagcggcaagctgcttatcaaacttaaggatggtagaaaagtggagaccgatcacatcgtggccgccgtgggcctcgagcctaacgtcgagctggcaaaaactggaggcttggagattgattctgatttcggcggatttcgggtaaacgcggaacttcaggcgcggagcaacatctgggtcgcaggcgatgccgcttgcttttacgacatcaaattagggagacgccgcgttgagcatcatgatcatgcagttgtgtccggtagacttgcgggggaaaacatgactggggcagcgaaaccgtactggcaccagagtatgttctggtctgacctcggccccgatgtggggtacgaggctatcggactggtggactcatcacttccaacagtcggagtgtttgccaaggccaccgctcaagacaacccaaaatccgccactgagcagtctgggaccggcattaggagcgaaagcgaaacagagagcgaggcatccgagatcactatcccaccttctactcctgccgtgccccaggcacctgtgcagggagaagactacggaaagggcgtgatcttttacctgagggacaaagttgtggtgggtatcgtgctttggaacatttttaatagaatgccaatcgcccgtaagatcattaaagatggcgagcagcatgaagacctgaatgaggtagctaagctttttaatatccatgaggac

SEQ ID NO: 32141 - DNA, 783 bp, Artificial Sequence
  Description of Artificial Sequence: Synthetic coding sequence
atggagaaagttagacgtgaaggggtgaaagtgatgcccaacgccatagtgcagtctgtaggggtatctagtggaaaacttctgatcaaactgaaagatgggaggaaagtggagacagatcacatcgtcgccgccgttggactagaacctaacgtagaactagcaaaaacaggaggactggaaatcgattccgattttggaggatttagggtgaacgcggagcttcaggccagatccaatatctgggtcgcaggagacgccgcctgcttctatgatattaaacttgggcgacggagggtagagcatcacgatcatgcagtggtgagtgggcgcctagccggggaaaatatgacaggagctgctaagccatactggcatcagtccatgttctggtccgatctcggacccgatgtggggtacgaagctataggactcgttgattcttcacttccaacagtaggagtctttgctaaggctactgctcaggataacccaaaaagtgctacagaacagtccggaacagggatccggtcagaatcggaaacagaaagtgaagcatctgaaattactataccaccatccactcccgcagtgccccaggcacccgtacagggggaagattatggaaagggggtgatcttctatctcagagataaagtggtcgtaggaatcgttttatggaacatattcaacaggatgcctatagctcgcaagatcataaaagatggggaacagcatgaggatctgaacgaagtggcaaaactgtttaacatccatgaagat

SEQ ID NO: 32142 - DNA, 783 bp, Artificial Sequence
  Description of Artificial Sequence: Synthetic coding sequence
atggagaaggtgcgcagagaaggtgtgaaagtgatgcctaacgcgatcgtgcaatcggtgggtgtttcgagcggcaagctcctcattaaacttaaagatggaaggaaagtcgagacggatcatattgtggccgcagtgggtcttgaaccgaacgtggagttggcaaagactggcggtcttgagatcgattcggacttcgggggatttagagtcaatgcagagctccaggcgcgttcaaacatttgggtggccggggatgcagcatgtttttacgacattaagctcggccggagacgggtggaacatcatgaccatgccgtcgtgagcggacgcctcgcaggtgaaaacatgaccggtgcagcaaagccatactggcaccagtcgatgttctggtccgatctggggcctgacgtcggttacgaggcaatcggactcgtcgattcgtctctccctaccgtcggagtgtttgcaaaagcaactgctcaagacaatccaaagtcggcaactgaacagtccgggaccggcatcaggtccgaatccgaaactgaaagcgaagcaagcgaaattacgattcctccatcaacgccggcggtgcctcaagctccagttcagggggaagattatgggaaaggtgtgattttctacctccgcgataaggtggtggtggggatcgtcctctggaacattttcaacagaatgcctatagcacgcaagatcattaaggatggagaacagcacgaagatctgaacgaggtggccaaattgtttaacatccacgaagat

SEQ ID NO: 32143 - DNA, 783 bp, Artificial Sequence
  Description of Artificial Sequence: Synthetic coding sequence
atggaaaaagtccgcagagaaggtgtcaaagttatgcccaacgcgatagtgcagagcgttggagtctcgagcggcaaactcctgatcaaacttaaggatggcaggaaggttgaaaccgaccatatagtggcagccgtcggactggaacccaatgtggagttggcaaagaccggtggactcgagattgattccgattttggcggatttcgcgtgaacgcggaacttcaagcaagatctaatatctgggtggcaggtgatgcggcatgtttctacgacattaagctcgggagacgtcgggtcgagcatcatgatcatgccgtcgtctcgggtagactggctggcgagaacatgactggcgcagcgaaaccctactggcaccagtcaatgttctggagcgacctgggcccagatgttggctacgaagcaattggactggtggactcctcgcttcctaccgtcggagtgtttgcgaaagccaccgcacaagataatccaaagtcagcaaccgaacaatccggtacgggaataagatccgaatcagaaaccgaatctgaggctagcgagattactattccaccatcgactcctgcagtgccccaggcacccgtgcagggagaagattacgggaagggagtcattttctacttgagagataaggtcgtggtgggcatcgtgctgtggaacatctttaaccgaatgccgattgctcgaaagattatcaaagacggtgaacaacacgaggatctcaacgaagtggcaaagctgtttaacattcatgaagat

SEQ ID NO: 32144 - DNA, 783 bp, Artificial Sequence
  Description of Artificial Sequence: Synthetic coding sequence
atggaaaaggtgagacgggagggcgtgaaggtgatgcctaacgctattgtgcagagcgtgggtgtgagctcgggaaaactgctgatcaaactgaaagacggccgcaaggtggaaactgaccatatcgtggctgcagtgggtctggaacccaacgtggagcttgcaaagactgggggcttggaaatcgactcagatttcggcgggttcagggtgaacgccgagttgcaggccagatcgaatatctgggtggcgggagatgcagcgtgtttctacgacatcaagctcggcagacggcgggtcgagcaccacgaccacgccgtggtttccggaagattggcaggagaaaacatgaccggtgctgcgaaaccatactggcaccagtcgatgttctggtcggatctgggtccggatgttggatacgaagccatcggcctcgtggactcgtccctgccgaccgtgggagtgttcgccaaggcgaccgcccaggacaacccgaagtcagctaccgaacagtccggaaccggaatccgctcagagtccgagacggaaagcgaggcctccgagatcacgatcccaccgtcgactccggccgtgcctcaagccccggtccagggagaggattacggcaagggagtgattttctacctgagggataaagtggttgtgggaatcgtcctctggaacatcttcaacagaatgccgatcgcgaggaagatcatcaaagacggtgaacaacacgaagatctgaacgaagtggctaaacttttcaacatccacgaggac

SEQ ID NO: 32145 - DNA, 783 bp, Artificial Sequence
  Description of Artificial Sequence: Synthetic coding sequence
atggaaaaggttagacgggagggagtgaaggtcatgcctaacgcaatagtgcagtccgtcggagtgagctccggaaaacttctgattaaacttaaggacggaagaaaggtggaaaccgaccatatcgtcgccgcagttgggcttgaacctaacgtggaactggcaaagaccggaggccttgaaattgatagcgattttggtgggtttcgagtgaatgccgagcttcaagctagatcgaacatttgggtggctggtgatgcagcctgtttctacgacataaagctggggcggcgccgagtggagcaccatgaccatgcagtcgtgtccgggagattggcaggcgaaaacatgacgggggcagcaaagccgtactggcaccaaagcatgttctggtcggacctgggccccgatgttggttacgaggcaattggactggtggactcaagcctgcctactgtcggagtgtttgccaaggccaccgcacaagataatcctaagagcgctaccgaacagagcggcaccggaatccgatccgaatcagaaacggaatcagaggcaagcgaaattactattcctccttccaccccggccgtgccacaggcacctgtccagggagaagattacggaaagggagtgatcttttacctcagagataaggtcgtcgtcggtattgtgctctggaacattttcaaccgcatgcccattgcccgaaagatcattaaggacggagagcagcatgaggacttgaacgaggtggcaaaacttttcaatattcacgaagat

SEQ ID NO: 32146 - DNA, 783 bp, Artificial Sequence
  Description of Artificial Sequence: Synthetic coding sequence
atggagaaagttcgccgcgaaggagtgaaagtgatgccaaacgcaatcgtgcaatccgtcggggtcagctcgggaaagctccttatcaagctgaaggacggtcggaaggtcgaaactgatcacatcgtggccgctgtcggactcgaaccaaacgtcgaactggcgaaaactggaggactggagatcgactctgacttcgggggattccgcgtcaacgccgaactccaagctcggagtaatatctgggtcgcaggagatgccgcgtgcttctacgatatcaaactgggaaggcgccgggtggagcaccacgaccatgcggtcgtgtcggggagactggccggtgagaatatgaccggagcggccaagccgtactggcatcagagcatgttctggtcggacctgggtcctgacgtgggctatgaggccattggactggtcgactcgtcacttccgaccgtgggagttttcgctaaggccacggcccaggacaatccgaagtccgcaactgaacagtcaggaaccggtattcggagcgaatcggagactgagtctgaagcctccgagatcaccattccgccaagcacccctgccgtcccacaagcaccggtgcagggagaagattacggaaagggggtgatcttctacctgcgcgacaaggtggtcgtcgggatcgtgctctggaacatattcaatcgcatgcctatagcacggaagattatcaaggacggagagcagcatgaggatctcaacgaagtggccaagctcttcaacattcacgaggac

SEQ ID NO: 32147 - DNA, 783 bp, Artificial Sequence
  Description of Artificial Sequence: Synthetic coding sequence
atggaaaaagtgaggcgagaaggagtgaaggttatgcccaatgccattgtccagtccgtgggggtgtcttccgggaagttgcttatcaaactgaaggatggcaggaaggtcgagactgatcatatcgtggctgcggtggggttagaaccgaacgtcgagctcgcgaaaaccggcggccttgaaattgattccgactttggaggattccgcgttaacgcggagctgcaggccaggtctaacatttgggtcgccggggatgctgcttgtttttacgacatcaaactcggtcgacgcagagtcgagcatcatgaccacgccgtggtgagtggtcgccttgctggagaaaatatgaccggggccgcaaaaccctactggcatcaaagtatgttctggagtgacctaggccctgatgtgggatacgaggctatcggtctggtcgactcttctttacctaccgtcggcgtattcgcaaaggccacggctcaggacaaccccaaatccgccactgagcaatctggcaccgggatacgttccgagtcggaaaccgaaagcgaggcttccgagatcactattcctccatctacccccgccgtgccacaagcaccagtgcagggagaggattacgggaaaggggtgattttttatttgcgagataaggtcgtcgtggggatagtcctgtggaacattttcaatcgcatgcctatcgcccggaaaatcatcaaagacggcgagcagcacgaagatctcaacgaggtggcaaaactcttcaacattcacgaggat

SEQ ID NO: 32148 - DNA, 783 bp, Artificial Sequence
  Description of Artificial Sequence: Synthetic coding sequence
atggaaaaggtcaggcgggagggagtgaaggtgatgcctaatgccattgtgcagtcggtgggagtctcctcgggaaaactcctgattaagctcaaggatggacggaaagtggaaaccgaccatattgtggcggctgtgggacttgagccgaacgtcgagctggccaagactggcggactcgagatcgattcggacttcggaggattcagagtgaatgcagagctgcaagcgagaagcaacatctgggtggctggagatgcggcatgcttctacgacatcaaactcgggcgcaggcgcgtcgaacaccacgaccacgccgtcgtgtcaggaagattggccggggagaacatgactggagcagcaaagccttactggcatcaatcgatgttctggagcgatctgggaccagacgtcggatacgaagcaatcggattggtcgatagctccctgccaacggtgggcgtgtttgccaaggctactgcccaagataatcccaagagcgccactgaacagtcggggaccggaatccggtccgagtcggaaactgagtcagaagcctccgaaatcaccatccctccttccacgccagctgtgccgcaggccccagttcaaggcgaggattacgggaagggggtcatcttttatctcagagacaaagtggtggtgggtatcgtcctctggaacatattcaaccgcatgcctatcgcccggaagatcatcaaggacggagagcaacacgaagatttgaacgaggtggcgaagctgttcaacatccacgaggac

SEQ ID NO: 32149 - DNA, 783 bp, Artificial Sequence
  Description of Artificial Sequence: Synthetic coding sequence
atggagaaggtgcgcagggaaggtgtcaaggtcatgcctaacgcgatcgtccaatccgtgggagtgtcgtcgggaaagctgcttatcaagctgaaagatggaaggaaagtggaaactgaccatattgtggcagcggtggggcttgaaccgaatgtcgaactggcaaaaactgggggtctggaaatcgattcggactttggtggcttcagggtcaatgcagaactgcaagcaagaagcaacatttgggtagcaggagatgctgcctgcttttacgatatcaagctgggacggcgaagagtggaacaccatgatcacgcggtggtgtcggggcggcttgctggtgagaacatgactggggcagctaagccatactggcatcagtcaatgttttggtccgaccttggcccagacgtgggatacgaagctatcggactggtcgactcgtcattgcctactgtgggggtgtttgcaaaggcaacggcacaagataacccaaagtccgcaaccgagcagtcgggtaccggtattagatcggaatcggaaactgagtccgaggcaagcgaaataaccatccccccttccactccagcagtcccgcaggcgccagtccagggcgaagattacggtaagggagtgattttctatcttagggacaaggtcgtggtgggaattgtcctttggaacatattcaatcgtatgccgatcgctagaaagattatcaaggatggagaacaacatgaagatctcaacgaggtggcaaaattgtttaacatacatgaggat

SEQ ID NO: 32150 - DNA, 783 bp, Artificial Sequence
  Description of Artificial Sequence: Synthetic coding sequence
atggaaaaggttcggcgagaaggagttaaggttatgccaaacgcaatagttcagtctgtcggagtttcttccggtaagttattgattaaattgaaagatgggcgaaaagtagagactgatcacattgttgcagctgttggtcttgaaccaaatgtggagcttgctaaaaccggaggcctcgaaattgattcagactttggcggctttcgggtaaacgcagaactgcaagcacgatccaatatttgggttgcaggagacgctgcatgcttttacgatatcaaattaggtaggagaagagtagaacatcatgatcacgccgtggtaagtggtcgccttgctggagagaatatgacaggagctgccaagccatattggcaccaatcgatgttctggagcgatttagggcccgatgtaggttacgaggctatcggtcttgtcgattcttcattgcctactgtaggtgtctttgcaaaagcgaccgcccaagataatcccaagtccgccacagaacaatccgggactggaattagatcggagtcggaaaccgagtcagaggcttcggaaattacaatccctcctagcaccccggcagtcccacaagctccggtgcagggtgaggattatgggaaaggtgtgattttttacttgagagataaggtcgtcgttgggatagtactctggaatattttcaaccgcatgccaattgcacgtaagattatcaaggatggggagcagcatgaagatttgaacgaagtggcaaaattatttaacattcatgaggat

SEQ ID NO: 32151 - DNA, 783 bp, Artificial Sequence
  Description of Artificial Sequence: Synthetic coding sequence
atggagaaggtccggagggaaggtgtaaaggtgatgcctaatgccatcgtgcagagcgttggggtttccagcgggaagcttcttatcaagctcaaggacggtcggaaagttgaaacagatcatatcgtggccgccgtcgggctcgaacccaacgtcgagctcgcgaagacaggaggacttgagattgattcagactttggagggtttcgggtgaacgccgaattacaagcgagaagcaatatttgggtcgccggggatgctgcatgtttttacgatatcaaattaggccgccggcgtgttgaacaccatgaccacgccgtcgtcagcggcagactggctggagagaacatgactggagccgcaaaaccttattggcatcagtctatgttctggagtgatctcggccctgacgttggctatgaagccataggcctcgttgactccagcctgccaactgtgggcgttttcgcgaaggcgaccgcgcaggataatccgaagagtgcgaccgaacagagcggaactggcattcgctccgaatccgaaactgaatcggaggcctcggagattaccatccctccgagtactcctgccgtcccccaggcacctgtgcaaggtgaagattacggtaaaggcgtgatcttttacctcagggacaaggtcgtcgtcggcatcgtactgtggaacatatttaaccgcatgccgattgcaagaaagatcatcaaagacggggagcagcacgaagatttaaatgaagtcgccaaactcttcaacatccatgaggac

SEQ ID NO: 32152 - DNA, 783 bp, Artificial Sequence
  Description of Artificial Sequence: Synthetic coding sequence
atggaaaaggtgcgtagagaaggggttaaggtgatgccaaatgcaattgtccagtccgtcggcgtgtcgtcgggtaaactcttgattaagctgaaagatggacgcaaggtggagactgatcatatcgttgcagccgtgggtcttgagccgaacgtcgagctcgcaaagacgggcggactggagatagattcggacttcggtggctttcgcgtcaatgcagaactgcaagcacgaagcaacatttgggtcgcaggcgacgcagcgtgtttttacgacattaaactgggcagacgccgtgtggaacaccacgatcatgctgtggtatctggtcgcctggctggagaaaacatgaccggtgccgcaaaaccttactggcaccaaagcatgttttggtcggatctcggtcctgatgtgggatacgaagcgatcgggttggtggactcgtcactgccgactgttggtgtgtttgccaaggccactgctcaggataatcccaagagcgcaactgagcaatctgggactggaataaggtccgaaagcgaaactgaaagcgaagcatccgaaataacgattcccccctccacccctgccgtgccacaggccccagtgcagggcgaagattacgggaagggagtgatattctacctgagggataaggtggtcgtcggtatcgtgctttggaacatcttcaatagaatgccaatcgcccgcaaaatcattaaggacggtgaacaacatgaagatctgaatgaagtggccaaacttttcaatattcatgaggat

SEQ ID NO: 32153 - DNA, 783 bp, Artificial Sequence
  Description of Artificial Sequence: Synthetic coding sequence
atggagaaggtgcggcgggaaggtgtgaaggtgatgccaaacgcgatcgtccagagcgttggagtgtccagcggcaagctgctcatcaagttgaaggatggaagaaaggtggaaaccgatcacatcgtggccgcggtgggattggaacctaacgtggaactcgcaaagaccggaggactggaaatcgacagcgattttggtggattccgcgtcaatgcggagctgcaagcacgctcgaatatctgggtcgctggagacgcagcatgcttctacgacatcaaacttgggcgccgtcgcgtggagcatcacgatcacgcagtggtgtcggggaggctggctggcgagaatatgaccggggcagctaagccctactggcaccagtcaatgttttggtcggacctgggacctgacgtcggctacgaggcaattggattggtcgactcctcactgcctacggtgggcgtgtttgcaaaggcgaccgcccaagacaatcctaaaagcgcgaccgaacagtcgggcacgggaatcaggtccgaatcagaaactgaatcagaagcgtcggagattaccatcccacctagcaccccggcagtgccgcaggccccggtccaaggtgaggactacggtaagggcgtgatcttctacctccgcgacaaggtggtcgtgggaatcgtgctgtggaatatctttaaccggatgccgattgcacgaaaaatcatcaaagacggtgaacaacacgaggatctgaacgaagtggccaagctcttcaacatccatgaagat

SEQ ID NO: 32154 - DNA, 783 bp, Artificial Sequence
  Description of Artificial Sequence: Synthetic coding sequence
atggaaaaagtgcgccgagagggagtcaaagtaatgcccaatgcaattgtccagtcggtgggcgtatccagtggtaaattgctgattaaactcaaggacggcaggaaggttgaaacagatcatatagttgcagcggtggggctggagccaaacgtcgagctggctaaaactggagggctggagattgactccgatttcggtggctttcgggtgaatgctgaacttcaggcccggtctaacatatgggtggccggcgacgcggcgtgtttttatgacattaagctgggccggaggcgagttgagcatcacgatcacgccgtggtgagcggaagactggcaggcgagaatatgacgggagcggctaagccgtactggcatcagtccatgttttggagtgatctcggccctgatgttggttacgaggcaatcggattagtggacagttccctaccaacagtcggggtgttcgctaaggccactgcccaggacaatcccaaaagcgccaccgagcaatcaggcacaggtattaggtccgaatccgaaactgaaagcgaggcaagcgaaatcacgatacctccatcaacccccgccgtgccgcaggcccccgtacagggtgaggactacggaaaaggggtaatcttttacctcagggataaggttgtggtgggcattgtgttatggaatatctttaacaggatgcccattgcccggaagatcataaaagacggagaacagcatgaagacctgaacgaagtcgcaaagctgtttaacatccacgaagac

SEQ ID NO: 32155 - DNA, 783 bp, Artificial Sequence
  Description of Artificial Sequence: Synthetic coding sequence
atggaaaaggtccggagggagggtgtcaaggtgatgccaaatgccatcgtccagtccgtcggcgtgtcatcgggaaagctccttatcaaactgaaggacggacgcaaagttgagactgaccacatcgtggcagccgttgggctggaacccaatgtggagctggccaagaccggaggactggaaatcgacagcgactttggcggattccgcgtgaatgctgaactccaggctaggagcaacatttgggtggccggcgacgctgcgtgcttctacgacattaagctgggaaggcggcgcgtcgagcaccacgaccacgcggtggtgtcaggacggctggcaggcgaaaacatgaccggcgccgccaagccgtactggcaccagtcgatgttctggtccgacctgggcccggacgtcggctacgaggcgatcggactggtcgattcatcgcttccgaccgtgggagtgttcgcaaaggctactgcccaagataacccaaaatcggccaccgaacagtcgggcaccggaatccggagcgaatccgaaaccgaatcagaagcctcggaaatcaccatcccgccaagcacgccggctgtgccacaagcgccggtgcagggggaagattacggtaagggagtgattttctatttgcgggacaaggtggtggtaggaatcgtgctctggaatatctttaatcgcatgcctattgccaggaaaatcatcaaagatggcgagcagcatgaagatttgaacgaagtggcgaaattgtttaacatccatgaggac

SEQ ID NO: 32156 - DNA, 783 bp, Artificial Sequence
  Description of Artificial Sequence: Synthetic coding sequence
atggaaaaggtgaggcgcgaaggggtcaaggtgatgcccaatgccatcgtgcaatccgtgggcgtgtcgagcggtaagttgctgatcaagctgaaggacggacggaaagtggagacggatcatatagtggcagcagtcgggttggaacccaacgtcgaacttgcaaagaccggtgggctggaaatagactcggattttggcggattcagggtcaacgccgaactgcaggcaagatctaatatctgggtggccggagatgcagcgtgtttctacgatatcaaactgggtagacgtcgcgtggaacatcatgaccatgccgtggtgtctggacgtttggccggagaaaacatgaccggcgcggcaaagccgtactggcatcagtccatgttttggtcagatcttggaccagacgtgggctacgaggctattggtctggtggattcatcgctgcctaccgtgggagtgtttgccaaggctaccgcccaagataatcctaaatccgcaactgagcaatcagggactggcatcaggtcggagtccgaaaccgaatcggaagcgtcggagatcactatcccacctagcacccctgcagtcccacaagcaccggtgcagggagaagattatggcaaaggagtgatattctacttgcgagacaaagtggtggtgggaattgtgctgtggaacattttcaaccgtatgcctatagcaagaaagatcattaaggacggtgagcagcatgaggatcttaatgaagtggcaaaactctttaacattcatgaagat

SEQ ID NO: 32157 - DNA, 783 bp, Artificial Sequence
  Description of Artificial Sequence: Synthetic coding sequence
atggagaaggtgcgacgcgaaggagtcaaggtaatgcctaatgcgattgtgcaatccgtgggggtgagttcaggcaagcttctgattaagctgaaggacggtaggaaagtcgagacagaccacatcgttgctgcagtggggttggaacctaatgtcgaattagcaaagactggcggcttagagatcgattctgatttcgggggtttcagggtgaatgccgaactccaagcgaggtctaatatatgggtggcaggcgacgccgcctgtttctacgatatcaaacttggaagaaggagggtggagcaccacgaccacgccgtggtctcgggtcgattggccggggaaaacatgacgggagccgctaagccctattggcatcaatccatgttctggagtgacctcgggcccgatgtaggttacgaagccatcggtttggtagactcctctctgccaacagtgggcgtctttgccaaggcaaccgcacaggacaacccaaaatctgccaccgagcagtcaggaaccggtattaggagtgaaagcgagacagaatctgaagcatcagaaataaccataccacctagtactcctgctgtgccacaggccccagtgcagggggaggattatggcaagggcgttattttttacctgcgggataaagttgtagtgggaatagtcttatggaatatttttaacagaatgcccatcgctcgtaaaatcatcaaggatggagaacagcacgaggacttgaatgaggtggcaaagttgttcaatatacacgaagat

SEQ ID NO: 32158 - DNA, 783 bp, Artificial Sequence
  Description of Artificial Sequence: Synthetic coding sequence
atggaaaaagtacgtagggaaggagtaaaagtgatgcccaatgctatagtacagtccgtgggggtgtctagtggaaaactcttgataaaactgaaagatggaagaaaagtcgaaactgatcacatcgtcgctgctgtggggctggaaccaaacgtggaattagccaaaacagggggactagaaatcgattctgattttggagggtttcgagttaacgccgaactccaggcacggtcgaacatctgggtggcaggagacgccgcatgtttttatgatatcaaactagggaggcggagagtagaacatcacgaccacgcagtggtgtcagggcgacttgccggagagaacatgactggggcagccaaaccatactggcaccagtcaatgttctggtccgatcttgggcctgatgtggggtatgaggccataggattagtcgattcttctttaccaacagttggggtgtttgccaaagcaactgcccaggataaccccaaatccgcaactgaacagagtggaacaggaatcagatccgaatctgaaactgaatccgaagcctctgagatcacaatccctccttccacacccgctgtgcctcaggctccagtgcagggagaagattacgggaagggggtaatcttctatttacgcgataaagttgtcgtagggatcgtgctttggaacatcttcaacagaatgccaatagcacgcaaaataattaaagatggggaacagcacgaagatttaaacgaggtagcaaagctcttcaatattcatgaagat

SEQ ID NO: 32159 - DNA, 783 bp, Artificial Sequence
  Description of Artificial Sequence: Synthetic coding sequence
atggagaaggtgaggagagaaggtgtgaaagtcatgcccaatgcaattgtgcagtctgtcggggtaagttccggaaaactgctgatcaagttgaaggacggacgcaaagtggaaaccgaccatatagtcgctgcggtcggcctggaacccaatgtggagctggctaagactggtggccttgagattgacagcgattttggcggctttcgggtgaacgctgagttgcaggctagaagcaatatctgggtcgcgggggacgctgcgtgcttctatgacattaagcttggccggcggcgagtggaacaccacgaccatgccgtggtgtccggcagactagctggtgaaaatatgacaggagccgccaagccctactggcatcagtcgatgttctggagcgaccttggccctgacgttggctacgaagctatcggattagtggactcatctctgcctactgtcggggtgttcgccaaggctaccgcgcaggataatccgaaatccgccacagagcagagcggtaccgggatccgtagtgaatcagagactgagtccgaagcctctgagatcaccataccaccatcgactcctgccgtgccccaagcgccagtgcagggggaggattacgggaagggcgtgatcttctacctccgcgacaaagtggtggtgggaattgtcctgtggaacattttcaataggatgcccatagctcgaaaaattattaaagacggagagcagcatgaagatctgaacgaggtggccaagctcttcaacattcatgaggat

SEQ ID NO: 32160 - DNA, 783 bp, Artificial Sequence
  Description of Artificial Sequence: Synthetic coding sequence
atggaaaaggtgcggagagaaggagttaaggtcatgcctaacgccatcgtgcagtcagtgggggtttcgtcaggcaagctccttatcaagctcaaggacggacgaaaggtcgaaactgatcacattgtggccgccgtggggctggaacctaacgtggagctggcaaagacgggcgggctggaaatcgatagcgatttcgggggattcagagtgaacgcagagctgcaagcaagatcgaacatatgggtcgcgggagatgcagcatgtttttacgacattaaactgggtcggcggcgggtggagcatcacgaccacgcagttgtgtccggacgtcttgctggagaaaacatgaccggtgcagccaaaccttattggcatcaatctatgttctggtccgacctgggacctgatgtgggatacgaagcgattggacttgtggacagctcgctgcctactgtgggtgtgttcgcaaaagctaccgcccaagataacccaaaaagcgcaaccgaacaaagcggaaccgggattcgttccgagtcggagactgaatcagaagcctccgagataactattccgccctcaactcctgcagtgccccaggcaccggtccagggggaggattatggaaagggtgtgatcttttacttgagagataaagtggtggttggtatcgtgctgtggaacatctttaatcggatgcccattgcccgtaagatcattaaagatggagaacaacacgaagatctcaatgaagtcgccaaactgtttaacattcatgaagat

SEQ ID NO: 32161 - DNA, 783 bp, Artificial Sequence
  Description of Artificial Sequence: Synthetic coding sequence
atggagaaagtccgcagagagggagtcaaggttatgcctaacgcaattgttcaaagtgtcggagtttcaagtggcaaattattgatcaagctgaaggacggtaggaaagtggagactgaccacattgtagccgctgtcggcctcgagcctaacgtcgagctagcaaagaccggcggactggagatcgattcggacttcgggggattccgggtgaatgcagaactgcaggcaagatctaacatctgggtcgccggagacgctgcttgcttttatgatatcaaactgggcagaaggagagtggagcatcacgatcacgccgttgtgtctggaaggcttgctggagagaatatgaccggagccgctaaaccctattggcatcagtccatgttctggagcgacctgggaccagacgttggatatgaggccataggcctggtagatagcagtctacctacagtgggcgtgttcgctaaggctaccgcccaggataatcccaagtcagcaactgaacagagcggcactggcattagatctgagtcagaaaccgaaagcgaggctagtgagatcaccattcccccatctacccctgcggttccacaggcacctgtccagggcgaggactacggaaagggagtgatcttttatctccgggacaaagttgttgtggggatcgtgctgtggaacatcttcaatcgcatgccaattgcgcggaaaattattaaagacggggagcagcatgaggaccttaacgaggtggctaagctattcaacatccatgaggat

SEQ ID NO: 32162 - DNA, 783 bp, Artificial Sequence
  Description of Artificial Sequence: Synthetic coding sequence
atggagaaggttcggcgagagggggtaaaggtgatgcccaatgccatcgtccagagcgtaggcgtgagttctgggaagctgctgattaagctaaaagacggacgcaaggttgaaactgatcatatagtcgctgcagtggggctggagcccaacgtcgaactcgccaaaacgggtgggctcgagatagattctgacttcggtggctttagggttaatgcagaacttcaggcaagatccaacatctgggtggcaggggatgccgcatgtttctatgatatcaagctgggccggagacgggtcgaacatcacgatcacgccgtggtgagcgggcgtttggccggtgaaaacatgaccggagctgccaaaccctattggcatcagtccatgttctggtcagatcttggtcccgacgtggggtatgaagccataggactggttgactcgagtctgcccactgtgggcgtgttcgccaaagcaactgcccaggacaaccctaaatccgctaccgagcagtctggtactggtatccgctccgaaagtgagacagagagtgaggcatctgaaattaccattccgccctccacccccgccgtcccccaggcacccgtccagggggaggactatggcaaaggtgttatcttctatttaagggataaagtagtcgttggcatcgtgctttggaatatatttaacaggatgcctattgctcgtaaaatcatcaaagatggagaacagcacgaggacctgaatgaggtcgcaaagttattcaacatccacgaagac

SEQ ID NO: 32163 - DNA, 783 bp, Artificial Sequence
  Description of Artificial Sequence: Synthetic coding sequence
atggagaaggttcggagagagggcgtgaaagttatgccaaatgccatcgttcagagcgtcggggtgagctcggggaaactcctcataaagctgaaggacggtcgaaaggtagagacggaccatatcgtcgctgcggtaggcctcgaaccgaatgtcgagctcgctaagaccggaggcttggaaattgactcagacttcggcggcttcagagtcaatgcggagctgcaggcccgttctaacatctgggtcgccggagacgctgcatgtttttatgacataaagctggggcgcaggagagtggaacaccacgatcatgctgtcgttagtggccggcttgccggtgagaacatgaccggtgcggccaagccatactggcaccaatcaatgttctggagtgacttgggccccgacgtaggctacgaggcaattggattggtggacagtagtttacctactgtaggagttttcgccaaggcaacagcccaggacaatccaaaatctgctaccgaacaatccggcactggcattcgctctgagtcagagaccgagagtgaagcttctgaaataaccattccgccttccacccccgccgtaccccaggcacccgttcagggggaggactacggcaaaggagttattttttaccttcgagacaaggttgtagtgggcatcgtactatggaacatatttaaccggatgcccattgcaaggaagattatcaaagatggagaacagcacgaagacctcaacgaggtggccaagttgttcaatatccacgaagac

SEQ ID NO: 32164 - DNA, 783 bp, Artificial Sequence
  Description of Artificial Sequence: Synthetic coding sequence
atggaaaaagtcaggcgcgagggagtgaaggtgatgcccaacgcgatagtgcaaagcgtgggggtgtcatccggaaagctgcttatcaagctgaaagatggcagaaaggtagaaaccgaccatattgtggcggccgtgggcctggaaccaaatgtggaactggcaaagactggaggactggaaatcgatagcgatttcggcggtttcagggtcaacgcggaactgcaggcacgttctaacatctgggtggcgggagacgcagcatgtttctatgacattaagctggggcgccggcgcgtcgagcatcacgatcacgcagtggtgtccggccgcctcgccggagaaaacatgactggagcggcgaaaccatattggcaccagtcaatgttctggtccgacttggggccggacgtgggctacgaggcaatcggattggtggattcgtccctcccaacggtcggtgtgttcgccaaggcgactgctcaggacaaccctaaatcggcaacggagcaatccggaaccgggatccggagcgaatcagagactgaatcggaggcctcagaaatcaccattccaccaagcaccccggcagtgccgcaggcacctgtgcagggggaggactacggaaaaggcgttatcttctacttgagagacaaggtggtcgtcggaatcgtgctctggaacattttcaacagaatgccgatcgcccgaaagattatcaaggacggagaacagcatgaagatctgaacgaggtggccaagctcttcaacatccacgaagat

SEQ ID NO: 32165 - DNA, 783 bp, Artificial Sequence
  Description of Artificial Sequence: Synthetic coding sequence
atggaaaaagtacggcgcgagggtgtaaaggtgatgcctaacgctatcgtgcagtccgtaggagtgtcatcgggtaagcttttgataaagctgaaggacggtcgcaaggttgagaccgatcatatcgtggccgctgtgggtttggagcctaacgttgaacttgctaagaccgggggccttgagatcgattcagacttcggcggcttccgagtgaacgctgagttgcaggcacgatctaacatttgggtagctggcgatgctgcttgtttctatgacataaaattagggcggcgcagagtcgagcatcacgaccacgcggttgtttccggccggctggcgggagagaatatgaccggcgctgccaagccttactggcatcagagcatgttttggagtgatctcggaccggacgtggggtatgaggcgattggcctcgtggactcttccctgccaactgtgggggtgttcgccaaagccactgcccaagacaatccgaagagtgccactgaacaatcaggcaccgggatccgtagcgagtccgaaacagaatccgaagcaagtgagatcaccatccctccatccacacccgctgtgcctcaagcacctgtgcagggtgaggactacggaaagggcgtcatcttctatctccgggataaggtggtggtgggcatcgtgctgtggaatatctttaacaggatgccaatcgccaggaagatcatcaaggacggggagcagcatgaggatctaaatgaggtggcaaaactgtttaatatacacgaggac

SEQ ID NO: 32166 - DNA, 783 bp, Artificial Sequence
  Description of Artificial Sequence: Synthetic coding sequence
atggaaaaggtgcgcagagagggcgtgaaagtcatgccgaacgctatagtgcagtcagtcggcgtgtcctcagggaagctgctcatcaagctgaaagacgggcgcaaggtcgaaaccgaccatatagtcgcggccgtgggactggaaccaaacgtggaattggctaaaacgggaggtttggaaatcgattccgatttcggaggattccgcgtcaacgctgaactgcaagcccgatcaaacatctgggtggcgggagatgcggcctgcttttatgacattaagctgggacgtaggcgcgtggagcaccatgatcacgccgttgtgagcggaaggctggctggggaaaacatgactggtgcagccaagccgtactggcaccaatccatgttttggtcggatctcggaccggacgtgggatacgaggcaatcggccttgtcgattcctctctgccaaccgtgggtgtattcgcaaaggccaccgcgcaagacaaccctaagtcagccaccgagcagtcggggactgggatccgcagcgaaagcgagactgaatccgaagcgtcggagattactattccgccgagcacccccgccgtgccacaggctcctgttcagggagaggactacggtaagggggtgatcttctaccttcgcgacaaggtggtcgtcggcatcgtgctctggaatatcttcaaccggatgcccatcgctagaaaaatcatcaaggacggagaacagcacgaggacctgaatgaggtagcaaagctcttcaatatccacgaggac

SEQ ID NO: 32167 - DNA, 783 bp, Artificial Sequence; identical to SEQ ID NO: 32118
  Description of Artificial Sequence: Synthetic coding sequence

SEQ ID NO: 32168 - DNA, 783 bp, Artificial Sequence
  Description of Artificial Sequence: Synthetic coding sequence
atggagaaagtgcggcgagaaggagtgaaggtgatgcccaacgccatcgtacagtctgtgggggtcagtagcgggaaacttttgatcaaacttaaggatggaagaaaggtcgaaactgaccatatagtggcagcagtgggtctggaacctaacgtcgaactcgctaagaccggaggtcttgaaatcgattccgacttcggggggttccgggtgaatgccgaactgcaggcacgctcaaacatttgggtcgcaggcgatgctgcatgtttttacgacataaagctgggaaggcgtagagtcgaacatcacgatcacgcagttgtgtcgggcagactggcaggtgagaacatgactggagcggccaaaccatattggcatcagtccatgttttggtcggacctcggccctgacgtgggatacgaagcaatcggactcgtggattcctcgcttccgacggtcggtgtgtttgccaaagcaaccgcccaagacaacccaaaatctgctactgaacaatcaggtaccgggattaggtcggagagtgaaaccgagtccgaggcatccgagattactattcctccgtcaaccccagcagtgccacaagccccagtgcagggagaggattacggcaaaggggtgattttctaccttagagataaggtcgttgtcggaattgtgctttggaacatctttaacagaatgcctatcgcacggaagatcataaaggacggagaacaacacgaagatctgaatgaagtggcaaagctcttcaacattcacgaggat

SEQ ID NO: 32169 - DNA, 783 bp, Artificial Sequence
  Description of Artificial Sequence: Synthetic coding sequence
atggaaaaagtgcgcagagagggagtgaaggtgatgcctaacgcgattgttcagtcagtgggagtgtctagcggaaagctcctgattaaactgaaggacggacgtaaagtggagactgaccacatcgttgccgcggtgggcttggaaccgaatgtggagctggccaagaccggcgggttggagatcgactccgactttgggggattcagggtcaatgctgaactgcaagctcggtcaaatatctgggtggccggagacgctgcatgcttttacgacatcaagctgggccggcgccgcgtggagcaccatgaccatgccgtcgtctccggacgccttgcgggtgagaacatgaccggtgctgcaaagccgtactggcaccagtcaatgttctggtccgatctgggtccggacgtgggatacgaagcgatcggactcgtcgattccagcctcccaactgtgggtgtttttgcgaaggctacggcacaggataaccccaaaagcgccactgaacaaagcggcactggaattcggagcgagtcagaaaccgagtccgaagcgagcgaaatcaccatccctccctcaaccccagcagtcccacaagcgccggtgcagggggaggattacggaaaaggagttatcttctatctccgcgataaggtggtcgtcgggatcgtgttgtggaacattttcaatagaatgccaatagcccggaagatcatcaaggatggcgaacagcacgaagatcttaacgaagtcgctaagttgttcaacatccatgaggac

SEQ ID NO: 32170 - DNA, 783 bp, Artificial Sequence
  Description of Artificial Sequence: Synthetic coding sequence
atggagaaggtgcgtcgcgaaggcgttaaggtgatgccaaatgcaattgtccaatctgtgggagtgtcatcaggaaagctgctcatcaagctgaaagacggaagaaaagtggagactgaccacattgtggcggcagtggggctcgaacctaacgtggaactggcaaagacgggaggacttgaaatcgattctgatttcggcggttttcgggtcaacgcagaactccaggcgcgaagcaacatttgggtcgcaggcgacgcggcctgcttttacgacatcaagctcggacgtaggagagtcgagcaccatgaccacgctgtcgtgtccggacggcttgcaggtgagaacatgactggcgcagccaaaccttactggcatcagtcaatgttttggtctgatcttggacctgatgtgggttacgaagcaatcggacttgtggattcgtcccttccaaccgtcggagtgttcgccaaagcaacggcgcaagataaccctaagtcggcaactgaacagtccggcaccgggattcggtcagaatccgaaactgaaagtgaggcctcggaaataaccattccaccttccactcctgcagtgcctcaagcacccgtgcaaggcgaagattatgggaagggagtgattttctatctgcgagataaggtggtggtcgggattgtcctttggaacatctttaacaggatgccgattgcaagaaagattatcaaggacggtgagcaacacgaagatttgaacgaagtggcaaagttgttcaatatccatgaagat

SEQ ID NO: 32171 - DNA, 783 bp, Artificial Sequence
  Description of Artificial Sequence: Synthetic coding sequence
atggaaaaggtgagacgggagggtgtgaaggtgatgcctaacgcaatcgtgcagtccgtcggcgtttcatccggtaaactcctcatcaagctcaaagatgggagaaaggtggaaaccgaccatatcgtcgctgctgtgggactggaaccgaatgtggaattggccaaaactggaggactggaaatcgattcggatttcggtggcttccgcgtgaacgcagaactccaggcgaggtcaaacatctgggtggccggagatgcagcctgcttctacgacatcaaactgggacgccggagagtcgaacatcacgaccacgccgtggtgtccggacggttggctggcgaaaacatgaccggagccgccaagccctactggcaccagtcaatgttctggagcgatctgggaccggacgtcggttacgaggccatcggactggtggactcgtcgctgccaaccgtgggagtgtttgcgaaggccactgcccaagacaatccgaaatcggccaccgaacagagcggcacgggaatccgctctgagtcggaaaccgaatcagaagcctcggaaatcaccatcccaccgtccactccagccgttccgcaagccccggtgcagggggaggattacggcaagggagtgatcttctatttgcgagataaggtcgtcgtgggcattgtgctgtggaacatattcaaccggatgcccatagcgcgcaagatcatcaaagacggggagcaacacgaggacctgaatgaggtggcgaagttgtttaacatccatgaggac

SEQ ID NO: 32172 - DNA, 783 bp, Artificial Sequence
  Description of Artificial Sequence: Synthetic coding sequence
atggaaaaagttcgtcgtgaaggtgtaaaagttatgccgaatgcgatagtacaatcggtaggtgtatcgtcgggtaaactactaataaaattaaaagatggtcgtaaagtagaaacggatcatatagtagcggcggttggtttagaaccgaatgtagaattagcgaaaacgggtggtttagaaatagattcggattttggtggttttcgtgtaaatgcggaattacaagcgcgatcgaatatatgggtagcgggtgatgcggcgtgtttttatgatataaaattaggtcgtcgacgtgtagaacatcatgatcatgcggttgtatcgggtcgtttagcgggtgaaaatatgacgggtgcggcgaaaccgtattggcatcaatcgatgttttggtcggatctaggtccggatgttggttatgaagcgataggtctagtagattcgtcgttaccgacggtaggtgtatttgcgaaagcgacggcgcaagataatccgaaatcggcgacggaacaatcgggtacgggtatacgatcggaatcggaaacggaatcggaagcgtcggaaataacgataccgccgtcgacgccggcggtaccgcaagcgccggtacaaggtgaagattatggtaaaggtgttatattttatctacgtgataaagtagtagtaggtatagtattatggaatatatttaatcgtatgccgatagcgcgaaaaataataaaagatggtgaacaacatgaagatctaaatgaagtagcgaaattatttaatatacatgaagat

SEQ ID NO: 32173 - DNA, 783 bp, Artificial Sequence
  Description of Artificial Sequence: Synthetic coding sequence
atggaaaaagtccggcgcgagggcgtgaaggttatgccgaacgcgatcgtgcagtccgttggagtttccagcggaaagttgctgatcaaactcaaggatgggcggaaggtcgaaaccgatcacatcgtcgccgctgtgggactggaaccaaacgttgaacttgccaagaccggaggtctcgagattgatagcgatttcggaggattcagggtgaacgcggagctccaggcgcgaagcaacatctgggtagcgggagatgccgcttgtttttacgacatcaaactaggcaggcgccgggtggagcaccacgatcatgccgtcgtctccgggcgccttgcgggggagaatatgaccggcgccgcgaaaccctactggcatcaatcgatgttctggagtgacctgggcccagatgtcggatacgaagccatcggtctcgttgatagcagcctgccaaccgtgggagttttcgcaaaggcaaccgctcaggataaccctaaatccgccactgagcagagcggaactgggatccgctcggaatctgagaccgagtccgaggcctcagaaattacaattccacctagtacccccgctgtcccacaggctcctgtgcagggggaggactatgggaagggggtcatattctatctgcgagacaaagttgtcgttggcatcgtgctctggaacatattcaaccggatgcccattgccaggaagattatcaaagatggcgagcagcatgaggacctcaacgaggtggctaagttgttcaacatccacgaggat

SEQ ID NO: 32174 - DNA, 783 bp, Artificial Sequence
  Description of Artificial Sequence: Synthetic coding sequence
atggagaaggtgagacgcgaaggggtcaaggtcatgcctaacgctatcgtgcagtccgtcggggtatcatccgggaaactcctgataaagttaaaggacggccgcaaagtagaaactgaccacattgtggccgcagtcggcctggagccaaacgtggagctggcaaagactggcggtctagagatagattcggacttcggaggcttcagagtaaatgccgaactgcaagcgcgatcgaacatctgggtggccggagacgccgcttgcttctatgatatcaaacttggccgccgacgagttgagcaccacgaccacgccgtggtttcaggaagactagctggggaaaatatgactggcgccgctaagccttactggcaccagagtatgttttggagcgacctggggcctgatgtaggctacgaggcgattggtctagtcgacagctctctgcccacagttggagtgttcgcaaaagctactgcccaggacaatccaaagtccgctaccgagcagtcaggcaccgggatacgatctgaaagcgaaaccgaatccgaggcatccgaaattactatacctcctagcaccccagcggtgccccaggcaccagttcagggcgaggattatggaaaaggtgttatattctatctccgagataaagtggtggtgggaatcgtcctgtggaacatattcaaccgaatgccgatcgccaggaaaattataaaggatggagagcagcacgaagatttaaacgaggttgcgaagctctttaacatacatgaggat

SEQ ID NO: 32175 - DNA, 783 bp, Artificial Sequence
  Description of Artificial Sequence: Synthetic coding sequence
atggagaaggtgagacgtgagggagtgaaggtcatgccaaacgctatcgtacagagcgtcggcgtgtcctctgggaaactcctgattaaattaaaagatggacgcaaagttgaaacggaccacatagtggccgccgtgggcctggaaccgaacgtcgaactcgccaaaaccggtggccttgagatcgacagcgacttcgggggctttcgcgtaaacgcagaattgcaagcacgaagcaacatctgggtggccggagacgcagcttgcttttacgacatcaagctgggccggaggcgagtggagcatcacgaccatgctgtggtctctggcaggctggctggagagaacatgactggcgccgctaaaccctactggcaccagtccatgttttggtcagaccttgggccagacgtaggctatgaggctatcggcttagttgactccagcctacccaccgtgggtgtgtttgctaaggccacagctcaggacaaccctaaatcagccaccgagcagagcggcactgggatccggagtgagagcgaaaccgagtcggaagcgtccgaaatcaccatccccccatccaccccagcagtcccccaggctcctgtgcagggcgaggattatggtaaaggcgtcatcttttacctcagggataaggttgttgtggggatagtactgtggaatatcttcaaccggatgcccatcgctaggaagattatcaaggatggggagcagcatgaagacttaaacgaggtagcaaagctctttaatattcatgaagat

SEQ ID NO: 32176 - DNA, 783 bp, Artificial Sequence
  Description of Artificial Sequence: Synthetic coding sequence
atggaaaaggtgcgccgcgagggagtcaaggtgatgcctaacgccatcgtgcaatcagtgggagtgtcgtcaggaaagttgctgattaaacttaaggacggtcggaaggttgaaaccgatcatatcgtggcagcggtgggcctggaaccgaacgtcgaactggctaagactggaggtctggagatcgacagcgatttcggaggattccgggtgaacgcagaattgcaggcccggtccaatatctgggtggccggcgatgccgcgtgcttttacgacatcaagctcgggagacgccgggtcgaacaccatgaccacgcagtggtgtccggcaggctcgcgggagaaaatatgactggcgccgcaaagccgtactggcaccaatcgatgttctggtctgacctgggaccggacgtggggtacgaagcaatcggactggtggattcgtccctcccaaccgtcggcgtgttcgccaaagccaccgctcaggacaacccaaaaagcgctactgagcagtcagggactggtatcaggtccgagtccgaaaccgaatcggaggcgagcgagatcaccatcccgcccagcacgccggccgtcccacaggcccccgtgcagggagaggactacggaaaaggcgtgatcttctatctgcgcgacaaggtcgtggttggaatcgtcctttggaacatatttaatcgaatgcctatcgctagaaagattatcaaggacggggagcaacatgaagatctcaatgaagtcgcgaaactgttcaacattcacgaggat

SEQ ID NO: 32177 - DNA, 783 bp, Artificial Sequence
  Description of Artificial Sequence: Synthetic coding sequence
atggaaaaagtccgtcgagagggggtcaaagtaatgcctaatgccatcgtgcagtcagtcggcgtgagttccggaaagctcctcatcaagttgaaggacggacggaaggtggaaaccgatcacatagttgcagcagttggcctcgagcctaatgttgaactggcaaagaccgggggccttgagatcgactcagatttcgggggcttccgcgtaaacgccgagctgcaggccagaagcaacatttgggttgcgggcgatgcagcctgcttttatgacattaaactggggcggcggagagttgaacaccacgaccatgctgtggttagtggcaggttggcaggagagaacatgaccggcgcagcaaaaccgtattggcaccagagcatgttctggagcgatttgggccctgacgtcggttacgaggcgatcgggcttgttgacagctctttgccaaccgtaggggtgtttgcaaaagcgaccgctcaggacaaccccaagtccgcaacggagcagagtgggaccggcattagaagtgagtccgagaccgaaagtgaggccagcgaaattacgatccctcccagtactccagctgtgccacaggcacccgtccaaggagaagactatggcaaaggagttatcttctatttacgggacaaggtcgttgtgggcattgtactctggaacattttcaatagaatgcctatagcccgtaaaattattaaagatggagagcagcatgaagacctcaatgaggtggcgaagttgttcaacatccacgaggat

SEQ ID NO: 32178 - DNA, 783 bp, Artificial Sequence
  Description of Artificial Sequence: Synthetic coding sequence
atggagaaagtcagacgggaaggcgttaaggtgatgccaaacgcaatcgttcaatctgtgggtgtctccagtgggaagttgctcatcaagcttaaagacggcaggaaagtggagacagatcatattgttgccgcggtcggtctggaacctaacgtggagcttgctaagacaggggggctcgagatagattcagatttcggcggttttagggtgaacgctgaattgcaagctaggtctaatatctgggttgcgggcgatgccgcctgcttctacgacattaagctgggaaggcgtcgcgtggagcatcacgatcatgccgtggtaagtggacggctggcaggcgaaaacatgacaggagctgctaaaccatattggcaccagtccatgttctggtctgatctgggccctgacgtgggttacgaagccatcggcttggtggatagcagcctgcccaccgtgggcgtgttcgctaaggccacagcacaggacaacccgaagagcgccaccgagcaatctggcaccggaattagatcggagtcggagacagagtccgaggcttcagaaatcacaatcccaccgagcaccccggctgtaccacaggcaccagtgcagggcgaagactatggtaaaggggtgatattttacctgcgggacaaagtggtggtgggtatcgtcctgtggaacattttcaacaggatgcccatcgcaagaaaaattataaaagacggagagcagcacgaagacctcaacgaagtagcgaagctgttcaacattcacgaagat

SEQ ID NO: 32179 - DNA, 783 bp, Artificial Sequence
  Description of Artificial Sequence: Synthetic coding sequence
atggaaaaagtgaggcgggaaggagtcaaagtgatgccaaatgcaatcgtgcagagcgtgggggtgtcgagcggcaagctcctgatcaagctgaaagatggacgcaaagtggagacggatcacatcgtggcggccgtcgggctggagccgaacgtggaacttgccaagactgggggtctggaaatcgactcggatttcgggggcttcagagtcaacgcagaactccaggcacggtcgaatatctgggtggctggagacgccgcctgtttttacgatatcaaactgggacgacgccgggtggaacatcacgatcacgcggtggtgagcggaagattggctggagaaaatatgaccggggcagcgaaaccatactggcatcagagcatgttctggtcagacctgggcccggacgttgggtacgaggccatcggcctcgtcgactcttccttgccgactgtgggagtgttcgccaaggcaactgctcaggacaacccaaagtcagccacggaacaaagcgggaccggaatccggtcagaaagcgaaactgaaagcgaagctagcgaaatcaccattcctccgtcaacccctgcggtcccgcaggccccggttcaaggagaagactacggaaagggcgtcatcttctacttgagggataaggtggtggtcggcatcgtgctttggaacatcttcaatcggatgccaatcgcacgcaagatcatcaaggacggtgaacagcacgaagacctgaatgaggtcgccaaactgttcaatatccacgaggat

SEQ ID NO: 32180 - DNA, 1854 bp, Artificial Sequence
  Description of Artificial Sequence: Synthetic coding sequence
atgcacaaaacagcgagtcagcggctctttccaggcccctcctatcagaacatcaagtctataatggaggattcaacaatcctctcggactggactaacagcaataaacagaagatgaaatatgacttctcctgtgagttgtacaggatgagtacatactctacatttcctgccggcgttccggtgtcagagcgatcccttgcgagagccggtttctactacaccggcgtgaacgataaagtcaagtgcttctgttgtgggctcatgctggacaactggaagctgggagattctcccatacaaaaacataagcaactatacccgtcgtgcagctttatccagaacctggtctcagcttcactgggtagtacctctaagaatactagcccaatgcgtaatagcttcgcacatagcctgtcaccgactctcgagcatagctctctgttctcaggatcttacagctcattgagtccgaatccccttaattcacgcgccgtggaagatatctcctccagccggactaatccgtattcttacgcgatgtccactgaggaggccaggtttctgacttatcatatgtggcccctgacctttctctcaccgagtgagctggctagggccggcttctactatattgggcctggagaccgcgtagcatgtttcgcctgtggtgggaaactcagcaattgggagccaaaggacgacgccatgtccgagcatagaagacattttcctaactgcccctttctagagaacagcctggagacactcaggttttcgatttccaatctgtccatgcagacacacgccgctaggatgagaacattcatgtattggccttcctccgtacctgtgcagccagagcagttggcaagcgctggcttttactatgtaggacgcaatgacgacgtcaagtgcttctgctgcgatggcggcctacggtgctgggaatccggcgacgatccgtgggtggaacatgccaaatggttccctcggtgtgaattcctcatccggatgaaagggcaagaatttgttgacgagattcaggggcgatatccgcaccttctagagcagcttctctcaaccagtgacaccaccggtgaggagaacgcagacccaccaattattcacttcggccccggcgagtcttccagcgaagatgcagtgatgatgaacacccctgtggttaagtcggctcttgagatgggattcaacagagatctggtgaagcaaaccgtgcagtcgaagatcttaactactggagaaaactacaaaacggtaaacgacatagtgagcgcgctgttgaatgctgaggatgagaagagggaagaagagaaggaaaaacaagccgaggaaatggccagtgacgatctttcactgattcgtaaaaatcgaatggccctgttccagcagctgacctgcgttctccccatcctggataatctgttaaaggctaatgtaatcaacaagcaggagcacgatatcatcaagcagaagacccaaatcccattgcaagccagagaactcattgacactatccttgtgaaaggtaatgccgctgcgaacattttcaagaattgcttaaaagaaattgactctactctgtacaagaatctgttcgtcgacaagaatatgaagtacatacctactgaggacgtgtccggactgagcctagaagagcagctcaggcgcctgcaagaggagagaacctgtaaggtatgcatggataaagaggtgtctgtggtcttcataccctgcggacaccttgtggtttgccaggaatgtgctccttctctgcgcaagtgccctatctgccgaggaattatcaaaggcaccgtgagaacctttctgtca

SEQ ID NO: 32181 - DNA, 1854 bp, Artificial Sequence
  Description of Artificial Sequence: Synthetic coding sequence
atgcacaagacagccagtcaaagactgtttcccgggccatcttatcagaacatcaagagcatcatggaggacagcactatcctgtccgactggactaacagcaacaaacaaaagatgaagtacgacttttcctgcgagctctatcggatgtccacttattctacttttcccgccggagtgcctgttagcgaacgaagtcttgcccgagccggattctattatactggcgtgaatgataaggtgaagtgcttttgctgcggtctgatgctcgacaactggaagctcggcgactccccaattcagaaacacaagcagctgtacccctcctgctcctttattcagaatttggtgtcagcaagcctgggaagcacgtctaagaatactagtcccatgagaaatagcttcgcccactcattgtcacctactctggaacacagctctctgtttagcgggtcttactcctccctgtctcccaatccactcaacagccgcgcagttgaggatatctcttccagccgcacaaatccctactcctacgccatgtctactgaggaagcacggttcctgacatatcacatgtggccattgacttttctttctcccagcgagctggcccgcgcgggcttctactatatcggcccgggagacagagtcgcctgcttcgcttgcggaggaaaactgtccaactgggaacctaaggacgacgctatgtcagaacatcgcaggcacttccccaattgcccatttctggaaaattccctggagaccctccgattcagtattagcaatctgagtatgcaaacacacgcagccaggatgcggacattcatgtactggccttccagtgttccggtacagccagaacagttggcttctgcaggcttttactacgtggggcgcaatgatgacgtgaagtgcttttgttgcgatggcggcctcaggtgttgggagtccggagacgatccttgggtcgaacacgctaagtggtttccccgctgtgagttcctgattcggatgaagggccaggaatttgtcgacgagatacagggtcgctacccacaccttctggaacagctgctttccactagcgataccactggtgaagagaacgccgacccacctattatacatttcggtccaggtgaaagctcttccgaagacgcagtgatgatgaatacacccgttgttaaaagcgccttggagatgggtttcaaccgcgatctggtcaagcagacggtgcagagcaaaattcttacaactggggagaactacaaaaccgtcaatgatatcgtgagtgcactgcttaacgccgaggacgagaagcgggaagaagaaaaggaaaaacaagccgaggagatggcttccgatgacctctccctcatcagaaaaaatcgaatggctctcttccagcaactgacctgtgtgctccctatactggacaacctcctgaaggcaaatgttattaacaagcaggaacatgacattattaagcaaaagactcaaattcccttgcaggcaagggagctgatagacacaatcctggtcaaggggaacgccgctgcaaatatttttaaaaactgcctgaaggaaatcgatagcacactgtataagaacctctttgtggataagaacatgaaatacatccctacagaagatgtgtctggactgtctcttgaggaacagttgcggcgcctgcaagaggagcgcacctgcaaggtctgcatggacaaggaagtgagtgttgtgtttataccgtgcgggcacctggtggtctgccaagaatgtgcaccctccctgagaaaatgtcctatatgtaggggcattatcaaagggacagtcaggacttttctttct

SEQ ID NO: 32182 - DNA, 1854 bp, Artificial Sequence
  Description of Artificial Sequence: Synthetic coding sequence
atgcataaaacagcttctcaacgactatttccaggacccagctatcagaacatcaagtccattatggaagacagcactatactctctgactggactaatagcaataaacagaagatgaagtacgatttttcatgtgaattatataggatgtcaacctacagcacatttcctgccggggtgcccgttagcgagaggagccttgctagagcagggttctattacactggtgtcaacgacaaagtcaaatgtttctgctgcgggctgatgttggacaactggaaactaggtgactctcccatccagaagcacaaacagctgtatccgagctgttctttcatccagaatctggtgagcgcatctcttggttctacttcgaagaatacttcccccatgcggaatagctttgcccacagcctgtcacctaccctggaacattcttcactgttctccggatcctactcctccctgtcgcccaaccccctgaactcccgggccgtggaagatatatcatcatctcggacaaatccatactcttacgctatgtccaccgaggaggcacgcttcctaacataccatatgtggccgctgactttcttgtcgccttctgaacttgctagagccggcttttactatatcggccccggggatcgcgtcgcttgtttcgcctgcggcggaaaattatctaactgggagcccaaagatgacgccatgtccgaacatcgaaggcacttcccgaactgtccattcctggaaaactccctggagaccttgcggttttccatcagcaatctctccatgcagacccacgcagcgcggatgcgcacttttatgtactggcccagctccgtcccggtacaacccgaacagctcgcatcggcgggcttctactacgtaggtagaaatgacgacgttaaatgtttctgctgtgacggcggtctacgctgctgggagtcaggtgatgatccttgggtggagcacgccaaatggtttcctcgctgtgagtttctgatcagaatgaaggggcaggagtttgtcgatgagattcaaggcagatatcctcatttactggaacagttgttgtccacctctgacaccaccggggaagagaacgctgatcccccaatcatccatttcggcccgggggagagttcgtccgaagatgctgtgatgatgaacacgcctgtggttaagagtgcgctggaaatgggttttaatagggacctggtcaagcagaccgtgcagagcaaaatcctaaccacgggcgagaattacaagactgtgaatgatatcgttagcgcactgctcaatgctgaagatgaaaaaagggaggaggagaaggagaagcaggccgaagagatggcttcagacgacctgtctctgatccgcaagaataggatggcccttttccagcagctgacttgtgtgctccctattctggacaacttgctcaaggcgaatgttattaacaagcaagagcatgacatcatcaaacagaaaacccagatccctctgcaagctagggaactgatcgacacgatcctcgtgaagggcaacgctgcggctaatatttttaagaattgcctgaaagagatcgactctacactctataagaatctgttcgtcgataagaacatgaagtacattccaaccgaagatgtgtctggtctgagcttagaagagcagttgcgaagactgcaggaggagcgtacatgcaaggtgtgtatggacaaagaagtctctgtagtttttatcccttgtggccacttggtcgtgtgccaggagtgtgcccctagtctgagaaagtgcccgatctgcagggggatcatcaaaggaactgttagaaccttcctttcc

SEQ ID NO: 32183 - DNA, 1854 bp, Artificial Sequence
  Description of Artificial Sequence: Synthetic coding sequence
atgcataaaactgcttcgcagcgactgttcccgggaccatcctaccagaatatcaagagcattatggaggattcgactatccttagtgactggactaattcgaacaaacaaaaaatgaagtacgactttagctgcgagctctaccgcatgtctacttactcgactttcccggctggcgtgccggtgtccgagcgctcattggcgagagcaggtttctactacaccggcgtgaatgataaggtgaagtgcttctgctgcggactgatgctggataattggaaactgggagactcgccgatccagaagcataagcaactctacccatcatgctcctttatccagaacctggttagcgcctcactgggctcaacctcgaagaacacgtcaccaatgagaaactccttcgctcacagcctcagcccgactcttgaacatagctcactgttctccggttcgtactcttcactgtccccgaatcctttgaactcccgcgccgtggaagatatctcatccagcagaaccaacccgtactcctatgcaatgtcgaccgaagaggcgcgcttcctcacctaccatatgtggcccctgactttcctctctccctccgaactggcgcgtgccggattttactacatcggacccggagacagagtggcgtgcttcgcctgcggcggaaaactgtccaattgggagcctaaggacgatgccatgagcgaacaccgcagacacttcccaaactgcccctttctggaaaattccttggaaactctccgcttctcgatcagcaacctgtcgatgcaaacccatgcagcacgaatgcgcaccttcatgtactggccatcctccgtcccggtgcaaccagaacaactggcaagcgcgggtttttattacgtcggaaggaatgacgatgtaaagtgtttctgctgtgatggtgggctccggtgttgggaaagcggggacgacccgtgggtggaacacgccaagtggttcccgcggtgcgaatttctgatcaggatgaagggccaagagtttgtggatgaaatccagggaagatacccgcacttgcttgaacagctcctctcgacttccgacaccaccggcgaagaaaatgctgatcctcctatcatccacttcggaccaggagaatcgtcgtccgaggacgccgtgatgatgaacactcctgtggtcaaatcggccctcgaaatggggttcaacagggatctggtgaagcagactgtccagtccaagattctcacgaccggagaaaactacaagactgtcaacgacattgtctcggcactgctgaacgccgaggacgagaaacgggaagaagaaaaagaaaagcaagccgaggagatggccagcgacgacctttcactgattcggaagaaccggatggctctgttccagcagcttacctgtgtgctcccgatcctggataacctcctcaaagctaatgttattaacaagcaggagcacgacattatcaagcagaaaacgcagatcccactgcaggcccgcgaactcatcgacaccatcctcgtgaagggaaacgccgcagcgaatatctttaagaactgccttaaagagatcgactcaaccctgtacaagaacctgttcgtcgacaagaatatgaagtacataccaaccgaagatgtgtcgggcctgagcctggaggagcaactgcggcgcctgcaagaggagcgcacctgcaaggtgtgcatggacaaggaggtgagcgtggtgttcatcccgtgtggacacttggtcgtctgtcaggagtgcgcgccgtcgctgcggaaatgccctatctgccgggggatcatcaaggggactgtgcggacgttcttgtca

SEQ ID NO: 32184 - DNA, 1854 bp, Artificial Sequence
  Description of Artificial Sequence: Synthetic coding sequence
atgcacaagaccgcatcccagcggctttttccgggaccaagctaccagaatatcaagtccatcatggaggactcaactattctttccgattggactaactccaataagcagaagatgaagtacgatttttcgtgtgaactgtaccgcatgtcaacctactcgacctttcctgcgggtgtcccggtgtcggagcgcagcctcgcacgagcagggttttactatactggcgtgaacgataaggtgaagtgtttttgctgtgggttgatgctcgataactggaagttgggagatagccctatccagaagcataagcaactttacccgagctgttcattcatccagaacctggtgtctgcatcgttgggttccacttccaagaatacctcgccgatgagaaattcgttcgcgcatagcctttcgcctactcttgaacatagttccttgttctccggctcgtactcctcgctctcccctaacccattgaactccagagcagtggaagatatatcgtcctccaggactaacccttactcctacgcgatgtccaccgaggaagcaagatttctgacgtatcatatgtggccccttacctttctttcgccttcggaactggccagagcaggtttttactacattggaccaggggatcgggtggcatgttttgcatgcggtggaaaactcagcaactgggaacctaaggacgatgctatgtcagaacatcggcgccactttccaaactgcccttttctggaaaactccctcgagactcttagattctccatttcgaacctttcaatgcagactcatgcagcccgtatgaggacttttatgtactggcctagctccgtgcctgtgcaaccggaacaattggcatccgcaggcttttactatgtgggtaggaacgatgatgtgaaatgtttctgttgtgatgggggactgcgctgctgggaatccggtgacgatccatgggtggagcacgccaagtggtttccaaggtgtgagttcctgattaggatgaaaggccaggaatttgtggatgaaatccagggcagataccctcacctcctggaacaactgctgtccacctccgataccaccggagaagagaacgcagacccacctatcattcatttcggaccaggagaatcctcgtcggaagatgcagtgatgatgaatacccctgtggtgaaatccgcactggagatgggattcaatcgggacctggtgaagcagactgttcaaagcaagattctcaccaccggcgagaattacaagacggtgaatgatattgtctccgcactgctcaacgcggaagatgaaaaaagggaggaagagaaggagaagcaggccgaggaaatggcgtcagacgacctgagcttgattagaaaaaaccgaatggccctttttcagcagctcacctgtgtgctcccaattcttgacaaccttctgaaggctaacgtgatcaacaagcaagaacatgacattatcaaacaaaagacccaaatacctcttcaagcgcgagagctgatcgatacgattctggtgaaggggaatgcagcagcaaacatcttcaaaaactgtctgaaagaaatcgattccactctgtacaagaatctgtttgtggataagaacatgaagtacattcccaccgaggacgtcagcggactgagcttggaggaacaacttcgtaggcttcaggaagagaggacttgcaaggtttgtatggacaaggaggtgtcagtggtgttcattccttgtgggcacctggtggtgtgtcaagagtgtgcaccgtcacttagaaagtgtcccatttgccgcggtatcattaagggaaccgtgcggacctttctctca

SEQ ID NO: 32185 - DNA, 1854 bp, Artificial Sequence
  Description of Artificial Sequence: Synthetic coding sequence
atgcataagaccgcatcgcaacggctgttccctggcccaagctaccaaaacataaagtccattatggaagattcgaccatcctttcagattggaccaattcaaacaaacagaagatgaagtacgatttctcatgcgagttgtacaggatgtccacttactcgaccttccctgcaggagtgccagtgagcgaaagatcgctggcgcgcgccgggttctactacactggcgtgaatgacaaggtgaagtgtttctgctgcgggctcatgctcgacaactggaagctgggagattcccccattcagaagcacaagcagctttacccctcttgcagctttattcagaaccttgtgagcgcatcgcttgggtcaaccagcaaaaacacttcccctatgcgtaactctttcgctcattcccttagcccgactctggagcattcatccctttttagcggatcctacagctcgcttagccctaatcccctgaacagccgcgcagttgaggatatttcctcctcgaggactaacccatatagctacgcaatgtccaccgaggaggcacgtttcctgacctaccacatgtggcctctgacgtttctttcaccatccgaactcgcaagagcggggttttactacattgggcctggtgatagagtggcatgttttgcatgcggaggtaagctgtcaaactgggaacctaaggatgacgccatgtcggagcaccgcaggcactttccaaactgtccttttctcgaaaactcgcttgagactctgcgctttagcatctcgaatctctcgatgcaaacccacgcagcgcgtatgcgcacctttatgtattggccatcgtcagtgccggtgcagcctgagcaactcgcatccgcaggattctactacgtcggacggaatgacgatgtcaagtgtttttgttgcgatggggggctccgctgttgggagtcgggagatgatccttgggtggaacatgctaagtggttccctcgttgtgaattccttattcggatgaaggggcaggaatttgtggatgagattcaaggtcgctacccacacctgctggaacagctgctctcgacctcggataccaccggagaggagaacgcagacccacccattattcattttggccctggcgaatcgagctccgaggatgcagtgatgatgaacacccctgtcgtgaagtcggcacttgaaatgggttttaacagagatctcgtgaagcaaactgtgcaatcaaagatcttgaccaccggagaaaactacaagactgtgaatgatatagtgtcggcactcctcaacgcagaggatgaaaagcgcgaggaagagaaagaaaagcaggcagaggaaatggcatcggacgatttgtccctgattcgcaagaatcgaatggcactctttcaacaacttacttgcgtcttgcctattctcgacaacctgcttaaagcaaatgtcattaacaagcaggaacatgatatcatcaagcaaaaaacccaaatcccactgcaggcacgtgaactgattgacactatcctggtcaagggtaacgcggctgcgaatatcttcaaaaactgtcttaaggaaattgattcaactctttacaagaatcttttcgtcgataagaatatgaagtatattcctaccgaagatgtgtccggacttagccttgaagagcaactccgcagactgcaggaggaaaggacgtgtaaggtgtgtatggataaggaagtgtcagtcgtgttcatcccatgcggtcacctggttgtgtgtcaggaatgtgcacccagcttgagaaagtgcccaatttgtagaggtatcatcaagggtaccgtgcgaacttttctgtcg

SEQ ID NO: 32186 - DNA, 1854 bp, Artificial Sequence
  Description of Artificial Sequence: Synthetic coding sequence
atgcacaaaacagcatctcagcggctttttcctgggccttcttaccagaacataaaaagtataatggaggatagtacaatcttatctgactggactaattccaataaacagaagatgaaatacgatttctcttgtgagctatatcgaatgtccacatactccacattcccggctggagttccagtgtccgaaaggagtctagctcgcgcagggttctattacacaggggtcaatgataaagtcaaatgtttctgttgtgggctcatgctcgataattggaaactaggagattcaccaattcagaaacacaaacagctctatcctagttgcagtttcatacaaaatctcgtgagtgcttccctcgggtccacttctaaaaacacatcacctatgcgcaactctttcgcacactctctatctcccacactggaacatagttctttattctccggatcatattcttctttgtctcccaatcctctgaactctagagctgtggaggatatatcctcatccaggactaatccttatagttatgcaatgtccacagaggaggctcggttcctgacatatcatatgtggccactcacttttctgagtcccagtgaactcgctagagcagggttctattacatcggacccggggatcgagttgcatgtttcgcctgcggagggaaactgtctaactgggaaccaaaagatgatgctatgtccgaacacaggcggcatttccccaattgtcctttccttgaaaactccctagaaactttgaggttctctatctctaacctcagtatgcagacgcatgcagccaggatgcggactttcatgtattggccttctagtgtacctgtacagcctgaacagctcgcatccgcaggattttattatgtcggacgaaacgatgatgtaaaatgtttttgctgtgatggaggactccggtgttgggaatctggggacgatccctgggtagaacacgccaaatggttccctaggtgtgaattcctaatccgaatgaaagggcaggaatttgttgacgaaatccaggggcggtacccccatcttctcgagcagttactgtctacaagtgatacaacaggggaagaaaatgccgatcctccaatcattcacttcggaccaggggagtcctcatccgaggatgcagttatgatgaatacacccgtggtcaaatccgccctggaaatggggtttaacagggacctggttaaacagactgtccagagtaaaattctgactactggagaaaattataaaacagtaaatgacatcgtgtctgctctcctgaatgctgaagatgaaaaacgggaagaggaaaaagaaaaacaggctgaagaaatggcctccgacgatctatccctaatccggaaaaatcgaatggctctgtttcagcagcttacttgtgtgctccccatacttgataaccttcttaaggctaacgtgataaataagcaggagcacgatataataaagcagaaaactcagattccactccaagcaagggaactgatagatactatcctagtaaaagggaacgctgctgcaaatatttttaagaattgcctaaaagaaatagattctactctgtataaaaacttatttgtagataaaaatatgaagtatattcccacagaagatgtctcagggctctctctggaggaacagcttcgacggctgcaggaagaacgaacttgtaaagtttgtatggataaagaagtctctgtggtcttcataccctgcggacatctcgtggtgtgccaggagtgtgccccttccttaaggaagtgtcctatctgccgcggaatcataaagggaactgtccggacattcctatcc

SEQ ID NO: 32187 - DNA, 1854 bp, Artificial Sequence
  Description of Artificial Sequence: Synthetic coding sequence
atgcacaaaactgcatctcagcgcctctttcccggcccaagctaccagaacatcaagagcatcatggaggactctactattctctctgactggacaaactcaaacaagcagaaaatgaagtacgacttcagctgcgagctgtatcgcatgtccacctatagtacctttccggccggggtccccgtgagtgagagaagtctggcaagggccgggttctactatacgggcgtcaacgataaagtgaagtgcttctgctgtgggctgatgctggataactggaaattaggggactcgcctatccaaaagcacaagcagctgtacccatcatgttcctttatccaaaatttggtctctgccagcctcggttccaccagcaagaacacatcgcccatgagaaactccttcgcccacagcctgagcccaactctcgagcactcttccctgtttagcggatcttatagctcgctgagtcccaacccactcaattcgagagccgtggaagacatatcgagctcccgaacaaatccctacagctacgcgatgagtacagaagaggcacggttcctcacctaccatatgtggcctctcactttcctttccccaagtgagttagcgcgcgccggcttctactatattggccccggggatagggtcgcatgcttcgcttgcgggggaaagctgagtaactgggaacctaaggatgacgctatgtctgagcacagacgccactttccgaactgtccctttttggagaacagtctcgagaccttacggttcagtatcagcaacctctctatgcagacacatgctgcaaggatgaggacgtttatgtattggccaagctccgtacctgtgcagcccgagcagctggcttctgctggcttctactatgtgggtcgaaacgacgacgtcaagtgcttctgttgtgacggaggactgcggtgttgggaatccggggatgatccttgggtggaacacgcaaagtggttccccagatgcgaattcttgattcgcatgaagggccaggaatttgtggacgaaatccagggtcgctacccgcacctgctggaacagttgctatccacgagtgacacgactggggaagaaaatgccgacccaccgataatccatttcggcccgggggagtcgtcaagcgaggatgctgtgatgatgaatactcccgtagtgaaaagcgccctggagatgggatttaaccgggacctggtcaagcagacggtccagagtaagatcctcacaactggcgagaattataaaacggtgaatgacatcgtgtctgcactgcttaacgcagaggatgaaaaacgtgaagaagagaaagagaagcaagctgaagaaatggcgtctgatgacctatccctcattaggaagaatcggatggcactgtttcagcagttaacttgcgttttacctatactggataatctcctgaaggccaatgttatcaataaacaagaacacgacatcatcaagcaaaagactcagattcccttgcaggcgagggaactgatagataccatcctggtcaaagggaatgctgccgcgaacattttcaaaaattgccttaaagagatcgacagcacattgtacaaaaatttattcgtcgataagaatatgaagtacatcccaactgaggacgttagcggcctgtcactggaagaacagctccgccggctccaagaagaacggacgtgtaaggtttgtatggacaaggaagtgtcagtagtttttatcccttgcggccacctcgtggtctgccaggaatgtgcccccagcctgcgaaagtgtccaatttgcaggggaatcataaagggaacggtgcgcactttcctgtcc

SEQ ID NO: 32188 - DNA, 1854 bp, Artificial Sequence
  Description of Artificial Sequence: Synthetic coding sequence
atgcacaaaaccgcctctcagcgactctttccaggcccaagctaccaaaatattaaatcaatcatggaagactccacaatcctgtctgattggaccaacagcaacaaacagaagatgaaatatgatttttcttgtgaactttacaggatgagcacatacagcacctttcctgctggggtcccagtgtctgaacgtagccttgcgcgagctggcttctactacactggcgtcaatgacaaggtgaaatgcttctgctgcggactgatgctcgacaattggaagctgggcgattcccccatccagaaacataagcaactgtatccctcttgctcttttatccagaacctggtgagcgcttcccttggttccacctcaaaaaataccagcccgatgcgaaattccttcgcgcattcactgagccctacactggagcactcctccctgttttctggaagttatagttcactaagcccgaatcccctaaactcccgagccgtcgaggacatcagttcatcccgcactaatccctattcctatgccatgagtacagaagaggcccggttcctaacttaccacatgtggccactgaccttcttgagccccagcgaactggctcgagccgggttctactatatcggccccggcgatagggtggcctgtttcgcatgcgggggcaagttatcaaactgggaaccaaaagacgacgccatgagtgagcaccgacggcactttcctaattgcccgttcttggagaattcactggaaaccctccgattctctattagcaacctaagcatgcagacccacgcggccagaatgcgcacctttatgtactggcccagcagcgtaccagtacagccagaacagctagcgtccgccggattctactatgtcggtcgaaacgatgatgtgaaatgcttctgctgcgatgggggcctgcggtgctgggagtccggtgacgacccttgggtggaacacgccaagtggtttcctaggtgcgagttcctcatacggatgaaagggcaagaattcgtggatgaaatccaaggccggtatccccacctgctggagcagctcctttcaacctcagacactacaggcgaagagaacgcagatcccccgatcattcattttggcccaggcgagagttcgtccgaagatgctgtcatgatgaatacgcccgttgtgaagtctgcacttgagatggggtttaacagagatctcgtaaaacagaccgtccaatccaaaattctgacaacgggcgagaattataagaccgtgaatgacatagtgagcgcactacttaatgctgaggatgagaaaagggaagaggagaaggagaagcaagccgaggagatggccagtgatgacctcagtcttatccggaagaatagaatggccctcttccagcagttgacatgtgtgcttccaattcttgataatctgctgaaagctaatgtgattaataaacaggaacatgatatcattaaacagaaaacacagatccctttgcaggcccgggaattgatagatacaattctagtaaaagggaacgccgcggctaacatctttaaaaactgtctgaaagagatcgactcgacactgtacaaaaacctgtttgtcgataagaatatgaaatatatcccgacagaggatgtgtctgggctcagcctggaggaacaactgcggagactccaggaggagaggacgtgcaaagtgtgcatggataaggaagtgagcgtggtgtttatcccctgcggccacctagttgtttgccaggagtgtgctccctcgctgaggaagtgccccatctgtagaggcatcatcaagggcactgtgcgcacctttctcagt

SEQ ID NO: 32189 - DNA, 1854 bp, Artificial Sequence
  Description of Artificial Sequence: Synthetic coding sequence
atgcataagacagcttcgcagaggctgtttccaggccctagctaccaaaacataaagtccatcatggaagattccacaatcctgagcgactggactaactctaacaagcagaaaatgaagtatgatttctcttgcgaactctatcgcatgtccacctacagcacttttcccgcaggcgtccccgtgagcgaacgctccttagcaagagcgggcttctattataccggcgttaacgacaaggttaagtgcttttgctgtggtctgatgctcgataactggaagctgggcgattccccaattcagaagcacaagcagttgtaccctagctgcagctttattcaaaacctggtgagtgcatccctgggaagcacctcaaaaaacacatcacctatgcggaactcattcgctcacagcttgtccccaaccctggagcatagtagcctcttctcagggtcatattcctctctttctcccaacccactgaacagcagagccgtcgaagacatctctagctcccgtaccaacccatactcctacgcgatgtcaactgaggaagcaaggttcctgacttaccatatgtggcccctgacattcctgagccccagcgaattggctcgtgcaggcttctactatatcggcccgggggaccgcgttgcttgttttgcctgcggagggaagttgtctaattgggagcccaaggacgacgctatgtcagagcaccggagacattttccgaactgcccctttcttgagaacagccttgagactctgaggttttccatttcaaaccttagcatgcaaacacacgctgcgaggatgcgcacctttatgtactggccttcgtcagtacctgtgcaacctgaacagctcgcttccgctggtttttactacgttgggcgaaatgatgatgttaaatgtttttgctgcgacggaggcctgcgctgttgggagagtggggacgatccatgggtggaacacgctaagtggttcccgagatgtgaatttttaatcaggatgaaaggccaagaatttgtggacgagatccagggaaggtacccccatcttctggaacaactgctgtccacaagtgacactaccggagaggagaacgctgatccaccaatcatacactttggcccaggagagtcaagctcagaagacgcagttatgatgaatacccctgtggtcaagagcgcactcgaaatggggtttaacagagacctggtgaagcaaacagtgcaaagcaagatactcacaaccggagaaaattataaaaccgtgaacgatatcgtgagcgcgctgttaaacgccgaggatgaaaagagagaagaagaaaaagaaaagcaggcagaagaaatggcaagcgatgacctgtcactcatcagaaagaatcgtatggccctgttccagcagctgacttgtgtcctccctatcctcgataacttgctgaaagctaatgtgatcaacaaacaggagcacgacatcatcaaacaaaaaacccagatccccctgcaggctagagaactcattgatacaatcttggtgaagggcaacgctgctgccaatatctttaagaactgtctaaaagaaatcgatagcaccctctacaagaatctttttgtcgacaaaaacatgaagtatatcccaacagaagacgtttctgggttgagcctggaggaacagctgcgcaggttgcaggaggaaaggacttgcaaggtgtgcatggataaagaagtttcagtcgtgtttataccatgtggacacctggttgtgtgccaggagtgtgctccaagcttgcgcaaatgccccatctgcagaggtatcatcaaaggcacggttcggactttcctttct

SEQ ID NO: 32190 - DNA, 1854 bp, Artificial Sequence
  Description of Artificial Sequence: Synthetic coding sequence
atgcataagaccgcaagccaacggttgttcccaggaccaagctaccagaatatcaagtcgatcatggaggattccaccattctctccgactggaccaactcgaacaagcagaaaatgaaatacgatttttcatgtgaactgtatcgcatgtccacttactctacttttcctgctggcgtccctgtgtccgagagatcactcgcgcgcgcagggttctactacaccggtgtgaatgacaaagtgaaatgtttttgttgtggactcatgctcgataactggaagctcggagattccccaatccaaaaacataagcagctgtacccatcctgtagctttattcagaaccttgtgagcgccagcctcggatcgacttcgaaaaacacgagccctatgagaaattcctttgctcattctctttcgcccactctcgagcactcctcgcttttctccggttcctacagctcgctgtcgcccaacccgcttaattcccgggcggtcgaggacatttcgtcgagccgtactaatccttacagctacgcaatgagcactgaggaggcaagatttttgacttaccatatgtggccactgaccttcctgtcgccttccgaattggcccgcgcaggtttttactacatcggtccaggagatagagtggcatgctttgcgtgcggaggcaagctgtcgaactgggaacctaaggatgatgcaatgtccgagcatcggcggcactttccaaattgtcctttcctcgagaattcgctcgaaacccttcggttctccatatcgaacctgagcatgcaaacccatgccgcccgcatgcgtaccttcatgtactggccctccagcgtgcccgtgcaacctgagcaactggcatcggcagggttttactacgttggacgtaatgatgacgtcaaatgtttctgctgtgacggagggcttcgatgctgggagtcgggggacgatccctgggtggaacatgcaaagtggtttcctcggtgcgaattccttattcgcatgaagggccaggaattcgtggatgaaattcaaggccgctacccacatctgcttgagcaactcctgtcgacctcggatacgaccggcgaagagaacgctgaccctccgatcattcacttcgggcctggcgagtccagcagcgaagatgcggtgatgatgaacacccctgttgtgaagtccgccctggaaatgggattcaatcgtgacctggtcaagcaaaccgtccagtcaaaaatccttaccaccggtgaaaactacaaaacggtgaatgatatcgtgtcggccctccttaatgcagaggacgagaagagggaagaagaaaaagaaaagcaagccgaagaaatggcctcggatgacctttcgttgatccgcaaaaatcggatggcgctttttcagcagctgacctgtgtgctccctatactcgacaacctcctgaaggccaacgtgattaacaagcaagaacacgacataatcaagcagaaaacccaaatcccccttcaggcaagggaattgattgataccatcctggtcaagggtaatgcggcagcgaacatattcaagaattgcctgaaggaaattgattccaccctctacaagaatctgttcgtggataagaacatgaaatacattcccacggaggacgtttccggactttcacttgaggaacaacttcggagactgcaggaagagagaacctgcaaggtttgtatggataaagaagtgtcggtggtctttatcccttgcggtcatctggtcgtgtgccaagaatgcgcaccctctctgcggaagtgtcctatttgtagaggcattatcaagggtactgtgcgcactttcctgagc

SEQ ID NO: 32191 - DNA, 1854 bp, Artificial Sequence
  Description of Artificial Sequence: Synthetic coding sequence
atgcacaaaacggcttcccaacggctgtttcctgggcctagttaccaaaacatcaagtccatcatggaggattctaccattctgtctgattggactaactccaacaagcagaagatgaagtacgacttctcctgcgagctctatcgtatgtcaacctattctacatttcctgccggagttccggtgtccgagcgtagcctggcccgtgctggtttctattacacaggcgtgaatgataaggtgaaatgcttctgttgtggccttatgctggacaactggaagctcggagacagtccaattcaaaaacacaagcaactttatccatcctgctcattcatccaaaacctggtgagcgcatctctggggagcacatccaagaatacgtcacccatgcgaaactcatttgcccacagtttatctcccactctcgaacattcgtctctgttctccggatcttattccagcttgtcccccaatcccctgaatagcagagccgtggaagatattagtagtagcagaacaaacccctacagctacgctatgagcactgaagaggcccgattcttgacctaccacatgtggcccttaacctttcttagtccgtccgagctggcccgcgccggtttctactatattggacctggagacagggtggcctgtttcgcctgtggggggaaactttcaaattgggaacccaaggatgatgcaatgtctgaacatcgccgccatttccccaactgcccctttcttgagaactccctcgagactctgcgattttccatttcgaatctgtcaatgcagacacacgccgcgaggatgcgaacttttatgtactggccttcttccgtgccagtccagcctgagcaactggctagtgccggattctactacgtaggacgcaatgacgacgtaaagtgtttctgctgcgacggggggctccggtgctgggagagcggagatgatccttgggtggaacacgccaagtggtttccgcgatgcgagtttttgatcagaatgaagggacaggaatttgtggatgagatccagggtcggtatccacaccttctcgagcagctcttatcgacatccgacaccaccggggaagagaacgccgatccacctatcattcattttggtccgggagaaagttcaagcgaggacgctgtgatgatgaatactccagttgtaaagtctgccctcgaaatgggctttaatagggaccttgttaagcagaccgtgcaatctaagattctcactaccggcgagaattacaagactgtgaatgacatcgtgtctgctttacttaatgccgaagatgagaaaagagaagaggaaaaggaaaaacaggcggaagagatggccagcgatgacctgtccctgataaggaagaacagaatggcacttttccagcagctaacttgtgtattacccattctggataacctcctgaaggcaaacgtgattaataagcaggagcacgacatcatcaagcagaaaacgcagatccctctccaggcccgcgagctgatcgataccattctggtgaaaggcaacgctgctgccaatatatttaaaaattgtctgaaggaaatcgatagtacactgtataagaatcttttcgttgacaagaatatgaagtatattcccacggaagacgtgtccggattgagccttgaagagcagttacgacggctgcaggaagagcgcacctgcaaggtttgcatggataaggaagtatccgtagtatttataccgtgcgggcatctggtggtctgccaggagtgtgcaccgtcactgcgaaaatgtcccatctgcagaggtatcattaagggaacagttagaacgtttttgagt

SEQ ID NO: 32192 - DNA, 1854 bp, Artificial Sequence
  Description of Artificial Sequence: Synthetic coding sequence
atgcataaaaccgcgagccagagacttttccctggcccgagctaccaaaatattaagtccattatggaggactccactattttgtctgattggacgaactctaacaagcagaagatgaagtatgatttttcatgcgagttatatagaatgagtacctattcaacctttccagctggggttcctgtgagcgagaggtctttggctcgcgccggattctattacacaggtgtcaacgataaggtcaagtgtttttgctgcggcctcatgctagataactggaagttgggagatagcccaattcagaagcataaacagttatacccatcatgctctttcattcaaaatctggttagcgcgtctttgggatcgacatcaaagaatacatctcctatgagaaactctttcgcacactcattatctcctacgttagaacattccagcttgttcagtggatcttattccagtctttcccccaatccattgaatagccgcgcagtggaggatatctccagcagtcgcaccaacccctattcctatgccatgagcacagaagaagccaggtttctcacttatcatatgtggccccttacattccttagtccttctgaactcgctcgggctgggttttattatattgggcctggcgatcgtgtggcttgctttgcctgcggtggaaagctttcaaattgggagcctaaggatgacgctatgtccgaacaccggaggcatttcccgaactgtccatttcttgagaattctttggaaactctaagattttcaatctctaatctgtcaatgcaaacccacgctgcccgtatgcgaacttttatgtactggccctcgagtgttcctgtgcagcctgaacagttggcaagtgctggattctactacgttggccgtaacgacgatgtgaaatgcttttgctgtgacggtggtcttcgatgctgggagagcggagatgatccatgggttgaacatgctaaatggttccctaggtgcgaattcttaatcaggatgaagggacaagagtttgtagatgagattcaaggcagatatcctcacctccttgaacaacttctctcaacatccgatacgaccggggaggaaaatgcagatcctccaattatccactttggacctggagaatcttcgtccgaggatgctgttatgatgaacaccccagtggttaagagcgcactagagatggggttcaatagggaccttgttaagcagacagtgcagagtaagatcttgaccactggggaaaattacaaaacggtgaatgacatcgtttctgctctactcaatgctgaggacgaaaagagagaggaagagaaggaaaaacaggcagaagagatggcgtcagatgacttgagtttgattagaaagaaccgtatggcgttatttcaacagcttacatgcgtccttccaatactcgataacctcctcaaagccaacgttattaataaacaggagcatgacattattaagcaaaaaactcaaatcccccttcaggcacgagagttgattgatactatcttggtaaagggaaatgcagcggcgaacatattcaaaaattgcttaaaggagattgacagtacactttacaagaacctatttgtggacaagaatatgaaatacattcccaccgaagacgtgagtggtcttagtcttgaagagcagttgaggagattgcaggaagagcgcacttgcaaggtgtgcatggataaggaagtgtctgttgtgtttatcccttgcggacacctggttgtatgccaggagtgtgcaccaagccttcggaaatgtcctatctgtcggggtattattaaaggtactgtaaggacatttttgtca

SEQ ID NO: 32193 - DNA, 1854 bp, Artificial Sequence; identical to SEQ ID NO: 32188
  Description of Artificial Sequence: Synthetic coding sequence

SEQ ID NO: 32194 - DNA, 1854 bp, Artificial Sequence
  Description of Artificial Sequence: Synthetic coding sequence
atgcataagaccgcatctcagaggcttttcccgggaccgtcatatcaaaacatcaagagcataatggaagattcgaccatcctctcagactggactaattccaacaagcagaaaatgaagtacgacttctcctgcgagctgtacagaatgtcgacctactccactttccccgccggagtgccggtttcagaacgttccctggcacgcgcgggattttactatactggggtgaatgacaaggtgaaatgcttctgttgcggcctgatgctggataattggaagctcggcgattcgccaatccagaaacacaagcagctctacccctcgtgctccttcatccagaacttggtgtcagcgagcctcggctccacctcaaaaaacacctcaccgatgaggaacagtttcgcgcatagcttgtcgcccactcttgaacactcgtccctcttctcggggagctattcatcgctgagccctaaccctctgaattctcgcgccgtggaggacatcagctcgagccggactaatccctactcctacgcgatgtcgacggaagaagcacggttcctgacctaccacatgtggccgcttacttttctgtcccctagcgagctggctcgcgcaggattttactacattggaccaggtgaccgcgtggcttgcttcgcctgtggcgggaagctgagcaattgggagccgaaagacgatgcaatgtccgaacatcgccgccatttcccgaactgccctttcttggaaaattcgctggaaactctgcgcttttccatctccaacctgtcaatgcagacccacgccgctcgcatgcgaaccttcatgtactggccatcgagcgtccccgtccagccggaacaactggcctccgctggcttctactacgtcggacggaacgacgacgtgaagtgcttctgctgcgacggagggctgagatgctgggagtcgggagacgatccatgggtagagcacgctaagtggttcccgcgctgcgagtttcttatcagaatgaaaggtcaagaatttgtggacgaaatccagggtagataccctcacctcctcgaacagcttctgtcgacttcggacaccacgggagaggagaacgccgacccaccgatcatccatttcggacctggtgagtcctcttcagaggatgccgtgatgatgaacactccagttgtaaaaagtgcgcttgagatgggattcaatcgcgaccttgtaaaacagacggtccaaagcaagatcctgactacgggcgagaactacaagaccgtcaacgatattgtctctgccctgctcaacgcggaagatgaaaagcgtgaagaagagaaggaaaagcaagcggaagagatggcttcggatgatctctccctgatacggaaaaacaggatggccctgttccagcagttgacctgcgtgcttcctattctcgataatctcctgaaggcaaatgtgatcaacaaacaagaacacgatatcatcaagcaaaagactcaaatcccgttgcaggcccgggaattgatcgacactatcctggtgaaaggcaacgcggccgccaatatctttaagaattgtctgaaggagattgactcaaccctgtacaagaacctgtttgtggacaaaaacatgaagtacatcccaactgaggacgtgagcggcctctccttggaagagcagctcagacgccttcaggaagagcggacctgtaaagtgtgtatggacaaggaagtctcggtcgtgttcattccatgcggccacctcgtggtgtgccaagaatgcgccccgagcctccggaagtgcccaatctgtcgtggaatcatcaagggaaccgtccgaaccttcctgagc

SEQ ID NO: 32195 - DNA, 1854 bp, Artificial Sequence
  Description of Artificial Sequence: Synthetic coding sequence
atgcacaaaactgcatcgcagcgcctgttccctggaccgtcctaccagaacatcaagtctatcatggaggactccacaatactcagcgactggacgaattcgaataaacagaagatgaaatatgacttctcctgcgagctgtaccggatgtctacctatagcacgtttccagccggagttcccgtgtctgagcggagtctggctagggcagggttttactataccggagtcaacgacaaagtgaaatgcttctgttgcggacttatgctggataattggaagctcggcgatagtccaattcagaagcacaagcagctatatccttcttgctcctttatccagaacctggtcagcgcgtctcttggcagcacttctaagaataccagtcctatgagaaacagcttcgcccactccctgtccccaacgttggaacattcttcccttttctcaggcagctactcatccttgtcaccgaatccattgaacagccgtgctgtcgaggacatctcttcctccaggactaacccttacagctacgcaatgagtaccgaagaggctagatttctgacttaccacatgtggccgctcacattcctttctccctctgaactggcccgcgccggattttattacatcggtcccggcgatagagtggcttgttttgcctgcggaggcaagctgtctaactgggagcccaaggatgatgcaatgagcgaacacagaagacactttcctaactgccccttcctggagaacagtctggagacattgcggttttccatttcgaatcttagtatgcaaactcacgcagcccggatgagaacctttatgtactggcctagcagtgtccccgtgcagcctgaacagttggcctccgcagggttctactacgtgggaagaaacgacgatgtgaagtgtttctgctgtgacggtggacttcgctgctgggaaagtggagacgacccctgggttgaacacgctaaatggtttccaaggtgcgagtttctaattcgaatgaagggccaagagtttgtggatgagatccagggcagatacccccatttacttgagcaactgctctcaactagcgatactactggcgaagaaaacgccgaccctcccatcattcattttggccctggcgaaagttcctctgaagacgctgttatgatgaacaccccagtggtgaagtctgctctggagatgggattcaatcgcgacctcgtgaagcagactgttcaaagtaaaatcctgacgactggtgagaactacaagactgttaacgatatcgtctctgcattgcttaatgccgaggatgagaaacgggaggaagaaaaggagaagcaggctgaggagatggcctccgatgacctgtctttgatcaggaagaaccggatggccctgtttcaacagctaacttgtgtgctccctattctggataatctgttgaaggccaacgtgatcaataagcaggagcatgatattattaaacagaaaactcagataccattgcaggcgcgagagcttatcgatactatccttgtgaagggcaatgccgccgctaatatctttaagaactgcctgaaggaaatcgatagcaccctatacaaaaatctctttgtggataaaaatatgaaatatatccctactgaggatgtcagcgggctcagcctggaggaacagttgcggcggctgcaggaggagcgcacctgtaaagtgtgcatggacaaggaagttagtgtcgtcttcattccgtgcggccatctggtggtgtgccaggagtgtgccccgagcctgcgcaagtgcccaatttgtcgcggcattatcaagggaaccgttcgaacctttctcagc

SEQ ID NO: 32196 - DNA, 1854 bp, Artificial Sequence
  Description of Artificial Sequence: Synthetic coding sequence
atgcataagacggcgtctcaacgactcttccccggtccgtcatatcaaaacatcaaatccattatggaggatagcaccattctgtctgattggactaattcgaacaaacaaaagatgaagtacgactttagctgcgaactgtacaggatgtcaacgtactccacttttcccgcaggtgtgcctgtgtccgaacgaagcctggcacgtgcagggttctactacactggtgtgaatgataaagtgaagtgtttttgttgcggactcatgctggacaactggaagctcggtgattctccaattcagaaacacaaacagctgtacccctcgtgctccttcatccagaatttggtgtccgcatcgcttggatcgacttcaaagaacaccagcccaatgcgcaactcctttgcccactccctgtccccgactcttgaacattcgagcctgttctcagggagctattcatcgctgagcccaaatccactcaattccagggccgtggaggacatttcgtcatcgaggactaacccatattcatacgcaatgtcgacggaagaggctaggttcctgacttaccatatgtggcctcttaccttcctcagcccatcagaactggcccgggcaggcttttactacattggcccaggggatcgcgtggcttgttttgcctgcggaggaaaactttcgaactgggaaccaaaggatgatgctatgagcgaacaccgccgacattttccaaactgtccttttctcgaaaactctcttgaaactcttcggttttcaatttcaaacctttcgatgcaaacccatgccgcaagaatgcgcaccttcatgtactggccgtcctcggtgcccgtccagcctgaacaactggcatccgccggtttttactacgtcgggcgcaatgacgatgtgaagtgtttctgctgtgacggaggacttcggtgttgggaaagcggagacgatccgtgggtggagcacgcaaaatggttcccacgttgtgaatttcttattaggatgaagggtcaagagtttgtcgacgaaatacagggtcgctacccacatcttcttgagcagcttctttcgacttcagacactaccggcgaagagaatgcagatcctcccatcatacattttggacctggagagtcaagctctgaggatgcagtgatgatgaatactcccgtggtgaagtccgcacttgagatgggatttaacagagatctggtgaagcagacggtgcaatcaaagatcttgaccaccggcgaaaactacaagactgttaacgacattgttagcgccctcctgaatgcggaggatgagaagagagaagaagagaaggaaaagcaggccgaagagatggcgtctgacgatctctcactgattagaaaaaaccggatggcgctttttcaacaattgacctgcgtgctgcctattctggataacctcctgaaggccaacgtcataaacaagcaagaacacgacatcataaaacaaaagacccaaattccactgcaagctagagagttgatcgataccattcttgttaagggaaatgcagccgcaaacatcttcaagaattgtcttaaggaaatcgattctaccctttacaaaaacctttttgtggacaagaacatgaagtacatcccaaccgaggacgtgagcggcctttctctggaggaacaactccggagactgcaagaagaacgaacctgcaaggtgtgtatggataaagaagtctccgtggtctttatcccatgtggacatcttgtggtttgccaggagtgtgcaccgtcacttcgtaagtgtccaatttgtagaggcatcatcaagggtacggttcggacttttctgtct

SEQ ID NO: 32197 - DNA, 1854 bp, Artificial Sequence
  Description of Artificial Sequence: Synthetic coding sequence
atgcataagaccgccagccaacgcctctttccgggaccgtcctaccagaatatcaagagtatcatggaggactcaaccattcttagcgactggaccaactcgaataagcagaagatgaagtacgacttctcatgcgagttgtacagaatgtcgacgtactccacgttcccagcaggagtgccggtgtcggaaaggtctttggcacgagccggattttactacactggcgttaatgacaaagtcaagtgcttctgttgcggacttatgctcgataattggaaattgggcgattcacctatccaaaaacataagcagctgtatccgtcatgcagtttcatccaaaacctggtgagcgcctcgctcggctccacttccaagaacacttctccgatgcgcaatagctttgcccactccctgtcgccgactctggaacattcctccctgttctccggatcgtactcaagcctctcaccaaacccactcaactcaagagcggtggaagatatttccagctcacgcaccaatccttactcgtatgccatgtccactgaggaggcccggttcctcacctaccatatgtggccgcttaccttcctctcgccgtccgagctggccagagctggcttctactacatcggcccgggcgaccgcgtcgcctgtttcgcatgtggaggaaagctgagcaactgggagccgaaggacgacgccatgtccgagcaccggcgacactttccgaattgtcccttcctggagaactcactcgaaacgctccggttctcaatctcgaatctgtcaatgcagactcatgcggcgagaatgcggaccttcatgtactggccgtcaagcgtgcctgtgcagccggaacagctggccagcgcgggtttctattacgtggggagaaacgacgatgtgaagtgcttttgctgtgacggtgggttgcgctgctgggaatcgggggatgacccgtgggtcgagcacgctaagtggttcccgaggtgcgagttcttgattcgaatgaaaggacaagaatttgtcgatgaaatccaggggcgctacccacacctcctcgaacagctcctgtccactagcgatactactggggaagaaaatgcagaccctccgatcattcatttcggacctggagagagctcgtccgaagatgccgtgatgatgaataccccggtcgttaagtcggcgctggagatgggcttcaatcgggacctcgtgaaacagacggtgcagagcaagatcctcactactggggagaattacaaaactgtgaacgatatagtatcggctttgctgaatgcagaagatgagaagcgggaggaggagaaagaaaagcaggcggaagaaatggcatccgacgatctgtccctcattagaaagaaccggatggccctgttccagcagctgacctgtgtactgccaatcctggacaacttgctgaaggccaacgtgatcaacaagcaagagcacgatatcatcaagcagaaaactcaaatcccgctccaggcacgggaattgatcgacaccatccttgtgaagggaaatgccgcggctaacatctttaagaattgcctgaaggaaatcgacagcactctttacaagaacctcttcgtggacaagaatatgaaatacatcccaactgaggacgtgtccggactttctctcgaggaacaactgcggcgcctccaggaagaaagaacttgcaaggtgtgcatggacaaggaagtcagcgtggtgttcatcccttgcggtcacctcgtggtgtgccaggagtgtgcgcccagcctcaggaaatgcccgatttgccgcggaatcatcaaggggactgttcggaccttcctttca

SEQ ID NO: 32198 - DNA, 1854 bp, Artificial Sequence
  Description of Artificial Sequence: Synthetic coding sequence
atgcacaagacggccagccaacgcctttttccgggacctagctatcaaaacatcaagagcatcatggaggacagcaccatactgtccgattggaccaactctaacaaacaaaagatgaagtacgatttcagctgcgagttgtaccgaatgtccacgtacagcacgtttccagcgggtgtgccggtgtcagagcggagcctggcgagagctggcttttactatacaggcgttaatgacaaggttaagtgcttctgctgtggtctgatgctggacaattggaaactgggggattcgcctatccagaagcataagcaactgtatccttcttgttcctttatacagaaccttgtgagcgcatctctcggaagcacgagcaagaacacgagcccgatgcgcaactctttcgcccacagcttgtcaccaaccctggagcatagctccctgttctctggtagttatagcagccttagcccgaacccactgaattctagagccgtcgaagacattagcagtagccgcacgaatccttatagctacgcaatgagcacggaagaggcgcgcttcctgacgtatcatatgtggccactgacctttctctcgccgagcgagctggcgcgcgctggcttctactacattggcccgggtgaccgcgtggcgtgcttcgcatgcggcggtaagctgtctaattgggaacctaaagatgacgcaatgagtgaacaccgtcgtcatttccccaactgtccctttttggagaacagtttggagactctgcgctttagcatcagcaacttgagtatgcagacccatgccgcacgtatgcgcacttttatgtactggccaagcagcgtgcctgtgcagcctgagcaattggcgtccgccggtttttattacgttggccgcaacgatgacgtgaagtgtttctgttgcgatggcggcctccggtgttgggagagtggagatgacccgtgggtggagcacgccaagtggttcccacgctgtgagtttctgatccgcatgaaagggcaagaatttgtagatgagattcagggtcgctacccacatctgctggagcaactgctgtccacctctgataccacgggtgaggaaaacgcagatcctcctatcatccactttgggcccggcgagtcctcaagcgaggacgcggtcatgatgaacacccctgtggttaagtccgcgctggaaatggggtttaatcgtgatctggtgaaacagactgtccagtctaagatcctaaccaccggggagaactataagactgtgaacgacattgttagcgccctactgaacgccgaagacgaaaaacgcgaggaggaaaaggagaagcaggcagaggaaatggcatctgacgacttgtcactgatcaggaagaatcgcatggctctcttccaacagctcacgtgtgtgctgcccattctggataacctactaaaagcgaacgtgattaacaaacaggaacacgatatcatcaagcagaagacgcagatcccgctgcaggcaagggagctgattgatacaatcctggtcaaaggtaatgccgctgcgaatatctttaaaaactgcctgaaggaaattgatagcacgttatacaaaaacctgttcgtcgacaaaaacatgaagtatatacctaccgaagacgtctccggactctcattggaggaacagctgcgcaggctgcaagaggaacgaacctgcaaggtgtgcatggacaaggaagtgagcgtcgtttttatcccatgcgggcacctggttgtttgtcaagaatgcgcgccatctttgcgcaaatgccctatctgcaggggcatcatcaaaggtactgtgcgcaccttcctttcc

SEQ ID NO: 32199 - DNA, 1854 bp, Artificial Sequence
  Description of Artificial Sequence: Synthetic coding sequence
atgcataaaaccgcctcccaaagactgttcccaggaccgagctaccaaaacattaagtcgattatggaggatagcaccatcctctccgattggactaactccaacaagcagaagatgaagtacgacttttcatgtgaactctaccggatgtccacttactccacttttcctgcaggtgtcccagtctcggaacggtcactggcaagagcaggattctactacaccggagtgaatgacaaagtgaaatgtttttgttgcggcctgatgttggataactggaagctgggagattcccctatacaaaagcataagcaactttacccgtcgtgttcgtttatccagaacctggtgtcggcatcgctgggttcaacttcgaagaacactagccctatgcgcaattcgtttgcacattccctgtcgccaacgttggaacattcatctctcttctcgggttcatactcgtctctctcgcctaatcctctgaatagccgtgcggtggaagatatttcctcctccaggaccaacccttattcatacgccatgagcaccgaagaggcacgattccttacttatcatatgtggcctctgacctttctgtcgccaagcgaacttgcacgcgcaggcttctactatatcggtccgggtgatagagtggcgtgctttgcatgcggaggcaaactcagcaactgggagcctaaagatgatgccatgtccgagcatcggagacattttccaaactgtcctttccttgaaaattcgctggaaactttgcggttttccattagcaatctcagcatgcaaacgcacgcagcaaggatgcgcaccttcatgtactggccctcgtcagtgccagtccagcctgagcagcttgcatcagcgggcttctactacgtcggacggaacgatgacgtgaaatgcttctgttgtgatggagggcttagatgctgggaatcgggagatgatccttgggttgagcacgccaaatggttccctaggtgcgaattccttataagaatgaagggacaagagttcgtcgatgagattcaggggaggtacccacatcttctcgaacaactgttgtcgaccagcgacaccaccggtgaggaaaatgctgatcccccaatcatccacttcggtcctggcgagtcgtcgtcggaggatgcagtgatgatgaatactcctgtcgtgaaatcagcattggagatgggctttaatcgagatttggttaagcagacggtccaatcaaagattttgaccacgggtgagaattacaaaaccgtgaatgacattgtgagcgcgctcctgaacgccgaggacgaaaagcgcgaagaggaaaaggagaagcaggcagaagaaatggcaagcgatgacctttcgcttattcgcaagaacagaatggccctgtttcagcagctcacctgtgtcctgccaattcttgacaatcttctgaaggcaaacgtgattaacaagcaagagcatgacatcattaaacaaaagacccagatccctctccaagccagagagctcatcgacactattcttgtcaagggtaacgcagcggccaacattttcaagaactgtctgaaggagattgactcgaccctttacaagaacctgttcgtcgataagaacatgaagtacataccgaccgaagatgtaagcggactttcacttgaagagcaacttcggagacttcaggaggaaagaacttgtaaggtgtgcatggataaagaggtgtcagtggtgtttattccatgtggacatcttgtggtgtgtcaagagtgcgcgcctagcctcaggaaatgccctatctgtaggggtatcattaagggcacggtgcggaccttcctttcg

SEQ ID NO: 32200 - DNA, 1854 bp, Artificial Sequence
  Description of Artificial Sequence: Synthetic coding sequence
atgcataagacggcctctcaacggctgttccctggtccttcataccagaacatcaagtcgataatggaagattccaccattctgtcagattggaccaactccaacaagcagaaaatgaagtacgatttttcgtgcgagctctacagaatgtcgacctactcaacttttccagcaggggttcctgtctctgaacggtcactggcgcgtgcaggattctactacactggcgtgaatgataaggttaaatgtttctgttgcggccttatgcttgacaactggaagctgggggactccccaattcaaaagcataaacagctttacccttcctgtagctttattcagaatttggtgtcggcatcgcttggaagcactagcaagaacactagcccaatgaggaatagctttgcacactcgctgtcccccacgctcgaacactcgtctctgttcagcggctcctacagtagtctcagcccgaatcctttgaactcccgggcggtggaggacatttcttcgtcccgtacgaacccatactcttacgccatgagcaccgaggaagcaaggtttcttacgtaccatatgtggcccctgacctttctttccccaagcgaactcgcaagagctggtttctactacataggtcctggagatagggtggcgtgcttcgcatgtggggggaaactctcaaactgggaaccaaaggatgatgcaatgtcagaacacaggcgtcattttcctaattgcccttttcttgagaattcgcttgagacgcttagattctccattagcaacctctctatgcagacccatgcagccagaatgagaaccttcatgtactggcccagctcggttcccgtccagccggaacagctggcctccgcaggtttttactatgttggacgaaacgacgacgtcaagtgtttttgctgtgatggaggtcttaggtgctgggaatcgggagatgatccctgggtggaacatgcgaagtggttcccacggtgtgaattcctcatcagaatgaaagggcaggagttcgtcgacgagatccagggaagatatccccacttgctggagcaacttctgtcgacctccgacaccaccggagaagaaaatgccgatcccccgataatccactttggacctggtgaatcatcatccgaagatgctgtcatgatgaacaccccagtagtgaagtccgcactggagatgggttttaaccgcgatttggtgaagcagactgtgcaaagcaagattctgactactggagaaaactacaaaactgtgaacgatattgtgagcgccctcttgaacgcagaggacgagaaacgggaggaagagaaggaaaagcaagctgaggaaatggcatccgacgatttgtcgcttattagaaagaatcgtatggcactgtttcaacaactgacttgtgtgcttcctatcttggacaaccttttgaaagcaaatgtgataaacaagcaggaacacgacattatcaaacaaaagacccagatccctctgcaagcaagggagcttattgatactatcctggtgaaaggcaacgcagctgccaacattttcaagaattgtcttaaggagatagacagcactctgtataagaatctttttgtggacaaaaacatgaaatacatcccgactgaggatgtgtcaggactgtcattggaagaacaattgcgtcgcctccaagaagaacggacctgcaaggtatgtatggataaggaggtcagcgtggtgtttattccttgcggtcaccttgtggtctgtcaagaatgtgccccgagcctccgaaagtgccctatttgtcgcggaattatcaaggggaccgtgcggacttttctgagc

SEQ ID NO: 32201 - DNA, 1854 bp, Artificial Sequence
  Description of Artificial Sequence: Synthetic coding sequence
atgcacaagactgcgagccagaggctctttccaggaccatcttaccagaacatcaagtccatcatggaagacagtaccattctcagcgactggaccaattcaaacaagcagaaaatgaagtatgattttagctgcgaactttacagaatgagtacctattccacattcccggccggcgtgcccgtgtcagagagatcactggcacgagccggattttactataccggcgtaaacgataaggttaaatgtttttgttgcggacttatgttggataattggaaactgggcgattctcccattcagaagcataaacagctatacccttcttgcagctttattcaaaacctggtcagtgcttcactggggtccacaagcaaaaataccagtcctatgcgaaactctttcgcccacagcctgagtcctactttagaacatagctcgctgttcagcggttcctattcgtccctcagtcctaatcctctgaactcccgagctgttgaggacatctcgtccagccgaacaaacccctattcctacgcaatgtctaccgaggaggccagattcttgacctaccacatgtggcctcttaccttcctctctccttcagagctcgccagggccggcttttactacattggccccggcgatcgagtcgcctgcttcgcctgcgggggaaagctttcaaattgggaacccaaagacgacgccatgagtgagcatagacgacatttcccgaactgtccctttctcgaaaattctttggagaccctacgattctccatctccaatttgagtatgcagacgcacgcagccagaatgaggaccttcatgtactggccttcgtcagtccctgtccagcccgagcagctagccagtgctgggttttactatgtgggtcgaaacgatgatgtgaagtgcttctgctgtgacggagggctcaggtgctgggagagtggagacgatccctgggtcgaacacgcaaaatggtttcccaggtgtgaatttctaatacgaatgaagggacaggagttcgtagatgaaattcaggggcgatatccacatctgttagagcagttactgtccacctctgatacaactggcgaggagaacgcggacccgcccataatccatttcggtcctggagaatcaagttccgaggatgcagtaatgatgaacacacccgtggtcaaaagcgccctggaaatgggtttcaaccgagatttagtgaaacagaccgtgcagtctaaaatcctgaccaccggtgaaaattataagacggttaatgatatcgttagcgcacttttaaatgcggaggacgagaaacgtgaagaggaaaaggaaaagcaagcagaagagatggctagtgacgacctgtctttgattcgaaaaaacaggatggctctctttcagcagttgacttgtgtgctgcccattctcgataacctgttaaaggccaacgttattaataaacaggagcacgatatcattaagcagaaaactcagattcctttgcaggcccgagaacttatcgataccatcctcgttaaaggtaatgctgcggctaatatatttaaaaactgcctcaaggagatagattctacgctttacaaaaacttgttcgtggacaaaaacatgaaatatatacctacagaagatgtgtcgggactttcgttggaagagcagctaagacgcttgcaggaggagcgcacctgtaaggtgtgtatggataaggaggtcagcgtcgtgttcattccctgcgggcacctagtcgtctgccaggaatgcgctccctccctccgaaagtgcccaatttgtagggggatcatcaaagggacagttcgtacatttttatct

SEQ ID NO: 32202 - DNA, 1854 bp, Artificial Sequence
  Description of Artificial Sequence: Synthetic coding sequence
atgcataaaacagcttcgcagcggttgttccccggtccgtcgtaccagaatattaaatccatcatggaggacagcacgatcttgagcgattggactaatagcaataaacagaaaatgaagtacgactttagctgcgagttgtaccgaatgtcaacgtactctacattccccgctggtgtgccagtgagcgagaggtcccttgctagagcagggttttactatacgggcgtgaatgataaggtcaagtgcttctgctgcggacttatgctggataattggaaactaggtgattctcctattcagaagcacaagcagttgtatccctcctgttcatttattcagaatctcgtgagtgctagcctcggcagcacctctaaaaacacctctccaatgaggaatagcttcgctcattcgctgtctcctacgcttgagcactcttcattgttctctgggagttactcatctttgtccccaaacccactaaattcaagagctgttgaggatataagctccagccgtactaacccttactcttatgccatgagcactgaagaggccagatttctcacataccatatgtggcctctgaccttcctaagtccctccgaattagcccgggcaggtttttattatataggacccggggaccgggtggcttgctttgcttgcgggggcaaactaagcaattgggaacctaaggacgatgccatgagtgagcataggaggcattttcccaattgtccattcctggaaaactcgctagagacattacgattttctatctctaatctgtccatgcaaactcatgctgcccgcatgcgcacattcatgtactggcccagcagcgtccctgtccaacctgagcagcttgcctcagctgggttttattatgtgggtagaaacgacgatgttaaatgcttctgttgcgacggcggtctcaggtgctgggaatctggcgatgacccatgggtggagcacgcaaagtggtttccgcggtgcgagttccttatcaggatgaaaggccaggaatttgtggacgagatccagggacgttacccgcatctgttggagcaactcctgtctacctctgacactacaggagaggaaaacgcagacccacccattatccattttggtcctggggaaagcagctccgaagatgcagtgatgatgaatacaccagtggttaagtctgctctcgagatgggcttcaatcgagacctggtgaaacagaccgtgcagtccaaaattttaacaaccggtgagaattacaaaactgttaacgatatcgtgtcagccctactcaacgcagaggatgaaaagagagaagaagagaaagaaaagcaggccgaggagatggcaagtgatgacctctccctgatcaggaaaaataggatggctctcttccagcagttaacctgcgttttgcctatcctcgacaatttactgaaggcgaatgtcatcaacaagcaggaacatgacataataaagcagaagactcaaattcctctccaggcaagggagctgattgacactatacttgtaaagggaaatgcggctgccaatatctttaagaactgcttgaaggagatcgatagtacactgtacaaaaatttgtttgtggacaagaacatgaagtatattcctaccgaagacgtttctggcttgtctctggaagaacagcttcgacgattgcaggaagagaggacatgcaaagtatgtatggacaaagaggtgtctgtagtgttcattccctgcgggcacctcgttgtgtgccaggaatgcgccccttccctgcgaaagtgcccaatctgccgaggcataattaagggaaccgtgaggaccttcttgagc

SEQ ID NO: 32203 - DNA, 1854 bp, Artificial Sequence
  Description of Artificial Sequence: Synthetic coding sequence
atgcacaagaccgcgagccaaaggctttttccaggcccttcatatcaaaacattaagagcataatggaagattccactattctgtccgactggaccaactctaacaagcagaagatgaaatacgatttttcatgcgaattgtaccggatgtccacttacagcacctttcctgcaggcgtccctgtgtcggagagatccctcgcgcgagcagggttttactacactggggtcaacgataaggtcaagtgtttttgttgtgggcttatgcttgataactggaagctgggcgactcacccattcaaaagcataaacagctttaccctagctgttcatttatccaaaaccttgtctccgcatccctgggatctacttccaagaacacttcaccaatgcgcaactccttcgcccattccctgtcccccaccctggagcattcatcacttttcagcgggtcctactcatcccttagcccgaatcccctgaattcaagggctgtcgaagatatatcctcgagccgaaccaacccatactcatacgccatgtcgaccgaagaagcacggtttcttacctaccacatgtggccactgacctttctgagcccttctgaacttgcacgcgcaggtttctattacataggacctggtgaccgggtggcctgttttgcatgtgggggtaagctctcgaactgggaacctaaagacgatgccatgtcggaacaccgtcgccattttcctaattgtccgttcctggaaaactcacttgaaaccctgcgattctccatatcaaatttgtctatgcaaactcatgccgcaaggatgcggacttttatgtactggccatcctccgtgccggtgcagcctgagcagcttgctagcgctggattttactacgtgggaagaaacgacgatgtgaagtgtttttgctgtgacggcggccttaggtgttgggagtcgggagatgacccttgggtagagcatgccaagtggttcccaaggtgcgagttcctgatcagaatgaaaggccaagagttcgtggatgaaattcagggtaggtacccccatttgctggagcaactgctttccacctccgatacgacgggagaagagaatgcagacccaccgatcatccacttcggcccaggagaaagttcatccgaagatgcggtgatgatgaatactcctgtggtgaaatcagcactcgaaatgggatttaaccgagatctggtgaaacagaccgtgcaatccaagattctgactaccggagaaaactacaagacggtgaacgatattgtctcagcacttctgaatgccgaagatgaaaagcgtgaagaggaaaaggaaaaacaagctgaagaaatggcgtcagatgatctgtcccttatccgtaagaacagaatggcactctttcaacaacttacgtgtgtcctgcctatcctcgacaatctccttaaagcaaacgttatcaataagcaggaacatgacataatcaaacaaaagacccagattcctctccaggcacgcgaactgattgatacgatcctcgtgaaagggaacgcggcagcgaacattttcaagaactgtcttaaggaaatagattccaccctgtacaaaaaccttttcgtggacaagaatatgaagtatattcccactgaagatgtgtctgggctctcacttgaagaacaactgcgcaggctgcaggaagaacggacttgcaaggtgtgcatggataaggaagtgtcggtggtgtttatcccgtgtggacacctggtggtgtgccaagaatgcgcaccctcccttcgtaagtgtcctatctgtagaggtattatcaagggtactgtgagaacctttcttagc

SEQ ID NO: 32204 - DNA, 1854 bp, Artificial Sequence
  Description of Artificial Sequence: Synthetic coding sequence
atgcacaagaccgcaagtcagcgtctttttccggggccctcctatcagaatatcaagagcataatggaggactccaccatcctgagtgactggaccaacagcaacaagcaaaaaatgaaatacgattttagctgtgaactgtaccgcatgtccacctattcaacgttcccagcgggcgttcctgtaagtgagaggagcttggcccgcgccggcttctattataccggagtgaacgacaaagtgaaatgtttttgttgtggcctgatgttggataattggaaactgggcgatagtcccattcagaagcataaacaactgtacccaagctgctcatttatccagaacctagtgagtgcctccctgggttccacaagcaaaaacactagccccatgcgtaactcattcgcccattcactctcccctacattggagcactcctcactcttcagtgggtcctacagctccctctcccctaatccactgaatagtagggccgtggaggacatcagtagtagccgaacaaacccttattcttatgcaatgagcaccgaggaggcaagattcctgacttatcacatgtggccattaacattcttgagcccatcggagctggcacgggccgggttctactacattggccctggagaccgcgtggcttgtttcgcctgtggtggcaagctgtccaattgggaacccaaggatgacgccatgtcagaacatcggcgccacttcccaaactgccccttcctggaaaacagtctcgaaacccttagattcagcatttccaatttgtccatgcagacacacgctgctcgcatgcggacttttatgtattggccttcctctgtgcccgtgcagccagagcagctggcctctgcaggcttctattacgtaggtcggaatgacgacgtgaagtgtttctgttgcgacggtggactgagatgttgggagtcaggagatgatccttgggtggagcatgcgaagtggtttcctagatgcgaatttttgattcggatgaagggccaggagttcgtcgacgagatccaaggtagatacccacacttgctggaacagctcctcagcacttcggatactacgggagaagagaatgccgacccccctataatacattttggtcctggggagtcatcctcggaggacgctgtaatgatgaacaccccagtggtgaagagcgccctcgaaatgggcttcaaccgagatttagtcaagcagacagttcagtctaagatcctgaccactggcgagaattataaaactgtgaatgatatcgtgtccgccctcctaaacgctgaagatgagaaacgggaggaggaaaaggagaagcaggctgaggagatggcatccgacgacctgagcctgatcagaaagaaccgtatggctctcttccagcagctgacctgcgtgctgcctatcctcgacaacctgctgaaggctaatgtcatcaataaacaggagcacgatataatcaaacagaagacccagatccccctccaggcacgcgagcttatcgacactattctcgtcaagggcaatgcagccgccaatatctttaaaaattgcttaaaggaaatagattccacactgtacaagaatctgttcgtcgacaaaaatatgaaatacattccgactgaagatgtatcaggcctgtccttggaagagcagctcaggaggcttcaggaagaaaggacctgtaaggtctgcatggacaaagaagtgagtgtagtgttcatcccctgtggccatcttgtagtatgtcaggagtgcgccccttcattgaggaaatgtcctatctgcagagggatcatcaagggcactgtccgcaccttcctgagt

SEQ ID NO: 32205 - DNA, 1854 bp, Artificial Sequence
  Description of Artificial Sequence: Synthetic coding sequence
atgcacaaaaccgcaagccaacggcttttccctggcccgtcataccaaaacattaagtctatcatggaagattctacgattctgtcggattggaccaattccaacaaacaaaagatgaagtatgacttctcgtgcgaactctacagaatgagcacgtactcgacctttccagcaggtgttcctgtctcggagcggtcactcgcacgcgccggattttactacactggggtgaatgataaggtgaaatgtttttgttgtgggcttatgcttgataattggaagttgggggattccccgatccaaaaacataaacaactttacccttcatgttcatttatccagaacctggtgtcggcgtccctgggcagcacctccaagaatacctcaccaatgagaaactcgttcgcccactccctgagccctaccctggagcattcatctttgttttcgggatcctattcatcgctgtcaccaaacccccttaattcgagagccgtggaggacatctcaagcagcagaaccaacccttactcatacgccatgtctaccgaagaggcaaggtttcttacctaccatatgtggcctttgacctttttgagcccttcggagcttgcacgagcaggattctactacattggcccaggagatcgggtcgcatgtttcgcgtgcggaggaaaactgtccaactgggaacctaaggatgacgcaatgagcgaacatagaaggcattttcctaattgtccattcctggaaaattcgctcgaaactcttcgcttctcaatttccaatctttcaatgcagactcatgcagcccgcatgagaacctttatgtactggccatcttcggtgcctgttcaacctgaacagctggcctcagcaggcttttactacgtgggccggaacgatgatgtgaagtgcttttgttgcgatggggggcttcgttgttgggaaagcggcgacgacccttgggtcgaacacgccaaatggtttccaaggtgtgaatttctgattagaatgaagggccaagagtttgtcgacgaaatacagggacgttatcctcacctcctcgaacaactgctgtcgacctcggatactaccggcgaagagaacgcggaccctccgatcattcatttcggaccgggagaaagctcatcggaagatgccgtgatgatgaatactcctgtagtgaagtccgcactggaaatggggtttaacagggaccttgtgaagcaaactgtccaatcgaagattctgaccactggtgagaattacaaaacggtcaacgatatagtgtccgctctgcttaacgcggaggacgagaagcgggaagaagaaaaagaaaagcaagcagaggaaatggcgtcggacgacctctcgctgattcgcaagaacaggatggcactctttcaacagctcacctgtgtgctgccaattcttgacaacctgctgaaagcaaacgttatcaataagcaggaacacgatatcattaaacaaaagacccagatccctctgcaagcaagagagcttattgatacgattctggtcaaaggtaacgcagcagcaaacatcttcaagaattgccttaaggaaatcgatagtactctttacaagaacctgtttgtggacaagaacatgaagtacatcccgactgaggacgtgtccgggctcagcctggaagagcaactgagaagattgcaggaagagaggacctgcaaagtctgtatggacaaagaagtatcagtcgtgttcattccatgtggacatctggtggtgtgccaagaatgtgcaccttcccttcgaaagtgccccatatgtcgcggtattatcaaggggactgtgcgaacctttctgtcg

SEQ ID NO: 32206 - DNA, 1854 bp, Artificial Sequence
  Description of Artificial Sequence: Synthetic coding sequence
atgcacaagaccgcctcccagcgtctctttccaggcccctcctaccaaaacatcaagtccatcatggaggactccacaatcctgtctgattggactaatagtaataaacaaaagatgaagtatgatttctcctgcgagctataccggatgtcgacgtacagcaccttccctgcaggtgtgcccgttagtgagcggtcgctcgcccgcgccggtttctactacactggcgtgaacgataaggtcaagtgtttctgttgtggcctcatgctcgataattggaagctgggtgatagccccattcagaagcacaagcagctttacccctcctgctcgttcatccagaacctcgtttccgcctctcttggatcaacgagtaagaacaccagccccatgcggaactcgttcgctcactctttgtcgcctaccctcgaacactcttccctgttctccggctcgtatagctcgctgtctccaaaccccctcaattcgcgtgctgtcgaggacatctcctccagccgtacgaatccttattcgtatgctatgagcaccgaagaggctcgcttcctgacataccacatgtggcctttgacctttctatcgccttccgagctggcacgcgccggcttctattatatcggccccggagatcgtgtcgcctgctttgcctgcggcggcaaactcagcaactgggagcctaaggatgatgccatgtccgagcatcgccggcattttcctaactgcccctttttggagaactcgctcgagacgctcaggtttagcatttccaacctttccatgcagacccacgcggccagaatgcggaccttcatgtactggccttccagcgtcccggtccagccagagcagctcgcctctgccggtttctactacgtcggacgtaacgatgatgtcaagtgcttctgctgcgatggcggcttacgctgttgggaatccggcgacgacccttgggtcgagcatgctaagtggttccctcgctgtgagttcctcatccgcatgaaagggcaggagtttgttgacgagatccagggccgttacccacacctgcttgagcagctgctttctacgtccgatacgaccggtgaggaaaacgcggacccgcccatcatccacttcggtcctggtgagtcctcatctgaggacgctgtcatgatgaacacccccgtcgtgaagagcgctctcgagatgggtttcaatagagatctggtcaagcaaaccgtgcagtccaagatcctgacaactggagagaactacaagaccgtcaacgacatcgtgagtgccctcctgaacgcggaggatgagaagcgtgaggaggagaaggagaagcaggcggaagagatggcgtccgacgacctctccctgatccgcaagaaccgcatggccctgttccaacagctgacgtgcgtattgcccattctggacaacctgctaaaagctaatgtcatcaacaagcaggaacacgacattatcaagcagaagacgcagattcccctccaagcgcgtgaacttatcgacacgatcttggtcaagggcaacgcggcggcgaacatcttcaagaactgcctcaaggaaatcgattccacgttgtacaagaatctcttcgtcgacaaaaacatgaagtacattcccactgaggacgtctctggcctgagcttggaggagcagctgagacgcctccaggaagagcgcacatgcaaggtgtgcatggacaaggaggtcagcgtcgttttcattccctgcggccacctggtcgtctgccaggagtgcgccccatctctccggaagtgcccaatctgtcgcggtatcattaagggcaccgtgcgcactttcctatcc

SEQ ID NO: 32207 - DNA, 1854 bp, Artificial Sequence
  Description of Artificial Sequence: Synthetic coding sequence
atgcacaaaactgcatctcagcgcctgtttcccggcccttcttatcagaatataaagagcatcatggaagattctaccatcttatctgattggactaattccaataagcaaaagatgaagtatgatttctcttgtgaactgtaccggatgagcacttacagcacatttcctgcaggcgtgcccgtgtcagagcgaagtctggcaagagctggcttctattatacaggggtgaatgacaaggttaagtgcttctgttgcggattgatgctagacaattggaaactgggggattccccaattcagaaacataaacagctttaccctagttgttcttttatccaaaatcttgtgagtgccagcctggggtccacctcaaagaatacttcccctatgagaaattcttttgctcattctctttctccaacactggagcacagctctctgtttagtgggagttactcgagcctatcacctaatcccctgaatagcagagccgtggaggatatatccagctctcgcaccaacccgtattcttacgccatgagcactgaggaggcgagattcttaacctatcacatgtggcccttgacttttctgagtccttctgaactggcccgcgcagggttttattacattggacccggtgatagagtcgcgtgcttcgcatgcggaggtaaactctccaactgggagcccaaggacgacgccatgagcgagcatcgcagacacttccctaactgccccttcttggaaaacagcctggagacccttaggttctcgatctccaacctgtccatgcagacacacgccgcacgcatgaggacctttatgtactggcctagttcagtgccggtccagccagagcagttagctagcgccgggttctactacgtgggacgtaacgatgacgtgaaatgtttctgttgcgacgggggtctgcgctgctgggagtctggcgacgatccctgggtggagcacgcaaagtggttcccaagatgtgaattcctgatccggatgaagggccaggagttcgtagacgagatccaggggcgatatccccacctgctggaacagctgttatccaccagcgacacgactggagaagagaacgcagacccccccatcatccacttcggaccaggagagagttccagcgaggatgccgtgatgatgaataccccggtcgtgaaatcagccctggagatgggattcaatcgcgatcttgtcaagcaaacagtccaatccaaaatattaaccaccggcgaaaattacaagactgtcaacgacatagtctcagctctgctaaacgccgaggacgaaaagcgcgaagaggaaaaagagaaacaggcagaggagatggcctccgacgacctatccctcatacgcaagaacagaatggcactttttcagcaattgacctgcgtcttgcctatattggataatctcctgaaggccaatgtaattaataaacaggaacacgatatcatcaagcagaagactcagatcccgctgcaagcaagagagctcatcgataccattctcgtgaagggaaacgctgctgctaatatcttcaagaattgcttgaaggagattgatagcaccctgtataaaaatttgttcgtggataagaatatgaaatatatcccaaccgaggatgttagcggcctcagcctggaagaacaactgaggcgcttgcaggaagagagaacatgcaaggtgtgtatggacaaagaagtgagcgtggtgtttatcccatgtgggcacctggtggtctgtcaggagtgtgcccctagtctcagaaaatgccccatctgtcgagggatcattaagggcacagtgaggacttttctgtct

SEQ ID NO: 32208 - DNA, 1854 bp, Artificial Sequence
  Description of Artificial Sequence: Synthetic coding sequence
atgcataaaactgcatcacaaagactttttccaggaccatcttatcaaaacattaaatcaattatggaagattcaactattttatcagactggacaaattcaaataaacaaaaaatgaaatacgacttcagttgtgaattatatagaatgtcaacttatagtacttttcctgcaggagttccagtatctgaaagatctttagctagagcaggattctattatacaggagtaaatgataaagtaaaatgtttttgttgtggtttaatgcttgacaattggaaacttggagattcaccaattcaaaagcataaacaattatacccttcatgttcttttattcaaaatcttgtttcagcatcattaggtagtacttcaaaaaatacctctccaatgagaaattcattcgcacattcacttagtcctacactagagcattcatctttattttcaggttcttacagtagtttaagtccaaatcctttaaatagtagagctgtagaagatattagttcatctagaactaatccttattcatatgctatgtctacagaagaagcaagatttcttacctatcatatgtggccattaacttttttatctccatcagaattagctagagcaggattttattatataggacctggagaccgtgttgcatgtttcgcatgtgggggtaaattaagtaattgggaaccaaaggacgatgctatgtcagaacacagacgtcactttcctaattgtccatttttagaaaattcactcgaaacattaagatttagtatttctaatttaagtatgcaaacacatgctgcaagaatgcgtacatttatgtattggccttcatcagttcctgttcagcctgaacaacttgctagtgctggattctattacgttggaagaaacgatgatgtaaagtgtttttgttgtgatggaggacttagatgttgggaatcaggtgatgatccatgggtagaacatgcaaaatggtttcctagatgtgaatttttaattagaatgaaaggacaggaattcgttgacgagattcaaggaagatatcctcatcttcttgagcaattattaagtacttcagatacaacaggagaagaaaacgctgatccacctattattcattttggaccaggtgaatcaagttcagaagatgcagttatgatgaatactccagtagtaaagtcagcacttgaaatgggatttaacagagatttggttaaacaaacagttcaaagtaaaattttaacaacaggagaaaattataaaacagtaaatgatatagttagcgcattattgaacgcagaagatgaaaaaagagaggaagaaaaagaaaaacaagctgaagaaatggcttcagatgatttatctcttataagaaaaaacagaatggctttattccaacaattaacatgcgttttaccaattttagataatttattaaaagctaatgtaattaataaacaagaacatgacataattaaacaaaaaactcaaattcctttacaagctagagaacttattgatacaatcttggttaagggaaatgctgctgcaaatatttttaaaaattgtttaaaggaaattgattcaacactatataaaaatttattcgttgataaaaatatgaagtatattcctacagaggatgtttcaggattatcgcttgaagaacaactcagaagattacaagaggaaagaacatgtaaagtttgtatggataaagaagtaagtgttgtttttataccatgtggacatttggtagtctgtcaagaatgtgcaccaagtcttagaaaatgtccaatttgtagaggtattataaaaggaacagtaagaacatttttatct

SEQ ID NO: 32209 - DNA, 1854 bp, Artificial Sequence
  Description of Artificial Sequence: Synthetic coding sequence
atgcacaagaccgcatcgcaaagactgttccccggccctagctaccagaatatcaaaagcatcatggaagattcgaccattttgtcggattggaccaattccaacaagcagaagatgaagtacgactttagctgcgaactgtacagaatgtcaacgtactccactttccctgccggagtgccggtgtcggagagatcgctggcccgcgccggattctactacaccggcgtgaacgacaaggtgaaatgcttctgctgtggactcatgcttgacaactggaagctgggtgactcgcctattcagaagcacaagcaactgtacccgtcctgcagcttcatccagaacctcgtctccgcctccctgggatcaacgtcgaagaataccagcccaatgcgaaacagcttcgcccactcgctgtctccgactctggaacattcctccttgttttctggatcctattcctcgctgtccccgaaccccttgaactctcgcgcagtggaagatatctcatcctcacggaccaatccatactcgtacgcgatgtccaccgaagaggcgcggttcttgacttaccatatgtggcctctcactttccttagcccttcggaactggccagagctgggttctattacattggaccgggggatcgcgtggcgtgcttcgcttgtggaggaaagctctctaattgggagcctaaggatgacgcaatgagcgaacacaggagacacttcccaaattgcccgttcctggagaactcgctggaaacgctgcgcttcagcatcagcaacctctcgatgcaaacccacgcggcgaggatgcggaccttcatgtactggccttcatcagtgccagtgcagccagagcagctcgcatccgcaggattctattacgtcgggcgcaacgacgacgtgaagtgcttctgctgcgatgggggtctgagatgctgggagtcgggcgacgatccttgggtcgaacacgccaagtggtttccgaggtgcgagttcttgatcaggatgaagggacaggagttcgtggatgagattcaaggcaggtacccacacctgcttgaacagctgctgtccacctcggacactaccggagaagaaaacgccgaccccccgattattcatttcggtccgggagagtcgtcatcggaggacgcagttatgatgaacactcctgtggttaaatcagcactggagatgggctttaaccgggacctcgtgaagcaaaccgtccagtccaagatcctcaccacgggcgaaaactataagactgttaacgacatagtctccgctctgctcaacgctgaggacgagaagagagaagaggaaaaggaaaagcaggcggaagagatggcatcggacgacctgagcctcatccgcaaaaaccgcatggccctcttccagcaattgacttgcgtcttgccaatcctggacaacctgctgaaagctaacgtcatcaacaagcaagaacacgacatcatcaagcagaaaacgcagatcccgttgcaagctcgcgaactcatcgacaccatcctcgtcaagggcaatgccgctgcaaatatcttcaagaactgcctcaaggaaatcgatagcaccctctacaagaatttgtttgtcgataagaacatgaagtatatcccgacggaggatgtgtccgggctgtccttggaggaacagctgcgccggctgcaagaagaacggacctgcaaagtttgcatggacaaagaggtgtccgtggtgttcatcccgtgcggacatctggtggtgtgtcaagaatgcgctccgtcgctgcgcaagtgtccgatttgtcggggaatcataaagggaaccgtgaggaccttcctctca

SEQ ID NO: 32210 - DNA, 1854 bp, Artificial Sequence
  Description of Artificial Sequence: Synthetic coding sequence
atgcataagactgccagccagcgactgtttccggggccaagctatcagaatatcaaatcaattatggaggacagcaccatcctgtcagattggaccaactccaacaagcagaaaatgaagtacgacttctcctgcgaactctatcgtatgtctacttactccaccttcccagccggggtgccagtcagcgagcggtcacttgccagggccggcttttattacactggagtgaatgataaagtcaaatgtttttgctgtggacttatgctagataattggaaactgggggacagtccgattcagaagcataagcagctgtatccatcttgttccttcatccagaatcttgtctctgccagtttaggatcaacgtccaaaaatactagtccaatgcgaaatagcttcgctcattcactctctccaactctggagcactccagtcttttcagcgggtcctatagctccctcagccctaatccactaaacagccgcgccgtcgaggatatatctagctcccggaccaacccctactcatatgccatgtctaccgaagaagcccggttcttgacttatcacatgtggccgctgacattcttatccccaagtgagctcgcccgggccgggttttactatatcggaccgggggatcgggtcgcatgttttgcctgcggtggcaaacttagcaactgggaaccaaaagatgacgcaatgagtgaacatcggagacatttccctaactgtcccttcttagaaaattctttagagaccctcagattttccatatctaatctgagcatgcagactcacgccgccaggatgagaacattcatgtattggccctcttctgttcccgtccagccagagcagctcgcctcagctggattttattacgttggccggaatgatgatgtgaagtgcttctgttgcgacggagggctgaggtgttgggagagcggagacgatccttgggtagaacacgcaaagtggtttcccaggtgcgagttcttaatacgcatgaagggccaggaattcgtggacgaaatccagggtcgctatccccacctcttggaacaattgttgtcgacctccgatactaccggagaggagaacgcagacccccccataattcattttggcccaggggagtcatcatccgaggacgcagttatgatgaacacccctgtggtgaagtcagcactcgagatgggatttaaccgcgatctggtgaaacaaaccgtccagagtaagatcctgaccacaggtgagaattataagaccgtcaacgacattgtgtcggccctactcaatgctgaggacgaaaaaagggaagaggagaaggagaaacaagctgaagaaatggcgagtgacgacttgtctcttatccgaaagaaccgtatggctcttttccagcagctcacttgtgttcttcctattctggacaaccttctcaaggctaacgtgattaacaaacaggagcacgatatcattaaacagaagacacagataccgttgcaggcccgcgagctgatcgacacaattcttgttaaagggaacgccgccgcgaatatttttaaaaattgtcttaaggagatagacagcaccctgtacaagaacctcttcgttgataaaaatatgaagtatattccaaccgaagatgtgtcgggactttcccttgaggagcaactaagaaggctgcaggaagagcgtacttgtaaagtatgtatggataaggaggtgtcagtcgtgttcatcccctgtgggcacctcgtggtctgccaggagtgtgcaccctccttacgaaagtgccccatctgtagaggaatcatcaaaggcactgtgcggacgttcctctcg

SEQ ID NO: 32211 - DNA, 1854 bp, Artificial Sequence
  Description of Artificial Sequence: Synthetic coding sequence
atgcacaagaccgccagccagcggctctttcccggcccatcatatcagaacatcaagtcgattatggaagatagcactattctgtcggattggactaactcgaacaaacaaaagatgaagtacgacttctcctgtgagctttaccgcatgtcgacgtactcgacctttccagcaggtgtgccggtcagcgaacgtagcctcgcaagggctgggttttactacaccggggttaacgataaggtgaagtgtttttgctgtgggttgatgctggataattggaaactcggcgattcaccgatacaaaagcataagcagttgtacccttcctgcagcttcatccaaaacctcgtgtcggcctcactgggcagcacctcgaaaaacacttcgcccatgcgtaattcgtttgcacattccctctcccccaccctcgaacattcctcgttgttcagcgggtcctatagctcccttagcccaaacccccttaatagcagagcagtcgaggacatttcctcctcccgcactaacccatactcctacgcaatgagtacggaagaagcgcgctttctgacctaccatatgtggcccttgaccttcctgtctccgtcagagctcgcccgggcaggattttactacattggtcctggcgatcgcgtggcatgcttcgcatgtggggggaagctctcaaattgggagcctaaggatgatgcaatgtccgaacatcgtagacactttcctaattgtccatttctggaaaacagcctggaaaccctgagatttagcatctcgaacctttccatgcagacccacgccgcccgcatgaggaccttcatgtattggccgtcctcagtgcccgtgcagccagaacaacttgcaagcgccggtttttactacgtcggacgtaatgatgatgtgaagtgtttctgttgtgacggcggtctgcgctgttgggaatcgggtgatgatccatgggtcgaacatgccaagtggtttccgcgctgtgaatttcttatccggatgaagggtcaggagttcgtggacgaaattcaaggacggtatccacatctcctggagcagctcctgtcgaccagcgatactaccggcgaagagaatgccgatccccctatcattcacttcggtccaggagagtcctcctcggaagatgcggtgatgatgaatacgcctgtggtgaagtcggcacttgagatggggtttaaccgagatctggtgaaacaaactgttcagtcaaagatattgaccactggagaaaactacaagaccgtgaacgatatcgtgtccgcactccttaatgcagaagatgaaaagagagaggaggagaaggaaaaacaagcagaggaaatggccagcgacgacctgtctctgataagaaagaatcgcatggcactgtttcagcagctcacctgcgtgcttcctatcttggataacctccttaaagctaacgtgattaacaagcaggaacacgacatcatcaaacaaaagactcaaatcccactccaggctagagaacttattgatactatacttgttaagggtaacgcagccgccaacatcttcaagaactgcttgaaagagattgattcgactctctacaagaacctcttcgtggataagaacatgaagtacatccccaccgaagatgtgtccggactgagccttgaagaacaactccgtaggctgcaagaggagcggacttgtaaggtgtgtatggacaaggaagtctccgtggtctttattccctgcggacatctcgtcgtctgtcaagagtgtgcaccttccttgcgcaaatgtcccatttgcagaggtatcataaaaggaaccgtgagaactttcctttcc

SEQ ID NO: 32212 - DNA, 1854 bp, Artificial Sequence
  Description of Artificial Sequence: Synthetic coding sequence
atgcataagacggccagccaacgcctctttccgggaccttcctaccaaaacattaagtctattatggaggattcgaccatcttgtcggattggactaattcgaacaaacaaaagatgaaatacgatttttcttgtgaactttaccggatgtccacctactcgaccttcccggcaggtgtcccagtgtcggaacgttcgttggcaagagctggtttctattacaccggcgtcaatgacaaagtgaagtgtttctgctgtggactcatgctggacaactggaaacttggcgatagccctattcagaagcacaagcagctgtacccctcatgttcctttatccaaaacctggtgtcggcatccctcggttccacctctaagaatacctcgccaatgcggaattcctttgcacactcgctgtcccctactctcgaacattcatccctgttctctggttcctacagctcactgtcaccaaatccactgaactcccgggcagttgaggacattagcagcagccggaccaatccctactcatacgcgatgtccactgaagaagccagatttcttacctaccatatgtggcctctgacttttctgtcgccctcggaactcgcgagagccggtttttactacatcggtccaggggatcgtgtcgcgtgttttgcatgcggaggtaagctgagcaactgggagccaaaggatgatgccatgtccgagcatcggcggcattttccaaattgtcccttccttgaaaactcacttgaaactctgcgattttcgatatcaaacctctcgatgcaaactcatgccgcgcgaatgagaacgttcatgtattggccttcatccgtgccggtccagccagaacagctggcctcggccgggttctactacgtgggaagaaacgacgacgtgaagtgcttttgctgtgatggcggtctgagatgttgggagagcggggatgatccctgggtggagcatgccaagtggtttccacgctgtgaattcttgatacgtatgaagggtcaagagtttgtggatgaaatacagggccgttaccctcaccttctcgaacaactgctttcgacttcggatactactggagaggaaaatgctgatcctccaatcatccattttggaccgggagaaagctcatcggaagatgcggtgatgatgaacacgccagttgtgaagtccgcactggaaatgggattcaacagggacttggtgaagcagactgtgcaatcgaagatccttaccaccggtgaaaactacaagacggtgaacgatattgtgtctgcgttgcttaacgcagaggatgaaaaacgggaagaagaaaaggagaagcaggcagaagagatggcttcagacgacctgtccctgattaggaaaaatcgaatggcactgttccaacagttgacctgtgtgctcccaatccttgataatctgctcaaggccaatgtgattaacaaacaggaacacgatatcattaaacaaaaaacccagattccgctgcaggcacgggaactcattgataccatactggtgaagggaaacgcagcagcaaatatcttcaagaactgcctcaaggagatcgacagcaccctgtacaaaaacttgtttgtggacaaaaacatgaaatacattcctaccgaagatgtttcaggactctcgctcgaagaacaactgagacggcttcaagaggaaaggacgtgcaaagtgtgcatggacaaggaagtctccgtcgtgttcatcccatgtgggcaccttgtggtgtgtcaggagtgcgcaccatcgttgcgcaagtgtcctatttgtaggggaatcattaaaggaactgtgaggaccttcctgtcg

SEQ ID NO: 32213 - DNA, 1854 bp, Artificial Sequence
  Description of Artificial Sequence: Synthetic coding sequence
atgcataagaccgcgtctcaacgcctgttcccgggcccttcctaccagaacatcaaatcaatcatggaggattcgaccatcctctccgattggacgaattcgaacaaacagaaaatgaagtatgacttcagctgcgaactgtaccggatgtccacttactccacgttcccagccggcgtgccggtgtcggagcgctcactcgcaagagccggcttttactatactggtgtgaacgataaggtgaagtgcttctgttgcggactgatgctggacaactggaagctcggagactcgccgatccagaagcataagcaactgtacccctcctgctccttcatccagaaccttgtgagcgcatcgctgggatcaacgtcgaagaatacttcccctatgcgcaactcgtttgcacattcactgtcaccgactctggagcattcttcccttttctcaggatcctacagctcgctttcgccgaatcctcttaattcgagagcggtcgaagatatctcatcctcaagaactaatccatactcctacgccatgtcgaccgaagaagcccgcttcctcacttaccatatgtggccgctgactttcctgtctccttcggaactcgcgagggcaggtttctactacatcggcccgggggaccgcgtggcatgcttcgcttgtggcggaaaactgagcaattgggagccgaaggatgacgccatgtcggaacatcggcggcattttccgaattgtccgttcctcgagaattccttggaaactttgcgcttctccatctcgaacctcagcatgcaaactcacgcggcgagaatgagaactttcatgtattggccaagcagcgtgccggtgcagcctgagcaactggcttcggcgggattctactacgtgggtcggaacgacgacgtgaagtgtttctgttgcgacggaggactccggtgttgggagagcggggacgatccatgggtcgaacatgctaagtggttcccgcgctgcgaatttcttatccgaatgaagggacaggagttcgtggacgagattcaggggagatacccgcatctgctggaacagctgctgtcgactagcgacaccactggcgaggaaaatgccgaccccccgatcattcacttcggacctggagagtcatcatcagaggacgccgtgatgatgaataccccagtcgtgaaatcagcgcttgaaatggggttcaaccgggatctcgtgaaacagactgtccaatcaaagatcctcactaccggagagaactacaagacggtcaacgacatagtctcagccctgctgaacgccgaagatgaaaagcgcgaagaggaaaaggagaagcaggcggaggaaatggcctccgatgatttgagcttgatccggaagaacagaatggctctcttccagcagttgacctgcgtgctcccgatcctggacaaccttctgaaggcgaacgtcatcaacaaacaggagcatgacattatcaagcagaaaacgcagatcccactgcaggcccgcgagctcatcgacaccatcctggtgaagggcaatgctgccgcaaacattttcaagaattgccttaaagagatcgacagcaccctctacaagaatctgttcgtcgataagaacatgaagtacatccctaccgaggacgtgagcggcctgtctttggaggaacagctgcggagacttcaggaggagcgcacgtgcaaggtctgcatggataaagaagtttcggtcgtgttcatcccctgcggacatctggtggtgtgtcaggaatgcgcaccgtcgttgcgcaaatgcccaatctgtcggggaatcatcaaggggaccgtgaggactttcctttca

SEQ ID NO: 32214 - DNA, 1854 bp, Artificial Sequence
  Description of Artificial Sequence: Synthetic coding sequence
atgcacaaaactgcgtcacagagactgttcccaggaccatcctaccagaacataaagtccattatggaggactcgaccattctgagcgactggacgaactccaacaagcaaaagatgaaatacgacttctcctgcgagctctacagaatgtcgacctactcgactttccccgctggagtgccagtgtccgaaaggtcattggcccgcgcggggttttactacactggagtgaacgacaaggttaaatgcttctgttgcggccttatgctggataactggaagctgggggactccccgattcaaaaacataagcaattgtaccccagctgctccttcatccagaacttggtgtccgcctccctcggaagcacctcaaagaacacctcaccgatgcgcaacagcttcgcccatagtctctcacccaccctggagcattccagcctgttctcaggctcgtactcgtcgctttccccgaatcctctcaactcacgcgccgtggaggacatcagctccagccgcacgaacccgtactcatatgccatgtccactgaggaggctagattcctcacttatcacatgtggcctctgaccttcctgtcgccgtcagaactggcacgtgcgggattctactacatcggtccaggcgaccgcgtggcctgctttgcctgtggcggaaagctctcaaactgggagcccaaggacgacgccatgtcagaacacagacgccacttcccgaattgcccatttctggagaactcactggagactttgaggttctccatctccaacctctccatgcaaacccacgcagcgagaatgcgcaccttcatgtactggccgtcgtcggtcccggtccagccggagcagcttgcttccgcgggattttactacgtcggaagaaatgacgacgtgaagtgcttctgctgtgacggcggcctccggtgctgggagtccggggatgatccctgggtcgagcacgccaaatggtttccacgctgcgaatttctgataagaatgaagggccaggaattcgtcgacgagatccaaggacggtacccacatctccttgaacagttgctttcgacttccgatactactggggaggagaacgcggaccctccaatcatccattttggtccgggagaatcgtcgtcggaagatgccgtgatgatgaacactccagtggtgaagtcagccctcgaaatgggcttcaatcgagatctggtcaagcaaactgtgcaatccaagatcctcactactggagagaattacaagaccgtgaatgacattgtgtccgcgttgctgaacgccgaggacgaaaagagagaagaagagaaggaaaagcaggccgaggagatggcgtcagacgacctcagcctgattcgcaaaaatcggatggcacttttccagcagctgacctgcgtgctccccatccttgacaacctgttgaaggctaatgtcatcaataagcaggaacacgatatcatcaagcaaaagactcaaatcccgctccaggcgcgcgaactgatcgatacgatccttgtgaagggaaacgcagccgcaaacatcttcaaaaactgtctgaaggaaatcgattcgacgctgtacaaaaacctcttcgtcgataagaacatgaagtatattccgaccgaagatgtgtcaggactgtccctggaagagcaattgcggcgccttcaagaagagcggacctgtaaggtgtgcatggacaaggaagtgtcagtggtgttcattccgtgcggacatctcgtcgtttgtcaggaatgcgccccttccctcaggaagtgtccaatctgccgcggaatcattaagggcacggtgagaaccttcctttcc

SEQ ID NO: 32215 - DNA, 1854 bp, Artificial Sequence
  Description of Artificial Sequence: Synthetic coding sequence
atgcataagaccgcttcgcaacggctttttccagggccttcttaccagaatatcaagagtattatggaggatagtacaatcctgtccgactggacgaactcaaacaaacagaagatgaagtacgacttctcctgcgaactctaccggatgtccacctattccacttttcccgccggggtgcctgtgtccgaaagatcgctggcccgggctggattttattatacaggcgttaacgataaagtgaaatgcttctgttgtgggttgatgctggacaattggaaactgggagactctcccattcaaaagcacaagcagctgtacccttcatgctcctttattcagaacttggtatcggcgtcattaggatcaacctctaaaaatacttctccaatgaggaacagcttcgcccatagcctaagtcccaccctggagcacagctctctctttagcggcagctactcatcgttaagccccaacccccttaatagtcgagcggttgaggacattagcagctcccggacgaatccatattcttatgcaatgagtacggaagaggcgagattcttaacctatcatatgtggccactgacgtttctatctcctagtgaactggccagagcagggttttactatattggtccaggggatcgtgtggcttgttttgcttgtggcggcaaactttcaaattgggagccgaaggatgacgctatgtccgagcaccggcgccacttccccaactgccccttcctggaaaactctctggaaactctgcgattctccatcagcaacttgtccatgcagacacatgcggcccgtatgagaacgtttatgtactggccgtcatcagtccccgttcagcctgaacagctggccagtgccggtttttattatgtgggacgcaatgatgatgtgaagtgtttttgttgtgatggtggcctacgctgctgggagagcggcgacgacccgtgggtggagcacgcaaaatggttcccaagatgtgagtttcttatccgaatgaaggggcaggaatttgtagatgaaatccagggccgttacccccatctgttggagcagctcctcagcacctccgacaccacgggcgaagagaacgcagacccaccaataattcatttcggaccaggcgagtctagctccgaggatgccgtgatgatgaatacccctgtcgttaagagcgccctggaaatgggttttaatcgcgatctggtgaaacagaccgtacagtccaaaatcttgaccacaggcgaaaactataagactgtcaacgatattgtgagcgcgctgctaaatgccgaagacgaaaagagggaggaggagaaggaaaaacaggcagaagagatggcctcggacgatctgtctttgatccgcaagaaccggatggctctgtttcagcagctgacttgcgtactgcctattctggacaacttactcaaagcaaatgttattaacaagcaggaacacgatattataaagcagaaaacccagattccactccaggcacgcgaattgattgacaccattttggtcaagggaaacgccgccgctaatattttcaaaaactgccttaaggagatcgattccactctttataagaacctattcgtcgataagaatatgaagtacattccgaccgaggatgttagtggtctgtctctcgaggaacagctgaggcgcctccaggaagaacgcacctgcaaagtgtgcatggataaagaagtctctgtggtgttcataccctgcggacacctggtcgtgtgccaagaatgtgcgcctagtttacggaagtgcccgatctgtcgagggattattaagggcacggtacgtacatttcttagt

SEQ ID NO: 32216 - DNA, 1854 bp, Artificial Sequence
  Description of Artificial Sequence: Synthetic coding sequence
atgcacaagactgcctcacaaaggctgtttccaggcccgagttaccagaatatcaaatcaataatggaggattccactattctgtccgattggaccaacagcaacaagcaaaagatgaagtacgacttcagctgtgaactataccggatgtccacatactctacatttcccgccggggtgcccgtgagtgaacgcagcttagcaagggccgggttctattatacaggcgtgaacgacaaagtgaaatgtttttgctgcggcctgatgcttgacaactggaagctgggggatagcccaattcagaagcacaagcagctctatccctcttgctcatttatccagaatctggttagtgcaagtctagggtctaccagcaagaataccagccccatgagaaattctttcgcacactccttgagtccaacattggagcattctagcctgtttagcgggagctactcatcactatcccctaatcctctaaactcccgggctgtggaggatattagctctagtcgtaccaatccatactcttacgcaatgtcaaccgaggaggcacgcttcctgacctaccatatgtggcctctgacatttcttagtccatccgagttggctcgggcaggattttactacataggtcctggtgacagggtggcatgtttcgcttgtgggggcaaactgagcaattgggagcccaaggacgacgctatgtctgaacaccggcgccattttccaaactgtcctttcttggagaactctctggagactctgcgcttctctatatcaaatctgagcatgcagacacatgctgctagaatgcgtactttcatgtattggccctcatctgttcctgtgcagcccgagcaactggcatcagctggcttctactatgtgggccggaatgatgatgtgaagtgcttctgctgcgatggaggcttaaggtgttgggagagtggcgacgacccctgggtcgaacatgccaagtggtttcctagatgtgagttcttaattaggatgaagggccaggaattcgtggatgaaatacagggccggtacccacatctgctcgagcagttactgtctacttctgatacaacaggggaggagaacgccgaccctcctattatacacttcgggcctggggaatcatccagtgaagacgcagtcatgatgaacacccccgtggtgaagagtgctttagagatgggctttaatcgggacctcgtgaagcaaacagtccagagcaagattctgactaccggcgagaactataagacagtgaacgacatagtgagcgccctgctcaacgccgaagacgaaaagagagaggaggagaaagagaaacaagccgaggaaatggcaagtgatgatctatctctgattcgcaagaaccgcatggcattattccagcaattaacttgtgtcctgcctattctggataacctgctgaaggcaaatgtgatcaataaacaggagcatgacatcattaagcagaagacacagattcctctgcaggctagagagcttatcgacactatactcgtgaaaggcaacgctgccgccaatatatttaagaattgcctaaaggaaatcgactcaaccctgtacaagaatctgttcgtagataaaaatatgaaatatattcctacagaggacgtttccggactgtcactggaagaacagctgcgccggctgcaggaggaacggacctgcaaggtgtgtatggataaggaggtgtcagtagtgtttattccctgcggccacctcgtagtttgccaggagtgcgctcccagcctgaggaaatgccctatttgccgaggaattatcaaaggcaccgttcggaccttcctcagt

SEQ ID NO: 32217 - DNA, 1854 bp, Artificial Sequence
  Description of Artificial Sequence: Synthetic coding sequence
atgcacaagaccgcctcccagaggctgttccctgggccgtcctaccagaacattaagagcatcatggaagattcgactattctctcggactggaccaatagcaacaagcagaaaatgaagtacgacttctcgtgtgagttgtacaggatgtccacttactccacttttccggctggcgtgcccgtcagcgagcggagcctggcgcgcgcgggcttctattacacgggagtcaatgacaaggtcaagtgcttttgctgcgggctgatgttggacaactggaagctcggggactcgccaatccagaagcacaagcagctctatccatcctgctcattcatccagaatcttgtgtcggcgtcgttgggttcgacgagcaagaatacgtcgccaatgcgcaactcattcgcacactcactgtcgccgacgctggagcactccagcctcttctccggatcatactcgtccttgagccccaacccgctcaactcgagagccgtggaagatatctcatcatccaggaccaatccctactcctacgcgatgagcaccgaagaggcccgttttctcacttaccatatgtggccattgactttcctgagcccttcagagctcgcgcgcgccggtttttactacatcggcccgggcgaccgcgttgcgtgcttcgcctgcggaggaaaactttcgaactgggaaccaaaggatgatgccatgtcggaacaccggcggcattttccaaattgcccattcctcgaaaattccttggagactctccgtttctcgatctcaaatctgagcatgcaaactcacgccgccagaatgcggaccttcatgtattggccgtcctcggtgcctgtgcaacccgaacaactcgcctccgcaggtttctactacgtggggcgcaacgacgacgtcaaatgtttctgctgcgatggaggactccggtgttgggaaagcggcgacgatccgtgggttgaacatgccaaatggttcccgagatgcgaatttctgattcgcatgaagggacaggagtttgtcgatgaaatccagggacggtacccgcacctgcttgaacaactgctctctacctcagataccaccggggaagagaacgcagacccacctataatccatttcggcccaggtgagagttcgagcgaggatgcggtgatgatgaacaccccggtcgttaagagcgccctggaaatgggattcaaccgcgatttggtgaaacagactgtgcaatcaaagatcctgacgaccggagaaaactacaagacggtgaatgatatcgtcagtgctttgctcaatgcagaggacgagaaacgcgaagaggaaaaggagaaacaggccgaagagatggcgtccgacgacctgtcgctgattcggaagaatcgcatggccttgtttcagcaactgacttgcgtgctgccaatccttgacaatcttctgaaagccaacgtgataaacaaacaagagcatgacattatcaagcagaaaactcagatcccgctccaggcccgcgagctgattgatactatcctggtgaagggaaatgcggcggcaaacatctttaagaactgcctgaaagagatcgatagcactctctacaagaatctgttcgtcgacaaaaacatgaaatacatcccgacggaggatgtgagcggcctgagcctggaggaacagctgcgccgccttcaagaagaacgcacctgcaaggtgtgcatggataaggaggtgtccgtggtgttcatcccgtgtggacacctcgtcgtgtgtcaggagtgtgctccgagcctcagaaagtgcccgatctgtcgggggatcataaagggtaccgtgcgcacttttctgagc

SEQ ID NO: 32218 - DNA, 1854 bp, Artificial Sequence
  Description of Artificial Sequence: Synthetic coding sequence
atgcacaagaccgcctcccagagactttttcctggaccctcctaccaaaacattaagtcgatcatggaagattcgactattctgtcggactggactaactccaataagcagaagatgaaatacgattttagctgtgaactctacaggatgtccacctactcgaccttccctgctggcgtgcccgtgtccgaaagatctttggcaagagcaggattttactacacgggcgtgaatgacaaggtgaagtgcttttgttgcggactcatgcttgacaattggaagctgggtgacagcccaatccagaagcataaacaactgtacccttcctgttcgtttatacaaaatctcgtgtcagcatccctgggaagcaccagcaagaatacctcgcctatgcggaactcctttgctcattcactgtcgcccacgctcgaacattcgtcccttttttcgggctcgtactcaagcctttcgcctaatcctcttaactcccgcgcagtcgaagatatctcctccagcaggaccaacccgtattcctacgcaatgtcaaccgaggaagcccgtttcctcacttaccatatgtggcccctgacctttctttcgccttcagaacttgcaagagcaggtttctactacattggaccgggggaccgcgtagcatgtttcgcctgtggaggaaagctgagcaactgggaacctaaagatgatgcaatgtctgaacataggcgccattttccaaactgtcctttccttgaaaatagcctggaaactcttaggttttccattagcaatttgtccatgcagacccatgcagcccgaatgaggactttcatgtactggcctagctcagtcccggtgcaaccagagcagcttgcgtcagctgggttctactacgtgggccgcaacgacgatgttaaatgtttctgttgtgatgggggtctgcgttgttgggaatcgggagacgacccatgggtggaacatgctaagtggttccctcgctgtgaattccttatacgtatgaaggggcaagaatttgtggatgagattcaaggtagataccctcacctgcttgaacagcttttgtccactagcgacactaccggggaagaaaatgcagacccacccataatccacttcggcccgggtgaatccagctcggaagatgcggtgatgatgaacactcccgtggttaaaagcgccctcgaaatgggatttaacagagatcttgtcaagcaaactgtgcaatccaagattctgaccactggagagaattacaagacggtgaacgatatcgtctccgcacttctcaatgcagaagatgagaagagggaagaggagaaggagaagcaggcggaagagatggcgtctgacgacctgagcctgattaggaaaaaccgtatggcacttttccagcagctgacttgcgttctgcctatccttgataaccttctcaaggccaatgtgatcaacaagcaagaacatgatatcataaagcaaaagacgcaaattccactgcaagcacgggaactgattgataccattctcgtcaaggggaatgcagcggcaaacattttcaaaaactgcctgaaggaaattgatagcactctgtacaagaatctctttgtggacaaaaacatgaagtacatcccaaccgaagatgtgtcaggtctttcacttgaagaacagctgcggagacttcaggaggaacgaacgtgtaaggtgtgcatggataaggaggtttcagtcgtgtttattccttgtggccatcttgtggtatgccaggagtgtgcgccatcgctgaggaaatgtcctatctgcaggggcattatcaagggtactgtcagaaccttcctgtcg

SEQ ID NO: 32219 - DNA, 1854 bp, Artificial Sequence
  Description of Artificial Sequence: Synthetic coding sequence
atgcacaagacggccagccagcggttgttcccgggaccatcgtaccaaaatattaaatccatcatggaagatagcactatactgtccgactggacgaatagtaataagcaaaaaatgaaatacgactttagttgtgagctatataggatgtccacctactctacgtttcccgcaggtgtgcccgtcagcgagcgatcgctggcacgtgccggcttctactacacaggggttaacgataaagtgaagtgcttttgctgtggcctcatgctggacaactggaagctgggcgattccccgattcagaagcataaacagctctacccctcctgttccttcatccagaacctggttagcgcgtcccttggcagcacatcaaagaacacatcccctatgcggaatagtttcgcacacagcctgtctccgactctcgagcatagttcactgtttagcggctcgtattcctccttaagcccgaatcccctgaactcgcgggccgtggaggatatctctagttcccgtaccaatccgtactcctatgctatgtctacagaggaggccaggttcttgacctatcacatgtggcccttgacctttttgagccctagtgaactggcgcgcgctggattctactacatcggcccaggagacagagttgcctgtttcgcatgtggcggaaagctttctaactgggagccgaaggacgacgccatgtcggagcatagacggcatttccctaattgccctttcctggagaactctcttgaaaccctgcgcttctccatttctaatctctcgatgcagactcatgctgcaaggatgaggaccttcatgtattggccctcgtccgtcccagttcaacccgagcagctcgcctccgccggcttctactacgtgggcaggaacgacgatgttaaatgcttttgctgcgacggtggcctccgatgctgggagagcggagacgatccctgggtcgagcacgctaagtggttcccccggtgcgagttcttgattcgaatgaaggggcaggaattcgtagatgagatccaaggacgctacccccacttgctggaacagctgctcagtacctcggacacgacgggagaggagaatgccgatccaccaatcatccacttcggccccggcgagagctccagtgaggacgcagtgatgatgaacacgcctgttgttaagagcgctttggagatgggcttcaatcgcgatctggtaaagcagaccgttcagtccaagatacttacgacaggcgagaattacaaaacggtgaatgatatcgtgtcggctttgttgaacgctgaggatgagaagagagaagaagaaaaagagaagcaggcggaggagatggccagcgatgatctctcgctgattcgcaagaatcgcatggccctcttccagcaactgacctgcgtgctgccaattctggataacctgttgaaggccaatgtgatcaataagcaggagcacgatattatcaagcagaagacgcagattcctctgcaggcacgcgaactgatcgatacgatattggtcaagggtaacgcagccgccaacatctttaagaattgcctgaaggaaatagacagtacactgtacaagaacctcttcgtggacaagaacatgaaatacatccccaccgaggatgtgagcgggcttagcttggaggagcagcttcgaagactccaggaagagcggacctgcaaggtgtgcatggacaaagaggtgtcagtggtttttatcccgtgcggccatttggtggtctgccaggagtgcgctccctccttgcgcaagtgtccgatctgcaggggcataattaaaggcacggttagaacgttccttagc

SEQ ID NO: 32220 - DNA, 1854 bp, Artificial Sequence
  Description of Artificial Sequence: Synthetic coding sequence
atgcacaagaccgcttctcagagactctttcctgggccttcttatcagaatatcaagagtatcatggaagattcaactatcctttccgattggacaaatagcaataaacaaaagatgaagtacgacttctcttgtgaactttacagaatgtcaacgtactcaacgttccccgctggagtgcccgtttcagaacgcagcctcgcccgagctgggttttattacaccggcgttaatgacaaggtgaagtgcttttgctgcggtcttatgctggacaactggaagctgggcgacagtccgattcaaaaacataaacagctgtaccctagctgtagttttattcagaacctcgtgagtgctagtctggggtctacatcaaaaaacacaagtcctatgaggaatagctttgcccacagtctgagccccacactggagcactctagtcttttcagcggaagctactctagcctctctcccaacccccttaactcccgtgctgtggaagatataagctctagtaggaccaacccatattcctatgcaatgagtacggaagaagcccggttcctgacataccatatgtggcccttgactttcctaagcccatctgaactcgcccgcgccgggttttactatatagggccaggggaccgagtggcatgctttgcatgtgggggtaagctgtccaactgggaacccaaagacgacgcgatgtcagagcataggagacacttccctaattgtcccttcctagaaaactcattggaaaccttgagatttagtatttctaatcttagtatgcagacccatgccgctagaatgaggaccttcatgtactggccaagttcagtgccggtccaaccagagcagctggctagtgccgggttttattacgtgggacgaaacgacgacgtgaagtgtttctgttgtgacggtgggctgcgatgctgggagagcggggatgacccttgggtggagcacgctaagtggttcccccggtgtgagttcctgatccgaatgaaggggcaggaatttgttgacgaaatccagggtagataccctcatctgttggaacagttgttgtcaacctctgatacaacaggagaagaaaacgcagatccacccataattcattttggacctggtgagtcatctagtgaggacgccgtgatgatgaacaccccggtcgtcaaaagtgctctggagatgggatttaatagggacctggtcaagcagacggttcagtccaagatcctgaccaccggcgaaaactacaaaactgtaaacgacatcgttagcgcactgctgaatgctgaagatgagaaaagagaagaggaaaaggagaagcaggccgaagagatggcaagcgatgatctgagtttaatccgaaagaacagaatggcactgttccagcaattgacttgtgtgctgccgatcttagataacctgctgaaagcgaacgtgattaacaaacaggaacatgatatcataaaacagaagacacagataccactgcaggcccgtgagcttatcgatactatactagtgaaagggaatgccgccgccaacatctttaaaaactgtctcaaggaaatcgatagtaccctttacaaaaacttattcgtggataagaacatgaagtacatccctacggaagatgtgagcgggctttcgttagaggagcaactgcgacggttgcaggaagaacgaacctgtaaagtgtgcatggacaaggaggtgagcgtggtgttcatcccttgcgggcatctagttgtgtgtcaggagtgcgcgccgagcctacgaaaatgcccaatctgcagggggattattaaaggcaccgtgagaacctttctcagt

SEQ ID NO: 32221 - DNA, 1854 bp, Artificial Sequence
  Description of Artificial Sequence: Synthetic coding sequence
atgcacaaaacagcctcacaacggttgttcccaggtccatcgtaccaaaatatcaagagtataatggaggattcaactatattgagcgactggactaacagtaataagcaaaaaatgaagtatgacttctcttgtgagttataccggatgagcacctattccaccttcccagctggagttccggtttccgagcgatccctggctcgagccgggttctattatacaggggtgaacgacaaggttaaatgcttttgttgcggtctgatgcttgataactggaagctcggggactcccccattcagaagcacaagcagctgtatccgtcctgcagtttcattcagaatctggtgagcgcttctctgggttccacctccaaaaatacgtctccgatgagaaacagttttgcccactctctttccccaacattagaacactctagcctgttcagtggtagttactctagcttgagtccaaacccactgaattccagggctgtggaagacatcagttcttcaaggaccaacccgtactcttatgcgatgagcaccgaggaagcccgtttccttacataccacatgtggcctctgaccttcctgagcccctctgagttagcccgcgccgggttctactatatcggccccggagatcgtgtagcttgcttcgcatgtggcgggaaactctctaactgggaacctaaagacgatgcaatgtcagagcacagaaggcattttccgaactgccccttcctggagaatagcctggaaacactgcgattttccatctccaacctgtctatgcagacccacgctgctcgtatgcgaaccttcatgtactggcccagcagcgtgcctgtgcagcctgagcagctggccagcgcaggcttttattatgtgggtcgcaatgatgatgtgaaatgcttctgttgtgatggaggactaaggtgctgggagagtggggacgatccatgggtcgagcacgccaaatggtttccccgctgtgagtttctgatccgcatgaaaggacaggaattcgtggatgaaatacagggtcgatacccacatctactggagcagcttctgtcaacttccgatacaaccggagaggaaaacgcagatccgcccattatccacttcggcccaggcgagtcatcatcagaggatgcagtaatgatgaatacaccggtggtcaagagtgccctggaaatgggttttaatcgagaccttgtaaagcaaacggtgcagagtaagatcctcacgacaggggaaaattacaagacggtgaacgacattgtctctgctctgctgaatgcagaagatgagaaaagggaagaagagaaggaaaaacaggcagaggaaatggcgtcagacgacttgagcctcataagaaaaaatcgcatggcactgtttcagcagctcacctgcgtgctcccaatcttggataacctgctaaaggccaacgtgatcaataagcaggagcacgacattattaagcagaaaacacaaatcccactgcaggcacgcgaactgattgatactatccttgtgaagggaaacgctgcagccaacatttttaagaactgcttaaaggagattgattcaacgttgtataagaatctttttgtggacaaaaacatgaagtacatcccaaccgaggacgtaagtggcctgtcattagaggaacagctgcgacgccttcaggaagaacgaacgtgcaaggtgtgcatggataaagaggtgtccgtcgtatttattccgtgtgggcaccttgtggtttgtcaggagtgcgctccgtctctgaggaagtgccctatttgtcggggtattatcaaggggacagtgagaacttttctctcc

SEQ ID NO: 32222 - DNA, 1854 bp, Artificial Sequence
  Description of Artificial Sequence: Synthetic coding sequence
atgcataaaacggcgtcgcaacgattatttccgggtccgtcgtatcaaaatataaaatcgataatggaagattcgacgatattatcggattggacgaattcgaataaacaaaaaatgaaatatgatttttcgtgtgaactatatcgtatgtcgacgtattcgacgtttccggcgggtgttccggtttcggaacgttcgctagcgcgtgcgggtttttattatacgggtgtaaatgataaagtaaaatgtttttgttgtggtctaatgttagataattggaaactaggtgattcgccgatacaaaaacataaacaactatatccgtcgtgttcgtttatacaaaatctagtttcggcgtcgttaggttcgacgtcgaaaaatacgtcgccgatgcgaaattcgtttgcgcattcgctatcgccgacgttagaacattcgtcgttattttcgggttcgtattcgtcgctatcgccgaatccgttaaattcgcgagcggtagaagatatatcgtcgtcgcgtacgaatccgtattcgtatgcgatgtcgacggaagaagcgcgatttctaacgtatcatatgtggccgctaacgtttttatcgccgtcggaattagcgcgtgcgggtttttattatataggtccgggtgatcgtgtagcgtgttttgcgtgtggtggtaaattatcgaattgggaaccgaaagatgatgcgatgtcggaacatcgtcgacattttccgaattgtccgtttttagaaaattcgttagaaacgttacgattttcgatatcgaatttatcgatgcaaacgcatgcggcgcgtatgcgtacgtttatgtattggccgtcgtcggttccggttcaaccggaacaattagcgtcggcgggtttttattatgtaggtcgtaatgatgatgtaaaatgtttttgttgtgatggtggtctacgatgttgggaatcgggtgatgatccgtgggttgaacatgcgaaatggtttccgcgttgtgaatttttaatacgaatgaaaggtcaagaatttgtagatgaaatacaaggtcgttatccgcatctactagaacaactattatcgacgtcggatacgacgggtgaagaaaatgcggatccgccgataatacattttggtccgggtgaatcgtcgtcggaagatgcggtaatgatgaatacgccggtagttaaatcggcgctagaaatgggttttaatcgtgatctagtaaaacaaacggtacaatcgaaaatattaacgacgggtgaaaattataaaacggttaatgatatagtatcggcgctattaaatgcggaagatgaaaaacgtgaagaagaaaaagaaaaacaagcggaagaaatggcgtcggatgatttatcgttaatacgaaaaaatcgtatggcgttatttcaacaattaacgtgtgttttaccgatactagataatttattaaaagcgaatgttataaataaacaagaacatgatataataaaacaaaaaacgcaaataccgttacaagcgcgagaactaatagatacgatactagttaaaggtaatgcggcggcgaatatatttaaaaattgtttaaaagaaatagattcgacgctatataaaaatttatttgtagataaaaatatgaaatatataccgacggaagatgtttcgggtttatcgttagaagaacaactacgacgattacaagaagaacgtacgtgtaaagtttgtatggataaagaagtttcggtagtttttataccgtgtggtcatctagtagtttgtcaagaatgtgcgccgtcgctacgtaaatgtccgatatgtcgtggtataataaaaggtacggtacgtacgtttctatcg

SEQ ID NO: 32223 - DNA, 1854 bp, Artificial Sequence
  Description of Artificial Sequence: Synthetic coding sequence
atgcacaaaacggcttcccagcggctgttccctgggccctcctatcagaatatcaaatccattatggaagacagcaccattcttagtgattggacaaatagcaacaaacagaagatgaagtacgattttagctgtgagctgtatcggatgagcacatacagcacctttcccgcaggagtgcccgtgagtgagcggtctctggctcgcgcgggcttctattacacgggcgttaatgacaaggttaagtgcttctgctgtggcctcatgctggataattggaagctaggagactcaccaattcaaaagcataagcaattgtacccatcatgttccttcatccagaatttggtgtccgcaagcctcggtagcacctccaagaacacctccccaatgaggaactctttcgcccattctttatctcccacacttgagcatagctccttgttcagtggcagttatagtagtttaagccccaatccgctgaactcaagggcggtggaagatatctcttccagccgtactaacccttattcatacgcaatgtctactgaggaggctcggttccttacctatcatatgtggcctctgacttttttgtcaccctcagagcttgcaagggctggattctattatataggcccgggggatcgcgtagcatgcttcgcttgtggcggcaaactctccaattgggagcccaaagacgatgccatgtccgagcatagaaggcacttccccaattgtccctttctggaaaactcattggaaactctgcgattctctatcagcaacctgagtatgcagacgcacgccgcgcggatgcggaccttcatgtattggccaagctctgtgcccgtgcaacctgagcagctggcatcggcagggttctattacgtggggagaaacgatgacgtgaagtgcttctgctgtgacggcggtttaaggtgctgggagtccggggatgatccctgggtagagcacgcaaagtggtttccacggtgtgagtttctaattcgtatgaaaggacaggagttcgtcgacgaaattcagggccggtacccacacctcctggaacagctgttgagtacctctgacaccacaggcgaggagaatgctgatccacctatcattcacttcggccctggcgaatcaagtagtgaagatgccgtaatgatgaacacaccagtggttaaatctgctcttgagatgggcttcaaccgggacctggttaagcagaccgtacagtccaaaattttgaccactggcgagaactataagacagttaatgacatcgtgtcagcccttcttaacgccgaggatgagaaaagggaggaggaaaaagagaagcaggcggaagaaatggcctccgacgatcttagcctgatcagaaagaaccggatggctttgttccagcagctcacgtgcgttttgcccatactcgataacctgcttaaggcgaatgtgattaataagcaggagcatgatatcatcaaacagaagacgcagatccccctgcaggctagagagctaattgacaccatcctggtaaagggaaacgcggcggctaatattttcaagaattgcctgaaggagatcgacagcaccttatacaaaaatttgttcgtcgataaaaacatgaaatacatcccaactgaggacgtgagcgggctgtccttggaggaacagcttcggcgtttgcaggaagagagaacttgtaaggtgtgcatggacaaggaggtttctgtcgtcttcataccatgcggccacttagtcgtctgccaggaatgtgccccatctctgagaaaatgtcctatatgtagaggtattatcaagggtaccgtcagaacttttctaagt

SEQ ID NO: 32224 - DNA, 1854 bp, Artificial Sequence
  Description of Artificial Sequence: Synthetic coding sequence
atgcacaagactgcctcacagcggctcttccctggaccatcgtaccagaacattaagtcaatcatggaggactccaccatcctgtcggactggactaattcgaacaagcaaaagatgaaatacgacttctcgtgcgagctgtaccgaatgtcgacctactccacctttccggctggagtgccagtgtcggagcgttctctggcccgggcgggattttactacactggagtgaacgacaaagtgaagtgtttctgctgcgggctgatgctggacaattggaaactcggagactccccgatccagaaacataagcaattgtacccgtcatgctccttcatccagaatctggtgtcggcctcgctgggaagcaccagcaagaacacttcccctatgaggaactccttcgcacactcactctccccgactctcgagcactcctcactgttcagcggtagctacagctcactgtcaccgaacccgctgaattcccgcgcggtagaggatatctccagctccaggacgaacccgtattcctacgccatgtcgaccgaagaggcgcgtttccttacttaccatatgtggccgctgactttcctgagcccgagcgaattggctcgggcaggattctactatatcggccctggtgaccgcgtggcctgcttcgcttgcggcggaaaactgtccaattgggagcctaaggatgacgcaatgtcagaacacaggcgccattttccgaattgcccatttctcgaaaacagcctcgaaaccctccgcttctccatcagcaatctctcgatgcagacccatgcggcccgcatgcgcaccttcatgtactggcctagctccgtgccggtgcagccggagcagctcgcctccgccggcttctactacgtgggccggaacgatgacgtcaagtgcttctgctgtgacggaggactccggtgttgggaatccggagacgacccgtgggtcgaacacgccaagtggtttcctcgctgcgagttcttgattcgcatgaagggccaagaattcgtggatgaaatccagggaaggtacccgcatctgttggagcagctgctgtcgactagcgacactacgggagaggaaaacgccgacccaccgatcatccactttggtccgggcgaatcgtccagcgaggacgcggtgatgatgaacacccctgtggtcaagtctgcgctggaaatgggttttaacagggatctggtgaaacagacggtgcagtcaaagatcctgacgaccggagagaactacaagactgtgaacgacatcgtgtcagcactcctgaacgcggaagatgagaaacgggaggaagaaaaggagaagcaggctgaggaaatggcttcggatgacctctcccttatccgcaagaaccgcatggcgctcttccaacagcttacgtgcgtccttcctatactggataaccttcttaaggcaaatgttatcaataagcaggaacacgacatcatcaagcaaaagactcagatcccgctgcaggcaagggaactgatcgatactattctggttaagggaaacgcagccgcgaatatcttcaagaattgcctgaaggagattgactcgacgttgtacaagaatctgttcgtggataagaatatgaaatacattccgactgaggacgtgtcaggacttagcttggaagagcagctccgccggctccaagaagaaagaacttgtaaggtgtgcatggacaaagaagtcagcgtggttttcatcccgtgcggacatctcgtggtctgccaggagtgtgcaccaagcctcagaaagtgtccaatctgccgcggaatcatcaaaggtactgtgcgcactttcttgtcg

SEQ ID NO: 32225 - DNA, 1854 bp, Artificial Sequence
  Description of Artificial Sequence: Synthetic coding sequence
atgcataaaacagcctcccagagactcttccccggcccctcataccagaacattaagagcatcatggaagacagtactatactgtctgattggaccaactcaaacaagcaaaaaatgaagtacgatttttcctgcgaactctataggatgagcacatacagcacctttcccgccggcgtcccagtgtctgaacggtctctggccagggccggcttttattacacgggagtgaatgacaaggtcaaatgcttttgctgtggactgatgctggacaattggaagctgggcgatagtcccattcaaaagcacaagcagttgtacccgagctgttcttttatccagaatctggtcagcgctagcctgggatctacttcaaaaaatacctcacccatgaggaattcctttgcccacagcctctcccccaccctggagcacagtagcctgttctcgggatcatactcttccctatcaccgaaccccctgaattcccgggccgtggaggatatttcctcatccaggaccaatccctactcctacgctatgtccaccgaggaggcacgtttcttgacttaccatatgtggcccttgaccttcttgagccctagcgagctggcccgcgcagggttttactacattggacctggcgaccgcgtggcctgcttcgcatgtggaggaaagctgtctaattgggaacctaaggatgatgccatgtcagaacaccgccggcattttcccaactgcccattccttgaaaacagtcttgagaccctgaggttcagcatctctaatctctccatgcagacacacgctgcgcgtatgcgcaccttcatgtattggccttcgagcgtccccgtccagccggaacagctggcctccgcaggtttctattacgtgggcaggaatgatgacgtgaaatgcttttgttgcgacggcggactgaggtgttgggagagcggtgatgatccatgggtcgaacacgcaaaatggttccctaggtgcgagtttctgatccggatgaaagggcaggagtttgtggacgaaatacaggggaggtaccctcacctccttgagcaattgttgtcaacctctgataccactggtgaggagaacgctgacccacctataatacactttggacctggagaatcttcctctgaggacgctgtaatgatgaatactcccgtggtaaagagtgccctggaaatgggattcaacagagatctcgtgaaacagactgtgcagagcaaaatattgaccactggagaaaattacaaaacggtgaatgacattgtatccgcgctactaaatgcggaggatgaaaagcgcgaagaggagaaggagaaacaggcagaggagatggcatcagatgatttatctttaatccgaaaaaatcgcatggccttatttcagcagcttacatgcgtcttgccgattttggacaatctgctcaaagccaacgtgattaacaagcaggagcatgacattattaaacagaaaacccagattcctttgcaggcacgcgaactgatagacacgattctggtgaaagggaacgcagccgcgaacatcttcaaaaactgccttaaagagattgatagtaccctttacaagaatttattcgtggacaagaacatgaaatatattcctactgaggacgtgagtggcctcagcctggaagaacagttgcgacgcttgcaggaggagcggacctgtaaggtgtgcatggacaaagaagtgagcgtagtcttcataccatgtggccaccttgtggtttgccaggaatgtgcaccgtccttgaggaaatgcccaatttgtagaggcatcattaaaggcactgtgcggacgttcctatct

SEQ ID NO: 32226 - DNA, 1854 bp, Artificial Sequence
  Description of Artificial Sequence: Synthetic coding sequence
atgcataaaacagcgtcccagagattattcccaggcccatcgtatcagaacatcaagtcaatcatggaggattcaactatcttgagtgactggaccaattcaaacaaacagaaaatgaagtatgacttctcttgcgagctttatcgtatgtctacctatagcactttccctgcgggcgtgccagtatcagagaggtctctggcccgcgcaggattctattacactggcgttaacgataaggttaaatgcttctgttgtggcctaatgcttgacaattggaagcttggggatagtcccattcagaaacataaacaactgtacccctcttgcagcttcattcagaaccttgtgtcagcttccttagggagcacatctaaaaacacctccccaatgagaaattcgtttgctcatagtctttcccccacattagaacactcaagtctgttttcaggatcatattcatctttaagcccaaaccctctcaacagcagggccgttgaagacatcagctcgtctcggactaacccctattcatacgccatgtctacggaagaagcccgcttcctgacataccatatgtggccgttgactttcctcagcccttctgagctcgccagagcaggcttctattatattggtcctggggacagagtcgcttgcttcgcatgcggtgggaaattgagcaactgggaacctaaggatgatgccatgtcagaacaccgaagacactttccaaattgccccttccttgaaaatagcctggagacacttcgtttctccatcagtaatttatcaatgcaaacccacgcagctagaatgagaacatttatgtattggccctcctctgttcccgtccagccggaacagctggccagtgcaggtttttactatgttggtaggaatgatgacgtgaagtgtttctgttgcgatgggggactgcggtgctgggagagcggggatgacccctgggtagagcatgcaaaatggttcccgcgctgtgagtttctgattcggatgaaagggcaggaattcgttgatgaaattcaaggccggtaccctcatttgttagaacagttgctttccacaagtgacaccaccggtgaggagaacgccgatccaccaatcatacattttggccccggtgaatctagcagcgaagatgccgtcatgatgaacactcccgtggtgaaatccgctcttgagatgggctttaatcgtgacctcgtgaaacaaacggtgcagtctaagatactcactacaggggaaaattataagactgtgaacgacatcgtttccgcactcctcaacgccgaagatgagaaacgcgaagaagaaaaagaaaagcaggccgaggagatggccagcgatgaccttagcctcattcgcaaaaaccgcatggccctgttccaacagctgacatgcgtgctgcccatcctggacaacctcctcaaggccaatgtaatcaataagcaggaacacgacatcatcaagcaaaagacccagatacccctgcaggccagagaactgattgatactatactcgttaaaggtaacgccgccgccaacatattcaagaactgtctcaaggagatagacagtaccctttacaaaaatttgttcgtggacaagaacatgaagtacatccccacggaggacgtgtccggcttgtcactcgaagagcagctgcgacggctgcaagaggaaagaacctgcaaagtttgtatggacaaggaagtgtcagtcgttttcataccgtgtggacatctcgttgtgtgtcaagagtgtgccccatctctcaggaagtgccctatctgtcggggaattataaaggggaccgtgcggacttttctctct

SEQ ID NO: 32227 - DNA, 1854 bp, Artificial Sequence
  Description of Artificial Sequence: Synthetic coding sequence
atgcataaaaccgccagccagagattgttccccggcccctcctatcagaacattaagtcgattatggaggactctaccattctgtccgattggacaaatagcaacaagcaaaaaatgaaatacgatttctcctgcgaattgtatagaatgtcaacctatagtaccttccccgcaggcgtgcctgtctccgaacgatctctagctagggcagggttctactatacaggagtcaacgataaggttaaatgtttttgctgcgggttgatgttagacaattggaaactaggtgactcacccattcagaaacacaagcagttatacccgagctgttcatttattcagaatctggtcagcgcatccctcgggtctactagtaagaacaccagccctatgaggaacagttttgctcactccctgagcccaaccttggaacattcctcgctgttctcaggcagttactcttccttaagccctaatcccttgaattctagggcggtcgaggatatctcaagctctcggaccaatccttatagctatgccatgagtacggaagaggcgcgtttcctgacgtatcacatgtggccactaacttttctctcgccgtcagaactcgctagggcaggtttctactatatcggacctggcgaccgagtggcatgtttcgcatgcgggggtaagttgtctaactgggagcccaaggatgatgctatgagcgaacaccgccgccacttccctaactgtcccttccttgagaatagcctggaaactctcaggttctccattagcaacttgtcgatgcagacccacgccgctcgcatgagaaccttcatgtactggccctcctctgtgcccgtgcagcctgagcaactcgccagcgcaggtttctattacgtcggaagaaacgatgatgtgaagtgtttctgctgtgacggtggcctccgctgttgggaatctggggatgacccttgggttgaacacgctaagtggttcccccggtgtgagttcctcatccgtatgaagggccaagagttcgtggacgagattcagggaaggtatccacatctgttagagcagttactgagcacttcagacaccacaggggaggagaatgctgaccctccaatcattcacttcgggcctggggagagtagctcagaagatgccgtgatgatgaacacacctgttgttaagtcagcgttagagatgggtttcaatagagacctcgtgaaacaaacggtgcagtcgaagatcctgacaacaggagagaactataaaactgtgaatgacattgtctcagccctactcaatgctgaagatgagaaaagggaggaggagaaagagaaacaggctgaagagatggccagcgacgatttatcattaattaggaagaaccgaatggcactatttcagcagttaacatgcgtcctgccaatcctggacaacctgttgaaggcgaacgtaatcaacaaacaggagcatgacatcataaagcagaaaacccaaattcctctgcaggcacgtgagttaattgataccatactcgtcaaggggaacgcagccgcaaatatttttaagaattgcctcaaggagatcgatagcacactgtataaaaatctgtttgtagataagaatatgaagtacatacccacagaagacgtcagcggactgagcttggaggaacagttacggcgactacaggaagagcggacatgcaaagtgtgcatggacaaggaagtgtctgtggtctttatcccctgcggacacctggtagtgtgccaggaatgcgctccatcgctgcgaaagtgcccgatctgtcgcgggatcatcaaagggacagtcagaacattccttagc

SEQ ID NO: 32228 - DNA, 1854 bp, Artificial Sequence
  Description of Artificial Sequence: Synthetic coding sequence
atgcacaaaactgcaagccagcgcctattcccagggccctcttaccagaacatcaagagcatcatggaagacagcactatcctgtcagactggacgaattctaataagcagaaaatgaagtatgacttttcgtgcgaactgtatcggatgagtacatattccactttccccgcaggtgtcccagtgtcggaaagatctctcgctcgtgcaggcttttattatactggagtaaacgacaaagtaaaatgcttctgctgcggcctcatgttggacaactggaagctgggggattctcctattcagaagcacaagcagctgtacccctcctgttcattcatacagaatctcgtttctgcttctttagggtctacatccaagaatacttcacccatgaggaactccttcgctcattctctgtcacctacgctggagcattcgtctttgttttcaggatcatattctagcctgagccctaacccacttaacagccgcgctgtggaggacataagctcatcacggaccaacccttattcttacgcaatgtcgactgaggaggctagattcttaacatatcatatgtggcctctgactttcctgtcgcctagtgagctggcccgcgccggattctactacatcggtcctggggaccgagttgcatgcttcgcttgcggagggaagctgagcaactgggaaccgaaggatgacgctatgagcgagcataggcggcacttcccaaattgtccgttcctggaaaacagcttggagacgctcagattttctatcagtaatctaagcatgcaaactcacgccgcccgcatgcggacatttatgtactggccaagctctgtgcctgttcagccagagcagctggcgagcgcagggttttattacgtgggccgtaatgatgacgtcaaatgcttctgttgtgacgggggtcttaggtgctgggagtccggggacgatccatgggttgaacacgcgaaatggtttccccgatgcgaattcctcatccgcatgaaaggccaggagttcgtagacgaaatccagggccggtacccacatctgctggaacagctgctgagtacctccgacactacaggcgaagaaaacgctgaccctcccattattcacttcgggccaggagaaagtagttccgaggacgccgtaatgatgaacactcctgtggtcaaatccgctttagagatgggcttcaatcgggatctggttaagcagacagtgcagtccaaaatcctgaccactggcgaaaattataagaccgtgaatgatatcgtgagcgctctgctcaatgccgaggatgaaaaacgcgaagaggaaaaggagaaacaggctgaggaaatggcaagtgacgatttgagtctgatccgcaagaaccggatggcactgtttcagcaactaacctgcgtgttaccaatcttggataatctgttgaaagcgaatgtgatcaataaacaggagcacgatataatcaaacagaaaactcagatccccctccaagcccgggagcttatcgatacaatcttagtcaaaggcaacgccgccgctaacatttttaaaaactgcttgaaggagatagactcaacactctacaaaaacctgttcgtagacaagaacatgaaatatattcctacagaagatgtgtctgggttgtctctagaagaacagctcaggcgactccaagaagaaaggacctgcaaggtatgtatggacaaagaggtatcggtggtgttcattccctgtggacatctcgtcgtgtgtcaggagtgtgctccatcattgcgcaaatgccctatatgccgagggatcatcaaaggaacggttaggactttcctgtca

SEQ ID NO: 32229 - DNA, 1854 bp, Artificial Sequence
  Description of Artificial Sequence: Synthetic coding sequence
atgcacaagacggccagtcagcgactctttccaggaccgagttaccaaaacataaaatccatcatggaggactctacaattcttagcgattggacaaattctaataagcagaagatgaagtatgacttctcctgtgagctataccgcatgtccacctatagtacgtttcccgcaggcgtaccggtgtcagaacgttccctcgcccgggctgggttctactacactggcgtgaatgataaggtgaagtgcttttgctgtggtctgatgcttgacaattggaaactgggagactcccctatccaaaagcataagcagctctacccctcatgttcctttatacagaacctggttagtgccagcctggggagcacctccaaaaatacgtcacccatgagaaactccttcgcccactccttatcaccgaccctggaacatagcagtttgtttagtggcagctatagcagtctgagtccaaacccactcaattcccgggccgtcgaggacatctccagctcaagaactaatccatacagctatgcaatgtcaactgaggaggcccgtttcctgacttatcatatgtggccactgacgtttctctccccctctgaactagcgagggctggattttattatattgggcctggagatagggtcgcttgttttgcctgcggcggcaagctgtcaaattgggagcccaaagacgacgccatgtcagaacatcgccggcatttccccaactgccccttcctggaaaattcgctagagactctgaggttcagtatcagcaacctatcgatgcagactcacgctgccaggatgcgaacctttatgtattggcctagctcggtaccggtgcagcctgagcagctggcatcagcaggcttctactatgtggggcgtaacgacgatgtcaagtgtttttgctgcgacggcggcctaagatgctgggaatctggggacgacccttgggtcgaacacgcaaagtggttcccgcggtgcgagttcttgatcagaatgaaaggacaggagtttgtcgatgagattcagggacgctacccccacttactggagcagctactctccacgtctgacactaccggagaagagaacgccgatccaccaataatccactttggccccggcgagtcttcaagcgaggatgcagtcatgatgaatactcctgtggtgaagagcgcactggaaatggggttcaaccgcgatttagtaaagcagacagtccagagcaaaatattgacaacaggcgaaaattacaaaacggtgaatgatattgtgtcagccctgctgaatgcagaggatgaaaagagagaggaagaaaaagagaaacaagcagaagaaatggcaagcgatgatctgtctctgataaggaagaacaggatggcactgtttcaacaacttacctgcgtcctgccgattttagataatttactgaaggctaatgtaattaataaacaggagcacgatattatcaaacaaaaaacacagatcccccttcaggcccgcgagttgatcgacaccatcttagtgaagggaaatgccgctgccaatattttcaagaattgcttgaaggagatagacagcaccctgtacaaaaacctcttcgttgataagaatatgaagtacataccaactgaagatgtctccggactttcgttagaggagcagcttcgccgcctgcaggaagaacgaacgtgcaaggtctgtatggataaagaagtgagtgtagtgttcatcccatgcggtcatcttgtggtgtgccaggaatgcgccccttctctgaggaagtgcccaatctgtcggggcattattaagggcactgtgaggacattcctgagt

SEQ ID NO: 32230 - DNA, 1854 bp, Artificial Sequence
  Description of Artificial Sequence: Synthetic coding sequence
atgcataaaacggcatcccagagactttttccaggtccgtcgtaccaaaacattaagagcattatggaagattccaccattttgtcagattggaccaacagcaacaagcagaaaatgaaatacgatttttcctgtgagctgtaccgcatgagcacctactcgacttttccagcaggagtccctgtcagcgaacggtcactggcaagggctggattttactatactggtgtgaacgataaggtgaaatgtttctgctgtggtctgatgctcgataattggaagctgggagattcgccgattcaaaagcacaagcaactttacccctcgtgctccttcattcagaacctggtgtcggcatcattgggaagcacctcaaagaacacctcaccaatgcgcaactcctttgcccattcgctgtcgcctacgctcgagcatagcagccttttctccggttcgtacagctcgctttcccctaaccccctcaactcccgagcagtggaggatattagcagctcgagaactaacccttactcttacgcgatgtcgactgaagaagcacgcttccttacttaccatatgtggcctctgactttcctgtcgccctccgaactggcgagagcaggcttctactacattggcccaggtgatagagtggcatgtttcgcatgtgggggtaagctcagcaactgggagccaaaggacgatgcgatgtccgaacatagacggcattttcccaactgtccctttttggaaaactccctcgaaaccctgcgattctccatctcaaatctctcgatgcaaactcatgcagcaaggatgagaacttttatgtactggccatcatcagtgccagtgcaacctgagcagctggcctcagcaggattttactacgtgggtcggaatgacgatgtcaagtgtttttgttgcgatggggggcttcgctgctgggaatcgggtgacgacccttgggtcgaacatgcaaaatggtttcctcgctgcgagtttctcatacggatgaagggtcaagaatttgtggatgagattcaaggaagatacccgcatctccttgagcagctccttagtacttcggatactactggagaagaaaacgcggatccacccattattcattttggaccaggggaatcttcgtcagaggacgcggtgatgatgaataccccggtggtgaaaagtgcattggagatgggctttaatcgagatctcgtcaaacaaaccgtgcagtccaaaatcctgactactggtgaaaactacaagaccgtcaacgatatcgtgtcggcactcctgaacgcagaggacgagaaacgagaagaggaaaaagagaagcaggccgaggaaatggccagcgacgatctcagcttgatccgaaagaacagaatggcactttttcaacaacttacttgtgtgctgcccatcctggacaaccttcttaaggcaaacgttatcaacaagcaggagcacgacattatcaaacagaaaacccagatccccctgcaggctcgagaattgatcgatacgattttggtgaagggcaatgcagcggcgaacatattcaagaattgccttaaggaaatagattcaaccctttacaagaatctcttcgtggataagaacatgaagtatattcccactgaggacgtgtcgggtcttagcctggaggaacagcttagacgacttcaagaagaacgcacttgtaaagtgtgtatggataaggaggtgtcggtcgtgttcattccatgtggacacctggtggtgtgtcaggagtgtgcaccctctcttcggaagtgtccaatttgtcgtggaatcattaagggaactgtgcgcacgtttctttcg

SEQ ID NO: 32231 - DNA, 1854 bp, Artificial Sequence
  Description of Artificial Sequence: Synthetic coding sequence
atgcacaagactgctagccagaggctgttcccggggccctcgtaccagaatatcaagtcgatcatggaggactcgaccatcttgtccgattggactaactccaacaaacagaagatgaaatacgacttctcatgtgagctttaccggatgtccacttactcgacctttccagcgggagtgcctgtgtcagagcgctcgctcgcgcgggcgggattttactacactggtgtgaacgataaggtgaagtgtttttgctgtggactgatgctcgataactggaagctcggagatagtccgattcagaaacataagcagctgtatccatcgtgttcgttcatccagaacctcgtctcagcgtccctgggctccacctcgaagaatacctcgcctatgcgaaactccttcgctcatagcctgtcgcctactttggagcattcatcgctgttctccggatcctactcgtcgctgtccccgaaccccctgaactcaagagccgtggaggacatcagctcgtcccggactaatccgtattcatacgcaatgtcaaccgaagaagcgcgctttctgacttaccatatgtggccgctgactttcttgagcccgtccgaactcgcacgcgccggcttttactacatcggaccaggagatcgggtcgcatgctttgcatgtggcggcaagctgtcaaactgggaaccaaaagacgacgcaatgtcagaacatcgcaggcactttccgaattgtccgttcttggagaactcgttggaaactctgcggttttctatttcaaacctgtcgatgcagacccacgccgcgagaatgaggacctttatgtactggccgtcgtccgtgccagtccagccagagcaacttgcaagcgccggattctactacgtgggacgcaacgatgacgtgaagtgcttctgttgcgacggtggcctgaggtgctgggagagcggagacgatccgtgggtggagcacgctaagtggttcccgcgctgcgagttcttgattcgcatgaaaggacaagaatttgtggacgaaatccaaggaagatacccgcatctgctggaacaactgctctcgacgtcagataccaccggagaggaaaacgccgatccaccaatcattcatttcgggccgggcgaatcgtccagcgaggacgccgtgatgatgaataccccggtggtgaaatcggctctcgagatgggatttaaccgggacctcgtcaagcaaaccgtccaatcgaaaatcctcaccactggagaaaactacaagactgtgaatgacatcgtctccgcgcttctcaacgccgaggatgaaaaacgcgaagaagaaaaggaaaagcaagctgaagagatggcgtcggacgatctgtcactgatccggaaaaaccgcatggcgctcttccagcagctgacctgcgtgctccccatattggacaacctgctcaaggccaacgtgattaacaaacaggaacatgatatcattaaacaaaagacccaaatcccactccaagcacgggaactgatcgacaccatccttgtcaagggaaacgcggctgccaacatctttaagaattgcctcaaggagatcgatagcactttgtacaagaacctcttcgtggacaagaacatgaaatacatcccgaccgaagatgtctcgggactgtcgcttgaggaacagctgaggcgactgcaggaagagaggacttgcaaggtgtgcatggacaaggaggttagcgtggtgttcatcccgtgtggacatttggtcgtctgccaagaatgcgcaccttccctgagaaagtgcccgatctgtcgaggaatcattaaaggcaccgtccgcactttcctgtct

SEQ ID NO: 32232 - DNA, 1854 bp, Artificial Sequence
  Description of Artificial Sequence: Synthetic coding sequence
atgcacaaaactgcatcgcaacggttgttcccgggaccaagttatcaaaatattaaaagtattatggaagattctacaattttgtcggattggacaaactcaaacaagcaaaagatgaagtatgatttttcatgtgaactgtatcgtatgagtacgtacagcacttttccagcaggagtcccggtctcggagcgatctcttgccagagctggtttctactatacgggggtaaacgataaagtcaagtgtttttgttgtggtctcatgctcgataattggaagttgggagattctccgatccaaaaacataaacaattgtatccttcttgcagttttattcagaacttagtatccgcttcattgggtagtacgtctaagaacacatcaccgatgcgaaattcattcgcacactcactgtcaccgactttggaacactcgtccttgttttcgggtagttatagtagcctctcgccaaatcccctaaatagccgagcagttgaagacattagcagttcacgaacaaatccatatagctacgctatgtctactgaggaagctaggtttttgacttaccatatgtggccacttacatttttaagtccatctgaacttgcccgtgcaggattttattatatcggacctggagatagagtcgcttgcttcgcctgcggaggtaaacttagtaattgggaaccgaaagatgacgcaatgagtgagcatagaagacatttcccaaattgtccgtttctagaaaattcactggagaccttgagattttcaatatcaaatttatcaatgcaaacccacgcggcacgtatgagaacttttatgtattggccaagttctgtcccagttcaacctgaacaacttgcctcagccggattttattacgttggacgaaatgatgatgttaagtgcttttgttgcgacggaggactaagatgttgggaatccggggatgatccatgggtcgagcacgcaaagtggtttccacgttgtgagtttcttatccgtatgaaaggacaggagttcgttgacgaaatacagggacgttatcctcatctactcgaacaattgctctcgacaagtgatacaacaggcgaggaaaatgctgatccaccgattattcactttggtccgggtgaatcatcttctgaagacgctgtcatgatgaacacaccagttgtgaaaagcgctttggagatgggcttcaatcgagacctcgtcaaacagacagttcaatcgaaaattttgacaacgggcgaaaactataagacggttaatgatattgtttccgctttgctgaatgcagaggacgaaaaacgtgaggaggagaaggaaaaacaagcagaggagatggcctccgacgatctctcgctaatccgcaaaaacagaatggcactttttcaacaattgacatgtgttcttccaatcctcgataacctcttgaaggctaatgttattaacaagcaggaacatgacataattaagcaaaaaacccagatccctcttcaggcaagagaactaattgacacgattttggttaaaggtaatgcagctgcaaatatatttaagaattgcctgaaggaaattgactcaactttatataaaaatctcttcgtggataagaatatgaaatacatcccaacagaagatgtctcgggcctaagtctagaggaacaattgagacgtctacaagaagaaagaacttgcaaagtctgtatggataaagaagtgtctgtagtatttattccatgtgggcacttggtagtatgccaagagtgcgcccctagtcttcgcaaatgtccgatttgcagaggtattattaaaggaaccgttagaacgttcttaagt

SEQ ID NO: 32233 - DNA, 1854 bp, Artificial Sequence
  Description of Artificial Sequence: Synthetic coding sequence
atgcataagactgcgtcacagcgcctctttccgggcccttcctatcagaacatcaaatcgatcatggaggatagcacgatcctgtccgactggaccaacagcaacaaacagaagatgaaatacgacttctcatgcgagctgtaccggatgtctacttactcgactttcccagctggtgtgccggtgtcggaacggtccctggcccgcgcaggattctactacaccggggtcaatgacaaggtcaagtgcttctgctgcggactgatgctggataattggaagctcggggactcgcctattcaaaagcacaagcagctgtacccgtcctgttccttcatccagaatctcgtgtcagcgagccttggatcgacgtcgaaaaacacttctccgatgcgaaactcgttcgctcattcgctgtccccgaccctggaacactcgtcattgttctccggctcctacagctccctgtcgccaaaccctctgaacagcagagccgtggaagatatctcatcatcccggactaacccgtactcgtacgccatgagcaccgaggaagcacgctttctgacctaccatatgtggccgctgactttcctgtcaccgtccgagctcgcccgagcaggcttctattacatcggacctggcgaccgggtggcttgtttcgcttgtggtgggaagctgtccaattgggagccgaaagatgatgccatgtccgagcaccgccggcactttccaaactgcccctttctggagaattcactggaaaccctgcgcttcagcatctcgaacctgagcatgcaaacccacgctgctcgcatgcggaccttcatgtactggccaagcagcgtgcctgtgcagccagagcaattggcatcagctggcttctactacgtgggacggaatgacgacgtgaagtgtttctgttgcgatggcgggttgcgatgttgggagtcgggagacgacccttgggtcgaacacgccaaatggttccctcgctgcgaatttctgatcaggatgaaaggccaagaattcgtggacgaaatacagggaaggtacccgcatctgctggaacagctgctctccactagcgatacgactggtgaagaaaacgccgacccgccaatcatccactttggacccggagagtcgtcatcagaggacgctgtgatgatgaataccccggtcgtgaagtcagcgctggaaatggggttcaaccgggacctggtgaaacagaccgtgcagagcaagatactgacgacgggtgagaactacaaaacggtcaatgatattgtgtccgcactgctgaatgccgaagatgagaagagagaagaagaaaaggaaaagcaggcggaggaaatggcctcagatgatttgtcacttatccggaagaacaggatggcattgtttcaacagcttacttgcgtgctcccaatcctcgacaacctgttgaaggcaaatgtcatcaataagcaagagcacgacatcatcaagcaaaagacccagatcccattgcaggcaagagaactgatcgacaccatcctggtgaaaggaaatgcggccgcgaacattttcaagaactgtctgaaagagattgactccaccctgtacaagaatctgtttgttgacaagaacatgaaatacatcccaaccgaagatgtgtcagggctttccctcgaggaacagctccggagactccaggaggaacggacttgcaaggtttgtatggacaaggaggtgtcggtggtgtttatcccgtgcggacatctggtcgtgtgccaggaatgcgccccttctctgaggaagtgtcccatctgtagaggaatcatcaagggaaccgtgcgcacctttctgtcc

SEQ ID NO: 32234 - DNA, 1854 bp, Artificial Sequence
  Description of Artificial Sequence: Synthetic coding sequence
atgcacaagaccgcaagccaaagactcttcccaggtccgagctaccagaacatcaaatctatcatggaggacagtaccatcctctccgactggaccaacagcaacaagcagaagatgaaatacgacttctcctgtgagctgtaccgaatgtcgacttactcgactttcccagccggagtgccagtcagcgagagatcattggcgcgagctgggttctattacaccggtgtgaacgataaggtgaagtgcttttgctgcggactcatgcttgacaactggaagctcggggattcgccgatccaaaagcataagcagctgtacccgtcatgcagcttcatacagaacctggtgagcgcctcgttgggctccaccagtaagaacacttccccaatgcggaatagcttcgcacattcgctgtccccaaccctcgagcactcaagcctgttttcaggatcgtactcttcactgtcgcctaatcctttgaatagccgtgcggtcgaggacatttcatcctcacgcaccaacccatactcgtacgctatgtcgaccgaagaagcgcggttcctgacgtaccacatgtggccgcttactttcctctcgccgtccgaacttgcccgcgcgggattctactatatcgggccaggagacagagtcgcttgctttgcctgcgggggcaagctgtccaattgggaaccgaaggacgacgcgatgtcagaacataggcgccatttccccaactgtccatttctggagaactcgctggaaaccctgcgcttcagcatctccaacctgtccatgcaaacgcacgcagcgcggatgcgcactttcatgtactggccgagttcggttccggtccaaccagaacagctggcttccgcaggattttactacgtgggaagaaacgacgacgtgaaatgtttctgctgcgacggcggcctccgctgctgggaatccggcgacgatccctgggtggagcacgcaaagtggtttcccagatgtgaatttctgattcggatgaaaggacaggaattcgttgacgaaattcaaggacggtacccccatctgctggaacagctgctctcgacgtccgacaccaccggggaggaaaacgctgaccctccgattattcacttcgggccaggcgagtcgagctcagaggatgccgtcatgatgaatacccccgtcgtcaagtcagcactggaaatgggctttaatcgggacctggtgaaacagactgtgcaatctaagatcctcaccacgggcgagaattacaaaaccgtcaatgatatcgtgtcagccctgctgaacgctgaagatgaaaagcgggaggaggagaaagaaaagcaagccgaagaaatggcatccgacgatctgtcgcttattcggaaaaatcggatggccctgttccaacagctcacctgcgtccttccgatcctcgataatcttttgaaggcgaacgtgatcaacaaacaggagcacgatatcataaagcaaaaaactcagatccccctccaggccagggaacttattgacactatcctggtgaagggcaacgccgccgcaaacatattcaagaattgcttgaaagaaatcgattcgaccctgtacaagaatctcttcgtggacaaaaacatgaaatacataccgactgaagatgtgtccggattgtcgctggaagagcagttgcgcagactgcaggaggaacgcacttgtaaggtgtgcatggataaggaagtgagcgtggtgtttattccgtgcggacacctggtggtctgccaggagtgcgccccgtcacttagaaagtgcccgatttgtcgaggaatcatcaagggtacggtaagaacgttcctcagc

SEQ ID NO: 32235 - DNA, 1854 bp, Artificial Sequence
  Description of Artificial Sequence: Synthetic coding sequence
atgcataagactgcatcacaaagactgtttcctggaccgtcgtaccaaaacataaagtcaattatggaggattccactattctgagcgattggactaattcgaataaacagaaaatgaagtatgatttttcatgcgagctttaccggatgagcacttacagcacttttcctgccggagtgcccgtctctgaaagatccctggccagagctgggttctactacaccggggtcaatgataaagtcaagtgtttttgttgcggtctgatgcttgacaattggaaacttggtgattcccctattcagaaacataagcagctctatccttcctgttcgtttattcaaaacctggtgtcggcaagcctgggatccacttctaagaacacctccccaatgcgtaactcgtttgcacactccctgagcccaactctggagcattcctcccttttttcagggtcatacagctccctctcgcccaatcctttgaactcacgtgccgtggaagatataagctcgtcgcgcaccaacccttacagctacgctatgtccactgaagaagcacgttttctcacctaccatatgtggcccctgacgtttctttcaccttcggaacttgctagggccggattctactatatagggcccggcgatagagtcgcttgcttcgcatgtgggggaaaactctcgaattgggagccgaaagacgacgcgatgtcggagcataggagacactttcccaattgtccattccttgaaaacagcctcgaaactctgagattttcgatctcgaatctgtccatgcagactcatgctgcgagaatgagaacctttatgtactggccatcgtcggtgcctgtgcaacccgaacaattggcatcggcaggattctattacgtgggacgcaacgacgatgttaagtgtttttgctgtgatggaggactgagatgctgggagtcaggtgatgacccctgggtcgaacacgccaagtggtttcctagatgtgaattcctgattcgcatgaaagggcaagagtttgtcgatgagattcaaggacggtacccacatctgctggagcaactgcttagcacctccgataccaccggtgaagaaaacgcagatcccccaatcattcatttcggaccaggggaaagctcatctgaagatgccgtcatgatgaacaccccggtggtgaaatcggcacttgagatgggttttaaccgtgatcttgtgaaacaaactgtccagtcaaagatccttaccaccggggagaactacaagaccgtgaacgatatcgtgagcgcattgctcaacgcagaggacgagaagcgcgaagaagagaaggagaaacaggcagaagaaatggcatcggatgacctctcccttatcagaaagaacaggatggcactttttcagcaactgacctgtgtcttgccaattctggacaaccttctgaaggcgaacgtcattaacaagcaggaacatgacattatcaagcagaaaactcaaattccactgcaggcgagagaacttatcgataccattctcgtgaagggaaatgcggcagcaaacattttcaaaaactgtctgaaggaaatcgattcgaccctgtacaagaacctctttgtggacaaaaacatgaagtacattcctactgaagatgtgtcaggcctcagccttgaagaacaactgcggagactccaagaggaacggacctgtaaggtgtgtatggacaaggaggtgtcggtggtgttcatcccctgtggccatcttgtggtgtgtcaggagtgtgcaccgtcccttcgcaagtgccctatttgtagagggatcataaaaggcaccgtcagaactttcctctct

SEQ ID NO: 32236 - DNA, 1854 bp, Artificial Sequence
  Description of Artificial Sequence: Synthetic coding sequence
atgcataaaactgcttctcagaggctgttcccaggacctagctatcaaaatatcaagagcatcatggaggatagtaccatactgagcgactggacgaactctaacaagcagaaaatgaaatatgatttctcatgtgagctgtataggatgtctacctacagcacattcccagccggcgtgccggtatctgagcgcagcctggcccgcgctggattttactacacaggagtgaacgataaggtgaaatgcttctgctgtggactcatgctggacaactggaagctgggcgattcccccatccagaagcacaagcagctctacccttcatgttccttcatccagaatcttgtgtccgcttctttgggcagcacttcaaagaacacaagtcccatgaggaacagttttgcacattccctctccccaacactggagcattcttccctgttctctggttcctactcctctctgagccccaatcctctgaattctagggccgtggaggacatctccagctccaggaccaacccttatagctacgctatgtccacagaagaagcgcggttcctgacataccatatgtggccactgacattcttgagtcccagtgagctggccagagctggtttctattacatcgggcccggtgaccgcgtcgcttgttttgcatgcggtgggaaattgtccaactgggagcctaaggatgatgccatgagtgaacaccgcaggcactttccaaattgccctttcctcgaaaactcactggagactctgcggttttccatctctaacctgagtatgcagacccatgccgctcggatgcggacattcatgtactggcccagctctgttcctgtgcagcccgagcaacttgcatccgctggcttttattatgtcggacggaacgacgatgtgaagtgcttttgctgcgatggagggctgagatgttgggagtctggcgatgacccttgggtggagcatgcaaaatggttcccccggtgtgagttccttatcagaatgaaggggcaggaatttgtggacgaaatccaaggccggtacccacatctgctggagcagctgctctcaacatcagatacaactggagaagagaatgcggaccctccaatcatccatttcggccccggtgagtctagctccgaggatgcagtgatgatgaacactccagtcgtcaagtctgccctggagatgggttttaatcgggatctggtaaagcagaccgtgcagtcaaaaatacttacaactggagagaactacaaaactgttaatgacattgttagcgctcttcttaacgccgaagacgagaagcgggaggaagagaaggagaaacaagcagaagaaatggccagtgacgatttgtcacttataagaaaaaatcggatggccttgttccaacagctgacatgcgtgcttcccatactggataatctcctgaaggccaacgttatcaataagcaagaacatgacattataaaacaaaagacccagatccccctgcaggcccgggaactcatcgataccattcttgtgaagggaaacgccgctgctaatatctttaagaactgcctcaaagagatcgattctaccctttacaaaaatctcttcgttgataaaaacatgaagtacatcccaaccgaggatgtgagcggcctttcactggaagaacagctgcgaaggctgcaggaagagcggacatgcaaggtctgtatggacaaagaagtttcagtcgtcttcattccctgtggacatctcgtagtgtgtcaggaatgcgcccccagtctgcgaaagtgccctatctgtcgcggaataattaagggcactgtccggactttcctgagc

SEQ ID NO: 32237 - DNA, 1854 bp, Artificial Sequence
  Description of Artificial Sequence: Synthetic coding sequence
atgcacaagactgcgtcacagaggctgttcccaggaccgtcctaccagaacatcaagtctattatggaggactccaccatcttgagcgactggacgaactcaaacaagcaaaagatgaaatatgacttctcctgcgaattgtaccggatgtcgacctactcaacgttccccgccggcgtcccggtgtccgaacgatcactcgcgcgcgcgggtttctactacaccggcgtcaacgataaggtgaaatgcttttgctgtggtctgatgctggacaattggaagctgggtgactcccccatccagaaacataagcagctctacccgtcgtgctcgttcatacagaatctcgtgtcagcatctctcgggtcaactagcaagaacacttcaccgatgcgcaactcctttgcccactccctttccccgaccctggaacattcgtcactgttttcgggctcgtactcctcactgagccctaaccctttgaactcccgcgccgtggaggacatctcaagcagcagaactaacccgtactcgtacgccatgtccactgaggaggcgcggttcttgacttatcacatgtggcctctgaccttcctgtcgccgagcgaactggcacgagcaggattttactacatcggaccgggggaccgcgtggcctgcttcgcatgcggcgggaaacttagtaattgggagccaaaggatgatgccatgtcggaacatagaaggcacttcccaaattgtccctttctggagaatagtctggaaaccctccggttcagcattagcaatctcagtatgcaaacccatgcggcgaggatgagaactttcatgtactggccgtcgagcgtgccggtccagccggaacagctcgcctctgctggattttactatgttggcagaaacgacgatgtcaagtgtttttgttgcgatgggggcctccgctgctgggaatcaggagacgacccatgggtggaacatgctaaatggtttcctagatgtgaattcctgattaggatgaaaggacaggaatttgtagatgagatccaggggcggtacccccacctcctggaacaactcctcagcacttccgatacgactggggaggagaatgcagatccaccgatcatacacttcggccctggagaatcgagctccgaagatgccgtgatgatgaacacgccagtggtgaaatccgccctggaaatggggttcaaccgcgacctggtgaaacagactgttcaatccaagatcctgacgaccggagaaaactacaagactgtcaatgacatcgtctctgcgctcctcaacgctgaggacgaaaagcgggaggaggagaaggaaaagcaagcggaggagatggcctcagacgatctttcgttgatacggaagaataggatggcactcttccaacagctcacctgtgtgctcccgatcctcgataatcttctcaaagccaacgtcatcaacaagcaagagcacgatatcattaaacagaaaacccagatcccgttgcaagcccgggaattgattgatactatcctcgtgaagggaaacgctgccgccaacatcttcaagaattgcttgaaggaaatcgactccactttgtataagaatctgttcgtggacaaaaacatgaaatacatcccaaccgaggacgtctctggactgtcgctggaggaacagcttcggcggctgcaggaggaaagaacttgcaaggtctgtatggataaggaagtgtcagtcgtattcatcccttgcggacaccttgtggtttgccaagagtgcgctccatcactgcgcaagtgccctatctgccgcggaatcatcaagggcaccgttcgcaccttcctctcg

SEQ ID NO: 32238 - DNA, 1854 bp, Artificial Sequence
  Description of Artificial Sequence: Synthetic coding sequence
atgcacaagactgcttctcagaggctgttcccagggccctcttatcagaacatcaaatccattatggaagactcgacaattctctcagactggacaaattctaataagcagaagatgaaatatgatttttcttgtgaattatatagaatgtccacatattctacttttccagctggagtgcccgtttctgagcggagtctcgcacgggcaggattttattatactggggtcaacgacaaggtgaaatgcttctgctgtggactaatgctcgacaattggaaactgggggatagtcctattcagaaacataaacagctgtatccttcctgctccttcatccagaacctcgtatccgcatctctcgggagtacatccaaaaatacatccccaatgagaaattcctttgctcacagtttatctccaacactagaacattcctcgcttttcagtgggtcatactcgtccctaagtcccaatcctctcaattctagggcagtagaggatatatcttctagtagaacaaatccttacagttacgccatgtcaacagaggaagctcggttcctgacttatcacatgtggcctctcacattcctttcaccctccgaactcgcccgcgccgggttttattatatagggcctggagatcgcgttgcctgcttcgcatgcgggggaaaactctctaactgggaacctaaagatgacgctatgtctgaacaccggcggcactttccaaattgcccatttttggaaaattcattagaaactcttcgattttcaatatcaaacctatcaatgcagacacacgccgcacgcatgcggacattcatgtattggcccagtagtgtgcccgtacaaccagagcagttggcgagtgctggattttattatgttgggaggaatgacgatgtaaaatgcttttgctgtgacggggggctgcgatgctgggaatctggggacgatccttgggtagagcatgcgaaatggtttccacggtgtgagttcctcattagaatgaagggacaggaatttgttgatgagatccaggggaggtatcctcacttacttgaacagctcctctctacatccgatacaacgggagaagaaaacgctgatcctcccatcatccatttcgggcctggggaatcctcatccgaagacgccgtcatgatgaacactcccgtggtgaagtcagctctggaaatggggtttaatcgcgatctcgtcaaacagacagtgcagtccaaaatcctgactacaggagaaaattataaaacagtcaacgatatagtttcagcccttctgaacgcagaagatgaaaagagggaagaagaaaaagaaaaacaggccgaggagatggcctctgatgatctatctctcataaggaaaaaccggatggcactattccagcagctcacttgcgtgctccctatcctcgataaccttcttaaagctaatgtcattaataaacaggaacacgatataataaaacagaaaacacagatcccactacaggctagggagctgatagatacaatcctagttaaaggaaacgctgcggccaacatctttaagaattgccttaaagaaatcgattcaacattgtataagaacctgtttgtggataagaacatgaaatatatccctactgaagatgtgtctggacttagtcttgaagaacagctgcggcggcttcaggaagagagaacatgcaaagtgtgtatggacaaagaggtctctgtagtatttattccttgtgggcacctagtggtatgtcaggagtgcgcaccatccctcaggaagtgtccaatttgcagagggattattaaaggaactgtgcggacttttctgtct

SEQ ID NO: 32239 - DNA, 1854 bp, Artificial Sequence
  Description of Artificial Sequence: Synthetic coding sequence
atgcacaagacagcgtctcaacgactgttcccaggtccaagttaccaaaacattaagtcgattatggaagactcgaccatcctgtctgattggacaaatagcaataaacagaaaatgaaatacgatttctcatgtgaactatatcgcatgtctacgtattcgacttttccggcaggtgtgcccgtgagcgagcgatcactggcgagggccggattctattatacgggggtgaatgacaaggtgaagtgtttctgttgtgggctgatgctggacaattggaaactgggcgattctccaatacagaagcataagcaattataccccagctgtagcttcatacagaatctggtgagtgccagcctgggttcaacatcaaagaacactagccccatgcgcaacagttttgctcattctctgtcacctactctggaacactccagcctgttttcaggctcttatagctccctcagccccaaccccctgaactcccgcgccgtggaagatatatcctcatcacgcactaacccgtactcgtacgctatgtcgaccgaagaggctcgttttttgacttaccatatgtggccgctgactttcctgagtccgagtgagctcgcacgtgcagggttctactacatagggcctggcgatagggtggcatgctttgcttgtgggggcaagctctctaattgggagcctaaagacgacgctatgtccgagcatcgccgccacttccctaactgtccctttctagaaaacagcttggagactcttcggttttctatcagcaacctgagtatgcaaacccacgccgcccgcatgcgaacttttatgtactggccctcctccgtccccgtacaacctgagcagctggcatccgcaggcttctactacgttggtcgcaacgatgatgtgaaatgtttttgctgcgacggtggactccggtgctgggagtcaggagatgacccctgggtcgaacacgccaagtggttccccaggtgcgaattcctgataaggatgaaggggcaggaattcgttgatgaaattcagggacggtacccacatctcctggagcagttgctttccacctcggacaccactggagaggaaaacgccgacccgccaatcattcacttcggtcccggtgagagtagcagtgaggatgctgtgatgatgaacacgccggtggtgaagtctgctttggagatgggtttcaatcgggacttggtaaagcaaacagttcaatcaaagatactgactacaggtgagaactataagactgttaacgatatcgtgtccgctttgttaaatgccgaagatgagaagcgtgaggaggagaaagaaaagcaggccgaagaaatggcgtcagacgacttaagcttgatcagaaaaaatagaatggccctattccagcaattgacgtgtgtccttccaattcttgataatctgctaaaggcaaatgtgatcaataagcaggaacatgatatcataaaacagaagactcagatccccctacaggcacgagaactgattgatactattctggtcaaagggaacgccgctgctaacatattcaagaattgtctgaaagaaatcgattcgacactgtacaaaaatctgtttgtggacaagaatatgaaatatatccctacagaggatgtgagcgggctaagtctggaagaacagcttcgcagactgcaggaagaaaggacatgtaaagtgtgcatggacaaggaagtctccgtggtctttatcccttgtggtcacttggttgtttgccaggagtgtgcaccaagcctccggaaatgccctatttgccgaggtatcatcaaaggtacagttcgcacttttttgagt

SEQ ID NO: 32240 - DNA, 1854 bp, Artificial Sequence
  Description of Artificial Sequence: Synthetic coding sequence
atgcataaaactgctagccaacgtctttttccgggtcctagctatcagaatattaagtcgataatggaggatagcactatactttctgactggacgaattcgaataaacaaaagatgaagtatgacttctcctgcgaactgtataggatgtcaacgtactcgacattccccgcgggcgtcccggtgagcgagcgctccttagcccgcgcaggtttctattacacaggcgtcaacgacaaggtgaaatgtttttgctgcgggttaatgctggacaactggaagcttggcgattcgccgattcagaagcataaacaactgtatccatcatgtagctttattcaaaacttagttagtgctagtctcggcagcacttccaaaaatacaagtccaatgcgtaactcgttcgcccatagtctgtcccctacactagaacactctagtttgttcagcggatcctattcctccctcagtcccaacccccttaactcgcgtgcagtcgaggatatatcgagcagccggaccaatccgtacagctatgccatgagtacggaggaagcccgtttccttacatatcatatgtggcccctgacgtttcttagtcctagtgaacttgcgcgggctgggttctactatatcggcccaggggacagggtggcttgctttgcgtgcggaggtaaactctcgaattgggagcccaaggacgacgctatgtcggaacatcggcgacactttccaaattgcccttttttagaaaactctctcgagacattgcgtttctcgatctctaatttgtcgatgcaaactcatgcggcccgtatgcgtaccttcatgtattggccgtcgagcgtaccagttcagccggagcagctcgcatccgctgggttctattacgttgggcgaaatgacgacgttaagtgtttctgctgcgatgggggcctaagatgttgggaatcaggcgacgatccctgggtggagcacgcgaagtggttcccacgctgtgagttcctcattaggatgaaggggcaggaattcgtggatgaaattcagggacgctacccccaccttcttgagcagttgctcagcacgagtgacacaactggtgaagagaacgcagatcccccgatcattcatttcgggcctggcgagagttctagtgaagacgctgtcatgatgaataccccagttgtaaagtccgctctcgagatgggtttcaaccgggacctcgtgaagcaaacagttcagtcaaagatcttgacgacaggggagaattataagacggtaaatgatatcgttagtgcccttctcaatgcagaagacgagaagagggaggaagaaaaagagaagcaggcggaagagatggcctctgacgacctcagtttgatccggaagaatcgtatggcacttttccaacagttgacatgtgtcttacccatcctggacaacctcctgaaagctaatgtgatcaataagcaggaacatgatattatcaagcagaagacccagatcccgctgcaagcccgtgaactaattgatactatcctcgtaaaagggaatgcagccgccaacattttcaaaaattgtctaaaggaaatagacagcacgctctataagaatctgttcgttgacaagaatatgaagtatatccctacggaggatgtctccggactttctcttgaggagcagcttcgacgacttcaagaagagcgcacatgtaaagtttgcatggacaaagaggtctcggtggtatttattccgtgtggtcatttggtggtatgccaggaatgtgccccgtctcttcgcaagtgtccaatttgccggggtatcatcaagggtacggtccggacctttttgagt

SEQ ID NO: 32241 - DNA, 1854 bp, Artificial Sequence
  Description of Artificial Sequence: Synthetic coding sequence
atgcataaaacggcatcccagcgcctgttcccaggaccgtcctaccaaaacataaagtcgatcatggaggacagcacgatcctctccgactggaccaactcgaacaaacagaagatgaagtacgatttttcgtgcgagctgtacaggatgtcaacctattcgactttcccggccggtgtcccggtgtccgagagatccctggcacgggcgggcttctactataccggagttaatgacaaggtcaaatgcttttgctgtggtctgatgctcgataattggaagctcggagacagccccatccaaaagcacaagcagctgtacccgtcctgctcgtttatccaaaatctggtgtcggcctccctgggtagcacctcgaagaacacctcaccaatgaggaatagctttgcccacagcctgtcaccgactcttgaacattcatcccttttctccggctcgtactcgagcttgagccctaacccccttaattcgagagctgtggaggacatttcgtcctcgcgcactaatccgtacagctacgcgatgtccaccgaggaagccaggtttctgacttaccacatgtggccgctgaccttcctgtcgccgagcgagctcgcccgcgccggcttctactacatcggcccgggagacagggtggcctgcttcgcctgcggcggaaagctgtccaattgggaaccaaaggacgacgcgatgagcgaacaccgccgacattttccaaactgtccgtttctcgagaactcgctggaaaccttgcgtttctccatttccaacctctcgatgcagacccacgccgcccgcatgcggactttcatgtattggccatcttcggtgccagtccagccggagcagttggcttcagcgggattctactacgtcggacgcaatgatgacgtgaagtgcttctgttgcgatgggggcctgcgctgctgggagtcgggagacgatccttgggtggagcacgcgaagtggtttccgcgctgcgagtttctgatcaggatgaaaggacaggaattcgtagatgaaattcagggaaggtacccacacctgctcgagcaactcttgtctaccagcgacactactggagaggagaacgccgatccaccgatcatccattttggaccgggggaaagctcctccgaggacgctgtcatgatgaatactcccgtcgtgaaatcggctctggaaatgggctttaatcgggaccttgtgaaacagacggtgcagagcaagatcctgaccaccggagaaaactacaagactgtgaacgacatcgtcagcgcgctgctcaatgcagaggacgagaagagagaggaagagaaggaaaagcaagctgaagaaatggcatccgatgatttgtctctgatccgcaagaatagaatggcactcttccagcagctcacgtgcgtccttccaatcctcgacaacctcctcaaagccaatgtgatcaataagcaggaacacgacatcatcaagcaaaagacccagatacccttgcaggctcgggagctgatcgacaccatcctcgtcaagggtaacgccgccgccaatatcttcaagaactgcttgaaggagatcgattcgacgttgtacaaaaatctctttgtggataagaacatgaagtacatcccgactgaggatgtgtcaggattgtcgttggaggagcaactgagacgcctccaggaagagcgcacgtgtaaagtctgcatggataaggaagtctccgtggtgttcatcccttgtggacatcttgtggtgtgtcaagagtgtgctccgtcgcttcgcaagtgccctatttgccggggtatcatcaaagggactgtgcggacttttctgtcg

SEQ ID NO: 32242 - DNA, 1854 bp, Artificial Sequence
  Description of Artificial Sequence: Synthetic coding sequence
atgcacaaaactgcctcgcagagactgttcccgggcccatcataccaaaacatcaaatcgatcatggaggacagcacgatcctctcagattggactaatagcaataagcaaaagatgaagtacgacttctcgtgtgagctctaccgcatgtccacctactcgacctttcctgccggcgtgccagtgtccgaacgctcccttgctagagcaggtttctattacaccggggttaacgacaaagtgaagtgcttttgctgtggcctgatgcttgacaattggaaacttggagattcgccgatacaaaaacataaacagttgtatccgagctgctcgttcatccaaaacctcgtgtccgcttctctgggctccacctccaagaacacttcacctatgcggaactcgttcgctcactcgctcagccccactctcgaacattcttcgctgttcagcggctcttactccagcctttcaccgaacccgctgaactcccgcgccgtcgaggacatctctagctcacggacgaatccttatagctacgcgatgtcgaccgaagaggcccgattcttgacctaccatatgtggccactgaccttcttgtctccatccgaactggcgagggccggtttttactacatcggaccaggggaccgggttgcctgcttcgcatgcggaggtaagctgtccaactgggaacccaaggacgacgctatgtcggagcaccgcagacacttcccgaattgccccttcctcgaaaattcgctcgaaaccctgcggttttcgatttcaaacctgtccatgcagactcatgctgcgagaatgagaaccttcatgtactggccaagctctgtgccagtccagcctgagcagcttgcgtccgccggtttctactacgtgggaagaaacgacgacgtgaagtgtttttgctgtgacgggggactgcggtgctgggagtccggagatgatccgtgggtggagcacgccaagtggtttccgcgctgtgagttcctcattcgcatgaagggacaagaattcgtggatgagatccagggacgctacccgcacctcctggaacaactgctgagcacctcggacacgactggagaagaaaacgccgatcctcccatcatccactttggccctggtgagagcagctccgaagatgccgtcatgatgaacactccggtggtgaaaagcgcccttgagatgggcttcaatcgggacctggttaagcagaccgtccagtcaaagatcctgactaccggcgagaactacaagactgtcaacgacatcgtgtccgcgctcctgaatgcagaagatgagaagcgcgaagaggagaaggaaaagcaggcggaagaaatggcgtctgacgatctgtcgctcatccgcaagaataggatggcgctgtttcaacagctcacctgcgtcttgccgattctggataacctgctcaaagcaaacgtgatcaacaagcaagaacatgacatcattaagcaaaagactcagatcccgcttcaggccagggaactgattgacacgatcctcgtgaagggaaacgccgcagctaacatctttaagaattgtcttaaagagatcgatagcactctgtacaaaaacttgtttgtggacaaaaacatgaagtacatcccgaccgaagatgtgtccgggctctctttggaggaacagttgcgccgactgcaagaagaacgaacgtgcaaggtgtgcatggacaaggaagttagcgtggtgttcatcccgtgcggtcatctcgtggtgtgccaggaatgtgcaccaagcctgcgcaagtgcccaatttgccggggaatcatcaaaggaactgtgcgtactttcctctcg

SEQ ID NO: 32243 - DNA, 1854 bp, Artificial Sequence
  Description of Artificial Sequence: Synthetic coding sequence
atgcataaaaccgcttcacaacggctgttccctggaccttcataccagaatatcaagtccataatggaagatagcaccatcttgtcggactggaccaactcaaacaagcagaagatgaaatacgattttagctgtgaactctaccgcatgtcgacttactcgacgtttccagcaggagtgcccgtgagcgaacggtcgctggccagagcaggtttctactacactggagtcaatgacaaggttaaatgcttctgttgtggtcttatgctcgataattggaaacttggagattcgcctattcagaagcacaagcagctctacccgtcttgctcctttatccaaaacttggtgtcagcatcactgggatccactagcaagaatacttcacctatgagaaacagctttgcccattccctctcccctaccctcgagcacagcagcctcttttcgggatcgtactcgtccctttccccgaatcctctgaattcgagagcggtggaagatatctcatcctccagaacgaacccctacagctacgcaatgagcactgaagaggcacggtttcttacttatcacatgtggcccctcaccttcctgagcccctccgaacttgcaagagcaggcttttactacatcggaccgggcgatagagtggcatgtttcgcttgtggaggtaagctgtcaaactgggagccaaaggatgacgccatgtccgaacatagacgccacttcccaaactgtccttttctggaaaactcgctggaaaccctgcgattctcgatttccaatctgtcgatgcagactcatgccgcgagaatgcgcacctttatgtactggccttcgtccgtgcctgtccaacctgaacagctggcatcagcagggttttactacgttggacggaacgacgatgtgaagtgcttctgttgcgatggcggtctgcggtgttgggaatccggtgatgatccttgggtggaacacgcaaagtggtttcctcgttgcgaattcttgatccggatgaagggacaggagtttgtggatgagattcaaggtagatatccgcatcttcttgaacagctgttgtcgaccagcgatactaccggcgaagaaaacgcggacccacctattatccatttcggccccggggagtcgtcgtcggaagatgcagtgatgatgaataccccggtggtgaagagcgccctcgagatgggtttcaacagagatcttgtgaagcaaaccgtgcaaagcaagatcttgaccaccggtgaaaactacaaaaccgtgaatgatattgtgtccgcgcttcttaacgccgaagatgaaaagcgcgaggaagaaaaagaaaagcaagcggaggaaatggcaagcgatgacctgtcgcttattcggaagaatcgaatggcactttttcagcaactgacctgtgtcctgcctattctggacaacctcctcaaggcgaatgtcattaacaaacaagagcacgacatcattaagcaaaagactcaaattccactccaagcgcgcgaactgattgatactatacttgtgaaggggaacgccgccgccaacatcttcaagaactgtctcaaggagattgattcaactctctacaaaaacctgttcgtggacaagaacatgaagtacataccaactgaggatgtgtccggactcagcttggaagagcaacttaggcgcctccaagaagagagaacgtgtaaggtgtgtatggataaggaagtctccgtggtgtttatcccgtgtggacatctcgtggtgtgtcaggaatgtgctccatcacttagaaaatgtcccatctgtagaggaatcattaagggaacggtcaggacctttctttcc

SEQ ID NO: 32244 - DNA, 1854 bp, Artificial Sequence
  Description of Artificial Sequence: Synthetic coding sequence
atgcacaaaaccgcttcccaacgcttgtttccgggaccgtcataccagaacatcaagtcgatcatggaagatagcactatcctgtcggactggaccaattcgaacaagcagaagatgaagtatgacttctcctgcgagctgtacagaatgtccacctactctacgttcccggccggagtgccggtgtccgaacggagcctggcccgggcagggttctactacactggggtgaacgacaaagtgaagtgcttctgctgcgggcttatgttggacaactggaagttgggtgattcgccgatccaaaagcacaagcagctctacccgtcgtgcagcttcatccagaatctggtgagcgcgtcactgggatcgacttctaaaaacacctcgccgatgcggaactccttcgcccattctctctcgccaaccctggaacattcttctctgttctcgggaagctactcaagcctgagcccgaatccgctgaattcacgggccgtcgaggatatatcgtcgtcacggactaatccttactcatacgcgatgtcgactgaggaggcaaggttcctgacttaccacatgtggccgctcacgttcttgtccccgtcggaactggcgcgggccggattctactacattggtccaggagacagagtggcctgtttcgcatgtggagggaagctgagtaattgggagccgaaggacgatgccatgagcgaacaccggagacattttcccaactgcccattcctggaaaactcgctcgaaaccctccgcttctcgatctcgaacctgtctatgcagactcatgcagcccgcatgcggactttcatgtactggccttcgtcagtgccagtgcagcctgaacagcttgcctccgctggattctattacgtgggaagaaatgacgatgtcaagtgcttttgctgtgacggagggctgaggtgctgggaatcaggtgatgatccatgggtggaacacgcaaagtggttcccgcgctgcgagtttttgatccgcatgaagggacaggagtttgtcgacgagatccaaggacgctatccacacctgctggagcagctgctgtcaacctcagacactaccggcgaggagaatgccgacccacctatcatccacttcgggcctggggagtcctcctccgaggacgccgtcatgatgaacaccccagtcgtcaaatccgcactggaaatgggattcaacagggatctggtgaagcagactgtgcaatcgaaaatcctgacgaccggagaaaactacaagactgtgaacgatatcgtgtcggccctcctcaacgccgaggacgaaaagcgcgaggaggagaaggagaagcaagctgaggaaatggcctcggatgatctgtccctgattcgaaagaatcggatggccttgttccagcaactcacttgcgtgcttcccatcctggacaacctgctgaaagccaatgttatcaacaaacaggaacatgacatcatcaagcagaaaacccaaatcccgctgcaggctcgagagctcatcgacactatcttggtgaagggaaacgcagcagcaaacattttcaaaaactgcttgaaagaaattgactcgacgctctacaagaacctgttcgtggacaaaaacatgaagtacattcctaccgaggacgtgagcggactgtcccttgaagagcagctcaggaggctgcaggaagagcgcacctgcaaggtgtgtatggacaaggaagttagcgtggtctttatcccgtgtggacatctggtggtgtgccaagagtgcgcgccgagcctgcggaagtgccctatttgtcgcggaatcattaagggaaccgtcagaactttcttgtcg

SEQ ID NO: 32245 - DNA, 1854 bp, Artificial Sequence
  Description of Artificial Sequence: Synthetic coding sequence
atgcacaagactgcatcccaacgcctgtttccgggtcccagctaccagaatatcaagagcatcatggaggactccactatccttagtgattggaccaacagtaataagcagaaaatgaagtacgatttctcatgtgaactttatcgtatgtcaacctactcgacttttccggccggggtccccgtctcggaaaggagcctcgcacgtgcaggattttactacaccggagtgaacgacaaggtgaagtgcttctgctgcggtctgatgctggacaactggaagctgggggactcgccaattcagaagcataaacaattgtacccgtcttgttcctttatccaaaatctggtatccgcttccctgggtagcacctcgaagaatacttcacctatgcgcaattccttcgcccactcattgtcgcccactctggaacacagcagcctgttctccggttcgtactcgtccctgtcgccaaacccgctgaactccagagcagtcgaggacatctcgtcatctcggactaacccttacagctacgcaatgtcaactgaagaagcccggttcctgacctaccacatgtggccgctcaccttcctgagcccatccgagttggctcgcgctggcttctactacatcggacccggcgacagggtggcttgctttgcctgcggaggtaagctctcgaactgggaaccaaaggacgacgccatgtccgaacaccgccggcactttccgaattgcccgttcctcgagaattcgctggaaacgctgaggttctcgatctcaaatctgtcaatgcaaacccatgctgcgcggatgagaaccttcatgtactggccctcatcagtgccggtgcaaccagaacagctcgcgtctgccggtttctactacgtcgggagaaacgatgatgtgaagtgtttttgttgcgacggtggccttcggtgttgggaatctggagacgatccatgggtcgaacatgccaaatggttccctagatgcgagttcctgatcagaatgaagggacaggaattcgtagatgagatccaggggcggtacccacatctgcttgagcagctcctctccacctcggatactacgggcgaggagaacgcagacccgcctatcattcacttcggaccgggagaatcctcatcggaggacgcggtgatgatgaacaccccggtggtgaagtccgccctggaaatggggttcaaccgggacctcgtcaaacaaacggtgcaatcaaagatcctgactactggagagaactataagaccgtcaacgacatcgtctccgctctcttgaacgcggaggacgaaaaacgcgaggaagaaaaggaaaagcaggccgaagaaatggcgtccgacgatctgtcacttatacgaaagaataggatggccttgtttcagcagctgacctgcgtgcttccgattctggataaccttctgaaagcgaacgtgatcaataaacaggagcatgatatcatcaagcagaaaactcaaatcccgctccaagcccgcgagctcattgacaccatcctggtgaaaggaaacgcagccgcgaacattttcaaaaactgtctgaaggagatcgacagcacgctttacaaaaatctgttcgtggacaaaaacatgaagtacatccctactgaagatgtctcgggactctccctcgaagaacagttgcgccggctccaggaggagaggacctgcaaggtgtgcatggataaggaagtgagcgttgtgttcataccatgcggacacttggttgtgtgccaggagtgcgcaccatccctgagaaagtgccctatctgccgcggcatcataaaaggaacggtccgtactttcctcagc

SEQ ID NO: 32246 - DNA, 1854 bp, Artificial Sequence
  Description of Artificial Sequence: Synthetic coding sequence
atgcataagacggcttctcagagactatttcccggtcccagctaccaaaatatcaagtccatcatggaggacagtaccatcctgtccgattggactaactccaacaaacagaagatgaaatacgacttctcgtgcgagttgtaccgcatgagcacctactctacatttccagccggagtccccgtgtccgaaaggtcgcttgcccgggccggcttctactacaccggggtgaatgataaagttaaatgcttctgctgtggcctcatgctcgacaattggaagctgggtgactcacccattcagaagcacaaacagctctatccttcatgcagcttcattcagaatctcgtctctgcaagtttgggatcaacctcaaaaaacacatcgcctatgcggaatagctttgctcatagcctgtccccaactctcgagcattcctcactcttctcgggttcgtactcctcgctgtcccctaacccactcaacagcagggccgtagaagatatcagctcctctaggaccaacccttattcatatgccatgtccacagaggaagctaggttcttaacataccacatgtggccactgacgtttctgtcccctagcgagttggcccgggccggcttttattatatcgggccaggagatagagtggcttgcttcgcgtgcggtgggaaactctcaaactgggaacccaaggacgatgccatgagtgaacatcgcaggcacttccccaactgtccgtttttggaaaacagtttagagactctccgctttagcatctctaacctgagcatgcagactcacgccgcccgtatgagaactttcatgtattggccttcgagtgttccagtacagcccgaacagctcgcttcagcaggattctactatgtgggacgcaatgacgatgtcaaatgcttctgctgcgacggcgggctgagatgctgggagtccggcgatgatccttgggtcgagcatgcaaagtggtttccacgatgcgaattcctgattagaatgaaaggtcaggagtttgttgacgagattcagggccggtaccctcacttgcttgagcagctgttgagcacgagcgacacaacaggagaggagaatgcggacccacccattatccacttcgggcccggcgagtcttctagtgaggatgctgtgatgatgaatactccagtagtgaagagcgccctggagatgggctttaacagggatctcgtgaagcagacggtgcagtcaaagattttgactaccggtgagaactacaagacggtgaatgatattgtgtcagcattgctgaatgctgaggacgagaagcgggaggaggaaaaggagaagcaggccgaagagatggcgtccgacgacctgagcctgataaggaaaaacaggatggctttgttccagcagctcacctgcgtcttacccattttggacaaccttcttaaggccaacgtgatcaacaagcaggagcacgatatcataaagcagaagacccagatacctttgcaagccagggagctcattgatacaatcctggtcaagggcaacgcggctgccaatattttcaagaactgtctgaaagaaattgacagcactctctataagaacctcttcgtggacaaaaatatgaaatatatccccactgaggacgttagcggcctgtctttagaagagcaactccgtaggttgcaggaggagcggacctgtaaagtctgcatggacaaggaagtgtcagtagtattcattccatgtggtcatctcgtcgtgtgccaggagtgcgccccttcattaagaaaatgtcctatctgccgaggcatcatcaaaggaactgtccggacatttctctct

SEQ ID NO: 32247 - DNA, 1854 bp, Artificial Sequence
  Description of Artificial Sequence: Synthetic coding sequence
atgcacaaaaccgcaagccagcgcctcttcccgggaccgtcctaccagaacatcaagtcaatcatggaggactccactatcctcagcgattggaccaacagcaacaagcagaagatgaagtacgatttctcctgcgagctgtacaggatgtccacgtactccaccttcccggccggagtcccagtgtcagaacggagcttggcccgcgccggattttactatacgggtgtgaatgataaggtgaagtgcttctgttgcggtctgatgctggacaattggaagttgggcgacagccctatccaaaagcacaagcagttgtacccttcctgctcgttcatccagaaccttgtctcggcctcattgggctctacctccaagaacactagcccgatgagaaactccttcgcacactctctctcgccgactctggagcacagctccttgttctccggatcatattcatccctgtccccgaacccactgaactcacgtgcggtggaagatatctctagctcccgcaccaacccatactcctacgctatgtcaactgaagaagccagattcttgacttaccatatgtggcctctgaccttcctttcgcctagcgagctggcgagagctggcttctattacattggcccaggagacagggtcgcatgcttcgcctgcggaggaaagctctcgaactgggaaccgaaggacgacgcgatgtcggaacatagaaggcattttccgaactgccctttcctggaaaattcgctggaaaccctgcgtttttcaatttctaacctctccatgcagacgcacgccgcacgcatgcggactttcatgtactggccgtcctccgtgccagtgcaaccggaacagcttgcctccgcaggcttttactacgtgggccggaatgacgacgtgaagtgtttctgctgcgacggcggactgcgctgttgggagtcaggagacgatccgtgggtcgagcatgctaaatggttcccgagatgcgaattcctcatcaggatgaaaggacaggagttcgtcgacgagatccaaggacggtacccccatctgctcgagcaactgctgagcactagcgacactaccggggaagaaaacgcggacccgcctattatccacttcggcccaggggaatcctcatcagaagatgcggtcatgatgaacaccccagtggtgaaaagcgcgctcgaaatgggtttcaatcgcgacctcgtgaaacagaccgtgcagtcgaaaatcctcacgacgggagagaactacaaaaccgtgaacgatatcgtgtcggcgttgttgaatgcggaggacgaaaagcgggaggaagaaaaggaaaaacaggccgaagaaatggcgtcggacgacctctcgctcatcagaaaaaacagaatggcactctttcaacagctgacgtgcgtgctgccgatccttgacaacctcctgaaggccaacgtgatcaataagcaggagcatgacatcattaagcaaaaaacccagatcccactccaagcacgcgagctcatcgacaccattctcgtcaagggaaacgctgccgcgaatatctttaagaattgcctcaaggaaattgactcaaccctgtacaaaaatctgttcgtcgataagaacatgaagtacatccctaccgaggacgtgtccgggctgagcctcgaggaacagctcagaagattgcaggaagagaggacctgcaaggtttgcatggataaggaggtttcggtcgtctttatcccatgcggccatctggtcgtgtgtcaggaatgcgccccgagtctcagaaagtgtccaatttgcaggggaatcatcaagggaactgtgaggacctttctctcc

SEQ ID NO: 32248 - DNA, 1854 bp, Artificial Sequence
  Description of Artificial Sequence: Synthetic coding sequence
atgcataagacggctagtcagcgactgttcccggggcccagttaccaaaatatcaagtctattatggaggacagcacaatcctgtccgactggaccaatagcaacaagcagaagatgaaatatgatttctcctgcgaattgtaccggatgtctacctattctactttccccgccggggttcccgtatcagaaagatccctggcaagagctgggttctactacacgggcgttaacgataaggtgaagtgcttttgctgcggactgatgctagataattggaagctgggcgatagtccaattcagaagcacaagcaactgtatccctcttgttcttttatacagaatctagtgagcgcctccctcgggtccaccagcaagaacactagcccaatgagaaatagctttgcgcacagtctgtccccaactctagaacacagcagcctgttttcgggctcgtattccagtctttcaccaaatcccctaaattcacgcgccgttgaagacatttctagctctagaaccaatccatactcatacgctatgtccactgaggaggcacgattcctgacctatcatatgtggccgctaacattcttaagtccaagtgagttagcccgggcggggttctattatatcgggccaggagatagggtggcgtgctttgcctgtggcgggaaactatcgaattgggagcccaaagatgacgctatgtctgagcacagacggcacttccctaattgtccctttctggaaaacagtctggagactctacgcttcagtatctccaacctgtccatgcaaacacacgccgcaagaatgcggacctttatgtactggccatccagtgtgcctgttcagcctgaacagctagcgagtgccggattctactacgtgggccgcaacgacgacgtaaaatgtttctgctgcgacggtggacttcgctgctgggaatctggtgacgacccatgggtggaacatgcaaaatggtttccacgttgtgagtttctcatacggatgaaagggcaggaattcgtagacgagattcagggtagatatccacatcttctggaacagttgctcagcacctcagacacaacgggcgaggaaaacgccgatccacctattatccactttgggcctggcgagtctagtagcgaggatgccgtcatgatgaacacccccgtggtgaagtctgccctggagatgggatttaatcgggatctcgtcaaacagacagtgcagtccaagattctgactactggcgagaattataagaccgtcaacgatatagtgagtgccctattaaacgccgaggacgagaagagagaggaagagaaagagaagcaggccgaggaaatggcgtcggatgatctgagtttgattcggaagaaccgcatggcactctttcaacagctgacgtgcgtcttgccaattctggacaatcttttgaaggccaatgttatcaacaagcaagagcatgacatcattaaacaaaaaacacaaatcccgttacaggcccgtgaattaatagacactattctggttaagggaaacgccgccgccaacatttttaaaaattgtctgaaggagatcgactcaactctgtacaagaatctatttgttgacaaaaatatgaaatatattcccactgaagacgtgagcggattgagtttagaggagcaattgaggcgcctgcaggaggagcgcacgtgcaaggtttgtatggacaaagaggtctccgtggtgttcatcccttgtggtcacttggtggtgtgtcaggagtgtgccccctcgctgcggaagtgccccatatgtcgcggcattattaagggtaccgtgcgcaccttcctctct

SEQ ID NO: 32249 - DNA, 1854 bp, Artificial Sequence
  Description of Artificial Sequence: Synthetic coding sequence
atgcataaaactgcctcacaacggctgttcccaggaccatcatatcagaacattaagtctatcatggaagacagcactatcctgtcagactggaccaactctaacaaacagaagatgaaatacgacttcagctgcgaactctataggatgtcgacatacagcacattccctgctggcgtccccgtgtctgagcgcagcctggcgagggccggtttttattacaccggtgtgaatgacaaagtcaagtgtttttgttgtggactgatgctggacaattggaagctgggcgacagtcctatccagaagcataaacagctctatccttcctgctcatttatccagaacctggtcagcgccagcttaggatccacatccaagaatacatcccctatgaggaatagctttgcacattctttatccccgacgcttgagcactcttcactgttcagcgggagttactcttcattgtccccgaatccactcaattctcgagccgtagaggatatcagtagttcgaggacaaatccatactcttacgccatgtctaccgaggaggcaagattcctcacctaccatatgtggccactgactttcttgtcccctagcgaactcgcccgtgccggattctattacattgggcccggagatcgcgtcgcatgctttgcttgtggtggaaagctcagtaactgggagccaaaggacgacgccatgtccgaacatcgtcggcattttcccaactgtccgtttctagaaaatagcctcgagaccctccggttctccatatctaacctgagcatgcagacgcatgccgccaggatgagaaccttcatgtattggcctagttcggtgcccgtccagcccgaacagctcgcctcggctgggttttactacgtaggaagaaacgacgatgtaaagtgtttttgttgcgatggcgggctccgatgctgggagtctggagacgatccctgggtggaacatgccaagtggttccccagatgtgagttcctgatcagaatgaaagggcaggagtttgtggacgagattcagggtcggtacccgcatctgctggaacaactgttatcaacctccgacactacaggagaagaaaatgccgatcctccaatcattcattttggccccggagagtcatcctccgaggacgcagtaatgatgaatactccagtcgtgaagtcggcattagagatgggctttaacagggacttggtgaagcagacggtccagtcaaaaatcctgaccactggtgagaactacaagacagtgaacgacatcgtcagcgctcttctgaacgctgaggatgaaaaacgggaggaggagaaagagaagcaggccgaagagatggccagcgacgacttgagtctgattaggaaaaataggatggctctgttccaacaacttacttgcgtcctgcctatcctagacaacctgctgaaagccaacgtgattaataagcaggaacacgacatcattaagcagaagacccagatacctctccaggcacgggaactgatcgatactatcctggtcaagggtaatgcagcagccaacatttttaagaactgcttgaaagaaatcgattctacactgtacaagaacctgtttgtggacaagaacatgaagtacatccccactgaagatgtatctgggctgtctttggaagagcagttgagacggctgcaagaagaacgaacctgcaaggtatgcatggataaagaagtctctgtggtctttatcccctgcggccacttggttgtttgtcaggagtgcgcacctagtctgagaaaatgcccaatctgccgcggtattattaaggggaccgtgcggacatttctatca

SEQ ID NO: 32250 - DNA, 1854 bp, Artificial Sequence
  Description of Artificial Sequence: Synthetic coding sequence
atgcacaagacagcttcacagcgactatttccagggcctagctatcagaacatcaaaagtatcatggaggacagcaccatcctatcggactggaccaatagtaacaagcagaaaatgaagtacgattttagctgcgagctctaccggatgagcacttatagtactttccccgccggagtacctgtgagtgagcggtctctggccagagccggcttctattacaccggcgtgaacgataaagtgaaatgcttttgttgtgggcttatgcttgataactggaagctgggcgactctcccattcagaaacacaagcagctttacccatcctgctctttcattcaaaatctggtctccgccagtctgggcagcacatctaagaacacaagcccaatgcgcaatagttttgcgcattccttgagtccaacgctcgaacacagcagtctgttcagcggttcgtacagcagtttatctcccaaccccttaaattcacgggccgtggaagacattagctcttcccggaccaacccttattcttatgccatgtccaccgaggaggcaagattcctaacctatcacatgtggccactgaccttcctctcacccagcgaactcgcccgagccggcttctattatatcgggcccggagatcgggtggcctgcttcgcctgcggcggaaagttgtcaaactgggagcccaaggacgacgccatgagcgagcacagaaggcacttcccgaattgtcccttcttagagaattctctggaaacccttagatttagcatttctaatctctctatgcaaactcacgctgccaggatgaggaccttcatgtattggccttcgtccgtgccagtccaacccgagcagctggcatccgccgggttttactacgtggggcggaatgatgatgtgaagtgcttttgttgcgatgggggcctgcgatgttgggagtctggggatgacccatgggtggaacacgcaaaatggtttcccaggtgtgaattccttataaggatgaaggggcaggagttcgtggacgaaatccagggtaggtaccctcacctgctggaacagctcttatctacatctgataccaccggagaggaaaacgccgatcctccaattatacacttcggccctggcgaatctagctctgaggacgctgttatgatgaacacacctgtggtgaaaagcgctctggaaatgggattcaaccgggatctcgttaaacagacagtacaatcaaagattctgaccactggcgagaactacaagacagtcaatgacatcgtcagtgcactgctaaacgctgaggacgaaaagagggaagaggagaaggagaagcaggccgaggagatggcatctgacgatctgtcgctgatccgcaagaatcggatggcactgttccagcagctgacatgcgtgttgccgatactcgataatcttcttaaggcgaatgtaattaacaaacaggagcacgatatcattaaacagaagacacagattccattgcaggctagagaactgattgacaccattctggtaaaagggaacgctgcagctaatatcttcaaaaattgcttgaaggaaatcgattctactttgtataaaaacctatttgtcgataaaaacatgaagtacatcccaaccgaggacgtgtctggcctcagtttggaagagcaactcaggcggttacaggaagagcgcacgtgtaaagtgtgcatggacaaagaagtgtccgtggtgttcataccttgcggccacctcgtggtctgtcaggagtgtgcaccctcattgcgcaagtgcccaatctgcagagggataatcaagggtaccgtgcgcacgttcctctcg

SEQ ID NO: 32251 - DNA, 1854 bp, Artificial Sequence
  Description of Artificial Sequence: Synthetic coding sequence
atgcacaaaactgcttcacagagactcttcccaggacctagctaccagaatattaagtccatcatggaggacagcacaatactgtctgactggacaaattcaaacaagcagaagatgaaatacgatttctcctgtgagctataccgtatgtctacttattcaaccttcccagccggggttcccgtgtccgaacgatccctggcaagggcaggattctattataccggggttaatgacaaagtgaaatgtttctgttgtggactgatgctggataattggaaacttggagattctcccatccagaaacacaagcagctatacccgagttgcagtttcattcagaacttggtaagcgccagtctcggcagtaccagtaagaacacctctcccatgcgcaatagcttcgctcattctttatcccccacactggagcattcatcactgttttccggaagctactcatccctttctccaaacccgctcaactcacgagctgtagaagatattagcagttcacggaccaacccctatagctacgccatgtctacagaggaggctcgatttctcacgtatcatatgtggcctctgacctttctgtcgccatccgagttagcccgggcaggcttttattacatcggaccaggggatcgtgtggcctgtttcgcatgtggcgggaaattatctaactgggaacccaaggacgatgcaatgtccgaacacaggagacatttccctaattgcccattcctggagaattcactcgaaactctaaggttcagtatatccaatcttagtatgcaaactcatgctgcgagaatgaggacttttatgtactggccctctagtgtgccggtacaacctgagcaactggctagcgctggtttttattatgtgggcagaaatgatgatgtcaaatgcttctgttgtgacgggggcttgcgctgctgggaaagcggcgacgatccatgggtggagcacgccaagtggttcccccgatgcgaattcctcatccggatgaagggacaagaatttgttgatgagattcagggtcgttacccgcacctgcttgagcagcttctctctacaagtgataccacaggagaagaaaacgccgatccccccattattcactttggtcccggcgaaagttctagcgaagacgcggttatgatgaacacccctgtggtgaaaagtgccctcgagatgggattcaatagggatctggtcaagcagaccgtgcagagcaaaatcttaaccaccggcgagaattacaagaccgttaacgatatcgtgtccgccttgttgaatgctgaggacgaaaagcgtgaggaggagaaagagaaacaggccgaggagatggcctctgacgatctgagcctgattcgcaagaataggatggctctgttccagcagctcacctgtgtcttgcctatcttggataatctgctcaaagctaacgtcattaataagcaagagcatgacatcatcaagcagaaaacccagattcctctccaggcaagagagctcattgataccatacttgtcaaagggaatgcggctgccaatatattcaagaactgcctaaaggaaatcgactcgacactgtacaagaatctttttgtggacaaaaatatgaagtatatcccaacggaggacgtgtctggcctctcactcgaggagcaactacgccgcctgcaagaggagcgcacatgtaaggtgtgcatggacaaggaagtgtctgtggtcttcattccatgcgggcacttggtggtgtgccaagagtgtgccccttctctgcggaagtgccctatttgccggggaatcattaagggaacagtcagaacgttcctcagc

SEQ ID NO: 32252 - DNA, 1854 bp, Artificial Sequence
  Description of Artificial Sequence: Synthetic coding sequence
atgcacaaaactgcctcccagcgcctgtttcctggaccctcctaccaaaacataaagtccattatggaggactcgactattctctccgactggaccaattcgaataagcagaagatgaagtatgacttttcctgcgaactctacagaatgtcaacttattccacctttccagcgggtgttcctgtgtcggaaagatcactcgcccgggcgggcttctactatactggtgtgaatgataaagtcaaatgcttctgttgtggactgatgttggataactggaaactcggtgacagccctattcaaaagcataagcagctttacccatcatgttcctttattcagaacttggtgagcgcttccctgggttcaacttcgaagaacacttcaccaatgaggaacagctttgcacattccctctcgcccaccctggaacactcctccctcttctcaggttcgtactccagcttgagccccaacccgctgaatagcagagcagtggaggatatctcatcttccagaacgaacccctacagctacgcaatgtccaccgaggaggccagatttctgacctaccatatgtggcctctcacctttctgtcgccatcggagcttgcaagggccggattctactacatcggccctggagatagggtcgcatgttttgcgtgtggcggcaaactctcgaactgggagccaaaggatgatgctatgtcggaacatcggagacattttcctaactgccctttcctcgaaaattcactggagactctgagattttctatcagcaaccttagcatgcaaacccacgctgcacggatgcgaactttcatgtactggccatcgtcggtgccagtccaacctgaacagctggcttctgcaggtttttactacgtgggacgtaatgatgatgtgaagtgtttctgttgcgacggagggctcagatgttgggagtccggagatgatccatgggtggaacatgccaagtggtttccacggtgtgaatttctgatccgtatgaaaggtcaggagtttgtggatgaaatccagggaagatacccacatctcctggagcaactcctttccacctcggatactaccggagaagaaaacgccgatcctccaatcatccacttcggtccgggcgaatcatcgagcgaggacgcagtgatgatgaatactccagtggtgaagtcagctctggaaatgggtttcaacagagatcttgtcaagcagaccgtccagagcaagattctgaccactggcgaaaactacaagactgtgaatgatatagtttcagctcttctgaacgccgaagatgagaagcgcgaggaagagaaggaaaaacaggcagaggagatggccagcgacgacctttcgctgattcgcaagaaccggatggcactgttccaacagctgacctgcgtgctgcctatacttgacaaccttctgaaggctaacgtcatcaataagcaagagcacgatatcataaaacaaaagactcagatcccactgcaagcacgtgaactgattgataccattctcgtgaagggaaacgcagcagcgaatatcttcaagaattgcctcaaagaaattgactcaaccctttacaagaacctgttcgtggataagaacatgaagtatatcccgaccgaggacgtgtcgggcctttcgctggaagagcaactgaggcggcttcaggaggaaagaacctgcaaggtgtgtatggacaaggaagtctccgtcgtgtttatcccatgtggacatcttgtggtgtgtcaagagtgtgcaccatccttgaggaagtgtcccatatgtcgtggtatcattaaggggacggtcagaacgtttcttagc

SEQ ID NO: 32253 - DNA, 1854 bp, Artificial Sequence
  Description of Artificial Sequence: Synthetic coding sequence
atgcacaaaaccgcatcacagcgactttttccggggcctagctaccagaatatcaagagcattatggaagattccaccattctttcagattggaccaactccaataagcaaaagatgaagtacgactttagctgcgaactctacagaatgtccacttactccaccttcccagccggagtccctgtgtcggagcgctcccttgcccgagcagggttttactacactggagtgaacgacaaggtgaaatgcttttgctgtggcctgatgcttgataattggaagctgggtgattcgcctattcaaaagcacaaacaactttacccttcgtgttcgtttattcagaatcttgtgagcgcatcgcttggaagcacttccaaaaacacttcaccaatgcgcaacagctttgcgcattcactctcgccaaccctggaacactcatctcttttctccggctcctactcttcactgagccccaatccactgaactccagagcagtcgaagatatctcgtcaagccgcactaatccttactcctatgcaatgtccaccgaagaagcccgcttcctgacgtaccatatgtggccacttacttttctgagcccttccgaacttgcaagagcaggattctattacattggaccaggcgatagggtggcctgctttgcttgtggaggaaaactgagcaactgggagcctaaggatgacgccatgtccgaacataggagacatttccccaactgtccctttctcgaaaactctctggaaactctgagattctccatttccaatctgtccatgcagactcatgcagcaagaatgcggacctttatgtactggccttccagcgtgcctgtgcagccagagcaactggcatcggcaggattttactacgtcggccgcaatgatgatgtgaagtgtttctgttgcgatggtggacttagatgttgggaaagcggagacgatccttgggtcgaacatgcaaagtggtttcctcggtgcgaatttcttattagaatgaagggacaagaatttgtggacgagatccaaggccgctacccacatctcctcgaacagcttctgtctaccagcgacactactggggaagaaaacgccgatcctcctatcatacattttggacctggtgagagctcgtccgaagatgcggttatgatgaacacccctgttgtgaagtccgccctggagatgggtttcaacagagatctggtgaagcagaccgtgcaatcgaagatcctgactaccggcgagaactacaaaaccgtgaatgatattgtgtccgccctcctcaacgcagaagatgagaagcgggaagaggagaaggaaaagcaggccgaagaaatggcgtcggatgatctgtcactcatccgtaagaacagaatggcacttttccaacaacttacttgcgtgctcccaatcctggacaacctccttaaggccaacgtcatcaacaagcaggaacacgacatcattaagcagaaaactcaaattccgctgcaagctcgcgaactgattgacactattctggtgaagggtaatgccgctgcgaacattttcaagaactgcctcaaggaaattgattcgactctgtataagaacctttttgtggataagaatatgaagtacattccgactgaagatgtctccgggctctcgctggaggaacagctgcggcggcttcaagaagagagaacttgcaaggtctgtatggacaaagaagtctcagtggtgttcattccctgcggtcacctggtggtctgccaggagtgtgcaccttcgctgagaaagtgccctatttgccgcgggataatcaaaggcactgtcagaaccttcctgtcc

SEQ ID NO: 32254 - DNA, 1854 bp, Artificial Sequence
  Description of Artificial Sequence: Synthetic coding sequence
atgcataaaaccgcaagccagcgactttttccgggtccttcctatcaaaatatcaaatctattatggaggattcaacgatccttagcgattggacaaactcaaataagcaaaaaatgaaatacgatttttcctgcgagttgtatcgcatgagcacatactctaccttcccggctggagtcccagtgagtgaaaggagtcttgcaagagctgggttttattataccggcgtaaatgataaagtcaagtgcttctgttgcggcttgatgttggataattggaaactcggagattcacctatacaaaaacataaacagctctatccatcgtgtagtttcatacagaacctagtgtctgcaagtcttgggtcaacttcaaaaaacacgtctcctatgcgaaacagtttcgcccattcactgagtcctacattggagcattctagcttgttttcaggatcttattcgtctttaagcccgaatccgctcaattcacgggccgttgaagatatttctagttctcggacgaacccgtactcatatgcgatgtcaacggaagaggcccggttccttacataccacatgtggcctcttacgttcttgtcacctagtgagttagcgcgggccggcttttattacataggacctggtgatcgagtggcatgttttgcctgtggcggaaaacttagcaactgggaaccgaaagatgatgcaatgagcgaacatcgacgacatttcccaaactgcccgtttcttgaaaattctctggaaacactgcgcttttctattagtaatctttcaatgcaaacacatgcggctcggatgagaacgtttatgtactggccttcatctgttcctgtccaacctgaacaattggcgagcgcaggcttttattatgtgggcaggaacgatgatgtgaaatgcttttgctgcgatggaggactgcggtgctgggaatccggagatgatccatgggttgaacacgcaaagtggtttcctcgttgcgaattccttattcgcatgaaagggcaagaatttgttgacgagattcaaggcagatatccgcatcttcttgagcaattgctttccacgagtgacacaactggggaagagaatgctgatcctcctattatccattttggcccgggcgagtcaagttctgaagatgctgtcatgatgaatacccccgtcgtcaaatctgctctagagatgggattcaatagagatttagtcaaacaaacagtccaaagtaaaatattgaccactggggagaactataagacggttaatgacattgtaagcgccctcctaaacgccgaggatgaaaaacgggaagaagaaaaagaaaagcaagccgaagagatggcctcagatgatctctccctcattcggaaaaatcgcatggctctctttcaacaactgacatgcgtccttccgatccttgataatctccttaaagcgaatgtaattaacaagcaagaacacgatattatcaagcagaaaacacaaatcccactgcaggctcgggaacttattgatacgatactggtcaaaggtaacgcggccgcaaatatatttaagaattgcttaaaggagattgactcaactctgtacaaaaacttatttgtcgataaaaatatgaaatacatccctacagaagacgtgagcggacttagtcttgaagaacaattgcgtcgacttcaggaagaacgtacgtgtaaagtatgcatggataaagaggtaagtgttgttttcatcccttgcgggcacctagttgtgtgccaggaatgcgctccgtctctgagaaagtgcccgatttgccggggcatcattaaaggaaccgtccgtacgtttctatct

SEQ ID NO: 32255 - DNA, 1854 bp, Artificial Sequence
  Description of Artificial Sequence: Synthetic coding sequence
atgcacaaaaccgcctctcagcggctgtttccagggcccagttaccaaaacattaaaagcattatggaggatagcactattctgagtgactggacaaactctaacaagcagaaaatgaagtatgacttcagctgcgagctttacagaatgagtacgtactccacgtttcccgcaggggttccggtgtcagaacgctccctcgcccgggccggattttactatacaggagttaatgacaaggtcaaatgcttctgttgtggtctgatgctcgacaattggaaactcggcgactcaccaatccaaaaacataagcagctgtatccgagctgttccttcatacagaaccttgttagcgcaagcttgggtagcacatcaaaaaacaccagccccatgaggaacagtttcgctcactctctgtctcccaccctggaacattctagtctgttttccgggtcatactctagcctttcccctaacccgctcaatagtagggctgtggaggacataagcagcagtcggacaaacccctactcatatgccatgagtaccgaggaagcccgattcctgacgtaccatatgtggcccctcacctttctctccccatccgagctggcacgcgctgggttttactatataggacccggggatagggttgcctgttttgcctgtggcgggaagctgagtaattgggaacccaaggacgacgcaatgtcagagcatagaaggcacttccctaattgcccttttctggaaaattctctggagaccttgagattctcaatctcaaacctgtccatgcagactcatgctgcgcggatgcgcaccttcatgtactggccttcctccgtgccagtacagcccgagcagctcgccagcgccggcttctattacgttggcaggaatgacgacgtcaaatgtttttgctgtgacggaggactgagatgttgggagagcggcgacgatccatgggtggaacacgcaaagtggtttccccggtgtgaatttctgatccggatgaaaggccaggaatttgtagatgagattcagggaaggtacccacaccttctggagcagctcctttcaacatccgatactacaggagaggaaaacgctgatccccccatcattcatttcggaccaggggagtcatcatccgaagatgccgtgatgatgaatacccctgtggttaagtctgccctggaaatggggttcaatagggacctggttaagcagaccgtgcagtccaaaatactgacaacaggagagaattataaaacagttaatgacatcgtgtcagctctgctgaatgctgaggacgagaagagagaggaggaaaaggagaaacaagccgaagaaatggcaagtgacgatctgtccctcatccggaagaaccgaatggcgctgttccagcagttgacctgcgtgctgcccattctggataacctgctgaaagccaatgtgatcaataagcaggagcatgacataattaagcagaaaacccagatccctctgcaagcccgggagctgattgataccatcctggtgaagggcaacgcagctgccaatatctttaaaaactgccttaaagagatcgactccacactgtataaaaatctctttgtcgacaaaaacatgaagtatattccaactgaggatgtcagcggactgagccttgaggagcagcttcggagacttcaggaggagcggacttgcaaggtgtgcatggacaaagaggtgtcagtggtgtttattccctgcgggcacctggtggtctgccaggagtgtgccccttccctgcggaagtgtccaatatgcagaggaattatcaaagggaccgtcagaaccttcctttcc

SEQ ID NO: 32256 - DNA, 1854 bp, Artificial Sequence
  Description of Artificial Sequence: Synthetic coding sequence
atgcacaaaacagccagtcagcggctcttccctggtcccagctatcagaacattaagagtatcatggaggactccacaatcctgagcgattggactaactccaataaacagaaaatgaaatacgattttagttgtgaactgtacaggatgagcacctattctacatttcccgcaggcgtgcccgtcagtgagcgatccctggcccgcgcgggcttttactataccggcgtaaatgataaagtaaagtgcttctgctgtggactcatgctggacaactggaaactgggcgatagcccaatccagaaacataagcagctctacccttcttgctctttcatccaaaatctcgtcagtgcctccctggggagtacctcaaagaacacatccccgatgcgtaatagtttcgcccacagtctgtcccccacgctcgagcactctagcctgttttccggaagttattcctctctgtctcccaatccgctgaattccagggctgttgaagacatctcaagttctcgcacaaacccttactcttacgctatgtctacagaggaagcccgcttcttgacctaccacatgtggccacttacttttctgtctccatcagaattagcacgagcgggtttctattacatcggcccgggagaccgcgttgcttgtttcgcatgcggcggtaagctgtccaattgggagccaaaggacgacgccatgtctgaacacagacgtcacttccccaactgcccctttctggagaattcactcgaaaccctccgcttcagcatctcaaatctttcaatgcagacccatgcagcacgcatgcgaaccttcatgtattggccctcctcagtgccggttcaacccgaacaactagctagcgccggattctactacgtgggccggaatgacgacgttaaatgtttctgctgtgatggcgggctgagatgctgggaaagtggtgacgacccctgggtcgaacacgcgaagtggttccctcggtgtgaattcctgattagaatgaagggccaggaatttgttgatgaaatccagggccgatatcctcatctcctcgaacagctgctgagcactagcgacacgactggggaggagaacgcagaccccccgattattcatttcggtccaggcgagtcttcctccgaagatgccgtgatgatgaatacccctgtcgtgaagtcggccctggaaatgggtttcaatcgcgatttggtgaagcagactgttcagtctaagatattgacgacaggcgagaattacaaaacagttaatgatattgtgagcgcgctgctcaacgcagaggatgaaaagcgagaagaggagaaggagaaacaagctgaggagatggcctccgacgacctttctttgatccggaagaaccgtatggccctgtttcagcagcttacgtgtgttcttccgatacttgacaatctgttgaaagccaacgtcattaataagcaggagcacgatattattaaacagaagacacaaatcccactgcaggcccgggaactcattgatactatactggtcaagggcaatgctgccgcgaatattttcaagaactgcctgaaagaaatagactctacgttgtacaagaatctttttgtagataagaacatgaagtacataccgaccgaagatgttagtggtctgtccctcgaggaacagttgcggcgcttgcaggaggagcgcacctgcaaagtgtgtatggacaaggaagtgtcagttgtgttcattccctgcggccacctagtagtctgtcaggaatgtgctcctagtctgagaaaatgcccgatctgccgaggaataattaaggggaccgtaaggacatttttatct

SEQ ID NO: 32257 - DNA, 1854 bp, Artificial Sequence
  Description of Artificial Sequence: Synthetic coding sequence
atgcacaagaccgctagccagaggttgttccctggcccgtcctaccaaaacatcaaatctatcatggaggactcgaccatcctctcagactggaccaactcaaataaacagaagatgaagtacgatttttcctgcgaactgtatcggatgtccacgtattcgaccttcccggccggggtccctgtctccgaacggagcttggccagagccggattttactacaccggcgtcaacgataaggtgaagtgcttctgttgcggattgatgctcgacaactggaagctcggagatagccctattcagaagcataagcagctttacccgtcctgctcgttcatccaaaacctggtgtccgccagcctcggtagcacctctaaaaacacttcccccatgcggaactcgttcgcccacagccttagccctacccttgagcactcgtctctcttctcaggcagctacagctcactttccccaaatcccctgaattcgcgggcggtggaggacatctcctcgtcgcggaccaatccctactcgtacgcgatgtctactgaggaagcgcggttcctcacttaccacatgtggccgctcactttcctctcaccgtcggaactggcccgcgctggattctattacatcggaccaggagatagggtggcatgctttgcgtgcggaggcaagctcagcaactgggaaccgaaagacgacgccatgagcgaacaccgcagacatttccctaactgcccgttcctggaaaattcgctcgaaacgctgcgcttttcaatctcaaatctgtcgatgcaaacccacgctgccagaatgcgcacctttatgtactggccgtcgagcgtcccagtgcagccggagcaactcgcgtcggcaggattctactacgtcggaaggaacgatgatgtcaaatgcttctgctgcgacggcggactgcggtgctgggaatcaggcgatgacccttgggtcgagcacgcgaagtggttcccacgctgcgaatttctgatccgcatgaaaggacaggagtttgtcgacgaaatccaaggtcgctacccgcatctcctggagcaactgctgtccaccagcgataccactggagaggaaaacgcagatcccccaatcattcattttggtcctggagaatcttcgtcagaagacgccgtgatgatgaataccccggtggtgaagagcgcactggagatgggtttcaaccgcgatctcgtgaagcaaaccgtgcaatcgaaaatcctgacgaccggtgaaaactataagactgtgaacgatatcgtcagcgctctcctcaacgcggaagacgaaaagagagaagaagagaaggagaagcaggccgaagagatggcatccgatgatctgagcctgatccgcaagaaccgcatggcactttttcaacagctgacgtgcgtgctccccatcttggacaacctgctcaaggctaacgtgattaacaaacaagagcacgacatcattaagcagaagactcagatcccactccaggcccgcgaacttatcgacacgatccttgtgaagggcaacgccgctgcgaacattttcaagaattgcctgaaggagatcgactcgactctctacaaaaatctgttcgtggataaaaacatgaagtacatccccacggaggacgtgtcgggtctgagcctcgaagagcagctgcgacggctgcaggaggaacggacttgcaaggtgtgtatggacaaggaagtcagtgtggtctttatcccttgcgggcatctggtggtctgccaggaatgtgccccttccctgcgcaaatgtccgatttgtcggggaatcatcaagggcactgtgagaacgttcctgtcc

SEQ ID NO: 32258 - DNA, 1854 bp, Artificial Sequence
  Description of Artificial Sequence: Synthetic coding sequence
atgcataagacggcttctcagcgcctttttccaggccctagctaccagaatatcaagagtatcatggaggactcgacaatcttatccgattggactaattcgaataagcaaaaaatgaagtacgattttagctgtgagttatacagaatgagcacgtactccactttccctgcgggagtcccagtttcggaacggagcctggctcgtgcggggttttattacaccggcgtgaatgacaaggtaaaatgtttctgttgcggcctcatgttagataactggaagctgggcgattcccctattcagaagcacaaacagttgtacccatcctgcagcttcattcagaacttggtcagcgcaagccttggttcgacttcgaagaacacaagccccatgcgcaatagcttcgctcactcgctgtcccccacccttgagcacagcagtttgttcagtgggtcttacagctcactgtcccccaatccactgaactcgcgggccgtggaggatatctccagttctcggaccaacccatatagctacgccatgtctactgaagaggctagatttctgacataccatatgtggccacttacctttctgtctccctcggaactcgcccgtgccggcttctactatatcggccccggagaccgcgtggcttgctttgcctgcggcggtaagctgagtaattgggaacccaaggacgacgctatgagcgaacatcgaagacacttccctaattgcccatttctggaaaattccctggaaactcttcgctttagtattagcaatctgagcatgcagacccatgctgcccgaatgaggacctttatgtactggccttctagcgtgccagttcagccagagcagttggcatcagccggcttctattatgtcggcaggaatgacgacgtaaagtgcttttgttgcgacggcggtctgagatgttgggaatccggcgacgacccttgggtcgaacacgccaagtggtttcctagatgcgaattcctgatacgaatgaagggccaggaatttgtcgacgagattcaaggtcgataccctcatcttctagagcaactgctctccacctcagatacaacaggggaagagaatgcagacccgcccatcatccacttcggacctggcgagtcctctagcgaggatgccgtcatgatgaacaccccggttgtgaaatctgcactggaaatgggctttaaccgtgatttggtcaagcagacagtgcagtcgaagatccttacaaccggtgaaaactataagactgttaatgatatagtgagtgcgcttctgaacgccgaagacgagaaacgagaggaggagaaagaaaagcaagcagaagaaatggctagcgatgacttgtctctgatcagaaagaaccgaatggccctcttccagcaactgacttgtgttttaccaattctcgataaccttttaaaagctaacgtgatcaataagcaagagcatgacataatcaagcaaaaaacccagatccctctacaagcccgcgagttaatcgataccatactggtaaaggggaatgccgcagccaacattttcaaaaactgcctcaaagagattgattctaccttgtataaaaacttgttcgtcgacaaaaatatgaagtatatcccaactgaagatgtctccggactttcactggaagagcagcttcgacgcctccaggaagaaagaacctgtaaggtgtgtatggataaggaagtatctgtggtgttcattccctgcgggcacctcgttgtgtgtcaagaatgcgccccaagcctcagaaaatgtcccatctgcagagggattatcaagggcaccgttaggacttttctaagt

SEQ ID NO: 32259 - DNA, 1854 bp, Artificial Sequence
  Description of Artificial Sequence: Synthetic coding sequence
atgcacaagaccgcctcgcagaggctcttcccaggaccttcctaccaaaacatcaaaagcataatggaagattccactatcctgtccgactggacgaattcaaataagcagaaaatgaagtacgatttctcctgtgagctctaccgcatgagcacctattcgactttccctgctggagtgccagtgtccgaacgttccctcgctcgcgccggattctactacaccggtgtgaatgataaggtgaaatgtttctgttgtggtttgatgcttgataattggaaactgggtgattccccaattcagaagcataaacaactctacccatcatgctcattcattcaaaacctggtttccgcatcacttggatccacttccaaaaacacctctcccatgagaaattcctttgcccatagcctgtcccctacccttgaacacagcagcctcttttcgggatcgtacagctcgctgtcgccaaaccccttgaactcaagagcagtggaggacatctcgtcaagccgtactaatccatattcatacgcaatgtcgaccgaagaagcacggtttctgacctaccacatgtggcctcttacttttctctcgccatccgagctcgctagggcaggtttttactacattggacctggggatcgggtggcatgcttcgcatgtgggggtaagctctcaaattgggaaccaaaggatgacgcaatgtcggagcataggagacactttcctaactgtccatttctggaaaactccttggaaaccctgagattttcgatttcgaacctgtccatgcaaacccacgcagctagaatgcgcacttttatgtattggccctcctctgtgccagtgcagcctgaacaacttgcaagcgcagggttctactacgtggggcggaacgacgacgtgaaatgcttttgttgtgatggaggtctgcgctgttgggagtccggagatgacccttgggtggaacatgcaaagtggttcccacgatgcgaattcctcatcagaatgaagggacaagagttcgttgacgaaatacagggaaggtaccctcacctgcttgaacagctcctttccacctccgacactactggtgaggagaacgcagatcctccaattatccattttggccccggggagtccagctcggaagatgcagtgatgatgaatactcctgtggtcaaatccgccctcgagatgggtttcaatagggacttggtcaagcagactgtgcagtcgaagattctgactaccggagaaaactacaaaaccgtcaacgatattgtgagcgcactgcttaacgcagaagatgaaaagagggaagaagaaaaagaaaagcaagcagaagaaatggcatccgatgatctttcacttatccgcaagaatagaatggcactctttcagcagctgacctgtgtcctcccgattctggataacctgcttaaggccaacgtgataaacaagcaggagcacgacatcattaaacaaaaaacccagataccgcttcaggcgagagaactcattgataccattcttgtgaaagggaatgcagccgccaacatcttcaaaaactgtttgaaggagatcgacagcaccctgtacaagaacctttttgtcgataagaatatgaagtacatacccaccgaggacgtgagcgggctctccctcgaggaacagcttagacggcttcaagaggaacgaacttgcaaggtctgtatggataaggaggtgagcgtggtgtttattccttgtggacacttggtggtctgtcaggaatgtgcaccatcgctgcgtaagtgccctatatgtcgggggatcattaaggggaccgtgcgcacgtttctctca

SEQ ID NO: 32260 - DNA, 1854 bp, Artificial Sequence
  Description of Artificial Sequence: Synthetic coding sequence
atgcacaagacagccagccagaggctgttccccggcccctcttaccagaatatcaaatccataatggaggactctacaatcctatctgattggactaacagtaataagcaaaagatgaagtatgatttctcatgcgaattgtatagaatgtcaacatattccacatttccagcgggggtgccagtgtctgagcggtctctcgcaagggcaggcttctattacaccggggtaaacgacaaggttaagtgcttttgctgcgggcttatgttagacaattggaagcttggggatagtccaatccagaagcataagcaactgtacccttcctgctcattcattcagaatttggtgtctgcttcattaggatccacatccaagaacacatcacctatgagaaattcttttgctcactctctgtctcccaccctcgagcatagcagcctattttccggcagctactccagtctttccccaaacccactcaactccagagcggtggaagatatctcgagttctcgaactaacccatactcctacgccatgtccacggaggaggcacgtttcctgacttaccatatgtggccacttaccttcttatcacctagtgagctcgcgagagctggattctattacattggcccgggagacagggtggcctgcttcgcctgcgggggcaaattgtctaattgggaacccaaggatgacgcaatgagcgagcacagaagacacttccctaactgtcctttcttggagaatagtttggagacattacgcttttcaatatctaacctgtctatgcaaactcacgcggccaggatgagaacatttatgtattggccgagttcagttcccgtccaacctgagcagctggccagcgccggattctattacgtcggtcggaatgacgacgtgaagtgtttctgctgtgatggcgggctgagatgctgggaaagtggggacgatccctgggtggagcacgcaaagtggttcccccggtgtgagtttctaatacgcatgaagggccaggagttcgtggatgagattcagggaagatatccacatctgctcgagcagctgctctcaacatccgatactaccggtgaggaaaacgctgaccctcccatcatccacttcggccccggggagtcgagcagcgaagatgccgttatgatgaacactcctgttgtaaagagcgcgctggaaatggggttcaacagggatctcgtcaaacagaccgtgcagtcaaagatacttaccacaggagagaactataagacggtgaatgatattgtgtcagccttgctgaacgcggaagacgagaagcgggaggaggagaaagaaaagcaggccgaagaaatggccagtgacgatctctctctgataagaaaaaatcgcatggcgctttttcagcaacttacgtgcgtcctgccaattttggataatctgctgaaagcgaacgtaattaataagcaggaacatgatatcatcaagcagaaaacgcaaataccactgcaggccagggagcttattgatacgatactcgttaagggaaacgctgctgctaatatttttaagaactgtctgaaagaaattgactctactctgtacaaaaacctgttcgtggataagaatatgaagtacatccccacagaggatgtttcaggcctgtctttagaggagcaattgcgcaggctgcaggaggaaaggacctgtaaggtgtgcatggacaaggaggttagtgtcgttttcatcccgtgcggtcatcttgtcgtgtgtcaggagtgcgccccaagtcttagaaaatgtcctatctgccgcggaatcatcaagggcaccgttagaacgttcctgtct

SEQ ID NO: 32261 - DNA, 1854 bp, Artificial Sequence
  Description of Artificial Sequence: Synthetic coding sequence
atgcataagacggcctcccagcgactgtttccgggaccaagctaccagaacattaagtctatcatggaagactccaccattctgtcagactggacgaactctaataagcagaagatgaagtatgatttcagctgtgagctgtatagaatgtcaacctatagtacatttcctgcaggtgtgccagtaagtgaacggtctttggcccgcgccggtttctattataccggagtaaacgataaggtcaagtgcttttgctgtggactgatgctggacaattggaagttaggtgacagcccgattcagaagcacaagcagctctacccctcttgtagctttatacagaacctcgtaagtgcttccctgggaagcacgtctaagaacacgagcccaatgcggaatagcttcgcacactcattgtctcccacacttgagcactcttcactttttagcggctcctatagctccttgagccctaaccccctcaactctcgggcagtcgaagacatatcctcgagccggaccaatccctacagctacgctatgtctaccgaagaggcccgctttctgacctatcacatgtggcccctaaccttcttgtcaccctccgaacttgctcgggccgggttttactatatcggaccaggggaccgggtggcctgttttgcttgtggaggaaaacttagcaattgggagcccaaagacgacgccatgtctgaacatagacggcactttccaaactgtccttttctcgaaaacagcctcgagaccttgagattcagcatctcgaacctcagcatgcagacccatgctgcacggatgcgaacgtttatgtactggccttcttcagtgccagttcagcccgagcagttggctagtgccggcttttactatgtcggacggaatgacgatgtaaagtgcttctgctgcgatggcggacttcggtgctgggagtcaggtgacgatccgtgggttgagcacgccaagtggttcccgaggtgcgaatttctgatccgcatgaaaggccaggagttcgtcgatgagatccaggggcgttatccccatctgctggagcaactgctgagcaccagcgacaccacaggtgaggagaatgcagaccctcccatcatacattttgggcccggcgagtccagcagtgaggatgcagtgatgatgaatacccccgtcgtgaagagcgcactggagatgggttttaatcgagacctcgtaaagcagacggtgcagagtaaaattctcacgacaggcgagaattacaagacagtgaatgacatagtgtcagccctgctgaacgccgaggacgaaaagcgagaggaggaaaaggaaaaacaggcagaagagatggcttccgacgatctgtcactcattcggaagaaccgcatggccctattccagcagctgacctgcgtgctgcccattctagacaatcttcttaaggcaaatgtgattaataagcaggagcatgatattatcaagcagaagacacagattcccctgcaggctagggaactgatagacactattctcgttaaaggcaacgccgcagccaacatttttaaaaactgcctcaaagagattgactctaccctgtataagaacctgttcgtggacaagaacatgaagtacatccctaccgaggatgtgtctggactgtctctggaggagcagttgaggagattgcaggaggagagaacttgcaaagtctgtatggacaaggaggtttccgtggtgtttattccatgcggtcacctggtggtctgccaggagtgtgccccatccctacgcaagtgccctatctgcaggggcatcattaaaggaacagttcggaccttcctcagc

SEQ ID NO: 32262 - DNA, 1854 bp, Artificial Sequence
  Description of Artificial Sequence: Synthetic coding sequence
atgcacaagactgcatcccagaggctctttcccgggccctcttatcagaacatcaaaagcatcatggaagatagcacaatccttagcgattggactaactcaaataagcagaaaatgaagtacgatttcagttgcgaactttaccgaatgagcacctacagtacctttccagcgggcgttccagtgagtgagaggtcacttgcaagagccggattttactacaccggagtcaacgacaaagtgaagtgtttttgctgtggtttgatgcttgataactggaagctgggcgacagtccaatccagaagcataaacagctctacccctcttgttcttttattcaaaatctggttagtgctagtctgggtagtacctccaaaaacacatctccaatgagaaactcatttgcccactccttgagtccgactctggagcatagttcactgttcagcggatcgtactcctcactaagcccaaacccactgaactctagggctgttgaagatatcagcagttcaagaaccaatccgtactcctatgctatgagcaccgaagaggcgcgttttttaacctaccacatgtggccactgacttttctaagcccatccgagctcgccagggccggattttactatataggacccggggatcgggtagcttgctttgcctgtggcgggaagttgtcaaactgggaacctaaggatgacgcaatgagcgaacacaggcggcactttcctaattgtccttttttggaaaactcactggagacactgaggttctctatctcaaatctcagtatgcaaacccacgctgcacgaatgagaacgtttatgtattggccctcgagcgttcccgttcaacccgagcagctcgccagtgccggattctactatgtgggtcggaatgatgatgttaaatgcttttgttgcgacgggggactgagatgctgggagtccggggatgacccatgggttgaacatgcaaagtggtttcctaggtgtgaatttttgatcaggatgaaggggcaagagtttgtggatgagatacaggggcgctacccccacctgctggagcagttgctgagcaccagtgatactactggtgaagaaaatgccgatcctcctattattcatttcggccccggtgaaagcagcagtgaggacgctgtgatgatgaatacaccagtggtgaagtcggccctcgagatgggcttcaatagggatttagttaaacagacagttcaatctaagattctgacaacaggagagaactacaaaacagtgaacgatatcgtcagtgccttgctcaatgcagaagatgaaaagagagaagaggagaaagagaaacaggctgaggaaatggcatccgacgacctgagtctcatccgcaagaaccggatggccttgttccagcagctcacatgcgtcctgcctatccttgataatctgctgaaagccaatgtgattaacaagcaagagcatgatatcattaagcagaagacacagatcccccttcaggcgcgtgagctgatcgacacgatcctggtgaaaggcaatgctgccgccaatatctttaagaattgccttaaggagattgacagtaccttgtacaaaaatcttttcgtggacaagaacatgaagtatatccccacggaggacgtgtctggactgagtctcgaggagcagctccggcggcttcaggaggaaaggacgtgtaaagtgtgcatggacaaagaagtctccgtggttttcatcccttgcggtcacctggtggtgtgccaggagtgcgctccgtcactccgcaagtgtccaatctgtcgcggcatcataaaagggacagtgcgcaccttcttgtct

SEQ ID NO: 32263 - DNA, 1854 bp, Artificial Sequence
  Description of Artificial Sequence: Synthetic coding sequence
atgcacaagactgcttctcagcgcctcttccctggcccaagctatcaaaacatcaaaagcatcatggaagattctactatcttgagcgattggaccaattctaacaagcaaaagatgaagtacgacttctcctgcgagctctacaggatgagcacctatagtaccttccctgcaggcgtccctgtgagcgagaggtcactggctcgcgcaggcttctactacaccggggtgaacgataaagtgaagtgtttctgctgcggcctcatgttggataattggaagctcggcgacagtcccatccagaagcacaagcagttgtacccaagttgcagttttatccaaaaccttgtttccgcgagcctcggttcaacgtcaaagaacacaagcccgatgcggaactcttttgcgcacagcctgagtcccactctggagcactcaagccttttctctggatcttacagctcactgtcaccaaaccccctgaacagccgcgcagttgaggatatctcgagcagtcgaactaacccttatagctacgccatgagcaccgaggaagcacgcttcctgacctaccatatgtggcccctgacttttttgtccccatctgaactggctagggcaggcttttactatatcggtcccggcgacagggtggcatgttttgcatgtggcggaaagctgtcaaattgggagcccaaggacgatgccatgagtgagcataggaggcattttcctaactgtccattcttggagaacagccttgaaactctgaggttctccatcagtaacctgtcaatgcagacgcatgctgcccgtatgcgcacatttatgtattggccaagctctgtgcctgttcaaccagagcagttggcaagtgctggcttctactacgtgggccgaaatgatgatgtgaagtgcttctgttgcgatggaggactgcgctgctgggagagtggagacgatccatgggtggaacacgctaagtggttccctcgatgcgaatttctgattaggatgaaaggacaggagttcgtggatgaaattcaaggccgctaccctcacctcttggaacagctactgtccacatcagatacgacaggcgaggagaatgccgatccaccaatcatccattttgggcccggagaatctagctctgaggatgctgttatgatgaacacacctgtggtgaagagtgccctggaaatgggattcaacagagacctggtgaaacagaccgtccagagcaaaatcctcaccaccggcgaaaactacaagactgtgaacgatatagtcagcgccctgctgaacgccgaagacgaaaagagggaagaggagaaagagaagcaggctgaggagatggcctccgacgatctgtccctcataaggaaaaatagaatggctctgtttcagcagctgacctgcgttttgcccattttggataatcttctgaaagcaaacgtgatcaacaaacaggagcacgatatcatcaagcaaaagacacagatcccactgcaggctcgagagctaatcgacaccatccttgtcaagggcaacgctgctgctaacatcttcaaaaactgcctgaaggagattgactccacgctctataagaacttgttcgtagataagaacatgaagtacatcccaaccgaagacgtcagcggccttagtctggaggagcaattgagaagacttcaggaagaacgcacctgtaaggtttgtatggataaggaagtaagcgtggtcttcatcccatgtggtcatctcgtggtgtgccaggagtgcgcacctagtctgaggaaatgtccaatctgtagggggattatcaagggaacagtaagaaccttcctgtcc

SEQ ID NO: 32264 - DNA, 1854 bp, Artificial Sequence
  Description of Artificial Sequence: Synthetic coding sequence
atgcataagactgcttcccaacgtctgtttccaggaccttcctaccagaacatcaagtccattatggaggatagcacaatcctctccgactggactaactcaaacaagcagaagatgaagtacgatttctcttgcgagctgtataggatgtctacctactccaccttcccagccggagtacctgtttctgaaaggtctcttgcaagggctggtttctactacacaggcgtgaacgacaaggtgaagtgcttctgttgcggtctgatgctcgacaactggaagcttggtgactcacccatccagaagcacaagcagctttacccctcatgttctttcatacaaaatcttgtttctgcaagtcttggatccacctcaaagaatacttctcctatgcgtaacagctttgcacactctctgtctcctacattggaacatagctcactgttttcaggatcttactctagcttgtccccaaacccattgaatagccgtgctgtagaggacattagttcatcccgcaccaacccttactcctacgctatgtctactgaggaggctcgtttcctgacctaccatatgtggccactgacctttctctccccatccgagctcgctcgtgctggattctactacattggccccggcgaccgcgtcgcttgctttgcctgcggcggcaaactgtccaactgggaacccaaggacgatgccatgtccgagcatcgtaggcacttccccaattgtccattcctggagaacagtctggagactctgcgctttagcatttctaacctgagcatgcagactcatgctgccaggatgcgtacattcatgtactggccaagttccgtgcccgttcagccagagcagttggcttccgccggtttctattatgttggtcgcaatgacgacgtcaagtgcttttgctgcgacggcggactgcgctgttgggagtccggcgacgacccatgggtcgaacacgcaaagtggttccctcgctgcgagttcctgattcgtatgaaaggccaggagttcgtcgatgaaattcagggcagataccctcacttgctggagcagcttctctccactagtgacaccactggcgaggagaatgccgatccaccaattatccacttcggacccggagagagttcaagcgaggacgctgtaatgatgaacaccccagttgttaaatcagctctggagatgggattcaacagagacttggtcaagcagaccgtccagtccaagattttgactaccggagaaaactataagactgtgaacgatattgtgtccgccctgctgaacgcagaagatgaaaagcgcgaggaggaaaaggagaagcaggcagaggagatggcctccgacgatctgagcctgatacgcaaaaacagaatggccctgttccagcagctcacatgcgtgttgcctatacttgataacctcctgaaggccaatgtgatcaataagcaagagcatgatatcatcaagcagaagacacagatccctctccaggccagggagctcattgataccatcttggtaaagggtaacgctgctgctaatatttttaaaaactgtcttaaggaaatcgacagcacactgtataagaatctgttcgtggacaagaatatgaaatatatccctaccgaggatgtgtccggactctccctggaggaacagcttagacgcttgcaggaggagagaacctgcaaagtttgcatggataaggaagtgtcagtggtgtttatcccttgtggtcacctcgtagtttgccaagaatgtgctccatccttgaggaaatgcccaatttgtagaggtattattaaaggtacagttcgtacctttctgtca

SEQ ID NO: 32265 - DNA, 1854 bp, Artificial Sequence
  Description of Artificial Sequence: Synthetic coding sequence
atgcataagactgcttcccagcggctgttccctggaccttcataccaaaacataaagtcaatcatggaggacagcactattctgtctgattggactaattccaacaaacaaaagatgaaatacgatttcagctgcgagctgtaccggatgtcaacttatagcacctttccggccggagtgccggtgagcgagaggtccctggctagagcgggattctactacactggagtgaatgacaaggtgaaatgtttctgctgcgggctgatgctggacaactggaaattgggggactcgccgattcagaagcataaacagctctaccccagctgctcatttatccagaacctcgtgtcggcgagcctgggaagcacctcgaagaacacttcacctatgcggaattcgttcgcgcattcgctctcgccgactttggaacacagctccctgttctccggtagctactcctcgctgagtccaaaccccctcaactcccgggccgtggaggacatctcatcgtccaggaccaacccgtactcctatgccatgtcgacggaagaggcccggttcctgacctaccacatgtggccgctcaccttcctgtcccctagcgaactggcaagagcaggattttactacatcggaccgggtgatcgggtcgcttgcttcgcgtgcggaggtaagctgtcgaattgggagcctaaggatgacgcgatgtccgagcacaggcgccatttccccaactgcccgttccttgagaactcgctggaaacgctccgcttctcaatctcaaatctctcaatgcagacccatgcagctcggatgagaacctttatgtactggccaagctccgtccctgttcagcccgaacaactggcttctgcaggcttctattatgtgggacggaacgacgatgtgaaatgcttctgctgcgacggaggactgcggtgctgggagtccggtgacgacccgtgggtcgaacatgcgaagtggtttccgcggtgcgaatttcttatcagaatgaaaggacaggagttcgtggatgagatccaaggtcggtacccgcaccttctcgagcaactcctgtcaacctcggacactaccggcgaagaaaatgccgatccacccattattcattttggccccggcgagagtagctctgaagatgccgtgatgatgaatactccagtggtgaagtccgccctcgaaatgggattcaaccgcgacctggttaaacaaaccgtgcagtcaaaaatcttgaccaccggagagaattacaagaccgtgaatgatattgtgtcagctttgctgaacgccgaagatgagaagcgggaagaagaaaaagagaagcaagcagaagagatggcatcggacgacctttccctgatccggaagaatagaatggccttgtttcagcagcttacttgcgtactgcccattctcgacaaccttttgaaggcgaacgtgatcaataaacaggagcacgatatcatcaagcaaaagacccaaattccgctgcaggctcgcgagctcatcgataccatcctggtgaaaggcaacgccgcggcgaacatcttcaagaactgtctcaaggaaattgattcgactctgtacaaaaacctgttcgtggacaagaatatgaagtacatcccgaccgaagatgtgtcgggactttcactggaagaacagcttaggcgccttcaggaggaacggacctgcaaggtgtgtatggacaaggaggtcagcgtcgtctttataccgtgcggacatctcgtggtctgccaggaatgtgcgccttcgcttcgcaagtgtccgatctgccgcggaatcattaaagggactgtgcgaactttcctctct

SEQ ID NO: 32266 - DNA, 1854 bp, Artificial Sequence
  Description of Artificial Sequence: Synthetic coding sequence
atgcataagactgctagccaacgccttttcccaggtccctcctaccaaaatattaaaagcatcatggaagacagcaccatcctgtccgattggactaactcaaataagcagaagatgaaatatgacttctcctgcgaactttatcgcatgtccacgtactctacattcccggccggtgtccctgttagtgaacgcagtttggccagagcaggtttttactacaccggagtgaacgataaggtgaagtgcttctgctgtggactgatgttggacaattggaagcttggagactccccaattcagaaacacaagcagctctacccgagctgctcatttatacagaatctggtgtcagcttccctcggatcaactagtaaaaacacatccccaatgaggaatagtttcgcccactcccttagccctacgctcgaacactcttccttgttcagtggctcttacagttccctttcccccaaccccctgaacagtagagctgtggaggacatctccagcagtagaaccaacccttactcttacgctatgtctacggaggaggctaggtttctcacataccatatgtggccactcacttttctgagtccatctgaacttgctagggccggattctattacattggcccgggcgaccgcgtggcatgttttgcgtgcggtggcaaactgtccaattgggaaccaaaggacgatgctatgtcagagcaccgcagacacttcccaaattgccccttccttgagaacagcctggagaccctgaggttctcaataagtaacctgtccatgcagacccacgctgcaaggatgcgcaccttcatgtattggccatcctctgttcccgtacagcccgagcagctggcctccgctggattctactacgttggcagaaatgacgacgtgaagtgcttctgttgtgacggtggactcaggtgctgggaatccggtgatgacccatgggttgagcacgccaagtggttcccgagatgcgagttcttgatcaggatgaagggacaagagttcgtggatgaaattcagggccgctacccgcacctgctggaacagctgctgtccacctctgacaccactggcgaagagaacgccgatccacccatcattcactttggccctggtgagagctccagtgaagatgccgtcatgatgaacactcccgttgtgaaatctgctctcgagatgggcttcaatcgcgatctggtgaagcagaccgttcagagcaaaatcctgaccaccggagagaactacaaaaccgtgaatgatatcgtgtcagcacttctgaacgccgaggatgagaagagagaagaagaaaaagagaagcaggccgaggagatggcgtccgacgacctgagcctgatcaggaaaaataggatggcactttttcagcagttgacctgtgttttgccgattttggacaatctcctcaaggccaatgttattaacaagcaagagcatgacatcatcaaacagaagacccagattcccctccaagccagggaactcatagatactatcctggtaaagggtaatgcggccgctaatatattcaagaattgcttgaaggagatagattctaccctctacaagaatctctttgttgacaagaatatgaaatatatccccactgaagacgtatccggactttccctggaggaacagcttcgcaggcttcaggaagaacgcacctgtaaagtgtgcatggacaaagaagtgtcagtggtcttcataccttgcggtcacctggttgtctgtcaagagtgcgccccgtcactcagaaagtgccccatttgtagaggcattattaagggtaccgtacgcaccttcctgagc

SEQ ID NO: 32267 - DNA, 1812 bp, Artificial Sequence
  Description of Artificial Sequence: Synthetic coding sequence
atgaatattgtggaaaactcaatcttcctttcaaacctgatgaaatctgccaacacgttcgagctcaagtacgacctgtcctgtgaactttaccggatgtcgacgtattcgacgtttccagcgggagtgccagtgtcggagcggtccctggcaagagccggcttttactatactggagtgaatgataaggtcaagtgcttctgctgtggtctgatgcttgacaattggaagcggggagactcgccaaccgaaaagcacaagaaactgtacccatcatgtcgttttgtccaatccctcaactccgttaacaatctcgaagccacctcccaacctaccttccctagcagcgtgacgaacagcactcattcacttctgcccgggacggaaaacagcggatactttagaggatcatattccaattctccttccaaccctgtcaactcaagggccaaccaggacttttccgcactgatgagatcgtcgtaccattgtgccatgaacaatgaaaacgcacgtctgcttacttttcaaacgtggcccctgacctttctttcgcctactgaccttgctaaggcaggtttttactacattggacccggtgatcgcgtcgcgtgtttcgcatgtggtggaaaattgtcgaactgggagcctaaggataatgcgatgtcggaacatttgaggcacttcccgaagtgtccctttatcgagaaccaactgcaagacaccagcagatacactgtctcgaatctttccatgcaaacccacgccgcacgcttcaaaacttttttcaactggcccagttcagtgcttgtgaatccagaacagctcgcgtcggccggtttctactatgtgggtaattccgacgatgttaagtgtttttgttgcgatggaggtttgagatgctgggaatctggcgacgatccatgggtgcagcacgcaaagtggtttccgcggtgtgaatacctgatacgcatcaaggggcaagaattcattagacaagtccaggcatcatacccacacttgctcgagcagcttctttcgacctctgactcaccaggcgacgagaatgctgaatctagcattatacattttgaacctggagaagatcattccgaggatgccattatgatgaacactccagtcattaacgcagcagttgaaatgggattcagtagatctcttgtcaaacaaaccgtgcagcggaagatactggcaaccggggaaaactacaggttggtgaatgatctggtgctcgatctcctgaatgcggaagatgaaattcgcgaagaagagcgtgaacgcgcaactgaggagaaggagtccaacgacctgctcctcattagaaaaaaccgaatggctctgtttcaacatctcacctgtgtgatacccattttggactcactgctgactgcaggcattatcaacgaacaagagcacgatgtgattaagcagaaaactcagacttcgctgcaggcaagggaactgatagataccatcctcgtgaaaggaaacatcgcagccactgtgtttaggaactccctgcaggaggccgaggcagtcttgtacgaacatctttttgtgcaacaggatatcaagtacattccaactgaagatgtctcggaccttccagtggaggaacagctcagacgtttgcaagaagaacggacctgcaaagtgtgcatggacaaagaggtgtctatcgtgtttataccatgtgggcacctcgtggtttgcaaagattgtgcaccgagcttgaggaagtgcccaatttgtcggtcgaccataaagggaaccgtgagaacttttctgagc

SEQ ID NO: 32268 - DNA, 1812 bp, Artificial Sequence
  Description of Artificial Sequence: Synthetic coding sequence
atgaatattgtggaaaattctattttcctatctaaccttatgaaaagcgctaatacttttgaattgaagtacgatctctcttgtgaactctatagaatgtcaacgtattctactttcccagcaggagttccggtgagtgaacgcagtttggcccgtgctggtttctattacactggagtaaatgataaagttaaatgtttctgctgcggactcatgcttgataattggaagaggggagattcaccgaccgaaaagcacaaaaaactgtatccttcctgtcggttcgtacagtccttgaatagcgttaacaatcttgaagctacttctcaaccaacgtttcctagctcagttactaattcaacgcattcgcttttgccggggacagagaatagcggatactttagaggatcttattcaaactctccatccaatccggtaaattcgcgagcaaatcaagatttttctgcattgatgcgctcatcgtatcattgtgcgatgaataacgagaatgcccggttattgactttccaaacttggccgttgacgttccttagtcctacagatttggctaaagctggattttactatatcggtccgggagatagagttgcatgtttcgcatgtggtggaaaactttctaattgggaaccaaaagataatgcgatgagtgagcacctaagacattttcctaagtgccctttcatagagaatcagttgcaagatacgagtagatacactgtttcaaacctatcgatgcaaacacatgccgcccgattcaaaacgttttttaattggccatcttcagttcttgtcaatccagaacagctcgcctcggcaggattctattatgtgggtaatagtgacgatgtaaagtgtttttgttgtgatggtggactccgctgttgggaatcgggagatgatccttgggttcagcatgctaagtggttcccgaggtgtgaatatcttatccggatcaaaggacaggaattcattagacaggtccaagcctcgtatcctcatctgttagagcaattgctgtctactagcgattctccgggagatgagaatgcggagtcatcgattattcactttgagccaggggaagaccactccgaagacgcgattatgatgaatacccctgttatcaatgcagcagttgaaatgggttttagtcgatcgctagtcaagcaaaccgtacaacgcaaaatcttagcaacaggagaaaattatcgcttagttaatgatctggtcctcgatcttctaaatgcagaagatgaaattcgagaagaggagcgtgagagggcgactgaggaaaaggaatcaaatgatttgctattaatacgaaaaaatagaatggcactttttcaacatttaacctgcgtaatcccaattcttgacagtctcctaacagctggaatcattaacgaacaggaacatgatgtcatcaaacaaaaaacccagacttccttgcaggcgcgcgaattgattgataccattctagttaaaggcaatattgcagcaacagtgtttcgtaactcactccaggaagctgaagccgttttgtatgagcatcttttcgtacaacaggatattaagtacataccgaccgaagatgtgagcgatctgcctgttgaagaacagcttagaagactccaagaagaacgtacttgcaaagtttgtatggataaggaggtttcgattgtctttattccttgtggacatttggtcgtttgcaaagattgtgccccatcacttagaaaatgcccaatttgtagaagtacaataaaaggcacagtgcgcacatttttatcc

SEQ ID NO: 32269 - DNA, 1812 bp, Artificial Sequence
  Description of Artificial Sequence: Synthetic coding sequence
atgaacatcgtggagaacagcatctttctctcgaacctgatgaagtccgcaaatacctttgaactgaagtacgacctgtcctgcgagttgtaccggatgtcaacttattccaccttccccgcaggtgtgccggtgtctgaacgctcactcgcgcgcgcaggattctactacacgggcgtcaatgacaaagtgaaatgtttctgctgcggattgatgctggataattggaagcggggcgacagcccaactgagaagcacaagaaattgtaccccagttgccggtttgtgcagtctctgaatagcgtgaacaatctggaggcgacctcgcagccaaccttcccatccagcgtaactaactctactcattcgctgctgccgggtactgagaactcaggctactttagggggtcctactcgaattccccatcaaacccagtgaactcgcgggcgaatcaagacttctctgctctgatgcggtcctcgtaccattgcgccatgaataacgagaatgcacggctgcttaccttccagacctggcccctgaccttcctctcacccaccgatctcgccaaggccggattttactacattggaccaggcgaccgcgtggcttgcttcgcatgtggcgggaagctgtccaactgggagcctaaggacaatgccatgtccgagcacctgcggcacttcccaaagtgcccgtttatcgaaaaccaactccaagacaccagccggtacaccgtgagcaacctctccatgcagactcacgcagcgcgcttcaagacgttcttcaactggcctagctccgtcctggtcaaccctgaacagctcgcaagcgcaggcttctactatgtgggaaattcagacgatgttaagtgtttttgttgcgacgggggcctgcgctgctgggaatccggggatgacccgtgggtgcagcatgccaagtggttccctcgctgcgaatacctcatccggatcaaaggtcaggaattcatcagacaagtgcaagcatcttacccgcatctgctggaacagctcctgtcaacctcagactcgccgggggatgaaaatgcagaaagctccattatccacttcgagccgggggaggaccacagcgaggacgccatcatgatgaacacgccagtgatcaatgctgccgtggaaatgggattctcgcggtccctcgtcaaacaaaccgtgcagcgcaaaatcctggcaaccggggaaaactaccgactggtgaatgatctcgtcctggatctgctcaacgcagaagatgagatacgcgaggaggaaagagagagagccactgaggaaaaagaatccaacgaccttctcttgattagaaagaaccggatggccctgtttcaacacctgacgtgcgtgatcccgattcttgactcactcctgaccgcgggaattatcaacgagcaggagcatgacgtgatcaagcaaaagactcaaaccagcctgcaagccagggaactcatcgatactatcctcgtgaaaggtaacatcgcggctaccgttttcagaaattccttgcaagaggcagaagccgtgctgtacgaacatctctttgtgcagcaagacatcaaatacatcccgactgaagatgtctcagacctgccagtcgaggagcagctgcgccggttgcaagaagaacgcacttgcaaggtctgcatggataaagaagtgagcatcgtgttcatcccatgcggacacctggtcgtgtgtaaggactgtgcaccgtcgctgcggaagtgccctatttgtagatccactatcaaaggcaccgtccgaacgtttcttagc

SEQ ID NO: 32270 - DNA, 1812 bp, Artificial Sequence
  Description of Artificial Sequence: Synthetic coding sequence
atgaatatcgtagaaaactcgatttttttgagcaaccttatgaagtctgcaaacacgttcgaactcaagtacgatttgtcatgcgaactgtatcggatgagcacctatagcacttttccagccggagtgcccgtgagcgagcgaagtcttgccagagccggcttttattacaccggcgttaatgataaagttaagtgtttctgttgcggactgatgcttgacaattggaagagaggtgacagcccgacagagaagcacaaaaaactgtacccttcctgtagattcgtgcagagtctcaacagcgtgaataacctcgaagctacatcacagccgacattcccatcaagtgttaccaatagtacccattcattactgcccggcactgaaaattctggatactttcggggaagttactccaactcgccaagcaacccagtgaatagcagagccaaccaggattttagtgcactgatgcgctcctcttatcactgcgcgatgaataatgaaaacgcacgtctactgacatttcagacatggcctttgacctttttgtccccaactgatttggccaaggccggattttattatatcggaccgggagacagagtcgcttgtttcgcctgtggggggaagctctctaattgggaaccaaaggataatgctatgagtgagcacctgagacattttccgaagtgtccattcattgaaaaccagcttcaggatactagcaggtacaccgtgtccaatctttccatgcagacacatgctgcaagatttaaaacgttcttcaattggcctagctctgtgctggtgaatcccgaacagctggcctctgctgggttctattatgttggcaattcagacgacgtaaagtgcttctgttgcgacggcgggctgcgctgttgggagtccggcgatgatccctgggtgcagcacgcgaagtggttcccccgttgtgagtaccttataaggattaaaggccaggaattcattagacaggtgcaagcatcatacccccatcttcttgagcagctgctgtctacaagtgacagtccaggtgatgagaacgctgagtcttcgatcatccacttcgagcctggcgaggaccactccgaagatgcaattatgatgaacacccccgtgattaatgccgcagtggagatggggtttagcaggtcactggtgaagcaaacagttcagcgtaaaatattagcaactggagaaaactatcgactcgttaacgaccttgttcttgacctgcttaatgctgaggatgaaattcgggaggaagagagggaaagagcgacagaggagaaggaaagcaacgacttacttctgatccgaaagaacagaatggcactctttcagcatttgacctgtgtgattcccattttagacagcctgctgacggcaggcattatcaacgagcaggaacacgatgttattaagcagaagactcaaacgtctttacaagcacgtgagctgattgatacgatattggtgaaaggcaacatcgcggccaccgtgttcagaaattctctgcaggaggctgaggccgtgctctatgagcacttgtttgtgcaacaggacattaagtacatccctaccgaagacgtaagtgacctgcctgtggaggaacaactgcgacggctgcaagaggagcgtacttgtaaagtctgtatggataaagaagtgagtatcgtctttataccttgcggccatctcgttgtctgtaaggactgtgctccaagtttgcggaaatgtcctatatgtcggtctaccatcaaggggacagtgcgcaccttcctctca

SEQ ID NO: 32271 - DNA, 1812 bp, Artificial Sequence
  Description of Artificial Sequence: Synthetic coding sequence
atgaatatagttgagaactctatttttttatccaacctgatgaagtccgctaacacctttgaactcaaatatgacctctcttgtgagctttatcgtatgagtacctattctactttcccggccggagttcccgtgtccgaaaggagtttggctcgagcgggcttctactatactggggtgaacgataaggtaaagtgtttctgctgtggcttgatgctcgacaactggaaaaggggggacagcccaacggagaaacacaaaaagttataccctagttgtaggtttgttcaaagtttaaactctgtaaataacctggaagcgacctcacagccaacctttccaagctccgtcaccaacagcactcactcgttgctgccagggacagaaaacagtggttacttccgcggctcatactccaactcaccttccaacccagtgaactctagagccaatcaagatttcagcgccctcatgcggtctagttaccattgtgcaatgaacaatgagaatgcccgcctgctcacctttcagacctggcctctgactttcctgtctccaactgacttggcaaaggctggcttttactatattggtcctggggaccgcgtggcttgcttcgcttgtgggggaaaactgtcgaattgggaaccaaaggacaacgcaatgagcgaacacctgcgacatttccctaagtgtcccttcattgagaaccagttgcaagacacttcacgctatacagtctccaacctgagcatgcagacgcacgctgcacgctttaagactttctttaactggccgtccagtgtgctggtaaaccctgagcaactggcctctgcgggcttttactatgttgggaacagcgatgatgtgaaatgtttctgctgcgatggagggttgcgttgctgggaatcaggcgacgacccctgggtgcagcacgcgaagtggtttccccgatgtgagtacctcatcaggatcaaaggccaggaattcatccgccaggtgcaggcctcttacccgcacctcttagagcagcttctgtctacctccgattcacctggcgacgagaacgcggagagctctattattcacttcgagccaggagaagatcatagcgaggatgccatcatgatgaacaccccagtcattaacgccgccgtcgaaatgggctttagccgctcactggtaaaacagaccgtgcagaggaagattctagccaccggcgaaaactatcgactcgtgaatgaccttgtgctagatctgctgaacgcagaagacgagattcgagaggaggagagggagcgcgccactgaggaaaaagagtctaacgacttactgctaattcgaaagaacaggatggcactcttccaacacctgacctgtgtaatccccattctggattctcttctaactgctgggattataaatgagcaagagcacgacgtgatcaaacagaagactcagaccagtcttcaagcccgcgagctgatagacacaattcttgtgaagggaaacatcgctgcaacagtcttccgtaactcccttcaggaagccgaagctgtgctgtatgagcatctgttcgtacagcaagacataaaatatattccaaccgaggacgtgagcgatctgcccgtcgaagagcaactccgtaggctgcaggaggaaaggacatgtaaggtgtgcatggacaaggaagtgtcgattgtgttcatcccttgtgggcatctggtggtttgtaaggattgtgcgcctagtcttcggaaatgccctatctgtcgatccactattaagggtactgtgcggacattccttagc

SEQ ID NO: 32272 - DNA, 1812 bp, Artificial Sequence
  Description of Artificial Sequence: Synthetic coding sequence
atgaatatcgtggagaattctatctttttgagtaacctgatgaagagtgcgaacactttcgagcttaagtatgacttgagctgcgaactatatagaatgtccacctattcaacttttcctgcaggcgtacctgtgtcagagaggtctctcgcaagagcgggattttattacaccggtgtgaacgacaaagttaagtgtttctgttgtggcctgatgctggataactggaaacgtggtgatagtcctaccgaaaagcataaaaaactgtacccctcctgtcgcttcgtgcagagcctcaatagcgtcaacaacctggaagccacgtctcagcctactttcccctcttcagtaacgaactccacgcattccctattacccggaacggaaaacagcggctactttaggggcagttattctaattcgccgagtaatcctgtgaactctcgggccaatcaggattttagcgccctaatgcggagctcctaccactgcgcaatgaacaatgaaaacgcacgactgctgacctttcagacatggcctctgacatttctgtcccctacagatctggccaaggctggtttctactacatcggcccaggcgatcgggtggcatgcttcgcttgtgggggcaaactgtctaactgggagccgaaggataacgccatgtcagaacatttacggcacttcccaaaatgcccttttatcgagaatcaactgcaggacaccagtcgctacacagtgtccaatcttagtatgcagactcatgccgcacggtttaagacgttttttaactggccatcttccgtcctggtgaaccccgaacagttagctagtgcaggtttctactacgttggcaatagcgacgatgtaaaatgcttttgctgtgacggcgggttacgttgctgggaatctggagatgacccctgggttcagcatgctaagtggtttccgcggtgtgagtatctgattcggatcaaggggcaggaattcataagacaagtgcaggcttcttatccccatctgttagaacagctgctctcaacttctgacagtcctggagatgagaatgcagagagttccatcatccacttcgaacccggggaagaccacagtgaggatgctataatgatgaataccccggtcatcaacgctgccgtcgagatgggattctcaaggagtctggtgaagcagacagttcagagaaagattttggcaaccggcgaaaattacagactcgtaaacgatctagttctggacctcttgaacgccgaggacgagatcagggaggaagagcgggagcgtgccaccgaggaaaaggaatctaacgatcttctgctcatccgtaaaaatcggatggctctgtttcagcaccttacctgtgttattcctattctggactccttgctaaccgcagggatcattaatgaacaggagcacgatgttatcaagcagaaaacacaaactagtctgcaggctcgggagttaattgacaccatcctggtgaagggaaacatcgctgccactgtcttccgaaacagcctgcaggaagccgaggcggtgctgtatgagcatctcttcgtgcagcaggatattaagtatattccgacggaagatgtatctgacctgccagtagaggaacaactcaggcggctgcaggaggagaggacctgcaaggtatgtatggacaaagaagtgtctattgtctttataccttgcgggcatctcgtggtgtgcaaagattgtgccccctcattgcggaaatgtccgatttgccggtcaactatcaagggcactgtgagaacgttcctctct

SEQ ID NO: 32273 - DNA, 1812 bp, Artificial Sequence
  Description of Artificial Sequence: Synthetic coding sequence
atgaacatcgtggaaaattcgatttttctttccaacctgatgaagagcgcaaatacctttgagcttaagtacgatctctcgtgtgagctctataggatgagcacttacagcacctttcctgcaggagtcccagtgtcggaacggtcgttggcacgggcagggttctactacaccggtgtgaatgataaggttaagtgtttctgctgcggactgatgcttgataattggaaacgtggagactcgcccacggaaaaacacaagaagctgtacccttcgtgccgcttcgtgcagtcgctcaattcggtcaacaatcttgaagcaacgtctcaacctaccttcccttcgtcggtgactaattcaactcatagccttcttccagggactgaaaactctggatacttccggggatcttattcaaacagcccatcaaacccggttaatagccgagcaaaccaagatttttctgctttgatgagatccagctaccactgcgcgatgaacaatgagaacgctcgactgctgacctttcagacttggccgttgacgtttctgtcgccgactgacctcgcaaaggcaggtttctactacattggccctggagatcgggtggcctgttttgcgtgtggaggtaaactttcgaattgggagccaaaagataacgcaatgtccgagcaccttagacattttcccaagtgtccattcattgaaaatcaactgcaggatacctccagatacactgtgtctaacctgagcatgcaaactcatgcagcccgctttaagaccttctttaactggcctagctcagtgctggttaaccctgaacagcttgcatcggctggattttactacgtggggaatagcgatgacgtcaagtgtttttgctgtgatgggggtcttagatgttgggagtcaggtgatgatccttgggtgcaacatgcgaaatggttcccccgctgtgaatacctgatccgtatcaagggtcaggagttcatcaggcaagtccaagcatcctacccccatctgctggaacaactgctgagcacctccgattcacctggcgacgaaaacgccgagagcagcattattcattttgaaccaggggaagatcattccgaagatgccatcatgatgaataccccagtgattaacgcagcggtggaaatgggtttctcccgcagcctggtgaaacagaccgtgcagagaaagattcttgcgaccggagagaattatcgccttgtgaacgacttggtcctggatcttctgaacgcggaagatgagattcgcgaagaagaaagggagagagcaacggaagagaaggaaagcaacgatctgctccttatcaggaagaatcgaatggcgttgtttcagcaccttacctgcgtgatccccatcctggattccctccttaccgccgggataatcaacgaacaggaacacgatgtgataaagcagaaaacccagaccagcctccaagcgagagagctgatcgataccatcctcgtgaaagggaatatagcagctacggtgttccggaactcactgcaggaagcagaggcagtcctttacgaacacctgtttgtgcaacaagatatcaagtacattcccaccgaggatgtctccgatcttccagtggaagaacagcttagacgcctgcaggaagagagaacttgtaaggtttgcatggataaggaggtgtcaattgtgttcatcccctgtggacatctggtggtgtgtaaggactgtgcaccttcactgagaaagtgccctatttgtcgatcaacgattaaggggaccgtgcgcacctttctttca

SEQ ID NO: 32274 - DNA, 1812 bp, Artificial Sequence
  Description of Artificial Sequence: Synthetic coding sequence
atgaatatcgtcgaaaactctatctttctgagcaacctgatgaagagtgcaaatacctttgagcttaagtacgatttgagctgcgagctgtaccgcatgtccacctacagcactttcccagcgggagtgccggtgagcgaacgctcgctggcccgggcgggtttctattacaccggggtcaacgataaggttaagtgcttttgctgcggactgatgctggacaactggaagcgcggagactccccgactgaaaaacacaagaaactgtacccctcgtgtcggttcgtgcagagcttgaactcggtgaataacctggaagctacgtcccagccaacgttcccgtcatccgtgacgaattcgacccacagcttgctgcctggcaccgaaaattccggatacttccggggatcatattccaattcgccctctaatccggtgaatagccgggccaaccaggatttctccgcactcatgcgctcgtcctaccattgcgctatgaacaacgaaaatgcgcgactgctcaccttccagacttggccactgacctttctctcgcccacggatctggccaaggcgggattctactacatcggaccgggggaccgcgtggcctgttttgcgtgtgggggaaagctcagtaactgggaacccaaggacaatgctatgtcggagcaccttcgccatttcccgaagtgcccgtttatcgaaaatcaactgcaggatacctcccgctacaccgtgtccaacctgtccatgcaaacgcacgcggcgagattcaagactttcttcaattggccgagctcggtgctcgtgaacccggaacagctggcatccgcagggttctactacgtgggcaactctgacgacgtgaagtgtttctgttgtgacggtggacttagatgctgggaaagcggcgacgatccgtgggtgcagcatgccaaatggttccctcggtgcgaatacctcatcagaatcaaaggccaggagttcatccgccaagtccaggcgagctacccccacctgctcgaacagctgctctcgacttcggattcccccggggacgagaacgcggaatcgtcaattatccacttcgagccgggagaggatcacagcgaggacgccattatgatgaatacccctgtgattaacgcagcggtggaaatgggattctcaagaagcctggtgaagcagactgtgcagaggaagatcttggccaccggggagaattacagattggtaaacgatctcgtgctggatctgctgaatgccgaggacgaaattcgtgaggaggagagggaacgggcgactgaggaaaaggagtccaacgacctgctgctgattcgcaagaacaggatggctttgttccagcacctgacttgcgtcatcccaatcctcgattccctcctgaccgctggaatcatcaatgaacaagaacatgacgtgatcaaacagaaaactcagacttccctgcaagctcgagaactgatcgatacgatcctcgtgaagggaaacatcgcagccaccgtctttcgaaactcactccaggaagccgaagccgtgctgtacgaacatctgttcgtccagcaagacatcaagtacattcctactgaggacgtctccgatctgcccgtggaggaacagttgcgcagactccaagaagaacgcacctgtaaggtgtgtatggacaaggaggtttctatcgtgttcattccctgcggccacttggtcgtgtgcaaggattgtgctccgtccttgagaaagtgcccaatctgccgctcgactatcaagggaactgtgcgaacttttctctcg

SEQ ID NO: 32275 - DNA, 1812 bp, Artificial Sequence
  Description of Artificial Sequence: Synthetic coding sequence
atgaatatcgtggagaactcaatcttcttgtccaatctgatgaagtccgcaaacactttcgaactgaaatatgatttgtcctgcgaactgtaccgtatgagcacatatagcactttccctgcaggcgtacctgtgtctgaaaggtcccttgctcgtgctggtttttactacacaggagttaacgacaaggtcaagtgcttctgctgtggtttgatgttggataactggaagcgtggcgactcccccactgagaagcacaaaaagctgtacccctcctgtagattcgtccagtccctgaattctgtcaacaatctggaggccacctcccagccaacttttccttcctctgtcactaactccacccacagtttgctgcccggcactgagaatagtggctacttccgcggctcctactcaaactcaccatccaatccagttaatagtagagctaaccaagatttttcagcccttatgagaagcagctaccactgcgctatgaacaacgaaaatgctagactgctgacctttcaaacatggcctctgaccttcttgagcccaactgacctggcaaaagcaggtttctactatatcggccccggagatcgtgtcgcctgttttgcttgcggtggcaaactctccaactgggagcccaaggacaacgctatgtctgagcatcttcgccattttcccaagtgcccattcattgagaaccagttgcaagacacttctcgctacacagtgtctaatctgtctatgcaaactcatgccgcccgcttcaaaacctttttcaattggcccagtagtgtcttggtcaaccccgagcagttggcctccgccggcttctactacgtaggtaatagtgatgacgttaagtgcttctgctgcgatggcggccttcgctgctgggaatccggcgatgacccttgggtgcagcacgccaagtggttccccagatgtgaatatcttatacgcatcaagggtcaggagtttataaggcaggtacaggcatcttacccacacctgctggaacagttgctctccactagtgattcaccaggtgacgaaaatgccgagtctagtatcattcacttcgaaccaggagaggaccacagcgaagacgctatcatgatgaatacccccgttattaacgccgcagtggagatgggattttctcgcagtcttgttaagcagactgtgcagcgtaagatcctggccactggtgagaactacagactcgtcaacgatctggtgctggaccttctcaacgccgaagacgaaattagagaagaggagagggagcgcgcaacagaggagaaggaatctaatgatctgttgctgatcagaaagaaccgcatggcattgttccagcatttgacatgcgtgattccaatcttggactcactgctgaccgcaggcattatcaacgaacaggagcacgatgtgatcaagcagaagactcagacatctctgcaggcaagggagctgatagacacaattctggtgaaaggtaatattgctgccacagtgtttagaaacagtttgcaggaggctgaggctgttctgtatgagcatcttttcgtgcagcaggatattaaatatatccctaccgaagacgtctcagatctgcctgtggaagagcagctgcgtaggctgcaggaggagcgtacctgtaaagtgtgtatggacaaggaagtgtccatagtcttcattccctgcggacacctggtcgtgtgtaaggactgtgctccctctctgcgtaaatgtcccatatgtagatccaccatcaaaggcaccgtgcgcacttttctttcc

SEQ ID NO: 32276 - DNA, 1812 bp, Artificial Sequence
  Description of Artificial Sequence: Synthetic coding sequence
atgaatattgtggagaacagcatttttctttcaaacttgatgaaatcagccaatacttttgaacttaagtacgatctgagttgtgaactgtatcgaatgtcgacttactcgactttcccggccggagtgcctgtgtcggagagatccttggcaagggcgggtttttactacaccggagtgaatgacaaagtcaagtgcttctgttgtggcctcatgttggacaactggaagaggggagactcgcccactgaaaaacacaaaaagctgtacccaagctgtaggtttgtgcaatccctgaatagcgtcaacaacctggaagcgacctcccagcctacctttccttcctcagtgaccaattcaacccatagcctgcttcctggcaccgaaaattcgggatactttcgaggatcgtactccaactcgccttcgaaccctgtcaattccagggcaaaccaagatttttccgcactcatgaggagctcataccattgtgccatgaacaatgaaaacgcaaggttgttgaccttccagacttggccacttacttttctttcccccactgatctcgcaaaagcgggattctactacataggtcccggagacagagtcgcatgtttcgcatgtggtgggaagctgtcgaactgggaacctaaggataacgcaatgtcagagcatcttcggcattttccgaaatgtccattcattgagaaccagcttcaggacacgtcaagatacactgtctcgaatctgtccatgcaaacgcacgcagcgcgcttcaagactttcttcaattggccgagctcggtgctcgtcaacccagagcagcttgcgtcagcaggattctattatgtgggcaacagcgacgacgtgaagtgcttttgctgtgacggaggtctgaggtgttgggagtcaggtgatgacccctgggtgcaacatgcaaaatggtttccaaggtgtgaatacctcattaggattaagggacaagagtttatcaggcaggtccaggcttcctacccgcaccttcttgaacaactcctttcaacctccgactcccctggtgatgaaaatgctgaatcatccattatacatttcgagccaggcgaagatcattcggaagatgcaatcatgatgaacactcctgtgattaatgcagctgtggagatggggttttcgcgctcactcgtgaagcagacggtccaacgcaagatattggcaaccggagaaaactaccggcttgtgaacgaccttgtgctcgatctgttgaacgccgaagatgaaattagagaagaggaacgtgaaagagcaaccgaggagaaagagtccaacgatctccttcttatcagaaagaataggatggccctgttccaacacctgacttgtgtgatcccaattctggattccctcctcacggccggtatcattaacgagcaagaacacgacgtcatcaagcaaaagacgcaaactagccttcaggcccgggaactgatcgataccatacttgtgaagggtaacatcgccgccaccgtctttagaaactcgctgcaggaagcagaagccgtgctgtacgagcacctcttcgtgcaacaagacattaagtatattcctactgaggacgtgtcggatctgccagtggaagagcagctcagaagattgcaagaggaacgtacttgtaaagtgtgcatggacaaagaagtctctattgtctttatcccgtgcgggcatctggtcgtgtgcaaggactgtgcgcctagccttagaaagtgtccaatctgtagatccactattaaggggaccgttcgcacgtttctgtcc

SEQ ID NO: 32277 - DNA, 1812 bp, Artificial Sequence
  Description of Artificial Sequence: Synthetic coding sequence
atgaatatagtcgagaattctatcttcctctcgaacctcatgaagtctgccaatactttcgaactgaagtacgacttaagctgtgagctgtatcgtatgtcaacatactcaactttcccggccggcgtccccgtctctgaaaggagcctcgcccgtgctggcttctactataccggcgtaaacgataaagttaagtgcttttgctgtggcctcatgctcgataattggaagcgcggcgattccccaaccgaaaaacacaagaagctgtatccctcatgtcggtttgtgcagtcactgaacagcgtgaacaatttggaggcaacttcacaaccaaccttccctagcagcgtgaccaactctacccattccttgctacccgggacagaaaactctgggtactttcgggggagttactctaactcgccgagtaaccccgtcaactcccgtgccaatcaggacttctccgccctcatgcggtcatcctatcattgtgcgatgaacaacgagaacgctcggctgctgacctttcagacgtggcctctaaccttcctgtcacccactgatctcgcgaaggcaggtttctattatatcggcccgggcgaccgcgtggcttgctttgcctgcgggggcaaactttccaactgggaacctaaggacaacgcgatgtccgagcacctgcggcatttccccaaatgtcccttcatcgagaaccagctccaggacacatcccgctacaccgtctcgaatttgagtatgcagacccatgccgccaggttcaaaacattttttaactggccgagttctgtactggttaatcctgaacagctcgcaagtgccgggttctactacgttgggaattccgacgacgtaaagtgcttctgctgcgacggaggacttcggtgctgggagtcgggagatgatccctgggtccagcatgcaaagtggtttccaagatgcgagtatcttattagaattaaaggacaggagttcattcgccaggtgcaggctagttaccctcatctgctagagcagctgttgtccacaagtgatagtcccggcgatgaaaacgcagagtcctctataatccatttcgagccaggtgaagaccactcagaggacgccattatgatgaacactcctgttatcaacgctgcagttgagatgggcttctctcgttccctggttaagcagacagtccagcgcaagattctggcaactggcgaaaactatcggctggttaacgaccttgtgctcgacctgcttaacgcggaggacgaaattcgcgaggaagaaagggagagagccacagaagaaaaggagtcaaatgacctcctgctgatccgcaaaaatagaatggcactgttccagcacctaacatgtgtgataccgattctagactccctgctcaccgcgggaattataaatgagcaagaacatgacgtcattaagcagaagacccagacgagcctgcaggcacgcgagcttatagatacaatcctggtgaaggggaatattgctgcgaccgtgtttcggaattctcttcaggaggccgaggctgtactttatgaacatctgtttgtgcagcaggatataaagtacattcccacggaggatgtgtcagatctgcctgttgaagagcagctgaggaggctgcaggaggagcgaacatgcaaggtctgtatggacaaggaggtgagcatcgtatttattccctgtggtcacctcgtggtctgtaaagattgcgccccgagcctgcggaagtgtcccatttgccgctctacaatcaagggtacagtcagaacatttctgagc

SEQ ID NO: 32278 - DNA, 1812 bp, Artificial Sequence
  Description of Artificial Sequence: Synthetic coding sequence
atgaatattgtcgagaattccattttcctttcaaatcttatgaaatccgccaacacctttgagctcaagtacgacctcagctgcgagctctatcgcatgtccacgtacagcaccttccccgctggcgtccctgtatccgagcgttcgctggcccgagccggtttctactacacgggcgttaatgataaggtcaaatgtttttgttgcggtctaatgctggacaactggaagcgcggcgattctcccaccgagaaacataagaagttgtaccctagttgtcgcttcgtgcaaagcctgaactccgtaaataatctcgaggctaccagccaaccaacattcccttcgagcgttacgaactctacccactcccttctgcccggcacagagaatagtggatactttcgtggcagctacagcaactctccctccaaccccgttaactctcgcgcgaaccaggactttagcgctctgatgcgcagttcctaccactgcgccatgaacaatgagaacgcccgcttgctaacattccaaacctggcccctcaccttcctgtctcccaccgacttggcgaaggccggcttctattacatcggtccgggtgaccgcgttgcttgcttcgcctgcggtggtaagctatccaactgggaacccaaagataatgctatgtccgaacacctgcgtcacttccccaagtgccccttcatcgagaaccagctgcaagatacgagccgctacactgtctccaacctttccatgcagactcacgctgcccgcttcaaaacgttctttaactggccatcctccgtgctggtgaacccggagcaactagcctccgcaggtttctactacgtaggcaactctgatgacgtgaagtgtttctgctgtgatggcgggctccgctgctgggagtctggtgatgacccttgggttcagcacgcgaagtggttcccgcgctgcgagtatctcatccgtatcaagggacaggagttcatccgccaggtgcaagcgagctaccctcatctgctcgagcagcttctgtcgacttccgacagccctggagacgaaaacgctgagagctccatcattcacttcgagcccggtgaggatcactcggaagatgcgattatgatgaacaccccggtaatcaacgccgcggtcgagatgggtttttcacgcagcctcgtcaagcaaaccgtccagagaaagatccttgccactggagagaactaccgcctggtgaacgatctcgtcctcgatctccttaacgccgaagatgaaatccgcgaggaggagcgagaacgcgctaccgaggagaaggagtcaaatgacctgctgttgattcgtaagaaccgcatggccctgtttcagcacttgacgtgcgtcatccccatcctcgattcgctactgactgctggaatcattaatgagcaggagcacgatgtcattaagcagaagactcagacgagcctccaggcgcgtgagctcattgacaccatccttgtaaagggaaacatagctgccacagtgtttcgcaactcactgcaggaagcagaagctgtcctctatgaacacctgttcgttcagcaggacattaagtacatcccaaccgaggacgtttccgatctccccgtcgaggagcagttgcgccgattgcaggaagaacgtacgtgtaaggtctgcatggataaggaagtttctattgtcttcatcccttgcgggcatctggtggtctgtaaggattgtgccccaagccttcgcaaatgccccatctgccgttccaccatcaaggggaccgtccgtacattccttagt

SEQ ID NO: 32279 - DNA, 1812 bp, Artificial Sequence
  Description of Artificial Sequence: Synthetic coding sequence
atgaacatcgtcgagaattccatcttcctatcgaacttgatgaaaagcgcaaacaccttcgaactgaaatacgacctgtcttgcgagctgtataggatgtctacctatagcacattccccgccggagttccggtatctgagaggtccttggcccgtgcaggcttttattacaccggcgtaaacgataaggtaaaatgcttttgttgtgggttgatgctagacaattggaagcgcggagattcacctaccgagaagcataaaaagctgtatccgtcatgtcgatttgttcagagcctgaactccgtcaacaacctggaggctacctctcagcctacattccctagtagtgttaccaactctacacactccctcctgcccggcacagagaattcagggtatttcagaggctcatacagtaattcgccgtcaaacccggttaactctcgggcaaaccaggatttctcagccttgatgcgctctagctaccattgcgcgatgaataatgagaacgctcgcctactcacattccagacttggcccctgactttcttgagccccaccgacctggccaaggcgggtttctactacatcggccctggagatcgggtagcatgtttcgcatgtggcggcaaactgtccaattgggaacccaaggacaacgcaatgtccgaacatttacggcactttcccaaatgcccatttattgagaatcagcttcaagacacgtctcgctacaccgtatcgaacctatccatgcagacccacgctgcccgtttcaaaactttctttaactggccctcctctgtgcttgttaatccggagcagctcgcctcagcaggattttactatgttggcaactctgatgacgtcaaatgcttctgctgcgatggcggactacggtgctgggagtcaggtgatgacccctgggtacagcacgccaagtggttccccagatgtgaatacctgatccggatcaaaggccaggagtttatacgccaggtgcaggcatcatacccacaccttttggagcagctgctgagcacctcggacagtccaggggacgaaaatgcagaatcctccataatccattttgagccaggagaagaccactcggaggatgcaattatgatgaatacaccagtcattaatgcggccgtcgagatggggttctcacggagcctcgtcaagcaaaccgtacagcggaagatcctagcaaccggcgagaattaccgcctggtgaacgacctggttctggacctcctgaatgccgaagacgagatccgcgaagaggagcgtgagcgcgccactgaagagaaggaaagcaatgacctgctgctgattcggaaaaatcgcatggcactctttcagcacctcacatgcgtgatacccatccttgatagcctgctgaccgctggaatcatcaatgagcaggaacatgacgttattaaacagaagacacagacctccctccaggcccgcgagcttatcgacactatactggtgaaggggaatattgccgctactgtttttcggaattcactacaggaggcggaggctgtcttatacgagcacctgtttgtacaacaggacatcaaatacataccaacagaggatgtgtcggatctgcctgttgaggagcagcttcgcagactgcaggaagaacgcacgtgtaaagtctgcatggataaggaagttagcatcgtctttatcccttgcggacatcttgtagtatgcaaggattgtgccccaagtctgagaaagtgccccatctgcaggtccacaatcaaagggacggttcgaaccttcctgtca

SEQ ID NO: 32280 - DNA, 1812 bp, Artificial Sequence
  Description of Artificial Sequence: Synthetic coding sequence
atgaatatcgtggaaaactcaattttcctctctaacttaatgaagtctgctaacacgtttgaacttaagtacgacctgtcctgcgagttatacagaatgagcacatactctacgtttccagccggagtcccagtgtcagaacggtcactggcacgggccggcttctactataccggtgttaacgataaggtaaaatgtttctgttgtggtctgatgcttgacaactggaaacggggtgactctcccaccgaaaaacacaaaaagctgtatcccagttgcaggttcgtgcagtctctgaattctgtgaataacctggaagcaactagccagccaacattcccgagctcggtgaccaacagcacgcactcattactgcccggcacggagaatagcggttattttcgcgggagctactctaactctccttccaaccccgtgaactcgcgcgccaatcaggatttcagcgccttgatgcgaagctcgtatcattgtgccatgaataatgagaacgccaggctgctgacattccagacatggccactcaccttcttgtcccccaccgatcttgcaaaggccgggttctactatataggccccggcgaccgagtggcttgtttcgcctgtggcggcaaactgtctaactgggaacctaaggacaacgcgatgtccgagcatctaaggcacttcccgaagtgcccttttatcgaaaaccagctgcaggacacatcgaggtacaccgtgagcaacttatcaatgcagacacatgcagcccgattcaagaccttcttcaactggcctagttctgtgttagtcaatcccgagcagttggccagtgcaggattttattacgtgggtaattccgatgatgtaaaatgcttctgttgtgacggtggcctaagatgttgggaatcaggtgacgacccatgggtccagcacgcaaaatggttccccaggtgtgaatacctaattaggattaagggtcaggaattcatccggcaggtgcaggccagctatccacatttgctggaacagctcctgtcgacctccgattctcccggtgatgaaaacgccgagagctctatcatccatttcgagccaggggaggaccactctgaagatgcaatcatgatgaatacgccagtcattaacgccgctgtggagatgggcttcagcaggtcgcttgtaaaacagacagtccaacgcaaaatccttgccaccggcgagaactatcgcctcgtgaatgacctggtgctggacttgcttaatgccgaggatgagatcagagaagaagaacgcgaaagggccactgaagagaaggagtctaatgacttattgctgatccgtaaaaatcgtatggcactctttcagcacctgacctgcgtcatccccatcctggatagcctcctgactgccggcatcattaacgagcaagagcacgacgtcatcaagcagaaaacccaaactagcctgcaggctagggagctcatcgacaccatcttggtgaaagggaatatcgctgccaccgtgttcagaaattccctccaagaagccgaagccgtactttacgaacacctatttgttcaacaagacattaaatatattccaacagaggatgtgagcgacctgccagtagaagaacagctgcgccggttacaggaagagcgcacctgcaaagtgtgcatggataaggaggtctctatagtcttcatcccatgcgggcacctcgtcgtatgtaaagattgtgcgcccagcctccgaaagtgtccgatctgtcggtcaacgataaaggggaccgtccgcaccttcctcagc

SEQ ID NO: 32281 - DNA, 1812 bp, Artificial Sequence
  Description of Artificial Sequence: Synthetic coding sequence
atgaatatcgtggaaaactctatttttttgagcaacttaatgaagagcgcaaacacatttgagcttaagtacgacctgagttgcgaactctacagaatgtctacatacagcactttccccgccggcgttcccgtgagcgagcgatctctggcaagagccggcttttactatacaggggtgaatgataaggtaaaatgtttttgttgtggtttaatgttagacaactggaaaaggggagactcaccaacagagaaacacaagaagctctacccatcttgtagatttgttcagagtctgaacagcgtcaacaatctagaagcaaccagtcaaccaacctttccctctagtgtgaccaattccacccatagtctactacccggcaccgagaattccggttatttccggggcagctatagcaattccccatccaatcccgtgaactcacgcgccaatcaggacttttctgctctgatgcggtcctcctaccattgtgctatgaataacgagaatgccagattattaacttttcagacatggccactgacttttttatcaccaaccgacttagctaaggctggattctattatattggccctggcgaccgcgttgcctgcttcgcttgtggcgggaagctaagcaattgggagcctaaagacaatgccatgtctgaacatctgagacacttccctaagtgcccatttatcgagaatcagctgcaggacacctcccgatataccgtttctaacctgtccatgcagactcatgctgccagattcaaaactttctttaactggccctcaagtgtactcgtgaatcccgagcaattagcttctgccggattttattatgtgggaaactctgacgatgtgaagtgcttctgctgcgacggtggcctccggtgctgggagagcggtgatgatccatgggtgcaacatgcaaagtggtttccacgatgcgaatatctcattcggattaaaggacaggaattcattagacaggtacaggcctcttatcctcacctactggagcagctactcagtacatcagatagcccgggcgatgaaaacgccgagtcctccattatacatttcgagcctggcgaggaccatagcgaagacgctataatgatgaatactccagtcataaatgctgccgtggaaatgggctttagcaggagcctagtgaaacagacagttcagaggaaaatccttgctaccggtgagaactaccgactggtgaatgatctggtcctggacctgctgaatgccgaggacgagatccgagaagaagagagagagcgtgctaccgaggaaaaggagtccaacgacctgctgctcatacggaagaacaggatggccctgtttcagcatcttacctgcgtgattcctatactcgactccctactgacagctggcattattaatgaacaggagcatgatgttataaaacaaaagacacagacctccctgcaggcccgcgaactaattgacaccatactggtcaaaggtaacatagctgccactgtgtttcggaactcactacaggaggctgaagcagtgctgtatgagcacctgtttgtgcaacaggatattaagtacatacctacagaagacgtgtctgatctaccagtcgaggagcaactgcggcgcctccaagaggagcgcacctgtaaggtgtgcatggacaaggaagtatccatcgtattcatcccatgcggccatttagtggtgtgcaaagattgtgctccttctctgagaaagtgtcccatttgtaggtctactatcaaggggactgtgaggacttttctatcc

SEQ ID NO: 32282 - DNA, 1812 bp, Artificial Sequence
  Description of Artificial Sequence: Synthetic coding sequence
atgaacattgtggagaattcaatttttctgagcaacctgatgaagtccgccaatacctttgagctaaaatatgacctgtcctgcgaactatataggatgtctacctacagtacgttcccggcgggggtgcctgtaagcgagagaagcctggctcgcgctggcttctactacacaggtgttaacgacaaggtgaagtgcttctgttgtgggctgatgttggacaactggaagcgaggggattctcccacggaaaagcacaaaaagttgtatcctagttgcaggtttgtacagagcctgaacagtgtgaataatttggaggccacatctcaaccaacattcccttccagtgtcaccaactcaacacacagcttattgcccggcactgaaaatagtggatactttaggggctcatactcaaactcgcccagcaaccccgtcaatagtagagccaaccaagatttttcagcactgatgagatcctcctatcattgcgcaatgaacaatgaaaatgcaagactgctcaccttccagacttggcccttgaccttcctaagtccaaccgaccttgccaaagctgggttttattacatcggaccaggcgatagagttgcctgcttcgcttgtggaggaaaactcagcaattgggagcctaaggacaatgcgatgagtgaacatttgcgacattttcccaagtgcccatttatcgagaatcagctgcaggacaccagtcgatataccgtgagcaatctctccatgcaaacccacgccgccaggttcaagacctttttcaattggcctagcagcgtcctcgtgaacccagagcagcttgcctctgctggattttactacgttggcaactctgacgacgttaagtgcttttgttgtgatgggggccttcggtgctgggagagtggagatgacccttgggtgcaacatgccaaatggtttcccaggtgcgagtatcttatacgtataaagggacaggagtttataaggcaggtccaggcatcatacccccacctgctggagcagctgctgtctacttccgattctcctggcgacgagaacgctgagtcatcaattatccacttcgagcctggagaagatcacagtgaggatgccatcatgatgaacactccggtgataaacgcagccgtggaaatggggttcagtcgcagtctggtgaagcaaaccgtgcagcggaagatcctggcaaccggagagaactatcgcctggtaaacgacctggtactggatctgctaaacgccgaagatgagattcgagaagaagagcgcgaacgcgcgacagaagaaaaagaaagcaacgacctattgctgattcgaaaaaataggatggcactgtttcagcatctaacttgcgtgattcctattttggattcgcttcttaccgcgggcataattaacgaacaggaacacgatgttattaagcagaagacacagacgtctcttcaggcccgggaactcattgacaccattctggtcaaaggcaatattgccgcaactgtgttccgcaattcactacaggaggcagaggctgtgctgtatgagcacctgttcgtgcagcaggatatcaaatacatccctacggaagatgtcagtgatttgccagtcgaggagcaactcaggagactccaggaggagcgcacatgcaaggtctgcatggacaaagaagtgagcattgtgtttatcccttgcggtcatctggttgtgtgcaaagactgtgccccgtcgctccgcaagtgccccatctgccgttcaacaatcaaaggcactgttaggacatttctgtcc

SEQ ID NO: 32283 - DNA, 1812 bp, Artificial Sequence
  Description of Artificial Sequence: Synthetic coding sequence
atgaatatcgttgagaatagcattttcctgtcaaatctgatgaaatccgccaacacctttgagctgaagtatgacctcagttgtgaactgtatcgcatgagtacctatagcacatttccagcaggcgtgcctgtgtcagagaggtcccttgcacgggcggggttttattacacaggggtcaatgacaaagtcaagtgcttttgctgtggactcatgttggacaattggaagcgcggagactcaccaacagagaagcataagaaactttaccccagctgtcgctttgtgcaaagtttaaactcagttaataatctggaggctacctcccagcctaccttcccctcctccgtgacaaactctacccacagtctgctgccaggaaccgaaaacagcggatatttccgtggaagttacagcaatagtcctagcaacccagtgaattcgagagccaaccaagactttagcgcactgatgcgtagcagctaccactgcgccatgaataacgagaacgcacggttactgacctttcagacatggccactcacgtttctctctccaacggacctggcaaaagcaggtttctattatattggacccggggatcgcgtagcgtgcttcgcctgcggtggaaagctgtctaactgggaacccaaggataatgccatgagcgagcaccttcgccatttccctaagtgcccctttatcgagaatcagctccaagacacttccaggtataccgtttccaacttgtctatgcagactcacgcagcaagatttaagacatttttcaactggccctctagcgtgttggtcaacccagaacaactggcatcggcaggattttactacgtgggaaactccgatgacgtcaaatgtttctgctgtgatggagggctgagatgttgggaaagtggagacgacccctgggtgcaacatgcaaagtggttcccgcgctgcgagtatctcatacgcataaaggggcaggagttcattagacaagtccaggcatcctatccccatctgttggaacagcttttatctacttccgactcccccggggatgaaaacgctgaaagtagcatcattcattttgagcccggagaggaccattctgaagatgccatcatgatgaacactcccgtaatcaatgcagcagtagaaatgggtttctctaggagcttagtcaaacagacagtgcagcggaagatacttgcgaccggagaaaattatcgcctggtgaatgacctagttcttgaccttctgaacgcggaagatgaaattagagaagaagagagagagagagctactgaggaaaaggaatctaatgatttgctgctcattcgtaagaatagaatggctctattccagcacttgacctgcgtaatcccgattctcgattcgctcctgaccgccggcatcatcaatgagcaggaacatgacgtgatcaaacagaagacccagacatcgctccaggccagagagcttatcgacaccattcttgttaagggtaacattgctgctacggtgttccgcaatagcctgcaggaggctgaagctgtgctctacgaacatctgttcgtacagcaggacatcaaatatattcccacggaggacgtgtccgacctgcccgtggaagagcagctaagaagactgcaggaagaaagaacttgcaaggtctgtatggacaaggaggtctctatcgtattcattccgtgcggacacctggtcgtctgcaaagattgcgccccttctctaaggaagtgccccatttgccgctccacaatcaagggcactgtcagaacctttctgtct

SEQ ID NO: 32284 - DNA, 1812 bp, Artificial Sequence
  Description of Artificial Sequence: Synthetic coding sequence
atgaacatagtggagaattccatatttctgtccaatctaatgaaaagtgctaacactttcgagttgaagtacgacctctcttgtgaactgtatagaatgtcgacctattcaacctttcccgccggagtgcccgttagcgagaggtctctggctagagccgggttctactatacaggggtcaacgacaaggtgaaatgtttttgttgtgggctgatgctggataactggaaacgaggagattcacctactgaaaagcacaagaagctgtacccgtcttgccgatttgtccaaagcctgaacagcgttaataatttggaagccacaagtcagccgactttcccaagttccgttactaatagcacccactcgctgcttcctgggaccgagaatagcgggtacttccgaggatcttatagtaatagcccgagtaacccggtcaactcaagggctaaccaggattttagcgcattaatgaggtcttcctaccattgcgcaatgaacaatgagaatgctcgattgctgaccttccagacgtggccccttacatttctgagccccactgacctcgcaaaggcaggtttctattatattggtcccggtgatagggttgcttgcttcgcatgcggcggaaaattatctaattgggagcctaaagataacgctatgtccgaacatctgcgtcattttccaaaatgtcctttcattgaaaatcagctgcaggacacctcgagatataccgtgtctaacctgtcaatgcagacccacgccgccagatttaagacctttttcaactggccttctagcgtgctggtgaatccagagcagttggcctccgcagggttttattacgttggtaactctgacgacgtgaaatgtttctgctgcgacgggggtctcaggtgttgggaaagtggagatgatccttgggtccaacacgccaaatggttccccagatgcgagtatttgattagaatcaaggggcaggaatttattcggcaagtacaggcaagctaccctcatttactggagcagctcctgagcacatccgatagcccaggggatgagaatgcagagtctagcattatacacttcgaacccggcgaggaccacagcgaagatgctatcatgatgaatactcccgtgattaacgcagccgtcgagatgggcttcagtagatcccttgtcaaacaaacagtccagcgtaagattctggcaaccggcgagaattaccgtttagttaatgacttggtactcgatctgctgaacgcagaagatgagataagggaggaggaaagagaacgtgcgacagaggagaaggagagcaatgatctgctgctcatcagaaaaaacagaatggcattgttccagcatctgacttgtgtaattcccatcctggacagcctgctgaccgccggcatcataaacgagcaggaacatgatgttataaaacagaaaacccagacctccctacaggcacgagagcttatcgataccattctagtcaaggggaatatcgcggctactgtcttcagaaattctctgcaggaagccgaggcggttctgtatgagcatctgttcgttcagcaggacattaaatatatcccgacggaagacgtgtctgatctgcctgtagaagaacaactgcgacggttgcaagaggagcgcacatgtaaggtgtgcatggataaagaggtgtctattgttttcataccgtgtgggcacctggtggtgtgcaaagactgcgcaccaagcctcaggaaatgccccatttgtcgctccacaattaaaggtacagttcgtaccttcctgagc

SEQ ID NO: 32285 - DNA, 1812 bp, Artificial Sequence
  Description of Artificial Sequence: Synthetic coding sequence
atgaatattgtggagaattcaatcttcctgtccaatttgatgaaatccgccaacaccttcgagctgaaatatgatctatcttgtgaactatacagaatgtcaacttattcgacttttcccgcaggtgtgcctgtctcagagcgcagccttgccagggcagggttctattataccggagtgaatgataaagtcaagtgtttttgctgtggcctcatgctcgataactggaagaggggggactccccgactgagaaacacaaaaagctgtatccttcgtgtaggttcgtgcaatctctcaacagtgtcaataacttagaggccacatcccagccgacatttccaagcagcgtgactaacagtacccatagtctgctgccaggaacagaaaactctggatattttcggggaagttattctaattcccccagcaacccggtgaactctcgcgccaaccaggacttttccgctctcatgaggagttcctatcactgtgctatgaacaatgaaaatgccagactcctcactttccagacttggcctctcacctttctgtcccctactgacttagcaaaagcagggttttactatatcggccctggcgaccgcgtcgcctgctttgcctgtggcggaaaactcagcaactgggagccgaaggacaacgccatgagcgagcatctgcgccactttcccaagtgtccatttatcgaaaatcagctccaggacactagcagatatacagtgagtaatctgtcgatgcagactcacgcagctagatttaagactttcttcaattggcccagctctgtacttgtcaatccggaacagctggcctcagccgggttctactacgtaggcaattccgatgacgtcaagtgtttctgttgtgacggtgggctccgttgttgggagagtggtgacgacccttgggtccagcacgctaagtggtttccgaggtgtgagtatctgattcgcatcaaagggcaggagtttatcaggcaggtgcaggcctcctacccacatcttcttgaacagctactttccacttcggatagtcctggtgatgagaacgccgaaagttctataattcactttgagccgggcgaggaccattctgaggatgctattatgatgaatacgcccgtgattaatgctgctgtggaaatgggtttcagccgctcactcgtgaaacagactgtccaaaggaagatcttggctacaggagaaaattaccgcctcgttaatgatctggtcctcgatttgctgaacgcagaggatgaaatccgagaggaggagagggaacgcgcaacagaggagaaagaatccaacgacctactgcttattcgtaagaaccggatggctctattccaacacctgacttgtgtcatacccattctagactctttgctgaccgctggcatcatcaatgaacaagagcatgacgtaataaaacagaaaacacaaacctccctgcaggcacgagaactgattgacactatcctggtcaaagggaacatcgccgcaactgtgttcagaaatagcctgcaggaggctgaggctgtcttgtacgagcacctgttcgtgcagcaggacatcaaatacattccaaccgaagacgtctccgacttgccggtggaggagcagcttcgaagactccaggaagagcggacatgtaaagtgtgcatggataaggaggtctcgattgttttcattccatgtgggcacctggtcgtctgcaaagactgcgcccccagtctccgtaagtgccccatttgccggagcaccatcaaagggaccgttagaacctttctgtct

SEQ ID NO: 32286 - DNA, 1812 bp, Artificial Sequence
  Description of Artificial Sequence: Synthetic coding sequence
atgaacatcgtggaaaattctatttttctgagtaacctaatgaagtccgcaaatacattcgaacttaaatacgatctgtcatgcgagctgtaccgaatgtctacgtacagcacctttcctgccggggtcccggtcagcgagcggtctctggctagagcaggtttttactataccggcgtcaacgacaaggtcaagtgcttctgttgtggtcttatgttggacaattggaagagaggtgattcacccaccgaaaaacacaaaaaactatacccgtcttgccgctttgtacagtcattgaactcagtaaacaacctcgaggccacctctcagccgacttttccatcatctgtaacgaactcgacacattctcttctgccgggcaccgaaaattctggatatttcaggggctcttatagtaactcaccctccaatcccgttaatagtagagctaatcaggacttctccgctctgatgcgctccagctaccattgcgcgatgaacaatgaaaacgcaagactactgacctttcagacctggccactaaccttcctttctccaaccgacttggccaaggccggcttttattacattggcccaggtgacagagtggcttgtttcgcctgcggcggcaaattgtccaattgggaacctaaggataacgcgatgtctgagcatctgcgacacttccccaagtgccccttcatagaaaatcagttgcaggatacttccaggtacactgtgtcaaacctcagcatgcagacccatgccgctcgcttcaagactttctttaactggccaagcagcgtcctagtgaacccagaacaactggcctcagcgggcttttactacgtgggtaactcagatgacgttaaatgcttttgctgcgacggtggtctgcgctgctgggagtctggtgatgatccgtgggtacagcatgccaaatggtttcctagatgtgagtatttgattcggatcaagggccaggagttcatccgccaggtccaagcttcttatccacatctactcgagcagctcctgtcaacatcagatagccccggagatgaaaatgccgaatcatctatcatccattttgagcctggcgaagatcacagcgaagatgctattatgatgaacaccccggtaattaatgccgccgtggaaatggggttttcccgctctctggtcaaacagacagttcagagaaaaatcctagctaccggggagaattatcgtttggtaaacgatctggtgctggatctgctgaacgccgaggatgagatacgagaggaggagcgtgagcgggctacagaggaaaaggaaagtaacgacctgctgctgattcgaaaaaacaggatggccctgttccaacatctcacctgcgtaatccccattctggacagcctgctgaccgccgggattatcaatgaacaggagcatgacgtgattaagcagaagactcagacaagcttgcaggctcgggagcttattgacactattctggtcaaaggcaacattgcagccactgttttccgtaattcacttcaagaggcggaagcagtcctctatgaacacttattcgtccagcaggatatcaagtatattcctacggaggacgtttctgacctgcccgtcgaagagcaactccgaaggctccaagaggagagaacctgtaaggtgtgcatggataaggaagtgagcattgtttttattccctgtggtcatctggtcgtttgcaaagactgcgcccctagtctcagaaagtgccccatctgtagatcgacgattaagggcactgtgaggacgtttctgagc

SEQ ID NO: 32287 - DNA, 1812 bp, Artificial Sequence
  Description of Artificial Sequence: Synthetic coding sequence
atgaacattgtcgagaactcgattttcctgtccaaccttatgaaaagcgcaaatacttttgagttgaagtacgacctgtcgtgtgagctttaccgcatgtctacgtactccaccttcccagcaggggtgcctgtgtcggagagatcactggcacgcgccggcttttactacaccggagttaatgataaggtcaagtgcttctgttgcggactgatgctcgataattggaaaaggggtgattcgcctactgaaaagcacaagaaactttaccctagctgtcggtttgtgcaatccttgaactcggtgaacaacctggaagccacctcgcaacccactttcccatcgagtgtcacgaatagcacgcactccctcttgcccggaaccgaaaactcgggatactttaggggttcctactcgaactccccttcaaatcccgtcaacagcagagctaaccaggatttctccgcactgatgcgctcatcgtaccattgtgctatgaacaacgagaacgctaggctgttgactttccaaacctggccacttacttttctgtcgccgaccgacctggcaaaggcgggattctactacatcggaccaggggaccgcgtggcatgctttgcatgcgggggaaaactcagcaactgggaacctaaggacaacgcaatgtccgagcatcttcgacacttcccaaagtgcccctttatagagaaccaacttcaagatacttccaggtatactgtgtcgaatctgagcatgcagacgcacgcagcaagatttaagaccttcttcaattggccttcttcggtcctcgtgaatccagaacaactcgcatccgccggtttttactacgtgggtaacagcgatgacgtcaagtgcttttgttgtgatggaggactgagatgttgggagtccggagacgatccttgggttcagcacgccaaatggttcccaagatgtgaataccttatccgtatcaagggacaagagttcattagacaggtgcaagcctcctacccccatctcctggaacaacttctttcaacttccgactcgccaggagatgaaaacgccgaatcctcgattattcatttcgaaccaggggaagatcactccgaggacgcaatcatgatgaatactcccgtgattaacgcagcagtggagatgggattttcacgctcccttgtgaagcagactgtgcaacgcaagatactcgccactggggagaactatcgactggtcaatgacctggtgcttgatctccttaacgccgaagatgagatcagagaggaagagcgcgaacgagcaaccgaagagaaagagtcgaacgacctccttttgataaggaaaaatcgcatggcactttttcagcatctgacttgcgtgataccaattttggactcgctccttactgcaggaatcataaacgaacaagaacatgatgtcattaagcaaaagactcaaaccagccttcaggctcgcgaacttatcgacactatcctggtgaagggcaacatcgccgccactgtttttcgtaactctttgcaagaagcggaagcggtgctgtacgaacatctttttgtgcaacaagatatcaaatacattccaaccgaagatgtgtcagacctccctgtggaggaacaactgcggaggttgcaggaggaaagaacgtgtaaggtttgcatggataaggaagtttccattgtgttcataccatgtggtcatctggtggtctgcaaagattgtgctccatcgctcagaaaatgtcctatctgtaggtccaccatcaaaggcaccgtgagaacttttctttcc

SEQ ID NO: 32288 - DNA, 1812 bp, Artificial Sequence
  Description of Artificial Sequence: Synthetic coding sequence
atgaatattgtggaaaactccatttttctctcaaatctcatgaagtcggcgaatactttcgaacttaagtacgatctttcgtgcgagctctaccgaatgtccacctactcgacgttcccggccggggtgcccgtgtcggagcgcagcctggccagagccggattttactacactggagtgaacgataaagtgaagtgcttctgttgtggccttatgctggacaattggaaacgcggggattcaccgactgaaaagcataagaagttgtacccatcttgtcgttttgtgcaatctctcaattccgtgaataaccttgaggcgacctcccaacccaccttcccttcgagcgtgaccaattccacccactccttgctgcccgggactgagaactcgggatactttcgtgggtcgtacagcaattccccatcgaaccctgtcaactcaagagcaaaccaggacttctcagcgctcatgagatcctcctaccattgcgctatgaataacgaaaatgcccggctgctgacttttcaaacctggccactgacctttctgagcccgactgatttggcaaaggcaggtttctattacattggaccgggagatcgcgtcgcttgttttgcatgtggaggtaagctctccaactgggaacccaaagataatgcaatgtcggagcaccttcgccattttcctaagtgtcccttcatcgagaaccaactgcaggatacctcgcgatacactgtgagcaacttgagcatgcaaacgcatgcagcaagatttaagacttttttcaactggccttcatcggtgctggtgaaccctgagcaactggcctcagcaggcttttactacgtgggcaactcagatgatgtgaaatgtttctgctgtgacggtgggttgcggtgttgggaatccggagatgatccctgggtccaacatgccaaatggttcccgcgctgtgagtatttgatacgaatcaaggggcaggagtttatacggcaagtgcaggcttcctatccccacctcctggaacagctgctttcgacgtccgacagcccaggagatgaaaacgcagagtcatcgattattcacttcgaaccaggtgaggaccattccgaggatgccataatgatgaacaccccagtgatcaacgcagctgtcgaaatgggattttcccgttccctggtgaagcaaaccgtgcagcgcaagattctggcaaccggcgagaactaccggctggttaatgacctcgtgcttgatcttctgaatgccgaagatgaaataagagaagaagagagagaaagagcaaccgaagaaaaggaatccaacgatcttctgctgatacgcaagaataggatggccttgtttcagcatctcacttgcgttattcctatcctggacagccttctgacggctgggatcatcaacgagcaagagcatgatgtgattaaacaaaaaacccagaccagcttgcaagcccgcgaactcatcgatactattcttgtgaaaggaaacattgcggcaaccgtgtttagaaactcacttcaggaagcagaagccgtcctgtacgaacatctgtttgtccaacaggacatcaaatacatacctaccgaggacgtgagcgacctccctgtcgaagagcagcttcgacgacttcaagaagaacggacttgcaaggtctgtatggataaggaagtgtccattgtgttcatcccttgtggacatctcgtggtctgtaaagactgcgcgccttcacttcgcaagtgtccaatctgccgtagcaccataaagggtactgtccgaacctttctttca

SEQ ID NO: 32289 - DNA, 1812 bp, Artificial Sequence
  Description of Artificial Sequence: Synthetic coding sequence
atgaacatcgttgaaaactccatcttcctcagtaacttgatgaagtccgcaaacacattcgagctgaaatacgacctgtcatgtgagctgtatcgcatgtccacctactccactttccccgccggagtgccagtgtccgaacgctcccttgcgcgcgccggattctattacaccggtgtgaacgacaaggtcaagtgcttctgttgtggtcttatgttggataactggaaaaggggagattcaccgaccgagaaacacaaaaagctgtacccgtcctgtcgatttgtgcagtcgttaaattcggtgaacaaccttgaggctacaagccagcccaccttcccttcttccgttaccaactcaacacatagcctgctccccgggacagagaacagtgggtactttcgcggctcttatagcaactccccctctaatccagttaacagtagagctaaccaggactttagtgctctgatgagaagcagttaccactgtgctatgaacaacgagaatgctcgcctactgacctttcagacatggccacttacctttttaagccctacggatctggccaaggctggcttctattatataggaccaggcgatcgcgtggcttgctttgcctgcggcgggaaactgtccaactgggagccgaaagacaatgctatgagcgagcacttaagacatttcccgaagtgtcccttcatagagaaccagttgcaagatacatctcggtacacagttagcaatttaagcatgcagacacatgctgccaggttcaaaaccttcttcaattggccctcgtccgtgctcgtgaatcctgagcaattagcatccgccggattctattacgtcgggaactccgacgacgtcaagtgcttctgctgtgacggaggtctgcgttgctgggagtcgggagatgacccgtgggtgcagcatgccaaatggttcccaagatgtgagtatctgatccgcataaagggacaggagtttatccggcaggttcaggctagttacccccacctgctcgaacagttactgtcaacctctgattcaccaggggacgaaaacgcagaaagctctattattcatttcgagcctggagaagaccacagcgaagacgcaataatgatgaacactcccgttattaacgcagcagttgaaatggggttcagccggtccttggtgaagcagactgtccagagaaaaattcttgctaccggagaaaattaccgcctggtgaacgatcttgtgctagacctgctaaacgcggaggacgagattagagaggaagagcgcgaacgcgcgaccgaggagaaggagtctaacgatctgctgctcatcagaaagaaccggatggctctttttcaacacctgacgtgcgtcatcccaattttagatagccttctgaccgctggcataatcaatgagcaagagcacgacgtgattaagcagaagacccaaacatcgctgcaggcgcgagagctgatcgatacgatcctggtgaagggaaatatagcagccactgtttttaggaacagcctccaagaggccgaggctgtgttgtacgagcacctgttcgtgcaacaggatatcaagtacatccctaccgaggacgtgagcgacctacctgttgaggagcagctcagaaggctgcaggaggagagaacttgcaaggtgtgcatggacaaggaggtatcaattgtgtttatcccatgcggacatttagtcgtttgtaaagattgtgccccgagcctcagaaagtgccctatttgtaggagcaccatcaaggggactgtcagaactttcctgagt

SEQ ID NO: 32290 - DNA, 1812 bp, Artificial Sequence
  Description of Artificial Sequence: Synthetic coding sequence
atgaacatcgtggagaactccattttcttgagcaacctgatgaagtcagcgaatacttttgaattgaaatacgacctgtcgtgcgaattgtaccggatgtcaacctattccacttttcccgcaggcgtccctgtgtccgaaaggtcgctcgcgcgcgccggcttctactacaccggagtgaatgacaaagtcaaatgtttctgttgcggactgatgctcgacaactggaaacggggggactccccgacggaaaaacacaagaagctctacccttcctgcaggttcgttcaatcccttaattccgtgaataacctggaagcgacttcgcagcctaccttcccgtcctcggtgaccaacagcactcactccttgctgccaggaactgagaattcgggatacttccggggaagctactcgaatagtccaagcaatccagtgaattcgcgggcaaaccaggacttctccgcactcatgagatcgtcctaccactgcgctatgaacaatgagaacgcccggctgctgacttttcagacttggccactgactttcctctctcctactgatcttgctaaggccggattctactacattggacccggagatagagtagcttgtttcgcttgtggtgggaagctgtcgaattgggaaccgaaagacaacgccatgtccgagcatcttagacatttcccgaagtgcccgtttatcgaaaaccaactgcaggataccagccgctacaccgtgtccaacttgagcatgcagactcacgctgcccgatttaagacgtttttcaattggccatcaagcgtacttgtgaacccggagcagctcgcctctgcaggattctattacgtgggcaactcggacgatgtgaaatgcttctgctgcgacggagggctccggtgctgggaatctggcgatgacccgtgggtgcagcacgctaagtggtttccgcgatgcgaatacctgattaggatcaaaggccaggaattcatccgtcaagtccaggcatcatacccgcatctgctcgagcaactgttgagcacttcagacagccccggagatgaaaacgccgagtcatcaatcatccacttcgaaccgggagaggatcattccgaggacgcgatcatgatgaacactcctgttatcaatgccgcggtggaaatgggattctcacgcagccttgtcaagcagactgtccagagaaagatccttgccactggagagaactaccgcttggtgaacgacctggtgctggatctgctgaacgccgaagatgaaatcagagaggaagaacgggaacgcgccacggaagaaaaggaatcgaacgaccttctcctcattcgcaagaaccggatggcactctttcagcatcttacttgtgtgattccaatcctcgacagcctgcttacggccggtattatcaacgaacaggaacacgacgtgatcaagcagaaaacccaaacgtccctccaagctcgggagctcattgacaccatcctggtgaagggcaatattgctgctactgtgttcagaaactcgctgcaagaagcggaggccgtgctgtacgagcacctcttcgtgcaacaggacatcaagtacattccgaccgaggatgtctccgatctcccagtggaggagcagctgcgccggctgcaggaagagagaacctgtaaggtttgtatggacaaggaagtttcgattgtgttcataccatgcgggcacctggtggtttgtaaggattgcgcaccgagcttgcgtaagtgtcccatctgtcgctctactatcaaagggactgtgcggaccttcctgagc

SEQ ID NO: 32291 - DNA, 1812 bp, Artificial Sequence
  Description of Artificial Sequence: Synthetic coding sequence
atgaatattgtggagaactcaattttcctgagtaaccttatgaagtccgccaacaccttcgagctaaagtatgacctgtcgtgcgagctttatagaatgtccacctactccacctttcctgcaggagtccctgtgtccgaacgctctcttgcccgagccggattctactacacaggcgttaatgataaggtcaagtgtttctgctgtggattaatgctggacaattggaagaggggggacagccccacagagaagcacaagaaactgtacccctcgtgtcgatttgtgcagtcattaaactctgtcaacaatctggaggcaacctcacaacccacgttcccttcgtccgtcactaattccacccatagtctgctgcccgggacagaaaattccgggtactttcgcgggtcctactccaattcgccttctaacccggttaactcaagggctaaccaagactttagcgctttaatgaggagttcataccattgcgcgatgaacaatgaaaatgcacgactgctaacatttcaaacgtggccactcacctttctgtctccgactgacctagctaaggctgggttctactacatcggacctggtgatcgcgtggcctgctttgcctgcggcggcaagctgtctaactgggaaccaaaggacaacgccatgtccgagcatctgagacatttccctaagtgcccattcattgaaaatcagttacaggatacttctcgatacaccgtgtctaatctgtctatgcaaacacatgctgctaggttcaaaacatttttcaactggccgtcatccgtcttggttaacccagagcagctcgcatccgcggggttctactatgtggggaacagtgacgatgtgaaatgcttctgttgcgatggaggactgcgctgctgggaatctggcgatgatccatgggtgcagcacgccaagtggttccccaggtgtgagtatctgatcaggattaagggtcaggagttcattcggcaagttcaggcctcatatcctcacttgctcgaacagctcctgagcacaagcgattccccaggtgatgagaacgccgaaagctctataattcatttcgagccaggagaggaccatagtgaggatgccatcatgatgaacacccctgtgatcaacgcggcggtcgagatgggctttagtagatccttagtgaagcaaactgtgcagaggaagatactggcaactggagaaaactatcgcctcgtgaatgatctagtcttggacttgctaaacgcagaggacgaaattcgggaggaggaacgagaaagggccactgaagagaaagaaagtaatgacctgctgttaatacgcaagaatcggatggctttgtttcagcatttgacctgtgtgatccccattctcgactcactccttactgctggaattatcaacgagcaggagcatgatgttatcaagcagaaaactcaaacgagtctccaggctcgggagctaattgacaccatcctggtgaaagggaatatcgctgcaactgtgttcaggaactccttacaagaagccgaagcagtcctgtacgagcatctgtttgtgcaacaagacatcaagtacatacctactgaagacgtctcagacttgcccgtggaggagcagcttagaagactacaggaggaacgtacctgcaaggtgtgtatggacaaagaggtttctattgtgtttataccatgtggccatctcgtcgtgtgcaaagattgcgctccttcattgagaaaatgtccaatctgccgatcaacaattaaaggaaccgtgagaaccttcctgagt

SEQ ID NO: 32292 - DNA, 1812 bp, Artificial Sequence
  Description of Artificial Sequence: Synthetic coding sequence
atgaacattgtggagaattccatctttctttcaaacctgatgaaatctgcaaatacattcgaactgaagtatgacctatcttgcgaactgtatcggatgagtacctacagcacctttcctgccggggtgcccgtgtcggaacgctccctggcccgcgcgggcttctactacaccggggtaaacgataaagtcaaatgcttttgctgtgggctgatgctggacaattggaagcggggggattcccctacagagaaacataagaaactttatcccagctgccggttcgtgcagagcttaaactctgttaataatcttgaagctacctcgcagccaacattcccgagctctgttaccaatagcacacattcccttcttcctggaaccgagaattctggctatttccgtggctcctattcaaactcaccctccaaccccgtgaactccagagctaatcaggactttagcgctctgatgcggagttcatatcattgcgccatgaataatgagaatgctcgtctgcttacctttcagacctggcccttgaccttcctctccccaaccgatttggccaaggcgggcttctactatataggccctggagatcgggtggcttgttttgcctgtggcgggaagctgtccaactgggaacctaaggacaacgccatgtctgagcatctgaggcactttccgaagtgccctttcatcgagaaccagctgcaggatacatcacgttacactgttagcaacctgagcatgcagactcatgcagcgcggttcaaaaccttctttaattggccatctagcgtgctggtgaatccggaacaactagccagcgccgggttctattacgttggaaacagcgatgacgtgaaatgcttctgctgtgatggagggcttcgatgttgggagtcaggcgacgatccatgggtgcaacatgccaaatggttcccacgatgtgagtacctgatcaggatcaagggtcaagaatttatccgtcaggtgcaggcatcttatccccatttgttggagcaactgctgtccacaagtgatagcccgggggatgagaatgccgagagctctatcatccacttcgaaccgggtgaagaccactcagaagacgctatcatgatgaatactcccgtcattaatgccgccgtagagatgggattctcacgaagtctagttaagcagacagttcaacgtaaaattctggccactggcgaaaactaccgtctcgttaacgaccttgttctagatctgcttaacgcagaggacgagatccgcgaggaagaaagagagcgggccacagaagagaaggaatccaatgacttactgctcattcggaaaaataggatggcattatttcagcatctcacctgcgtgatacctattctggactcactgctcaccgccgggatcattaacgagcaagagcatgatgtcataaagcaaaaaacacagacatcactgcaggcccgcgagctcattgatactattctggtcaagggaaatattgccgccacagtatttcgcaacagcttgcaggaggccgaggccgtcctgtatgagcatctttttgtgcagcaggatatcaagtatatccctactgaggatgtcagtgacctgcctgtggaagaacagttaagaaggctgcaggaggaacgcacctgcaaggtgtgtatggacaaagaggtttccatcgtgttcatcccctgtgggcatcttgtggtttgtaaagattgtgcaccctctcttaggaagtgccctatctgtaggtctacaataaaaggcacggtgcgcacatttctgtcc

SEQ ID NO: 32293 - DNA, 1812 bp, Artificial Sequence
  Description of Artificial Sequence: Synthetic coding sequence
atgaacatcgtggagaattccatcttcctctcaaaccttatgaagtccgcgaacacgttcgagctgaagtacgacctgtcgtgcgaattgtaccggatgtctacctactcgacgttcccggcgggagtgccggtatcggaacgtagtctcgcacgcgctggtttctactacaccggagtgaacgataaagtgaagtgcttctgctgcggactcatgctggataattggaaaagaggggatagcccaactgagaaacataagaaactctacccttcttgtcggttcgttcagtcgctgaactcagtgaacaatttggaggccacttcacaaccgactttcccatcctcggtgactaactcaactcactccctgctgccgggcactgaaaatagcggatactttcggggaagctacagcaactccccatcgaatcccgtgaattcgagagccaatcaggatttttccgctttgatgcgctcttcgtatcattgcgcgatgaacaatgagaacgctcggctgctgacgttccaaacgtggcccttgacttttcttagccctaccgatctggccaaagccggattctactacatcggtcccggcgaccgcgtggcctgtttcgcgtgcggaggcaagttgagcaactgggaacctaaggacaacgcgatgtccgaacacctgaggcattttccgaagtgcccgttcatcgaaaatcagctgcaggatacttcaagatacaccgtctcgaacctctctatgcaaacgcatgccgcccgtttcaagaccttctttaactggccgtccagcgttctggttaacccagaacagttggcatcggcaggcttctattacgtcgggaacagcgacgacgtcaaatgtttttgctgcgacggtggacttaggtgttgggagtccggggacgacccttgggtccagcacgcgaaatggttcccgaggtgcgaataccttatccgcatcaagggtcaggaattcatccgccaggtccaggctagctatccacacctcctggaacagctcctcagcaccagtgactcgccaggcgacgaaaacgccgagtcatcaatcattcacttcgagccgggcgaggatcatagcgaggatgcgatcatgatgaacacccctgtcattaacgcagctgtcgaaatgggattctctcgcagccttgtcaagcagaccgtccagcggaagatcctggcaaccggagagaattacagactggtgaacgatctggtgctggatttgctgaatgcagaggacgaaatccgcgaggaggagcgagaacgcgctaccgaggagaaggaatcaaatgatctgctgctcatcagaaagaacagaatggccctcttccaacacctgacctgtgtaatccctatccttgactccctgcttactgcaggaattatcaacgaacaagaacacgacgtaatcaaacaaaagacccaaaccagcttgcaggcccgggaactgattgacactattctcgtcaagggtaatatcgctgcgactgtgttccggaactcgcttcaagaagccgaggcggtgttgtacgagcacctgtttgtgcagcaggacatcaagtacatcccaacggaagatgtgtcggaccttccggtcgaagagcaacttcgccgactccaggaagagcgcacctgcaaggtgtgcatggacaaggaagtttcgatagtgttcatcccgtgcggacacctcgtggtttgcaaggactgcgcgccgtcactgaggaaatgcccgatttgtcgctccactataaagggaaccgtccggacctttctgtcg

SEQ ID NO: 32294 - DNA, 1812 bp, Artificial Sequence
  Description of Artificial Sequence: Synthetic coding sequence
atgaatatagtggaaaattctatattcctatccaaccttatgaaaagtgctaatactttcgaattgaaatacgatctctcttgtgaattgtatcggatgtctacatattccacttttcctgctggagttcccgtgagtgaacgttctctggcccgagctggattttattatactggagttaacgataaagttaaatgtttctgttgcgggttaatgctcgataattggaaacggggggactcccccacagaaaaacataaaaaactgtacccctcttgccggttcgtgcagtccctcaattctgttaacaatctggaagccacaagtcagcctactttcccttcttctgtgacgaattccactcattctctcctgcctgggacagaaaattcagggtattttagagggagttattccaactctcctagtaatcccgtgaattctcgcgccaaccaggatttcagtgctctcatgcgctcaagttaccactgcgccatgaacaacgagaatgcaaggctactgacttttcagacatggcccttaacttttctcagtccaacagatctcgctaaagccggattttattacatcgggccgggagatagagtagcctgttttgcatgtgggggaaaactgtccaactgggaacctaaagataatgccatgtccgagcacctaagacactttcccaaatgtccctttatcgagaatcagctccaggatacatctcgatatactgtatctaacctctccatgcagacgcacgccgctcggtttaaaactttctttaactggccttcgtcagtcctcgtgaaccccgagcagctagcttctgccggattctattacgttgggaactcagacgatgtaaaatgcttctgttgtgatggaggactgagatgctgggaatctggggatgatccatgggtgcagcatgccaaatggtttccaagatgcgaataccttatcaggataaaaggacaggagttcatacggcaggtgcaggcctcctacccccatctcctcgaacagctgctgtcaacttcagatagtcccggagatgagaatgccgagagtagtataattcattttgaacccggggaagatcactctgaggatgccataatgatgaacacaccagtcatcaatgccgctgtagaaatgggattctcccgctccctggtaaaacagacagttcagaggaagattctagcaacaggagaaaattatcgacttgtgaacgacttagtgttggacctgcttaacgcagaggatgaaataagagaggaagagcgagaacgcgctacagaagaaaaagaatcaaatgacctcctcctgatacgcaagaatcgaatggccttgtttcagcatctcacatgtgttatacctatcctcgatagtctccttacagccgggattataaatgaacaggaacacgatgtcataaaacagaaaacacagacttctcttcaagcacgtgaacttattgatacaatactagtgaaaggaaacatcgccgccacggtattccgcaactctctccaggaagcagaagcggtgctgtacgaacatctgtttgttcagcaggatataaaatacataccaacagaggatgtctcggatttgcccgtggaagaacagcttagaaggctacaggaggaacggacatgtaaagtgtgcatggataaagaagtcagtatcgtgttcataccctgtggacacctggttgtgtgcaaagactgcgctccctctctgcggaaatgtccaatatgccgcagtacaatcaaagggacagtgaggacatttctatcc

SEQ ID NO: 32295 - DNA, 1812 bp, Artificial Sequence
  Description of Artificial Sequence: Synthetic coding sequence
atgaatattgttgaaaattcgatcttcctttccaacctgatgaagtcagcgaatacctttgaactgaagtacgacctgtcgtgcgaattgtaccgaatgtcgacgtactcaacctttcctgccggagtgccagtgtcggaaagatccctggcacgggcaggtttctactacaccggagtgaacgacaaggtcaagtgtttttgttgtggcctgatgcttgataattggaagagaggagatagccctaccgaaaagcataagaagctgtacccatcctgcaggttcgtccaaagcctcaactcggtgaataacctggaagccacttcgcagccaacgttcccatcatccgtgactaacagcactcattccctgctgcctggtaccgagaatagcggttactttaggggctcatacagcaactcgccatcgaatcctgtgaattcacgcgcaaatcaggatttcagcgcactcatgcgctcatcgtaccattgtgccatgaacaacgagaacgcaagactgttgactttccagacgtggccgctgacttttctttcgccaaccgacctggccaaggccggattttactacataggacccggtgatagggtggcatgttttgcatgtggagggaagctctccaactgggaacctaaagacaatgcgatgtccgagcatttgagacatttccccaagtgtccctttatcgagaatcagcttcaggatactagccgctacactgtcagcaatctgagcatgcagacccatgctgcacgcttcaaaaccttcttcaactggccctcgagcgtgctggtgaaccctgaacagctggcttcagccgggttctattacgtgggtaactcggatgatgtgaagtgtttttgctgcgatggagggcttcgctgttgggaatcaggagatgatccttgggtgcagcacgctaaatggtttccaagatgtgagtaccttattaggattaagggacaggagtttatccgacaggtccaggcttcgtacccacacctgttggaacagctcctttcgacctccgattcccctggtgacgaaaatgcagaatcgagcattatacacttcgaacctggtgaggatcattccgaagatgccatcatgatgaatactccagtgattaacgccgcagtggaaatggggttttccagatcactggtcaagcaaactgtgcaaaggaagattctggccaccggtgagaattatcgtcttgtaaacgatttggtgctggacttgcttaatgccgaggacgaaattagggaggaagagcgggaacgagccaccgaagaaaaggagagcaacgatctgcttctgattcggaagaacagaatggccctttttcaacatctcacctgtgtgattccaatactggattccctgctgacggcaggaatcattaatgaacaggagcatgatgtgattaagcaaaagactcaaacctcccttcaagcacgggaactcattgatactatcctggtgaagggaaatatcgctgctaccgtgtttcgcaactctcttcaagaggcagaagcagtcctgtacgaacatctttttgtgcaacaagatatcaagtacatccccaccgaagatgtgtctgatctgcctgtggaagagcagctgcggcgcctccaagaagagcgtacttgtaaggtgtgtatggacaaagaggtcagcattgtgtttattccctgtggacatcttgtggtgtgtaaggattgcgcaccttcgctcaggaagtgccctatatgtcgcagtaccattaagggaaccgtgcggaccttccttagc

SEQ ID NO: 32296 - DNA, 1812 bp, Artificial Sequence
  Description of Artificial Sequence: Synthetic coding sequence
atgaatatcgttgagaactccattttcctttccaacctaatgaagtcagcgaatacctttgagctgaagtacgatttgtcttgcgaactctatcgaatgagcacctactcgacattcccagccggcgtcccagtcagcgagagaagccttgcaagagctggattctattatactggagtgaatgataaagtgaaatgcttttgttgcggattaatgctggacaattggaagagaggagattcccccacggagaaacacaaaaaactgtaccccagctgcagattcgtacagtcactgaattccgtgaacaatttggaggcaacaagccagcccacattcccttccagtgtgacaaacagcactcactcgctcttacctggaaccgagaacagtggatatttccgagggagctacagtaatagcccatccaaccctgttaatagtagagctaatcaagacttctctgctctgatgagaagttcctaccattgtgccatgaacaacgaaaacgcccgcttgctgacttttcagacatggcccctgaccttcctttcaccgacagacttagcaaaggcaggattttactacatcggcccaggggaccgtgtcgcctgctttgcctgcggcgggaaactgagcaactgggaaccaaaagacaacgcgatgtcagaacatctccgccattttccaaagtgtcccttcatcgagaaccagttgcaggatacaagccggtatacagtgtcgaatctctccatgcagacacacgctgcgcgttttaagactttctttaactggccctcaagtgtactggtgaatcctgaacagttagccagcgcaggattctactacgtgggaaatagcgatgacgtgaagtgcttttgctgcgacggtggtctgaggtgctgggaatcaggagatgatccctgggtgcagcacgcgaagtggttcccacgatgtgagtacttgatacgaatcaagggccaggagttcatccgacaggtccaggccagttacccccacttactcgaacaacttttgtctacctctgattcccccggagatgaaaatgccgaatcgtctataatccacttcgagccaggcgaggaccacagcgaggacgccattatgatgaatactcccgttatcaatgccgctgtggaaatggggttctctcggagcctggttaagcagacagtccaaagaaagattcttgccactggtgagaactacaggctcgtcaatgacctagtcctggacctgctgaatgcggaagacgaaatccgcgaggaggaacgtgagcgagctaccgaagagaaagaatctaacgacctactgttgattagaaagaaccgtatggccctgtttcagcacttgacttgtgtcattcccattctggatagcctgctcaccgcgggaataattaacgaacaagaacacgatgtaataaaacagaagactcagaccagcctccaggcccgggaactcattgacaccattctggtgaaagggaacattgcagccacagtgtttagaaactcactgcaggaggctgaggcagtgctctacgaacacctgtttgtacaacaagacattaagtacatccctaccgaagatgttagcgatctccctgtggaggagcagctgcggcgtctgcaggaagagagaacctgtaaagtttgtatggataaagaggtgtctattgtgtttatcccgtgtgggcatctggtggtatgtaaggactgcgcaccgagccttcgtaaatgtccaatctgtaggagcacaattaaaggcacggtccggactttcctttca

SEQ ID NO: 32297 - DNA, 1812 bp, Artificial Sequence
  Description of Artificial Sequence: Synthetic coding sequence
atgaacatcgtggaaaactcgatttttctgtccaatctcatgaaaagcgctaatactttcgaactgaagtacgatttgtcctgtgagctgtaccggatgtccacctacagcaccttcccagctggtgtgcctgtctccgaacggtccctggcaagagcaggattttattacaccggagtcaacgacaaagttaagtgcttttgctgcggacttatgctggataattggaagcgcggggacagtccgaccgagaagcacaagaaactctaccccagctgccgattcgtccaatccctcaattcagttaacaatctggaggccactagccagccgacctttccgtcgtcggtgaccaactctactcactcgctgctgcctggaaccgaaaactccggatacttcagaggctcgtacagcaactccccgagcaaccccgtcaactcacgcgcgaaccaggacttctcggcactgatgagatcctcctaccattgtgccatgaataatgagaacgccagacttctcactttccaaacttggccgctgactttcctgtcccccaccgacctggcgaaggcgggattctactatatcggaccaggagacagagtggcctgcttcgcctgcggaggcaaactttcgaattgggaaccaaaggacaacgccatgagcgaacatctccgacactttccgaagtgcccttttatcgaaaaccaactgcaagatacctctcggtacaccgtgagcaacctgtcgatgcagacccatgccgccaggttcaagaccttcttcaactggccgtcatcggtgctggtcaaccctgaacagctcgcttctgccgggttctactacgtcggtaactcggatgatgtgaagtgcttctgctgtgacgggggcctgaggtgctgggagagcggggacgacccgtgggtacagcatgctaagtggttcccacggtgtgaatacctcatccgtatcaagggtcaagagttcatcagacaggtgcaagcgtcatacccacacctcctggagcagttgctcagcacttccgattccccaggtgacgaaaacgcggagtcatcgataatccacttcgaaccaggcgaagatcacagcgaagatgcgattatgatgaacaccccggtgatcaacgcggcagtggagatgggattctcgcgctcactggtgaaacagaccgtccaaaggaaaatccttgcgaccggagagaactacaggctcgtgaacgatctggtcttggacctcctcaacgccgaggacgagatccgcgaagaagaacgcgagagagcaacggaggaaaaagagagcaatgacttgcttctgatccgcaagaatcggatggccctgtttcaacacttgacttgtgtgatccctattttggactcactgctcacggcaggcatcatcaatgaacaggaacatgacgtgattaaacaaaagactcagacctcactgcaggcccgcgaactgatcgacacgattcttgtgaagggaaatatcgccgccactgtgttccgcaattcacttcaggaagcagaggctgtgctctacgagcatctgttcgtgcagcaggatatcaagtacatccctactgaagatgtctcggacctcccggtcgaggaacagctgcggcgcctgcaggaggagcgcacttgcaaagtgtgcatggataaggaagtgtccatcgtgtttatcccgtgcggacacctggtggtgtgcaaggactgcgctccctcgctgcggaagtgcccgatctgtcggtcaactattaagggcactgtccggacgttcctctcg

SEQ ID NO: 32298 - DNA, 1812 bp, Artificial Sequence
  Description of Artificial Sequence: Synthetic coding sequence
atgaacattgtggagaattccatctttctgtctaacctcatgaagagcgcaaacacctttgagctcaagtatgatttgtcatgcgaattgtacaggatgtcgacttacagtactttcccagcaggtgtacctgtgtccgaacgttctctggccagagctgggttctattacactggggttaacgataaggtaaaatgcttttgttgtggactgatgcttgataattggaagagaggagactcaccaactgaaaaacacaaaaagctttatccctcgtgtcggtttgtacaatccctcaatagcgtgaataacttggaagccacctcccagcccaccttcccatcatctgtgactaactctacccactccctgttaccaggtacggaaaattctggctattttcgggggtcatatagtaactcgccatccaatcctgtcaactcccgggctaatcaggatttctccgctcttatgaggtcctcttatcactgtgccatgaataatgagaacgcgaggctgctgacctttcagacatggccactcacgtttctgagtccaacagatctcgctaaagccggtttttattacattggacccggggatcgtgtggcgtgcttcgcctgtggtgggaaactcagtaattgggaacccaaagataacgccatgtcagagcacctacggcatttcccaaaatgcccatttatcgagaatcagctccaagacacgagcaggtacaccgtgtcaaacctcagcatgcagacccacgccgcacggtttaagaccttcttcaattggcctagcagcgtcttggtgaatccagagcagctggcctctgctggattctactacgtgggaaactccgatgacgtcaagtgtttttgctgcgatgggggcctgaggtgttgggagtctggggacgacccatgggtgcagcatgctaagtggttcccacgctgtgaatacctgattagaattaaaggtcaggagttcatccgccaggtacaagcaagctacccccaccttctcgaacaacttctgagtacatcagactccccaggagatgaaaacgcggaatctagcatcattcattttgagccgggcgaagaccacagcgaggatgctatcatgatgaacactcctgtgataaatgccgctgtggagatgggtttttcacggagcctggtgaagcagactgtccagagaaaaatactggctactggagaaaattataggctggtcaatgacctggtgctcgatctgttaaacgctgaggacgaaattcgagaggaggagagggaacgggcaaccgaagagaaggaatctaatgatctgttgctgatccggaagaataggatggcattattccagcacctgacgtgtgttatccccatactggactctttactcacagcaggcataatcaatgagcaggagcacgatgtgataaagcagaagacacagacctccctgcaggcccgagaactcatcgatacaatactcgttaaaggtaacatcgcggccacggttttcagaaactcgcttcaggaagccgaggccgttctttatgagcatctgttcgtgcaacaagacattaagtacatccccactgaggatgtgtccgacctcccagttgaagagcaactgcggaggctgcaagaagagcggacatgcaaggtatgcatggacaaagaagtttccatcgtattcatcccatgcggacatcttgtggtttgtaaggactgtgccccttcccttagaaagtgcccaatctgcaggtcaaccatcaaaggcacagtgaggactttcttatct

SEQ ID NO: 32299 - DNA, 1812 bp, Artificial Sequence
  Description of Artificial Sequence: Synthetic coding sequence
atgaatatcgtcgaaaactcaatctttctgagtaacctcatgaagtccgctaacacctttgaactgaaatatgacctgtcttgcgaactataccggatgagcacatactctaccttccccgctggcgtgccggtgagcgagcgaagtctagcccgggcaggattctactataccggagtgaatgacaaggtgaaatgcttttgttgtggcctcatgcttgacaattggaaaaggggcgacagtcctaccgaaaagcacaaaaagttgtacccgagttgtcgattcgtgcagtcactgaacagcgtcaacaatttagaagcaactagccagccaacttttccctcctccgtcacaaattctactcacagcctgctgcctggcaccgaaaattccggatactttcggggaagctacagcaattctccttccaaccccgtaaattcccgagcaaatcaggatttttcagccctgatgcggagctcttaccactgtgccatgaataacgagaatgcaagacttctgaccttccaaacctggcctcttacctttttatcccctaccgacctggcaaaggccgggttctattacataggccctggcgatagagttgcgtgcttcgcgtgcgggggcaaactttccaactgggagcccaaggataatgccatgtctgaacacttgcggcatttccccaagtgtcctttcattgagaaccagctgcaagatacaagtagatacacagtttcaaatctgagcatgcaaacacacgcagccaggttcaagaccttctttaattggccatctagcgtgcttgtgaacccggaacaacttgcatccgctggcttttattacgtagggaacagcgatgatgtgaaatgtttttgctgtgacggtggactgcgctgctgggagtcaggcgatgacccctgggttcagcacgcgaagtggttccctcgctgcgaatacctgattaggatcaagggccaagagtttattcgacaggtgcaggcctcttatccccacctgctggagcaactgctcagtactagcgacagtcctggggacgaaaatgctgagagtagcattatccactttgagcctggagaagatcatagcgaagatgctattatgatgaatactcctgtcatcaatgccgccgtggagatggggttctctaggtctttggttaagcagaccgtacagagaaagatcttggctaccggagagaattataggctcgtgaacgatctagtgctggacctgctgaacgcagaggacgagattcgggaggaggagagagagagagccaccgaagaaaaagaatccaacgatcttctgttgatcaggaaaaacagaatggctctcttccagcatttgacttgcgtgatacccatcctggatagcttgctcaccgccggtatcataaatgagcaagagcacgacgtgatcaagcaaaaaacccagaccagtttgcaagctcgggaactgatagacacaatcctagttaaggggaatattgctgctaccgtgttccggaactctctgcaggaggccgaggctgtgctgtacgagcatctgtttgtgcagcaagatattaaatacattcctacagaggatgtgagtgacctgcctgtagaagagcagctgcggcgcctgcaggaagagaggacctgcaaagtgtgtatggataaagaggtctccatagttttcattccttgcgggcacctagtcgtctgtaaggattgcgccccttcccttcgtaagtgcccaatctgtaggtcaactattaaagggaccgtgcgcacgttcctgagc

SEQ ID NO: 32300 - DNA, 1812 bp, Artificial Sequence
  Description of Artificial Sequence: Synthetic coding sequence
atgaacatcgtcgaaaattctatctttctgagcaaccttatgaaatccgctaacacctttgagctgaaatacgacctctcctgcgagctttacaggatgtccacatattccactttccctgcaggtgtccccgtgtctgaaaggagtctggcacgggccggattttattacactggcgtgaatgataaggtgaagtgcttctgttgcggcctcatgctggataactggaagcgcggtgattccccgacagagaaacataaaaaactctatcccagttgtcgattcgtacagagccttaatagtgtaaacaacctggaggcaactagccagcccacctttcctagctccgtaaccaattcaacccattccctgctgccagggaccgaaaacagcggctacttccgggggagttacagtaacagcccgagcaatcctgtgaatagcagggccaaccaggatttcagcgccctcatgcgatcatcttatcattgtgctatgaacaacgagaacgcaagactgctgacgtttcagacgtggcctctgactttcctgtcaccaactgacctggccaaggccggcttttactatattggtccaggagaccgagtggcctgttttgcctgcggtggtaaactttcaaactgggaacccaaagataatgccatgtctgaacatctcagacattttcccaagtgtccctttatcgagaatcagctgcaggatacatctaggtacacagtgagtaaccttagcatgcagacccatgccgcgcggttcaaaactttcttcaactggccatcaagtgttcttgtgaacccagagcaactggcatctgctggtttttactacgtagggaactcagacgacgtgaagtgcttttgctgcgatggaggactgcggtgctgggaatccggagatgatccttgggtacaacatgccaaatggttcccccggtgcgagtatcttataaggattaaaggacaggaatttatcagacaggttcaggccagttatcctcatcttctggaacagctgctctccacctctgatagcccaggggatgaaaacgccgagtcctccatcattcatttcgagcctggcgaggatcactccgaggatgccattatgatgaacacccccgtgatcaatgccgctgtcgaaatggggtttagccggagcctcgtgaaacagaccgttcagaggaaaatccttgcaaccggggaaaactatcggctggttaatgatttggtgctggacttgctgaatgccgaggacgagatccgggaagaagaaagggaacgcgcaacagaggagaaagagtccaatgacttgcttcttataaggaagaaccgcatggctctcttccagcacctcacctgtgtcatcccaattctcgacagtctgcttactgcgggcattatcaacgaacaggagcacgacgtgatcaaacagaagacacagacctcactccaggccagggaactgatagatacaattctggtcaaggggaatatcgccgcaaccgtcttccggaattccctccaggaggcagaagcagtgctgtatgagcacctgtttgtccagcaagacatcaagtacatccccacagaagacgtcagcgatctgcccgtcgaggagcaactgcggcgattgcaggaggaacgcacatgcaaggtttgcatggacaaggaggtgtctattgtgttcatcccgtgcggacatctggtcgtgtgtaaggactgcgccccatccctccgaaagtgtccaatctgcaggagcaccataaaagggacagtgcggacatttctgtcc

SEQ ID NO: 32301 - DNA, 1812 bp, Artificial Sequence
  Description of Artificial Sequence: Synthetic coding sequence
atgaatatcgtcgaaaattccatttttctttcgaatctgatgaaatcggcaaacactttcgaattgaaatacgatctttcctgtgaattgtaccggatgtccacttactcgacttttcctgcaggtgtgccggtgtcggaaagaagcctcgccagagcaggattctactacaccggtgtcaatgataaagtgaagtgcttctgctgtggacttatgctggataattggaaaaggggagattcgccaaccgagaagcacaagaagctgtacccctcctgtaggtttgtgcaatcgctgaattcggtcaataacctggaggccacctcccaaccaactttcccgtctagcgtgacgaattcaacccactcgctgctgccaggtactgagaattcaggatatttcagaggttcgtactctaactcaccgtccaacccagtcaactcaagagctaatcaagatttttcggcgctcatgagatcctcgtaccactgcgctatgaacaatgagaacgcaagactcctcacttttcagacttggcccctgacttttctgtcccctactgacttggcgaaggcagggttctactacattgggcctggagatcgtgtggcatgctttgcatgtggcggtaagctctctaactgggaacccaaggataatgcaatgtcggagcacctccggcactttccaaaatgcccctttattgagaatcaactccaggatacctcaaggtacacggtgtcgaacctgagcatgcaaacccatgccgccagatttaagaccttctttaactggccttcgtcggtgctggtcaacccagaacagcttgcatctgcgggattttactacgtgggaaactccgatgacgtgaagtgtttttgttgtgacggagggctgaggtgctgggaatcgggtgatgatccatgggtacagcatgccaagtggttcccgcggtgtgagtaccttattaggattaaaggccaggagttcattagacaggtgcaggcatcataccctcatttgcttgaacagcttctttcaacttctgattcgcctggtgacgagaacgcagaatcaagcattatacacttcgaaccaggagaagatcattccgaggacgcaattatgatgaacacccctgtgattaatgcagctgtggaaatggggttctctcgctccctcgtgaagcagaccgtgcaaagaaagatcctcgccactggtgaaaactacaggcttgtgaatgatcttgtgcttgatcttctgaacgcagaagatgagatcagggaagaagaacgcgaaagggccactgaggaaaaggagagcaacgacctgctgctgattcggaagaacagaatggcgttgtttcaacatcttacgtgtgtgatccctattctggactcccttttgacggcaggaatcataaacgagcaggagcatgatgtgattaagcaaaagactcaaaccagccttcaagcccgcgagctgatcgacaccatcctggtgaaggggaatatcgcagcaaccgtgtttagaaactcgctgcaggaagcagaagcagtgctgtatgaacacctgttcgttcagcaggacatcaagtacatcccaacggaagatgtgagcgatctcccagtggaggaacaactccgccgcctgcaagaggaacgtacgtgtaaggtgtgcatggataaagaagtgtcgattgttttcattccttgtggacatcttgtggtgtgtaaggactgtgctccttcgctgcggaagtgccccatctgccggtccactatcaaaggcactgtgagaactttcctgagc

SEQ ID NO: 32302 - DNA, 1812 bp, Artificial Sequence
  Description of Artificial Sequence: Synthetic coding sequence
atgaatattgttgaaaattctatttttttgtcaaatcttatgaaatcagctaatacatttgaattaaaatatgatttatcttgtgaattatatagaatgtctacttattcaacttttccagcaggagtgccagttagtgagagatcacttgctcgtgcaggattttattataccggagttaatgataaagttaaatgcttttgttgtggacttatgttagacaattggaaaagaggagattcaccaactgaaaaacataaaaagttgtacccatcttgtagatttgttcaaagtttaaattcagttaataatttagaagctacatcacaaccaacttttccatctagtgttactaattcaacacatagtttattaccaggaacagaaaattcaggttattttagagggtcttatagtaattctccatctaatccagtaaattcaagagcaaatcaagatttttctgcacttatgaggagttcatatcattgtgcaatgaataatgaaaatgcaagattattaacatttcaaacttggccattaactttcctttctccaacagatttagcaaaagcaggattttattatattggaccaggagatagagtagcttgctttgcttgtggaggaaaattatcaaattgggaacctaaagataatgcaatgagtgaacatttacgacatttccctaaatgtccttttatagaaaatcaattacaagatacaagtagatataccgtttctaatttatcaatgcaaacgcatgctgctagatttaaaactttttttaattggccatcaagtgttcttgttaacccagaacaactcgcttcagctggattttattatgttggtaattcagatgatgtaaaatgtttttgttgtgatgggggattaagatgttgggaatctggagatgatccttgggttcaacatgctaaatggtttccacgatgtgaatatttaattagaattaagggacaagaatttataagacaagtacaagcaagttatccacatcttttagaacaattacttagtacttcagattctcctggtgatgaaaacgcagaaagttctattattcactttgaacctggtgaagatcatagcgaggatgctattatgatgaacactccagttattaatgctgctgttgagatgggattttctcgttcacttgttaaacaaacagttcaaagaaaaattcttgctacaggagaaaattatcgtcttgttaatgatttggtactagatttacttaatgctgaagacgaaataagagaagaagaaagagaaagagcaacagaagaaaaagagagtaacgacttacttttaataagaaagaatcgtatggctttattccaacatttgacatgtgttattccaattttagattcattattaacagctggaattattaacgagcaagaacatgatgtaattaagcaaaaaacacaaacaagtcttcaggcaagagaattaatcgatacaattcttgttaaaggaaatattgcagcaacagtttttagaaattcacttcaagaagctgaagctgtattgtatgaacatctttttgttcaacaagatattaaatatattcctacagaagatgtttcagatttaccagttgaagaacaacttagaagacttcaagaagaaagaacttgtaaagtatgcatggataaagaagttagtattgtattcattccatgtggtcatttagttgtatgtaaagattgtgctccatctttaagaaaatgtccaatatgtagatctactattaagggaactgttagaactttccttagt

SEQ ID NO: 32303 - DNA, 1812 bp, Artificial Sequence
  Description of Artificial Sequence: Synthetic coding sequence
atgaatatagtggaaaactccatattcctttcaaacctgatgaaatccgctaatactttcgaactgaaatacgatctgtcgtgcgagctttacagaatgtcgacctactccacgttccctgcaggggtccccgtgagcgaacggtcgcttgctagggcagggttctactacactggtgtgaacgataaggtgaagtgtttttgctgtgggctcatgctcgacaactggaagaggggagacagccctaccgagaagcacaaaaaactctacccttcctgtcgattcgtgcagtcgcttaattccgtgaataaccttgaagcaacttcgcaacccaccttcccttcgagcgtgactaacagcacccatagcctgcttccgggaactgaaaactccggttacttcaggggttcatacagcaactcacctagtaacccagtgaacagcagagcaaaccaagacttcagcgcactgatgcggagcagctaccattgcgctatgaacaatgaaaatgcacgtctgctgactttccagacttggccactcacgttcttgagccccaccgacctcgcaaaggcaggtttttactacatcgggcccggtgatcgagtggcatgtttcgcatgtggcggtaagttgtcgaactgggagccgaaggataacgcgatgtcagaacatcttagacacttcccaaaatgcccttttatcgaaaatcagctccaagataccagccgatacaccgtgagcaacctttcgatgcagacccatgcggcacgcttcaagacttttttcaactggccaagctcagtcctcgtgaacccagaacagcttgcgtccgctggtttctactacgtgggcaattcggatgacgtgaagtgcttttgttgtgacggcgggctgcgctgctgggaatcgggagatgatccatgggtgcaacacgccaaatggtttcctcgatgtgaatacctgatccggattaaggggcaggagttcattagacaagtgcaagcatcgtacccccacctgctggagcaacttctgtcgacttcggacagccctggagacgaaaatgcagagtcctcaattatccattttgaacccggggaggatcattctgaagatgcaattatgatgaacaccccagtgattaacgccgcagtggaaatgggcttcagccgatcgcttgtgaagcaaaccgtgcaacgcaaaattctcgccactggagagaactacagattggtgaacgacctggtattggacctcctgaatgccgaagatgaaataagagaggaggaacgggagagggcaactgaagaaaaggaatcgaacgacctgcttctgattcgcaaaaaccgcatggccctgtttcaacatctgacctgcgtcattcccatactggattcgctgctgaccgccgggatcattaacgagcaagaacacgatgtgataaaacaaaagacgcaaacctccctgcaagcacgtgaactgattgataccattctggttaagggaaacatcgcagccactgtctttaggaattcgctgcaggaagcagaagcggtcctttatgagcatctctttgtgcagcaggatatcaagtacatacccactgaggacgtctcagaccttccagtggaggaacaacttcggagactgcaggaagaaaggacttgcaaggtctgtatggataaggaagtgtcaatagtgttcattccttgtggtcacctcgtggtgtgtaaggactgcgcgccttccctgagaaagtgcccgatctgtaggtcgaccattaaaggaaccgtgcgcacttttctgtcg

SEQ ID NO: 32304 - DNA, 1812 bp, Artificial Sequence
  Description of Artificial Sequence: Synthetic coding sequence
atgaacattgtcgaaaattcaattttcctgtcgaacttgatgaaatctgcaaacaccttcgaacttaagtacgatcttagctgtgagctgtataggatgtccacctacagcacgtttcctgcaggtgtgcccgtgtcggagcgttctctggccagggcagggttttactacactggggtcaatgataaggtgaagtgcttttgttgtgggcttatgctcgataattggaaacggggcgactcgccaaccgagaaacataagaagctgtacccatcatgtcgatttgttcagtcgcttaattcagtcaacaaccttgaggctacttcacaaccaaccttcccctcaagcgtgaccaattcaacccattcacttctgcctggaactgaaaactccggttacttcaggggctcatactccaactcgccgtccaaccctgtgaattcacgtgccaatcaagattttagcgcactgatgcgctccagctatcactgcgctatgaataatgaaaacgcacggctgcttaccttccaaacttggccgttgacctttctttcgcccaccgatctggcaaaggcaggattctactacatcggccctggggatagagtggcatgttttgcctgtggtggtaagttgtccaactgggagcctaaggacaacgctatgtcagaacatctgagacacttccctaaatgtcccttcatagagaaccaactgcaagacacctcccggtacacggtgagcaacctttccatgcaaactcacgcagctcggttcaagaccttctttaactggccttcatccgttctcgtgaacccagagcagctcgcctcggcgggattttactacgttggcaacagcgatgatgtcaaatgcttttgctgcgatggaggcttgaggtgttgggagagcggggatgacccatgggtgcagcacgccaagtggttccctcggtgcgaatacctgatccgaattaagggacaggaattcattagacaagtccaagcatcctacccacatctgctggagcagcttctttcgacttccgacagccctggagatgagaacgctgaaagctccatcatccattttgaaccaggtgaagatcattcagaggatgcaatcatgatgaataccccagtgattaatgcagcagtcgagatgggttttagccgctcgctcgtaaaacagactgtgcagaggaagattttggcgaccggggagaactaccggttggtgaacgatctggtgctggatcttctcaacgccgaagatgaaatccgggaggaagaaagagaaagggcgactgaagaaaaggaatcgaatgatctccttctgattaggaagaatcggatggcactctttcagcatctgacttgtgtgatccctattcttgattctctgcttactgcaggcatcattaacgagcaagaacatgatgtcattaagcaaaagactcagacttccctccaggcccgagaacttattgataccattctcgtcaagggcaatattgcagcaaccgtgtttcgcaactccctgcaggaagccgaggcggtgctgtacgaacatctgtttgtgcaacaagacatcaagtacattccgaccgaggacgtgtcagaccttccagtggaggaacagctgcgcaggctgcaggaagaacgcacctgtaaggtttgtatggataaagaagtgtcgattgtgttcattccttgcggacatctggtggtttgtaaggattgtgccccatcgctgcgcaagtgtcccatctgcaggtcgacgatcaagggcaccgtgcgcacgtttctttcc

SEQ ID NO: 32305 - DNA, 1812 bp, Artificial Sequence
  Description of Artificial Sequence: Synthetic coding sequence
atgaacattgtcgaaaattccatcttcctctccaaccttatgaagtccgcgaataccttcgagcttaagtacgatttgtcgtgcgaactgtatcgaatgtccacctactcgaccttcccggccggcgtgccggtgtcagaacggagcctggcaagagccggattctattacactggagtcaatgacaaggttaaatgcttttgttgcgggctcatgctggataactggaagcgcggcgactcccctaccgaaaagcacaaaaaactttaccccagctgcagatttgtgcagagcctgaactcggtgaacaacctggaagcaacttcccagccgaccttcccatcgagcgtcaccaactcaactcatagcctccttccaggaaccgagaatagcggatacttcagaggaagctactcgaactccccgagcaacccggtgaattcccgggctaatcaagacttctcggctctcatgcggtcgagctaccactgcgcaatgaacaatgaaaatgcccggctgctcaccttccagacttggccgttgactttcctttcgcctaccgacctcgcgaaggccggtttctactacattgggccaggcgatagagtcgcgtgcttcgcctgcgggggcaaactctcaaattgggaaccgaaggataatgcaatgtccgagcatctgcggcactttccgaagtgcccattcattgaaaaccaactgcaggacacttcacggtacaccgtgagcaatctgtcaatgcaaactcatgccgcgcggttcaagacgttcttcaactggccatcttccgtgctggtgaacccggaacaactggcctcagcgggcttctactacgtgggaaattcggacgacgtgaaatgcttttgctgtgacgggggcctgcggtgctgggaaagcggggatgacccgtgggtgcagcacgccaaatggttcccgcgctgcgaatacctcatccgcatcaaaggacaggagtttattcggcaggtgcaggcatcatacccccacctgctggagcagttgctctcgaccagcgactcaccgggagacgaaaatgcagaaagctcgatcattcacttcgagccgggagaagatcattcggaggacgccattatgatgaacactccggtgatcaatgcggccgtcgagatgggctttagccgctcgctggtcaagcaaaccgtgcagcgcaagatcctcgctaccggggagaactaccgcctcgtgaacgatctcgtgctcgatctgctgaacgccgaggacgagatccgcgaagaggagcgagagcgcgcgaccgaagagaaggagtcaaacgatttgctcttgatccggaagaacagaatggcgttgttccagcacctgacgtgcgtgatccccatactcgatagcctgctgactgcaggaattatcaatgaacaagagcatgacgtgatcaaacagaaaactcaaacctcactgcaggcacgggaactcatcgacactatcctggtcaagggaaatatcgccgccaccgtgttcaggaactcgctccaggaggcagaggcggtgctgtacgaacatctctttgtgcagcaggacatcaagtacatcccgaccgaggacgtctctgatctgcctgtggaggaacagttgcggcggctgcaagaagaacgcacttgcaaggtgtgtatggataaggaagtgtcgatcgtgttcatcccatgcggtcatctcgtggtctgcaaagactgcgctccgtccctccgcaaatgcccgatctgccgctcgaccatcaagggcactgtcagaactttcctctcc

SEQ ID NO: 32306 - DNA, 1812 bp, Artificial Sequence
  Description of Artificial Sequence: Synthetic coding sequence
atgaacatcgtggaaaactcaatcttcctgagtaacctgatgaagagcgctaacacttttgagttgaaatacgacctgtcctgcgagctgtacagaatgtctacttacagtacttttccagccggggttcccgtcagcgagcggagccttgcacgcgctggcttttattacacaggggtcaacgataaagtgaagtgcttttgctgcggactgatgttggataactggaaaaggggcgattctcccacggagaagcataaaaagctgtacccctcatgtcgcttcgtccagtcactcaatagcgtaaacaacttggaggctacatcacagcccacgttcccgtcttccgtgaccaacagcacacattccctgctgcccggcacagaaaacagcggatatttccgcggctcctatagcaattcacccagcaatcccgtaaactcacgggctaaccaggatttttccgccttgatgcgctcttcttaccactgtgcgatgaataatgaaaacgccagactcctgacattccagacctggcccctgactttcctgagcccaaccgacctcgccaaggctgggttttattatatcggtcccggtgacagagtggcctgttttgcgtgcggcggtaagctttccaattgggagccgaaagacaacgccatgagcgagcacctgcgacatttccctaagtgtccttttatcgagaaccagttgcaagacaccagcaggtacaccgtctccaatctcagtatgcagacgcatgctgccaggtttaagaccttctttaactggccatcatcagtcctggtgaatcccgaacagctcgcttccgcagggttttattatgtgggaaattccgatgacgtgaaatgtttctgctgcgacggaggactgagatgctgggaatccggcgacgatccatgggtgcaacacgccaaatggtttccacgatgtgaatatttgatacggattaaaggccaggagtttattcgccaggtgcaggctagttacccacacctgttggagcaactgctgagcacgtctgactccccaggcgacgagaatgcggagtcaagcatcatccacttcgagcccggagaagatcacagcgaggatgcaattatgatgaacacccctgtgattaatgccgccgtggaaatgggtttctcaagatcactcgttaagcagactgttcagcgaaagatacttgccacaggggagaactaccggctcgtcaatgacctggtgcttgacctcctgaatgccgaagacgaaattcgagaagaggagcgagagagggctacagaggagaaggaatccaatgatctgctcctgatacgaaagaataggatggcactgttccagcacctgacgtgtgtcatacctattctggactccctgttgacagcagggatcatcaatgaacaagagcatgacgttataaagcagaaaacccaaacctctctccaggctagggagctcattgacaccatactggtcaagggaaatattgccgctaccgtcttcaggaattctctgcaggaggcggaagcggtactgtatgaacacctctttgtgcagcaggacatcaaatacatacccactgaagatgtctctgacctcccagtcgaggagcaactgcggcggctccaggaagagaggacatgcaaagtgtgcatggacaaggaagtcagcatcgtgttcatcccctgtgggcacctcgtggtctgcaaggactgcgccccctcactgagaaagtgtcctatttgcagatctaccattaagggcactgtccgcactttcttgtca

SEQ ID NO: 32307 - DNA, 1812 bp, Artificial Sequence
  Description of Artificial Sequence: Synthetic coding sequence
atgaatatagtggaaaattcaattttcctctcgaaccttatgaagtccgctaacacttttgaactgaagtacgatttgtcctgcgaactttaccgtatgtccacttactcgacttttcctgctggagtgcctgtctccgaacgatcccttgcacgggcaggtttttactacaccggtgtgaacgataaggttaagtgcttttgttgcgggctcatgctggataactggaaaagaggtgactcacctactgaaaaacacaagaagctgtacccgtcttgccggttcgttcaatcgctgaactcggtgaacaatctcgaagcaacgagtcagccgacctttccctcgtccgttactaatagcacccacagccttctgcccggtaccgaaaactccggttacttccgaggttcgtattctaattcaccatcgaaccctgtgaactcccgcgctaatcaagatttttccgcacttatgaggtcatcgtatcactgtgccatgaacaatgagaacgcaagactgcttaccttccaaacttggcctctgacctttctgagcccgactgatcttgcaaaggcaggattttactacatcggtcccggcgatcgtgtggcctgttttgcatgtggaggtaagctgagcaactgggaacctaaggataatgcaatgtcggagcatcttcggcattttcctaaatgtccctttatcgagaatcaacttcaagatacttccagatacaccgtctcaaacttgtccatgcaaactcatgctgcccggttcaagacctttttcaattggccaagcagcgtgctggtcaaccctgagcaacttgcaagcgccggtttctactacgtgggtaacagcgatgatgtgaaatgtttctgttgcgatggcggtttgcgctgttgggaatcaggagacgacccttgggtccaacacgccaagtggttcccaagatgtgaatacctgattagaattaaggggcaagagtttatccgacaggtccaggcctcatacccacaccttttggaacagcttctctccacttccgattcccctggagatgaaaacgcggaatcaagcattatccatttcgagccgggggaagatcatagtgaagatgcaataatgatgaatacccccgtcattaacgcagcagtcgaaatgggtttctcgagaagcctcgtcaagcagaccgtccaacgaaagattcttgcaaccggagagaattatcggctcgtgaacgatctcgtgcttgacttgctcaacgcggaggatgaaattcgtgaagaggaaagagagagggcaactgaggaaaaggaatcgaatgatctcctgctgatcaggaagaatcgtatggccctcttccagcaccttacttgtgtcattcctattctggattcccttctcacggccggaatcataaacgaacaggaacacgacgttatcaagcaaaagactcagacttcgcttcaagcacgggaattgatagacaccattcttgtgaaggggaacatcgcagcaactgtgttcagaaacagcctgcaggaggcagaagcagtgctttacgagcatctgttcgtgcagcaagatatcaagtacattcccactgaagatgtctccgatcttccagtggaggaacaactgcgccgcctccaggaagaacggacctgcaaagtgtgtatggacaaggaagttagcattgtgttcattccatgcggacatcttgtggtttgtaaggactgcgcaccctccttgcgaaagtgtcctatctgtagatcgaccataaagggaaccgtgagaacttttctgagc

SEQ ID NO: 32308 - DNA, 1812 bp, Artificial Sequence
  Description of Artificial Sequence: Synthetic coding sequence
atgaacatagtggagaattccatcttcctatccaacttgatgaagagtgccaacaccttcgagctcaagtatgacctgtcctgcgagctttaccgcatgtccacctattcaacgttccccgctggcgtcccggtgagtgaaagatctctggccagagctggcttctattacactggagtgaacgataaggtgaagtgtttttgctgcggcctgatgctggacaactggaagaggggagattcccccacagagaaacacaagaaactgtacccatcctgtagatttgtccagtccctcaattcagttaataacctggaggccacttcccaaccaacctttcctagcagtgtgactaattccactcattcccttctgcctggcactgaaaacagcggttatttccggggaagctactccaactccccctctaatcctgtcaactcacgggctaaccaggatttttccgccctgatgcggtcttcctatcactgtgctatgaacaacgagaatgcccgtctgttaacctttcaaacttggccactgacattcctgtcccccacagacctagccaaggccggattttattatatcggtcctggcgatagggtcgcctgctttgcctgtgggggtaaactctctaactgggaaccgaaggacaatgctatgagcgagcatcttcgccacttccccaaatgccccttcatcgaaaatcagctgcaagatacatcccgctacaccgtatcaaacctttctatgcaaacacatgctgcccgattcaaaacatttttcaactggccctccagtgtcctagtcaatcctgagcagttagcatctgcagggttttactacgtgggcaattctgatgatgtaaagtgtttttgttgtgatggcggactgcgctgttgggagtccggcgacgatccctgggtgcagcatgcaaagtggtttccccgttgtgaatacctgatccggataaagggccaggaattcatccggcaggtgcaagctagttatccacacctactggagcagttgttgtcaacgtccgactcacctggggatgaaaacgcggaaagttcaatcattcattttgaaccaggcgaggatcactcagaagatgctattatgatgaacaccccagtgatcaacgcagctgtcgaaatgggtttttccagatccttggtaaagcagaccgtgcagcggaaaatcctcgccacaggtgaaaactatcgcctcgtgaatgacttggtgctggacctcctcaatgcagaggacgaaattcgggaggaagagagggagcgcgctaccgaagagaaggagtcgaacgatctcctgctgatcaggaagaatagaatggcccttttccaacatctcacgtgcgtcatccccatcctcgactctcttctgacagccggcataattaatgaacaagaacatgacgtgattaagcagaagacccagactagtctccaggcgcgggagctgatcgataccatcctggtgaagggaaatatcgcagccaccgtgttccgtaactcccttcaagaagctgaagctgtgctgtatgaacaccttttcgtacagcaggacatcaagtacatcccaactgaagatgtctccgatctgcccgtcgaggaacaactgcgaaggctgcaggaggaacgtacctgtaaggtgtgtatggataaggaggttagcattgtgttcattccatgcggccacttggtggtgtgtaaggactgcgcaccatctttgaggaagtgccccatttgccgatccaccatcaagggcacagtgagaactttcctaagc

SEQ ID NO: 32309 - DNA, 1812 bp, Artificial Sequence
  Description of Artificial Sequence: Synthetic coding sequence
atgaatatcgtggagaattcaatcttcctctctaacctcatgaaatccgcgaacaccttcgagttgaagtacgacctgtcgtgcgagctctaccggatgtcgacctacagcactttcccagcaggagtcccggtgtcggagcggtcgctggctcgcgcgggattctattacacgggagtcaatgacaaggtgaagtgcttctgctgtggactgatgcttgacaactggaagagaggtgattccccgactgaaaagcataagaagctgtacccttcctgccgcttcgtgcaatcactgaactcagtgaacaatctggaagcaacctcgcagcccaccttcccgtccagcgtgacgaattctactcatagcctcctgccgggaactgaaaacagcgggtacttcagaggctcctactctaattccccgtccaacccagtgaattcaagagccaaccaggatttctcggccctgatgagatcgtcctaccactgcgcgatgaacaacgaaaatgccaggctgctcactttccagacttggcctctgaccttcctttcccccaccgaccttgccaaagcgggattttactacatcggtcctggcgatagagtcgcctgcttcgcatgcggaggtaagctgtccaactgggaacctaaagacaatgccatgtccgagcatctgagacatttcccaaaatgtccctttatcgagaaccagctgcaagacacgtcgcgctacactgtctcgaaccttagcatgcagacccacgccgctaggttcaagactttcttcaactggccatcatcggtgctggtgaacccggagcagctggccagcgccgggttttactacgtcggaaatagcgacgatgtcaagtgtttctgctgtgacggaggtctgcggtgctgggaatcaggggatgatccgtgggtgcagcacgccaagtggttcccgcggtgtgagtatttgatccgcattaaagggcaagagttcatcagacaggtgcaagccagctacccgcatcttctggaacaacttctgagcacctcggacagcccgggagacgagaacgcagagtcatccatcatccattttgaaccaggagaggaccattccgaagatgccatcatgatgaataccccggtgatcaacgccgctgtggagatgggattttccagatcgctggtcaagcagaccgtgcaacgtaagattctggcgacgggagaaaactacaggctggtgaatgaccttgtcctcgatctcctcaatgcggaggacgagatccgggaagaagagagggaacgcgcaactgaggaaaaggagagcaatgacctcttgctcataaggaaaaaccgcatggcgctgttccaacacctgacttgcgtcatccctatcctggactcgctgctcaccgccggtatcatcaacgagcaggagcacgacgtgatcaagcagaaaacgcagacctcacttcaggcgcgcgagctcatcgatacgattctggtcaagggaaacattgccgcgactgtctttcggaactcgctgcaggaggcggaagctgtgttgtacgagcatctgttcgtgcagcaagatatcaaatacatccctaccgaagatgtcagcgacctgcccgtcgaagaacagctgcgcaggctccaggaagaacgcacttgtaaggtgtgcatggataaggaagtttccattgtgttcatcccctgcggccatttggtggtgtgcaaggattgcgctccgagcctgcgcaagtgtccaatttgtcggagcactatcaaagggaccgtgaggactttcctgtca

SEQ ID NO: 32310 - DNA, 1812 bp, Artificial Sequence
  Description of Artificial Sequence: Synthetic coding sequence
atgaacattgtggagaatagcattttcctgtctaatctgatgaagtccgccaacaccttcgagctaaaatatgacctgtcgtgcgaactttaccgtatgagcacctattccacgttcccggccggcgtgccagtaagtgagcggagtctcgcccgcgccggtttttattatactggcgtcaatgataaggtaaagtgcttttgctgtggcttgatgctggataattggaaaaggggagactcgccgacagaaaagcataagaagctatatccttcgtgccgatttgtgcagagtctgaatagtgtgaataacctggaggcgacttcgcagcccacctttccgtctagtgtaaccaactcgacgcacagcctgttgcccggcaccgagaattccggctatttccgaggctcgtattcgaactcgccatcgaaccctgtgaactcccgggcgaatcaggatttcagcgccctgatgcggtcttcttatcattgcgctatgaacaatgagaacgcgcgtctgctgacgttccagacttggccattgacttttctgagtcccacggatctcgccaaggctggtttctactacatcggcccaggcgatcgtgtagcatgcttcgcttgcggaggtaaactgagtaactgggaaccgaaggacaacgccatgtcggagcacttgcggcactttcccaagtgtccgtttatcgaaaaccaactgcaggacactagcagatacactgtctcgaatctgtcgatgcagacccatgccgcacgttttaagactttctttaactggccctcgagtgtgctagtgaacccagagcagttggcaagcgcgggattctactacgtcgggaactcggatgatgttaagtgcttctgctgtgacggaggtctccggtgttgggagagcggcgacgacccgtgggtgcaacacgcaaagtggtttccccgctgcgaatatcttatcaggataaaaggtcaggagtttatccgtcaagtccaagccagttacccgcatcttctggaacagctgctgagtacgagcgacagccctggcgatgagaacgccgagtcgagcatcatccatttcgagcctggagaagaccatagcgaggacgccattatgatgaatacaccagtgatcaatgccgccgtcgaaatgggattcagccgatccttggtgaaacagactgtacagcgcaaaatcctagctactggtgaaaactaccgccttgttaacgatctagtgctggacttacttaacgcagaggatgagatacgggaggaggagcgcgagagggctactgaggaaaaggagtctaacgatctgcttctcatccgtaaaaaccgcatggctctgttccagcatttgacctgcgtgatccccatcctcgactcactcctgactgcaggaattataaatgagcaagagcatgacgtaattaaacagaagacccagacctcgctgcaagcccgcgagctgatcgacaccatcctggtcaagggtaacattgctgccaccgtgtttcgcaacagtctccaggaggccgaggccgtcctatatgagcatttgttcgtgcagcaggatataaagtacatacctacggaggacgtgagtgatttgcccgtcgaagagcagctcagacggctgcaagaagagcgcacttgtaaggtgtgcatggacaaggaagtgagtatagtgtttatcccgtgcggccacctggtggtgtgcaaagattgcgcgcctagcctcagaaagtgcccaatctgtagatcgacgatcaagggcaccgtacggacgttcttgagt

SEQ ID NO: 32311 - DNA, 1812 bp, Artificial Sequence
  Description of Artificial Sequence: Synthetic coding sequence
atgaacatcgtggaaaactctattttcctgtctaacttgatgaagtcagcaaacaccttcgaactaaagtacgacctgtcatgcgagttatacagaatgtcaacttatagcaccttccccgctggagttcccgtgagcgagagaagtcttgctcgcgccggtttctactacaccggagttaatgacaaggtgaaatgcttctgctgcggcctaatgctagacaactggaaacgaggggattcgcccacagagaaacataaaaaactgtacccgagctgcaggtttgttcagagtctgaatagcgtgaacaatctggaagccacgagccagccaacatttcctagttctgtgaccaactccactcacagtcttctgcctgggaccgagaactctgggtacttccgaggatcttactcaaacagccctagcaaccccgttaactcaagagcaaatcaggacttttctgcactgatgcgtagtagctaccactgcgccatgaacaacgaaaacgcccgcctgttgacttttcaaacttggccattgacgttcctaagcccaactgatctggctaaagcaggcttctactatataggccctggtgatcgggttgcgtgtttcgcgtgcggtggtaagctcagcaattgggagccaaaagacaacgcaatgtctgaacacctccggcatttccccaagtgtcccttcatcgagaaccaactccaggataccagcagatacacggtctcgaatctttctatgcaaacccatgctgccagattcaaaacgttttttaactggcccagtagcgtgcttgtcaatccagagcaactagcttccgctggcttctactatgtcggcaatagcgatgacgtcaagtgtttttgctgtgatggcggcttacggtgctgggagagtggggatgatccttgggtccagcacgccaagtggtttccacgctgtgaatatctaattcgtatcaaggggcaggagtttatcagacaggtgcaggcttcctatccacacttgcttgagcagctcttatccacatcagactctcctggagacgagaatgccgaatctagcatcatacacttcgagcccggagaggaccactcggaggacgccataatgatgaacactcccgtaatcaatgctgcagtggagatgggatttagccgctcactggtaaagcaaacagtgcagagaaagatccttgcaaccggagagaattatcgcctagttaacgatctggtgttggacctgctcaacgcagaggacgagattcgggaggaagaaagggagcgcgctacagaggagaaagaaagcaacgaccttcttctcattagaaagaatcgcatggcacttttccagcacctcacttgtgtaattccaatcctagactccctgctaactgccgggattatcaacgagcaggagcacgacgtgatcaagcaaaaaacacagacaagcctgcaggctcgggaactgatagatacaatcctcgtgaagggaaacatcgccgcaactgtgttccggaattctttgcaagaagcggaggccgtcttgtatgaacacctttttgtgcagcaggacatcaaatatattcctactgaagatgtttcagaccttcccgtagaggaacagctgcgaaggctccaggaggagcgtacttgtaaggtgtgcatggataaagaagtcagcatagtgttcataccttgcgggcacctcgttgtttgcaaagactgcgctccctcccttcggaagtgtcctatttgccgatcaacaattaagggtacagtgaggacattcctctcc

SEQ ID NO: 32312 - DNA, 1812 bp, Artificial Sequence
  Description of Artificial Sequence: Synthetic coding sequence
atgaacattgtcgaaaatagtatatttctgtctaatctgatgaagtcagccaatactttcgaacttaaatacgacctgtcatgcgagctgtaccgcatgagcacttactccaccttccccgcgggagtgccagtgagcgagagaagcctggctcgggccggcttctactacacgggtgttaacgacaaagtgaaatgcttctgttgtggcctcatgttagataattggaaaaggggcgactccccaacagagaagcataagaaactatacccctcctgccggttcgtgcagtctttgaattctgtcaataacctggaagctacctcccagccaacctttccttcttctgtaacaaacagcacgcattctctcctccctggaactgagaactccggttacttccgtgggtcctactcaaattcaccctctaatccagtgaatagtagggccaaccaagacttttccgcgctgatgaggagctcataccactgcgctatgaataacgagaatgctaggcttctcacattccagacgtggccactcacctttctgtccccgaccgatctcgctaaagctgggttctactacatcgggcctggcgaccgcgtagcctgcttcgcatgtggggggaaattgtctaactgggagccaaaggacaatgccatgtcagagcatttaagacatttcccaaagtgtcctttcatcgaaaatcaacttcaagacacaagcaggtacacggtttccaatctgtctatgcagacccacgcagcccgcttcaaaacattctttaactggccatcgtctgtcctcgtgaacccggagcagctggccagcgctggcttctactatgttggtaactcagatgatgtgaagtgtttttgctgtgacgggggactgcgctgttgggaatcaggggatgatccttgggtgcagcacgctaagtggttccctcggtgtgagtacctcatccgcatcaagggccaggagtttatccgccaagtgcaggcatcctatccacacctccttgaacagttgctgtccacaagcgactctcctggtgacgagaatgccgaatctagtatcatccatttcgaaccgggggaagatcattccgaagacgccattatgatgaatactcccgtgatcaatgcggccgtggagatggggttttctaggtccctggtgaaacagaccgtccagagaaaaatacttgctaccggcgaaaactacaggttggtcaacgatttggtgctggatcttctaaacgctgaagatgagattagagaagaagagcgggagagagctacagaagaaaaagaaagcaatgatctgctgctgatcaggaagaacaggatggcacttttccaacacttgacatgtgtgattccaatccttgatagcctgctgacagcaggaatcatcaacgagcaggagcatgacgttattaaacagaagactcagaccagcttacaggctcgagagctgatcgataccatcctggtcaaaggaaatatcgcggccaccgtctttaggaatagcctgcaggaggccgaggcggtcctttatgagcatttgttcgtgcaacaagatattaaatatatcccgaccgaagacgtgagcgacctgccagtcgaggaacagcttaggagactccaggaggagagaacctgcaaagtgtgcatggacaaagaagtgtctatagtttttatcccctgcggtcacctcgtagtgtgcaaagattgtgctcccagcctgagaaagtgccctatctgccgctcgacaataaagggtactgtgaggacatttctgagc

SEQ ID NO: 32313 - DNA, 1812 bp, Artificial Sequence
  Description of Artificial Sequence: Synthetic coding sequence
atgaatatcgtggaaaactcgatctttctgtccaatcttatgaagagcgccaacaccttcgaactcaaatacgacctcagctgtgaactgtacagaatgagcacctactcgaccttccctgccggcgttcccgtttcagagagatccctcgcacgagcgggtttctactacactggtgtgaacgacaaggtgaaatgtttctgttgcgggctgatgctggacaattggaagcgcggcgattcccctaccgaaaagcataagaaactgtacccttcttgtcgatttgttcaatcactgaactctgtgaacaacctcgaagccacttcgcagccaaccttcccttcttccgtgacgaattccacgcattcgctgttgcccggcactgaaaacagcggctattttcggggctcgtactccaactccccgagcaaccccgtcaactcccgcgctaaccaggacttttcggcactcatgcggtcctcctaccattgtgcgatgaataatgaaaacgcaaggctgctgaccttccaaacctggccacttactttcctgtccccaactgatcttgcaaaagcaggcttttactacattggaccaggagatcgggtggcttgtttcgcctgcggaggaaagctctccaactgggaaccgaaagataatgcaatgtcggaacatctgcgacatttcccaaaatgtccctttatcgaaaaccaactgcaagatacctcccgctacaccgtgtccaatctgagcatgcagactcatgcggccaggtttaagacctttttcaattggccatcctcagtgcttgtgaaccctgaacagctggcatcggcaggtttttactacgtcgggaactccgatgacgtgaagtgcttctgctgcgatggagggctcagatgctgggaatctggagacgatccatgggtgcagcacgccaagtggttcccaaggtgcgaatatctgataagaatcaaaggccaggagtttattcggcaggtgcaggcttcgtaccctcatctgctggaacaactccttagcaccagcgattcacccggcgatgaaaatgcagaatcgtcgattatccattttgaaccgggtgaagatcatagcgaggatgcgattatgatgaacactcctgtcatcaacgccgcagtcgaaatgggttttagccgttcacttgtgaagcaaaccgtgcaacggaaaattctggcaaccggtgaaaactacaggcttgtgaacgatctggtgcttgaccttcttaacgcagaggacgaaatacgagaagaagagagggaacgagcgactgaggagaaggaatcgaacgacctccttctcattagaaagaatcgcatggccctttttcaacatctgacctgtgtgatcccaattcttgactcgctgctgaccgcaggtattatcaatgaacaagagcatgatgtcatcaagcaaaaaactcagacttccctgcaggcacgtgaacttatagataccatcctggtcaaggggaacattgccgccacggtgttccgcaactcattgcaggaagcagaagcggtgttgtacgaacacctgtttgtgcagcaagatatcaagtacattcctaccgaggatgttagcgacctccctgtggaagagcagctgcgtagactccaggaagaaagaacttgtaaagtgtgcatggataaagaggtgtcaattgtgttcattccctgtggacatctcgttgtgtgtaaagactgcgcaccctcccttaggaaatgtcctatctgtcggtcgaccatcaaaggtaccgtgcggaccttcctttcg

SEQ ID NO: 32314 - DNA, 1812 bp, Artificial Sequence
  Description of Artificial Sequence: Synthetic coding sequence
atgaatatcgtggaaaattccatcttcctctcgaacctcatgaagtcagccaatacgttcgagctcaaatatgacctgtcttgcgaattgtaccgcatgtcgacctatagcacgttcccggcaggagtgccagtttcagagcgatcgttggctagagccggcttttactacactggcgtgaacgataaagtcaaatgtttctgctgcggactgatgctggataattggaagcggggagactcaccaacggaaaagcataagaagctgtacccgagctgcaggttcgttcagtcactcaactctgtgaacaatctcgaagcaactagccaaccgaccttcccgtcgtccgtcaccaattcaactcactcgttgctcccgggaaccgaaaattcgggatacttccgggggtcgtacagcaacagcccttcgaacccggtgaactcccgcgcgaaccaggatttcagcgccctgatgcgctcatcttaccattgtgccatgaacaatgaaaacgcccggctgctgaccttccaaacttggccgctcactttcctgagcccgactgatctggccaaagccggcttctattacatcggacccggagatcgggtggcgtgtttcgcctgcggaggtaaactcagcaactgggagccaaaggacaatgcgatgtccgaacacctgaggcatttcccaaagtgtccgttcatcgaaaatcagctgcaagacacctcacgatacactgtcagcaatttgtccatgcagacccatgccgccaggttcaagacgttcttcaactggccatcgtccgtgctggtgaatcctgaacagctcgccagcgccgggttctactatgtgggtaattcggacgacgtgaagtgcttctgctgcgacggggggctgcggtgctgggaatccggcgacgatccatgggtccaacacgccaaatggttccccagatgcgagtacctcatcagaatcaagggacaggagtttatacgccaggtgcaggcgtcgtacccgcaccttctggaacagctcctgagcactagcgattccccaggagacgaaaatgccgaatcctccattatccatttcgaaccaggagaggaccatagcgaagatgctattatgatgaacacccctgtgatcaacgccgcggtggaaatggggtttagccggagcctcgtgaagcaaactgtccagcggaagatcctggccactggcgagaactatcgcctggtgaatgacctcgtccttgacctgctcaatgctgaggacgagatcagagaggaagaacgcgagcgcgcaactgaggaaaaggaatcaaacgatctcctgctgatccgcaagaaccgcatggcgctgttccagcacctgacctgcgtgatcccgatcttggactcgctgctgacggcgggaatcattaatgaacaagaacacgacgtgatcaagcaaaagactcagacttccctgcaggcgcgcgaacttattgatactatcctcgtcaagggcaacatcgcggcaaccgtgttcagaaattccctgcaggaggccgaggccgttctgtacgaacaccttttcgtgcaacaagatatcaagtacatccccactgaggacgtctcagacttgccagtcgaagaacagctgagacggctgcaggaagaacgcacttgcaaggtgtgcatggacaaggaggtgtctatcgtgttcatcccgtgcggacatctggtggtgtgtaaggattgtgcgccgagcctccggaagtgtccgatctgtcggtcaactatcaaaggaaccgtgcggaccttcctctcg

SEQ ID NO: 32315 - DNA, 1812 bp, Artificial Sequence
  Description of Artificial Sequence: Synthetic coding sequence
atgaatattgtcgaaaactcgatcttcttatcgaatctcatgaaatctgccaacactttcgaactcaagtacgacctctcgtgcgaactttatcgtatgtccacctacagcaccttccctgctggtgttccggtctctgagagatcattggcaagggcgggcttctactacacaggtgtcaacgataaggtgaagtgtttctgttgcgggctcatgctagataattggaagaggggcgattcccccactgaaaagcacaagaagctctacccatcatgcagattcgtccagtcactaaactctgtcaacaatctggaagcgacctcccaaccgaccttcccgtctagtgttaccaacagcacccattctctcttgccagggactgaaaactcgggctacttccgaggttcctattcaaacagtcccagcaaccctgtgaactcgagagctaaccaagatttttccgctctaatgcgtagctcttaccattgtgcaatgaataacgaaaatgccaggcttctcacgttccagacctggcctcttacctttctgtccccaacagacctcgcaaaagctggtttttactatattggtcccggagacagagtcgcatgtttcgcttgtggaggcaagttgagtaattgggagcccaaggacaatgcgatgagcgagcatcttcgacacttccctaaatgtccgttcatcgagaaccagttgcaagacacctctaggtacacagtgtcgaacctttcaatgcaaacgcacgccgctcgattcaagacctttttcaactggccctcttctgtgttggtaaatccagagcaacttgccagcgcgggtttttattacgttgggaactccgatgatgttaaatgcttctgctgtgacggcgggctcaggtgctgggagtcgggcgatgatccttgggtccagcacgcaaagtggttcccacgttgtgagtatctgatcaggataaaggggcaagagttcatacgccaagtccaagcttcctatccccacctgcttgagcaactgctctcgacctccgattcgcccggagatgagaacgcagaatcatctatcatacattttgagccaggcgaagatcactcagaggatgctatcatgatgaacacaccggttatcaatgccgcagtggagatgggcttctcacgttcccttgttaagcaaacagttcagcgtaagatcttggctaccggtgagaattatcgattagtaaatgatctcgtcttagatctgttgaacgcagaggatgagatcagagaggaggagcgtgaacgggcgacagaggagaaggaatcgaacgatctactcttgattaggaaaaaccgcatggctttgttccaacatcttacttgtgtcatcccgatcctcgactcgttgctaacggccggcatcatcaatgaacaggaacatgacgtgatcaaacagaagacgcaaacgagtctgcaagctcgtgagttgatagataccattctagttaaaggaaatatagcagcaaccgttttccgaaacagcctacaagaagccgaagcggtcttgtacgaacacctttttgtacagcaagatatcaaatatataccgacagaggacgtaagcgatctccccgtggaagagcagctcaggcgtttacaggaggaacgtacatgtaaggtgtgcatggacaaggaggttagtattgtgttcattccgtgcggacatttagtagtctgcaaagactgcgccccctcactgcgaaagtgcccgatctgtaggagcaccataaagggaacggtccgtacctttctgtca

SEQ ID NO: 32316 - DNA, 1812 bp, Artificial Sequence
  Description of Artificial Sequence: Synthetic coding sequence
atgaacatcgtcgaaaactccatcttcctctcaaatctgatgaagtcggcgaatacgttcgaactcaagtacgacctgtcctgcgagctgtaccggatgagcacttactccacgtttccggccggcgtgccggtcagcgagagatcacttgcacgcgctggcttctactacacgggagttaatgataaggtgaagtgtttctgctgtggactgatgctcgataattggaagcgcggcgacagcccgaccgaaaaacacaaaaaactgtacccatcatgcaggttcgtccaatctctgaactcagtgaataacctcgaagcaacttcccagcctacttttccaagcagcgtcacgaactctacccactcgctgctgccaggcactgaaaattcaggctattttcgaggatcgtactccaactccccgtcgaatcccgtgaactcgagagctaaccaagatttctccgccctcatgcggagcagctaccactgcgcaatgaacaacgagaacgcccgcttgctcaccttccagacctggccgctgacgttcctctcccccaccgacttggccaaggctggcttttactacatcggacccggcgaccgcgtggcctgcttcgcctgcggcggaaaactgtccaactgggagccaaaggacaacgccatgagcgaacacctgagacacttccccaagtgccccttcattgaaaatcaactccaggacacttccagatacaccgtgagcaacctctcaatgcagactcatgcagccagatttaagaccttctttaactggccgtcctcagtcctggtgaaccctgaacaactggcctcggcgggattttactacgtcggtaactcggatgacgttaagtgcttttgctgtgatggtggacttcggtgctgggagtcgggagacgatccgtgggtgcaacacgccaaatggttcccgaggtgtgagtacctgatccgcatcaaaggccaggaattcatccgccaggtccaagcctcgtacccacacctgctggaacagctgctgtccaccagcgattcccctggagacgaaaatgccgaatcatcaatcatacatttcgaaccaggagaagatcatagcgaggatgcaatcatgatgaacaccccggtcatcaacgcggctgtggaaatgggattttcccgcagcctggtcaagcagaccgtgcaacggaagatcctcgccaccggagaaaactaccgcctggtgaacgacctggtgttggatctcctcaatgccgaggatgagatccgcgaggaggagcgtgaacgggcaaccgaagagaaggagtcgaatgacctgctgctgatcagaaagaaccgcatggcccttttccagcatctgacctgcgtcatccctattttggactcattgctgaccgctggtattatcaacgagcaggagcacgacgtcattaaacaaaaaacccagaccagtttgcaggcgcgggaactcatcgatacgatcctggttaagggtaatatcgctgcgactgtattcaggaatagcctgcaggaagccgaggcggtcctctacgaacatctctttgtgcaacaggatatcaagtacatcccgaccgaggacgtcagcgacctgccggtggaggagcagttgcggcgcctgcaggaggagcgcacctgcaaagtgtgtatggataaagaagtatcaatcgtgttcatcccttgtggccaccttgtggtctgtaaggactgtgccccgtcactgcggaaatgcccgatctgccgctccaccattaaggggaccgtgaggaccttcctgtcg

SEQ ID NO: 32317 - DNA, 1812 bp, Artificial Sequence
  Description of Artificial Sequence: Synthetic coding sequence
atgaacattgtggaaaactccatattcctttccaatctgatgaagagcgctaacacattcgagctcaagtacgacctcagctgcgagctgtataggatgagtacttacagtactttccctgcaggagtgcccgtgtccgaaaggagcttagctagagcagggttctactacacaggagtaaacgacaaggtaaagtgcttctgttgtggtctgatgttggacaactggaaaagaggtgattccccgaccgaaaagcataaaaagctctacccatcttgccggtttgtccaatctcttaacagcgtaaacaatctcgaggctaccagccagcccacttttccctcttccgttacaaatagtacacattccctcctgcctggcaccgaaaactccggctacttccgcgggtcctatagtaactcgccctcgaatcccgtcaacagtagagctaaccaggatttcagtgccttaatgaggtctagctatcactgcgcaatgaataacgagaatgcgagattactcacttttcagacttggccactcacattcctaagtccaacggatttggccaaggccgggttttattacatagggcccggcgatcgtgtcgcttgctttgcgtgcggcggcaaactctcaaattgggagccgaaagacaatgccatgtcggaacaccttaggcatttccccaaatgcccattcatcgaaaaccaactgcaagacacctcacgatacacagtgtctaacctcagtatgcaaacgcacgccgctcgattcaaaacgttttttaattggccctccagcgtgctggttaaccccgagcagttggcctccgccggcttttattacgtgggcaatagtgacgatgtgaaatgtttctgttgcgacggggggctccgatgttgggaatccggcgacgacccctgggttcagcacgctaagtggtttccgcggtgcgagtatcttattcgcattaaaggccaggagttcattaggcaggttcaggcctcatacccccatctgctagagcagctcctttcgaccagcgattcgcctggcgacgaaaacgccgagagcagtataatccatttcgagcccggggaggaccacagtgaggatgctattatgatgaacacgcctgtgattaatgcagcagtggaaatggggttctccagatcccttgtcaagcaaactgtgcagcgaaagattctggccacaggagagaattatcgattggttaacgacctcgtcctcgatctgctgaacgctgaggatgagatccgggaggaggaacgggaacgggctactgaggagaaggagagcaatgacctgttgcttatcaggaagaatagaatggctttattccaacatttaacatgtgtgatccccattctggacagtctactgaccgcaggtattatcaatgaacaggagcatgatgtcatcaaacagaagacccagacttctctgcaggctcgggagcttatcgatactatattagtcaagggcaacattgccgccaccgtttttaggaattcactacaggaagccgaggccgtgctctacgagcacctcttcgtacagcaggacatcaagtacatacccaccgaggatgtcagcgatctgcctgtagaggagcagctaaggaggttgcaagaggaacgaacatgcaaagtgtgtatggataaagaggtctctattgttttcataccatgcggtcatttggtagtctgtaaagattgcgccccttctttacgaaagtgcccaatttgcagatccaccattaaagggaccgtgaggacctttctgtcc

SEQ ID NO: 32318 - DNA, 1812 bp, Artificial Sequence
  Description of Artificial Sequence: Synthetic coding sequence
atgaatatcgtggaaaactcaatctttttgagcaatctgatgaagtcggccaacaccttcgaactgaagtacgacctgtcatgcgagctttataggatgtcgacttactcgacctttccggcaggagtccctgtcagcgagcggagcctggcgcgcgccggcttttactacactggagtgaacgacaaggtgaaatgcttttgttgtggattgatgctcgataactggaagcggggcgattcccccacggagaagcataagaaactctacccgtcgtgcagattcgtgcagtcgctgaactcagtcaataacctcgaggccacctctcaaccaaccttcccgtcatcggtgactaactccactcactcactgctccccggcaccgaaaacagcgggtacttcagggggagctactcgaactcgccgtctaaccctgtcaattccagggcgaaccaggatttctcagccctgatgcgctcctcgtaccactgcgctatgaataacgaaaatgctcgcctgctgaccttccagacctggccactgacttttctctcaccgactgatctggccaaggctggattctactacatcggaccgggcgaccgcgtggcttgctttgcgtgtgggggcaagctctctaactgggagccgaaggacaacgcgatgtcagaacacttgcgccatttcccaaagtgtccgttcatcgagaaccaactgcaggatactagccggtataccgtgtccaacctgtcgatgcagacccacgcggccagattcaagaccttcttcaactggccgtcgtccgttctggtgaatccggaacagcttgcctccgcgggattctattacgtgggaaatagcgatgacgtgaagtgcttctgctgtgacgggggactgcgctgctgggagtcaggggatgacccttgggtccaacatgcgaagtggttcccacgctgcgaatacctcatccgcattaaaggccaggagttcatcagacaggtccaggcatcatatccacatctcctggagcaactcctctccacgtccgactcccccggcgatgagaacgcggaatcaagcattatccacttcgaaccgggcgaagatcactcggaagatgccattatgatgaacaccccggtgataaacgcagcagtggagatgggattttcgcgctcactcgtcaagcaaaccgttcaacgcaaaatccttgctaccggagaaaactaccgccttgtcaatgatcttgtcctggacctgctgaacgctgaggatgaaatcagagaggaagagcgggagagagcaacggaagagaaggagagcaacgacctgctgctcatccgcaagaaccggatggcactgttccaacacctcacttgcgtgatcccaatccttgactccctgctcaccgccggaatcatcaacgaacaggagcatgacgtgatcaagcagaaaacgcaaacgtcactccaagctcgggagctcatcgacaccattttggtcaagggaaatatcgccgccaccgtctttcgcaactctctgcaagaagccgaagccgtgctgtacgaacacctgttcgttcagcaagatatcaagtacatcccaactgaggacgtctccgatctgccagtggaagaacaactgcggcggctccaagaggaacggacttgtaaagtctgtatggataaagaagtgagcatcgtgttcatcccctgcggccatctggtggtgtgcaaagactgcgccccgtcactgaggaaatgcccgatttgccggagcaccatcaaggggactgttcggacttttctgtcg

SEQ ID NO: 32319 - DNA, 1812 bp, Artificial Sequence
  Description of Artificial Sequence: Synthetic coding sequence
atgaatatagtggagaattccatcttcctcagtaatcttatgaagagtgccaatacatttgaactcaagtatgacctgtcttgtgaattgtaccgcatgagcacgtatagcacgttccccgctggagtgccggtctcggagaggtctctggcgagggcaggcttctattacaccggggtgaacgataaagtgaaatgcttctgctgtgggttaatgctcgacaactggaagcgcggcgacagtcccaccgagaagcacaaaaagctctatccctcttgccgattcgttcaatctttaaatagcgtcaataacctcgaggccacaagtcagccgacctttcccagttctgtaaccaacagtactcactctctgctgccaggaacggaaaatagtggctattttcggggatcttacagcaattccccttctaacccagtgaacagccgcgcgaaccaggacttctcagctctgatgaggtcctcataccattgcgccatgaacaacgagaacgcaagactgttgacttttcagacctggccactgaccttcctctctcccactgacttggcaaaagctggcttctactacattgggccaggcgaccgcgttgcatgcttcgcgtgcggcggaaaattgagtaattgggaacctaaagataatgccatgtccgagcatttgagacacttccctaagtgtcccttcatagagaaccagctccaagacactagccgttatacagtcagcaatctgtctatgcaaactcacgccgcgcgttttaagactttttttaactggcccagtagcgttcttgtgaaccccgagcagctcgcctctgccggattctactacgtgggtaacagtgacgatgtaaagtgcttttgctgtgatggtggcctccggtgttgggaatccggcgatgatccgtgggtacagcacgccaagtggttcccacgttgcgaatatctgattaggatcaagggacaggaattcattcgccaggtgcaagcctcctacccccatctgctagaacagttgctgtctacgtccgattcccctggcgatgagaacgccgaatcgtccatcattcatttcgaacctggggaggatcattccgaagatgccattatgatgaacactccagtgattaatgccgcagtggagatgggtttcagccggtctttggtcaagcaaaccgtgcagcgaaagattctggcaacgggcgaaaactataggctcgtgaatgatctggtgcttgacctactcaatgccgaagacgagatcagggaggaagaacgggaacgagctaccgaggagaaagagtctaatgatctcctgctgatccggaagaaccgtatggccttattccagcaccttacttgtgtgattcctatcttggattccctcttgactgccggcatcataaacgagcaagagcatgatgtaatcaagcaaaagacacagactagcctgcaggcccgggaactcattgacactatcctcgtcaaaggaaatatcgcagcaaccgtcttccgcaattccctgcaggaggctgaagcggtgctttatgagcatttgttcgttcaacaggatatcaagtacatcccaactgaagatgtgtccgatctgccagtcgaggagcagttacgacggctccaagaggaacggacttgtaaggtgtgcatggacaaggaggtctcaatagtattcataccgtgtggccacttggtggtgtgtaaggactgtgctccttcattgagaaagtgcccgatttgccgcagcacaattaaggggaccgtcaggaccttcctgtcc

SEQ ID NO: 32320 - DNA, 1812 bp, Artificial Sequence
  Description of Artificial Sequence: Synthetic coding sequence
atgaacatcgtggagaattccatctttctctctaatctgatgaagagtgccaacacctttgaactgaaatacgacctgtcttgcgaactgtacaggatgagcacttactccacatttcctgccggcgtgcccgtgagcgagcggagtctggcacgggctggcttttactataccggcgtgaatgataaggtcaaatgcttttgctgtggacttatgctggacaactggaaacgcggagatagcccaacggagaagcacaagaagctgtatccatcctgccggttcgtgcagtctcttaacagcgtaaataacctggaagccactagtcaacccacgttcccgtccagtgtaacgaatagcacacactcgctgctgcccggtactgagaatagtggctattttcggggatcatacagcaattctccttctaatcccgtgaacagtcgcgccaaccaagacttctccgctttgatgcgatcgtcttatcactgtgccatgaacaatgaaaacgcgcgcttgttgacctttcaaacgtggcccttaacctttttgtctccgactgacctggcaaaggctggattctactacataggacccggggacagggtagcttgctttgcatgcggcggcaaattgtcaaattgggagccaaaagacaacgctatgtccgaacatttacggcactttcctaagtgcccttttatcgagaaccaactccaggacacatccaggtacacagtgagcaacctcagcatgcagacacatgccgccagattcaagacattcttcaattggccttcttctgtcctcgtgaatcccgagcaactcgcgagcgccgggttctattatgttggtaattcagacgatgtgaagtgtttctgctgcgacggcggccttcgatgctgggaatccggagatgacccttgggtgcagcacgctaagtggtttcccagatgtgagtatctgattcgaatcaagggccaggagtttatcaggcaagtgcaggcttcctatccacacctccttgagcagctgctgtctacaagtgactcaccaggcgatgagaacgccgaatcttccataatccacttcgagcccggagaggatcactctgaggatgctatcatgatgaacacccctgtgataaatgctgcagtagagatgggcttctcccgctcgttagttaagcaaacggtccaacgcaaaatcctggcgactggcgaaaactatcgtttagtgaatgaccttgttcttgacctgcttaatgctgaagacgagatacgggaagaagagagggagagagctacggaagaaaaagaatcgaatgatctgcttctgatcagaaaaaatcgaatggccctttttcagcacctgacttgcgtcattccaatactggatagccttcttacagccggcatcattaatgagcaagaacacgacgtaattaaacagaagactcagacatctttgcaggcccgcgagctaatcgacacaatccttgtcaaaggcaacatcgctgccaccgtgttccggaattccctccaggaagcggaggcagtgctttatgagcatctatttgtgcaacaggacatcaaatacatccctaccgaagatgtaagtgatctgcctgttgaagagcaactcaggaggctacaggaagaacggacatgcaaggtttgcatggacaaagaagtttccattgtgttcattccctgcgggcaccttgtggtatgtaaagactgcgctccctccctgcggaaatgccctatctgtcggtccacgattaaagggaccgtccgcaccttcctgagc

SEQ ID NO: 32321 - DNA, 1812 bp, Artificial Sequence
  Description of Artificial Sequence: Synthetic coding sequence
atgaatatagtagaaaattcgatatttctatcgaatttaatgaaatcggcgaatacgtttgaactaaaatatgatttatcgtgtgaactatatcgaatgtcgacgtattcgacgtttccggcgggtgttccggtttcggaacgttcgctagcgcgtgcgggtttttattatacgggtgttaatgataaagtaaaatgtttttgttgtggtctaatgctagataattggaaacgtggtgattcgccgacggaaaaacataaaaaattatatccgtcgtgtcgttttgtacaatcgttaaattcggtaaataatttagaagcgacgtcgcaaccgacgtttccgtcgtcggtaacgaattcgacgcattcgttactaccgggtacggaaaattcgggttattttcgtggttcgtattcgaattcgccgtcgaatccggtaaattcgcgagcgaatcaagatttttcggcgctaatgcgttcgtcgtatcattgtgcgatgaataatgaaaatgcgcgtctactaacgtttcaaacgtggccgctaacgtttttatcgccgacggatctagcgaaagcgggtttttattatataggtccgggtgatcgagttgcgtgttttgcgtgtggtggtaaactatcgaattgggaaccgaaagataatgcgatgtcggaacatttacgacattttccgaaatgtccgtttatagaaaatcaattacaagatacgtcgcgatatacggtatcgaatttatcgatgcaaacgcatgcggcgcgatttaaaacgttttttaattggccgtcgtcggtattagtaaatccggaacaattagcgtcggcgggtttttattatgtaggtaattcggatgatgttaaatgtttttgttgtgatggtggtctacgatgttgggaatcgggtgatgatccgtgggttcaacatgcgaaatggtttccgcgatgtgaatatctaatacgtataaaaggtcaagaatttatacgacaagtacaagcgtcgtatccgcatttattagaacaactattatcgacgtcggattcgccgggtgatgaaaatgcggaatcgtcgataatacattttgaaccgggtgaagatcattcggaagatgcgataatgatgaatacgccggtaataaatgcggcggtagaaatgggtttttcgcgttcgttagtaaaacaaacggttcaacgtaaaatactagcgacgggtgaaaattatcgattagtaaatgatctagttctagatttactaaatgcggaagatgaaatacgtgaagaagaacgagaacgagcgacggaagaaaaagaatcgaatgatttattattaatacgaaaaaatcgaatggcgctatttcaacatctaacgtgtgtaataccgatattagattcgttactaacggcgggtataataaatgaacaagaacatgatgtaataaaacaaaaaacgcaaacgtcgttacaagcgcgagaactaatagatacgatattagttaaaggtaatatagcggcgacggtttttcgtaattcgttacaagaagcggaagcggttttatatgaacatttatttgtacaacaagatataaaatatataccgacggaagatgtatcggatttaccggtagaagaacaactacgtcgtttacaagaagaacgaacgtgtaaagtttgtatggataaagaagtatcgatagtttttataccgtgtggtcatctagtagtttgtaaagattgtgcgccgtcgctacgtaaatgtccgatatgtcgttcgacgataaaaggtacggttcgaacgtttttatcg

SEQ ID NO: 32322 - DNA, 1812 bp, Artificial Sequence
  Description of Artificial Sequence: Synthetic coding sequence
atgaacatcgtggagaactctattttcttgtcaaatctcatgaagtccgctaacacgttcgagctcaagtacgacctctcatgcgagctctatcggatgagcacctactcgaccttcccggctggagtcccagtgtcagagcgaagtctggcccgggcgggtttctactacaccggagtgaacgacaaggtgaagtgtttctgctgcggtctgatgctggataactggaagagaggggactccccaactgaaaagcacaaaaagctgtacccgagctgccggttcgtgcagtccctgaattcagtgaataacctggaagccacctcgcaacctactttcccatcgtctgtgaccaattcgacccactcgcttctgcccggtaccgaaaactccggctacttccgtggatcctacagcaattcgccatccaacccggtgaactccagggctaatcaagacttttcagctttgatgcggtcatcctaccactgcgccatgaacaacgagaacgcccggcttcttactttccagacctggcctctcactttcctctccccgaccgacctcgcaaaagcaggattctactacatcggaccaggggaccgggtggcttgtttcgcttgcgggggaaaactgtccaattgggagccgaaggataatgccatgtccgagcacctccgtcatttccctaagtgtccattcatcgaaaaccagctccaagacacttctcgctacacggtgagcaacctgtcgatgcaaacccacgccgctagattcaagacctttttcaattggccgtcgtcagtgctcgtgaaccccgagcaactggctagcgcgggcttttactacgtgggaaacagcgatgacgtgaaatgcttctgttgtgatggcggattgcgctgctgggagtcgggggatgatccctgggttcagcacgcgaaatggtttccccgttgtgagtacctgattcggatcaaagggcaggaattcattcggcaagtgcaagcctcgtacccacacctgctcgaacagctgctttccacgtccgatagcccgggggatgaaaatgcggagagctcgatcatccatttcgagccgggagaggaccattccgaagatgccatcatgatgaacactcccgtgattaacgccgccgtggagatgggattctccagatcgcttgtgaaacaaactgtccaaaggaagattctggcgaccggagagaattacagactggtcaacgacctcgtgctggacctgcttaatgccgaggacgaaatccgcgaggaagagcgcgagagagcgaccgaagaaaaagaatcgaacgatctgctgctgattagaaagaaccggatggccctgttccagcacctcacttgcgtcatcccaatactcgactcacttctgactgccggaatcatcaatgaacaggaacacgatgtgattaaacaaaagacccaaacctcgctgcaagcgcgtgaactgatcgacactatcctggtcaagggcaatatcgctgcgaccgttttcagaaacagcttgcaggaagcagaagcagtcttgtacgaacatttgtttgtgcagcaggacatcaagtacatcccgaccgaagatgtgtccgacctcccggtcgaggagcaactgcgcagactgcaggaagaacgcacctgcaaggtgtgcatggacaaggaagtatcgatcgtgttcattccgtgcggacatctggttgtgtgcaaggactgcgcccctagcctgcggaaatgcccaatctgccgcagcaccatcaagggcaccgtgaggacctttctgtcg

SEQ ID NO: 32323 - DNA, 1812 bp, Artificial Sequence
  Description of Artificial Sequence: Synthetic coding sequence
atgaacatcgtggagaactccatcttcctgagtaatcttatgaagagtgctaatacctttgagctgaagtacgatctctcttgcgagctttacagaatgagcacgtatagtactttcccagctggtgtaccggtgtccgagcgttccctggcccgcgctggcttttactacactggagtgaacgacaaggtgaaatgcttttgctgtggtttgatgctggataactggaagcgcggggatagtcccaccgaaaagcacaagaaactctacccaagctgccgcttcgttcaatctctcaacagcgttaataatttggaagcgaccagccaacccacctttccctcttctgtgacaaactcgacccattctttattgccaggcaccgagaactctggatattttagaggaagctattcaaactcaccaagcaatccagtgaattctcgcgctaaccaggattttagtgccctcatgagaagctcttaccattgcgctatgaataacgagaacgcccggcttctgacttttcagacatggccacttactttcctttccccaacagatcttgcaaaggcgggtttctactatattggacccggcgatagggtggcatgttttgcttgtgggggcaaactgagtaactgggagcctaaagacaatgcaatgtccgagcacctgagacacttccctaaatgcccgttcatcgagaaccagttgcaggacacttctaggtacacggtcagtaacctgtctatgcaaacacatgccgccagatttaaaaccttcttcaactggccttctagtgtgctcgttaaccctgagcaacttgcaagtgcaggcttttactatgtgggtaactccgacgacgttaagtgtttctgctgtgacgggggtctgcgctgctgggagtccggagacgatccttgggtgcaacacgcgaaatggttccccaggtgtgagtacctgatacggatcaaaggccaagagttcatcagacaggtgcaagcgtcttacccacatctccttgagcagctgctgtctacatctgattcccccggcgatgaaaacgcggagtcgtcaatcattcattttgagcctggagaggatcatagtgaggatgctattatgatgaacaccccagtcatcaacgcggccgtggagatgggattctctcggagtctagtcaagcaaaccgtgcaaagaaaaatcctcgctaccggagagaactaccgtctcgtaaacgatctggtgctggacctgctgaatgctgaggacgagatcagagaggaagaaagagagagggcgaccgaggaaaaggagtctaacgatcttctgctcatccgcaagaatcggatggccctcttccagcatctgacatgcgtgatccccatcctggattccttgctgactgccggaattataaacgagcaagaacacgacgtgattaaacagaagactcagacatctctccaggccagagaactgattgacacaatactggtcaaaggcaacatagccgctaccgtgttccgcaattctctccaggaagcagaggctgtgctgtacgaacatttgtttgtgcagcaagacatcaagtacatccccaccgaggatgttagtgacctgccggtggaggagcagttacgtaggcttcaagaagaacgaacatgtaaggtctgcatggacaaggaagttagtatagtcttcattccctgcggccaccttgttgtttgtaaagactgtgcaccatcactgagaaagtgtcccatatgccgcagcactataaaagggactgtgaggacatttctgtca

SEQ ID NO: 32324 - DNA, 1812 bp, Artificial Sequence
  Description of Artificial Sequence: Synthetic coding sequence
atgaatatagtggaaaactccatcttcctatccaaccttatgaagtctgctaacactttcgaactcaaatatgacttgtcatgtgaactgtatcgcatgagcacatatagcacgttccccgcgggagtccctgtgtccgaaaggagcctcgcccgagctgggttctactacaccggtgtgaacgataaggtgaagtgcttctgttgtggtctcatgctggataattggaaaagaggggactcccccaccgagaagcataaaaagctgtacccttcatgccgatttgttcagtccctcaactccgtgaataatttggaagcaacatcacagccgacttttcctagctctgttactaacagcacccactccctccttcccggcaccgaaaattctggttactttcgggggtcttactctaactccccctccaacccagtgaactcgagggcgaaccaagatttctcagcactcatgcgaagcagttaccactgcgccatgaacaatgaaaacgccaggctgcttacctttcaaacttggcctttgaccttcctgagccccacagacctcgccaaggccggcttttattatattgggccaggagatcgcgtagcgtgcttcgcatgtggtgggaagctcagcaactgggaaccaaaggacaatgccatgagcgaacatctgagacattttcccaagtgtccctttattgagaaccagctgcaggatacatctagatacactgtgtccaacctgtcaatgcagacacacgctgcgagatttaaaacgttctttaactggcctagcagcgtgctggtgaatccagaacagctggcgtcagctggattttactacgtcggtaattcagacgacgttaaatgtttctgctgtgacgggggccttaggtgttgggagtccggtgacgatccttgggtgcagcacgcgaaatggttcccaagatgcgaatacctcatccgaattaagggacaggagttcatcaggcaggtacaggcttcctatccccatctccttgaacagttactgagtacttcagacagccccggcgacgaaaatgctgaatccagtattatccatttcgagccaggtgaagaccactcagaggatgccatcatgatgaatactccagtcatcaacgctgccgtggagatgggtttcagccgaagcctggtgaaacagactgtccaacgaaagatcttggccactggcgagaattaccgcctggtgaacgacctcgtgttggatctgttgaatgctgaagatgaaatcagggaggaggaaagggaacgagcaactgaagaaaaggaatcaaacgacctgttgctgattcgcaaaaacagaatggcactctttcagcacctgacttgtgtgataccaatcctggactcgctgcttactgcagggattattaatgaacaggagcacgatgttatcaaacagaaaacacagaccagtctccaggctagagagttgattgacaccatcctagtcaaaggtaacattgccgccaccgtgttcaggaactccctacaggaagccgaagcggtgctctacgaacacctgttcgtgcaacaagacattaaatacataccaaccgaagacgtttcagacttgcctgtagaagaacagctgaggaggcttcaggaagagcgcacctgtaaggtgtgtatggacaaagaagtaagcattgtttttataccgtgcgggcacctggtggtctgcaaggactgcgctccctccctcagaaagtgcccaatatgtagatccaccatcaagggcactgttagaacctttctgtca

SEQ ID NO: 32325 - DNA, 1812 bp, Artificial Sequence
  Description of Artificial Sequence: Synthetic coding sequence
atgaacattgtggagaactcgatttttctgtcgaacctgatgaagtcagcgaatacctttgagttgaaatatgatctttcgtgcgaactgtaccgcatgagcacctactccacttttcctgcaggtgtgccagtgtcggaacgctccctggcacgagcaggattctattacactggagtgaacgataaagtgaagtgcttttgttgtggccttatgcttgataactggaagagaggtgactcgcctactgagaagcacaaaaaactgtacccttcctgtcgcttcgtccagtccctcaactcggttaacaaccttgaggcgacttcgcagccaacctttccatcatcggtgactaattcgactcacagcctcctgcccggaaccgaaaactcggggtactttaggggttcctactccaactctccgtcgaatcctgtgaactcacgggcaaaccaagatttttccgcactgatgaggtcatcgtaccactgtgccatgaataacgagaacgcaaggcttctgaccttccagacctggccactgacctttttgtccccgactgatctggcgaaagctggattctactacattggtccaggagatagggtcgcatgctttgcatgtggaggaaagctgtctaactgggaaccaaaagataacgccatgtcagagcatttgagacactttcccaaatgtccattcattgaaaaccaactgcaggatacttcgaggtatactgtgtccaacctctcaatgcagacccatgcggcacgctttaagaccttctttaactggccatcctcggtccttgtcaatccagaacagctggcaagcgctggcttttactacgtgggcaatagcgatgatgtgaagtgtttttgctgtgatggcggacttcgctgttgggaatctggtgatgacccttgggtccaacatgccaagtggtttccgcggtgcgagtacctgatccgcataaagggacaagaattcattcgtcaggtgcaagcctcatacccccacctgctggagcagctccttagcacttcggattcaccaggagatgaaaatgcagagtcgtccataattcatttcgaacctggagaggatcactcagaggacgccattatgatgaataccccagtgatcaacgccgcagtggaaatggggttttcacgatcacttgtgaagcaaactgtgcagagaaagatccttgccactggtgagaattaccgtcttgtgaacgacctggtgctcgacctgcttaatgccgaagatgaaattcgggaagaagaacgtgaacgtgccaccgaagaaaaggaatccaacgatctcctgttgattagaaagaaccgcatggcgttgtttcagcaccttacttgtgtgatcccaatccttgactcgctccttacggccggtatcattaacgagcaagaacatgatgtcataaagcagaaaacccagacctctctccaggcaagggaacttatcgacaccatcctcgtgaaaggtaacatcgctgccactgtctttcgcaactccctgcaggaagcggaagcggtcctttacgagcatctgtttgtgcagcaggacattaagtatatacctaccgaagatgtctcagatcttcccgtcgaggaacaacttcgcagactccaggaggagaggacctgtaaggtgtgtatggacaaggaagtcagcatagtgtttattccatgcggtcatctggtcgtgtgtaaggattgcgcaccttcgctgcggaagtgtcccatctgtcggtcgaccatcaaggggactgttaggacctttctctca

SEQ ID NO: 32326 - DNA, 1812 bp, Artificial Sequence
  Description of Artificial Sequence: Synthetic coding sequence
atgaacattgtggaaaatagcatattcctttcgaacctgatgaagtccgcaaatactttcgagctgaaatacgacctgagctgtgaactgtacagaatgtcgacctactcaacttttcccgccggggttccagtgtcggaaagatcgctggcacgtgcagggttctactacaccggagtgaacgataaggtgaagtgcttctgctgtggtctgatgctggacaactggaagcggggagattccccgaccgagaagcacaaaaaactttacccgtcgtgtagatttgtccaatcccttaattcggttaacaacctcgaagcaaccagccaaccaacgtttccctcctcagtgactaactccacccattcgcttcttccaggtactgaaaactccggctacttccgagggtcttactctaacagcccctcgaatccagtgaattcgcgcgccaaccaagattttagcgccctgatgagaagcagctaccactgtgctatgaacaatgaaaacgcccgtttgctgacttttcaaacttggccattgacttttctctcccccaccgatctggccaaggcaggcttttactacatcgggcctggcgatcgggttgcctgttttgcatgtggggggaagttgtcgaattgggaaccaaaagacaacgcaatgtcggagcacctcagacatttcccaaaatgcccttttatcgaaaaccagctgcaggatacctcccgttacactgtgtcaaatctttccatgcagactcatgcagcaaggttcaaaacctttttcaattggccgtcctccgtccttgtgaatcccgaacaactggccagcgcaggtttttactacgtgggcaacagcgacgacgtgaaatgtttttgttgtgacggaggactccgatgttgggagtcgggtgatgatccctgggtccagcatgccaagtggtttccacgctgtgagtaccttattagaatcaagggccaagaattcattaggcaagtgcaagcatcatacccacatctgctggaacaactgctttcgacgtcggattcacctggtgacgaaaatgcagagtcatccatcatccatttcgaacctggagaggaccattctgaagatgcaataatgatgaatacgcctgtgattaatgcagcggtggaaatgggattttccagaagcctggtcaagcagaccgtgcaaagaaagatccttgccactggcgagaactacaggctcgtcaatgatctggtgctggacctgctgaatgcagaagatgaaattagagaggaagagcgggagcgggccaccgaagaaaaggagtcgaatgatctgctgcttattagaaagaaccggatggcacttttccagcacctgacttgcgtgattcccattctggactccctgttgaccgcggggattatcaatgaacaagagcatgatgtcatcaagcagaaaacgcaaacctcgctgcaagcacgggaactcattgacaccattttggtgaaaggcaatattgcggcaaccgtctttcgcaacagcctgcaagaggctgaagctgtcctctacgagcaccttttcgtgcagcaagacattaagtacatcccaacggaagatgtgtccgacctgccggtggaagaacaactgcggcgcctgcaggaagaaaggacttgcaaggtttgtatggataaggaagtctcaattgtctttattccttgtggccatctcgtcgtctgcaaggactgcgcacctagcttgcgaaagtgtcccatttgtcgctcgactatcaaaggaactgtgcggacttttctgagc

SEQ ID NO: 32327 - DNA, 1812 bp, Artificial Sequence
  Description of Artificial Sequence: Synthetic coding sequence
atgaacatagtggaaaacagcatctttttgagcaacctgatgaagtctgcgaatactttcgagctcaagtacgatctgagctgcgagctatacagaatgtctacctacagtacgttccccgccggcgttcccgtcagtgagcgctctctggcccgagctggcttctattataccggggtgaacgataaggtcaagtgcttctgctgtggcctgatgctcgacaactggaaaaggggtgattctccaaccgaaaaacacaagaagttgtacccctcttgccgatttgttcagtccctgaactcggttaacaacctcgaggcaacctctcaacctaccttcccaagcagtgtgactaactcaacccatagcctgcttcctgggacagaaaattcaggttacttcagaggtagttactcaaacagcccaagcaaccccgtgaacagtcgggcgaaccaggacttttcagctctgatgaggagtagttatcactgtgctatgaataacgagaacgcccggctactgaccttccagacgtggccactgacattcttaagcccgacagaccttgcaaaggccggcttctattatataggccccggagatagagtcgcttgtttcgcttgcggcggaaaattgagcaattgggagccgaaagataatgctatgagtgaacacttacgtcactttccaaaatgtccatttattgaaaaccagttacaagacacctctcgctacaccgtcagcaacctgtcaatgcagacccacgccgcaagatttaagacattcttcaactggccgtccagcgtgctggttaatccagaacagctggcctccgctggattctattatgttggcaatagtgatgatgtaaagtgcttttgttgcgacggcggcttgcgatgttgggagtctggcgatgacccctgggtgcaacacgccaagtggtttcctcggtgcgagtacctgataaggattaaaggtcaggaattcattcgccaggtacaggcttcttatcctcatcttctggagcaactgctcagcacctccgacagtcccggcgatgagaatgcagagtcttcgattatacactttgagcctggagaggaccacagcgaggacgccattatgatgaacacgcctgtgattaatgccgccgtcgagatggggtttagccggagccttgtcaagcagacggtgcagcgcaagatattagcaaccggtgagaattatcgactggttaacgatctcgtcttggacttacttaacgccgaagatgagatccgtgaggaggaaagggaacgcgccacggaggagaaagagagtaatgaccttctgcttattaggaagaatcgcatggccctatttcagcacctgacatgtgtgattcccatccttgactccctgctgacggctggtatcataaatgaacaggaacacgacgtcattaagcaaaagacccaaacttccctgcaggcacgggaactgatagatactatcctggtaaaggggaacattgccgctactgtgttcaggaatagcttgcaggaagctgaggccgtcctctacgaacatctgtttgttcagcaagatatcaagtacatacccacggaagacgtgtctgacctaccagtggaggagcagctcaggcgcctgcaggaagaaaggacttgcaaagtatgcatggataaggaagtgtctatagtgtttatcccgtgcggtcatctggttgtctgcaaagactgcgctccctcactccggaagtgccccatttgtaggagcaccattaaggggaccgttcggacgtttttatca

SEQ ID NO: 32328 - DNA, 1812 bp, Artificial Sequence
  Description of Artificial Sequence: Synthetic coding sequence
atgaacattgtggagaactcgatcttcctgtcaaacttaatgaagtcagcgaacacattcgaacttaaatatgatctttcctgcgagctgtatcgcatgtccacatatagcacctttcccgccggggtgcccgtcagtgagcggagcctggcgagagcaggattttattatactggtgttaacgataaggtcaagtgcttttgctgcggtcttatgcttgacaactggaagcgtggagacagccccactgagaaacacaagaagttatacccttcctgcagatttgtgcagtcccttaatagcgtgaacaacctcgaggctactagccagcccacattccccagttcggtgaccaactcaacgcattccctgttgcccgggactgagaatagcggttattttagggggagctattccaactccccttctaatccagttaattcccgtgccaatcaggatttttccgctctgatgcgttcgtcttatcactgcgccatgaacaacgaaaacgcccgccttctgacttttcagacatggccactgaccttcctgtcccccactgacctggccaaggccgggttttactatattggaccaggtgaccgggtcgcctgtttcgcgtgcggaggcaaacttagcaattgggaaccaaaagataacgctatgtctgagcacttaaggcacttcccaaagtgcccttttattgagaaccagctacaggatacctctcgttacaccgtttccaatctgagcatgcagacgcatgccgcccgctttaagacgttctttaactggccttcatctgtgcttgtgaatcctgagcaactggcgtctgccggcttctattatgtcggtaattccgacgacgtgaaatgcttctgctgcgacggggggctccgttgctgggagtctggagacgacccctgggtgcagcacgccaaatggtttcctcggtgcgagtatctgatcagaattaagggccaagaattcatcaggcaagtgcaggcctcctatcctcatctgctggagcaactcctgtctacctctgattccccgggcgatgaaaacgcggagagttccattatccactttgagcccggcgaagatcactcagaagacgcaattatgatgaatacacccgtaattaacgctgccgtcgagatggggttcagtcggtcgctcgtgaagcagactgttcagcgtaagatcctggccactggggaaaactatcgcctggtgaatgaccttgtcctagatctgctcaatgcagaagatgagatccgggaggaagaacgcgaaagagcgaccgaggaaaaagaatctaacgatctcttgctgatcaggaaaaaccggatggctctgttccagcacctcacttgcgtgattccgatacttgacagtctgttaaccgcaggaataataaacgagcaggagcacgatgtgataaaacagaaaacccagacatccctccaggctcgtgaactgattgataccatactggtgaagggcaacatcgctgccactgtctttaggaacagcctgcaggaggccgaagccgttctttatgaacatctcttcgtgcaacaggacatcaaatacataccaaccgaggatgtaagcgatctgcccgtagaggaacagcttagacgcctgcaagaggaacggacctgtaaggtttgcatggacaaggaagtttccatagtcttcatcccctgtggccacctggtggtgtgcaaggattgcgctccgagcctgcgtaagtgccccatttgtcgcagcaccataaaaggaacggttcgcacattcttgtca

SEQ ID NO: 32329 - DNA, 1812 bp, Artificial Sequence
  Description of Artificial Sequence: Synthetic coding sequence
atgaacatcgtcgagaattccatctttctttctaacttgatgaagtctgctaacacatttgagctgaagtatgatctttcttgtgaactgtacaggatgtccacctattcaacctttcccgccggggtccctgtgagcgagcggtctctggcccgggctggcttctactacacgggggtgaacgacaaggttaagtgcttctgttgcgggcttatgctggataactggaagagaggcgatagcccaacagagaagcacaaaaaactctacccgtcttgtcggttcgtccagtctctgaattcggtcaacaatttggaggctactagtcagcctacatttcccagctctgtgaccaatagcacacactcccttctgccaggaacagagaatagcgggtactttagaggcagttactcaaacagccctagcaacccggttaactctagagctaatcaggacttttccgccctgatgcggtctagctatcactgcgctatgaacaacgaaaacgcccggctgctgacgttccaaacatggccactcacattcttgtcaccaacggatcttgcaaaggccggcttctattatatcggcccaggggacagagtggcatgcttcgcctgtgggggcaaactctccaattgggagcccaaggacaatgctatgagcgagcatctgcggcactttcccaaatgcccattcatcgagaatcagctacaggacaccagccgctataccgttagtaacctgagtatgcagacccatgccgctcggtttaaaacgttctttaattggccttcatccgtgctcgtaaatcccgagcagctggcaagcgcggggttttattacgtcgggaactccgacgatgtgaaatgcttctgttgcgatggggggttgcggtgttgggagtccggagacgatccgtgggtacagcacgctaagtggttcccccgttgcgaatacctcattcgaatcaagggccaggagttcatcagacaggtgcaggcctcttacccccatttattagagcagctgctatccaccagcgattcgcccggggacgagaatgctgagtcgtcgatcattcacttcgaacctggggaagatcatagcgaagacgccatcatgatgaacacacccgtgattaacgctgctgtggagatgggcttttctcgttctctcgttaaacagaccgtgcaaagaaagatcctggctaccggcgagaactatcggctggtgaacgatctggtgcttgacctcctcaatgccgaggacgagatcagggaagaggaacgggaaagagccaccgaagagaaagagtctaacgacctgctgttgatccgcaagaatcgcatggcactgttccagcacctgacctgtgtgattccaattctggattccctcctgactgcaggtattatcaatgaacaggaacacgacgttatcaagcagaagacccagacaagcctccaggcgagagaattgatcgatacgatcctggtaaaagggaacatcgccgccaccgtgttccgcaatagcctgcaggaggcggaagcagttctgtatgagcacctgttcgtacaacaggatatcaagtacatccctacagaggacgtgagcgacctgccggttgaagagcagctgagacggttgcaggaagagcggacttgcaaggtctgtatggataaagaagtttcaatcgtgtttataccctgtggccacttagtggtatgcaaggactgcgctccatcgttaagaaaatgccccatatgtaggtctaccattaaggggacagtccgcaccttcctctct

SEQ ID NO: 32330 - DNA, 1812 bp, Artificial Sequence
  Description of Artificial Sequence: Synthetic coding sequence
atgaacattgtggagaactcgatctttctctccaaccttatgaaatcggcgaacactttcgaactcaagtacgacctgtcttgcgagttgtacagaatgagcacgtattccactttcccagcaggtgtgcctgtgagcgaacgcagcctcgcgagagcaggattttactacactggagttaacgacaaggttaagtgcttctgctgcggcctgatgctggacaattggaagcgcggagattccccaaccgagaaacacaaaaagctgtacccgtcctgccggttcgtgcagagcctgaactccgtcaacaatctcgaggcaacctcccagccgaccttcccttcgtcggttaccaacagcacccactccctgcttccaggcaccgaaaattccggctattttcgggggtcatactcaaatagcccgtccaaccctgtcaactcacgggccaatcaggacttctcggcccttatgcggtcgtcgtaccactgcgcgatgaacaatgaaaatgctcggcttctcaccttccaaacctggccgctgacttttctttcaccaactgaccttgcgaaggccggattctattacattgggccaggggatcgcgtggcctgttttgcctgcgggggcaaactgtcgaattgggagcctaaggacaacgccatgtcagaacacctccgccacttcccgaagtgccctttcatcgaaaaccagctccaagatacctcacgctacacggtatcgaatctgtccatgcagacccatgccgcacgtttcaagacctttttcaattggccgtcatcagtccttgtgaatcctgagcagctggcctcagcgggattctactatgtgggtaattccgatgacgtcaagtgtttttgttgtgacggaggactgcgctgttgggaatcgggcgacgacccgtgggtgcagcatgccaagtggttcccacggtgcgaatacctgattcggatcaagggccaggaattcatccggcaagtccaagcatcgtacccacatctgctcgaacaattgcttagcaccagcgacagcccgggggacgagaacgctgaatccagcatcatccacttcgagccgggcgaggaccattcagaggatgcgattatgatgaacaccccggtgatcaacgcggccgtggagatgggtttctcaagaagtctcgtgaagcagactgtgcagaggaaaatactggctaccggagagaactaccgcttggtgaatgacctcgtgctggatttgttgaatgccgaagatgaaatccgcgaagaggaacgggaacgtgccaccgaagaaaaggaatccaacgatctgctcctgatcagaaagaaccgaatggcgctgttccagcacctgacctgcgtgatccctatcctcgattctcttctgacggccgggatcataaacgaacaggagcacgacgtaatcaagcaaaaaactcagacgtcgctgcaagctcgggagctgatcgatacgatcctggtgaaaggcaacattgccgccacggtgtttcgcaattcgcttcaagaggccgaggcagtgctgtacgaacatttgttcgtgcaacaagacattaagtacatccccactgaggacgtctccgacctgccggtggaggaacagctgcgcagattgcaggaagagagaacctgcaaggtgtgcatggataaggaagtttccatcgtgttcatcccctgcggacatcttgtcgtgtgcaaagattgcgcgccttcactgcggaaatgtccaatctgtagatcgactatcaagggaaccgtccggacttttctgtcg

SEQ ID NO: 32331 - DNA, 1812 bp, Artificial Sequence
  Description of Artificial Sequence: Synthetic coding sequence
atgaacatcgtagaaaactccatctttctgagcaatcttatgaaaagtgccaacacctttgagttgaaatatgacttgtcatgtgaactctaccgcatgagtacatattccacattccctgctggcgtgcccgtgtctgagaggtccttggctagggcaggcttttactacacgggagtgaacgacaaggttaagtgcttctgctgcggcctgatgctcgataactggaaacggggcgatagccccactgaaaaacataaaaagctctacccttcatgcagattcgtgcagagtctgaatagtgtaaataacctggaggctacatctcagccaaccttcccatcctctgtgaccaactcaacccattccctgctccccggcacggagaacagcggttatttccggggctcctactctaacagcccaagcaatccagtgaatagtagggcaaaccaggattttagcgctttgatgaggtcatcttatcactgcgcaatgaacaatgaaaacgctcgactgctgacatttcaaacttggcccctcacattcctgtcaccaaccgatctggcaaaagccggattctattatatcgggccaggagatagggttgcctgcttcgcatgtggggggaagctttccaactgggagcctaaggacaacgctatgtctgagcacctgagacacttccctaagtgtcctttcatcgaaaaccagctgcaagacacttctaggtacacggtatctaacctgtccatgcagactcatgccgccagattcaagaccttctttaactggcctagctcagtgctggtcaacccggagcaactggccagcgccggtttttattatgtaggtaacagcgacgacgtcaagtgtttctgctgcgacggaggattgcggtgttgggagagcggcgacgacccctgggtgcagcacgcaaaatggtttccacgatgcgaatacctgattaggattaaggggcaggagttcattcgccaggtgcaggcgagctatccgcatctgctggagcagctcctcagcacgtcagattctcccggggatgagaacgccgagtcctccataatacacttcgaacccggtgaggatcacagcgaggacgcgatcatgatgaatacccccgtgatcaacgctgccgttgaaatgggcttttcaagaagcctggtgaagcagacagtgcaaagaaagattctggccacaggcgagaactacagactggtcaacgacctggtgttggacctcctcaacgctgaggatgagatcagagaggaggaacgagagagggcaacagaagagaaggaatcaaacgatcttctgctgatcaggaagaatcggatggctctgtttcagcacctcacctgtgtgatcccgattctggacagtctgttgacggctgggataataaacgagcaagaacatgacgtcatcaaacagaaaacgcagacatcacttcaggccagggagctcattgacacgattctggtaaaagggaatatcgctgcaacagtgttccgcaactccctgcaggaggccgaggccgtgttgtacgagcatttgttcgtgcagcaggacatcaagtacatcccaacggaggatgtgtcagatctcccagtggaggaacagttgaggaggctgcaggaggagagaacatgcaaagtttgcatggacaaggaggtctcaattgtgttcattccctgcggccaccttgtcgtgtgcaaagattgtgccccatccctccgaaagtgcccaatctgtcggtctacaatcaaagggacagtgcggacattcctctcc

SEQ ID NO: 32332 - DNA, 1812 bp, Artificial Sequence
  Description of Artificial Sequence: Synthetic coding sequence
atgaatatcgttgagaacagcatctttctttcaaatctaatgaaatctgccaatactttcgagctgaaatatgatctctcttgtgaactgtatagaatgagcacttacagtacatttcctgctggggtaccagtgtctgagcgatctctcgccagggccggattctactacacgggggtgaacgacaaggtcaaatgcttttgctgtggcctcatgctcgacaattggaaaaggggtgatagcccaacagagaagcacaaaaagctctacccaagctgcagattcgtccagtcgctgaatagtgtgaacaatctggaagcaacttcccagcccacatttcccagctcagtaacaaactcgacccacagcttattgccaggaacagaaaactctggctatttccggggctcatactcaaacagccccagtaatccagtcaacagcagagctaatcaggattttagcgctttgatgcgctcctcttaccactgtgctatgaacaatgagaatgcacgactcctgacattccagacatggccacttacattccttagccctaccgatctcgcaaaagccggattttactacatcggcccaggcgaccgcgtggcttgctttgcctgtggggggaagttgtcaaattgggagccaaaggataatgccatgtccgagcacctcagacacttcccaaagtgtcccttcatcgagaatcagctccaggatacgtcccgctatacagtctccaacctctcgatgcagacacacgctgctagattcaagacattttttaattggcccagctccgtactggtaaaccccgaacagttagcttccgccggtttctattatgttgggaattcagacgacgtcaagtgtttttgctgcgacgggggcctgaggtgttgggaatctggagacgacccatgggtacaacatgcgaaatggtttcctagatgcgagtacctcattcgcataaagggccaggagtttataaggcaggtgcaagccagctatccgcatctcctggaacaattgctgtcaacatccgattcccccggcgacgaaaatgccgagagctccattatacatttcgagccaggcgaagatcactccgaggatgccatcatgatgaatacacccgttataaatgccgctgtcgaaatgggttttagccgttctcttgttaagcagactgtgcagaggaagattctggccaccggagagaattaccggcttgtcaacgatttggtgcttgacctgctaaacgcagaggacgagataagggaggaagagcgggagcgtgctacggaagagaaggagagtaatgatctgctgctgatacggaagaacagaatggcattgttccaacacctcacctgcgtgatcccaatcctcgacagcctgctcaccgcaggcattattaacgaacaggagcatgatgtgattaagcaaaaaacccagacatcactacaagcccgcgaactgattgataccattctcgtgaaaggcaacatagccgccacagtgttccgcaacagccttcaagaagccgaagccgtcttgtacgagcacctatttgtgcaacaggatataaagtacatacccactgaagatgtgagcgatctgccagtcgaggaacagctccggagactgcaggaggagaggacctgcaaggtctgcatggacaaggaagtatccatcgtgttcataccctgcgggcatttagtcgtgtgtaaggattgcgctcctagcctccggaaatgccccatatgcaggtcgacaataaaagggactgttcgcactttcttatcc

SEQ ID NO: 32333 - DNA, 1812 bp, Artificial Sequence
  Description of Artificial Sequence: Synthetic coding sequence
atgaatatcgtggaaaatagcatcttcctgtcgaacctcatgaagtccgcaaacaccttcgaactgaagtacgatctgtcgtgcgagctgtaccggatgtccacttacagcaccttcccagccggagtgcctgtctccgagcggagcctcgcccgtgcaggattttactatactggagtgaacgataaggtgaaatgcttttgttgcggtctgatgctggataactggaagcgcggagacagcccgacggaaaagcataagaaactttatcccagctgccgtttcgtccagagcctcaattcagtaaacaaccttgaagcgacctcgcagcctaccttcccgtcgtccgtgactaactcgactcactctcttcttccgggcactgagaactctggatacttccgcgggagctactcgaacagcccaagcaacccagtgaattcgagagccaatcaagatttctccgccctcatgagatcctcctaccactgcgccatgaacaacgagaatgcccgcttgctcactttccaaacttggccactcacttttctgagcccgaccgatctcgcgaaagcaggcttctactacatcggacctggagatcgcgtcgcgtgttttgcatgcggagggaagctgtcgaactgggaaccgaaagacaacgccatgtccgagcatcttcggcactttccgaagtgcccatttatcgaaaatcagttgcaggacaccagcagatacactgtgagcaacctgtccatgcaaacccatgctgctcggtttaagactttcttcaactggccttcaagcgtgctggttaaccccgagcagctcgcttccgccggattctactatgtgggcaactcagacgatgtgaagtgcttctgctgtgacggcgggcttaggtgctgggaatcaggtgatgacccctgggtgcaacacgcgaagtggttcccgcggtgcgaataccttatccggatcaaaggccaggaattcatacgccaagttcaggcctcttatccgcacttgcttgaacagcttctgtcgacttccgactccccgggagatgaaaacgcggaaagctccatcatccactttgagccaggagaggatcactcagaggacgcaattatgatgaacaccccggtgatcaatgccgccgtcgaaatgggcttctcacgaagtctggtgaagcagacggtgcagaggaaaatcctggcgacgggtgagaactaccgcctggtgaacgatttggtccttgacctgctgaatgccgaggacgagatccgggaagaagaaagagaacgggcaactgaggagaaagaatccaatgaccttctgctgatccgaaagaatagaatggctttgttccagcaccttacctgcgtcatccccatcctcgactccctgctcaccgctggcatcataaatgaacaagaacatgacgtgattaagcaaaagacccagacctccctgcaagctcgcgaactgatcgatactatcctggtgaagggtaatatcgcggccaccgtgtttcgcaatagcctgcaggaagccgaagccgtcctgtacgagcaccttttcgtccagcaggatatcaaatacattcctaccgaggatgtgtcggacttgccagtcgaggaacaactgcgcaggctccaggaggagcggacctgtaaggtctgtatggacaaggaagtctctatcgtgttcatcccttgtggacatctggtagtgtgcaaggactgcgctccgtcgctgagaaagtgcccgatttgccggtcgacgatcaaaggtaccgtgcgcactttcctgtcg

SEQ ID NO: 32334 - DNA, 1812 bp, Artificial Sequence; identical to SEQ ID NO: 32317
  Description of Artificial Sequence: Synthetic coding sequence

SEQ ID NO: 32335 - DNA, 1812 bp, Artificial Sequence
  Description of Artificial Sequence: Synthetic coding sequence
atgaacattgtcgagaattccatttttctctcgaatcttatgaagtccgcaaacaccttcgaactcaaatacgacctgtcgtgtgaactttataggatgagcacctattcgaccttcccagcaggggtccccgtgtccgagagatcccttgcaagagccggcttttactacaccggagtgaacgataaagtgaaatgtttttgttgcggtctgatgttggataactggaagagaggagatagccctactgaaaaacacaagaagctctacccaagctgccggtttgtccagtccctcaactcagtcaacaatcttgaagcaacttcgcaacccacgttcccttccagcgtgactaattccacccatagcctgctccctggtaccgaaaattccggatacttcaggggtagctactctaactcgccgtccaaccctgtgaacagccgcgctaatcaggatttttcggcactgatgaggagctcataccattgcgccatgaataacgaaaacgctagacttctgaccttccagacttggccactgacctttctttcgcctacggatctggctaaggcaggcttctactacatcggacctggtgatcgggtcgcgtgttttgcatgtggtggaaagctgtcaaactgggaaccgaaggacaacgcaatgtcggagcatcttagacattttcccaagtgtccgtttatagagaatcagctgcaagacacctcgcggtacacggtgtcgaacttgtccatgcagacgcatgccgcacgttttaagacctttttcaattggccctcatcggtcttggtcaacccagaacaactggcaagcgcagggttctattacgtggggaacagcgatgatgtcaagtgtttctgttgcgacggtggcctgaggtgctgggaaagtggtgatgacccttgggtgcagcatgcaaagtggtttcctcgctgcgagtacctgattcgaattaagggtcaagagtttattcgtcaggtccaagcatcatacccgcatctgcttgaacagctgctcagcacctcggacagccctggtgatgaaaacgcagagagctcgataattcattttgaaccaggcgaagatcactccgaggacgcgatcatgatgaatactcctgtgattaatgcagctgtggaaatgggcttttcacgaagcctggtgaagcaaaccgtccaaaggaagattctggccaccggggagaattacagacttgttaacgaccttgtcttggatcttctcaatgccgaggacgagatccgggaggaagaacgcgaaagagccaccgaagagaaagagtccaacgatctgctcctgataaggaagaacaggatggcactcttccagcatctgacctgtgtgatacctatcctggactcccttcttaccgcagggatcataaacgaacaagaacacgatgtgattaagcaaaagacccaaacttcccttcaagcccgggagctgattgatactattctggtcaaggggaatatagcagcgaccgtctttcgcaattcgttgcaagaagcagaggcggtgctctacgagcatctgttcgtccagcaagacattaagtacattccgaccgaggacgtgagcgatcttcctgtggaggagcaactgagacgtctccaagaggagaggacctgtaaggtgtgcatggataaggaggtgagcattgttttcatcccatgtgggcatctggtggtgtgtaaggactgtgcaccttcgctgaggaagtgtccaatttgtcggtccaccatcaagggaactgtgcgcacttttttgtcg

SEQ ID NO: 32336 - DNA, 1812 bp, Artificial Sequence
  Description of Artificial Sequence: Synthetic coding sequence
atgaatatcgtggagaactccatcttcttgtcgaatctcatgaagagcgccaataccttcgaactgaaatacgatctcagctgcgaactctaccgcatgtcgacgtattcgacctttccagctggtgtgcccgtgagcgagcggtccctggcgcgcgcaggtttctactacactggcgtgaacgacaaggtgaagtgtttctgctgcggactgatgcttgacaactggaagcggggagacagcccaactgaaaaacacaagaagctgtacccatcatgcaggttcgttcagtcccttaactcggtaaacaacctcgaagctacctcacaaccgactttccctagctcagtgactaattcgactcactccctgctcccagggaccgagaactcgggatactttcggggaagctactctaattcccctagcaacccagtgaactcccgggcgaaccaagacttctcagcgctcatgaggtcgtcctaccactgtgctatgaataacgagaacgctcgccttctcacctttcagacttggcctctgaccttcctgtccccgaccgacctggccaaggcgggattctactacattggaccgggagatagagtggcttgcttcgcctgcggcggtaaactgtccaattgggaaccgaaggataacgcgatgtcagagcacctgaggcacttcccgaagtgtccgttcatcgaaaaccaacttcaagacacctcccgctacactgtctccaatctctcaatgcaaacccatgccgcgcgctttaagactttcttcaactggccgagctcagtgctggtgaaccccgaacagttggcgtcagcaggattttactacgtgggcaactcagacgatgtgaagtgcttctgctgcgatggggggcttcgctgctgggagtccggcgacgacccttgggtgcaacatgcaaaatggttcccgcgctgtgagtacttgattagaatcaaaggacaggaattcatcagacaagtccaggccagctacccgcacctgctggagcagctcctgtctacttcggacagccctggcgatgaaaatgcagaaagctcgatcatccacttcgagcctggagaggatcactccgaggacgccattatgatgaacactccagtcatcaacgcagcggtcgaaatgggattttcgcgctccctcgtgaagcagaccgtgcagcgcaagatcctggcgactggggagaattaccggctcgtgaatgacctcgtgctcgacctcctgaatgcagaagatgaaatccgggaagaggaacgggaaagagctaccgaggaaaaggagtccaatgacctgctgctgatcaggaaaaatcggatggctctgttccagcacctgacttgcgtgatccctatcctcgacagcttgcttactgcggggatcattaacgaacaggaacatgatgttatcaagcagaaaactcagacctccctgcaggcacgcgagctgattgacactatccttgtgaagggaaacattgcggccactgtctttcgcaactcactgcaggaagcggaagcagtgctgtacgaacacctgtttgtccagcaagatatcaaatacatcccaactgaagatgtttcagatctccccgtggaagaacaactgagacgactgcaggaggagcggacctgcaaggtctgcatggacaaggaagtgagcatcgtctttatcccgtgcggacatctggtcgtctgtaaggattgcgcaccgtccctgaggaagtgtcctatctgtcgctcgacgatcaagggaaccgtgagaaccttcctgtca

SEQ ID NO: 32337 - DNA, 1812 bp, Artificial Sequence
  Description of Artificial Sequence: Synthetic coding sequence
atgaatatagttgagaattctatctttttgtccaatcttatgaaatctgccaacactttcgagcttaaatatgacctctcatgtgagctatatcgcatgagtacatattcgacttttcccgctggggtgcccgtatcagaacggtcactcgctagggcaggattttattatactggggtgaacgacaaagtgaaatgcttctgttgcgggttaatgctcgataattggaaacggggggactctcctacagagaagcataaaaaattgtatccctcttgtcggtttgtgcagtcactcaatagtgtgaacaaccttgaggccacatctcagcccacatttccctcatccgttacgaattccacacatagtcttctgcctggaactgaaaactccgggtatttcagggggtcttattctaactctccctctaaccctgtgaactcgcgggcaaatcaggatttctcagctctcatgagaagtagttatcattgtgcaatgaataatgaaaatgcgcggctcttaactttccagacatggccactcacattcctgtcccccacagatctagcaaaagccggattctactacattgggcccggggatagagtagcctgttttgcttgtgggggaaaactctcaaactgggagcctaaagataatgctatgagtgaacacctccggcattttcccaagtgtccttttatagagaaccaattgcaggacacatcacggtacacagtatcgaatttgtccatgcagactcacgctgcaaggtttaaaacattctttaattggccttcaagtgtcctcgtgaatcctgagcagctagccagtgccggattttattacgtgggaaattctgatgatgtgaagtgcttctgttgcgacgggggactccgatgctgggagtccggagatgacccttgggtgcagcatgccaaatggttccccagatgcgaatacctcattagaatcaaagggcaggagttcataagacaggttcaggcatcttatccacatctattagaacagttactttccacaagtgattcacctggggacgagaacgcagaatcttccatcatacattttgaacctggagaagatcatagtgaggacgccatcatgatgaatacacctgtgattaacgccgccgtggaaatgggattcagtcggtccttggttaaacaaactgtacaacggaagatccttgccacaggagaaaactaccgactcgttaacgatctagttctagatcttctgaatgccgaggacgaaataagggaagaagaaagagagagagcaacagaagaaaaagagagtaacgatctcttgcttataagaaaaaatcggatggctctcttccaacatctaacttgcgtgatccctatcctagattccctgctgacagccggaataattaatgaacaagaacacgatgtgattaaacagaaaacacagacttctttacaggctagagaactaatcgacactatccttgtgaaagggaacattgctgccactgtctttaggaattccttacaggaggcagaagctgtcctctatgaacacctgttcgtccagcaagatattaaatatatccccactgaggatgtcagtgatctaccagttgaagagcagctcagaaggctgcaggaagagcgcacttgtaaagtgtgtatggacaaagaagtctctatagtcttcataccctgcgggcacctcgttgtgtgtaaagattgtgctcctagtcttaggaaatgccctatttgtcggtccacaataaaagggactgtgcgcacttttctctct

SEQ ID NO: 32338 - DNA, 1812 bp, Artificial Sequence
  Description of Artificial Sequence: Synthetic coding sequence
atgaatatcgtcgagaactcgatctttctcagtaaccttatgaaatcagccaataccttcgaactgaagtacgacctttcgtgcgagctgtacaggatgtccacgtactccacctttccagccggagtgcccgtgtcggaacggtccctggctcgcgcgggcttttactacactggagtgaacgataaagtcaagtgcttctgttgtggcctcatgctcgacaactggaagcggggtgactcacccactgagaaacacaagaagctctacccgagctgccggttcgtgcagagcctgaattctgtgaataacctggaggccacttcacagccgacgttcccatcaagcgtaactaattctactcactcactgcttcctggaacggaaaactccggatatttccggggatcgtacagcaacagcccatcgaaccctgtgaattcgcgggcgaaccaagacttttccgcactgatgaggtcgtcctatcattgtgccatgaacaacgaaaacgcacgcctgctgactttccagacttggcctctcaccttcctcagcccgaccgacctggcaaaggctggattttactacatcggtccgggggaccgcgtagcttgcttcgcgtgcggcggtaagctgtccaactgggaaccgaaggacaacgccatgtcagagcatttgcgccacttccctaaatgcccctttatagagaatcaactgcaggacacttcgcggtacaccgtgtccaatctcagcatgcagacccacgcagcacgcttcaagaccttcttcaattggccttcatcggtcctggtgaacccagaacaactggcgtccgcaggcttctactacgtcgggaactcagacgatgtgaagtgcttctgctgcgacggaggtttgagatgttgggaaagcggagacgatccgtgggtccaacacgctaagtggttcccgcgctgcgaataccttatccgcattaaaggccaggagttcattaggcaagtgcaagcgtcgtacccacatctcctggaacaactgctctccacctctgactcaccaggcgacgagaacgctgaatcatcaatcatccatttcgagccgggagaggatcactcggaggacgctatcatgatgaatacgccggttatcaatgcggccgtggaaatgggattctcccgctccctcgttaagcaaaccgtccaaagaaaaatcctggcaacgggcgaaaactacagactcgtgaatgatcttgtgcttgacctcctgaatgccgaagatgagatacgcgaggaggaacgggagcgggcgaccgaagaaaaggaatctaacgacctgcttctcattcgcaaaaaccggatggcgctgttccagcatctgacctgcgtgatccccattctggactcgctgttgaccgcaggaatcatcaacgagcaggaacacgatgtgatcaagcagaaaacccagacctcactccaggcaagagaactgatcgacaccatcctcgtgaagggaaacatcgccgcaactgtctttcgaaattctctgcaggaggccgaagccgttttgtacgaacatctcttcgtccagcaggatatcaaatacattccgaccgaagatgtgagcgatctgccagtcgaggagcagctgaggcgtctgcaggaagaacgcacctgcaaggtgtgcatggataaggaggtgtcgatcgtgtttattccttgcggccacctcgtagtctgtaaggattgtgccccgagccttagaaagtgcccgatctgtagatcgactatcaaggggaccgttcgtacgttcctgtct

SEQ ID NO: 32339 - DNA, 1812 bp, Artificial Sequence
  Description of Artificial Sequence: Synthetic coding sequence
atgaacattgtggagaacagcattttcttatctaatctaatgaagagcgccaatacttttgaactgaagtacgacttgtcgtgtgagttgtaccgtatgagtacgtactcaacttttcctgcgggggtgccggtatcggagaggtctctggcaagggcaggtttctactacactggtgtcaacgacaaggtgaaatgcttctgctgcggtctgatgctggataactggaaacgcggtgatagccctacggagaagcacaagaagctgtacccttcttgtagatttgtgcaaagcctgaacagcgtgaataacttggaagcaacctcacaaccaacctttccttccagcgtcactaatagcactcactctctgctgcccggtactgagaactccggttacttccgggggtcttattccaatagcccttccaatcctgtcaacagccgcgcgaaccaggattttagcgcgctgatgagatcctcttaccactgtgccatgaataacgaaaatgcgcgcctgttaacttttcaaacgtggcccctcaccttcctgagcccaaccgacctggccaaggccgggttctattacattgggcctggcgatagagtcgcatgtttcgcgtgtggaggtaaactgtccaactgggagccgaaggataatgctatgagcgagcatctgcggcatttcccaaagtgcccattcattgagaaccagttacaggacacgagcaggtatactgtcagcaacctgtctatgcagacccacgccgctcgctttaaaacgttctttaattggcccagctctgttctggttaacccagagcagttggcaagtgctgggttttactacgttggtaattcagacgacgtcaagtgtttctgttgtgacggaggtctgagatgctgggaaagcggagacgacccgtgggtgcagcatgctaaatggttcccacgctgcgaatatctgattaggatcaagggtcaagaattcattcgccaggttcaagcgagctacccgcacctcctggagcagctgctgagtacgtccgacagccctggcgacgagaatgcggagtcctcaattatccactttgaacctggggaggatcactccgaagacgccattatgatgaatactccagtgataaacgcggcggtcgaaatgggtttcagtcggagtctcgtgaaacagaccgtgcaacgcaagattctggcaacgggcgaaaattatcgcctggtgaatgatctagtgctggatctgttgaacgctgaggacgagattcgtgaggaggagcgcgaacgcgctaccgaagagaaggaaagcaatgacctgttgctgatccgaaaaaataggatggccctgtttcagcacctgacgtgtgtcatccccatcctggatagcctgctgacggcgggtattatcaatgagcaagaacacgatgtgatcaaacagaaaacgcagactagcctgcaagcacgcgagctgatcgacaccattctagtcaaaggtaacattgctgccacggtctttcggaatagcctgcaggaagccgaggccgtgctctacgaacatctgttcgtgcagcaggacattaaatatattccgacggaggacgttagcgatctgcctgtcgaggagcagttgagacgcctgcaagaggaacgaacctgtaaggtctgcatggacaaggaagtatctatagtgtttatcccatgcgggcatctggttgtttgtaaggattgtgcaccgagcttgcgtaaatgcccaatctgccgatccacaatcaaaggcaccgtgcgcacattcctgagt

SEQ ID NO: 32340 - DNA, 1812 bp, Artificial Sequence
  Description of Artificial Sequence: Synthetic coding sequence
atgaacatcgtggaaaactcaatcttcctctccaacctcatgaaaagcgctaacaccttcgaactgaagtacgacctttcctgcgaactgtacagaatgtcgacttactccactttccccgcaggtgtcccagtctccgaacgctcgttggcccgcgccgggttctattacacgggcgtaaacgacaaggtgaagtgtttttgttgcggactgatgttggacaactggaagcggggtgacagccctactgaaaaacataaaaagttgtacccatcctgccggttcgtgcagtccctgaactcagtgaataacctggaagctacctcacagccgaccttcccgtcgtcagtcacgaattccactcactcactgctcccgggaactgagaattcgggatacttccgcggatcatactccaatagccctagcaacccggtgaactcacgggcaaaccaggatttctccgccctgatgaggagctcctaccactgcgccatgaacaacgaaaatgccaggctgctcactttccagacctggcccttgacttttctgtcccctaccgatctggcgaaggctgggttttactacatcggaccaggagatcgcgtggcctgcttcgcgtgtgggggaaagctgagcaactgggagccgaaggacaatgccatgagcgagcatctgaggcatttcccgaagtgtccttttatcgagaatcaactgcaagatacgtcacgttacactgtgtcgaacctctcgatgcaaacgcatgctgcccgctttaagacgttcttcaattggccgtcatcggtcctcgtgaatccagagcagcttgcatcggctggattctattacgtcggtaattcggatgacgtcaagtgtttctgctgcgatggtggactgaggtgctgggaatctggagacgatccatgggtgcagcatgcaaagtggttcccaagatgcgagtacctgatcagaattaaaggacaggaattcattcgccaagtgcaggcctcgtaccctcatcttttggaacagctgctctccacttccgactcgcccggagacgaaaacgcagaaagctcgatcatccactttgaaccgggagaagaccactccgaagatgcgattatgatgaacactccagttatcaatgcagcggtggaaatgggattcagccgttccttggtcaaacagaccgtgcaaagaaaaatactggccactggagaaaattaccggctggtgaatgacctcgtgctggatctgctgaacgcagaagatgaaatacgcgaagaagagagagaacgcgctaccgaagaaaaagagagcaacgatctgcttctgatccggaagaataggatggctctcttccaacatcttacctgcgtgatcccaattctggactccttgctgaccgccgggatcatcaatgagcaagagcacgatgtgatcaaacagaagactcagacttcgctgcaggcccgcgagctgattgacaccattctcgtgaagggaaatatcgccgctaccgtcttccgcaactccctgcaggaggccgaagctgtgttgtatgaacacctgtttgttcagcaagacattaagtacattccgaccgaggacgtgtcagacctgccggtcgaggagcagctgcgcagactgcaagaggagagaacttgcaaggtgtgtatggataaagaggtgtctattgtgttcatcccgtgcggacacctcgtcgtgtgcaaggactgcgcaccgtcactccgtaaatgccctatctgtagatccactatcaagggtaccgtccggactttcctttcc

SEQ ID NO: 32341 - DNA, 1812 bp, Artificial Sequence
  Description of Artificial Sequence: Synthetic coding sequence
atgaacattgtcgaaaactcgatcttccttagcaaccttatgaagtcggcaaacacttttgaacttaagtacgacctttcgtgtgaactctacagaatgtcaacgtattcaacctttccggcaggtgttcctgtcagcgagcggtcgctggcccgtgcaggtttttactacactggtgttaacgataaagtgaagtgcttttgttgtgggcttatgcttgataattggaaaaggggagacagcccaacggaaaagcacaagaagctgtacccgtcgtgccgattcgtccagagcttgaattctgtgaataacctcgaggcaacttcccagccgaccttcccgagcagcgtcactaactccacgcactcacttctccctggtactgagaattcaggatatttcagaggatcatactcaaactcgccctctaatcccgtgaactcaagagccaaccaagatttctccgccttgatgagatcctcataccattgcgccatgaataacgaaaacgcccgcctgcttacttttcaaacctggcctctgacctttctgtcgcccaccgaccttgcaaaagccggattctattacatcggaccaggagatagagtggcatgcttcgcttgtgggggaaaattgtcgaactgggagccaaaggataacgctatgagcgagcatcttcgtcattttcctaagtgtccctttatcgagaatcaactgcaagacacttcccggtacaccgtgtccaacctctccatgcagacccacgcggcccgtttcaagacgtttttcaattggcctagctccgtgctcgtgaaccccgaacaacttgcatcggcaggattttactacgtgggaaattcagacgacgtgaaatgtttctgttgtgacggcggcttgcgctgttgggaatcaggcgacgatccttgggtgcaacatgcaaagtggtttcctagatgtgaataccttataagaattaagggacaagagtttatccggcaggtgcaagcctcttaccctcacctcttggaacaactccttagcacctctgatagccctggcgatgaaaatgcggagtccagcattatacatttcgaacctggtgaggaccactcggaagatgccattatgatgaacactcccgtgattaacgccgcagtggaaatgggtttttcacggtcgcttgtgaaacagaccgtgcagcgaaagatactcgcaacgggagaaaactacagacttgtgaatgaccttgtgcttgacctgctgaatgcagaagatgagatccgtgaagaagagcgcgagagagcaactgaagagaaggaatctaacgatcttcttcttattcgcaagaataggatggcgctgtttcagcatctgacctgtgtcattcctatccttgattcgctgctgaccgcggggatcattaatgagcaagaacatgatgtgatcaaacagaaaactcagacctcccttcaagctagggagctgattgataccattctggtgaagggtaacattgcagcaaccgtgtttagaaactcgttgcaagaagcagaagcagtcctttacgagcatctttttgtgcagcaggatatcaagtatatccccactgaggatgtgagcgacctgccagtggaagagcagctcaggaggctccaagaggaaagaacttgcaaagtctgtatggacaaggaagtgtcgatcgtgttcatcccttgcggccaccttgtggtgtgcaaggattgtgcaccctctctgcggaaatgccctatctgtcggtccactattaagggtactgtgcgaacttttctctcc

SEQ ID NO: 32342 - DNA, 1812 bp, Artificial Sequence
  Description of Artificial Sequence: Synthetic coding sequence
atgaatatcgtcgagaattcgatctttcttagcaacctcatgaagtccgccaacaccttcgaactgaagtacgatttgtcgtgtgagctgtaccgcatgtctacttactcgacctttcctgcgggagtgccagtctcagagcggtcccttgcacgggcaggtttttactacaccggtgtcaatgataaggtcaagtgtttctgctgcggactgatgctcgataactggaagaggggagatagcccaaccgaaaagcacaagaagctctatccgagttgcagattcgtccagtcccttaactccgtgaataacctggaggccacctcgcagccgaccttcccgagttccgtgaccaactctacccattcactgctcccgggcaccgagaactcaggttatttccggggcagttacagcaactcaccaagcaacccggtgaattctcgggccaatcaagacttttcggctctcatgcgctcgtcgtatcactgtgctatgaacaacgaaaatgcccgcctgctgacctttcagacctggcctctgacttttctctcccccacggaccttgctaaggctggcttctactacatcggcccgggagatcgcgtggcctgttttgcatgtgggggaaagctctcgaactgggagccgaaggataatgcgatgtcggagcacttgcggcactttcctaagtgtccgttcatcgagaaccagctccaagacacctcaagatacaccgtgagcaatctgtccatgcagactcatgcagcaaggtttaagacctttttcaattggccctccagcgtgctggtgaaccctgagcaactggccagcgcaggattctactacgtgggaaatagcgacgacgtgaaatgcttctgttgcgacggaggattgcgctgttgggagtcaggagacgacccatgggtgcaacacgctaagtggttcccccggtgcgagtacctgatcagaatcaagggccaggaattcatccggcaagtgcaagcctcctacccacatctgcttgagcagctgctgtcaacttcggattctcccggggacgagaatgccgaatcgtcaatcatccactttgaaccgggagaagatcattcggaagatgcaatcatgatgaacactccagtgattaacgccgctgtggagatgggtttcagccgctcgcttgttaaacagactgtgcaaagaaagatactggctacgggcgagaactaccgcttggtgaacgatcttgtgctggacctgctgaacgccgaggacgaaatcagagaggaagaacgcgaacgggccactgaagaaaaggaatccaacgacttgttgctcatccggaaaaacaggatggcgctgttccagcaccttacctgtgtgataccgattctcgactcgttgctcaccgccggcatcatcaatgaacaggaacacgacgtgatcaaacaaaagacccaaacctcgcttcaggcgcgggagctgatcgacactatcctggtgaaggggaatatcgccgccaccgtttttcggaactcactgcaggaagctgaggcggtgctgtacgaacacctcttcgtccagcaggacattaagtacatccctactgaagatgtgtccgatctcccggtggaagaacagctcagacggttgcaagaggagcgtacttgcaaagtgtgtatggataaagaagtctcgatcgtgttcatcccatgcggacatcttgtcgtgtgcaaggattgcgcgccgtctctgcggaaatgcccgatttgccgcagcaccatcaagggtactgtccgcacgttcctgagc

SEQ ID NO: 32343 - DNA, 1812 bp, Artificial Sequence
  Description of Artificial Sequence: Synthetic coding sequence
atgaacatcgtggagaacagcatctttttgagcaatctgatgaagagcgctaacactttcgaattgaaatacgacctctcgtgcgagctgtaccggatgtcgacttactccacctttccggcaggagtgcccgtcagcgagcgctctctggcacgcgcaggtttctattacaccggagtgaatgacaaagtgaagtgcttctgttgtggactgatgctcgacaattggaagcgcggagattcacctaccgagaagcacaagaagttgtatcctagctgtcggttcgtccagtcactgaatagcgtgaacaacctggaagcgactagccagccgaccttcccctcttccgtaaccaactcaacccactcgctgctgccgggcactgaaaactcagggtatttccggggatcctactccaattcgccttcgaacccggtcaactctcgggcaaaccaagatttctccgccttgatgcgcagctcgtaccactgcgctatgaacaacgaaaacgcgcgcctgcttacgttccaaacgtggccgctgacttttcttagcccgactgatctcgccaaagcgggtttctactacattggtcctggggaccgggtcgcttgcttcgcctgcggcggaaagctgagcaattgggaaccaaaggacaatgccatgtcagaacacctgcgccacttccctaaatgcccattcatcgagaaccagctccaggacacgtcgaggtacaccgtgtcgaatctttccatgcagactcatgctgcccggtttaagacttttttcaactggccatcatcggtgcttgtgaatccagaacagctcgcaagcgcgggattttactacgtcggaaatagcgacgatgttaagtgtttctgctgtgacggaggactgcggtgctgggaatcaggagatgatccctgggtccagcatgcaaagtggttcccaagatgcgagtacctgatccggattaagggacaggagttcatccgccaagtgcaagcgtcgtatccgcacctgctggaacaacttctctcgacctccgattccccgggtgacgagaacgcagaatcaagcatcatccattttgagcctggagaagatcatagcgaagatgcgatcatgatgaacactccagtgatcaatgctgcagttgaaatgggctttagcagatctctcgtcaagcagactgtgcagcgcaagattcttgctaccggggagaattatcgtctggtgaatgacctcgtcctcgatctgctgaacgcagaggacgagattagagaagaagagcgcgaacgggcaaccgaagaaaaagaatctaatgacctgctcctcattaggaagaacaggatggccctgtttcaacacctgacctgcgtgattccgattctcgactctctcctgaccgccgggattatcaatgagcaggaacacgacgtgatcaaacaaaagacccaaacttcacttcaagcgagagaactgatcgacactatcctcgtgaagggcaatatcgcagcgactgtctttagaaacagcctccaagaagccgaggcggtgctgtacgaacacctgttcgtgcagcaggatatcaaatacattcccactgaggatgtttccgatttgcccgtcgaagagcagctgcggcgccttcaagaggagcggacctgcaaggtgtgcatggacaaggaagtgtccattgtgttcatcccgtgcggccacctggtggtgtgcaaagattgtgcgccttccttgcgcaagtgcccgatctgccgttcgaccatcaagggaactgtgcgcacgttcctctcc

SEQ ID NO: 32344 - DNA, 1812 bp, Artificial Sequence
  Description of Artificial Sequence: Synthetic coding sequence
atgaatatcgtcgagaacagcatctttctttccaacctcatgaagtccgcgaacaccttcgaacttaagtacgacttgtcgtgcgaactgtaccggatgtcaacttattccaccttcccagccggtgtgcccgtgtccgaacgaagcctcgcgcgtgccggattttactacactggagtgaacgacaaggtgaaatgcttctgctgcgggctgatgctggacaactggaagagaggcgattcgcccactgaaaaacacaagaaactgtatccatcgtgtaggttcgtacaatcactcaactcggtcaacaatctggaggccacctcacagccaactttcccgtcgtcggtgacgaactcaacgcattcactcctgccgggaaccgagaactcaggatactttcgcggatcctactccaactcaccgtcgaatcccgtcaactcgagagctaaccaagatttcagcgcgctcatgcgctcttcctaccactgcgcgatgaataatgagaacgccagactcctgacctttcagacttggcctctgacgtttctctcgccaactgacctggcgaaggccggtttctactacatcggcccgggtgaccgcgtggcctgcttcgcctgcggagggaagctctcaaattgggagccaaaggacaatgcaatgtcggagcatctgagacacttccccaagtgccccttcatcgaaaatcagctccaggacacctcgagatacactgtttcgaatctgtcgatgcagactcacgcagccaggttcaagacgttcttcaactggccgagctcagtcctcgtgaacccagagcaactcgcttccgctggattctactacgtgggaaactccgatgatgtgaagtgcttctgttgtgacggaggcctgaggtgctgggaatctggcgacgacccttgggtgcagcacgctaagtggttcccgcgatgcgagtaccttatccgaataaagggtcaggagtttattcgccaagtgcaggcgtcgtacccccacctcctcgagcagctgttgagcacctcagattcaccaggagacgaaaacgccgaatccagtatcatccacttcgaaccaggagaagatcatagcgaggacgccattatgatgaatactcccgtgatcaacgcagcagtggaaatgggattcagcaggtcactggtgaagcagaccgtgcagcgcaagattcttgcgaccggcgagaattacagactcgtgaacgatctggtgctcgatttgctcaatgcggaagatgaaatccgggaagaggagcgggagcgtgctaccgaagagaaagagtcgaacgacctgctgctcatccggaaaaaccgcatggcgctgttccagcaccttacctgcgtcattccgatcctggatagtctcctgacggcaggaatcatcaacgaacaggaacacgacgtgatcaagcagaaaactcaaacctcgctccaagctagagagctgatcgataccatcctcgtgaaaggaaatatcgcagcgacggtgttccgcaattcattgcaggaggccgaagcagtgttgtacgagcacctcttcgtgcaacaagatatcaagtacatacctactgaggacgtgtcggatctgccggttgaggagcaacttcggagactgcaagaagaacggacttgcaaggtctgcatggacaaggaagtgagcatcgttttcatcccctgcggacacctggtcgtttgtaaggactgtgccccgagcctccggaagtgtccaatctgccgctcaactatcaaaggaaccgtgaggactttccttagc

SEQ ID NO: 32345 - DNA, 1812 bp, Artificial Sequence
  Description of Artificial Sequence: Synthetic coding sequence
atgaatattgtcgaaaattccatttttttgagcaatttaatgaagtctgcgaacaccttcgaactgaagtatgacctgagttgcgaattataccgtatgtcgacctacagcacgtttccggcgggcgtaccggtaagcgaacgttcactggcgcgggcaggtttttattataccggtgtgaatgataaagtaaagtgtttttgttgtggccttatgttagacaattggaagcggggggattcacctaccgaaaaacataaaaagctgtatccgtcctgtaggtttgtgcagagcttaaattcagtaaataatcttgaagccacatcacaaccaaccttcccatctagtgtaacaaatagtacacatagcctcttaccgggcacagaaaactcaggatactttcggggttcttattctaatagtccttcaaatccggtcaattccagggccaaccaggattttagtgccttaatgaggagctcctatcattgcgctatgaataatgaaaacgctcgcctccttacattccagacctggccgttaacttttttaagcccaacggacttagctaaagctggattctattatatcggacccggtgatagggttgcttgctttgcctgtgggggaaagttgagcaactgggaacctaaagataatgctatgtcggaacacttgcgtcactttccgaaatgcccttttattgagaatcaactccaagatacatctcgctatacggttagcaatctttccatgcagacgcacgctgcgcggtttaaaacgtttttcaactggccatcgtcagtgttagtcaatcccgagcagcttgcttctgctggcttttattatgtcgggaattcggatgatgtcaagtgtttttgttgcgatgggggcctgagatgctgggaatctggggatgatccgtgggttcagcatgcaaaatggtttccgcggtgtgaataccttatccggattaaaggccaggagttcatccgccaagttcaggcctcttatccgcacctgctcgaacagcttctgtcaacaagcgattctcctggcgatgaaaacgccgagtcatcaatcatacacttcgaacctggagaagatcattcggaagatgccataatgatgaatacaccggttataaatgctgcagtggagatgggatttagcaggtcattagtcaagcaaaccgtccaaaggaagatcttagccaccggagaaaattatagattagtcaatgatttagtactggatctgttgaatgcggaagacgagattcgagaagaagagcgtgaacgagcaacagaagaaaaagaaagcaacgatctactgcttattcgcaaaaaccgcatggccctgtttcagcatctgacatgcgtcatccctattctggattccctgctgacagcaggaattattaacgagcaagaacatgacgttataaaacaaaaaacacagacttctctgcaagcaagagaactgattgatactattcttgtaaaaggtaatattgcggcaacagtgtttcgaaattcattacaggaggccgaggcggtcttgtacgaacacctgttcgttcaacaggacataaaatatattccgacagaagacgtctcagacttaccggtcgaagaacagttgcgtagactccaagaagaaagaacgtgtaaagtttgcatggacaaagaggttagtatcgtatttatcccttgcggtcatttggtagtatgcaaagactgcgcaccatcgctgagaaaatgtcctatatgccgatcgacaatcaaagggaccgtgcgcactttcttgagc

SEQ ID NO: 32346 - DNA, 1812 bp, Artificial Sequence
  Description of Artificial Sequence: Synthetic coding sequence
atgaacattgtcgaaaactcgatttttctctccaatctgatgaagtccgctaataccttcgagctgaaatacgatctgagttgtgagctttatagaatgtccacctactcgacctttccagcaggtgtgccagtgtccgagagatccctcgcacgcgctggattctactacaccggagtcaatgacaaggtgaagtgcttctgctgcggactgatgcttgacaactggaagcgaggtgattcccctactgagaagcataagaaactttaccctagctgtagattcgtgcaaagcctgaattcggtgaataacctggaagctacctcccaacctactttcccaagctcggtgaccaacagcacgcacagcctgctgccaggtactgaaaattcaggttactttagaggatcgtacagcaatagcccgtcgaatcctgtaaacagtcgggcaaaccaagatttttccgcacttatgcgctcaagctaccattgcgccatgaacaacgaaaatgcccgccttctgaccttccaaacctggccccttacctttctctcgccgacggatcttgcaaaggcaggattctattacatcggcccaggagacagagtcgcctgttttgcatgcggaggtaaactttcgaattgggagcctaaggataatgccatgagcgaacatctcaggcactttcctaagtgcccatttatcgaaaaccaacttcaggatacttccaggtacaccgtgtcgaacctcagcatgcaaacccacgcagcgaggttcaagaccttctttaactggcccagcagcgtcctggttaatccagaacaactggcatccgcaggtttttactatgtcggtaatagcgatgatgtgaaatgtttttgctgtgatggcggacttcgatgttgggaatctggggatgatccatgggtgcagcacgcaaaatggttcccccgctgtgaataccttataaggattaaggggcaggagttcattcggcaggtccaagcatcgtaccctcatttgctcgagcagctgctgtccacttccgattcgcccggcgacgaaaacgcagaatcctccatcatccatttcgaaccaggagaggatcattcggaagatgcaattatgatgaatacccctgtgataaacgcagcggtggaaatgggtttttcgaggtcccttgtgaaacaaactgtgcagcgcaagattcttgccaccggagaaaactacagactggtgaacgatctggtcctggatcttcttaatgcagaagatgaaatacgagaagaagagcgagaacgggcaactgaagaaaaggagtcaaatgatcttctgctgattcgcaagaatcgcatggcactgtttcaacatctcacgtgcgtcattcctatccttgatagcctgcttactgcaggaatcattaacgagcaagaacatgacgtgattaagcagaaaacccagacttcactccaggcgagggaactgattgacactatcctggtcaaaggaaacattgcggccactgtgttcaggaacagcctgcaagaggcagaagctgtgctctacgaacatctcttcgtgcaacaggacataaagtacatcccaactgaagatgtctccgatctgcccgtggaagagcagcttagacggctgcaagaagaaaggacctgtaaggtgtgtatggataaggaagtgtcgatcgtgttcatcccttgcgggcacctggttgtgtgtaaggattgtgcaccaagcctccggaagtgtccaatttgtcgaagcacgatcaaggggaccgtgagaacctttcttagc

SEQ ID NO: 32347 - DNA, 1812 bp, Artificial Sequence
  Description of Artificial Sequence: Synthetic coding sequence
atgaacatagtggagaactctatctttttgtccaacctgatgaagtctgcgaacaccttcgaactcaaatacgatctctcatgtgaactctacaggatgtccacatactcaactttccccgccggcgtaccggtctccgagagatcactggcccgcgcaggattttactacacaggagtgaacgacaaagtcaagtgcttctgctgcggattgatgctggacaactggaagcgcggcgactctcccaccgaaaagcacaaaaaactctatccttcctgtcgcttcgttcagtccttgaactcagtgaataaccttgaggccacaagtcaacccaccttccccagcagcgtaactaactctacccatagcttgctgccaggtaccgaaaatagtggctattttagaggtagctacagtaattccccaagtaaccctgtgaacagcagggcaaaccaggacttcagcgcactgatgcgctccagctatcactgtgccatgaacaacgaaaacgccagattgctcactttccaaacctggcccctcacgtttctgtcaccgactgatctggccaaagccggtttttactatatcggcccaggcgatcgcgtggcgtgttttgcatgcggcggcaaattgtcaaattgggagcccaaggacaacgccatgagcgagcacctgaggcacttcccaaagtgtcccttcatagaaaatcaattgcaggacactagcaggtacactgtgagcaacttgtcaatgcagacacacgcggctcgcttcaagacttttttcaactggcccagttccgtcctcgtgaaccctgaacagttggccagcgctggtttctattatgttggaaactccgatgacgtgaaatgtttctgttgcgatggcggactgcgctgctgggaatccggagatgatccctgggtgcagcacgccaagtggttccccaggtgtgaatacctgatcaggattaagggccaggaatttatccgccaggtccaagcctcttacccccatcttctcgagcaactgctgagcacctcagattctccaggcgatgaaaatgctgaaagctccatcattcacttcgagcccggtgaggatcactctgaggacgccatcatgatgaacaccccagtgatcaacgcggccgtagagatgggctttagcaggtctcttgtcaagcaaacagtacaaaggaagattctggcgaccggcgaaaattatcgcctcgtgaacgatttggtcctggatctgttgaacgctgaggatgagattagagaagaagaacgcgaaagagccacagaagaaaaggagtctaatgacctgctgttgatccgcaagaacaggatggccctgtttcaacacctgacttgtgtgatcccaatccttgacagccttctcaccgcgggaatcataaacgaacaggaacatgatgtgatcaaacaaaagactcagaccagcttgcaggctagggaactgattgacacaatcctcgtgaagggaaatatcgctgcaacggtgtttagaaatagtctccaggaggcagaagcggtgctctatgagcatctgttcgttcaacaggatatcaaatacatccctacagaggatgtgagtgacttgccagtggaagagcaactgaggaggcttcaggaagagcgcacgtgcaaagtctgtatggacaaggaagtaagcatcgttttcatcccttgtggacacctcgttgtctgcaaagactgcgccccatcactcagaaaatgcccgatttgtcgcagcacaatcaagggcactgtgaggacgtttctgtca

SEQ ID NO: 32348 - DNA, 1812 bp, Artificial Sequence
  Description of Artificial Sequence: Synthetic coding sequence
atgaacattgtagagaactcaatatttttatccaaccttatgaaatcagcgaatacttttgagctgaaatatgatctttcttgcgaattgtataggatgagcacttattccactttccctgccggtgttcctgtgtccgagcgcagcctggcaagggctggtttctattacaccggtgttaacgataaggtcaaatgtttttgttgtgggcttatgctcgataactggaaacgaggggatagccctacagaaaagcacaaaaaactttacccatcatgcaggttcgtgcagagtttgaacagtgttaataatttggaggctacttcacaacctacctttccaagttcggtaactaatagcactcattctctattaccaggaacagaaaatagcgggtattttaggggaagttacagtaattcaccgtccaacccagttaatagtagggctaatcaagatttttctgcgttgatgcgttcatcctaccattgtgctatgaataacgagaacgcaaggctcttgacgttccaaacttggcctctcacctttctctcacctacagatctggccaaggccggtttttattacattggcccaggagatcgcgttgcatgttttgcttgtggtggtaagctcagcaattgggaacccaaggataatgctatgagtgaacaccttaggcactttcctaagtgtccatttatagaaaatcaactgcaagatacttcccgttataccgtgtcaaatcttagtatgcagactcatgccgccaggttcaaaacttttttcaactggccatcttccgttctggttaatccggagcaacttgctagcgcaggattctactacgtagggaattccgatgacgtcaagtgcttttgctgcgatggaggtctcaggtgctgggaaagcggtgatgacccttgggttcaacatgcaaagtggttcccacggtgcgagtatttgatccggattaagggacaggagttcattcgacaagttcaagcttcgtatccgcatctactcgagcaacttttatcaaccagtgactccccgggggatgaaaatgctgagtcctcaattattcatttcgaacccggggaggatcacagcgaagatgccataatgatgaatacacccgttatcaatgctgctgtagaaatgggattctcgaggtctcttgttaagcaaactgtgcagaggaagatccttgctacaggagaaaactacagactcgttaatgatcttgttttagacctgttgaatgcagaagatgagataagagaagaagaacgagaacgtgctactgaggaaaaggaatccaatgacttgcttcttataagaaagaatcgaatggcactatttcaacacttgacctgtgttattcctatattggactctcttctcacggctggtatcatcaacgaacaagagcatgacgtgattaaacaaaagactcaaacctcccttcaagctagggagctcattgatacgatccttgtgaaggggaacattgcagctaccgtgtttcgaaattccttgcaagaggctgaggctgtcttgtacgagcatctcttcgtccaacaggacatcaagtatattcctactgaggatgtgtctgatcttcctgtggaagaacagctcaggcggttgcaggaagagagaacctgtaaggtttgtatggataaagaagttagcattgtattcataccatgcggtcatcttgttgtttgtaaggattgtgctccaagtcttaggaagtgtccaatttgtagatctacaatcaaaggcactgtcaggactttcctttcg

SEQ ID NO: 32349 - DNA, 1812 bp, Artificial Sequence
  Description of Artificial Sequence: Synthetic coding sequence
atgaacattgtggaaaactcaatctttctctcgaatctgatgaaatcggcgaacaccttcgaactgaagtacgatctgtcctgcgagctctatcgcatgagcacctactcaacttttcctgccggggtgccggtgtctgaacggtccctcgcacgcgcaggattttactataccggagtgaacgacaaagtcaagtgcttttgttgtggtctgatgcttgataattggaaacggggcgattcgccaaccgaaaagcacaaaaagctctaccctagctgtagatttgtccagtcgctgaactcggtgaacaatttggaagcaacttcgcaacccactttcccatcgagcgtcaccaacagcacccattccttgctgccaggaactgagaattccggttactttcgtggcagctactcaaacagcccgtcaaatccagtgaattcaagggcaaatcaggactttagcgcccttatgagatcatcgtaccattgtgccatgaacaacgagaacgcacgccttctgacttttcagacctggcccttgaccttcctttcacctacggacctggcgaaggcaggtttttactacatagggccgggcgatagagtcgcatgctttgcatgtggagggaagctctcgaattgggaacctaaggataacgcaatgtcagaacatctgagacactttcccaagtgtccatttatcgagaaccaactgcaagatacctcgcggtacactgtgtcaaacctgagcatgcagactcatgcggcaagatttaagacctttttcaattggccttcgtctgtgctggtgaacccagagcagctggcctcagcaggcttttactacgtgggtaactcggacgacgtgaagtgtttctgttgtgatggaggccttcgatgttgggaatcaggtgacgacccatgggtgcaacatgctaagtggttccctagatgtgaatatcttataaggattaagggtcaagagtttatccgtcaagtccaggcatcatacccccatctgcttgagcaattgctgtcaacttcagattccccaggggatgaaaatgccgaatcatccataatacatttcgagcccggagaagatcactccgaagatgcgatcatgatgaacaccccagtgattaatgcggcagtcgaaatgggattttcgagatccctcgtgaagcagaccgtgcaaaggaagatcctggcaactggagagaattaccgcctggtgaatgaccttgtgctggaccttcttaacgcagaggatgaaattcgggaagaagaaagagaacgggcaactgaagaaaaggaaagcaacgaccttcttctcatccggaagaaccgtatggcactcttccagcatctgacttgtgtcattcccatcctcgattccctgctcaccgcaggaatcatcaatgaacaggaacatgacgttatcaaacaaaaaactcagactagcctgcaagcaagagagctgatagataccatccttgtcaagggaaatatcgccgcaactgtctttcggaactccctgcaagaagcagaagccgtgctttacgaacacctgttcgtgcaacaggacataaagtacattcctactgaggacgtctcagatctcccagtggaggaacaactcaggcgacttcaggaagaaagaacttgcaaggtgtgtatggataaagaagtctctattgtgtttataccttgtggtcatctcgtcgtgtgtaaagattgtgctccatccctgagaaaatgccccatttgcagatcaaccattaagggtaccgtgaggactttcctgtcg

SEQ ID NO: 32350 - DNA, 1812 bp, Artificial Sequence
  Description of Artificial Sequence: Synthetic coding sequence
atgaatattgttgagaatagtatttttctatcaaatctcatgaagtctgcaaacacattcgagctgaagtatgacttgtcttgtgagctctacagaatgtcgacatacagcacgttcccagcaggcgtgcctgtgtccgaacgaagcctcgctcgggccggattttactatactggtgttaacgataaagtgaaatgtttctgttgtgggctgatgctagataattggaagcggggcgactctccaaccgagaagcacaaaaagctgtatcccagttgtcggtttgtccagtctttgaattctgtgaacaacctggaggcgacctcccagccaacattccctagttcagtcactaactcgacgcacagcctccttcctgggaccgagaactccggctacttcaggggctcatattctaatagtccctccaatcccgtcaacagcagagccaatcaggatttctctgctttaatgcgatcaagttaccactgcgcaatgaataacgagaatgcacgtctgctgacctttcagacctggccactcacgttcctttctccaaccgacctcgctaaagctgggttttactatataggacccggagaccgcgtcgcgtgctttgcttgtggcggtaaactatcaaattgggagcctaaggacaacgcaatgtccgaacacctcaggcacttccccaaatgtcccttcatcgagaaccagctgcaggacacctcaaggtatactgtgagcaacctaagcatgcaaacacatgcagcacggtttaagacattttttaactggccctcttcagttctcgtgaatcctgaacagcttgccagcgcggggttctattatgtggggaatagtgacgacgttaaatgcttctgctgtgatggcgggctgcggtgttgggagagtggagacgacccttgggtgcaacacgccaaatggttccctcgctgtgaatacctcataagaatcaaaggacaggagtttataaggcaggttcaggccagttatcctcacttattggaacagcttctgagtactagtgatagccctggtgacgagaacgccgaatcctcgatcatacattttgagccaggcgaggaccactcagaggacgctatcatgatgaacactccagtcataaatgcggcagtggaaatgggattctccaggtccctcgttaaacagacggtgcagcgcaaaattctggccactggggagaattacagactggtgaacgatttagttttggatttactgaacgctgaagacgaaatcagagaagaggaacgagagcgtgctacagaggagaaggaatctaacgacctgctgcttatcaggaaaaatcgaatggccctctttcagcatctcacctgtgtaattccaattctggacagtttgctcactgcagggatcatcaacgagcaggagcacgatgtcatcaaacaaaaaacccaaacctctctgcaggctcgggaactgatcgatacgatcctcgttaaaggtaacatcgccgccacggtctttagaaacagcttacaggaagcggaggctgtgctgtacgaacacttgtttgtacagcaggacattaagtacatcccaacagaggacgtgtccgatttgccggtagaagagcagttgcggcgccttcaggaggaacgtacatgcaaagtgtgtatggataaagaagtctccattgtattcatcccatgtggccatctggtggtgtgcaaagactgtgctcccagtctacggaagtgccctatttgtcggtcgaccatcaaagggacggtgcgcactttcctcagc

SEQ ID NO: 32351 - DNA, 1812 bp, Artificial Sequence
  Description of Artificial Sequence: Synthetic coding sequence
atgaacatagtcgaaaattcgatattcctgtcaaacctgatgaagagcgctaatacatttgaattaaagtatgacctttcttgtgagctttacagaatgagcacatatagtacctttcctgcaggtgtccccgtatctgaacgcagcttagcgcgggcagggttctactacacaggggtgaacgataaagtgaagtgtttctgctgcggcctgatgctggataattggaaaagaggcgacagcccaacagaaaaacataagaaactttacccatcctgccgcttcgtgcaatctcttaattctgtaaataatctggaggcgacatcccaaccgacttttcccagctcagtcacaaattctacacactcactgttgccaggtaccgagaacagcggctatttccgtgggagctactcgaattctccatcgaatccggtaaacagccgggctaatcaggacttctccgccttgatgagaagcagctaccattgtgcgatgaacaatgagaatgctaggcttctcacctttcagacctggcccctgacttttttaagcccaaccgacctagctaaagcaggcttctactacatcggcccaggcgacagggtggcatgtttcgcgtgtggaggtaagctgtcaaactgggagcctaaagacaatgccatgagcgaacaccttaggcacttccccaagtgtccatttatcgaaaatcagttacaggatactagcaggtataccgtgagcaacctctcaatgcagacccacgccgcccgcttcaaaactttcttcaattggccttcctcagtattggtgaatccagaacaactcgccagtgccggattctactatgtgggaaattctgacgatgtgaagtgcttttgttgcgatggtggtctcagatgttgggagtcaggggatgatccatgggttcagcatgccaaatggttccctcgatgcgaatacctaatccgcattaaagggcaagaatttatccgccaggtgcaagcctcatatccacatcttctagagcagttactcagtacttctgacagccccggtgacgaaaatgccgaatcctcaatcatccactttgagcctggtgaggatcatagcgaagacgcaataatgatgaacaccccagtaataaacgcggcagtagaaatggggtttagtagatcattggtgaagcagacagtccaacgcaagatcctagctactggagagaactaccgtctcgtgaatgatttggtactagatctcctcaacgccgaggacgagattcgggaagaagagcgagagagggcaaccgaagaaaaggaatctaatgaccttcttttaatccgaaaaaatcgtatggccctctttcagcatctgacttgtgtaattcccattttagatagccttctgactgctggtattattaacgaacaggagcatgatgttattaagcagaaaacccagacttcccttcaagccagagaactaatcgatacgattctagtcaagggaaacatcgctgctacagttttcaggaatagcttgcaggaagccgaagccgtgctgtacgaacacttattcgtgcagcaagacatcaaatacatacctacggaagacgtttcagacctgccagtggaagagcaactgcggaggttgcaagaggagcggacctgtaaagtgtgcatggacaaggaagtatcaatcgtgtttatcccctgcggacatctggttgtctgtaaagactgcgccccatccttgaggaaatgcccaatctgcagaagcacaattaaaggtactgtgagaaccttcctgtct

SEQ ID NO: 32352 - DNA, 1812 bp, Artificial Sequence
  Description of Artificial Sequence: Synthetic coding sequence
atgaatatcgtggaaaatagcatattcctgtcaaacttgatgaagagcgctaacactttcgagcttaaatatgatttgagctgcgagctgtaccggatgtccacatactctactttccccgctggggtaccagtgagcgaacggtccctcgcccgggccggattttactacactggggtgaatgacaaagttaaatgcttctgctgcggcttaatgctcgacaactggaaaagaggggatagtcccaccgaaaagcacaaaaaattatatccatcttgccgttttgtacagagtctcaattctgtgaacaatctcgaagccacaagccaacccactttccctagcagcgtgacaaattctactcactcgttactgccaggcacggaaaattccggctacttccgcggatcctattccaactcgccctctaacccggtgaacagccgtgcgaaccaagatttctctgctttgatgcgctcgagctatcattgcgcaatgaacaacgagaacgccaggctgctcaccttccagacgtggcccttgacctttctgagccctactgacctggctaaagccgggttctactatatcggacctggtgatcgggtcgcttgttttgcctgcggaggaaaactgagtaattgggaacccaaggacaatgccatgtctgaacacctacgccatttccccaaatgtcccttcatcgaaaaccagctgcaggataccagccgctacaccgtgtcgaatctgtctatgcagacccacgcggcacgttttaaaaccttttttaactggcccagctctgtgctggtcaatccggagcagctcgccagtgcgggtttctattacgttgggaattcagacgacgtgaagtgcttctgctgcgatggagggttaagatgttgggaatctggagacgatccttgggttcagcacgccaagtggtttccccggtgcgagtatctgattcgcatcaaggggcaggagttcatcaggcaggtgcaggcatcttacccccatctgcttgaacagctgctcagtacgtccgacagcccaggcgacgagaatgctgagtcaagcatcatacatttcgagccgggggaagaccactcagaggatgctattatgatgaacacccccgtaattaatgcagccgtggagatggggttttcccgcagcctggtcaaacaaacagtccagagaaagatacttgcgacaggagaaaactatcggctggtgaacgatctagtgttagatctactgaacgctgaggacgagatccgggaagaggaaagggagcgtgcgaccgaggaaaaagagtcaaacgacctcctcctgattcgcaaaaatcgaatggcgctgttccagcatctcacctgcgtaataccaattttagacagcctgctcactgctgggatcatcaacgagcaagagcatgatgttattaagcagaaaacccaaacgtcgctgcaggcccgggaactgatagataccatactggtgaagggaaatatagccgcaaccgtttttcgcaactccctccaagaagctgaagcagtcctctatgaacatttgtttgtgcagcaggacatcaagtatataccgaccgaggacgtttcagatctgccagtcgaggagcaactcagaaggctccaggaagagcgcacttgcaaggtgtgtatggacaaggaggtgtccatcgtgttcattccatgcggccaccttgtggtgtgtaaggactgcgccccttctcttaggaagtgtccaatttgtcgatccactataaagggtactgtgagaacatttctgtca

SEQ ID NO: 32353 - DNA, 1812 bp, Artificial Sequence
  Description of Artificial Sequence: Synthetic coding sequence
atgaatatcgtcgaaaacagtattttcttaagcaatcttatgaaatccgctaacacattcgaacttaaatacgacctctcatgtgaactgtatagaatgtcgacatacagcacattcccagctggagtgcctgtgagcgagcgcagccttgccagagctgggttttactacaccggggtgaacgataaagttaagtgcttctgctgcggactgatgcttgacaactggaagcggggggacagtccaacagaaaagcacaaaaagctttacccgagctgcagatttgtgcagtcgttgaacagcgtgaacaaccttgaggcgacctctcaacctacatttccaagttctgttacaaacagcactcactcgttgctccctggaactgaaaactcaggctacttcagggggagctacagcaattcccctagcaaccctgtgaacagcagggcaaatcaggactttagcgctcttatgagaagctcctaccattgcgctatgaacaatgaaaatgcacgcctgctgacattccagacctggccactcacgtttctgagccccactgatctggccaaggccggattctactatatagggcctggggatagagttgcctgcttcgcttgcggaggaaaattaagcaactgggagcctaaagataacgctatgtccgaacacctgcgccactttcctaagtgtcctttcatagaaaaccagttacaagatacctcaagatatacagtgtccaacttgtcgatgcaaacacatgcagcccgcttcaaaaccttttttaattggccaagtagtgtccttgttaaccctgagcagctggccagtgctggcttctactatgtcggcaatagcgatgatgttaaatgcttttgttgcgatggcggcctgcgctgttgggaatctggcgatgacccatgggtgcagcatgccaaatggttcccgagatgtgagtatttaattagaatcaaaggccaggagtttatccgccaggtacaggcctcttacccacatctgcttgagcagttgctctcaacaagcgattctcccggagatgagaacgcagagtcttctatcattcattttgagcccggcgaggaccattccgaggacgccatcatgatgaacaccccggttatcaacgcagctgtggaaatgggcttcagccgcagcctggttaaacagaccgtgcagcgtaaaatcttggccacaggggagaattacagactggtgaatgatctcgtcttggacctgctgaatgccgaggatgaaatcagagaagaggaaagggagcgtgccaccgaggagaaggagagcaacgacctcctgctgatccggaagaacaggatggcactgtttcagcatttaacttgtgtgattcctatcctggattccttgctcaccgcagggataattaacgagcaagagcacgacgtgatcaagcaaaagacacaaacatcgctccaggccagagagttgatcgatacaattttggttaaaggaaatatagcagcaaccgtttttcggaatagtctccaggaagcagaggctgttctctatgagcatctttttgtccagcaggacatcaagtatattcccacggaagacgtgagcgatctgccggtggaagaacagctgaggagactgcaagaagaaagaacctgcaaggtttgtatggataaggaagtctcaatcgtatttataccttgcggccacctcgtcgtctgtaaggattgcgcaccctctctgaggaaatgtccaatctgcagaagcacaattaaaggtaccgttcggacttttctgtct

SEQ ID NO: 32354 - DNA, 900 bp, Artificial Sequence
  Description of Artificial Sequence: Synthetic coding sequence
atggtggaaatcgatgccgcgtccgtgtacaccttgcctgccggcgccgattttctgatgtgctactctgtcgcagaaggatattactcccatcgggaaacagtcaatggctcttggtacattcaggatctctgtgagatgctgggcaagtacggatcatccttggaatttactgagctgctaacactggtaaataggaaagtctcccagcggcgggtcgacttttgcaaggatcccagcgccatcggcaagaaacaagttccctgcttcgcaagtatgttgactaaaaagctgcactttttcccgaaatcaaacttggagcatcaccatcatcatcatgtcgaaattgatggcggctccccgatgagtagtgcatccggacttcgtcggggacaccccgccggtggcgaagaaaatatgaccgagacagacgccttctataaacgcgagatgttcgatcccgctgagaaatataaaatggaccaccgccgtcgcggaatagctctgatttttaaccatgagagattcttctggcatttgaccctcccggaacggagggggacatgcgccgacagagacaacctaacacgcagattttcagacctcggctttgaagtcaagtgtttcaacgatctgaaagccgaggagttactcttaaagatccatgaggtgtctacagtctcccacgccgacgccgactgcttcgtttgcgtctttctttctcacggcgaaggaaatcacatctacgcttatgacgccaaaatcgaaattcagaccttaactggcttatttaagggtgacaaatgtcatagcctcgtgggaaaaccgaagatcttcatcatccaggcatgtcgggggaatcagcacgacgtcccggttattcctcttgatgtggtggac

SEQ ID NO: 32355 - DNA, 900 bp, Artificial Sequence
  Description of Artificial Sequence: Synthetic coding sequence
atggtggagattgatgctgcgagcgtctacacgcttcccgcgggtgccgattttcttatgtgttactccgtggcagaaggatactacagccaccgcgagacagtgaacgggtcctggtacattcaagacctctgcgaaatgctgggaaagtacggatcttctttggaattcaccgagctgctgacattggttaaccggaaagtttcacaacggcgtgtggacttctgcaaggacccttccgctataggcaagaagcaagtcccgtgtttcgcttccatgttgaccaagaagctccatttcttccccaaaagcaacctcgagcaccaccaccaccatcatgtagagatagacggggggtccccaatgagcagcgccagtgggctgcggcggggacaccccgctgggggcgaggagaatatgactgagactgatgcattttataagcgggagatgtttgatccggccgagaaatacaagatggatcaccgacgcagagggatcgctctcatctttaatcacgagcgctttttttggcacttaactctccctgaaagacgaggtacttgcgctgacagagataatctgacccggagattttctgatttggggttcgaggtgaaatgtttcaacgacctcaaggccgaggagctgcttcttaaaatccacgaagttagcacagtcagtcacgccgatgctgattgctttgtctgtgtgtttcttagccacggggagggtaatcatatctatgcctacgatgccaagatcgaaatccagactctgaccggattattcaagggtgacaagtgtcactccttggttggcaagccaaagatcttcatcatccaggcctgccgcggtaatcagcatgatgtccctgtaatccctctcgacgtcgtggat

SEQ ID NO: 32356 - DNA, 900 bp, Artificial Sequence
  Description of Artificial Sequence: Synthetic coding sequence
atggtggaaatagatgccgcatcagtgtacacactaccagctggagctgattttcttatgtgttattccgtggccgaaggatattactcacatagagaaacagtaaacggatcttggtacatacaggatctgtgtgaaatgttaggaaagtatgggtcatctctcgagttcactgagctccttactcttgtgaacaggaaagtatcccagagacgggttgacttttgtaaggatccaagtgccatcgggaaaaaacaggtcccttgttttgcatccatgctcacaaagaaactccatttctttccaaaaagtaatttagaacaccaccatcaccaccatgttgaaatcgatgggggatccccaatgtcctctgcgagtggattacgccgaggacatcccgctgggggggaagaaaatatgacagaaacagatgctttttataagcgggaaatgtttgatcccgctgaaaaatacaaaatggatcatagaagaagaggaatagctcttatcttcaaccatgagcggtttttctggcaccttactctacctgagcgaagaggaacttgcgccgatcgcgataacctcactcgcaggttctccgatttgggattcgaggtgaaatgtttcaacgatttgaaagccgaagaactgcttttgaaaattcatgaagtatccacagtaagtcacgcagacgctgattgctttgtgtgtgtcttcctgtcccatggagaagggaatcatatttatgcttacgacgcaaagatagagatccagactctcacaggactctttaagggggataaatgccacagtctggtgggaaaacccaagatattcattatccaagcctgtagaggaaatcagcacgatgtgcccgtgatccccctcgatgtggttgat

SEQ ID NO: 32357 - DNA, 900 bp, Artificial Sequence
  Description of Artificial Sequence: Synthetic coding sequence
atggtggaaattgatgcagcatcagtctacaccctgcctgccggagcagacttccttatgtgttactcggtcgctgaaggttactacagccaccgtgagactgtcaacgggtcatggtacatccaagacctttgcgagatgctgggaaagtacgggtcctcactcgaatttacggaactccttacgctggtgaacagaaaagtgtcacagagacgcgtggatttttgtaaagaccccagcgccatcggtaagaaacaagtgccctgctttgcatcaatgcttaccaaaaagttgcacttcttccccaagtcgaacttggaacatcatcaccaccatcacgtggaaatagatgggggttcccctatgagcagcgcatcggggttgagacggggtcacccagcgggcggtgaggaaaacatgactgaaactgatgcgttctacaagcgcgaaatgttcgatccggcggagaagtataagatggatcatagaaggaggggaattgcactgatcttcaatcacgaaaggtttttctggcatcttactctgcccgaaagaagaggaacttgtgccgatcgagataatctcactcgccgattttcagacctgggttttgaggtgaagtgcttcaacgatctgaaggccgaagaacttcttctgaagatccacgaagtcagcaccgtctcccatgccgacgctgattgttttgtgtgtgtgtttctcagccatggagaggggaatcatatctacgcatacgacgcaaagattgaaatacagaccctcactggtcttttcaaaggtgataagtgtcattcgcttgtggggaaacctaaaatctttatcatacaagcgtgtcgtggcaaccagcatgatgtgcccgtgatccccctggatgtggtggac

SEQ ID NO: 32358 - DNA, 900 bp, Artificial Sequence
  Description of Artificial Sequence: Synthetic coding sequence
atggtcgaaattgacgctgcctcagtttatactttgcctgccggggccgacttcctgatgtgttatagtgtggcagagggctactattcccaccgagagacggtcaatgggagttggtatatccaggacctgtgtgaaatgctgggcaagtacggctcctccttagaatttacagaactgttgacactcgtgaataggaaggtgtcccagcgaagggtcgatttttgcaaggacccgtctgccattgggaaaaagcaggtgccttgcttcgctagtatgcttaccaagaagctccatttcttcccaaaatccaacctggagcaccatcatcaccatcacgtcgaaattgatggcggcagcccaatgagcagtgccagtgggctgagaagaggccacccagccggaggggaggagaacatgactgagacggacgctttctacaagcgagaaatgtttgatccagcggagaagtataagatggaccataggcggagaggaatcgccctgatattcaatcatgaacggttcttctggcacctaacactgccagagcggagagggacatgcgcggacagggacaatttgacccgcaggttttctgatttaggcttcgaagttaagtgttttaatgacctgaaggccgaagagctgcttctgaagatacatgaggtgagcactgtgtctcatgctgacgcggactgtttcgtgtgtgtgttcctgtcacacggcgaggggaatcacatctatgcttacgatgcaaagatagaaattcaaacactgactggtcttttcaagggtgacaagtgtcactcactggtggggaaacccaaaatctttatcattcaggcgtgccgcgggaaccagcatgacgttcctgtgatcccgctggacgtcgtcgac

SEQ ID NO: 32359 - DNA, 900 bp, Artificial Sequence
  Description of Artificial Sequence: Synthetic coding sequence
atggtggaaattgatgcagcatccgtgtacactttgccagctggtgcagactttcttatgtgttactcggtggcggagggttactactcgcaccgagaaaccgtcaatggctcgtggtacatccaagacctgtgtgagatgctgggcaaatacggttcatcacttgaatttaccgaactgctgacgctggtgaacagaaaggtgtcacagagaagagttgacttttgtaaagatccttcagcaattgggaagaagcaggtgccatgctttgcctccatgttgaccaagaagctgcatttctttcctaaaagcaatctcgaacaccaccaccaccatcatgtggaaatcgacggtgggtcaccaatgtcgtcggccagcggacttagacgcggacatcctgccgggggagaggaaaacatgacggagacggatgcattttacaagcgggaaatgtttgatccggccgagaagtataagatggatcatcggcgtcgtggaatcgccttgatattcaatcacgaacgcttcttctggcatctcactctgccggagcggcgggggacctgcgcggaccgtgataacttgactcgacggttttccgacctggggtttgaggtgaagtgcttcaacgatctgaaagcggaggaacttctgctcaagatccatgaagtgtctaccgtgtcccatgcagatgctgattgcttcgtgtgtgtgttcctctcacatggcgagggcaaccacatatacgcatacgacgcgaagattgaaattcaaactctcactggacttttcaagggagacaaatgtcactcgctggtcgggaagcctaagattttcatcattcaagcatgtcgcggcaaccagcatgacgtccccgtgatccctcttgacgtcgtggat

SEQ ID NO: 32360 - DNA, 900 bp, Artificial Sequence
  Description of Artificial Sequence: Synthetic coding sequence
atggttgagattgatgccgctagtgtctacaccctcccagccggggcagatttcctcatgtgttactctgtcgccgaggggtattattctcaccgtgagactgtaaatgggagctggtacatccaagatttgtgcgagatgttggggaagtatggttcatctcttgagttcacagagctgctgactctcgtgaaccgaaaggtgtcccagcggcgtgtcgatttctgcaaagatccaagcgcaattggaaagaagcaagtaccatgcttcgcttctatgctgaccaaaaagttgcacttcttcccaaagagtaaccttgaacaccatcatcaccatcatgtggaaattgacgggggatccccaatgtctagtgcttctggcctgcgaagaggtcacccggcagggggagaagagaacatgaccgaaacagatgctttctacaagcgtgaaatgttcgaccctgccgaaaaatataagatggaccacaggcgtaggggcatagccttgatcttcaaccacgagcgttttttctggcaccttaccctccctgaacgtcgcggcacgtgcgcggaccgagacaatctcacccgccgcttttctgatctcggttttgaggtgaagtgctttaacgatctaaaggccgaggaattgcttttgaaaatacatgaagtatccacagtgtctcatgctgacgcggattgttttgtatgtgtctttttgtctcatggggaggggaaccatatttatgcatacgatgccaaaatcgaaatacagactctcacgggtctgtttaagggtgataagtgtcactcactcgtgggaaaacctaagatttttatcatacaagcttgtcgtgggaaccagcatgacgtgccagtgatcccgctagacgtcgtcgat

SEQ ID NO: 32361 - DNA, 900 bp, Artificial Sequence
  Description of Artificial Sequence: Synthetic coding sequence
atggttgagattgacgctgcctccgtctacacgcttccagcaggcgctgacttcctcatgtgttactctgtagctgaaggatactatagccacagggaaacagtcaacggaagctggtacatccaggacctgtgcgaaatgcttgggaagtacggatcatccctggagttcactgagctgcttaccctggtgaaccggaaagtgagtcagcgcagggtggacttctgtaaggacccttctgctatagggaagaaacaggtgccttgtttcgctagcatgctgaccaaaaagttgcatttttttcctaaatcaaacctcgaacaccaccatcaccaccacgtcgagattgatggaggaagccctatgagttcagcatcgggcctgagacgtggtcaccccgccgggggcgaagaaaacatgacagagactgacgcattctacaagcgcgaaatgtttgaccctgcagaaaaatacaaaatggatcacaggcggaggggaatcgctctgatctttaaccacgagcgattcttctggcatttgacacttccggaacgcagaggtacatgtgctgatagagataacctcactcgtcgattctcagacctcggatttgaggtaaagtgtttcaacgatctgaaggctgaagaactgcttttaaagatccacgaggtgtcaaccgtcagccatgctgacgccgactgtttcgtgtgcgtgtttctgagtcatggagagggcaatcacatctacgcgtacgatgctaagattgaaatacagactttaaccggccttttcaagggcgataagtgccacagcctggtgggcaagccaaaaatctttatcattcaggcctgccggggcaaccagcacgatgtccctgtgatcccccttgatgttgtggat

SEQ ID NO: 32362 - DNA, 900 bp, Artificial Sequence
  Description of Artificial Sequence: Synthetic coding sequence
atggtggagatcgacgccgcatcagtttatacactaccagctggagccgatttcctaatgtgttattccgtggcagaagggtactactcgcatagagagactgtaaatgggagttggtatatacaagatttatgtgaaatgctggggaagtacggatcctctctcgagttcactgaattactgacattagtcaacaggaaagtgtctcagcggagagttgacttctgtaaagatcctagtgcaattggaaaaaaacaggtcccttgctttgcttcgatgcttactaaaaaacttcatttcttccccaagtctaacctggaacatcaccatcaccaccatgtcgaaatcgatggggggtcccctatgtcttccgcttctggactgcgacgcgggcatcccgctggaggagaagaaaatatgacagaaacagatgctttctataaaagggaaatgttcgaccctgctgagaaatataaaatggatcacaggcggcgggggatcgccctaatctttaaccacgaacggttcttttggcacttaactctgccggagcgacggggaacttgtgccgatagagataatctcacgagaagattttcagatctcggattcgaagttaaatgcttcaacgatctgaaagctgaagaactactactgaagatccatgaggtgtcaacagtatctcacgccgatgctgattgctttgtatgtgtgtttctctcacacggagaagggaaccacatctacgcatatgatgccaaaatagaaatacagacattaacagggctctttaaaggagataaatgtcactccttagtagggaaacctaagatttttattatacaggcatgtcgggggaatcagcacgacgtgcctgtaatcccattagacgtggtagat

SEQ ID NO: 32363 - DNA, 900 bp, Artificial Sequence
  Description of Artificial Sequence: Synthetic coding sequence
atggtcgagatcgatgcagcttccgtctacactctcccggctggcgccgatttccttatgtgctactctgtcgccgaaggctactattctcaccgcgagaccgtgaatggctcatggtacattcaggatctttgtgaaatgctgggcaaatacgggtcgtcactggaatttacggaactgttaactttggtgaacaggaaggtaagccagcgtcgggtcgacttttgcaaggacccaagcgccataggaaagaagcaggtcccatgttttgcctctatgctgacaaagaagctccatttttttcctaagtctaatctggaacatcaccatcaccaccacgtggagatcgacggggggagcccaatgagttcagcttcgggcttgaggcggggccaccccgctggcggcgaagagaacatgaccgaaaccgacgcattctacaaacgtgagatgtttgatccagctgaaaaatacaagatggaccacagaaggagaggtatcgctctgatcttcaatcacgaaaggttcttctggcacctgacgctgccagagagacgaggaacctgcgctgatcgggataaccttaccagacgcttctctgacttaggctttgaggtgaagtgtttcaatgaccttaaggccgaggaactgctgctcaagattcacgaggtttctaccgtctctcatgctgacgcagactgttttgtgtgcgtttttctttctcatggtgaaggaaatcacatctatgcctatgacgctaaaatcgagattcaaaccctgaccggcctcttcaagggtgacaagtgtcactccctggtcgggaaaccgaagatttttatcatccaggcctgccgggggaatcagcatgatgttcccgtgattccgctcgatgtcgtcgat

SEQ ID NO: 32364 - DNA, 900 bp, Artificial Sequence
  Description of Artificial Sequence: Synthetic coding sequence
atggtagagatcgatgcagcatccgtgtacactctcccagcaggcgccgacttcctaatgtgctactccgtggccgagggctactattcacacagagagaccgtgaacgggtcgtggtatattcaggacttgtgcgagatgttaggtaaatacggttcctctctggagtttactgaactcctcactttggtgaaccgcaaggtcagtcagcgtagggtggacttttgtaaagatccctccgctataggcaagaaacaggtaccatgctttgcatcgatgctgaccaaaaaactccacttctttccaaagagcaatctggagcatcaccaccaccatcacgtggagattgacgggggcagtccaatgtcaagcgcgtcggggctccggaggggacacccagctggaggcgaggaaaatatgacagagaccgacgccttctacaaaagggaaatgtttgatcccgccgaaaagtacaagatggaccacaggcggaggggaatcgctcttatctttaatcacgaacgctttttctggcatctcactttgcctgagcgccggggaacttgtgccgatcgagataatctgaccaggcggtttagtgatctgggattcgaggtgaagtgcttcaatgatcttaaggctgaggagttgttgcttaaaatccatgaggtctcaacagtctcacacgctgatgctgattgtttcgtgtgcgtgttcttatcccatggggagggaaatcacatttacgcctatgacgccaaaattgagatccagacattaacgggccttttcaaaggtgataaatgtcattcccttgtaggaaaaccaaaaattttcattattcaggcttgtagaggcaatcagcacgatgtgcctgttatcccactcgatgtcgtcgat

SEQ ID NO: 32365 - DNA, 900 bp, Artificial Sequence
  Description of Artificial Sequence: Synthetic coding sequence
atggttgaaatcgatgcggcgtcagtttacaccctgcccgccggagctgacttcctgatgtgctactctgtggccgaaggctattattctcatcgtgagaccgtgaatggctcctggtacatccaagatctgtgcgaaatgctgggaaagtatggaagctccctggaattcacggagctgctgactctggttaaccggaaagtgtctcaacgaagagtcgatttttgtaaagacccaagcgccatcggcaagaaacaggtgccgtgttttgctagcatgctgaccaaaaagttgcacttttttccgaaaagcaaccttgagcatcaccaccatcaccacgtggaaatcgatggtggtagcccgatgagctcggcctctggattgcgacgaggccatcctgccggtggggaggagaacatgactgagactgacgccttctacaaacgcgagatgttcgatccagccgagaagtacaaaatggatcatcgccgtaggggaatcgctctgattttcaaccacgagcgcttcttttggcacctgactctgcccgaacgacgaggtacttgcgccgaccgggataacctgactcgccgtttctctgacctaggctttgaggtcaagtgttttaatgacctgaaagcggaggaactgcttctgaagattcacgaggtgtcgacagtgtcgcatgctgacgcagattgtttcgtgtgcgtgttccttagccacggcgagggcaaccatatttacgcgtacgacgccaagatcgagatccagaccctgactggcctgttcaaaggtgataagtgtcattctcttgtggggaagccaaaaatttttatcatccaagcttgccgtggtaaccagcacgacgttccagtgattccactggatgttgtagat

SEQ ID NO: 32366 - DNA, 900 bp, Artificial Sequence
  Description of Artificial Sequence: Synthetic coding sequence
atggtggaaattgacgcagcatcggtgtacaccctcccagcgggagccgacttcttgatgtgttacagcgtggccgaaggatactactcccatcgggagactgtgaatggaagctggtacatccaagacctttgcgagatgctgggaaaatacggtagcagcctcgagtttaccgaactgctcacccttgttaaccgcaaggtttcgcagcgaagggtggacttttgcaaggatccgtcggccattggaaagaagcaggtgccatgttttgctagcatgcttaccaagaagctgcactttttccctaagagcaatttggaacatcatcaccatcaccacgtcgaaatcgatggtggatcgcctatgtcctcggcatcgggtttgaggcggggacatcccgcaggaggtgaagagaacatgaccgaaactgacgcattttacaagagagaaatgttcgatccagccgaaaagtacaagatggaccaccgacgccggggtattgctttgattttcaaccatgaacggttcttctggcatcttactttgcccgaacgtagaggaacgtgcgccgacagagataatctgactcgtagattctcagacctgggattcgaggtgaagtgctttaacgatctgaaggctgaagaacttcttctcaagatacatgaagtctcaactgtgtcgcacgcggatgccgattgctttgtgtgtgtgtttcttagccatggagaagggaatcacatatatgcctacgatgcaaagattgaaattcaaactctgaccggactcttcaagggagataagtgtcattcccttgttgggaaacctaagattttcattattcaagcatgtcgtgggaaccagcatgacgtgcctgtgatcccactcgatgtggtcgac

SEQ ID NO: 32367 - DNA, 900 bp, Artificial Sequence
  Description of Artificial Sequence: Synthetic coding sequence
atggtggagattgatgcagcctccgtctacactcttccagctggggcagactttctcatgtgttactccgtcgcagaaggctactactcgcatcgggaaaccgtgaacggatcctggtacattcaggatttgtgcgagatgctgggaaaatacggatcgtcgctcgagtttaccgagttgctgactctggtgaaccgcaaggtgtcgcagaggcgggtggacttttgtaaggatccctccgcaatcggaaagaagcaagtgccttgctttgcatcgatgcttactaagaagctccacttttttcctaagagcaacctcgagcatcaccaccatcatcatgtggaaatcgacggagggagccctatgtcctcggcctcgggactgcgtcgcggacatccagcgggaggagaggagaatatgaccgaaaccgacgcattctacaaacgagaaatgttcgatccagcagagaagtataagatggatcataggcggcggggcattgcactcatcttcaaccatgaacgtttcttttggcatcttactcttccagaacgacgcggtacctgtgccgatcgggacaacctgacccggagattctcggatctcggctttgaagtgaaatgcttcaatgacctcaaggcagaagagcttctccttaagattcatgaagtaagcactgtctcccacgccgatgcagactgttttgtctgcgtttttctttcccacggtgagggtaaccacatatatgcgtatgatgcaaagattgaaattcagaccctgaccgggctgttcaagggagataagtgccattctctggtgggtaagcccaagattttcattatccaagcatgccgcggaaaccaacacgacgtgcctgtgattcctctggatgtggtcgac

SEQ ID NO: 32368 - DNA, 900 bp, Artificial Sequence
  Description of Artificial Sequence: Synthetic coding sequence
atggtggagatcgatgctgcatccgtgtataccctgccagcgggggccgactttctgatgtgctacagcgtcgccgagggttattacagtcaccgcgagaccgtgaacggcagttggtatatacaggatttatgcgagatgctcggcaagtacggttcaagtcttgagttcaccgagctactgacattggtgaaccggaaagtttctcagagaagggtggacttttgcaaagacccttccgctatcggtaaaaagcaggtgccatgttttgcctcgatgttaacaaagaagctgcacttctttcccaaaagtaatcttgagcaccaccatcaccaccacgtggagatcgacggaggatccccgatgtcctcggccagtggtttaaggcggggacacccggcagggggcgaggaaaatatgacagagacagacgcattttacaagcgagaaatgtttgatcctgcagagaaatacaaaatggatcatcgcaggcgcggtatcgccctgatttttaatcatgagcgatttttctggcatttaactctgccagagagacggggaacatgcgctgatcgcgacaatctaactcggcgattctcagaccttggcttcgaagtgaagtgcttcaacgatctcaaagccgaggagctgctgctaaagatccacgaggtgtcaaccgtcagccatgctgacgctgactgtttcgtttgcgtcttcctgagccatggcgaagggaaccacatttatgcatatgacgctaaaatcgaaatacaaacactaactggcttattcaaaggcgacaagtgtcacagcctcgttggtaagcctaaaattttcattatccaggcttgtcgggggaatcagcacgacgtgcctgtgattcccctcgatgttgtggat

SEQ ID NO: 32369 - DNA, 900 bp, Artificial Sequence
  Description of Artificial Sequence: Synthetic coding sequence
atggtcgagatagacgcggcttcagtgtacacgttgccggcaggagctgatttcctcatgtgttacagcgttgcagaaggttactactcgcatcgcgaaaccgtgaatggaagctggtatatccaagatctttgcgagatgctcggaaagtacggcagctctttggaattcactgaattgctgaccctggtgaaccgcaaggtgagccagcgcagagtcgacttttgcaaggatccgtcggcgattggtaagaaacaggtgccctgctttgcgtcgatgttgactaaaaagctgcacttcttcccgaagtcgaatctggagcatcatcaccaccaccacgtcgaaatcgatggcggatctcctatgtcctccgcttccggtctgcgaaggggacacccggcaggaggggaggagaacatgaccgaaaccgatgcattttacaagagggaaatgttcgaccccgccgagaagtacaaaatggatcatcggcgcaggggcatcgcccttatcttcaaccatgagcggttcttttggcatcttacgctcccagaacggaggggaacctgtgcggatcgcgacaatctcaccaggaggttctcggacctgggattcgaagtaaagtgctttaacgatctgaaggctgaagagctgttgctgaagattcacgaagtctcgactgtgagccacgccgatgctgactgcttcgtctgcgtgttcctgagtcacggtgaaggcaaccacatctacgcctacgatgcgaagatcgaaattcaaactctcaccggacttttcaaaggggacaaatgtcactccctggtgggaaagccgaaaatcttcatcatccaagcgtgccgtggcaatcagcatgacgttccagtgatccctctcgacgtcgttgac

SEQ ID NO: 32370 - DNA, 900 bp, Artificial Sequence
  Description of Artificial Sequence: Synthetic coding sequence
atggtcgagatagatgccgctagcgtgtacaccctgcccgccggggctgattttctgatgtgttactccgtggcagaaggatattactctcacagagagacggtcaatggaagctggtacattcaagatttatgtgagatgctaggaaagtatggctcgagtttagaattcacagagctgcttacattggtcaacaggaaggtgtctcaacggagagtagatttttgcaaggatccttcagcgattggtaagaaacaagtgccttgcttcgcatcaatgctgacaaagaaactgcacttcttccctaaaagcaacctcgagcaccaccatcaccatcatgtggaaatcgatggcggatccccgatgagttctgcaagcggtctcagaagaggccatccagccggtggagaggagaacatgactgaaaccgatgctttctacaagagggagatgtttgatcccgccgagaagtacaaaatggaccatcggagacgcggcatagctcttattttcaatcacgaaaggttcttttggcatcttaccttaccagagcgtcgtggcacctgcgcagatagagataacctgactcgccgcttctctgaccttggattcgaagtgaagtgcttcaacgatttgaaggcggaagagctgttgttgaagatccacgaagtctccaccgtgagccatgcagacgctgattgctttgtgtgcgtctttctgagtcacggtgaaggcaaccacatctatgcatacgatgccaaaatcgaaattcagaccctcaccggactctttaagggcgataagtgtcactccctcgtgggaaagccaaaaatctttatcattcaggcttgtagggggaaccagcatgacgtgcctgtaatcccactggatgtggtagat

SEQ ID NO: 32371 - DNA, 900 bp, Artificial Sequence
  Description of Artificial Sequence: Synthetic coding sequence
atggtggaaatagatgcggcaagcgtgtataccctcccagccggagcagacttcctcatgtgttacagcgtcgctgagggctactactcgcaccgcgaaactgtgaacgggtcatggtatattcaagatctctgtgagatgctggggaagtacggctcctcacttgaatttaccgagctgctcacccttgtcaaccggaaagtgtcacaacgcagagtcgatttctgtaaggacccatcagcaattggaaagaagcaagtgccatgctttgcatcaatgcttaccaaaaaactccacttctttcctaaatccaacctggaacatcatcatcaccatcacgtcgaaattgatggaggtagccctatgtcgagcgcatccggacttcgaagaggtcacccggctggtggcgaagagaatatgactgaaactgatgcattttacaagagagagatgtttgatccagcagagaaatacaaaatggatcacagacggagaggaatcgcactgattttcaaccatgagcgtttcttttggcatttgacgctgcctgaaagacgggggacctgtgcagacagggacaacctgactcggaggttctcagaccttggatttgaggttaaatgttttaacgacctgaaggccgaagaactcctgcttaagattcatgaagtatccactgtgtcacatgcagatgcagactgttttgtgtgcgtgtttctcagccatggggaagggaatcacatttacgcttacgatgcaaagattgaaatccaaaccctgactggactgtttaagggggacaagtgtcattcccttgtgggaaaacccaagattttcattatacaagcatgcagaggaaaccaacacgacgtgcccgtcattccccttgatgtcgtcgac

SEQ ID NO: 32372 - DNA, 900 bp, Artificial Sequence
  Description of Artificial Sequence: Synthetic coding sequence
atggttgaaattgatgcagcttccgtgtacactctgcctgcgggagcggattttctgatgtgctactcggtggctgaaggatattactcgcacagggaaaccgtgaatggttcgtggtacatccaggacttgtgcgagatgctcggcaagtacgggtcctcgctggagttcaccgaactgctgacgctcgtgaaccggaaggtgtcgcaaagaagagtcgatttctgtaaggacccgtccgccattgggaaaaagcaggtgccttgcttcgcttctatgcttaccaagaagctgcacttcttcccaaagagcaacctcgaacatcaccatcatcaccacgttgaaatcgacggaggcagcccaatgagtagcgcgtcagggcttcgccgcggacatccggctggaggcgaagagaatatgactgaaactgatgccttctacaaaagagagatgtttgacccagccgagaagtacaagatggatcacaggcgccggggaatcgcactgatctttaatcatgaacggttcttctggcatctgaccctcccggagcgccgcggtacttgtgcagaccgggacaaccttactcggcggttctccgatctgggattcgaggtgaaatgtttcaacgatctgaaggccgaagaactcctcctcaagattcacgaagtgtcaaccgtgtcccacgctgacgctgattgctttgtctgcgtgtttctgtcgcatggagaagggaaccatatctacgcctacgacgcgaagatcgagattcagaccctcaccggcctcttcaaaggagacaaatgccactccctggtgggcaagccgaagatcttcatcatccaggcgtgccgcggcaaccaacacgacgtgccagtgattccgttggacgtggtggac

SEQ ID NO: 32373 - DNA, 900 bp, Artificial Sequence
  Description of Artificial Sequence: Synthetic coding sequence
atggtggaaattgatgcagcaagcgtgtacaccctgccagcgggagcagattttctcatgtgttactcagtcgcagagggttactattcgcacagggaaacggtgaacgggagctggtacattcaagatctttgtgaaatgctcgggaagtacggttcgtctcttgagtttactgaactgctcacccttgttaaccgtaaagtctcccagcgccgtgtggacttttgtaaagatccttcagcaattggtaaaaagcaggttccatgctttgcgtccatgctgaccaaaaaacttcactttttccctaagtcgaatcttgagcatcatcatcaccaccacgtggaaatcgacggaggttcgcccatgagctctgcatcgggtctgaggcggggacatccggcgggaggcgaggagaatatgactgagacggatgccttctataagagggaaatgttcgatcccgcggaaaagtacaagatggaccatcgacgcagaggcatcgcactgatattcaaccatgagaggtttttctggcaccttacgcttccagaaagaagaggaacctgtgcagatcgtgacaatctcaccagacggtttagcgatctgggatttgaggtgaagtgcttcaacgatttgaaggccgaagaactgctgctgaagattcatgaggttagcaccgtcagccacgccgacgcagattgctttgtgtgcgtgtttctctcccacggggaaggaaatcatatctacgcatacgatgccaagatagaaatccagacgcttactggtctgttcaaaggcgataaatgtcattccctggtgggcaagcctaagattttcataattcaagcctgtcgcggaaaccaacatgatgtgccagtgatccccttggacgtggtggat

SEQ ID NO: 32374 - DNA, 900 bp, Artificial Sequence
  Description of Artificial Sequence: Synthetic coding sequence
atggtcgaaattgacgcggcctctgtctataccctgcccgccggggcggactttctcatgtgttactcggtggccgagggatactactctcatcgcgaaactgtgaacggaagctggtatatccaagatctctgcgagatgctgggcaagtatggatcctcgctcgagttcactgagctgctgacgctcgtgaacagaaaggtgtcccaaagacgggtggacttctgtaaggacccgtccgcgatcggtaagaaacaggtgccgtgcttcgcgtcgatgctgaccaagaagctgcactttttcccgaagtcgaatctggagcatcaccatcaccaccatgtcgaaatcgacggaggatccccgatgtccagcgcttcggggctgcgcaggggacacccggccggaggtgaggaaaacatgaccgagactgacgctttctataagagagaaatgttcgaccctgccgaaaagtacaagatggaccaccggcggagaggcattgcactcatcttcaaccatgaaagatttttctggcatctgaccctgccagagcggcgaggaacctgcgccgacagggacaacctcactcggcgcttctccgacctgggctttgaagttaaatgcttcaatgacctgaaggctgaggagttgctgctcaaaatccacgaagtgtccactgtttcccatgcggatgcggattgcttcgtctgcgtgttcctgtcccacggcgaaggaaatcacatctacgcgtacgatgccaaaattgagatccagactcttactggcttgttcaagggagataagtgccactcactcgtggggaagccaaagattttcatcattcaggcctgccggggaaaccagcacgacgtgccagttatcccgctggacgtggtggat

SEQ ID NO: 32375 - DNA, 900 bp, Artificial Sequence
  Description of Artificial Sequence: Synthetic coding sequence
atggtcgaaattgacgctgcctcggtctacacccttcctgctggggcggatttccttatgtgctattccgtcgctgaaggttattactcacacagggagacagtaaatgggtcttggtacattcaggacctctgcgagatgctgggtaagtacgggtcgtccctcgagttcactgagctgctgactctcgttaacagaaaggtcagtcagagacgcgtcgacttttgtaaggaccctagtgctatcggaaaaaagcaggtgccgtgctttgcgtccatgctaactaaaaagctgcactttttcccgaagagtaacctcgagcaccatcaccatcatcatgtcgagatcgatggaggatcacccatgtcaagcgcatccggcctccgcagaggacaccctgccggcggcgaagaaaacatgaccgagaccgatgctttctataaaagagagatgtttgacccagcagagaaatataagatggaccacaggcgccgcgggatagcgctcatctttaaccacgaacggttcttctggcacctcactttgcccgaaaggcgcggcacctgtgccgatcgagacaatcttacgcgccgtttctccgacttgggcttcgaggtcaaatgcttcaacgacctaaaggctgaggagctactcctcaaaatccacgaagtatctaccgtttcccacgccgacgccgattgtttcgtgtgcgtcttcctcagccacggtgagggcaaccatatttacgcatatgatgcgaaaatagagattcaaactctgacaggcctgtttaaaggggacaagtgtcacagcttggtgggcaagccgaagatcttcattatccaggcttgccgggggaatcagcacgacgtgccggtcattccactcgacgtggtggac

SEQ ID NO: 32376 - DNA, 900 bp, Artificial Sequence
  Description of Artificial Sequence: Synthetic coding sequence
atggtggaaatagatgctgcctcagtgtacacattgcccgctggtgcggactttcttatgtgctatagtgtagcggaaggttactacagtcatagagagactgtgaacggtagctggtacatccaggatctctgtgagatgctcggtaagtatggatcaagtctcgaattcaccgagctccttactctggttaaccgcaaagtcagccaacgcagggttgatttttgcaaggatccatccgctatcggtaaaaaacaggtgccttgcttcgcgtcaatgctgacaaagaagttgcacttcttccccaaatccaacttggagcaccaccaccatcaccatgtggagattgatggtggtagccccatgtcatccgcaagcggtttgaggcgcggtcacccagccggaggagaggagaacatgactgagaccgacgcattctataaaagggaaatgttcgatcccgctgagaaatacaagatggaccaccgccgccgcggaatagctctgatttttaatcacgagagattcttctggcacctgaccctgcctgaaagaaggggaacatgtgccgaccgcgacaacctgactcgcaggttctccgacttgggctttgaggtgaaatgcttcaatgatctcaaagccgaggaactgctcctgaagatccatgaagtatccacggtttcccacgccgacgctgattgcttcgtgtgcgtattcctgtctcacggtgagggaaatcatatttacgcgtacgacgcaaaaatcgagatccagacattgacaggactgttcaaaggcgacaagtgtcactccttggtgggcaagccaaagattttcattattcaggcatgtcgcggaaaccagcatgacgtgcccgtcattcccttggatgtggttgat

SEQ ID NO: 32377 - DNA, 900 bp, Artificial Sequence
  Description of Artificial Sequence: Synthetic coding sequence
atggtagagatcgatgcagcttccgtctacacgctgccggcgggagccgactttctgatgtgctactcagtagcagaaggctactactcacatcgggagactgtgaacgggtcatggtacatccaggatctgtgtgaaatgctgggcaagtatggatcttcactggagttcacggagctgttgaccctggttaataggaaggtgtcgcaacgaagagtggacttctgcaaggacccatcggcgatcgggaaaaaacaggtgccatgcttcgcaagcatgctcaccaagaagctccatttcttcccaaagtcaaacttggaacaccaccatcaccaccacgttgaaatcgacggaggcagtccgatgtcgtccgcgtcgggactgcgcagaggccaccccgccggaggagaagaaaacatgactgagactgacgcattctacaagagagagatgttcgatccggctgagaaatacaaaatggaccatcggaggagaggcatcgcactgatattcaaccacgagcggttcttctggcatttgaccctcccggaacgcagaggaacttgcgccgatcgtgataatctgactcggcggtttagtgatcttggatttgaagtgaagtgctttaatgatctcaaagctgaggagctgcttcttaagatccatgaagtcagcaccgtgtcccatgccgatgccgactgctttgtgtgtgtgttcctttcgcacggcgaagggaaccatatctacgcctatgacgccaagatcgaaattcagaccctcaccggcctgttcaagggcgacaaatgtcactccctggtcgggaagcccaagattttcattatccaggcgtgccgcggtaaccaacacgacgtgcctgttatcccgctcgacgtcgtggac

SEQ ID NO: 32378 - DNA, 900 bp, Artificial Sequence
  Description of Artificial Sequence: Synthetic coding sequence
atggtggaaatagatgccgcgtcagtgtacaccctgccagcgggcgcggattttctgatgtgctactccgtggctgaagggtactactcccacagagaaaccgtcaacggatcatggtacatccaggacctgtgcgagatgctgggaaagtacggatcatcactggaatttactgagcttcttaccctcgtgaatcggaaagtctcgcagcgcagagtggatttttgcaaggacccgtcagcgatcggaaagaagcaagttccctgcttcgcctcaatgctcactaaaaagctgcacttctttccaaagtcgaaccttgagcatcaccaccatcatcacgtggaaatcgacggtggatccccaatgtccagcgcaagcgggctccgccggggccaccccgccggcggcgaggaaaacatgacggaaactgacgccttttacaagcgcgaaatgttcgacccagcagaaaagtacaagatggaccataggcgccgcggtattgccctgattttcaaccacgaacggtttttctggcatctgaccctcccggagcgccgcggtacttgcgccgaccgcgataacctgacgcggcggttctccgatctgggatttgaggtgaagtgctttaacgacctcaaagccgaagaacttctgctcaaaatccacgaggtttccactgtgtcacacgcggacgccgattgcttcgtctgcgtgttcttgtcgcatggagaaggaaaccatatctacgcgtacgatgcgaaaattgaaattcagactctcactggactcttcaagggagataagtgtcattcgctcgtcggtaagccgaagatcttcatcatccaggcttgtcgcggcaaccaacatgacgtgccggtcatcccgttggacgtggtggat

SEQ ID NO: 32379 - DNA, 900 bp, Artificial Sequence
  Description of Artificial Sequence: Synthetic coding sequence
atggtggagatcgatgcggcatcggtctacactctgcccgcaggcgcagatttccttatgtgctactcggtggccgagggatactactcccatagagaaactgtgaatggatcctggtacatacaagacctgtgtgagatgcttggcaagtacgggtcctcgcttgaattcaccgaacttctgaccctcgtgaacagaaaagtgtcacaacggagagtggacttttgtaaggatccctccgcgattggaaaaaagcaagtgccatgtttcgcatcaatgcttactaagaagctgcatttcttccctaaatcaaacttggaacatcatcaccatcaccacgtcgaaattgatggaggatcaccgatgtcgtcagctagcggtcttagacgcggtcatcccgccggtggggaggagaacatgactgaaactgacgcgttttacaagcgtgaaatgtttgatccagctgaaaagtacaagatggatcatagacgcagaggaattgccctgatattcaaccacgaacgctttttctggcacctgactttgcctgaacgccggggaacgtgcgcggatagagacaacttgaccagaaggttttcagacctcggatttgaggtgaagtgttttaacgatcttaaagcggaagaactcctgctgaaaattcatgaagtgagcaccgtgtcacatgctgatgcggattgcttcgtgtgtgttttcctgtcccacggcgaggggaaccatatctacgcatacgatgcgaaaattgaaatacaaaccctgaccggacttttcaagggcgataagtgtcattcgctggttggtaagcctaagatattcattatccaagcatgccggggtaatcagcacgatgtgcctgtgatcccccttgatgtcgtggac

SEQ ID NO: 32380 - DNA, 900 bp, Artificial Sequence
  Description of Artificial Sequence: Synthetic coding sequence
atggtggaaatcgacgccgcctctgtatacacactgcccgctggagcagatttcctgatgtgctactccgttgccgaggggtattactctcatagagagaccgtcaatgggagttggtatattcaggacctatgtgaaatgttgggaaagtatgggtccagtcttgagttcactgagctgctcacgctcgtgaatcggaaggttagccaaaggagggtcgatttttgtaaagatccttccgccataggtaaaaaacaggttccatgcttcgcaagcatgctgacaaaaaagctgcattttttcccaaagtcaaatctggaacaccatcaccatcaccacgtcgaaatcgacgggggatctccaatgtcttctgcctccgggttgcgtaggggccacccagccggaggggaggagaacatgacagagactgatgcgttttacaagagagaaatgttcgatccagccgagaagtacaaaatggatcatcgtcgcagaggaatcgctttaatcttcaaccacgaacgctttttctggcacttaaccttgccagagaggcggggcacttgcgccgacagagacaacctgacgagaaggtttagcgacctggggtttgaggtgaagtgctttaacgacctcaaagccgaagagctcctgttaaaaattcacgaggtgtcaaccgtgagtcatgctgacgccgactgtttcgtttgtgtgtttctgtcccatggggagggaaatcacatatacgcatacgatgcaaaaatcgaaattcagaccttgactggactctttaaaggggacaagtgccacagtttggtgggaaagccaaaaatcttcatcattcaggcctgtaggggaaaccaacacgatgtgcctgtgatccccctggacgtggttgac

SEQ ID NO: 32381 - DNA, 900 bp, Artificial Sequence
  Description of Artificial Sequence: Synthetic coding sequence
atggtcgagatagatgcggcctccgtttacaccctgcctgctggagctgatttcctaatgtgttattccgttgcagaaggctactacagtcacagagagactgttaacggttcatggtacattcaggacttatgcgagatgctcggcaagtacggatcgagcctagagttcaccgagctgctaactctggttaatcgcaaggtaagtcaaagacgtgtcgacttctgcaaagacccctctgccatcggcaagaagcaggtcccatgttttgcgtcaatgctcacaaaaaaactgcacttctttccgaaatcaaatctagagcatcaccaccaccatcacgtagaaatcgacggaggctctcccatgtccagcgcgagcggccttcggagggggcaccccgcaggtggcgaggagaacatgacggaaaccgatgcattttacaaaagggaaatgtttgatccggctgaaaaatacaagatggatcaccgccggcggggtattgccctcatctttaatcatgagcggttcttctggcatctgacccttccagagcgacgaggaacatgtgctgatcgggacaatcttacacgacgattcagcgacctcgggttcgaagtgaaatgtttcaatgacctgaaagccgaagagttgctgctcaagatccacgaagtctctacagtatcgcacgctgacgctgactgtttcgtgtgcgtgtttctcagtcacggggagggtaatcatatctatgcttacgacgccaagatcgagatccagactttaacggggctctttaagggggataaatgccactcgctcgtgggtaagcccaagatttttatcatccaagcttgcagaggcaaccagcatgacgttccagtcattcctctggacgtcgtggac

SEQ ID NO: 32382 - DNA, 900 bp, Artificial Sequence
  Description of Artificial Sequence: Synthetic coding sequence
atggttgaaatagatgcggcgtcggtatatacgctaccggcgggtgcggattttttaatgtgttattcggttgcggaaggttattattcgcatcgagaaacggttaatggttcgtggtatatacaagatctatgtgaaatgctaggtaaatatggttcgtcgttagaatttacggaattattaacgttagttaatcgaaaagtatcgcaacgtcgtgttgatttttgtaaagatccgtcggcgataggtaaaaaacaagttccgtgttttgcgtcgatgctaacgaaaaaactacatttttttccgaaatcgaatttagaacatcatcatcatcatcatgttgaaatagatggtggttcgccgatgtcgtcggcgtcgggtttacgtcgtggtcatccggcgggtggtgaagaaaatatgacggaaacggatgcgttttataaacgtgaaatgtttgatccggcggaaaaatataaaatggatcatcgtcgtcgaggtatagcgttaatatttaatcatgaacgttttttttggcatttaacgctaccggaacgtcgtggtacgtgtgcggatcgagataatttaacgcgtcgtttttcggatttaggttttgaagtaaaatgttttaatgatttaaaagcggaagaactactactaaaaatacatgaagtatcgacggtatcgcatgcggatgcggattgttttgtatgtgtttttttatcgcatggtgaaggtaatcatatatatgcgtatgatgcgaaaatagaaatacaaacgctaacgggtttatttaaaggtgataaatgtcattcgttagttggtaaaccgaaaatatttataatacaagcgtgtcgaggtaatcaacatgatgtaccggtaataccgctagatgttgttgat

SEQ ID NO: 32383 - DNA, 900 bp, Artificial Sequence
  Description of Artificial Sequence: Synthetic coding sequence
atggtggagattgatgcggccagcgtctacaccctccccgcaggcgccgattttctcatgtgctattctgttgccgagggatactatagccatcgcgagactgtgaatggcagttggtacatacaggacctttgtgagatgctgggaaaatatgggagctcattggaatttactgagctcctcactttggtaaatcgtaaagtgagccagagacgagtcgatttctgcaaagacccctctgctatcggaaagaagcaggtcccatgcttcgcatccatgctgacaaagaaattgcactttttccccaaaagcaacttagaacatcaccatcaccatcacgtggagattgacgggggctctccaatgagcagtgccagcgggcttcggcgaggacatcccgccggtggtgaggagaacatgaccgaaacagacgccttctataagcgcgaaatgtttgacccagccgaaaaatacaagatggatcacaggaggcgcggaatagcattgatttttaatcatgagagatttttctggcatctaaccctcccggagcggcgtggcacttgtgcggatagagacaacctaactaggcggttctcggacttgggctttgaagtgaaatgctttaatgacctgaaggccgaggaactcctgttgaaaatccatgaggtgtccacggtttctcatgcagacgcggactgtttcgtgtgcgtgttcctcagccacggggaggggaatcatatctacgcttatgatgcgaagatcgaaattcagacattgactggcttgttcaaaggtgacaaatgccactcactggtggggaaacccaaaatcttcattattcaggcctgtagggggaatcaacacgatgtgcccgtcataccgcttgacgttgtggac

SEQ ID NO: 32384 - DNA, 900 bp, Artificial Sequence
  Description of Artificial Sequence: Synthetic coding sequence
atggtggagatcgatgccgcctccgtgtacacgttgccggcgggagcggacttcctgatgtgctattccgtggcggagggatattactcccatagagaaactgtgaacggatcgtggtacatccaggatctgtgcgagatgctcggaaagtacggcagctcactggagtttactgaacttctgacgttggttaaccgcaaggtgtcgcaacgcagagtggacttctgcaaagacccaagcgcgattggaaagaagcaagtgccttgttttgccagcatgctgaccaagaagctgcactttttcccaaaatcgaacctggaacatcatcaccaccatcatgtggagattgacggtggatccccgatgtcctccgcctcgggcctgcgccgcggacacccggccggaggcgaagagaatatgaccgaaactgacgccttctacaagcgagagatgttcgatccagcagaaaagtataagatggaccatcgccggcgcggcatcgccctcatcttcaaccacgagcgtttcttctggcatctcacgctgccggaaaggcgcggaacttgtgctgatcgcgacaacttgacgcggcgcttctcagacctgggctttgaggtcaaatgcttcaatgacctcaaggccgaagaactcctcctcaagatccacgaagtcagcaccgtctcccatgccgacgctgattgcttcgtctgcgtctttctgtcgcacggggaaggtaaccacatttacgcctacgatgctaagattgagatccagaccctgaccggactgtttaagggtgacaagtgccattccctcgttggaaagccgaaaatcttcattatccaggcatgcagagggaaccagcatgacgtgccggtcatcccgctggatgtggtggac

SEQ ID NO: 32385 - DNA, 900 bp, Artificial Sequence
  Description of Artificial Sequence: Synthetic coding sequence
atggtggagattgatgctgcatccgtttacacactgcccgccggggccgattttctgatgtgttattcagtggctgaaggctattactcccaccgggagactgtgaacggatcttggtacatacaggacctttgcgaaatgctcgggaaatacgggtcatcccttgagttcactgagcttctgactctggtaaaccggaaagttagccaacgtcgtgtggatttctgcaaggacccgagcgcaattggcaagaaacaggtcccctgcttcgcatccatgctcaccaagaagctgcatttcttccccaaatctaatttagagcatcaccatcatcatcatgtggagattgacggtggatcgcccatgagtagcgcgagcgggctgaggcgaggacatcctgctggcggtgaggagaatatgacggagactgatgccttttataagcgcgagatgttcgaccccgcagagaaatataagatggatcacagaaggcggggtatcgcactgatttttaaccatgaacgctttttttggcacttaacattgcctgaacggcgcggcacctgcgcagatagagataatctgactaggagattctcagacttaggatttgaagttaagtgcttcaatgacctcaaagctgaggagctcctgctaaagattcatgaagtgagtactgtatctcatgccgatgcagattgcttcgtctgtgtcttcctgagccacggagagggtaatcatatatatgcatatgatgcaaagattgaaatccaaaccttgaccggcctgtttaagggcgacaaatgccattcactagtcggtaagcctaagatttttatcatccaagcttgccggggaaaccagcacgatgtgcccgtcattcccctagacgtggttgac

SEQ ID NO: 32386 - DNA, 900 bp, Artificial Sequence
  Description of Artificial Sequence: Synthetic coding sequence
atggtggaaattgacgcagcttcggtgtacactctgcccgcaggtgcggattttctcatgtgttactccgtggccgaaggttactactcgcatagagaaactgtcaatggttcatggtacatacaggacctctgtgagatgctcggcaagtacggctcgtcgctggagtttacggaactcctgactctggtcaatagaaaagtcagccagcgccgggtggatttttgtaaggacccttcagctatcgggaaaaagcaagtgccatgctttgcatctatgctgacgaagaaacttcatttcttccccaagtctaacctggagcatcaccaccatcatcacgtggagattgatggtggttcccctatgtcgtctgcatcgggtcttaggcgtggtcatccagcaggtggggaagagaacatgaccgaaactgacgcattctacaagcgcgaaatgtttgacccggcggagaagtacaaaatggaccataggcggagaggtattgcactcatattcaatcacgaacgattcttttggcatcttactctgcctgaaagacgcggtacctgcgcagaccgcgataaccttacgcggcggttttcggatctgggatttgaagtgaagtgttttaacgacctcaaggcagaagagctgcttctcaagatccatgaggtcagcaccgtgtcacatgcagatgcagactgttttgtgtgcgtattcttgtcacacggagaagggaaccatatctacgcctatgatgccaagattgagattcagactcttaccggcttgttcaagggagacaaatgccacagcctggtcggtaagccaaagatcttcattatacaagcatgtcgcggcaaccaacacgatgttcctgtcatcccactggatgttgtggat

SEQ ID NO: 32387 - DNA, 900 bp, Artificial Sequence
  Description of Artificial Sequence: Synthetic coding sequence
atggttgagatagatgctgccagcgtgtacacactgcctgctggcgcagattttctgatgtgttattcagtggcagaaggatactattcacacagagagactgtaaacgggtcctggtacatccaggatctgtgcgagatgctcggcaagtacggttcttcactggaattcactgagctcttgactttagtgaaccggaaggtgagccagcggcgggtcgacttctgtaaggacccctcagccataggaaaaaaacaggtgccatgttttgcgtcaatgctcacgaaaaaactccacttttttccaaagtctaacctcgagcatcaccaccaccaccatgtggagatcgacgggggatcccccatgtcttctgccagtggcctgcggcgcgggcacccagcaggtggcgaggaaaacatgaccgaaacagacgctttctacaagagggaaatgttcgaccctgcagaaaaatacaaaatggatcaccgccggaggggcatcgcgctcatcttcaaccacgagcgcttcttctggcacctcacactgcccgaaaggagaggcacttgcgccgacagagataacctgaccagaaggttcagcgacttggggtttgaagttaagtgcttcaatgacttaaaggctgaagaattgctactaaagatccacgaggtgagcaccgtgagccacgcagatgccgactgttttgtctgtgtctttctctctcacggagagggaaaccacatatacgcctacgacgcaaagattgagatccagaccttgacagggctgttcaagggagataaatgtcactccctggtggggaagccaaaaatatttatcatccaggcgtgtaggggcaatcagcatgacgtgccagtgatcccactagacgtggtggac

SEQ ID NO: 32388 - DNA, 900 bp, Artificial Sequence
  Description of Artificial Sequence: Synthetic coding sequence
atggtggagattgatgcagcttcggtgtataccctcccggcgggggcagacttcctcatgtgctactcggtggctgaaggatactactctcatagggagactgtcaacggaagttggtacatccaggatctgtgcgagatgctgggaaaatacggcagctcactggagttcactgagctgctgaccctggtgaataggaaggtgagccagcggcgtgtggatttttgcaaggacccgtccgccataggaaaaaagcaggtgccttgcttcgcatctatgctgaccaagaaacttcacttttttccaaagtccaatctggaacatcatcatcatcaccacgtggagatcgatggcgggtcgccaatgtcctcggcctcgggactgcgcagagggcaccctgccggtggtgaagaaaacatgactgaaaccgacgctttctacaagagagaaatgttcgacccggccgaaaagtacaagatggaccacaggaggcgcgggatcgctttgatcttcaaccacgaacggttcttttggcatttgaccctgccggagcggagaggaacttgcgcggaccgcgataatcttactcgccgcttctcggatctcggatttgaagtgaaatgcttcaacgacttgaaggccgaagaactgttgctcaaaatccatgaggtgtctactgtctcgcacgccgacgcggattgcttcgtgtgtgtgttcctgtcccacggcgagggaaaccacatctacgcctacgatgcgaagatcgagattcaaacgctcacgggactctttaagggggacaagtgtcacagcctggtggggaagccaaagatcttcatcatccaggcttgtagaggtaatcagcacgacgtgcccgtgatccctctcgacgtggtggac

SEQ ID NO: 32389 - DNA, 900 bp, Artificial Sequence
  Description of Artificial Sequence: Synthetic coding sequence
atggtcgagatagatgcggcaagtgtgtatacgcttccggccggggcagactttcttatgtgttactccgtcgccgaaggatactacagccatcgagaaactgtcaacggatcatggtacatccaagacctgtgtgagatgctgggtaaatacggctcctcccttgagtttaccgagctgctgacgctcgttaatagaaaagtcagccaaagacgcgtcgacttttgtaaagatccgtcggcaattggtaagaagcaggtgccctgctttgcatccatgcttaccaaaaaactccacttcttccccaagtccaacctggaacaccatcatcaccatcacgtcgaaattgatggagggagcccaatgtcgtcagcgtccggcctgcgccgcggacatccagcaggaggtgaggagaatatgaccgaaactgatgcattttacaaaagggaaatgtttgatccagcagagaagtacaagatggatcacaggagacggggaattgcattgattttcaaccacgaacggttcttttggcatctcacccttcctgaaaggcgtggtacgtgcgcagacagggacaatcttactcgccggttttcggatttgggatttgaggtgaagtgtttcaatgatctgaaggctgaggagctgttgctgaagatacatgaagtttcaaccgtgtcacatgcagacgcggactgtttcgtgtgcgtctttctttcgcatggagagggcaaccatatctatgcatacgatgcaaagatagaaattcagactcttactggtcttttcaagggtgataagtgccactccttggtaggtaagccaaagattttcatcatccaggcatgccgcgggaaccaacatgacgtccctgtgattccactggacgttgtcgac

SEQ ID NO: 32390 - DNA, 900 bp, Artificial Sequence
  Description of Artificial Sequence: Synthetic coding sequence
atggtggagatcgatgccgctagcgtctacacgctgccagcaggtgcagattttctcatgtgttactcagtggccgaaggttactacagccatcgagagacagtaaatgggagttggtacattcaggacttgtgcgagatgcttggcaagtatgggtctagcctggaatttacggagctgctgacgctcgtcaatcgaaaagtctcccagaggagggttgatttttgtaaggaccccagtgcaatcggaaagaaacaggtcccctgcttcgcgagtatgctgacgaagaaattacactttttccccaagtctaaccttgaacaccatcaccaccatcatgttgagatcgacggcggatccccgatgtcgtccgccagcggcttgcgccgcggccacccagctggtggcgaggagaatatgactgaaactgacgcgttttacaagcgagaaatgtttgatcctgctgaaaagtacaagatggaccacaggagaaggggtatcgccctaatcttcaaccacgagcgattcttttggcacctgacgttgccagagcggcggggtacttgcgcggatcgggataatctgacaagaagattttcggatctgggattcgaggtgaagtgctttaacgacctcaaggctgaggagctgctgctgaaaatccatgaggtctcaaccgtgtcacacgccgatgctgattgtttcgtgtgtgtcttcctgtcccatggcgagggcaatcacatttatgcttacgacgccaaaattgaaattcagacacttaccggactgttcaaaggagacaaatgccatagcctcgtggggaagccaaaaattttcattatccaggcctgccgcggcaaccaacacgacgtccctgtcattcctctggacgtagtcgat

SEQ ID NO: 32391 - DNA, 900 bp, Artificial Sequence
  Description of Artificial Sequence: Synthetic coding sequence
atggtcgagattgacgcggcatccgtctacacccttccagctggagctgatttcttgatgtgctactcggttgcggaagggtactactcccaccgcgagacggttaacgggtcctggtacatccaggatctgtgcgagatgctcggcaaatatggctcctcgctcgagttcaccgaactcctcactctcgttaatcggaaagtctcccaacgcagggtggacttctgcaaagatccctcagctatcgggaagaagcaggtcccatgcttcgcgtcaatgttgactaagaagctgcacttcttcccaaagtcgaacctcgaacatcatcatcaccatcatgtggaaatcgacggcgggtcaccgatgtcgtcggccagcggactcagacggggacacccggcgggaggagaagaaaacatgaccgagactgacgcattctacaagcgcgaaatgttcgatccggccgaaaagtacaagatggaccaccggcggagaggtatcgctctgatctttaatcatgagaggttcttctggcacctcacgctccctgagcggcgcgggacctgtgccgaccgcgataacctgacccggaggttttccgacctgggctttgaagtgaaatgcttcaatgacctgaaggccgaggagctcttgttgaagatccatgaggtgtcgactgtgtcccatgccgatgcagattgcttcgtctgcgtgttcctgtcacacggagaaggcaatcatatctatgcgtacgacgccaagatcgagattcagactctgaccggactgtttaagggagacaagtgccactcactggtcggaaagcccaagatcttcatcattcaggcgtgtagaggtaaccagcatgatgtgccggtgatcccgctggatgtggtcgac

SEQ ID NO: 32392 - DNA, 900 bp, Artificial Sequence
  Description of Artificial Sequence: Synthetic coding sequence
atggtagaaatagatgccgcatcagtgtacactctgcccgcaggcgccgactttttgatgtgctactcagtagctgagggttactactcccatcgagaaacagttaatggcagttggtacattcaggacctctgtgagatgctgggaaagtacggttcctctctagaatttactgaattgctcacactggtgaatcgaaaggtgtcccagaggagggtggatttttgtaaggaccccagcgcaatcggcaagaaacaggttccatgtttcgctagcatgctgactaagaagttgcatttctttcccaagagtaacctagagcaccaccaccatcatcacgtagaaattgacggcggctctccaatgtcatccgccagtggactgcgacggggtcaccccgccggcggtgaagagaatatgacagagacagatgcgttttacaaaagagagatgtttgatcctgccgaaaaatataaaatggatcaccgccgtaggggtattgccctgatcttcaaccacgagagatttttttggcatctgacactcccagaacgacggggaacgtgtgccgatcgggacaacctaacccgaaggttcagcgacctgggctttgaagtgaaatgttttaacgacctgaaggccgaggagctactacttaagattcacgaagtgtctacagtatctcatgccgatgccgactgtttcgtgtgcgtatttcttagtcacggggagggaaatcacatctacgcatacgatgcaaaaattgagatccaaactctcactggactcttcaagggcgataagtgtcacagcctggtgggcaagcccaaaattttcatcattcaggcctgccgaggaaatcagcatgatgtgcctgtgattccactggacgtagtcgac

SEQ ID NO: 32393 - DNA, 900 bp, Artificial Sequence
  Description of Artificial Sequence: Synthetic coding sequence
atggttgaaatcgatgcagcctccgtgtacactctgccggcgggcgcagactttctgatgtgctacagcgtggcggaaggatattactcccacagagaaactgtgaacggatcctggtacatccaagacctgtgcgaaatgcttggaaagtacggatcgtcgttggaattcactgagctgctgactctggtcaaccggaaggtgtcccaacggcgcgtggatttttgcaaggatccctcagctatcggaaagaaacaagtgccgtgcttcgccagcatgctgactaagaagctgcactttttcccgaagtccaacctcgagcaccaccaccatcaccacgtcgagatagatgggggctccccaatgagctcagcatcgggtctgagaaggggacatccagctggcggtgaagaaaacatgacggaaactgatgctttttacaagcgggagatgttcgatccggcggagaagtacaaaatggatcaccggaggcgagggatcgccctgatcttcaaccacgaacggttcttctggcatctcactttgccagagcgccgcggcacctgcgctgatcgcgataaccttactcggagattctccgaccttggattcgaggtgaaatgctttaacgacctgaaggccgaggaactgctgctcaaaatccacgaagtctctactgtctcccatgccgatgcggattgcttcgtgtgcgtctttctgtcacatggggagggaaaccatatctatgcatacgacgccaagattgaaattcaaaccctcactggactgttcaaaggcgacaagtgccattcactcgtgggaaagcctaaaatcttcattatccaggcctgtcggggtaaccagcacgacgtgccagtcatcccgctggatgtcgtggac

SEQ ID NO: 32394 - DNA, 900 bp, Artificial Sequence
  Description of Artificial Sequence: Synthetic coding sequence
atggtcgaaatcgatgccgccagcgtgtacactcttccagctggcgcggactttctcatgtgctattccgtcgccgagggatactacagccacagggaaaccgtgaacggttcatggtacatccaggacttgtgcgaaatgttgggcaagtacggaagtagcctggaattcaccgagctcctcacgttggtgaaccgcaaagtgtcccagagaagagtcgacttctgcaaggacccgtcggcaatcgggaagaaacaagtgccctgtttcgcctcaatgctgaccaagaaactgcacttcttcccaaaatcaaacctggaacatcatcaccatcaccacgttgaaatcgacggtggctcaccaatgtcgtcggcttcgggacttcggcgcggtcacccggcaggaggcgaggaaaatatgactgaaactgatgcgttctacaagcgggagatgtttgatccggccgaaaaatacaagatggatcaccgacgccggggaatcgcactcatcttcaatcatgagaggttcttctggcacctcaccctgccggagcggcgtggaacctgtgccgacagagacaacctgacccgccgcttctccgacctggggtttgaggtgaagtgcttcaatgatctgaaggctgaggagctgctcctcaagatccacgaagtgtccactgtgtcgcacgcggacgcggactgtttcgtctgcgtctttctgagccacggagaaggaaaccatatctacgcctacgacgcaaagatcgaaattcagacgctgactggactgtttaaaggagataagtgccattccctggtcggcaagcctaagatcttcattatccaagcctgccgggggaaccagcatgatgtgccggtgattcctctcgatgtggtggac

SEQ ID NO: 32395 - DNA, 900 bp, Artificial Sequence
  Description of Artificial Sequence: Synthetic coding sequence
atggtggagattgacgccgcctctgtgtatacattacctgctggtgccgacttcttgatgtgctactccgtggctgaggggtactactcccaccgagaaaccgtgaatggcagttggtacatccaagatctgtgcgagatgctgggcaaatacgggagtagccttgagtttaccgaactgctcactctggttaaccgaaaagtgtctcaacggcgtgtggatttttgtaaagacccgtctgcgatcggcaaaaaacaggtcccatgttttgccagcatgctcacaaagaagctacactttttcccaaagtctaatctggaacatcaccatcaccaccacgtcgagattgacggcggcagccccatgtcatcggcctccggactcaggaggggccacccagcaggcggggaagaaaacatgaccgaaactgatgcgttctataaacgcgagatgtttgaccccgctgaaaaatacaagatggatcatagacgaaggggcatcgcactgatctttaatcacgaaaggtttttctggcacctcaccctgcctgagagaagaggaacttgtgctgacagagacaatttaacccgtcgcttctctgatctcggctttgaagtcaaatgcttcaatgaccttaaggctgaagaactgttgctcaagattcacgaagtctcgacagttagtcacgcagacgcggattgctttgtctgcgtgtttctcagccacggagagggaaaccacatttatgcctatgatgccaagattgaaatccagacattaaccggactctttaagggtgacaagtgtcactccctcgtgggcaaaccaaaaatatttataattcaggcctgcaggggaaatcagcatgacgtgcctgtcattcctctcgacgtcgtcgat

SEQ ID NO: 32396 - DNA, 900 bp, Artificial Sequence
  Description of Artificial Sequence: Synthetic coding sequence
atggtggagatcgacgcagcttccgtctataccctgcccgccggggcagatttcctgatgtgttacagtgtggcagagggctactattcccaccgggagaccgtcaatggcagctggtatattcaagatttgtgcgagatgctgggcaagtatgggtctagcctggaattcacagagctgttgaccctggtgaatcggaaggtgtcccagcgccgggtggatttctgcaaagaccctagcgctatcggaaagaaacaagtgccgtgcttcgcctctatgcttaccaagaagttgcacttcttccccaaatccaatctcgaacatcaccatcaccaccatgtggagatcgacgggggctcccctatgagttccgcaagcgggctcaggagaggacacccagcgggaggggaagagaatatgaccgagacagatgccttctacaagagagagatgtttgaccccgcagagaagtacaaaatggatcaccgcagaagggggatagccttgatattcaaccacgagcgcttcttttggcatctcactctgcccgagcgcaggggtacctgtgctgacagagacaacttgactcgcagattttcagacttgggctttgaggtgaagtgtttcaacgacttgaaggctgaggaacttcttctcaaaatccacgaggtgagtacagttagccacgcagatgctgactgtttcgtgtgtgtcttcctgtctcatggcgagggaaaccacatttatgcctatgatgcaaagatagagatacagacactcaccggcctgttcaagggtgataaatgccattcacttgtagggaagcctaagatttttattatccaggcttgccgggggaaccaacatgacgtgccggtgattccacttgacgtggttgac

SEQ ID NO: 32397 - DNA, 900 bp, Artificial Sequence
  Description of Artificial Sequence: Synthetic coding sequence
atggtcgagattgatgcagccagtgtctacactctccccgccggagccgatttcctcatgtgttatagcgtcgcggagggctactattctcaccgggagacagtaaatgggtcatggtacatacaggacctctgtgaaatgctcggaaagtatggatctagcttggaattcaccgagctcctaacgctcgtgaatcgcaaggtctcacaaagaagggtcgacttctgtaaagacccctccgcgatcggtaaaaaacaggtgccatgcttcgcatctatgttgactaagaagttgcacttcttccccaagtccaatttagagcaccaccatcatcaccacgtcgagatagatggcggatcacctatgagttcggcctctgggctgcgaagaggacatcccgctggcggcgaggaaaatatgacggaaaccgacgccttctacaagagagaaatgtttgacccagctgagaaatataaaatggaccaccgtcgccgggggattgcactaatatttaaccatgagcgttttttctggcatttgaccctgccagagcggcggggtacatgcgcggaccgggacaacctaacgaggcggttctctgacctgggcttcgaggttaaatgtttcaacgacctgaaggccgaagaattgctgctcaagattcacgaggtcagtaccgtcagtcatgctgacgccgactgttttgtttgcgtcttcctgagccacggcgagggaaaccacatctacgcctacgatgccaaaatcgaaattcaaactctcacaggcttattcaagggtgataagtgccactcactagtggggaagccgaaaatttttattattcaggcctgtcgggggaatcagcacgacgtaccagttatcccgctggacgtcgtcgat

SEQ ID NO: 32398 - DNA, 900 bp, Artificial Sequence
  Description of Artificial Sequence: Synthetic coding sequence
atggtcgaaatcgatgctgcaagtgtctacaccttgccagcaggtgcggatttcctgatgtgttactctgtcgcagagggatattacagtcaccgcgagaccgtgaacgggtcatggtatatccaggacctctgcgagatgctgggcaaatacggcagtagccttgagttcactgaactcctgacattggtgaacaggaaggttagccagaggcgagtggatttttgcaaggatccaagcgcaatcggcaagaagcaagttccgtgctttgcctcaatgctgaccaaaaaactgcattttttcccgaagtctaacctggaacatcatcaccaccatcacgtagagattgatggcggtagccctatgagctcagccagcggcctccgccgaggccatccagccggaggcgaggaaaatatgaccgagacagacgccttctacaaacgagaaatgttcgatcccgctgaaaagtataagatggatcacaggcgaagaggcatcgcccttatattcaatcatgaacggtttttctggcatctcaccctgccagagagaaggggtacatgcgcggatcgagacaacctgactcgcagattctcagaccttgggtttgaggttaagtgttttaacgacctgaaggctgaggagctcctgcttaagattcacgaggtctctaccgtttcccatgcagatgccgattgcttcgtttgtgtgttcttgtctcacggtgagggtaaccatatatacgcatacgatgctaagatcgaaatccaaactcttaccggtttgtttaagggagacaagtgtcactcactggttggcaagccaaaaatcttcataatccaggcatgccggggcaatcaacatgacgtgcctgtgatccctttggatgtggttgac

SEQ ID NO: 32399 - DNA, 900 bp, Artificial Sequence
  Description of Artificial Sequence: Synthetic coding sequence
atggttgagatcgatgcggcctctgtgtacaccctgccggccggagcggacttcttgatgtgttacagcgtggcagaggggtactattcacatcgcgagaccgtcaatggctcctggtacattcaagatttgtgcgagatgctgggcaaatatggtagctccttggagttcaccgaactgttgacactagtaaacaggaaggtgtcgcagaggcgggttgacttttgcaaagacccatcagctatcggcaagaaacaggtcccatgttttgctagtatgctaacaaaaaagttacatttcttccccaaatcaaatctggagcaccaccatcaccatcacgttgagatcgatggagggagccctatgtcttccgctagtgggctacgtaggggccacccagccggcggagaggagaacatgacagaaaccgacgcattctacaagcgagagatgtttgacccggccgagaaatacaagatggaccaccgtaggcgaggcatcgcactgatcttcaatcacgaacggttcttctggcatttaacactccccgagagaaggggaacttgtgcagatagggataacctcacgcgacgttttagcgatctcgggttcgaagttaagtgttttaacgaccttaaggcagaggaactgttactcaaaattcatgaagtgtcaacagtgtcccacgccgacgccgattgcttcgtatgtgtctttctgagccatggagaggggaatcatatctatgcatatgatgccaagattgagattcagactcttacaggcctgtttaaaggcgataagtgtcacagcctcgtaggaaagcctaaaatattcataattcaggcttgccgagggaatcagcacgatgtccctgtgatcccactggacgtggtcgat

SEQ ID NO: 32400 - DNA, 900 bp, Artificial Sequence
  Description of Artificial Sequence: Synthetic coding sequence
atggtcgagattgatgccgcatccgtgtacactctgccggccggagcagatttcttgatgtgctactccgtggcagaaggatactactcgcacagagaaaccgtcaatgggtcctggtacatccaagacctctgtgaaatgctcggaaagtacggctcctccctggagtttaccgagctccttaccctcgtgaatagaaaggtgtctcagcggcgcgtcgatttctgcaaagacccgtcggcaattggcaagaagcaggtgccgtgcttcgcctccatgctgaccaaaaaactccatttctttccaaaatcgaacttggagcatcatcaccaccatcacgtggagatcgacggaggatcgccgatgtcgtccgcttcgggccttagacgcggccacccagccggtggtgaggaaaacatgactgaaaccgacgccttttacaagagggaaatgttcgatccggccgaaaagtacaagatggatcaccgccggagaggaatcgcgctgatctttaaccacgaacggttcttctggcacctgaccctcccagaaaggcggggaacttgtgcggatcgcgacaacctgactcggagattctcagatctgggattcgaagtgaagtgcttcaacgacctgaaagccgaggagctcctgcttaagatccatgaggtgtcgaccgtgtcccatgccgacgccgactgcttcgtctgtgttttcctgtcgcatggtgagggaaatcacatttacgcctacgacgcaaagatcgagatccaaacgctgacgggacttttcaagggagataagtgtcactccctcgtgggaaaaccgaagattttcatcattcaggcctgccggggaaaccagcacgacgtgccggtgatcccgctcgacgtggtcgac

SEQ ID NO: 32401 - DNA, 900 bp, Artificial Sequence
  Description of Artificial Sequence: Synthetic coding sequence
atggtagagatagatgcagcgtccgtatacacactaccagctggggcagatttccttatgtgctacagcgtagcagaagggtattattctcatcgtgagacagtcaacggaagttggtatatccaggatttatgtgaaatgttggggaagtatggaagttcactggaattcaccgaacttctaaccttggttaatcgaaaagtttctcagcgacgagttgacttctgcaaagatccttcggctattggtaaaaaacaagttccatgctttgcgagtatgctcactaaaaaactccacttttttcccaagagtaatctcgaacaccatcatcatcatcacgtggaaattgatggcggaagcccaatgtcatccgcatcaggcttgcgaagaggacatcctgcgggaggggaggaaaacatgaccgagacggatgctttttacaaaagagaaatgttcgacccagcagagaaatacaagatggaccataggagacgtggaattgccttgatttttaaccatgaaagatttttctggcatctaacgttgccagaacgtcgaggaacttgtgctgatcgcgacaacctaacacgacggttctccgatttgggattcgaagtaaaatgctttaacgatttaaaggcggaagaactgctcttgaagattcatgaggtatctacagtgtcacatgctgacgctgactgctttgtttgcgttttcttatcacatggggaaggaaaccacatctatgcatatgatgccaaaatcgagatccagacccttactggcctgttcaaaggcgacaaatgtcattctctggttggaaagccaaaaatctttattattcaggcctgcaggggaaaccaacacgatgtacctgtaattccacttgacgtggtcgat

SEQ ID NO: 32402 - DNA, 900 bp, Artificial Sequence
  Description of Artificial Sequence: Synthetic coding sequence
atggtggagatagatgcagcatcagtctacactctgcccgccggcgcagacttcctgatgtgctactccgtcgcagagggctattactctcaccgtgaaactgtgaatgggtcgtggtacatccaggacctgtgtgaaatgttgggaaagtacgggagctcccttgaattcactgaactgctgacgcttgtgaatagaaaggtgtcccaacggcgagtggatttttgtaaggatccttcagctattggaaaaaagcaggtgccatgtttcgcatccatgctcaccaagaagttgcacttttttcccaagtcgaaccttgaacaccaccatcatcatcatgtggagattgatggtggaagcccaatgagtagtgcctcaggtctgcgccgtggtcaccccgcaggaggagaagagaacatgactgagacggacgccttctataagcgtgaaatgtttgacccagcagaaaagtacaaaatggatcacaggagaagaggaattgcactcatattcaaccatgaacgtttcttttggcacctcaccctgcccgaaagacggggcacttgtgctgatagggataacctgactcgtcggttttccgatcttggatttgaggtcaaatgctttaatgatcttaaagcggaagagctcctgctgaagattcatgaggtgtcgaccgtctcgcatgcagacgctgattgctttgtctgtgtttttctttctcacggtgaaggcaaccatatctacgcatacgacgccaaaatcgaaattcagacccttaccggattgttcaaaggagataaatgtcactcgctcgtcggaaagcctaagatcttcataatccaagcatgccgaggaaatcaacatgatgtgcctgtcattcctttggatgtcgtggat

SEQ ID NO: 32403 - DNA, 900 bp, Artificial Sequence
  Description of Artificial Sequence: Synthetic coding sequence
atggtggagattgatgcagcatcagtctacacactacccgccggggccgattttctgatgtgttatagcgttgcagagggctattacagccaccgcgaaacagtaaacggatcctggtacattcaggatctgtgcgagatgctaggcaagtatggatcaagcctggagtttaccgagctgcttacactggtgaacaggaaagtgtctcagcgcagggtagatttttgcaaggatcctagcgctataggcaagaagcaggtgccttgcttcgcctccatgctgacaaaaaagctgcatttcttcccaaaaagcaacttagagcatcaccaccatcatcatgtagagatcgatggtgggtcacccatgagtagcgcaagcggactccgtagaggccatcccgctggaggcgaggagaatatgacagagaccgacgccttctacaagagagaaatgttcgaccctgcggaaaaatataaaatggatcatcgacggcgaggaatcgcgctaattttcaaccatgagaggttcttttggcacctaaccctgcctgaaagaaggggaacctgtgccgatcgcgacaacttaacccgcaggttttcagacctgggcttcgaagtgaagtgtttcaacgaccttaaggcggaggagctcctcctgaagatccatgaggtctctacagtttcacacgccgatgcagattgtttcgtgtgtgtatttttgtctcacggagaggggaaccacatctacgcttatgatgccaagatcgagatccagacattaacagggctgttcaagggggacaagtgtcactcacttgtgggcaagcccaaaatcttcatcatacaggcctgtcgcggcaaccagcacgacgtgcctgttatccccctagatgtggtcgat

SEQ ID NO: 32404 - DNA, 900 bp, Artificial Sequence
  Description of Artificial Sequence: Synthetic coding sequence
atggttgaaattgacgccgcgtccgtatatacgctcccggcaggagctgactttttaatgtgctactctgttgcagaaggctattattcccatcgggagacagtcaatggatcgtggtacatacaggatttgtgtgaaatgcttggaaaatacggaagctccttggagtttacagagcttctgaccctcgtgaaccgcaaagtctcccaaagaagagtagacttctgcaaagaccctagcgctattggaaaaaaacaagtaccgtgctttgcatccatgctgacaaagaaactgcattttttcccgaagtctaacctggaacatcaccaccatcatcatgtagaaattgatggtggatcgcctatgagctcagcgagcgggctgcggcgcggccaccccgcaggtggggaggaaaatatgaccgaaaccgatgcattttacaaacgcgaaatgtttgacccagcagagaaatataaaatggatcacagacgtagaggaatagcactgatttttaaccacgaaagatttttctggcatttgacacttcctgagcggagaggcacctgcgctgatcgtgataacttgacacggaggtttagtgatcttggttttgaggtaaaatgttttaatgatcttaaagccgaggagcttcttcttaaaattcatgaagtttctacggtgagccatgcggacgctgactgctttgtctgtgtttttctgtcacatggtgaaggcaatcatatctatgcgtatgacgcaaagattgaaattcaaaccctaacaggactgttcaagggcgacaaatgtcactcccttgtgggtaaacctaagatctttatcattcaggcttgtcgcggaaaccaacatgatgtgcccgttattcctcttgatgtcgtcgat

SEQ ID NO: 32405 - DNA, 900 bp, Artificial Sequence
  Description of Artificial Sequence: Synthetic coding sequence
atggtggagattgatgcagcatctgtgtacactctgccggccggtgccgactttcttatgtgctattcagtggccgagggttactactcccatagggagacggtgaatggcagctggtacatccaagacctttgtgaaatgcttggcaagtatggcagctcactggagttcactgagctgttgactctggtgaacagaaaggtgtcacagagacgcgtagacttctgcaaagatccttctgcaataggaaaaaagcaagtgccgtgctttgcaagcatgctgacgaagaaacttcacttctttcctaagtccaatctcgaacatcaccaccaccatcatgtggagatcgacggaggatcaccaatgtcgtcggcatcgggcttgcggagagggcacccggcaggaggtgaagagaacatgaccgagactgacgcattttacaagagagaaatgtttgatcccgcggagaagtacaaaatggaccaccgccgcagaggaattgcgctgattttcaaccatgagcgttttttctggcatctcaccctcccagagcgacggggaacttgtgccgatcgagacaacctcaccagacggttcagtgatctcggatttgaggtcaaatgtttcaacgatctgaaagcagaagaacttcttcttaagattcacgaagtgtccaccgtgagccatgccgacgccgattgctttgtgtgtgtgttcctgtcacatggtgaaggtaatcatatctacgcatacgatgcaaagatagaaatccaaactctgactggactgtttaaaggagataagtgtcattcgctcgtgggaaagccaaagatcttcattatccaggcgtgtcgtggaaaccaacacgatgtgcctgtgattccactcgatgtggtggat

SEQ ID NO: 32406 - DNA, 900 bp, Artificial Sequence
  Description of Artificial Sequence: Synthetic coding sequence
atggtcgagattgatgccgctagcgtctataccctgcccgctggcgccgattttctgatgtgttactctgtagccgaagggtactatagccaccgggaaaccgtgaacggaagctggtacatccaagatctatgcgagatgttgggcaagtatggttcctcgctagaattcactgaactgctgacattggtaaatcgcaaggtatcccagcgacgcgtcgatttttgcaaagacccttcggcaattggaaaaaagcaagtgccttgcttcgcatcaatgctgacaaagaaactccacttttttcccaaatcaaacctcgaacaccaccaccatcatcacgtggaaatcgacgggggatcgccaatgagttcagcatcaggactgcggcgcggccaccctgcggggggcgaggagaacatgaccgaaaccgatgccttttacaaacgtgagatgtttgacccagctgaaaagtacaaaatggaccatcgtagacgaggaatcgctctgatcttcaatcacgaacgatttttttggcacctgacactgcccgagcgaagaggtacgtgcgccgaccgtgacaacctcacccggcgtttctctgatcttggcttcgaggttaaatgtttcaacgaccttaaggctgaggagctcctcttgaagatacacgaagtctccactgttagtcatgccgacgctgattgttttgtatgcgtgtttctttcacacggtgaaggcaaccacatatacgcctacgatgccaaaatagagatccagaccctgacaggcttattcaagggcgataagtgccacagtctggtcggaaagccaaaaattttcatcatccaagcctgccgaggcaatcagcacgacgtgcctgtcatcccccttgatgttgtcgac

SEQ ID NO: 32407 - DNA, 900 bp, Artificial Sequence
  Description of Artificial Sequence: Synthetic coding sequence
atggtggaaatcgatgccgcctcagtgtacaccctgccggcgggagccgactttctgatgtgctacagcgtcgcggagggatactactcacacagggaaactgtcaacgggtcctggtacatccaggacctgtgcgagatgctgggcaagtacggatcctctctggagttcacggagctgctgaccctcgtgaatagaaaggtttcgcaacggcgggttgacttttgcaaggacccatccgccatcggaaaaaagcaggtaccctgttttgcgagcatgctgactaaaaagctgcatttcttccccaagtcgaacctcgagcatcaccatcaccaccacgtggaaattgacggaggatcgccgatgtcgtcagcgtccgggcttcggaggggccacccagctggtggtgaggaaaacatgaccgagactgacgcgttctacaagcgggagatgttcgacccagccgagaaatacaagatggaccacagacggagaggaatagcgctcatcttcaatcatgagcgctttttctggcatctgactctgcctgagcgcagaggtacctgcgcggatcgcgataacctgactaggagattcagcgatcttggattcgaggtgaagtgtttcaatgatctgaaggccgaagagctgttgcttaagatccacgaagtctcgaccgtgagtcatgccgacgcagattgcttcgtctgcgtctttctgagccacggggaaggcaaccacatctatgcatacgacgcgaagattgagatccaaactttgaccgggctgtttaaaggagataaatgtcactccctggtgggaaagcctaagatcttcatcatacaagcctgccgcggaaaccagcatgacgtgccggtgatcccgctggatgtcgtggac

SEQ ID NO: 32408 - DNA, 900 bp, Artificial Sequence
  Description of Artificial Sequence: Synthetic coding sequence
atggtcgaaatcgatgcagcgtctgtttacacgctcccagcaggggcggattttctgatgtgctacagcgttgccgaagggtactacagccaccgggaaactgttaatgggtcttggtacatccaggatctctgtgaaatgttgggtaagtacggcagcagtctcgaattcacggagctcctcaccttagtgaacagaaaagtttctcagcggcgggtagacttctgcaaggacccctctgctatcggaaagaaacaggttccttgctttgccagcatgctcaccaagaagctccatttcttcccaaagtccaatttagagcaccatcatcaccatcacgtcgaaattgatggcggctcacccatgtcttccgctagcggactcagacggggacaccctgccggcggagaagaaaacatgaccgaaactgatgctttttacaagcgggaaatgtttgatccggctgagaaatataaaatggaccacagaagacgcggcattgctctgatttttaaccacgaacgcttcttctggcacctgaccttgcccgagcgacgcggcacttgcgctgacagggacaatctgacaaggcggttttccgatttgggcttcgaagtaaaatgcttcaatgatctgaaagcggaggaattactcctgaagatccacgaggtgtccacggttagtcacgccgacgcggattgtttcgtatgcgtcttcctgtcacatggcgaaggaaatcacatctatgcgtacgatgctaaaattgaaatccagacactcaccggactgttcaagggtgacaagtgtcactctctggtaggaaagcctaaaatctttattatccaggcatgcagaggcaaccagcacgacgttcctgtgattcccctcgacgtcgtcgac

SEQ ID NO: 32409 - DNA, 900 bp, Artificial Sequence
  Description of Artificial Sequence: Synthetic coding sequence
atggtggagatagatgccgcttcagtgtacacgctgcctgctggtgcagatttcctcatgtgctactccgtggcggaaggctattacagccatcgcgagactgtgaacgggtcctggtacatacaagacctgtgtgaaatgctcgggaaatacggatcctccctcgaatttactgaacttcttaccctcgtgaatagaaaggtgtcacaaagacgcgtggacttttgtaaagatccatcggcaatcggaaagaagcaggtgccctgttttgcatccatgcttactaagaagctgcacttttttcctaagtccaatttggagcatcatcatcaccaccacgttgaaattgatggtggatctcctatgtccagcgcctcggggctgcgacggggtcatccagcaggtggggaagaaaacatgactgaaactgacgccttttacaagagggagatgttcgatccggcggaaaagtacaagatggatcataggcgacggggaattgcattgatattcaaccacgagaggtttttctggcatctcacccttcccgaaaggcgggggacctgtgcagatcgtgacaacctcacgcggaggttctcggatctgggtttcgaagtgaagtgtttcaacgatctgaaggccgaggagctgctgcttaagattcatgaggtgtccactgtctctcacgcagatgccgattgtttcgtgtgtgttttcctttcgcatggggagggaaatcatatctacgcttatgatgcgaagatagaaatccaaacccttaccggccttttcaagggggacaaatgtcactcactggtcggaaaacccaaaatcttcataatccaagcatgtcgtggaaaccagcatgatgtgccagtgatcccgctcgatgtcgtggac

SEQ ID NO: 32410 - DNA, 900 bp, Artificial Sequence
  Description of Artificial Sequence: Synthetic coding sequence
atggtggagatcgacgccgcctccgtgtataccttgcctgcaggagcagacttcctcatgtgctactccgtagcagagggatattatagccatcgcgaaacagtcaacggcagctggtacatacaggatctctgcgaaatgcttgggaagtatggttcctcgctggagttcaccgagttgctcacactcgtgaacaggaaagtcagccagcgaagagtagacttctgcaaggacccatctgcaatcggaaaaaaacaggtgccatgctttgccagcatgcttaccaagaagctgcatttctttcccaagtccaacctagagcaccaccatcatcaccacgtagagattgacgggggctcgcccatgtcatctgcgagtggccttcgtcgtgggcacccagccggtggagaagagaatatgacagagacagatgctttctataagcgtgagatgttcgatcccgccgaaaagtacaaaatggaccacaggcggcgcgggatcgccctgattttcaatcatgaaaggttcttttggcacctaactctgcctgagcgcagaggaacctgtgcagaccgcgacaacctaacacgtcggttttccgacttaggtttcgaggtgaagtgttttaacgatctgaaagccgaagagcttcttctgaaaatccacgaagtgtcaaccgtctcccatgccgatgctgattgcttcgtctgtgtttttctcagccacggagaggggaatcacatctacgcctacgacgcaaaaatcgaaatccagacactaactggcctgtttaagggagataagtgtcattctttggtcggcaaacctaagatctttattatccaagcctgtcgcggtaaccagcacgacgtcccagttatcccgctggatgtggtggat

SEQ ID NO: 32411 - DNA, 900 bp, Artificial Sequence
  Description of Artificial Sequence: Synthetic coding sequence
atggttgaaattgatgccgcttcagtctacacattacctgccggtgctgatttccttatgtgctattcggtcgctgaagggtactattcgcatagggagactgtcaatggatcttggtatatacaggatctgtgtgaaatgttgggcaaatacggtagtagtctggaattcactgagctcctaacacttgttaaccgtaaagtttcccaacgtagggtagacttctgtaaggatccaagcgcaataggcaaaaagcaggttccatgctttgcctcaatgctgactaaaaagttgcactttttccctaagtcgaaccttgaacatcatcatcatcatcatgttgagattgatggcgggtcacccatgtcttcggcttccggcttgcgtaggggccacccggccgggggcgaggagaatatgacggaaaccgatgccttctataagcgggaaatgttcgatcccgcagagaagtataaaatggatcatagacgtcggggtatagctcttattttcaatcatgaacggttcttttggcatctgactttacctgagcgaagaggaacctgtgctgaccgagataacttgaccaggagattctctgatctgggtttcgaagttaaatgttttaatgacctcaaggcagaagaactgctgcttaaaatacacgaagtatcaacagtaagccatgctgatgccgactgtttcgtttgtgtgttcctttctcacggagaaggaaatcacatttacgcttatgatgctaagattgagatacagacacttaccggtttgtttaaaggcgataaatgccacagtttggtcggtaagcctaagatatttatcatacaagcttgcaggggtaaccaacacgatgttccagttatcccactcgatgtggttgac

SEQ ID NO: 32412 - DNA, 900 bp, Artificial Sequence
  Description of Artificial Sequence: Synthetic coding sequence
atggtggagattgacgcggcgtcagtgtacacgttgccagctggagccgatttccttatgtgctattcggtagcagagggctattattcgcatcgcgagaccgtgaacggcagctggtatattcaggatctgtgcgaaatgcttggcaagtacggcagctcacttgagtttacggaactgctgacacttgtgaaccggaaggtgtctcagcgacgggtagacttttgtaaagatccaagtgcaatcggcaagaagcaagttccctgcttcgcttcgatgctcacgaagaaactgcattttttccccaagtccaatctggagcatcaccatcaccatcatgtcgaaattgatggcggatccccaatgagctccgcctccggcctgagacgaggccaccccgcggggggcgaggaaaatatgacagagacggatgccttctacaagcgggagatgttcgatccggcagagaaatacaaaatggaccatcgtcggcgcggaatcgccctgatatttaatcacgagcgattcttttggcacttaaccttgcccgaaagaagaggaacttgcgccgatcgagacaacttgacccggcgcttcagcgatctgggtttcgaggttaaatgttttaacgatttaaaggctgaggagctgttgctaaagattcatgaggttagcactgtgtcgcacgcggatgccgactgcttcgtttgcgtgtttctctcacacggtgagggcaatcatatttacgcgtacgacgccaagatcgagatacagaccctgactggtctgtttaaaggggataaatgtcatagtctggtgggcaagccaaagatttttatcatccaggcgtgcagaggcaaccaacacgatgttccggtcattccactggacgtcgtggat

SEQ ID NO: 32413 - DNA, 900 bp, Artificial Sequence
  Description of Artificial Sequence: Synthetic coding sequence
atggttgagatcgatgcagcgagcgtctacacgctgccagcgggagccgactttctgatgtgctactctgtggctgaaggttactactcacaccgtgaaacggtcaacggcagctggtacatccaagacctgtgtgaaatgcttggaaagtacggtagctctctggagtttacggaacttcttactctggtcaaccggaaggtgtcccaacgtagggtcgatttctgtaaggatccttcagcgattggaaagaaacaagtcccatgtttcgcatcgatgttgaccaagaagttgcacttttttcctaaatccaacctcgaacaccaccatcatcaccatgtggagatcgacgggggttctcccatgtcgagtgcatccggacttagacgcggacatcccgctggaggtgaagaaaacatgactgagactgatgccttttacaaaagagagatgtttgaccctgcggaaaagtacaagatggaccatagacgccgtggcatcgccctcatctttaatcatgagcggttcttttggcacctcactcttcctgagagacggggaacttgtgcagatagagataatctgactaggcgattttcggacctggggttcgaggtgaagtgctttaacgatctgaaagcagaagagctgctccttaagatacatgaagtatcaaccgtcagccatgcagacgcagattgttttgtttgtgtctttctctcgcatggagaaggaaatcatatctacgcatacgatgccaaaatagaaattcagaccctgactggtcttttcaagggcgacaagtgccattcgttggtcggaaaacccaagatattcatcattcaggcatgcagagggaatcagcacgatgtgcctgtcatacctcttgatgtggtggac

SEQ ID NO: 32414 - DNA, 900 bp, Artificial Sequence
  Description of Artificial Sequence: Synthetic coding sequence
atggtggaaatcgacgctgctagcgtctacaccctgcccgctggcgccgattttcttatgtgttactctgtggctgagggctactacagccatcgggaaaccgtgaatgggtcatggtatatccaggacctctgcgagatgctgggcaaatacggctcttctctcgagtttactgaactcctgaccctggtgaaccggaaggtttcacagcgccgggtcgacttctgcaaggacccttccgccattggaaagaagcaggtgccgtgttttgcttctatgctgacaaagaagttgcatttcttcccaaaatccaacttggagcaccatcaccatcaccatgtggagatcgacggggggtctccaatgtcttccgccagtggactgcgtagggggcatccagcaggcggcgaggaaaacatgaccgagactgacgccttctataagcgagagatgttcgacccagccgagaagtacaagatggatcatcggcgaaggggcatcgctctgattttcaatcacgagcggttcttctggcatctcacactccctgaacgccgtgggacttgtgcagatagagataacctgactcgacgatttagcgatctggggtttgaagtgaaatgtttcaacgatctcaaggctgaagagctcctcctgaaaatccacgaggtctcgacagtgagccacgcagatgccgactgctttgtttgcgtttttctgtcccacggagagggcaatcacatttacgcttacgacgccaaaatcgaaatacagacactaactgggctctttaagggcgataagtgtcacagtctggtggggaagcctaagattttcattattcaggcctgcagaggtaaccaacatgacgtacctgtaattcccctggacgtggttgac

SEQ ID NO: 32415 - DNA, 900 bp, Artificial Sequence
  Description of Artificial Sequence: Synthetic coding sequence
atggtggagatcgatgccgcgtcagtttataccctaccagccggcgccgactttctgatgtgttacagcgttgccgaaggatactactcacacagagagacggttaacggaagttggtatatccaagacctctgcgagatgctcggaaagtatggcagctccttggagtttaccgaactcctaactctagtgaatagaaaagtcagccagcgccgcgtggatttttgcaaggatccgtccgcaatcggcaagaaacaggtgccctgtttcgcatctatgctcaccaaaaagcttcacttcttcccgaaatcaaatcttgagcatcaccaccatcaccacgttgagatagatgggggcagtcccatgtcgtccgcaagcggattaaggcggggacatcctgcgggaggtgaggaaaacatgacagaaaccgacgccttctataaaagggagatgttcgaccctgcagaaaaatacaaaatggatcatagacggagagggatcgcgctgattttcaaccacgaaaggtttttttggcacctgacactgccagaacgtcgtggcacatgtgccgatcgggataatctgacccgcaggtttagtgatctgggctttgaggttaagtgtttcaacgatctaaaggccgaggagctgctactgaagatccacgaagtctcgactgttagtcacgccgacgcagattgtttcgtgtgtgttttcttgagccatggcgaggggaaccacatttatgcctatgatgcgaagattgaaattcagacgttgactggtctatttaagggcgataagtgtcacagcctcgtgggaaagcccaaaatcttcattatacaggcatgccgtgggaaccagcacgacgtgcctgtcatacctctggatgttgtggac

SEQ ID NO: 32416 - DNA, 900 bp, Artificial Sequence
  Description of Artificial Sequence: Synthetic coding sequence
atggtggagatcgacgctgcgtccgtgtacactctgcccgcgggggcggattttctcatgtgctacagcgtcgcggaaggatactactcccaccgcgaaaccgttaatggctcatggtacatccaagatttgtgcgaaatgctcggcaagtacgggtcatccctggagtttaccgagttgttgactcttgtgaaccgcaaagtttcgcaaaggcgcgtcgacttttgcaaggatccttcggcgattggaaagaagcaggtcccgtgctttgcttcaatgctgaccaagaagctgcatttctttccgaagtccaatctcgagcatcaccaccaccaccatgtggaaatcgacgggggctccccgatgtcatcggctagcggactgcgccgtggtcacccagcggggggcgaggaaaacatgactgagactgatgccttttacaaaagagaaatgttcgacccagccgaaaagtacaagatggatcaccgccgccgcgggatcgccctgatcttcaaccacgaaagatttttctggcatcttaccctgcccgagcggcgcggcacctgcgcggacagagataatcttacgcgcagattctccgacctgggattcgaagtcaaatgtttcaacgatctcaaagccgaagaactccttctgaaaatccacgaggtgtcaaccgtctcgcatgccgacgcagattgtttcgtgtgcgtatttctgtcacatggagaaggaaatcacatctatgcctacgacgcgaagatcgaaatccagactttgacgggtctgttcaagggagataaatgtcattccctcgtcgggaagccgaagattttcattatccaggcttgccggggaaaccagcatgatgtccccgtgatccctctggatgtggtcgac

SEQ ID NO: 32417 - DNA, 900 bp, Artificial Sequence
  Description of Artificial Sequence: Synthetic coding sequence
atggtggaaatcgatgctgcctccgtctacaccctgcctgcaggtgcagacttccttatgtgctactcggtggctgaaggatactactcacacagagaaactgtcaacggttcgtggtacatccaggatctttgtgagatgctgggaaagtacggatcgtcgctggagttcacggaattgctgactctggtgaataggaaagtcagccagaggagagtggatttttgcaaagacccaagcgccattggcaagaagcaggtcccgtgcttcgcatcaatgctgactaagaaactgcatttctttccaaagtccaacttggagcaccaccatcaccaccatgtggaaattgacgggggatctccgatgtcgagcgcgagcggtctgagaagaggacatccggcaggaggagaagagaatatgactgaaactgatgccttctataagcgcgaaatgttcgaccctgcggagaagtacaagatggaccatcgacgccgcggaattgcgctgatcttcaaccatgaaaggttcttttggcacctcaccctgccggaacggagaggcacttgtgccgaccgggataaccttacgagaagattctcagacctgggttttgaggtgaagtgcttcaacgacctgaaggccgaggagctgcttctgaagatccatgaagtgtcaaccgtctctcatgcagacgcggattgctttgtctgcgtgttcctctcgcacggagagggaaatcatatctacgcctatgatgcgaagatcgagatccagaccctgaccggcctcttcaagggcgacaagtgccactcactggtgggcaaaccgaagatcttcatcatccaagcgtgccgaggcaaccaacacgacgtgcctgtgatcccgttggacgtcgtcgac

SEQ ID NO: 32418 - DNA, 900 bp, Artificial Sequence
  Description of Artificial Sequence: Synthetic coding sequence
atggtggaaattgacgcagcgtcagtgtatacgcttccagcaggggctgatttcctgatgtgttatagcgtcgcggaggggtactactcacatcgggaaaccgtgaacggttcttggtatattcaggatctgtgcgagatgctcggcaagtacgggagtagcctcgaattcaccgaactcctgactctcgtcaatagaaaggtgtctcagcggcgggtggacttctgtaaagatccttccgctatcggaaagaagcaggtcccgtgtttcgcaagcatgcttactaagaaattgcatttctttcccaagtctaaccttgaacatcaccatcatcatcatgtggaaatagatggaggatcccccatgagctcggcatcgggcctccgaagaggtcacccagctggcggtgaagaaaacatgacggaaaccgatgccttctataaacgggagatgtttgaccctgcagagaaatacaaaatggatcatagacgacgcggaatcgcactgattttcaatcacgagcgatttttctggcacctcaccctgccagagcggcgcggcacctgcgcggatagagataaccttacccgtaggttttcggacttgggatttgaagtgaagtgctttaatgacctgaaagcagaggaacttctgcttaagatccatgaagtctcgactgtgtcgcacgcagatgcggactgttttgtgtgtgtttttctgtcccatggggaaggtaaccacatctacgcctacgatgccaagattgagatccaaactctgactggtttgtttaaaggagacaagtgccattccctcgtgggtaagccgaagattttcatcatccaggcttgtcgtggaaaccagcacgatgtacctgtcatacctcttgacgtggtcgat

SEQ ID NO: 32419 - DNA, 900 bp, Artificial Sequence
  Description of Artificial Sequence: Synthetic coding sequence
atggttgagatagatgctgcgtccgtatataccctgcctgcgggggctgattttctgatgtgctatagtgtggctgaaggatactacagccatagagagaccgttaacgggtcatggtatatccaagacttatgcgagatgctggggaaatacgggtcatctctagaatttacagagttgttgacacttgtgaatcggaaggtgtcccagcgacgagtggatttctgcaaggatccaagcgcaattggaaagaaacaggtaccttgttttgcttccatgctcacgaagaagcttcatttttttcctaagtcaaaccttgaacatcatcaccaccaccatgtggaaattgacggcgggtcacccatgagctcggcctccggactgaggagaggccatcctgccggcggcgaggagaacatgaccgagactgatgcattttacaagagagagatgttcgatcccgccgagaaatacaagatggaccatagacggcgaggaattgctctgattttcaatcacgaacggtttttctggcacctgaccttgcccgagcgccgagggacttgcgccgaccgcgataatctcacaagacggttctcggaccttggttttgaagtcaaatgttttaacgatcttaaggccgaggaactcctgctgaaaatccacgaggttagtactgtttcacatgcagacgcggattgtttcgtgtgtgtgttccttagccatggtgagggaaaccacatctatgcttacgacgcaaaaatagaaatccagactctgaccggtctatttaaaggtgataaatgtcatagcttggtcggcaaaccaaaaattttcataatccaggcctgtcggggtaaccagcacgacgtgcctgttataccactggatgtggtggat

SEQ ID NO: 32420 - DNA, 900 bp, Artificial Sequence
  Description of Artificial Sequence: Synthetic coding sequence
atggttgagattgatgccgctagcgtgtatacactgcccgccggggccgattttctgatgtgttattcagttgctgaggggtactatagccatcgcgagaccgtcaatgggtcttggtacattcaggatctctgtgaaatgctgggtaagtacggctcatcactggagttcacagagctcctgaccttggtcaaccggaaagtcagtcaacgacgggtggacttctgtaaagaccctagcgcaatcggaaaaaagcaggttccttgcttcgcaagtatgctcactaagaagctccacttcttcccgaagagcaatctggagcaccaccaccatcaccatgtggagattgacggagggtcacccatgtcttcagccagtggtctcagaagaggacaccccgccggcggcgaggaaaacatgactgagaccgatgccttttacaagcgcgaaatgtttgacccggcagaaaaatacaaaatggaccaccggagaagaggaattgctcttatttttaatcatgaacggttcttctggcatctgaccttgccagagcgccggggtacgtgcgccgatcgggataatctgactcggcggttctctgacctaggattcgaggttaagtgcttcaacgacctgaaagcagaggagttgcttctgaagatccacgaagtgagcacggtgtcccacgctgatgccgattgctttgtgtgcgttttccttagtcacggagaagggaaccacatatatgcatacgacgcgaagatagagattcaaacactcactggcctgtttaagggggataagtgccactcactggttggcaaacctaaaatctttatcattcaggcttgtcgggggaatcagcacgacgttcccgtaatacccctggacgttgtggat

SEQ ID NO: 32421 - DNA, 900 bp, Artificial Sequence
  Description of Artificial Sequence: Synthetic coding sequence
atggttgaaatcgatgcggcatccgtctacactttgcctgcgggagccgacttcctgatgtgttacagcgtggcagagggctactattcgcatcgggaaaccgtgaacggaagctggtacattcaggacctgtgtgagatgttgggcaagtacggttcaagcctcgaattcacggagcttctgactctggtgaaccggaaagtctcccaacgtagagttgacttttgtaaggacccatcggcgattggtaagaagcaggtgccttgttttgcgtccatgcttaccaagaagctgcacttttttcctaagagcaacctggagcatcaccatcaccatcatgtggaaatcgatggtggttcgcctatgtcgtccgcatccgggctcagaagaggacatcctgcagggggtgaagagaatatgaccgaaaccgacgcattttacaagcgtgagatgtttgatcctgccgaaaagtacaagatggatcatagacgcagggggattgctttgatattcaatcacgaaaggtttttctggcatcttaccctgccagaacgaagaggaacttgcgccgatcgcgacaacctgactagaagattttcggacctgggatttgaggtcaagtgctttaatgatttgaaagcggaggaacttctcctcaaaattcacgaagtctccacggtgtcacatgcggatgcagattgtttcgtctgtgtgttcctgtcgcatggtgaagggaaccacatttacgcctacgacgcgaagattgaaatccaaaccttgactggtcttttcaagggagataaatgccactcactggtgggtaaacctaaaatcttcataatccaagcatgtcgtggtaatcaacatgatgtgcctgtgatccctcttgacgttgtggac

SEQ ID NO: 32422 - DNA, 900 bp, Artificial Sequence
  Description of Artificial Sequence: Synthetic coding sequence
atggtcgaaatcgacgccgcctccgtgtacactctgcccgctggtgctgattttctgatgtgttactcggtggcggagggatactacagccacagggaaaccgtgaacggctcttggtatatccaggatctgtgtgaaatgctgggaaagtacggctccagcctggagttcactgagctgcttaccctcgtgaaccggaaggtcagtcagcgccgcgttgacttctgcaaggacccttcagccatcggaaaaaagcaggtgccgtgcttcgcgtcaatgctcacgaaaaagctgcacttttttccgaagtccaatctggagcaccaccaccatcaccacgtggagattgacggaggcagccctatgtccagcgcgagcggattgcggagaggacatcctgcgggcggagaagagaacatgaccgaaaccgacgcgttctacaagagagaaatgttcgatccagctgagaaatacaagatggaccatcgtcgccggggaatcgcgctgatcttcaatcatgagcgcttcttctggcatctgactctgccagaaagacggggcacttgtgctgatagagacaacctcacccgccgcttttcggacctgggtttcgaggtcaaatgcttcaatgatctgaaagcggaagaacttctgcttaagatccacgaggtttccaccgtgtcccacgccgacgcggattgcttcgtgtgcgtgttcctgtcgcatggagagggcaaccacatttacgcctacgacgccaagatcgagatccaaacccttactgggctgtttaaaggcgacaagtgccacagcttggtcggaaagccgaagatcttcatcatccaggcgtgtcggggaaaccagcatgatgtgccagtgatcccgctcgatgtggtcgac

SEQ ID NO: 32423 - DNA, 900 bp, Artificial Sequence
  Description of Artificial Sequence: Synthetic coding sequence
atggtggaaatcgacgcggcaagcgtgtacaccctgcccgcaggcgccgactttttgatgtgctactcggttgccgaaggatactattcccatagggaaactgtgaacggctcgtggtatattcaggatctgtgtgaaatgctcggtaagtacgggtcgtccttggaattcaccgaacttctgaccctggtgaaccgaaaggtgagccaacgtcgggtggatttttgtaaagacccgtccgcaattggtaagaagcaagtgccatgtttcgcctccatgctgaccaaaaaactccactttttccctaagagcaacctggagcatcaccatcaccaccacgtggaaattgacgggggttcaccaatgtcgtcagcgtcaggcctgaggagaggccatccagccggaggcgaagaaaacatgactgagactgatgcattttacaagcgagagatgttcgacccagcagagaagtacaagatggatcacaggcggcgtggtattgcactcattttcaaccatgaacgctttttctggcaccttactctgccagaaaggagagggacttgtgctgacagagacaacctgacgagacggtttagcgatctgggttttgaagtcaaatgctttaatgaccttaaggccgaagaacttcttcttaagatccacgaagtctcaaccgtgtctcatgccgacgcagattgttttgtctgtgtgtttctgtcgcacggggagggaaaccacatatacgcctacgatgccaagattgagattcagactcttaccgggctctttaagggagacaagtgtcattccctggtgggaaaaccaaagatcttcattatccaggcatgtaggggtaaccaacacgacgtgcccgtgattcctcttgacgtggtggat

SEQ ID NO: 32424 - DNA, 900 bp, Artificial Sequence
  Description of Artificial Sequence: Synthetic coding sequence
atggtggagatcgatgcagcctcggtttacaccttgcctgccggcgctgacttcctgatgtgttactccgtggcagaaggctactactcacaccgagagaccgttaacggatcatggtacatccaggatttgtgtgagatgctgggcaaatacggatcaagtctcgaatttactgagcttctgacgctggtgaacagaaaggtctctcagaggcgtgtggatttctgcaaagatccatctgccatcgggaagaaacaggtgccatgtttcgcgtctatgcttactaagaaattgcatttcttccctaaatcaaatctggagcaccaccaccatcatcacgtagagattgatggcggcagccccatgtcaagcgccagtgggctccgtagaggccatcctgccggtggggaggaaaatatgaccgagaccgacgcgttttataagagggaaatgtttgacccagctgaaaaatacaagatggaccaccgtcgcagaggaattgccctgatcttcaatcacgagagattcttttggcacctcaccctgcctgagagacgcggaacctgtgccgatagagataatctgactcgtcggttctccgacctgggattcgaggtaaagtgttttaatgatctcaaggccgaggagctgttgctgaaaatacatgaggtgtccactgtttcacacgctgacgccgattgtttcgtgtgtgtgttcctctcccacggagaagggaaccacatctacgcctacgacgctaagattgagatccagaccctgactgggctgttcaagggggataaatgccacagtctcgtgggtaaacctaagatatttataatccaggcatgcaggggcaaccagcacgatgtccctgtcatccccctggacgtcgtggat

SEQ ID NO: 32425 - DNA, 900 bp, Artificial Sequence
  Description of Artificial Sequence: Synthetic coding sequence
atggttgaaattgatgctgcatcagtttatacattgcccgccggagccgacttcctcatgtgttatagcgtggcagaaggctactatagccatcgcgaaactgtgaatggaagctggtatattcaagatctatgtgaaatgctcggaaagtacgggtctagtctcgagttcaccgagctgctgaccttggtgaacaggaaggttagccaacggagggtagacttctgtaaggaccctagtgcgatcggtaagaaacaggtgccatgcttcgcctcaatgctgactaaaaagctacacttctttcctaagagcaacctcgagcaccaccaccatcatcatgtggaaatcgatggtggctctccaatgtcctcagcttctggcctccgaaggggccaccctgcaggaggtgaggaaaatatgacggaaaccgatgcattctacaagcgcgaaatgttcgatcctgcggaaaagtataagatggaccacaggaggcggggtatagccctcatattcaaccacgagcggttcttctggcacttgacgctgcctgaaagacgtgggacgtgtgccgatagggacaatctgactaggcggtttagcgatctgggattcgaggtaaagtgtttcaacgatctgaaggccgaggagttgttactaaagatacatgaggtttcaacagtgtcccacgcagatgcggactgctttgtgtgcgttttcctgtcccatggcgaaggaaaccacatttatgcatatgatgctaaaattgagattcaaacattaacgggactgtttaaaggcgacaagtgccactccctggtgggaaagccaaagattttcatcattcaagcgtgcagggggaatcagcatgatgtgccggtaatacccttggatgttgtcgac

SEQ ID NO: 32426 - DNA, 900 bp, Artificial Sequence
  Description of Artificial Sequence: Synthetic coding sequence
atggtggagatcgacgcggctagtgtgtacactctccctgcgggagccgactttctgatgtgctattccgtcgcagagggttactactcgcatcgagagaccgttaacggctcctggtacatccaagacttgtgtgagatgcttggtaagtacggcagcagtctcgagttcaccgagctcctgacccttgtaaaccgcaaagtgagtcaacggagagtggacttttgcaaggatccgagcgcaatcggcaaaaagcaggtcccatgcttcgccagtatgctgactaaaaagctgcatttcttcccaaagtccaacctggagcaccaccaccaccaccacgtcgaaatcgatggaggttcccccatgagctccgcttccggcctgcgccgaggtcacccggccggtggcgaggagaacatgactgagactgacgccttctacaaacgcgaaatgttcgatcccgccgagaaatataagatggatcaccgccgacgcggaatcgccctgatctttaaccacgaacgtttcttctggcacctgaccttgcctgagcgtcgggggacatgcgctgatcgggacaacttgacgcgccgcttcagcgacctcggcttcgaggtcaagtgcttcaacgacttgaaggccgaggagctcttgttaaagattcatgaagtgtctacggtatcccacgctgacgccgattgcttcgtctgcgtgtttctcagtcacggtgagggcaaccatatctacgcctacgatgcaaagattgagattcaaaccctcactggacttttcaaaggagataagtgccactcccttgttggcaagccaaagatcttcattattcaggcatgccgcggcaaccagcatgatgtgccggttatccctctcgacgtggtcgac

SEQ ID NO: 32427 - DNA, 900 bp, Artificial Sequence
  Description of Artificial Sequence: Synthetic coding sequence
atggtggaaatcgatgcagcatcagtgtacaccctccctgcaggtgcagattttctcatgtgttacagcgtcgctgagggctactattcccatagagaaaccgtgaacggttcctggtacatccaagatctctgcgaaatgctggggaagtacggatcgtcactggaatttaccgagcttctgaccctcgttaataggaaagtcagccaacgtcgggtggacttttgtaaagacccttctgctattggtaaaaagcaggtgccgtgctttgcctcgatgcttaccaagaagctccacttttttcctaaatcgaacctggagcatcatcaccaccatcatgtggaaatagacggcggatcaccgatgtcgtctgcctcaggtctgcgcagaggtcatccagcgggcggcgaagaaaacatgaccgaaaccgatgcgttctacaaaagggaaatgtttgaccctgcagaaaagtacaagatggaccatcggagacgcggtattgcacttatctttaatcatgagagatttttctggcacctgaccctccctgaacgcaggggtacctgtgcggatagagataacctgactagaagattcagcgatcttggatttgaggtgaagtgtttcaacgaccttaaggctgaagaactgttgctgaagatccatgaagtgagcacggttagccatgcagacgctgattgttttgtgtgcgtgttcctgtcccacggcgagggaaaccatatctacgcatacgatgcaaaaatcgaaatccagactcttaccgggctcttcaaaggagacaagtgtcattccctggtgggaaagcctaagatcttcataatacaggcatgcagaggtaatcagcacgatgtccccgtgattcctctggacgtggtcgac

SEQ ID NO: 32428 - DNA, 900 bp, Artificial Sequence
  Description of Artificial Sequence: Synthetic coding sequence
atggtagaaatcgacgcagcttcagtgtacacgttgcctgccggtgctgatttcctgatgtgctactcggtggcggagggatattactcacatagagaaaccgtcaatggatcttggtacatccaggacctctgcgaaatgctgggaaagtacggtagcagcctcgaatttaccgaactcctcacgttggttaaccgcaaagtgtcccaacggcgcgtggatttttgcaaagacccgtccgccatcggaaaaaagcaagtcccgtgcttcgcttccatgctgactaagaaactgcatttctttcccaagtctaatttggagcatcatcaccaccatcatgtcgaaatcgatgggggatcgccgatgtcgagcgcatcgggactccggcgcggtcacccggccgggggagaagagaatatgaccgaaaccgatgcattttacaagcgggaaatgttcgatcctgcggaaaagtacaagatggaccatcggcggaggggcatcgcactgatcttcaaccacgagagattcttctggcacctcactctgcctgaacgacggggaacttgcgccgaccgagacaacctcacccggaggttctccgatctgggtttcgaggtcaagtgtttcaatgacctcaaagcagaagagttgctgctgaaaatccacgaagtgtcaactgtgtcgcacgcggatgccgactgtttcgtgtgtgtgttcctctcacacggagaaggaaaccatatctacgcttacgacgcaaagatcgagatccagacgctgaccggactgtttaaaggagacaaatgccactcgttggtcggcaagccaaagattttcattatccaggcgtgccgaggcaatcagcatgacgtgccggtgatcccattggatgtggttgat

SEQ ID NO: 32429 - DNA, 900 bp, Artificial Sequence
  Description of Artificial Sequence: Synthetic coding sequence
atggtagaaatcgacgcagcgtcggtttacactttgccagccggagctgacttcctgatgtgctactccgttgctgaaggttactactcacaccgggaaaccgtgaacggatcatggtacatccaggacctgtgtgagatgttgggaaagtacggatcgagcctcgagtttacggaactgttgaccctggtcaatagaaaagtctcgcaaaggcgcgtggacttctgcaaggatccttcggctattggaaagaagcaggtcccgtgcttcgcatccatgctgaccaagaagttgcatttctttcccaaatcaaatctggagcaccatcaccaccaccatgtggaaatcgacggtggatcccctatgagctccgcctccggactgcgccgcggccacccagcgggaggagaggaaaacatgaccgagactgacgcgttctacaaacgggaaatgttcgatccggcagagaagtataagatggaccataggcgccgaggaatcgcgttgattttcaatcatgagcggttcttttggcaccttaccttgccggaaaggcgcggtacttgcgcggatcgggacaacctgactagaagattctcagatctggggtttgaggtgaagtgtttcaacgacctgaaggccgaagaattgctgttgaaaatccacgaggtgtccaccgtgtcgcatgcggacgccgactgctttgtgtgcgtgttcttgtcccacggtgaagggaaccatatctacgcatatgacgccaagatcgagatccagactctcacgggactcttcaaaggagacaagtgtcatagcctggtcggtaaaccgaagatcttcattatccaggcttgccggggaaatcaacatgatgtcccggtgatcccactcgatgtggtggac

SEQ ID NO: 32430 - DNA, 900 bp, Artificial Sequence
  Description of Artificial Sequence: Synthetic coding sequence
atggtggaaatagacgctgcctccgtttataccttgccagctggtgcagactttctgatgtgttattctgtggcagaaggctactactctcaccgggaaaccgtgaacgggtcttggtacattcaggacttatgcgaaatgttagggaaatacgggtcttcccttgaattcacagaactcttaacactggtcaacagaaaggtcagccagcgccgcgtggacttttgtaaggacccttccgctatagggaagaagcaggtgccttgttttgcatctatgctgacaaagaaactgcatttcttcccaaagagcaacctggagcaccatcatcatcaccatgttgaaattgacggcggcagccccatgagtagcgcatccggattaaggcggggccatccagccgggggagaagaaaatatgacagaaactgatgccttttataagcgggagatgtttgatcccgcagaaaaatataagatggatcaccgccgacggggcattgccctcatattcaatcatgaaaggtttttttggcatttaactctcccagaaagacgtggcacttgcgctgatcgggacaaccttacaaggcgattctccgacctgggcttcgaggtcaagtgctttaatgatctgaaagccgaggagctcctgctgaagattcacgaagtgtcaaccgtgagtcacgccgatgccgattgcttcgtgtgcgtttttctgtcacatggcgagggcaaccacatctatgcttacgatgccaaaatcgaaattcagactctgaccgggctgtttaagggggacaaatgtcactccctcgtgggcaagcccaagatcttcatcattcaggcctgtcgtgggaaccagcacgacgttcctgttatccctcttgacgtcgtggac

SEQ ID NO: 32431 - DNA, 900 bp, Artificial Sequence
  Description of Artificial Sequence: Synthetic coding sequence
atggttgaaatcgacgccgcttccgtgtacactctcccggccggagctgacttcctgatgtgttactccgttgccgaagggtattactcccatcgcgaaactgtgaatggctcctggtatatccaagacctttgcgagatgctcggaaagtacggatcatctctggagttcactgaactgctgacgctcgtgaatcggaaggtgtcgcagcggcgagtcgatttctgcaaggatccgtccgcaattggcaaaaaacaggtcccctgttttgcgtctatgctgaccaagaaactccacttctttcccaaatccaatctggaacaccaccaccaccatcatgtggaaatagacggtggttcgccgatgtcgagcgcctcgggtcttagaaggggacacccagcgggcggagaggaaaacatgacggagactgacgccttttacaagcgggaaatgttcgacccagccgagaagtacaaaatggaccatcggagaagaggaatcgccctgatcttcaatcatgagcgctttttctggcacctcaccctgccagagcgccgcggcacctgcgcggatcgggataacctcacccgccgcttttccgacctgggattcgaagtgaagtgcttcaacgatctgaaagcagaagaattgctgctcaaaatccatgaggtgtcgaccgtttcgcacgcggacgctgattgctttgtctgcgtgttcctgagccacggggaggggaaccatatctacgcttatgatgccaagatcgagatccagactctgactggactgttcaagggggacaagtgccactcactggtgggcaagcctaagatcttcatcatccaggcatgccgcggaaaccaacacgatgtcccagtgatcccacttgatgtcgtggac

SEQ ID NO: 32432 - DNA, 900 bp, Artificial Sequence
  Description of Artificial Sequence: Synthetic coding sequence
atggtcgagattgatgcagcatctgtgtacactttgccagccggggcagattttcttatgtgttactctgtggccgaaggctactactcccatagagaaaccgtaaacggctcctggtacatacaggacctctgtgaaatgctgggaaagtacggctcttcactggagtttaccgagctgctgacgctggttaatcggaaagtgtctcagaggcgggtcgacttctgcaaggaccctagcgcaatcggaaagaagcaggtcccttgcttcgcctccatgctgacgaagaaacttcatttcttcccgaagagtaacctcgagcatcatcaccatcatcacgtggagattgatggcgggagcccaatgtcctcagctagcggcctgaggcggggacaccccgctggtggagaggagaatatgacagaaaccgacgccttctataaaagagagatgtttgatcctgccgagaagtacaagatggaccaccggcgacgagggatcgccctcatttttaatcatgaacggttcttctggcatctgactttgccggaacggcgggggacctgtgctgatagagataatctgacccgccggttctctgacctgggttttgaggttaagtgctttaatgatctgaaagcagaggagctcctgctgaaaatccatgaggtcagtactgtgagccacgcggacgctgattgctttgtgtgcgtgttcttgagccacggagaaggcaaccacatctatgcgtacgacgcaaagatagaaatccagaccctgactggactgttcaagggcgacaagtgccatagcctggtgggaaaaccaaaaatttttatcatccaggcctgtagggggaaccagcacgatgtgccagtcattccccttgacgtggtagac

SEQ ID NO: 32433 - DNA, 900 bp, Artificial Sequence
  Description of Artificial Sequence: Synthetic coding sequence
atggttgagattgacgccgctagtgtctacaccttgcctgctggggccgattttttgatgtgttacagcgttgccgaagggtactacagtcatcgggagacagtgaatgggtcctggtacatccaggatctctgcgagatgctcggaaaatatggatctagcctcgagtttaccgagctactgactctggtcaaccgtaaggtttctcaacgtcgagtcgatttctgcaaagacccttccgctatcggaaaaaagcaggtcccatgctttgcctccatgctcactaaaaagctgcacttcttccctaagtccaatttggaacaccatcatcatcatcatgttgagattgacggtggctctcctatgtccagtgcctcaggtttgagaagagggcaccctgctggcggcgaagaaaatatgaccgagactgatgcattctacaagcgggagatgtttgatcccgctgagaagtataagatggaccacagaaggcgaggcatcgccctgatatttaaccacgagcgcttcttctggcatcttaccctccccgagaggagagggacttgcgcagaccgggataacctgaccagaaggttttctgatctcggcttcgaagtaaaatgctttaatgatcttaaggcggaagaattactcttgaaaatccatgaggtgtcaaccgttagtcacgccgacgctgactgctttgtgtgtgtgttcttatcccacggcgaaggcaatcatatctatgcatacgacgcgaagatcgagatccagacattgacgggcctgttcaaaggtgacaagtgtcattccctcgttggcaaaccaaaaatcttcattattcaagcctgtagagggaaccaacatgatgtccccgtcattcctctggacgttgtggat

SEQ ID NO: 32434 - DNA, 900 bp, Artificial Sequence
  Description of Artificial Sequence: Synthetic coding sequence
atggtggaaattgatgctgcatcagtttatacattaccagctggagcagatttcttaatgtgttattctgtggcagaaggttactattctcatagagaaaccgttaacggatcatggtatatacaagatttatgtgaaatgttaggaaaatatggatcttctcttgaatttactgaactccttacacttgtcaacagaaaagttagtcaaaggagagttgatttctgtaaagatccttcagctattggtaaaaagcaagttccatgtttcgcaagtatgttaactaaaaaattacattttttcccaaaaagtaatttagaacatcaccatcaccatcatgttgaaattgatggtggatcaccaatgtcatctgcaagtggacttagaagaggacatcctgcaggaggagaagaaaatatgacagaaacagacgcattttataaaagagaaatgtttgatccagctgaaaaatataagatggatcatagaagaagaggtattgcattaatttttaatcatgaaagatttttttggcatttaacattaccagaaaggagaggaacatgtgctgatagagataatttaactagaagattctcagatttaggatttgaagttaaatgttttaatgatttaaaagcagaggaattacttttaaaaattcatgaagtttcaacagtatcacatgcagatgcagattgtttcgtttgtgtttttttatcacatggagaaggaaatcatatatatgcatatgatgcaaagatagaaattcaaactttaactggtttatttaagggagacaaatgtcattctttggtaggtaaaccaaaaattttcattatacaggcttgtagaggaaatcaacatgatgttcctgtcattcctttagatgtagttgat

SEQ ID NO: 32435 - DNA, 900 bp, Artificial Sequence; identical to SEQ ID NO: 32408
  Description of Artificial Sequence: Synthetic coding sequence

SEQ ID NO: 32436 - DNA, 900 bp, Artificial Sequence
  Description of Artificial Sequence: Synthetic coding sequence
atggtggagatcgacgcggcgtcagtctacactctcccagcaggtgcggacttccttatgtgctactcagtcgctgagggctactattcgcatcgggaaaccgtgaacggatcgtggtacatccaagacctctgcgaaatgctcggaaagtacggcagctccctggaattcacggaactcctgactctcgttaaccgtaaggtcagccagcgccgggtggacttttgtaaagatccttcagcgatcggaaaaaagcaggtgccatgcttcgcatcgatgctgacgaagaagctgcatttcttcccgaaatcgaatctggagcaccaccatcaccatcacgttgagattgatggcgggtcaccgatgagctccgcctcggggctccggcgcggacacccagctggcggagaagagaatatgaccgagactgatgccttctataagcgcgaaatgttcgaccctgccgagaaatacaaaatggaccacaggagacgggggatcgcccttatctttaatcatgagcgcttcttctggcacctcaccttgcctgaacggcggggtacttgtgccgatcgcgataacctgactagacggttctccgacctcggatttgaagtgaagtgtttcaacgatctcaaggccgaagaactcctgctgaaaatccacgaagtctccaccgtgtcccacgccgacgcggactgcttcgtctgtgtgttcctgagccacggggagggaaaccacatttacgcttacgacgccaaaattgaaatccaaaccttgaccggcctctttaagggcgataagtgccactcactggttggaaagccgaagatctttatcatacaggcatgccgggggaaccagcatgatgttccagtgatcccgttggacgtggtcgac

SEQ ID NO: 32437 - DNA, 900 bp, Artificial Sequence
  Description of Artificial Sequence: Synthetic coding sequence
atggtcgaaatcgacgctgcctccgtttacactttgcccgctggcgctgatttcctgatgtgttactcagtcgctgaaggatactattcacaccgtgaaactgttaacggtagttggtatattcaggacctttgcgagatgctgggcaagtatggttcaagcctggagttcactgaattgctgaccttggtgaaccgcaaggtatctcagcgtcgcgtagacttctgtaaggacccctccgcaatcggaaagaagcaagtgccctgttttgctagtatgctcacaaagaagctccatttctttcccaaatccaatctcgaacatcaccaccaccaccacgtagaaatcgatggaggatctcctatgtcctctgcctccggactcagacgcggtcacccagccggcggtgaagagaatatgactgaaaccgacgccttctacaagagagaaatgttcgacccagccgagaagtacaagatggatcatagaagacgcggcattgctttgatttttaaccacgagcgcttcttttggcaccttacactgcccgagcgcagaggaacttgcgctgacagggataacctcacaaggcgctttagtgacttgggttttgaggtcaagtgcttcaatgacctgaaggccgaggagctgctgttgaagatacacgaagtgtcaactgtctcacatgccgatgcagattgcttcgtgtgcgtctttttgtctcacggagaaggtaaccacatttacgcctacgacgctaaaatcgagattcaaactctcacaggtctctttaagggtgataagtgccattcactcgtgggaaagcctaagatcttcattatccaggcttgccgtggcaaccaacacgacgtccccgtgatccctcttgatgtcgtcgac

SEQ ID NO: 32438 - DNA, 900 bp, Artificial Sequence
  Description of Artificial Sequence: Synthetic coding sequence
atggtggagatagacgccgcttccgtgtatactctccccgcaggagccgattttttgatgtgctatagtgtggctgaggggtattactctcaccgcgaaacggtgaatggatcctggtacattcaagatctctgtgagatgctgggaaagtatggctccagtcttgaattcacggaactcttgactttggtgaaccgcaaggtgagccagagaagggtagacttttgcaaggatccttccgcgatcggcaagaagcaggtaccttgcttcgctagcatgctaacaaagaagctgcacttctttcccaaatccaacctggaacatcaccaccatcaccatgtggagatcgacggcggcagccctatgtcgagcgcttccggcctaaggcgtggacatcccgcaggaggtgaggaaaatatgacggagaccgatgcattctataagcgagagatgtttgatccagcagaaaaatacaaaatggaccatagaaggagaggaattgccctcatcttcaatcatgaacgctttttttggcacctgaccctgcctgaacgaagagggacctgtgccgatcgggacaaccttactaggcgattttctgacctgggatttgaggttaaatgctttaacgacctaaaagcagaagaactcttgttaaaaatccatgaagtatctaccgtaagccatgctgacgcagactgttttgtgtgtgtcttcctctctcacggtgagggaaatcatatttacgcctatgatgccaagatagagatccaaacactgactggactatttaagggcgataaatgtcatagtctggtgggtaagcctaagatctttattatccaggcctgccgggggaatcaacatgacgtccctgtcattccgttggatgtcgttgat

SEQ ID NO: 32439 - DNA, 900 bp, Artificial Sequence
  Description of Artificial Sequence: Synthetic coding sequence
atggttgagatagacgccgccagcgtatatactctgcccgctggcgccgatttcttgatgtgctactctgtggccgaaggatactatagccatcgagagactgtcaacggctcatggtacattcaggatttatgtgagatgctggggaaatacgggagcagcctggaatttaccgaactgctgactctggtgaaccgtaaggtgtcccagcgacgggtagatttctgcaaagatccctccgcgattggcaagaaacaagtgccatgctttgcatcgatgctcaccaagaagttgcatttctttcccaaatccaacttggaacatcaccaccaccatcatgtggaaattgatgggggttccccgatgtccagcgcttctggtctgcgacgaggccatcccgcagggggcgaagaaaatatgaccgagacagacgccttctacaaaagggaaatgtttgatcctgctgaaaagtataaaatggaccatcggcggcgaggaattgcgctaatttttaatcacgaacggtttttttggcacctgaccctccctgagagaagaggtacatgcgcagatcgcgataaccttacccgtcgctttagtgatttgggatttgaggtcaaatgctttaatgatttgaaagctgaggagctgcttctcaaaatccacgaggtgtccactgtgtcacacgctgatgcagattgttttgtctgcgtattcctcagtcacggcgaaggaaaccacatatatgcctatgacgcaaagatagaaattcagaccctgacgggtctgttcaaaggcgataagtgccactccctcgtaggcaagccaaagatatttattatccaggcatgcagaggcaaccagcacgacgtaccagtgatccctttagacgtggtggat

SEQ ID NO: 32440 - DNA, 900 bp, Artificial Sequence
  Description of Artificial Sequence: Synthetic coding sequence
atggtggagatagacgccgcctccgtgtatactttacccgccggcgctgattttcttatgtgctattcggtcgccgaaggctattattctcaccgggaaacagtgaacggctcatggtacatccaggacctttgcgaaatgctcggcaagtacggcagctctttagagttcactgagctgctgacccttgtgaatcggaaggtttcacagcgtagagtagacttctgcaaagatccttctgctatagggaagaaacaggtaccatgcttcgcgtctatgttgaccaagaagctgcactttttccctaagtctaatctcgagcaccaccaccatcatcatgtagaaattgatggcggttctcccatgtcttcagcctcaggccttcgccgagggcacccagctggtggagaggaaaatatgacagaaactgatgccttctacaagcgtgagatgttcgacccagcagaaaagtataaaatggaccaccgacggcgaggtatcgcgttaatttttaatcacgagaggttcttttggcacctcacactccctgagaggcgcgggacctgcgcggaccgcgacaatctaactcggcgattctccgaccttggatttgaggttaaatgcttcaacgatttaaaagccgaggagcttctactcaaaatccacgaggtttctactgtttctcacgccgatgctgactgttttgtgtgtgtcttcctgagtcatggcgagggaaatcatatctacgcctacgatgccaagatcgagatccagactctaacgggcttgttcaagggggacaaatgccatagtcttgtgggcaagccgaagatcttcattatccaggcttgcagggggaaccagcacgacgtgccagtgattccgctggatgtggtcgac

SEQ ID NO: 32441 - DNA, 4098 bp, Artificial Sequence
  Description of Artificial Sequence: Synthetic coding sequence
atgttgtcctttgtcgacactagaacgctgctcctgcttgctgtgaccctgtgcctggcaacttgccagagcctgcaagaagaaaccgtccggaagggaccggcaggggaccggggacctcgcggtgaacgagggcccccaggccctcccggcagagatggagaagatgggccaactggtccaccgggacctcctggaccgccaggaccgcctggcttgggaggaaacttcgccgcgcaatacgacggaaagggagtggggctcggccctggaccgatgggactgatgggaccgagaggcccccctggggctgcaggtgcgccgggtccccagggttttcagggacctgcgggagagcctggtgagccgggacagaccggacctgccggggctcgggggcctgccggaccgccagggaaggcgggtgaagatggacacccgggcaagccaggcaggcctggcgagcgcggagtggtgggaccgcaaggagctcgcggcttccccggaacgccaggactcccaggcttcaaaggtatccgggggcacaacggactggacggacttaagggtcaaccaggagcaccgggtgtgaaaggagagcctggcgcaccaggagagaacggcaccccaggacaaaccggcgcgagaggactgccaggcgaacgcggccgagtcggagcgcctggtcccgcgggagcaagagggtcggacggctcagtgggcccggtcgggccagcagggccgatcgggtcggccggaccacctggttttcccggggccccagggccgaagggagaaattggagcggttggcaacgcggggcccgctggacctgctggacctcggggagaggtgggtctgccgggcctcagcggcccagtgggaccccccggaaatccaggcgccaacggcctcaccggcgcaaagggcgctgccgggctgcctggagtggcgggggctccaggtctgccgggaccaaggggaatccccggaccggtcggcgccgcaggagctaccggagcccgcggactcgtgggcgaaccgggacctgctggttctaagggagaatcaggaaacaaaggagaaccaggatccgcaggtccgcaagggccgcctggtccctccggcgaagaaggaaaacgcggacctaatggagaagccgggtccgctggaccacccggtcctccgggactgaggggatcacctggatcgcgcggtctgccgggggccgacggacgcgcaggcgtgatgggcccgcctggttccagaggggcttccgggcctgcgggtgtgagaggaccgaatggagacgccggccggcctggggagccagggctgatgggacctaggggtttgcctggatcgccgggtaatatcggccccgccggtaaggagggcccggtgggattgcccggaatcgacggcaggccaggaccaatcggccctgccggagctcggggggagccaggaaatatcggattcccgggtccaaagggtcctacgggtgacccaggaaagaacggcgacaaggggcacgccggactggccggtgcgcgcggagcgcccggacctgacgggaataacggcgcacagggaccccctggtccacagggagtgcagggcggaaagggcgagcagggaccgccaggtcccccgggatttcagggactcccaggacccagcgggccggcaggggaggtcggcaagccgggggaacggggacttcatggagagttcggactgccaggtccagccggtccccggggtgagaggggaccaccgggcgagagcggcgcagccggacctaccgggccgattgggtcgcgcgggccgtccggccctccagggcccgacggaaacaaaggggagccgggggtggtcggtgcggtgggcactgccggtccgtcggggcccagtggtctgccaggagaacggggggctgcaggaatcccaggcggcaagggagaaaagggcgagccaggcttgcgaggcgagatcggaaacccgggtcgggacggcgccaggggtgcgcccggtgcagtgggagcacctgggccggcgggcgcgactggcgataggggggaggcaggcgcagccggccctgcgggcccagcggggccccgtggaagcccgggtgagagaggggaagttggaccggcaggccctaacggtttcgcgggtccggctggcgcagctggacaaccaggtgccaagggtgaacgcggagccaaagggccgaaaggcgaaaacggcgtggtagggccgaccggaccagtcggagcagctggaccagctgggccgaatggtccacctgggcccgccggaagccgtggagacgggggcccgccaggaatgaccggattccctggggcagccggacggactggtcctcccggcccttctggaatctcagggcccccggggccgccaggacccgcaggaaaggaaggcctccggggcccacggggggaccagggtccggtgggacgcaccggggaggtgggagcagtggggcctccggggttcgccggagaaaagggacccagcggcgaggcaggaactgccggacccccgggaacccctggaccgcagggactcttgggagcgccgggtatcctcggccttccggggagcaggggcgaacggggactcccgggtgtcgccggggcggtcggagaaccaggcccgctcgggatcgccggaccgcccggggcgaggggccctccgggcgccgtgggctcgcctggggtgaatggagcccctggagaggctggaagagacggaaacccaggcaacgatggcccgcccggtcgcgacggacaaccagggcataagggcgagcgcggttacccgggcaacatagggccggtcggagcggccggtgcccccggcccgcacggacccgttggtcctgccggaaaacatggaaatcgcggtgaaaccggaccgagcggacctgtggggccggcgggagccgtggggccacggggtccttcgggtcctcaggggatcagaggagacaaaggcgagcctggcgaaaaaggaccgcgggggctgccgggcttgaaaggacataacggactccagggactgccaggaatcgctggacatcacggcgaccaaggagccccaggaagcgtaggacctgcaggcccacgcgggcctgcagggccttcgggcccggctggcaaggatggacgcaccggtcatcccggcactgtcggcccggccggtattcggggaccccagggtcaccaagggccggcgggtccgcccggcccaccagggcctcctggcccacctggggtgtccggaggcggatacgatttcggatatgatggcgatttctacagagcagatcagcccagatccgctccctcacttaggccgaaggactacgaagtcgatgcgactctgaaatcgctcaacaatcaaatcgaaacgcttctcactcctgaaggatccagaaagaacccagcaagaacttgccgggacctgcgcctgtcgcacccggaatggtcctccggatactactggatcgatcctaatcaaggctgcactatggatgcgatcaaggtttactgtgatttctcgactggagaaacctgtatcagagcccagcccgagaacatcccggctaagaattggtacagatcatccaaagacaaaaagcacgtctggctcggagaaacgattaatgctggatcacagtttgagtataacgtggagggtgtcacctccaaggaaatggccactcagctcgcattcatgaggctgctcgccaactacgccagccagaatatcacctaccactgcaaaaactcgatcgcgtacatggatgaagaaactggaaatctgaagaaggccgtcattcttcagggcagcaacgacgtggagctggtggccgagggcaactcgaggtttacctacactgtgctggtcgatggatgttcaaaaaagactaacgaatggggaaagacgattatcgagtacaagaccaacaagccgtcgcggctgccgttcttggacatcgcaccgctggatattggaggggccgatcaggaattcttcgtggacatcgggccagtgtgcttcaag

SEQ ID NO: 32442 - DNA, 4098 bp, Artificial Sequence
  Description of Artificial Sequence: Synthetic coding sequence
atgctgtccttcgtggacacgcgcaccctgctgctcctggctgtcaccctgtgcctggcaacttgccaatcgcttcaggaggaaactgtgcggaaaggaccggcgggggataggggtccacgcggagagcgcggaccgcctgggccgccgggacgcgatggagaggacggaccaaccggtccaccggggccaccaggacccccggggccgcctgggttgggaggcaacttcgctgcccaatacgacggaaagggcgtgggccttggccccggacccatgggccttatgggaccaaggggacctccaggagcggcaggggccccgggccctcaaggttttcaaggaccggcaggcgaacctggcgagccaggacagactggtcctgccggagcccgcggaccagccggaccgccgggtaaggcaggagaagatggacaccctggcaaaccaggacgcccgggcgagagaggagtggtgggaccacagggcgcccgcggtttccccggtaccccaggattgccggggttcaaaggaatccggggacataacggactggacggattgaaaggccaaccgggagcgcccggagtgaagggagagccaggcgcgccgggcgaaaatggtaccccgggtcagaccggcgcccgtggactgccgggggaacggggacgggtgggtgcacctggccctgccggggcgcggggctccgacggatccgtgggcccggtcggccccgcaggaccgatcggatcggctggaccgccaggatttcccggagcgccgggaccgaagggggaaattggagccgtcggtaatgccggcccagctggtccagctggtcctcgcggtgaggtgggcttgccaggcctgagcgggccagttggtccgccaggaaacccgggcgcaaatggactcactggcgctaagggagctgcggggcttccgggtgtggctggagcgccgggtctgcccggaccacgaggtatcccaggtccagttggagcggcgggagccaccggagcgagaggactcgtcggagaaccgggacctgccgggtcgaagggcgaatcggggaataaaggggagcccggctcggcgggtcctcaaggcccgccagggccatccggggaggaaggaaagcggggcccaaacggggaggccggcagcgcgggtccaccgggtccgcccggactcagaggatctcctggcagccggggcctgccgggagcagatggacgcgcaggagtgatgggtcccccggggagcaggggagcatcggggccagctggagtgcgcggaccgaatggagacgcgggacgcccaggggaacctggtttgatgggaccacgcggcctccccggctcgcccggtaatatcggcccagccggaaaggaaggacctgtgggtctgcctggaatcgacggccgaccggggcccatcggaccggccggagcgcgtggggaaccaggtaacattggtttccccggaccgaaaggacctactggcgatccgggaaagaatggcgacaagggacatgcggggctcgctggggcgcgcggggcccctggacctgacgggaataacggggcgcagggtccacctgggccacagggcgtccagggaggaaaaggcgaacagggcccgccgggacctccgggattccaggggctgccaggtccatccggaccggcgggtgaggtggggaagcctggcgagcgcggtttgcacggggaatttggtttgccgggccctgcaggcccgcgcggagaaaggggcccgccaggcgagagcggcgccgccgggccgactggcccaatcggatcgcgcggaccgagtggtccgcccggcccagatggaaataagggtgaacctggagtggtcggagccgtgggaaccgcgggaccgagcggaccgtcaggtctgcccggggagcggggagcagccggaatcccgggaggcaagggagagaaaggggagccgggcctgagaggggagatcggaaaccctggacgcgatggcgcccggggggctccgggagcagtgggggcccccggtccggcaggtgcgaccggagatcgtggagaggccggggccgcagggccggccggtcctgccggcccgaggggatcaccgggcgaaaggggtgaagtgggacctgcgggccctaacgggtttgccggtccagcgggcgcagccggccagccaggggccaagggagagcgcggtgcgaagggccctaaaggggaaaatggtgtcgttggcccgaccggccctgtcggagccgctggtccagcagggcctaacggtccccctggccccgccggaagccgcggtgatggagggccgcccggcatgaccggtttccctggcgctgccggacgtacgggcccgcccggtccatccggcatttccgggccccctgggccacccggtccggcgggcaaggagggcctgaggggccctagaggcgatcagggcccggttgggagaactggggaagttggcgcggtgggtccgccgggattcgccggagagaaggggccatcgggggaagcaggaaccgccggacccccgggtactccgggacctcaagggctgctcggcgccccgggcatcctgggactcccaggaagccgcggcgaacgaggcctgcctggtgttgcgggcgccgtcggagagcctgggccactgggaatcgctggaccgcccggggcacggggccctcctggagcagttggtagcccgggggtgaacggagccccaggagaagctggccgggacggaaaccccggaaacgacggacctcccggacgggatggccagcccggacacaagggcgagagggggtatcccggaaacatcggacctgtcggagcggctggagcacccggaccgcacggaccggtggggcccgcagggaaacacggcaatcgaggagaaaccggcccgtccggtccggtcggacccgccggcgcagtgggtccgagaggcccatccgggccgcagggtatccggggggacaaaggagaaccaggggaaaaggggccgagggggcttccagggctcaagggccacaatggcctgcaaggtctgccggggatcgccggccaccatggagatcaaggggctccgggttcagttggcccagcggggccacggggacccgcaggcccttccggcccggctggaaaagatggaagaactggccatccgggcacggtagggccggcgggcatccggggaccgcaggggcaccagggaccagcaggaccaccggggccccctggaccacctggacctcctggagtgtccggaggaggctacgactttggctacgacggagacttctatagagctgaccaacctagaagcgcgccgtccctgcgcccgaaagactacgaagtcgatgccaccctgaagtctctcaacaaccaaatcgagactctcctgaccccagagggctcacggaagaacccggcccggacctgccgcgacctccgcctgtcgcatccagagtggtcgtcgggatactactggatcgaccctaatcaagggtgtactatggacgcgataaaggtttactgtgatttcagcactggagaaacgtgtatcagggctcagccggaaaacatcccagccaaaaactggtacagatcctcgaaggataagaaacacgtgtggcttggagaaaccatcaacgctggctcgcagttcgaatacaatgtcgaaggggtgacttcaaaggagatggcaacccagctggcgttcatgagactgctcgccaactacgccagccagaacatcacctaccattgcaagaactcgatcgcatatatggacgaagagactggaaacctcaagaaggcagtcatcctccagggaagcaacgatgtcgaactcgtcgctgagggaaattcccgcttcacttacactgtcctcgtcgacgggtgctcaaagaaaacgaatgaatggggtaagaccataatcgagtacaagaccaacaagccgagccgactgcctttcctggacattgcccctctcgacatcggtggagcagaccaggaattctttgtggacattggacctgtgtgcttcaag

SEQ ID NO: 32443 - DNA, 4098 bp, Artificial Sequence
  Description of Artificial Sequence: Synthetic coding sequence
atgttatcattcgtggatacccgtacccttctgctcctggccgtcactttgtgtctggctacgtgccagagtctgcaggaggagacagtcaggaaaggtccagccggggatagagggccccgaggcgaaagagggccccccggccccccagggagggacggggaggacggaccgactggcccccctggccccccaggccccccgggaccacctgggctgggaggaaattttgccgcacagtatgatggtaagggcgtgggactcggacccggacccatgggccttatgggccctagaggtccacctggagccgccggcgcgcctgggcctcagggattccagggcccagcgggtgagccaggtgagccagggcaaacaggacccgctggagctaggggccctgccggtcctcctgggaaggcaggcgaggacggccaccctggtaaacccgggagaccgggagagcgcggcgtggtgggaccccagggggccaggggctttcccggaaccccaggtttgcccggtttcaagggcattagggggcacaatggtttggatggtttaaaaggacagcccggagcacctggagtaaagggagagccaggtgcgcctggagaaaacgggactcctggacagactggcgcgaggggtctgcccggggagcgaggccgagtcggtgcccctggccctgccggggcccggggttctgatggtagcgtcggccctgttggacccgcgggcccaatcggatctgccggcccccctggtttccccggagcacctgggcctaagggcgaaataggagcagtggggaatgctggccctgcaggcccagccgggccacggggcgaggtgggtctgccggggttgtctggcccagttggcccgcccgggaatcccggcgctaatgggctaacaggggccaagggggctgctggactccctggcgtggcaggggcaccgggcctccccggtccccgggggatccccggccctgtcggagccgccggggctaccggagctagaggtctggtgggtgaacctggaccagccgggtctaagggcgagtccggaaataaaggagagcccggcagcgctggaccccaaggcccacccggaccgagcggggaggaggggaaacggggtccaaacggggaggcaggaagtgccggaccacccggaccccccggactccgagggagtcccgggagcaggggactgccaggcgctgacggacgcgccggggtgatgggtccccccgggtcccgcggcgcaagcggccccgccggtgtgcgggggcctaacggggacgctggtagacccggtgaacctgggttgatgggacctcgggggctcccaggatcccccggcaacataggccccgctgggaaagaggggcccgttggactcccaggaattgatggacgccctggacctatcgggccggccggggctagaggcgaacccgggaacattggctttccgggccccaagggcccaacaggggaccccggcaaaaatggggacaaaggccacgccggtcttgccggagcccgcggggccccagggccggatggcaacaacggggcgcaggggcccccaggacctcagggcgtgcaagggggaaagggtgaacagggcccccctggaccgccaggctttcaagggttgcccggcccctccggcccggcaggggaagtggggaaacctggagagaggggactccacggcgaattcggccttccagggccagcgggtccacggggcgagcggggtccacccggcgaatctggggccgccggtcccactggcccgatcggcagcaggggacctagtggccctcctggcccggacggcaacaagggcgaacctggggtagtaggggccgtggggactgccggcccctcggggcctagcggactccctggagaaagaggagctgctgggatcccaggcggcaaaggcgagaagggtgagccgggcctgcggggtgaaattggaaatcccggcagggacggagctcggggcgcccccggtgcagtaggtgctcccggaccagcaggggctacgggcgatagaggcgaggcaggggctgcaggccccgccggccctgccgggcctcggggaagtcctggagaacgcggcgaggtgggccccgccggccccaatggattcgcaggaccggccggtgccgccggtcagcccggcgccaagggcgaacggggagctaagggccccaagggcgaaaacggggtcgttggcccaacaggcccggtgggagccgctggccccgctggcccaaacgggcctcctggacccgcgggcagtagaggagacgggggaccaccaggaatgacggggtttcctggggcggcaggaaggaccgggccccccggaccatcaggcatttcggggccgcccgggcctccaggcccggccggtaaagaggggctgcggggaccgagaggggaccaggggcctgtggggcggactggagaagttggtgcggtcggaccccccggattcgcgggggagaagggccccagtggcgaggccgggaccgccggtccccctggaacacctggacctcagggactcttgggagcaccaggaatacttggactgcctgggagcaggggggagcgcggtttgccaggcgtcgcaggcgcagtgggtgagccaggtccccttggaattgccggaccccctggagctagaggccctcccggggccgtgggctctccgggagtgaatggggcccccggcgaggccgggcgcgatggaaaccctggcaatgatggccccccaggccgagacgggcagcccggtcataaaggagaaaggggctatcccgggaacataggccctgtgggggcagccggggcaccagggcctcacggccccgtggggcctgccggcaaacacggcaaccgcggcgaaacaggcccctccggcccagtgggccccgccggagctgttggtcctcgtggcccatccggcccccagggaataagaggggacaaaggtgagcccggcgaaaaaggcccaagaggccttccaggcctgaaaggtcataatggattgcagggactacctggtattgccggtcatcatggcgaccagggggcccccgggagtgtggggcccgctggcccgagaggccccgccggcccctctggccccgcaggcaaggatggaaggactgggcatcccggtacagtgggacccgcgggaatccgggggcctcagggccatcaaggaccagccggaccaccaggcccgcctggaccacctggaccacctggcgtttcagggggcggctatgacttcggttacgatggtgacttttatagggccgatcaaccccgctccgctccatcccttcggccgaaggattacgaggtcgatgccacgctgaagtctcttaataaccagattgagaccttgctgacaccagagggctctagaaaaaaccctgccagaacatgccgagaccttcgtctgagccaccccgagtggtcaagcggctattactggattgaccctaaccaaggctgtactatggacgccattaaagtatactgtgacttttctactggtgagacttgcattagggctcagcctgagaatatacctgcgaagaactggtaccggtccagtaaagacaagaaacacgtttggctcggtgagacgatcaacgcaggaagccaattcgaatacaatgtcgagggggtcacaagtaaagaaatggctactcagctcgcctttatgcggttactggctaattatgcttcacagaatattacatatcattgcaagaacagtatcgcctacatggatgaggagaccggcaaccttaaaaaagccgttatcctccaaggcagtaacgatgttgagcttgtagctgagggcaattcaagattcacctatacagtattggtggacgggtgcagcaagaagaccaatgagtgggggaagacaatcattgagtataagactaacaagccatctcgcttaccatttctggacatcgccccgctcgatattgggggggcggatcaggaattctttgtggatattggaccagtctgcttcaaa

SEQ ID NO: 32444 - DNA, 4098 bp, Artificial Sequence
  Description of Artificial Sequence: Synthetic coding sequence
atgctgtcgtttgtggacacacgcacgttattgttactggcagtgacgctctgcctggccacctgccaaagtttgcaggaagagacggtgagaaaggggcccgccggagatcgcggcccccgaggcgagagaggaccgccaggccctccaggcagggacggggaggacggcccgacagggccacccggacctcctgggcctcccgggccaccagggctcggaggcaacttcgctgcccagtacgatggcaaaggcgtggggctgggtccaggccccatgggactgatggggccccggggcccgcctggcgcagccggcgctccaggtcctcagggatttcaaggcccagctggtgagcccggcgaaccaggacagactggacccgccggggcccgcggccccgctgggcccccaggcaaggctggtgaagatggtcatcccggcaaaccaggcaggccgggggagagaggggttgtggggcctcagggcgcccgcggttttcctggaacgcccgggttgcccgggttcaagggaatcagagggcacaatgggctcgatggtcttaagggccaacctggcgcgcctggagtaaaaggtgagcctggggccccaggcgagaatgggacaccaggtcaaacaggggccagagggcttcctggggaacggggaagagtcggtgctcccggtcctgccggagccagagggtctgatgggtccgtgggtccggtcggcccagcaggaccaataggcagcgctggccccccgggattccccggagcccctggccccaagggcgagatcggtgccgtgggcaacgccggtcctgccgggcccgctggtcccagaggtgaagtcggcttgccaggcctctccggtcctgtcggccctcctggcaacccgggcgccaacgggcttactggagctaagggcgcggccggattgcccggcgtggcaggggcgcctggccttcctgggcccagaggaatccctggtcctgtgggggccgcaggcgcaactggcgcaaggggattggtgggagagcccggacctgccggaagtaaaggggagagtggcaacaagggagagcctggatccgctgggccccagggaccgcccggcccgtccggcgaggaaggaaaacggggtcctaatggcgaagcaggttctgcaggccctccgggaccccctggcctgagaggttcacccggatctcgaggattacccggcgctgacggcagagctggggtgatgggccccccaggctctcgaggcgcatccggccccgctggggtcaggggcccaaatggagacgcgggcaggcctggggaaccggggctgatggggccccgcggcctgcccgggtctcctggcaacattggcccggctggtaaggagggcccagtaggattgcctgggatagacgggagacctggacccatcggccccgctggggctcgaggtgagcctggcaacatcgggttcccaggacctaagggccccactggggacccaggcaagaacggcgataagggccatgcgggattggccggagcgcgcggggcgccaggacccgacggtaacaacggcgctcaaggaccgccagggcctcaaggggtgcagggcgggaagggtgaacagggaccacctggtcccccaggtttccagggattaccaggaccatctggccccgcgggtgaagtggggaaaccgggggagcggggtttacatggcgaatttggccttcctggccccgccggacccagaggtgaaaggggcccgccaggagaaagcggggctgccggacccactggccccatcggttcccggggcccctccgggccccccggaccagacggtaacaaaggagagcctggtgtagtcggagcagttggcaccgccgggccgtccggccccagcgggctgcccggagagagaggagcagccggaattcctggaggtaagggagaaaagggggagccaggactgagaggcgaaatcggaaaccctggacgcgacggtgcccgaggtgcccccggggccgtgggagcacccggacctgcgggcgctactggcgatagaggagaggccggcgcagccgggccggccggtcctgccggtccaagaggctctccgggcgagaggggcgaagtgggacctgcgggtccaaacggctttgcagggccagcaggagctgctgggcagcctggagcaaaaggggagcgaggtgccaaagggcccaaaggcgagaacggtgtcgtcggcccaaccggtcccgtcggcgcggcggggccggcggggcctaatgggccacctggccccgccggttcaagaggagacggcggaccacctggcatgactggattccctggcgcagccggacgcaccggaccacccggaccatctggtattagtgggccccctggcccccctggccccgcgggcaaggagggtctccgtggaccacgaggtgaccagggccctgtgggcaggaccggggaggtaggcgccgtcgggccccctggatttgccggagaaaaaggcccttctggagaagctggaactgctggccctcctgggaccccaggtcctcaggggctgctgggggcccccgggatcctggggctccccggatcacgcggtgaaagggggttaccgggggtcgcaggagctgtgggggagccggggccgctgggcatcgccggaccaccgggcgcccgggggcctccgggcgcagtgggaagcccaggtgtgaatggggcaccaggagaagccggccgggacggcaaccccggaaatgatgggccccccggccgggacggccaacctggtcacaagggcgagaggggatatccaggaaatatcgggcccgtgggggctgccggagcacccggcccccacggccccgtgggccccgcggggaaacacggtaaccgaggcgagacggggccatcaggacccgtggggcctgcgggagctgttggtccccggggccccagtgggcctcaaggcatacgcggggacaagggcgaaccgggcgagaagggaccccgggggttacccggccttaagggacacaatggactccaaggcctacctgggattgcagggcatcacggagaccaaggtgctcccggcagcgttgggccagctggcccccggggtcctgctggacccagcggcccagccgggaaagatggacgaacaggtcaccccgggaccgtgggccccgcgggcatcagaggaccacagggacatcaagggccagccggaccgcctggccccccaggaccacccgggccacctggtgtgtcaggaggtggctatgactttggctacgatggggacttttatagagccgaccagcctagaagtgccccctcacttaggccaaaggactacgaggttgacgccactctaaagagtttgaacaatcagatcgaaaccctgctgacccctgaagggtcccgcaagaatcctgccagaacctgccgagacctaaggctaagtcacccggagtggtccagcggctattactggatcgacccaaaccagggctgcactatggacgccattaaagtgtactgtgacttcagtacaggcgaaacttgtattcgggcccagccagagaatatacctgcgaaaaattggtataggtcctccaaagataagaagcacgtctggctgggtgagacgattaacgccggatcgcaattcgagtataacgtcgagggcgtcacaagcaaagaaatggctacccagctggccttcatgcgccttcttgccaactacgcttctcagaacattacttaccattgtaaaaattcaattgcgtacatggatgaggagaccggaaaccttaagaaagccgtaatcctccagggttcgaatgacgtggagctggtggccgaggggaacagtcgtttcacgtacaccgtgctggtggatggctgttctaaaaaaaccaatgagtgggggaaaacgattattgaatacaagacgaataaaccgtccaggctccctttcctcgacatcgcgccactagacatagggggcgctgatcaggagttcttcgtggacataggtcccgtatgctttaaa

SEQ ID NO: 32445 - DNA, 4098 bp, Artificial Sequence
  Description of Artificial Sequence: Synthetic coding sequence
atgctgtctttcgtcgacacacgcaccttgcttctcctggccgtaactctgtgtctggctacctgtcagtccctgcaggaggagaccgtgaggaagggccccgcaggtgataggggcccacgcggcgagaggggcccccccggtccacccggcagagacggtgaagatggtcccaccggccccccaggccctccaggccctcccggtccacctggactgggcggtaatttcgctgctcagtatgacggaaagggcgtaggtctcggtcctggccccatgggcctgatgggacccaggggccctcccggtgcagcaggtgcacccggacctcagggtttccagggtcccgctggtgagcccggtgagcccggccagacaggcccagcaggtgcacgcggtcccgctggccctccaggtaaggccggcgaggacggccatccaggtaaaccaggtcgtccaggcgagaggggtgtagtaggcccacagggtgctcgtggtttcccaggtacccccggactgcccggtttcaaaggcatcaggggccataatggcctcgacggcctcaaaggccaacctggagctcctggcgtgaagggtgaacctggcgcccccggtgagaacggcaccccaggccagaccggcgcccgcggattgcctggagaacgtggacgcgtcggtgcacccggacctgcaggagccaggggatccgacggctcagtgggcccagttggaccagccggccctatcggttccgctggaccccctggcttccccggtgctccaggccccaaaggagagataggcgccgtcggaaacgctggacctgctggacctgccggacctaggggtgaggttggcctgcccggcctttccggacctgtgggccctcctggcaaccctggcgccaacggtctgactggcgctaaaggcgctgccggtcttccaggtgtggcaggagctcctggactgcccggcccaaggggtatccccggtcctgttggtgctgcaggcgctaccggagcaagaggtctggtgggcgagcctggtcccgctggctctaaaggagagagcggcaacaaaggagaacccggctccgccggtccccagggacctccaggtccttcaggtgaagagggcaaacgtggacctaatggcgaggccggatccgccggccctcctggtccacctggattgaggggctcccccggcagcaggggactgccaggagctgatggacgtgctggcgtgatgggcccccctggcagtaggggcgcttccggtcccgctggcgtgcgcggaccaaacggcgatgctggtcgtccaggagagcctggtttgatgggccctcgcggcctgccaggtagccctggtaacatcggtccagccggaaaggaaggacctgtcggtttgccaggtattgacggccgtccaggtcctataggtcctgcaggtgcaagaggtgaacctggaaatatcggatttcctggcccaaagggtccaaccggcgatcctggaaagaatggcgataagggtcacgctggactggccggagcccgtggagcccccggacctgacggaaacaacggagcacagggaccacccggtccccaaggtgtacagggcggaaaaggtgaacaaggccctcctggacctcccggcttccagggcctgccaggtccatctggacctgccggcgaagtcggcaagcccggagaacgcggcttgcacggtgagtttggtctccccggccccgcaggacctaggggcgaacgtggaccccctggtgaaagcggcgctgctggccccaccggccccatcggatcccgtggaccatctggacctcccggaccagatggaaataagggcgaacccggagtcgtgggagcagtgggcaccgccggcccttccggacccagtggtttgcctggtgagaggggcgctgcaggtattcccggaggcaaaggcgagaagggtgagcctggcctgcgtggtgaaatcggtaatccaggcagagatggtgctcgcggcgctcctggagcagttggagcaccaggaccagctggagccacaggcgaccgcggtgaggccggtgctgccggccctgccggacctgccggtcctaggggttcccctggcgagagaggagaggtgggacctgctggacctaacggctttgccggcccagccggagcagccggacaacccggtgcaaagggcgaaaggggcgctaaaggacccaagggtgagaacggtgtggtcggccccactggcccagtcggagccgctggaccagctggtcctaatggtcctcctggacccgctggcagtcgcggcgacggcggtcctcctggcatgaccggtttccctggagcagccggtcgcacaggtccacctggaccctctggaataagcggccccccaggtcctcccggtcctgctggcaaagagggattgaggggccccagaggcgatcaaggtccagtcggtcgcacaggagaagtcggtgctgtaggacccccaggcttcgctggcgagaagggaccctcaggagaggcaggtactgctggaccacccggtacccccggcccccagggtctcttgggtgcccccggcattctgggtttgcccggttccaggggtgagcgtggtcttcccggagtggccggcgcagtaggtgagcctggcccccttggtatcgccggtcctcctggcgctcgcggtccaccaggagctgtgggctcacctggcgtcaacggtgccccaggcgaagccggcagagatggtaatcccggaaatgatggccctccaggtagagatggtcagcctggccataaaggagaacgtggttacccaggcaacatcggccctgtcggtgccgctggtgcccctggcccccacggtcccgtcggccctgccggcaaacacggaaaccgcggtgaaaccggtccatctggtccagtgggtccagctggtgcagttggtcctcgtggcccatccggccctcagggaatcaggggtgataaaggcgagcccggagaaaagggccccagaggtctccccggactcaagggtcataacggactgcaaggcctgcccggtatcgctggacaccacggtgatcaaggagctcccggctctgtaggccctgcaggaccaagaggtcctgctggccccagcggtcctgctggtaaggacggcagaaccggccaccctggaactgttggccccgccggaattagaggaccacagggccatcaaggaccagcaggcccccccggaccacccggcccacccggacctcccggcgtatctggcggtggctacgacttcggctacgatggcgacttctacagagcagatcagcctagatccgccccttcattgcgccctaaggactacgaggtggacgctactttgaaatccttgaacaaccaaatcgagacactgcttacacctgaaggttctcgcaagaacccagctcgtacctgtagggacctgaggctgtctcaccccgagtggagttccggatactattggatcgaccccaatcagggttgtaccatggatgccattaaggtgtactgcgatttttcaactggagaaacctgcataagggcccaacccgaaaatattcctgccaagaattggtaccgctcttcaaaggataaaaagcatgtgtggctcggcgaaactattaacgccggaagccagttcgagtacaatgttgagggcgttactagcaaggagatggctacccagcttgccttcatgaggctgctggccaattatgctagccagaacatcacctaccattgcaaaaacagcattgcttacatggacgaggagacaggcaatctgaagaaagccgttattctgcagggctctaatgacgtcgaattggtcgctgaaggtaacagcaggttcacttacacagttctggtcgacggctgctccaagaaaaccaacgagtggggtaagacaatcattgaatataaaaccaacaagccttccaggttgccttttctggatatcgcccctctggatatcggaggtgccgatcaagaattcttcgtggacattggacctgtctgttttaag

SEQ ID NO: 32446 - DNA, 4098 bp, Artificial Sequence
  Description of Artificial Sequence: Synthetic coding sequence
atgctgtcttttgtcgacacacgtactcttctattactggctgtgacactgtgcctcgccacatgtcagagtctccaggaggaaaccgtgagaaaaggcccagccggggatcgagggccacgcggcgaaagggggccccccggccccccaggccgcgacggcgaggatggacctaccggccctcccggccctcccgggccacctggccctcctgggttgggagggaactttgcagcccaatatgatggaaaaggagttggcctaggcccagggccaatgggactgatggggccacgtgggccccccggggccgccggtgcacctggcccacagggctttcaagggcctgcaggggaacctggggaacctggtcagactggccctgctggggccagaggcccagccggcccaccaggtaaggccggcgaagatgggcacccaggcaagcccggtcgaccaggcgagagaggagtggtggggccccagggtgcacgcggctttcctggaactcctgggctgccaggattcaaaggcataaggggacataacggactggacggcctgaaagggcagccaggcgctcccggtgttaagggagagcctggcgctccaggtgagaatgggacacccggccagaccggagccagagggctacctggggaacgtggccgggtgggggcacctgggcctgctggcgctcgtggctcagacgggagtgtgggacccgtgggccccgcaggccctattggaagcgcagggccaccagggttcccaggcgcccctggcccaaagggcgaaattggggctgttggcaacgccggccctgcaggacctgctggccccaggggggaagttggcctgcccggcctgagcggacccgtggggccaccaggaaatcctggggctaatgggttaaccggcgccaagggtgctgctggcctgccaggcgttgctggagccccaggacttccaggccctcgcggaatacccggacctgttggcgcagcaggcgccactggagcccgcgggcttgttggggagccgggacccgcaggctcaaagggtgagtccggtaataagggcgagcccggctcagccggcccccagggacctccaggccccagtggcgaggagggaaagcgtgggcccaacggggaggccggtagcgccggccccccagggccccccggtctcagaggctccccaggtagccgaggactccccggcgctgacggcagggcaggcgttatgggaccccccggatccaggggggcaagcgggccggccggtgtcagaggtcccaatggcgacgctggtcggccaggcgagcctggattgatgggccctcgaggcctaccagggagtccaggcaatatcggccctgcaggcaaggaggggcctgtgggccttcctggcatagatggtagacccgggcctatcgggcctgcaggagctaggggggaacctggcaacataggatttccagggccaaagggacctaccggcgacccaggaaagaacggtgataagggacatgccggcctggccggggcacgcggagctccaggacctgatggcaacaacggcgcacagggccccccaggaccacaaggagtgcagggtggcaaaggggagcagggtccaccaggaccaccaggcttccaaggactgccaggaccctctggccccgctggcgaagtcggcaaacctggcgagcgggggctgcatggcgagttcggattaccagggcccgctggtccccgcggcgaacgcggacccccaggcgaatccggggcagctgggcccactggacctattggcagccggggtccttccggcccacctgggccagacggcaataagggcgaaccaggcgttgtgggggccgttgggaccgcagggccttccgggcctagtggactgcctggcgagagaggcgcagctggaattcctggtggcaagggagagaaaggtgaaccgggactgcgcggcgagatcggaaaccccggtcgcgacggcgccaggggagcccctggggctgttggcgctcctggccccgcaggcgcaaccggggatagaggagaggctggtgctgcaggccccgccggtccagcagggcctagaggttcacccggcgaaagaggtgaagtgggcccagccggtccaaacggctttgccggtcctgccggcgcagcaggccagccaggcgccaaaggcgagcgcggggccaaagggcctaagggcgaaaatggcgttgttgggccaacaggacctgtcggagccgccggtccagctggaccaaacggccctccaggacctgccggatcacggggcgatggtggtcctccaggtatgaccggctttcctggggctgccggaagaacaggcccacctggccctagtggcatctccgggcctcctgggccaccaggacctgccggcaaagaaggcctgagaggccctagaggagatcagggccccgtgggccggacaggcgaagtcggggccgttggaccccctggctttgcaggggagaagggtccctccggagaagctggaacagcaggcccacctgggactccaggcccccaaggtctgctgggggcccctggcattctcggacttcccggatcccgcggcgagcgggggctccccggggtcgccggggccgtgggcgaacctggccccctgggtattgccggtcctccaggagcccgtggacctcccggtgctgtgggctcacccggagtcaatggcgccccgggcgaagctggacgtgatggcaacccaggcaacgacggcccacccggtcgggacggccaaccaggccacaaaggcgagagaggctaccccgggaatattggaccagtgggggctgcaggcgcccctggaccacacggcccagtaggaccagccggcaaacatggcaataggggcgaaaccgggccctccgggccagtgggtcccgccggagcagtgggacctcgtggcccttccggaccacagggcatacggggcgataagggcgagccaggcgagaagggtcctagaggcctgcctggcctgaagggacacaacggccttcaggggcttccagggattgccgggcaccacggcgatcagggcgccccagggagcgtgggcccagccgggcctagagggcccgccggtcctagcggccctgctgggaaagatggaagaacaggccatccaggaacagtgggcccagcaggcatccgaggaccacagggccatcagggccctgcaggcccaccaggcccacccgggccacctgggccccccggcgtttccggcggtggctatgattttggctacgatggggacttttaccgcgccgatcaacccaggtccgccccctctctgcgtcctaaggactacgaggttgacgccactttaaagtccctcaataaccagattgaaacactgctcactccagagggttccagaaagaaccccgcccgcacatgccgcgatctccgtctgtcccatccagaatggtcctcaggctactactggattgatccaaatcagggctgcaccatggacgcaatcaaggtgtattgcgacttctctaccggcgaaacctgcatccgcgctcagcctgagaacattcctgcaaagaactggtaccgatctagcaaggataagaagcatgtttggctgggcgagacaataaacgccgggagccagtttgaatacaatgttgaaggggttacctcaaaggaaatggcaactcaactagcctttatgcgccttttagcaaattatgcatcacagaacatcacttaccattgcaagaattccatagcctatatggacgaagaaaccggaaatcttaagaaagcagtcatcctgcaaggcagtaacgacgttgagcttgttgctgaggggaactctcgttttacatatactgtactggtggacgggtgtagtaaaaaaaccaacgagtggggcaaaaccattatcgaatataagacaaacaaaccatcacgcctgccctttctggatattgcaccgctagacatcggcggcgcagatcaagagtttttcgtggatattgggccagtctgctttaag

SEQ ID NO: 32447 - DNA, 4098 bp, Artificial Sequence
  Description of Artificial Sequence: Synthetic coding sequence
atgttgtcatttgtcgatacgcgcaccctgctcctgctagccgtgacactgtgtctggccacatgccagagcctgcaggaggaaacagtgaggaagggtccagccggtgacagaggccctcgaggagaacgaggtcctccaggaccgcccgggagagatggcgaggatggacccacaggtccacctggccctcccggtccacctgggccacccgggctgggaggtaacttcgctgcccaatacgacggaaaaggagtgggcttggggccgggtcccatgggactgatgggcccacgtgggccaccaggggctgccggcgcccccggacctcaaggattccagggaccagccggagaacctggagagccaggtcaaactggcccagccggagcgcgcggccccgctgggccgcccgggaaagcgggagaggatggacatccaggaaagccgggccgtccaggcgagcggggtgtggtggggccacagggggcgcgtggctttccggggacacctgggctcccggggttcaagggaatccgcggccacaacggccttgacgggctcaaaggacagcctggtgcacccggggtgaagggagagccaggtgctccaggagaaaacggcactccaggacaaacaggcgctagaggtctgccgggtgaacgagggcgcgttggggctcccggtcctgcaggtgctcgggggtcagacggttcagtcggacctgtgggccccgccgggcctattgggagcgctggcccgccaggattcccaggggctcctggccctaagggtgagattggggcggttggtaacgctggccccgctgggccagcgggccccagaggggaggttgggctgcccggattgagcggccccgttgggcccccagggaacccaggagcaaatgggttaacaggggcaaagggcgccgccgggttgcccggcgtagcgggtgcccctggacttcccggcccccggggaataccgggacccgtgggggctgctggcgcgacaggagcgcgcgggttagtaggtgaacctggtccggccgggtcaaaaggcgagtctggtaacaagggcgaaccaggctccgccggtccacagggaccaccgggacctagtggtgaggaggggaagagggggcccaacggagaggccggcagcgccggaccacccggaccgcctggcttaaggggctccccaggaagtagggggctcccaggcgctgatggtagggccggtgtcatgggcccaccgggtagtaggggcgcctccggccccgccggagtgaggggcccgaatggagatgcagggaggcccggggagcctggtttgatgggaccgcgggggctgccaggaagtccaggtaatatcgggcctgccggtaaagagggccccgtgggccttccaggaatcgacggaaggcccgggccaatcggaccggcgggggcaagaggagaacctggcaatataggtttccccggccccaagggccctacaggtgacccgggcaagaacggggacaaaggacatgctgggctcgccggtgctcgcggtgcccctggtcccgatggaaataatggagcacaggggccacctgggccgcagggcgtgcagggggggaaaggagaacaggggccccctggacctcctggatttcagggcctgccaggacccagcggacctgccggagaagttgggaagcctggagaaaggggactgcatggggaattcggtcttcctggtcctgccggccctcgcggagagaggggccccccaggcgagtccggggccgctgggcccaccggaccaatcggctcgcggggaccttctgggccccccggacctgatggaaacaagggggaacccggtgtggtaggcgcagtcggtaccgcagggccctccgggccaagtggactgccaggtgagcggggggcagctggaataccaggcggaaagggcgaaaagggtgagcctggtttgaggggcgaaattggaaacccaggtagagatggcgctaggggtgcgccaggcgcagtgggcgcacccgggccagccggtgccaccggggatcgcggcgaagccggcgctgcagggcccgctggacccgctggtcccagagggtcgcccggcgagaggggagaggttgggccagcggggcctaatggcttcgctggaccagccggagcagcaggccagccaggcgctaagggcgagcggggcgcaaaaggccccaaaggagagaacggggtagtggggcccacgggccccgtgggggctgcgggaccggctggacccaatggaccccccgggcccgctggatctcgcggagacggaggacctcctggaatgactggcttccctggcgctgccggacgcactgggccccctgggccttcagggatctctggtccgcccgggccgcctggcccagccggaaaggaaggcttgcgcggcccccgtggggaccagggccctgtgggacggaccggggaagttggcgccgttgggcctccaggttttgcgggcgagaagggccctagcggggaggccggtacagccggcccccccggtaccccaggacctcagggtctactgggtgctccaggcatccttggccttcctggaagcagaggcgagagaggcctgccaggagtggcaggtgcagtgggggaacctggccctcttgggattgcaggaccccccggagcccggggccctccaggggcagtcgggtcccctggggttaacggggcccctggggaggctgggagggatggtaacccgggaaacgatgggccacccggccgagatgggcagcctggccacaagggagagcgaggataccccggcaatatcgggccggtgggggccgcgggggcccctggtcctcatggccccgtgggcccagcagggaagcatgggaaccggggggagaccggtccctcaggaccagtgggacctgcgggcgctgtgggaccccgagggccctcaggccctcaggggattcggggcgataaaggtgagcccggagagaagggcccaagaggacttccagggctcaaaggacacaatggactccaggggctacccggaatcgctggtcaccacggagaccaaggcgctcctggatccgtcgggcccgccggcccccgcgggcccgctggcccaagtggacccgcagggaaagacggacgcactggacaccccggtactgttgggccggccggaatacgaggacctcagggccatcaggggcccgccgggccaccaggtccccctgggcctcctgggcccccaggggtgtctggcgggggctacgacttcggttatgacggcgacttttaccgggccgaccaacccaggtctgctccctccctcagacccaaggactatgaggttgacgcgaccctgaagagtctcaataaccaaatcgagaccctgctcacacctgaaggcagtcggaaaaaccctgctcggacttgccgcgatctaaggctctctcaccctgagtggagtagcggctactactggattgatcccaaccagggatgcaccatggatgctataaaggtttattgtgatttctctactggagaaacctgcattcgagcccagcccgagaacatcccagcaaaaaactggtatcggagtagcaaggacaagaagcacgtgtggctgggggagaccattaacgccggctctcagtttgagtataacgtggaaggggtaaccagtaaggaaatggctactcagctggccttcatgcggttgctcgccaattacgcttcccagaatattacgtaccattgcaagaatagtattgcgtacatggatgaggagacggggaatctaaagaaggctgtcatactccaaggttccaacgatgtggagctcgttgccgagggaaatagccgtttcacgtacacggtcctcgtcgatggatgttctaaaaaaacaaatgaatggggcaagacaataattgaatacaagacgaataagccctccaggctgcccttcttggatatcgccccgctcgatatagggggcgctgatcaggaatttttcgtggatatcggccccgtgtgcttcaaa

SEQ ID NO: 32448 - DNA, 4098 bp, Artificial Sequence
  Description of Artificial Sequence: Synthetic coding sequence
atgctctcattcgtggacacgaggactctcctcctccttgccgtcaccctgtgtctggctacctgccagtctctgcaggaagaaaccgtgcgcaagggtccggcgggtgatcgcgggccgagaggcgagcgtgggccgccgggcccgcctgggcgcgatggggaggacggacccaccggcccacctggcccaccaggacccccgggtccacccggacttggcggaaacttcgccgctcaatacgacggcaaaggtgtgggattgggaccgggtccgatggggttgatgggcccacgcgggccacctggcgccgctggtgcaccgggacctcaggggttccagggccccgctggggaaccgggagaaccaggacagaccggacctgcaggcgcgcgcgggccagcggggcctccaggcaaagctggagaggacggtcaccccggtaagccgggcagaccgggtgaaaggggagtggtcggacctcagggtgcgcgaggattccccgggactccaggcctccctgggttcaagggaatcagaggacacaatggactcgacggactgaagggccagccgggagcaccgggagtcaagggagaaccgggggcgcctggggagaatggaaccccaggccaaactggagcgagagggctgccgggggaacgcggacgcgtgggggcccccgggcctgccggcgcccggggaagcgatggtagcgtggggcccgtgggcccagcaggccctatcggctcggcggggccgccggggttccctggcgccccgggtcctaaaggagaaattggggcagtcgggaacgcggggcccgccggtccagcagggccgcggggagaggtggggctccctggtctgtcaggccccgtcggaccccccgggaacccgggcgccaatggcctgactggcgccaaaggagccgccggcctgccaggggtggcgggtgccccgggtctgcctggaccgcggggaattccgggtccagtgggagcagctggagcaaccggagcaagaggcctggttggcgaaccggggccggcaggatctaagggagaatcaggaaataagggtgaaccaggatccgccggtccccaaggaccgcctggtccctccggagaggagggaaagcgcgggccgaacggcgaagcggggtcggctggaccgccaggcccaccggggctgagaggctcgcctggctcgcggggactccctggcgcagatggtcgggctggagtgatggggccgccagggtcgcgcggcgcgtcaggaccagcaggagtgcggggacctaatggagatgcgggtcggccaggagaacctggactgatgggaccgagaggtttgccggggagtcctggaaacatcggacccgctggtaaagaaggtcctgtgggacttccgggaatcgatggccgcccgggaccgataggtcctgcgggagccagaggcgagcccggcaacatcggattcccgggccctaaaggaccaactggcgacccgggaaaaaacggagacaagggacacgcaggactcgctggggcacggggagctccgggacctgacggcaacaacggggcgcaaggtccccccggcccacagggtgtccagggcggaaaaggcgaacaaggcccgccaggtcctccgggcttccaaggactgccagggccgtccggaccagccggggaagtcggtaagcctggagagaggggactccacggggaatttggacttccaggaccggcgggtccgcgaggcgaacgtgggccaccaggtgagagcggagccgccggtccgactggcccgatcggatccaggggaccatccggaccgccggggcctgacggaaacaagggggagccaggcgtggttggcgcggtcgggacggcgggcccgtcgggacctagcgggctgccgggagagcggggggccgcgggaatccctggaggaaaaggagagaagggcgagcctggcttgcggggggaaatcggaaacccgggcagggatggtgcccggggggcccctggtgcggtcggtgcacctggtccagccggagccaccggggatagaggagaggctggggccgctggcccagcgggcccagccggtccaagaggatcacccggggaacgcggtgaagtcggaccagcaggcccgaacggattcgcaggaccggcaggagcagccggacaaccgggggctaagggagagagaggtgccaagggaccgaagggagaaaatggcgtagtgggaccaactggtccagtgggcgccgcgggaccagccggacctaacgggcctcctggtccggccggatcccgcggcgatggaggtccgcccggaatgactggattcccaggagctgcaggcagaactgggccccccggcccgtcgggtatctccgggccgcccggtcctccgggtccagctggtaaggaaggattgaggggaccgcgcggcgatcaaggaccagtgggacgcaccggggaggtgggcgccgttgggccaccgggctttgcaggcgagaaaggcccatctggcgaggccggtactgcaggaccgccgggcactccgggcccacaaggactgttgggggcgccgggaattctgggtctgccaggcagcagaggggaacgcggcctgcccggcgtggccggagcggtgggtgagccaggacctctcggaatagccgggcctccgggggctcgggggccgcccggagccgtcggctccccgggagtgaacggagcacctggagaggcaggacgcgacggcaatccagggaatgatggcccgccagggcgtgacggtcaacctggtcataagggcgaacgggggtaccctgggaacatcggcccggtaggcgccgcaggagccccgggaccgcacgggccggtaggacctgccggcaagcatggtaaccggggggaaaccggcccgtcaggacctgttggaccagccggcgccgtgggccctcgcggtccttcgggaccacaaggtattcgcggcgacaagggggaaccgggcgagaagggtcccagaggactgccgggactcaaggggcacaacggcctgcaggggcttccgggtatcgcaggacaccatggagatcagggtgcccctggctcggtcggtcccgctggaccaagagggcctgccggaccgtctgggcccgccggaaaagacggacggaccgggcatcctggaactgtgggacctgctggcattcgcgggccgcaggggcatcaaggcccggcagggccgccaggtcccccgggaccaccgggaccgcccggtgtctccggcggtggatacgacttcgggtacgacggcgacttttatcgcgccgaccagccgcgcagcgctccttcacttcggccaaaggattacgaggtcgacgctaccctgaagtcgctcaataaccaaatcgaaactttgctgaccccggagggcagcagaaagaatcctgccaggacttgcagggatctccgattgtcgcacccggaatggtccagcggatactactggatcgacccgaatcagggatgcaccatggacgccatcaaggtgtactgcgacttttcgaccggagaaacgtgcatcagagcgcagccggagaacatccccgcgaagaactggtaccggtccagcaaggacaagaagcacgtctggctgggagaaaccatcaatgcggggtcacagtttgaatacaacgtggagggcgtgacttccaaggagatggcgactcagctggcgttcatgcgcctgctcgctaactacgcctcacagaacatcacctaccattgtaagaatagcatcgcgtatatggatgaagaaactggaaatctgaaaaaggccgtgatccttcagggatcgaatgatgtggaactggtggcggagggaaattcccggttcacctacacggtgctggtggacggatgctcaaagaaaaccaacgagtggggaaaaaccatcattgagtacaaaactaacaagccgtcccggctgccgtttctggacatcgcgccactggacattggcggcgccgatcaggaattcttcgttgacatcggccctgtgtgtttcaaa

SEQ ID NO: 32449 - DNA, 4098 bp, Artificial Sequence
  Description of Artificial Sequence: Synthetic coding sequence
atgctatcgtttgttgatacgcgaacgttattactattagcggtaacgctatgtctagcgacgtgtcaatcgttacaagaagaaacggtacgaaaaggtccggcgggtgatcgaggtccgcgtggtgaacgaggtccgccgggtccgccgggtcgtgatggtgaagatggtccgacgggtccgccgggtccgccgggtccgccgggtccgccgggtttaggtggtaattttgcggcgcaatatgatggtaaaggtgttggtctaggtccgggtccgatgggtctaatgggtccgcgtggtccgccgggtgcggcgggtgcgccgggtccgcaaggttttcaaggtccggcgggtgaaccgggtgaaccgggtcaaacgggtccggcgggtgcgcgtggtccggcgggtccgccgggtaaagcgggtgaagatggtcatccgggtaaaccgggtcgtccgggtgaacgaggtgtagtaggtccgcaaggtgcgcgaggttttccgggtacgccgggtctaccgggttttaaaggtatacgtggtcataatggtctagatggtctaaaaggtcaaccgggtgcgccgggtgttaaaggtgaaccgggtgcgccgggtgaaaatggtacgccgggtcaaacgggtgcgcgtggtctaccgggtgaacgtggtcgtgtaggtgcgccgggtccggcgggtgcgcgtggttcggatggttcggtaggtccggtaggtccggcgggtccgataggttcggcgggtccgccgggttttccgggtgcgccgggtccgaaaggtgaaataggtgcggtaggtaatgcgggtccggcgggtccggcgggtccgcgaggtgaagttggtttaccgggtttatcgggtccggttggtccgccgggtaatccgggtgcgaatggtttaacgggtgcgaaaggtgcggcgggtttaccgggtgttgcgggtgcgccgggtctaccgggtccgcgtggtataccgggtccggtaggtgcggcgggtgcgacgggtgcgcgaggtttagtaggtgaaccgggtccggcgggttcgaaaggtgaatcgggtaataaaggtgaaccgggttcggcgggtccgcaaggtccgccgggtccgtcgggtgaagaaggtaaacgaggtccgaatggtgaagcgggttcggcgggtccgccgggtccgccgggtttacgtggttcgccgggttcgcgtggtttaccgggtgcggatggtcgtgcgggtgtaatgggtccgccgggttcgcgaggtgcgtcgggtccggcgggtgtacgtggtccgaatggtgatgcgggtcgtccgggtgaaccgggtctaatgggtccgcgtggtttaccgggttcgccgggtaatataggtccggcgggtaaagaaggtccggtaggtttaccgggtatagatggtcgtccgggtccgataggtccggcgggtgcgcgtggtgaaccgggtaatataggttttccgggtccgaaaggtccgacgggtgatccgggtaaaaatggtgataaaggtcatgcgggtttagcgggtgcgcgtggtgcgccgggtccggatggtaataatggtgcgcaaggtccgccgggtccgcaaggtgttcaaggtggtaaaggtgaacaaggtccgccgggtccgccgggttttcaaggtttaccgggtccgtcgggtccggcgggtgaagtaggtaaaccgggtgaacgaggtctacatggtgaatttggtctaccgggtccggcgggtccgcgtggtgaacgtggtccgccgggtgaatcgggtgcggcgggtccgacgggtccgataggttcgcgtggtccgtcgggtccgccgggtccggatggtaataaaggtgaaccgggtgtagtaggtgcggtaggtacggcgggtccgtcgggtccgtcgggtctaccgggtgaacgtggtgcggcgggtataccgggtggtaaaggtgaaaaaggtgaaccgggtttacgtggtgaaataggtaatccgggtcgtgatggtgcgcgtggtgcgccgggtgcggtaggtgcgccgggtccggcgggtgcgacgggtgatcgaggtgaagcgggtgcggcgggtccggcgggtccggcgggtccgcgaggttcgccgggtgaacgtggtgaagtaggtccggcgggtccgaatggttttgcgggtccggcgggtgcggcgggtcaaccgggtgcgaaaggtgaacgaggtgcgaaaggtccgaaaggtgaaaatggtgtagttggtccgacgggtccggtaggtgcggcgggtccggcgggtccgaatggtccgccgggtccggcgggttcgcgtggtgatggtggtccgccgggtatgacgggttttccgggtgcggcgggtcgtacgggtccgccgggtccgtcgggtatatcgggtccgccgggtccgccgggtccggcgggtaaagaaggtctacgaggtccgcgtggtgatcaaggtccggtaggtcgtacgggtgaagttggtgcggtaggtccgccgggttttgcgggtgaaaaaggtccgtcgggtgaagcgggtacggcgggtccgccgggtacgccgggtccgcaaggtctattaggtgcgccgggtatattaggtttaccgggttcgcgaggtgaacgtggtctaccgggtgttgcgggtgcggttggtgaaccgggtccgttaggtatagcgggtccgccgggtgcgcgaggtccgccgggtgcggttggttcgccgggtgtaaatggtgcgccgggtgaagcgggtcgtgatggtaatccgggtaatgatggtccgccgggtcgagatggtcaaccgggtcataaaggtgaacgaggttatccgggtaatataggtccggttggtgcggcgggtgcgccgggtccgcatggtccggtaggtccggcgggtaaacatggtaatcgtggtgaaacgggtccgtcgggtccggttggtccggcgggtgcggtaggtccgcgtggtccgtcgggtccgcaaggtatacgtggtgataaaggtgaaccgggtgaaaaaggtccgcgaggtctaccgggtttaaaaggtcataatggtctacaaggtctaccgggtatagcgggtcatcatggtgatcaaggtgcgccgggttcggtaggtccggcgggtccgcgaggtccggcgggtccgtcgggtccggcgggtaaagatggtcgtacgggtcatccgggtacggttggtccggcgggtatacgtggtccgcaaggtcatcaaggtccggcgggtccgccgggtccgccgggtccgccgggtccgccgggtgtatcgggtggtggttatgattttggttatgatggtgatttttatcgtgcggatcaaccgcgatcggcgccgtcgttacgaccgaaagattatgaagttgatgcgacgctaaaatcgctaaataatcaaatagaaacgttactaacgccggaaggttcgcgaaaaaatccggcgcgtacgtgtcgtgatttacgactatcgcatccggaatggtcgtcgggttattattggatagatccgaatcaaggttgtacgatggatgcgataaaagtatattgtgatttttcgacgggtgaaacgtgtatacgtgcgcaaccggaaaatataccggcgaaaaattggtatcgatcgtcgaaagataaaaaacatgtatggttaggtgaaacgataaatgcgggttcgcaatttgaatataatgttgaaggtgtaacgtcgaaagaaatggcgacgcaattagcgtttatgcgtctactagcgaattatgcgtcgcaaaatataacgtatcattgtaaaaattcgatagcgtatatggatgaagaaacgggtaatttaaaaaaagcggtaatactacaaggttcgaatgatgtagaactagtagcggaaggtaattcgcgttttacgtatacggtattagtagatggttgttcgaaaaaaacgaatgaatggggtaaaacgataatagaatataaaacgaataaaccgtcgcgtttaccgtttctagatatagcgccgctagatataggtggtgcggatcaagaattttttgttgatataggtccggtatgttttaaa

SEQ ID NO: 32450 - DNA, 4098 bp, Artificial Sequence
  Description of Artificial Sequence: Synthetic coding sequence
atgctctccttcgtggacacccggacgttgctgctgctggccgtcaccctctgtcttgccacctgccaatccctgcaagaggaaactgtacgcaagggcccggctggggatcggggaccgcgcggagagcgtggacctcctggtccgcccggccgagatggtgaggacggaccgaccgggccacccggcccaccagggccaccgggaccaccgggactgggaggaaacttcgccgcacagtacgacgggaagggagtgggactgggcccggggccgatggggttgatgggaccacggggaccgccaggagcggcgggggccccaggaccacagggattccaaggacctgctggcgaacccggggaaccaggacagaccggccctgctggcgcccgcggacccgctggaccgcctggcaaagctggcgaagatggacatccaggaaagccaggacgaccgggcgaaaggggcgtcgttggaccccagggggctcgcggtttcccgggaaccccgggcctgcccggattcaaaggaatcagaggccataatgggctcgacgggctcaagggacagcccggtgctcccggggtcaagggagaaccaggggcacccggtgagaacggaactcctggccagaccggagctagaggattgcccggtgagcggggacgggtcggtgcgccggggcctgcaggggcgcgcgggtcagacggcagcgtggggcctgtcggaccggctggtccgatcggctcggcaggtccgcctggcttcccgggtgctccgggtccgaagggcgaaatcggtgccgtcggaaacgccgggcctgccggtcccgctggacctaggggggaggtcggattgccagggctgtcagggccagtgggtccaccagggaatccgggtgccaacggcttgaccggggcgaagggtgccgccggccttcctggggtggccggggcccctggactcccggggcccaggggtatcccaggaccggtgggggcagcgggcgctaccggagcgcgcggcctcgtgggagagccggggccggctggatccaaaggcgaatcgggcaataagggtgaaccaggttccgccggaccgcaaggtccaccgggaccgtcaggcgaagagggaaaacgcggacccaacggcgaagcaggtagcgctggcccaccggggccgccgggtttgcgggggagtcccgggtcgagaggacttccgggagcggacggtcgcgccggagtcatgggcccgccgggatcgcgtggcgcatcgggtcctgctggtgtgcggggcccgaatggagacgcaggccgcccgggggagccgggactgatggggccgcggggactgcccggttcacctggaaacatcggcccagccggtaaagagggtcccgtgggccttccaggaatcgacgggaggcccggaccaattggaccggcaggggcccgcggagaaccaggcaatatcggcttccctggccctaagggacctacgggcgatccaggcaagaacggtgacaagggtcacgccggactggcgggtgcaagaggggctccaggccccgatggcaacaacggagcccagggacctccgggtccacagggagtacaaggtggaaagggcgaacaaggaccaccagggcccccaggatttcaggggctcccaggtccatcaggcccggccggcgaagttgggaagccaggagagcgcgggcttcacggagaattcggactcccgggaccggccggcccgagaggagaacggggtccacctggcgagagcggcgcagcaggaccgacgggacccatcggaagccggggaccgtccggccctccgggaccggacggtaataagggagaaccgggagtggtgggtgcggttggcacggccggtccgtccggcccgtcgggactgccaggggaaagaggagcggccggaatcccgggagggaagggtgagaagggagagcctggacttaggggagaaatcggaaacccggggcgcgacggcgcacgcggggctcctggcgcagttggcgcacctgggccagccggagccactggagatagaggggaagccggagcggccgggccggcaggacctgcgggcccacgcggctcgccgggtgagcggggcgaagtgggccctgcaggtcctaatggcttcgcaggacccgcgggagctgctggtcagccgggcgcaaagggagaacggggcgcgaaaggtccaaagggggaaaacggtgtggtgggtcctactggcccggtgggagccgcggggcccgcgggacctaacggaccgccggggccagccgggtctaggggagatggaggaccgcctgggatgactgggttccccggcgccgccgggagaactgggccgccggggccgtcaggcatctctggcccgcctggtcctccgggacccgctggcaaagaaggactgcgaggtccgcggggagatcagggccctgtcggacgcaccggagaggtgggagcagtggggccacctggtttcgcgggagagaagggaccatcgggagaagcggggaccgccggacctccgggcacgccgggcccacagggccttctgggggcgccgggaatccttgggttgccgggttcccgcggggagaggggcctcccgggagtcgcaggagccgtgggtgagccaggccccctgggcatcgccggaccacccggagcaaggggccccccgggagcggtgggatcgccgggagtgaacggagcgcccggggaagctggacgggacggtaacccgggaaatgacggcccacccggacgcgacggacaaccgggccataaaggtgagcggggttacccgggcaacatcgggccagtcggggctgccggtgcccctgggcctcacggaccagtcggacccgcgggtaagcacgggaatcgtggtgagactggaccgtcagggccggtgggtccggcgggcgctgtcggtccaagaggaccatcagggccacaaggtattagaggagacaaaggcgaaccaggtgaaaagggaccacgcggactgcccggactcaagggtcataacggtctgcaagggctgcctggaattgcgggtcaccatggagatcagggagcgcctggaagcgtcggccccgctggccccaggggaccagcggggccttcgggcccagccggaaaagacggacgcactggccatccggggactgttggaccagctggtatccggggaccgcagggtcaccaaggtcccgccggcccgcctgggccaccaggacctccgggacctccaggtgtcagcggcggaggatacgactttggctacgacggagatttctaccgggcagaccagccgagatccgcaccgtccctcagaccaaaggactatgaggtcgacgcgactctgaagtccctcaacaatcaaatcgaaacgctgctgacccccgagggatcaagaaagaatcctgcgcggacttgtagagatctgcggctgtcccacccggagtggagcagcggatactactggattgacccgaaccagggatgcaccatggacgctattaaggtgtactgtgatttctcaaccggcgaaacctgcattcgcgcccaacccgagaatattccggcaaagaactggtaccgctcctcgaaggacaagaagcacgtttggctcggcgaaaccatcaacgccggtagccagtttgaatacaacgttgaaggcgttacctccaaagagatggccactcagctcgcgtttatgcgcctgcttgccaactacgcctcacagaacatcacctaccactgcaaaaacagcatagcctatatggatgaggaaactggcaatctcaagaaggccgtgatcctgcagggatcgaatgatgtcgaactcgtggccgaaggcaatagccggtttacctacactgttctggtggacggatgctcgaaaaagactaatgagtgggggaaaactatcatcgagtacaagaccaacaaacctagccggctgcctttcctcgatatcgcccccctcgatatcggaggagcggatcaggagttctttgtggacatcggacctgtgtgcttcaag

SEQ ID NO: 32451 - DNA, 4098 bp, Artificial Sequence
  Description of Artificial Sequence: Synthetic coding sequence
atgctgtcctttgtggatacgagaaccctcctgcttctcgcagtgaccctgtgtcttgcaacctgccaatcactgcaggaagagactgtgaggaagggtcccgccggcgataggggacccaggggagaaagagggcccccgggcccacctggtcgtgatggtgaagatgggcctacgggtcctccgggccctcccgggccccctggacccccagggctgggagggaatttcgcagcacagtacgacggcaagggtgttggcctgggaccaggacctatgggtcttatgggacctagaggcccacccggtgcagcaggagcgcctggaccccaaggttttcaagggcccgcaggagagcctggggagcccggacagaccggcccagcaggagcccgagggccagcgggaccaccggggaaggcaggcgaagatggccatcctgggaagcctggacggcctggcgagaggggcgttgtaggacctcagggagcacgtgggtttcccggaactcctggactcccaggattcaaaggaatccgcgggcacaacggactggatggtctgaaaggacagcctggagcacccggtgtgaagggagagccaggagctcccggtgagaacggtactccggggcaaaccggcgcacgtggtctgccaggtgaacgcggtcgcgtgggtgctccggggccagcaggagcgagaggctcagacggttccgtagggccggtcgggcctgctggaccaattggctcggccggtcctcccggtttccccggtgcaccaggaccaaagggtgaaattggggcagtgggcaacgcaggaccggcaggaccagccgggccgcgtggagaagtggggcttccaggcctgtcggggccggtgggccctccaggaaaccccggagccaatggccttacgggagcgaagggagcagctggactccccggggtagccggggcacctggacttcccggacctcggggcatccccggacccgtgggtgccgcaggagcaacgggtgctaggggtcttgtcggtgaacccggaccagcaggatcgaagggcgaatccggaaacaagggagaacctggaagcgctgggccgcagggacctcctgggccttcaggagaagaaggtaagcgaggaccgaacggagaagcagggtcggcaggtccccccgggccaccgggactcagaggatcgccagggtcgcgcgggcttccaggtgcagatgggcgggcaggagtgatgggtccacccggctcacgcggggcgtccggtcctgcgggagtgcgcggaccaaacggtgatgcaggtcgtcccggcgagccgggcttgatgggcccacggggtctgcctggatcaccgggcaacattggtccagcgggaaaggaaggacctgttggcctgcctggaatcgatggccggccgggtccaatcggtccggcgggagcgcgaggcgaacctggtaacattggttttcctggtccaaaaggaccaaccggcgatcctggaaagaatggcgacaagggtcatgcaggattggcaggtgccagaggagcccctggccctgatggcaataacggtgcccaagggcctcctggtcctcaaggagtgcagggtggcaagggcgaacaaggtccaccgggacctcccggatttcagggactccccggaccaagcggcccagcgggcgaggtcggaaaacctggtgaaagaggtttgcatggagaatttggccttcctggcccagctggcccgagaggtgaaaggggccctcctggtgaatcgggagcggcagggccaaccggtcctataggctccaggggacccagcggacctccaggcccggacggaaataagggggaaccaggagtggtgggggcagtggggactgccggccctagcggtccatccggcctgccaggtgagcgaggagcagcaggaatccctgggggtaagggagaaaaaggagaaccaggtctgcggggagagatcggcaatccgggaagagacggcgcccgcggagctcctggggccgtgggcgcaccaggacccgcaggggcaaccggagatagaggagaagcaggcgccgcgggccctgccggtccggctggtccacgggggtcacccggtgaacggggagaggtcggcccggcaggacccaatgggttcgccgggccggcaggggcagccgggcagccgggagccaagggtgagcgaggtgccaaaggtcctaaaggagaaaatggtgtggtgggtcccactggcccagtgggtgcagctggacccgcgggaccaaacggccctccgggtccggcagggtcgaggggagatggcggacctcctggtatgaccggattcccaggtgcagccggtagaactgggccaccggggcctagcggcatttcagggcctccgggtcctcccggaccagctggtaaagagggactgaggggtcctaggggagatcagggccctgtgggacggaccggggaagtcggtgcggtgggtcctccagggtttgcaggagaaaagggcccatcgggtgaggcgggtacggcaggtccgccaggtacccccggcccacagggcctgctcggcgcacctggtatcctcggtctgccgggctcccgaggagaaagaggcttgcctggagtggcaggtgcagtgggtgaacctggtccactcggaatcgctggcccacctggggccagagggcctcccggggcagtcggaagtccaggcgtgaatggagcaccgggggaagcagggcgcgacggtaaccctggaaacgatggaccccctggccgcgatggccaaccagggcataagggagagcgtggatacccgggaaacataggcccagtcggggctgccggggcgccaggtcctcatggccccgtcggaccagcgggcaaacatggaaacagaggggaaactggtcctagcgggccggtgggacccgccggagcagtggggccaagagggccaagcggccctcaaggcattaggggagataaaggtgagcccggtgaaaaaggccctaggggactccctggtctgaaggggcacaacgggttgcaagggttgccgggcatagcaggccatcacggagatcagggagcacccgggtcggtgggtccagctgggcccagaggacctgcagggccttccgggccagccggaaaggatggaagaactggtcatccaggcaccgtcgggcctgccgggattagaggtccgcaaggccatcaagggccagcagggccaccaggcccgcccgggccgcccggaccacctggtgtcagcggagggggatacgatttcggttacgacggcgacttctaccgggctgatcaacccagatcagctccttccctgcgcccgaaggactacgaagtggacgcaacgctcaagagcctgaacaatcaaatcgagactttgctgaccccagaaggatcgcgcaagaatcccgcccgcacttgtcgggatctgcggctttcgcacccagagtggtcctccggctactactggattgatcctaaccagggatgtaccatggacgcgatcaaggtgtactgtgatttttccactggagagacttgtattcgcgcacagcccgaaaacatccctgcaaagaattggtaccgatcctctaaggacaagaaacatgtttggctcggcgaaactataaacgcgggttcccaattcgagtataatgtggagggtgtgacttcgaaggagatggccacccagcttgcgtttatgagacttctcgcaaactacgccagccagaacataacctaccattgcaaaaactcaatcgcgtacatggacgaggaaaccggaaacctcaagaaagcggtgattctccaaggatcgaacgatgtggaactggtggcagagggcaattcgcggtttacctatactgtccttgtcgatggatgcagcaaaaagactaacgaatggggaaagactattatcgagtacaagaccaataagccaagcagacttccatttcttgatattgcacctctggatattggcggggccgaccaagaattctttgtggatattgggcctgtgtgctttaaa

SEQ ID NO: 32452 - DNA, 4098 bp, Artificial Sequence
  Description of Artificial Sequence: Synthetic coding sequence
atgctgtcgtttgtcgataccaggacgctgctgctgctcgcggtcactctgtgtctcgccacctgtcaatcactgcaggaggagactgtgcgcaaagggcctgccggagatcgggggcctagaggcgaacgcggaccaccaggtccccctggacgtgatggggaggacggcccgaccggaccacccggacctccgggaccacccggccctcccggactcggcggaaactttgcagctcagtacgatggaaaaggagtcggtcttgggcctggtcctatggggttgatgggccctcgtggtcccccgggggcagcgggggcgcctggtccacaaggattccaaggtccagcaggtgagccaggagagcctggccagaccggtcctgccggagcaaggggtccagctggaccacccggtaaggccggagaagatggacacccaggaaagccagggcgacctggtgaaaggggcgtggtcgggccccaaggggcaaggggttttcctggaactccggggctgcctggctttaagggaatcaggggtcataacggtcttgatggacttaagggacagcctggcgctcccggagttaaaggagaacctggtgcccctggtgaaaatggaacccccggtcagaccggtgcacgcggactccccggagaacggggccgtgtgggtgcccccggtccagctggtgctcgtggttcagatggttccgtgggaccagtgggacccgcgggacctatcggatcggcagggcctccgggatttcctggagcgccgggacccaagggtgaaataggagcggtgggaaatgcgggaccagccggaccagcgggaccaaggggggaggtcggcctgcctggactgtccggtccagtcggcccacctggtaaccctggagcaaatggtcttactggagcaaaaggcgcagcaggacttcctggtgtggcaggtgcacctggccttcctgggcccagaggaattcctggtccggtgggtgcagcaggagctacgggagcacgtgggttggtcggggagccaggaccagcgggaagcaaaggagagtccgggaacaagggtgaaccaggtagcgcgggacctcaaggacctcctggtccctctggtgaagagggtaagagaggcccaaatggagaagctgggtccgcgggcccgcccggtccacctggactcagaggaagcccgggttccagggggctgccgggggcagatgggcgggcaggagtcatgggaccaccaggctcaagaggggcatccgggccagccggagtgcgaggaccaaacggggatgcgggtcggccgggtgagcctggacttatgggaccgagaggtctgcctggttcgccagggaacattgggccagcgggtaaggaaggacctgttggactgccaggaattgacggacgaccagggcctatcggtccggcaggagcacggggggagccgggaaacattggatttccggggccaaaagggcctactggtgatcccggaaagaacggcgataagggtcatgcaggactggcaggtgcaaggggagcaccaggacccgatggaaacaatggagcacagggaccccccgggccacaaggcgtgcaagggggcaagggtgaacaaggtcctcctggacctcccgggtttcaaggactgcccggaccatcgggaccagccggcgaagtgggcaaacccggagaacgggggttgcatggcgaattcggtctgccaggtcctgctggtcctagaggggagcgtgggccacccggcgaatcaggggccgcagggccaactggacctatagggagcagggggccttccggtccaccaggaccggatggaaacaagggagagccgggcgttgtgggtgcggtgggcaccgcgggacctagcgggccttcgggactgccaggtgaacgaggggcagcgggtatcccaggcgggaagggggaaaaaggtgagccaggtcttaggggtgagatcggtaatccgggacgcgatggtgcaagaggtgcccccggggccgtgggggcccctgggcctgccggtgccacgggcgacagaggcgaggcaggtgccgccggtccagcaggccctgctggccccaggggatcccccggtgaaagaggtgaggttggtcctgccgggccaaatggatttgccggcccagcaggagctgcaggacagcctggagccaagggggaacgcggagccaagggaccgaagggtgaaaatggcgtggtcggacctaccggaccagtgggtgcagctggtcccgccggaccaaatggtccacctgggcccgcgggtagcagaggtgatggaggaccacccgggatgaccggattccccggtgctgcaggccgtacgggtcctcctggtccatcgggaatctcaggtccgccaggccctccgggcccagcaggaaaagagggtctgagaggaccccgaggagatcaggggcctgtcgggcggactggagaggtcggagcagtgggtccaccaggttttgccggagaaaagggaccctcgggggaagcaggaacggcaggtcctcccggcacgcctggacctcaagggcttctgggcgcacctggcattttgggactccctggatcccgaggtgaacgaggactccctggggtggcgggagcagtgggcgagcccggacctctcgggatagcagggccccccggtgcaagaggcccgccaggtgcagttggttcgccgggagttaacggtgcaccaggggaagccggccgcgacggtaaccccggaaacgatgggccccctggacgcgatggacaacctgggcacaagggcgaacgtggttaccctggcaacattggacctgtcggggccgcaggcgcacccgggccgcacggaccagtcgggcctgctgggaagcatggtaaccggggagaaaccggtccatcaggacccgtgggtcctgctggggcggtgggccctcggggaccgtcaggccctcaaggcatccgcggggataagggagaaccaggagaaaagggacctcggggacttccggggcttaaaggacataacgggctgcagggtctgcccggcattgcagggcaccacggtgatcagggggcgccgggaagcgtgggccctgctggccccagaggaccggccggtccatcaggacctgccggaaaggacggaaggaccggtcatcctggaactgtgggtcccgccggtatccggggacctcaaggacatcagggcccggcaggcccacccggacctcctggaccgccaggcccaccaggagtgtcgggtggaggctacgacttcggatacgatggagacttttaccgcgcagatcaacctcgcagcgccccgagcttgcgacctaaggactacgaagtggatgctaccctcaaatcgctgaataatcagattgaaaccttgctcactcccgaaggttcccgcaagaatccggcaagaacttgtagagatctcaggctttcccacccagaatggtcgtctggctactattggattgacccgaaccagggctgtactatggacgcaatcaaagtgtactgtgacttctcaactggggaaacctgcattcgagcccaaccagagaacattcccgcgaaaaactggtacaggagctccaaagacaaaaagcatgtttggcttggggagactattaacgcaggcagccaatttgagtacaatgtcgaaggggtgacgtcaaaagagatggcaacccagctcgcctttatgcggcttctggctaattacgcatcgcaaaacattacctaccattgcaagaattccattgcatatatggacgaggaaactggaaaccttaagaaagctgttatactgcagggatcgaacgacgtcgagcttgtggcagaaggtaactcgagatttacctacactgtgctcgtggacggatgttcgaaaaagactaacgaatggggaaagactattatcgaatacaagaccaacaagccgagccggttgccttttctcgacattgcccctctggacatcggcggtgcagatcaagaattcttcgtggatatcggacctgtgtgcttcaag

SEQ ID NO: 32453 - DNA, 4098 bp, Artificial Sequence
  Description of Artificial Sequence: Synthetic coding sequence
atgctgagttttgttgatacaagaaccctgcttctgctcgctgtcaccctgtgcctggcaacttgccaaagcctgcaggaggaaaccgtgcgaaagggaccagccggagatcggggaccccgcggcgaaagaggcccaccagggccgcccgggagggacggggaggatggtccgacagggccaccaggaccccccggcccccccggaccccctggcctgggtggcaattttgctgctcaatatgatggcaagggagtgggtctgggcccaggtcccatggggctgatgggaccaagaggcccgcctggagctgccggggctccaggcccgcagggattccagggcccggcgggagagcccggggaacccggtcaaaccggaccagccggggcccgcggtcccgcagggccccctggaaaagcgggagaagacggacaccctggaaagcccgggcgccccggagaacgcggggtagttggcccgcagggggcccggggttttcctggaacccctggactgccagggtttaaggggatccggggccataatgggctggacggcctcaaaggccagccgggggcccccggtgtgaagggcgaaccaggagcacctggggaaaacggaacccctgggcagacgggagcacggggcctccccggagagcgcggccgcgtgggagctccaggtccagctggcgcacgcggctctgatgggtctgtgggccctgtgggcccagctggcccaatcggatctgccgggcctcccggcttcccaggtgcacccggccctaagggcgaaatcggcgccgtgggaaacgccggtcctgcgggtccagcagggcccagaggcgaggtgggcctgccgggattgtccggaccagttggtcccccgggtaacccaggagcaaatggactgaccggcgccaagggggcagccggactgccgggagtagctggggcaccaggcctgccaggaccaagaggtatccccggaccagttggcgctgccggcgcaactggggcaagaggactggtgggcgagcccggaccagccggcagcaagggtgagtctggaaacaagggagaacctgggtcagctggtccgcagggcccccccgggccatccggagaagaagggaagcggggacctaacggagaggccggctctgccgggcctcctggacctcccgggctgcgcgggtcccctggttccagggggttgcctggggctgatgggagggccggagtgatgggcccccccggtagcaggggggcttcaggccccgccggcgtgaggggaccgaacggagacgccggaagacctggtgagcccggtctgatggggccccgcgggctccctgggtcccccggaaacatcggtccagcggggaaagagggcccagtggggcttccaggtatagatgggcgacctgggcccattggtcccgctggcgctagaggtgagccaggcaatataggatttcctggtccgaaaggtccgacaggcgatcccgggaaaaacggtgataaaggccacgcaggcctcgctggcgcacggggcgcacccggccctgatggtaacaatggcgcacagggaccccccgggccacagggtgtgcaaggtgggaaaggagagcagggtcccccaggaccccccggttttcaggggctgccagggccttcaggcccagctggcgaggtggggaagccaggagagagaggtctccatggtgaattcgggctgcccggccctgcaggccctagaggagagagaggcccaccaggcgagtctggagcagcaggtcccaccggaccaatcggctctcgcggaccctccggcccaccaggacccgatggtaacaaaggcgagccaggcgtcgtaggcgctgtggggactgccggtcccagcggccctagtggtctcccgggagaaaggggcgcggccggcatacctgggggcaaaggggaaaagggagagcccggcctccggggggagatcggaaacccaggtcgggacggcgcacgcggtgccccaggcgcagttggggcaccagggccggcgggcgctaccggcgacagaggtgaagcaggcgctgccgggccagccggtcccgcgggccctaggggcagtcctggtgaacgaggggaagttggccctgcgggaccaaacgggttcgccgggcccgctggagccgccggacagcccggggccaaaggcgagcgcggagctaagggccctaagggagaaaacggagtggtaggacccaccggcccggtaggcgcagcgggaccggccggccctaacggccctccaggaccggctggcagccggggggatggaggccccccaggaatgactgggttccccggggctgccgggcgcaccggacccccaggccctagtgggataagtggtccaccaggaccacctggtcccgccgggaaggagggactccgaggcccgcggggcgaccaggggcccgtaggacggacaggcgaggtcggagctgtcgggccaccaggtttcgctggagagaaaggccccagtggcgaggcaggtacagcaggccctcccggcacacctggcccccagggactgctgggtgctcccggaatcttgggtcttcctggctctcggggcgagcggggactgccgggggttgcaggcgcagtcggggaacccggcccactgggcattgcagggcctcccggcgcccgcggacccccgggggccgtcggaagtcctggagtgaacggtgcccccggagaggccgggcgggatggcaatccgggcaacgacggcccacccggccgggacggccagcctggccataaaggcgagcgcggctatcctgggaacattggtcctgtgggagcagccggcgcgcccgggccacacgggccagtgggccccgccggcaagcacggcaaccgcggagaaaccggcccctccggtccagtgggacctgccggggctgttggtccaaggggaccatctgggccacaggggatccgcggggacaagggagagcctggcgaaaaaggtccacgcgggttgcctggcctgaaaggacataacggtctgcaggggctgcccgggatcgctggccatcacggagaccagggcgctccggggtcagttgggccagccgggcccagagggccagcaggccccagtgggcctgccgggaaggacggacggaccggtcatcctgggaccgtgggcccagccgggatcagaggtccacagggacaccagggccccgcaggacccccaggacctccaggccctcctgggccccccggagtttccggagggggatatgacttcggctacgacggggatttttatagggcagaccagccgcggagcgccccatcactccgccctaaagattacgaggttgacgcaacactgaagtcactcaataaccagatcgagaccctgctgactccggaaggttcccggaagaatccagccaggacttgcagagaccttcgactgagccaccctgaatggagtagcggatattactggatagaccctaatcagggctgtactatggacgccattaaagtttattgtgatttttccacgggcgagacttgcatacgcgcccagcccgaaaacatcccagccaagaattggtaccggtcttccaaagacaaaaaacatgtctggctgggggagaccatcaacgctggctcccagtttgagtacaatgtcgagggggtcacgtccaaggagatggctactcagctcgcatttatgaggctgctggcaaactacgcatcacagaacatcacatatcactgtaagaactccattgcatacatggatgaggagaccgggaacctgaagaaggcagttattctgcaaggctccaatgacgttgagttggtggccgagggtaactcaaggttcacatacaccgtcctcgttgatggatgtagcaagaaaaccaatgagtggggcaaaaccatcatcgaatacaaaacaaacaaacctagtcggctgccgtttcttgacatcgccccgctggacatcggaggagcggatcaggaattcttcgtagatattgggcctgtgtgtttcaaa

SEQ ID NO: 32454 - DNA, 4098 bp, Artificial Sequence
  Description of Artificial Sequence: Synthetic coding sequence
atgttgtcttttgtcgatacgaggacactcctattactcgccgtaaccctgtgtctggctacttgtcaatcactgcaagaggaaaccgtacgcaagggcccagccggcgatcgcggcccgcgtggtgaaagaggaccacctggacctcctggacgcgacggagaggacgggcctactggccccccagggcctccgggtcctcccggccctccagggcttggcggcaactttgccgctcagtacgacggcaaaggtgtgggcctcggtcccggccccatgggcttgatgggccccaggggcccccctggtgccgctggggcccctggaccacagggcttccaggggcccgccggcgaacccggtgagcccggccagactggcccagctggcgctcgggggccagcaggacctccagggaaggcaggagaggacggccaccctggaaagcccgggcggcctggcgagcgcggggtcgttggtccccaaggagccaggggcttccctggcactcctggcctgccaggattcaaaggaatccgtggacacaacggattggatggattaaaagggcagcccggggcccccggggtcaagggtgagccaggcgctcctggggaaaatggcacacccgggcagacgggcgcacgcgggctaccaggcgaacgcgggcgggtgggagctccaggcccggccggtgcgagaggttccgatggctccgtaggcccagttggccccgctgggcctattgggtctgccggtccgcctggtttcccaggagctcctggaccaaaaggcgagatcggagctgtggggaacgctggacctgccgggcctgccggtccgagaggagaggtgggacttccaggcttatccgggcccgtgggacctccgggcaatcccggggcaaacggacttacaggcgcgaagggagctgctgggctgccaggtgtggccggagctcctggcctgccagggccacgcgggatacccggcccagttggcgccgccggcgccactggggctcgaggcctggtcggcgaaccggggccagccggctcaaaaggtgagagcggcaataagggagaaccaggcagtgccggccctcagggcccccctggcccctctggcgaggagggtaagcgcgggcctaatggagaagcagggagtgcaggtcctcctggtccccccggtcttcgtggtagccccggtagcaggggccttccaggcgcagatggccgcgcaggcgtcatgggtcctccagggtcccgaggagcctccggtcccgcaggtgtgcgaggacctaatggggacgctggtcggcccggagagcctggactgatgggcccccggggcctgcctggctctcctggtaatattgggcccgccggcaaggaggggccggtgggcctcccaggcatagatgggcgccccggccctataggtcccgctggggcccgcggagagccggggaatatcggtttccccgggcccaagggacctacgggggatcccggaaagaacggggacaagggacacgccggcttagcaggagccaggggagcgccagggcccgacggaaacaacggtgcccaaggccctccgggtccccagggtgtgcagggcgggaagggagagcagggacctcccggcccgcctggtttccagggtttaccagggccaagcggcccagcgggagaagtaggcaaacccggagaaagaggcttgcacggggagttcggactccccggcccagccggaccacgaggtgaacgcggccccccgggcgaatcaggggcagctggacctactggcccaatcggaagtaggggtcccagtggaccaccaggtcccgacggaaacaagggtgagcccggagtggttggcgccgtaggcacggccggtccctcagggccctctggccttcccggcgagcggggagcagcgggcatcccaggaggaaaaggcgagaagggcgaacctggcctccggggcgaaataggtaatcccggtcgtgacggagcaaggggcgctccaggggccgtaggggccccaggacctgctggggccactggcgataggggagaggccggggccgcaggaccagcaggtccagccggccctcggggaagccctggtgaacggggggaagtgggacctgctgggcccaatggatttgccggcccggctggagccgcagggcagcctggagcgaaaggagaacgtggggcaaagggcccgaagggcgagaacggcgtagttgggcctaccggccctgtcggtgccgcgggacctgcgggtcccaatgggcccccaggtcccgcggggtcccggggggacggcggtcctccagggatgacaggtttccctggtgctgccggaagaaccggcccacccggaccgtcggggatatcaggaccccctggcccccccgggccggctggaaaggaaggtctgcgcggcccacgtggtgatcagggaccagttgggagaaccggtgaggtcggggccgtgggaccgcctggatttgccggagaaaaggggccgtctggcgaggccgggaccgccggccctccgggcacgcccggaccccaagggttgctgggcgctccgggaatccttgggctgccgggttctagaggcgagagggggctgccaggcgtggcgggagctgtgggtgaacctgggcctttggggatcgcgggaccccccggtgccaggggtccacccggtgccgttgggtcacctggcgtcaatggagctcccggagaagcgggccgcgatggaaatccaggcaatgacggccctcccggccgcgacggccagcctggacacaagggtgaacgcgggtacccaggcaatataggaccagtcggcgccgccggcgcaccaggcccccatggcccagtcgggccagccggcaagcacgggaaccggggcgaaaccggccccagcggaccagtcggaccagctggggcagttggacctcgcgggccatctggaccccaaggtatcagaggggataagggggaaccaggtgagaagggtccgcgaggcctgcccgggctgaaggggcacaacgggctacagggacttcccggtatagctggacatcacggcgaccagggtgcacccggctccgtcggacctgccggccctcgcggacccgcaggaccctccggccctgctggaaaagatggccgaacaggccatcctgggacggtgggcccagcaggaattcggggccctcagggtcatcagggccctgcaggccctcccggtcctcccggccctcccggtccgccaggggtttccggaggcggctatgactttgggtacgatggggatttctacagggccgaccagccccgatccgcacccagcctgcgacctaaggattatgaagtggacgcaacgctaaagtctcttaacaaccagatcgaaaccctcctcacgcccgaggggagtcgtaaaaatcccgcgagaacttgccgggatctaagactgtcgcacccagaatggtcctctggctactactggatcgacccgaaccagggctgtacaatggatgctatcaaggtgtattgcgactttagtaccggagaaacatgcatccgggcccaaccagaaaacattccagcaaagaactggtacagaagtagtaaggataagaagcacgtgtggttgggggagactattaatgctggtagccagtttgagtacaacgtcgagggagtcacctccaaggagatggccacgcaattggcattcatgcggctcctggctaactatgcgagccagaatatcacttaccactgtaaaaactcaattgcttatatggacgaagagaccgggaacctgaagaaggcagtgatccttcagggttctaacgacgtagagctggtggcggagggaaacagccggttcacctacactgtgcttgtggatgggtgttccaaaaaaaccaatgagtggggaaagaccattatcgagtacaagacaaacaagccttccagactgccatttttagatatagcacccctcgacataggcggggccgatcaggaattcttcgtggatattgggccggtctgcttcaaa

SEQ ID NO: 32455 - DNA, 4098 bp, Artificial Sequence
  Description of Artificial Sequence: Synthetic coding sequence
atgctttcgtttgtcgatacccgcactctgcttctccttgcggtgacgctttgccttgcgacctgtcagtcccttcaagaagagactgtgagaaagggacccgctggagatcgaggaccgcggggtgaacggggtcctcctggacctcctggacgagacggagaagatggaccgacggggccaccgggacctccaggaccgccggggccacctggacttggaggcaatttcgcagcacagtacgatggtaagggtgtgggtctgggacctggtcctatgggactcatgggtccacgcgggcctcctggtgcagcaggcgccccgggcccacagggtttccaaggccctgccggtgagcctggtgaacctggtcagactgggccggccggtgcacggggcccggcaggaccgccaggaaaagcaggagaggacggacaccctggtaagccaggaaggcccggcgaacgtggggtcgtcggacctcaaggtgcccgggggtttccaggaactccaggactgcccggatttaagggcatccgaggtcataacggactggatggacttaaggggcagcccggtgcccctggagtgaagggcgaacctggtgcgcctggtgaaaacggaaccccgggacaaaccggtgcaagaggactgcctggcgagcgggggcgggtgggggcacccggtccggccggggcccgaggttcggatggttccgtgggccctgtgggacctgcgggcccaattggaagcgcaggcccaccaggctttcctggcgcacctggaccaaagggagagattggtgcggtcggaaatgcagggcccgcaggacccgctgggcctaggggcgaagtcgggctccccggcctgtccgggcctgtgggccccccaggtaacccgggggcaaacggactcaccggcgcaaagggagccgccggtttgccaggtgtggcgggtgctccaggcctgcccggacctagagggattcctgggccagtgggcgccgcaggtgcaactggggcaagaggactcgtgggagaacctggtccagcgggatcaaagggtgagagcggcaataaaggcgaacctggctccgcagggccccagggtccgccaggcccttctggggaagagggtaaaaggggacctaatggcgaggcaggctcagccgggcctcccggcccgcccgggctccgaggatccccgggatcccgaggactgccaggagcggatggtcgagcaggagtcatgggccccccgggctcccgaggtgcaagtggtccagcaggcgtcagaggtcctaatggcgatgccggacgcccaggcgagcctggattgatggggccaagggggcttccaggatcgcctggcaatatcggaccagctggtaaggaggggccggtggggctccccggaattgatgggcggcccggtccaatcggcccggcaggtgcacgtggagaaccaggcaatattggatttcctggtcctaaaggtcctacgggtgaccccgggaagaacggggataagggacacgctggactcgcgggtgcgaggggagcacctgggccagatggcaataacggtgcccaaggaccgcctggtccccagggagtgcaagggggaaagggggaacaaggaccccccggccctccggggttccagggacttccaggtccttcgggtcccgctggcgaggtcggaaaaccaggagaaagggggcttcatggggagtttgggcttccggggcctgctggcccacggggtgagcgtggcccacccggcgaaagcggcgcagcagggccaaccggacccatcggttcgaggggcccaagcggaccaccaggacctgacggaaacaaaggtgaacctggggtggtcggcgcagtggggaccgcgggtccttcaggcccgtcaggacttccaggggagcgcggggctgccggcattcccgggggcaagggagagaagggggaacctggactgaggggcgaaattggaaaccccggacgggatggtgcgagaggggcaccaggtgcagtcggtgcacccggacccgccggtgctaccggtgatcggggtgaagctggagcagcagggccggcagggccagcaggtcctcgcgggtcccctggcgagaggggagaagtgggtcccgcaggtcctaacggctttgcaggcccagcaggcgctgcaggacaaccaggtgcaaaaggagaaagaggagcaaagggtcctaagggtgaaaacggcgtggtgggtcctaccggacctgtgggggcagcaggtcctgccggtcctaacggtccgcctgggccagctggttcacgaggagacggggggccacccggcatgaccggattccccggagccgcaggccgtactggaccccctggaccgtcaggcattagcggcccgcctggtccaccaggccccgcaggaaaagaggggcttagaggtccacgcggcgatcaagggcctgtagggcgcaccggcgaagtgggtgccgtgggccctccagggttcgcgggggaaaaaggcccatccggagaggccggtaccgcagggccgcctggaactcctgggcctcagggtcttttgggagccccaggtatactggggttgccaggatctcgcggagaaagaggcttgccaggcgtggcaggagcggtaggggaaccaggaccactcggaattgcaggtccgccgggggccagagggccaccaggagcagtgggctccccaggtgtgaacggagcgcccggagaagctgggagggacggtaaccccggtaacgatggacctccgggcagagacggtcagccaggtcacaaaggagagagaggatacccaggaaacataggaccagtcggtgcagcgggggctccaggaccacatggccccgtggggccagcagggaagcatggaaacagaggggaaaccgggccaagcggccctgtcggtccagccggtgcagtcggacctcgtggtccctcggggccacaaggaatcagaggtgataagggggagcctggagaaaaaggacctagaggtctgcctggtttgaaagggcataacgggcttcaaggcctgccaggaatcgcgggtcatcatggtgaccaaggtgctcccgggtcggtcggcccggccggcccgcgtgggcccgccggaccttcaggtcccgccgggaaggatggccgtactggtcaccctggtactgtcggaccagcgggcatccggggtccgcaaggacatcagggtccggcagggccgccgggtccccctgggcctcccggaccacctggtgtcagcggtggcgggtacgacttcggatacgatggagatttctatcgggcggatcaacctagatcggccccttcgctgaggcctaaggattacgaagtggacgcaacccttaaaagcctcaacaatcaaattgaaacccttcttactcctgagggaagcagaaagaaccccgccagaacgtgccgggatcttcggctgtcacaccctgaatggtcaagcggttactactggattgatcccaatcagggttgtactatggacgccattaaggtctactgtgattttagcaccggcgaaacttgtattcgcgcccagcctgaaaacatcccagcaaagaattggtaccgttcgtcgaaggacaagaaacacgtttggcttggagaaacgatcaacgcaggttcgcaatttgagtacaatgttgagggagtgaccagcaaagagatggccacccagcttgcatttatgagacttctcgcaaactacgcctcgcagaatatcacttaccattgtaagaattcgatagcttatatggatgaagaaactgggaacctcaaaaaggcagtgattttgcagggttcgaacgatgtggaactggtggcagaaggaaattcccgattcacttacactgttctcgtggatggttgctccaaaaagaccaacgaatggggaaaaaccataatagagtacaagacgaacaagccatcccggcttccgtttctggacatcgcaccactggatatcggtggagcggaccaagagttctttgtggacattgggcctgtgtgttttaag

SEQ ID NO: 32456 - DNA, 4098 bp, Artificial Sequence
  Description of Artificial Sequence: Synthetic coding sequence
atgctatccttcgtcgacacacgcacacttctgttgctggccgtcaccctgtgcctggctacatgtcagagcttgcaggaggagacagttcggaaggggcctgctggagatagagggccacggggggagaggggacctcctgggccacccggccgggatggggaggacggccctaccggccctcctgggcctcccggacccccaggtccacccgggcttggaggcaactttgcagcccagtacgacggcaagggggtgggtctgggccctggccccatgggcctcatgggcccaaggggccctcccggcgctgcaggcgcgcccggaccgcaaggttttcagggcccagctggggagcccggagagcccgggcaaaccggccccgccggagctcgaggcccagccggtcctcctggtaaggccggcgaggacggtcaccccggcaaacctggccgtcccggcgagcggggcgtcgtgggccctcagggtgctcggggattcccggggactccaggtcttcctggttttaagggaatccgcggacataatggcctcgacggtctgaagggccaacccggcgctccgggagtaaagggagaacccggggctcccggagaaaatggaacccccggtcaaactggcgctagaggcctccctggcgagagaggaagagtaggggcccctggaccagctggagctcggggctctgatggctcagtaggacctgtcgggcccgcaggtccgatcggctccgccggtccaccgggatttcctggggccccaggcccgaaaggagagattggcgccgtggggaatgctggccctgctggacccgccggaccacgcggggaagtggggctgccaggcctgtctggccccgtcggaccccctggtaaccccggggccaatggtctcacgggcgcgaagggagctgcaggtctgcccggggtggctggcgcccctgggcttcctggaccacgcgggataccaggacccgttggtgccgctggtgcaacaggagccagaggactcgtgggagaaccaggcccagccggatctaagggggagagtggcaataaaggcgagcctggcagcgcgggaccacagggcccacccggacctagcggagaagaagggaagcggggccccaatggagaggccggaagcgcaggtccaccagggcctcccggcctgcggggctcaccagggtcccgcggactaccaggggccgatggtagagctggggtaatggggcctcctggctctagaggagcttccgggccggctggagtccgcggtcctaatggagatgctggaaggcctggcgagccaggcctcatgggtccacgcgggctgcctggctctccaggtaacattggccctgccggaaaagaagggccggtagggctgcccggtatagatggtcgtcctggaccaattggtccggcaggagctagaggggagccgggtaatatcggtttccctggtcccaaagggcctactggcgatcctggtaagaatggagacaagggccacgcaggtctggcaggagccaggggagcccctgggcctgacggaaataacggtgcccagggcccccccggcccccaaggagtgcagggaggcaagggtgagcaggggcccccggggccacccgggtttcagggactgcccgggccatcagggcccgcgggtgaggtgggtaaacccggcgaacgcggcctacacggggaatttggcttacctggtcccgctggaccacggggcgagaggggaccccctggggaaagcggcgccgcaggacccactggaccaataggaagccggggccccagtggccctcccgggccagatgggaacaagggagagccaggcgtcgtgggcgcggtcgggacagccggcccgtcgggacctagcgggctgcctggcgaacgaggagcggccggcatccctggggggaaaggagagaaaggggagccaggcctgcgcggggaaattggtaatccaggccgagacggagctcggggggcccctggtgctgtcggagcgcccggtcccgcaggagctactggcgaccgaggcgaagccggggcggcaggaccggccggccccgccggaccacggggtagccctggtgaaagaggcgaagtaggtcctgcaggaccaaacggcttcgcaggaccagccggtgcagccgggcagcccggggccaagggggagcgcggcgcaaaaggaccaaaaggagaaaacggtgtagtaggaccaacaggcccagtcggcgcggcgggccccgccgggcccaacggccctcctgggcccgccggaagccgtggagatggcggcccacctggaatgaccggcttccctggagcggccgggagaaccggaccacctggtccatcaggaattagcggtcctccgggtccgccgggcccggcaggcaaggaaggcctgagaggtccaagaggtgaccaggggcctgtgggaaggacgggggaagttggcgcagtgggtccacctggttttgctggagagaaggggccctctggcgaagcagggaccgcaggtccgcccggaacacccggcccgcaaggtctgctgggggctcctggcattttagggctacccgggtcgcgtggtgaaagggggttaccgggggtcgccggcgcggtgggcgagcccggccctctgggaatagcaggaccgccgggagctcggggcccacccggcgctgtggggtctccgggggtcaacggtgcacctggcgaggcagggcgggacggcaaccctggcaacgatggtcctcccggccgagatggacagcccgggcacaaaggcgagagaggctaccccggaaacatcggcccagttggtgcggccggcgcccccggtcctcacgggcccgtaggcccagccgggaagcacgggaaccgcggagagactggcccctctgggcctgtgggccccgccggggctgtcggtcctcgtggccctagtggtcctcagggaatcaggggtgacaagggggaacctggcgagaagggtccacgtgggcttccgggactcaagggccataacgggctccaggggctaccaggaattgccggacaccacggagatcagggagcgcccggctcggtggggccagccggtccaagaggaccggcaggacccagcgggcctgcaggcaaggacgggcgaaccgggcatccggggaccgtgggaccggcggggatccgaggaccacagggacatcaagggccggccggccccccaggacctcccggacccccaggccctccaggcgtgtccgggggcggctatgattttggttacgacggtgacttttatagagctgatcagcctagaagcgccccatcgttaaggccaaaggattacgaagtagacgcaactctaaaaagcctgaacaaccagatcgagacactactgactcccgaaggcagccgtaagaacccagcccgcacgtgccgggatctgagactgtcacatcccgaatggtcatccgggtattactggattgatcctaatcaaggctgcactatggacgctattaaagtctattgcgacttcagcaccggagagacttgtattagggctcagcccgagaacatccctgccaaaaactggtatcgctcttctaaggataagaagcatgtttggctgggcgaaaccatcaacgccggttcccagttcgaatataacgtggaaggggtgacatccaaggagatggcaactcagttggccttcatgagacttctggctaattatgcaagccagaacatcacctatcactgcaaaaactccattgcatacatggacgaggagactggcaatttaaagaaagctgtaatcctgcagggaagcaacgacgttgagttggtggcagaaggcaactctcgctttacatacacagtcctggttgacgggtgttcaaagaaaacaaatgaatggggaaagacaattatagaatataaaaccaacaaaccttctagattgcccttcctggatatcgcacccctggatattggcggggccgaccaggagtttttcgtggatatcgggcctgtgtgcttcaaa

SEQ ID NO: 32457 - DNA, 4098 bp, Artificial Sequence
  Description of Artificial Sequence: Synthetic coding sequence
atgctgtcattcgtggacacgcgtaccctcctgctgctggcggtgaccctgtgtctcgccacctgccaatccctccaggaggaaactgtcaggaaaggtccagcgggggacagaggaccacgcggcgaacgaggtcctcctggcccgccgggtcgcgacggagaggatggtccgactggcccaccaggacccccaggtccaccgggtccgccaggactcggaggtaattttgcagctcagtacgatggtaagggggtgggactcggcccgggtccgatgggactgatggggccccgaggcccaccaggcgctgccggtgccccgggtccgcaagggtttcaagggccagctggagagccaggtgaaccgggacaaaccggtccagccggcgcgcgaggccctgccgggccaccaggaaaagctggagaagacgggcatccgggaaagcctggccgcccaggggagcgcggagtcgtaggtccccagggagctcgcggttttccgggaaccccgggcctgccggggttcaagggcattcgaggtcacaacggactggacggtctgaagggacagccaggggctccgggagtcaagggagaacctggggcccccggggaaaacggaacccctggccaaactggcgcccgcggcttgcctggggaaaggggtagagtgggggcaccgggaccagccggtgcccgtggaagtgatgggtcggtgggtcccgtgggacccgccggaccgatcggttccgctggtccacccgggttccccggagcgcctggccccaagggggagatcggagctgtcggaaatgccggcccagcgggaccagcaggtccgcggggcgaggtggggctgccaggtctgtccggccctgtgggtccgccgggaaacccaggagctaacggcctgacgggggccaagggggctgcgggcctgcccggcgtcgcaggagcgcctggactgccgggtccgcggggaatccctggacctgtgggcgccgccggagccaccggagcccggggactcgtcggcgagccagggccggcagggtccaagggggaatcaggaaacaaaggagaaccgggctcagccggacctcaaggccctcccgggccttccggcgaagaggggaaacgcggccccaacggcgaggccggtagtgccggaccgcctggtcccccgggactccgcggatcaccgggaagccgggggttgccaggagccgatggacgcgccggagtaatgggccctccaggatcgagaggagcgtcaggacccgccggtgtgcgcggtcccaacggtgatgccggaagaccgggcgaacctgggctcatggggccacgtggactgccaggaagccctggaaacatcggcccagcaggtaaggaggggccggtcgggcttccgggcatcgacggacgtcctggaccgattggaccggccggcgctcgtggcgagccgggaaatatcggtttccctggacctaaaggaccgactggggaccctggaaagaatggcgacaagggacatgctggcctggccggtgcacgcggagcgccgggtccagatggtaacaatggagcccagggacctccgggaccgcaaggagttcaggggggcaagggtgagcagggaccaccagggccgcctggattccaaggactgccgggaccatccggtccggcaggagaagtcggcaagcccggagagcgaggactgcacggcgaattcggattgcctggaccagccggcccgagaggcgagagaggccctccaggcgaatcgggcgcggcagggccgactgggcctatcggatctcgcggaccaagcggcccacctggaccggacggaaataaaggagaacccggggtcgtaggcgccgtgggaacggccggccctagcggtccttcaggcttgccgggtgaacgcggagctgcgggcattcccggaggaaaaggagaaaaaggagaaccaggcctgcgcggggaaatcggaaacccagggcgcgatggagcgcgcggagcgccaggggctgtgggcgcgcctggaccggcgggggccacgggcgatagaggagaggctggagcagccggtccagcagggcccgctggcccgcgaggctcgccaggcgagaggggagaagtgggcccggctgggccgaacggcttcgcaggacctgcgggtgcagcgggacagccgggagccaagggcgagcggggcgccaagggacctaagggtgaaaatggtgtggtggggcctaccggacccgtcggcgctgcaggccctgctgggccaaacggaccgccgggaccggcaggcagccgcggtgacggagggcctccagggatgactggatttccgggggcagcaggaagaactggacctccgggcccgtccgggatctcgggaccccccggacccccgggcccggcgggtaaggaaggactgcgcggaccacggggtgaccagggaccagtgggcaggaccggggaagtgggggcagtgggccccccgggattcgctggagaaaaaggcccgagcggagaagctggaaccgccggaccgcccggaactccgggcccgcagggactgttgggagcgccgggaatcctgggcctccctggctcgagaggagagagagggctccccggggtggccggcgccgttggagagcctgggccgctcggaatcgcaggaccgccaggggctcgcggtcctcccggagcggtgggatccccaggagtgaacggggcgccgggagaagcgggccgggatggaaatccgggtaacgatggaccgccaggacgcgacggtcagccaggccataagggcgagagagggtacccgggaaacatcggaccggtgggcgccgcgggggctccggggccgcacggcccggtggggccggccggaaagcacggaaaccggggagaaactggaccgtcgggcccagtggggccggcaggcgccgtcggcccaagggggccctcgggacctcagggcattcggggggataagggcgagcctggagaaaagggaccgcgggggttgccgggacttaagggccataacggacttcaaggactccccggcatcgcgggacatcacggtgaccaaggggcacctggatcggtgggtccggccgggccccgcggccccgcagggccgtccggaccggcaggaaaggacggacgtaccggccaccctggcaccgtgggaccggcgggaatccggggaccgcagggacaccaaggtcccgccggacccccagggcccccaggaccgcccgggccacctggcgtcagcggcggaggatacgacttcggttacgacggcgacttttaccgggcggaccaaccaaggtcggcaccgtcgctccgcccaaaggattacgaagttgacgccactctgaagtcactcaacaaccagatcgaaacccttctcaccccagagggctctcggaagaatcctgcccggacttgtagggatctgcggttgagccatccagaatggtcgagcgggtactactggattgatcctaatcagggttgcactatggacgccatcaaagtctactgcgatttctccacgggcgagacttgcatccgggcccagcccgagaatatcccagcaaagaactggtaccgctcatcgaaagacaagaaacacgtgtggcttggtgaaactatcaatgccggctcccagttcgagtataacgtggaaggcgtcacctcaaaggagatggccacccagctcgcgttcatgcggttgctggctaactacgcatcgcagaacataacctaccactgcaagaactccattgcgtacatggacgaagaaaccgggaatctgaagaaagctgttatcctgcagggatccaatgacgtggagcttgtcgcggagggaaatagccggttcacctatactgtcctggtggatggatgctctaagaagactaatgagtggggcaaaaccattatcgagtacaaaactaacaaaccctcgcggctgccgtttctggacatcgcgcccctcgacatcggaggagccgaccaggagttcttcgtggatatcggtccggtttgtttcaag

SEQ ID NO: 32458 - DNA, 4098 bp, Artificial Sequence
  Description of Artificial Sequence: Synthetic coding sequence
atgctgtcctttgttgatactaggacgctgttgctactcgcagtaaccctatgtctggccacttgtcaatcattacaggaggagacagtgcgcaaggggcctgccggagatcggggtccccggggtgaacgcgggccaccgggtccaccagggagagatggagaggatggcccaacaggtcctcccggtccccctggtccccccggaccccccgggctgggcggcaattttgctgctcaatacgacgggaagggtgtcggccttggccctgggcctatgggactcatgggcccccgcggccccccgggcgccgcaggagcccccgggccccaggggtttcagggtcctgccggagaaccaggagaaccagggcaaaccggacccgcaggagctaggggtccagcaggcccccccggcaaggccggcgaggacggccaccctggcaaacccgggcgacccggcgagagaggagtcgttggccctcaaggggcccgtggattcccagggacaccaggcctacccggcttcaaggggatcaggggacataatgggttggatggcctgaaaggccagcccggagcccctggtgtcaaaggggaacccggagcaccaggagaaaatggtacacccggccagacgggcgcacgcggcctgcctggcgagaggggccgggtgggagcccccgggcccgctggggctcgcgggtccgacggctctgtgggcccggtagggccagcaggacccatcgggtccgctggaccccccggcttcccaggggctccgggccctaagggagagatcggtgccgtgggaaacgctggccccgccggcccggccggtccccggggtgaagttgggcttcccgggctttcaggaccagtgggaccgccaggaaacccgggagcaaatggccttacaggtgccaagggcgcagctgggcttcccggagtggccggcgcgccggggctgccagggcctcgtggcatccccggtcctgttggggccgcgggcgcgactggggcccgcggtcttgtgggggagccaggtccggcgggttccaagggggagagcggtaataagggagagccaggaagtgctggcccacagggccctcccggcccctcgggagaagaaggaaagaggggcccaaatggagaagccggtagcgctggcccacctggccccccagggctgaggggaagccccggtagccggggtctccctggtgctgatggacgcgcgggagtcatgggtcccccagggagcagaggggcctccggaccagcaggcgtcaggggacccaacggggatgcgggacgaccaggtgagcctgggctgatggggccaaggggcctgccaggatctccaggcaacatcggcccggcaggcaaggaaggccccgtgggcctgcctgggattgacggacggcccggacctatcggtcccgctggtgcgaggggcgaaccaggcaacatcggctttcccgggcctaagggaccaactggggaccctgggaaaaacggggataaggggcacgcaggcctcgcaggggctcggggagcccccggaccagacgggaacaacggagctcagggccccccaggaccgcaaggcgtgcaaggcggaaagggcgaacaaggcccaccagggcctccgggcttccaaggcctgcccggaccaagtggacctgctggagaggttgggaaacccggcgaaagggggctacacggagaatttgggctgcctgggccggcggggccccggggcgaaagaggaccccccggtgagtctggggccgcaggtcccaccggtccaatcggctccaggggaccatctggtccaccaggcccagatgggaacaaaggagagccaggagttgtgggcgccgtgggcacagcaggtcctagcggtccaagcggcctccctggcgagcggggggcggcgggcattcccggagggaaaggggagaagggtgaacctgggctgcgtggcgaaatagggaatcctggccgtgacggagcaagaggtgcacctggagccgtgggtgctccggggcctgcgggcgccacaggtgacaggggcgaggccggggccgccggccccgcgggccccgccggcccaagaggatcacccggtgaaagaggggaggtgggccccgctggtccaaatggctttgccggacctgctggggcagctggccagccaggcgccaagggtgagcgaggtgctaagggacctaaaggggagaacggtgtagtaggccccacaggccccgtgggggcggcaggaccagcgggtcccaacggcccaccaggccccgccgggtccaggggcgacggtggccctcccggaatgacaggatttccgggggctgctggtcgaacgggcccaccggggcccagcggcataagcggaccaccagggcctcccggcccagcaggcaaggagggactacgtgggccccgcggagaccagggccccgtgggccggacgggcgaagtcggtgccgttggcccccccggattcgctggtgagaagggcccttctggggaggcaggcaccgcgggcccacctggcacaccaggcccacagggcctgctaggcgcgccaggtatcctcggcctccctggatcacggggagagagaggactgcccggtgtggccggggcagtgggggaacctggtcctctcggcatcgcagggccgcctggcgcccggggccctcccggtgccgtgggcagccccggagtgaacggtgctcctggtgaagctgggcgagacgggaatcccggcaacgacggtccccctggcagggatggtcagcccgggcataagggcgaacgcggatatcctggcaatatcggccctgtgggtgctgcaggcgccccgggaccccacgggccagtgggaccagcggggaaacacggaaatcgtggcgagacaggtcccagtggcccagtaggacccgcaggggctgtgggcccccgaggacctagcggtcctcagggaattagaggggataaaggggagcccggggagaaggggccccgcgggctgccaggtctgaaaggacacaatgggctgcagggccttcccggaatagccggacatcatggggatcagggtgcaccagggagcgtgggtccggcgggaccacggggccccgcagggccctcaggacccgctgggaaggacgggaggacaggtcatcccgggacggtgggacctgccggaataagaggccctcagggccatcaggggccagcagggcccccggggcccccaggccccccaggacctccaggcgtctcagggggggggtacgattttggttacgatggggatttttaccgggctgaccagcccaggtctgcgccgagccttcgaccaaaggactacgaggtggacgctactcttaagtctttaaacaatcagattgagaccctgctgacaccagaaggctcgcgcaaaaatcctgctagaacctgtcgcgacctgcggctcagccacccagagtggagctccggttactattggatagaccctaaccagggttgtaccatggacgctattaaggtctattgtgattttagcacgggcgaaacatgcataagagcgcagcctgaaaacattcccgctaagaattggtacagatccagtaaggataaaaagcacgtgtggttgggcgaaacgattaacgccggtagccagttcgagtataacgtcgaaggtgtaaccagcaaggagatggctacgcagctggcgtttatgaggctgctggctaactatgccagtcaaaatattacttaccattgcaagaattctattgcctacatggatgaggagacagggaatctcaaaaaagcagttattcttcagggctccaatgacgttgagcttgtcgccgagggcaatagccgatttacctacaccgtactggtagacgggtgttccaagaaaactaatgagtggggcaagactatcattgaatataaaactaataagcccagccgactgccattcttagatatcgcccccctggacatcgggggcgctgatcaggagttctttgttgacatcggacccgtgtgttttaag

SEQ ID NO: 32459 - DNA, 4098 bp, Artificial Sequence
  Description of Artificial Sequence: Synthetic coding sequence
atgctatcgtttgtggatacccgtactcttcttctcttagctgtgaccctgtgcctcgctacatgccagtcgctccaggaggagacggtaaggaagggcccagcaggggatcggggtccgcgaggggagcgaggtcctcccggccctcctggcagggacggcgaggatgggcccacaggtccaccaggacctcctggtccccctgggccccctggcctcggtggaaacttcgcagcacagtacgatggaaaaggggtgggcctaggtcccggccccatgggcttgatggggcctcgaggcccacctggcgctgcgggcgcacccggtccccagggattccaggggccggccggagagccaggcgagccaggccagacggggccggcaggcgcaaggggcccagcgggtccaccagggaaagctggtgaagacggccacccaggaaagcctggcaggccaggggagcgtggcgttgtgggcccacagggggccaggggtttcccgggcactccagggctacccggatttaagggtattcgtggccataatggcctcgacggcttaaagggtcagcctggagcccctggcgtgaagggcgagcccggggcccccggcgagaatggaaccccaggccagacgggagcccgtggcctgcctggagaacggggacgcgtcggggcacctggtccggccggtgcccgcggaagtgatggtagtgtcggtccggtaggccccgccggccctatcggctccgctggcccccccggcttcccaggcgccccaggacccaagggagagatcggtgccgtgggaaatgccggaccagctgggccagcagggccaagaggagaggtgggtttaccaggcctaagtggtcctgtcggacctcccggcaaccctggggctaatggccttacaggagcaaagggagctgctggcttgcccggtgtagccggcgcacccggactgcccgggcccaggggcatccccggcccagtgggcgctgcaggtgcgacaggagctcggggtctggtgggagagcccgggcctgcaggttcaaaaggtgagagtggcaataagggggagccgggctctgccggtcctcaggggccacccggaccaagcggagaggagggaaaacgtggccctaacggcgaggcgggctcagccggacctcccgggcctccagggcttcggggttcacccggcagccggggcttgcctggcgctgatggccgggcgggggtgatgggaccacctggaagtagaggggccagtggtcccgcaggcgtgagagggcccaatggggacgcgggcaggccgggtgagcctggtttgatgggcccaagaggattgcccggatccccagggaacatcggacccgccggcaaggaaggcccagtgggcctccccggcatcgatggtaggccaggccccatcgggcccgccggcgcacgcggagagccgggcaatattggttttccagggcctaagggcccgacaggtgaccctggaaagaacggtgataagggtcacgcaggattggccggtgctcgaggtgcaccgggccccgatggcaataatggagctcagggcccccctggcccacagggtgttcagggaggcaaaggggaacaaggccctcctggcccacccggattccaaggcttgcccgggcccagcggacccgccggcgaagtggggaaaccaggcgagcgaggactccatggagagtttggattgcctggccccgcggggcccaggggcgaaagaggcccaccaggcgagagtggcgcagccgggcctactgggcccattggatctcgagggccctccggtcctcccggccctgacgggaacaagggggaacctggggttgtcggagcagtgggtaccgcaggcccttcaggtccatcagggttgccgggcgaaaggggtgctgccggcatcccgggagggaagggagagaagggtgagcccggcctgagaggagagataggtaatcccggtcgagatggagccagaggtgctcctggtgccgtaggggcacctggaccggcaggggctacgggcgaccgcggggaggcaggggccgctggccccgctggaccagccggcccaaggggcagcccaggggagagaggagaagtaggtcctgcgggaccgaatggcttcgccggacccgctggagccgctggtcaacccggcgctaaaggggagaggggggccaagggaccaaagggagaaaacggggtggttggtccaactggccctgttggagccgccgggcccgcagggcccaacggtccacctggcccagccggtagtagaggagacgggggccctcctggcatgacagggttccccggtgcagcggggagaactggtcccccaggacctagtgggatcagcggacccccagggcctccagggccggctgggaaggaaggattgagggggcctagaggtgatcaggggccggtgggacggacgggcgaggtaggcgcagtgggaccgccagggtttgctggcgaaaaaggacccagcggagaggccggtacagcagggccaccgggcacacctgggccccagggcctgctgggcgctcctggaatcctcggactgccaggcagtagaggtgaacgcggacttcccggcgttgccggagctgtcggggaaccaggcccgctgggtattgctggccctccaggagcgcgcggcccccctggcgctgtgggatccccaggagtgaatggggctcctggggaagctgggcgtgatggtaatcctggtaatgatggcccccccggtagggacggacaacctggccacaagggcgagcgcggttacccgggcaatatcgggcccgtgggggccgccggggcgcccggtcctcacggcccggtgggacctgcaggcaaacatggcaaccgcggtgagaccgggccctcaggccccgtaggaccagcaggtgctgtgggaccaagaggtccaagtggacctcagggaatcaggggagacaaaggtgagccaggcgagaagggtcctagggggctcccaggactgaagggtcataacgggctgcagggtttgccagggattgctggacaccacggcgaccagggagcgcctggttctgtgggacccgctggcccccgcggtcccgcgggaccatctggaccagccggtaaagatggtcgtactggtcatccaggcactgtaggcccggccggaatcagagggccccaaggccaccaaggtccagcaggacccccgggcccacctgggccaccaggaccacccggggtgagcggaggtggatatgatttcgggtacgacggggatttttatagggctgaccagccccgcagcgccccttccctgagacctaaggactatgaggtcgacgcgacactgaaatcgctcaacaatcagattgaaaccttgttaactccagaaggctcacggaagaaccccgccagaacctgtagggaccttagacttagtcatccggaatggtccagcggatattactggatagatcccaatcagggctgtactatggacgcaataaaggtgtattgcgatttttcaacaggagagacttgcattcgagcgcagccggagaacattcctgcaaaaaactggtaccgttccagcaaggacaagaaacacgtgtggttgggcgaaactattaacgccggttcccagttcgagtacaatgtggagggagtgacatcaaaagagatggccactcagttggcttttatgcggctgctggctaattatgcgtctcagaacatcacctaccattgcaaaaacagcatagcctatatggacgaggagaccggtaatctgaagaaagccgtaatcctccaaggtagtaatgatgtggagctcgtcgctgagggcaacagtcggttcacttatactgtcctggtggacgggtgcagtaagaagacgaacgaatgggggaagactatcattgaatataagaccaacaagccctcgaggttgcccttcctggatattgcccctctggatataggcggagccgatcaggaattcttcgtcgacatagggccagtgtgcttcaag

SEQ ID NO: 32460 - DNA, 4098 bp, Artificial Sequence
  Description of Artificial Sequence: Synthetic coding sequence
atgctgtccttcgtagatacccggacattattgctcctcgctgtcactctttgtttggctacttgtcagtccttacaagaagagaccgtgcggaaaggcccggctggtgacagaggcccacggggagaacgcggccccccaggcccaccgggccgggacggtgaagacggtcccaccgggccaccgggccctccagggccaccgggccctcccggcttagggggtaacttcgctgcccagtatgacggcaaaggtgtgggtctcgggccggggccaatgggtttgatggggcccaggggccctcccggagctgcgggggcccctggtcctcaggggttccagggaccagcaggtgagccgggggaaccaggccaaacgggccctgccggcgctcggggcccagccgggccgcccggcaaggctggcgaagatggccaccctggcaagcccggaaggcccggcgaacggggcgtggttggacctcagggggcccgagggttcccaggcactcccggactgccaggctttaaagggattcgcggtcacaatgggttggatgggctaaaaggacagcctggggccccaggcgtcaagggggagcccggggcccccggagaaaacgggacacctgggcaaacaggtgcccgcggtctacctggcgaacggggccgtgtcggtgctccgggcccagccggggctcgtggcagtgatggctctgttgggccagtgggtcctgcagggcccatcggatctgcgggtcctccaggattcccaggagctccaggacctaaaggggaaattggagcagttggcaatgccggcccggcgggacctgcgggaccccgcggggaggtgggcctccctggcctcagtggaccagtcgggccccctggtaatcccggcgctaacgggttaacgggggctaaaggagctgcaggtttacctggcgtggccggagcaccaggcttgcccgggcctcggggaattcccggccccgtgggggctgccggagcaacaggggccagggggttagttggggaacctggacctgccgggagcaagggcgagtcgggaaataagggggagccgggaagcgccgggccgcaaggacctcctgggcccagcggtgaggaaggaaaacgggggccaaatggagaagcaggttcggctggccctccaggcccacctggactgaggggctctccaggcagtagggggctccccggcgctgatggtagagcgggcgttatgggccccccagggtcacggggggcttccggccccgcgggcgtcaggggtccaaatggcgatgccgggcgccctggagaacccggcctaatgggcccccgcggcctgcccggctcgccaggaaacatcggaccagctggcaaggaggggcccgtgggcctcccaggaatcgacggaagaccaggtccaattggtcccgccggggcccggggagaaccagggaacatcggatttccagggcctaagggcccaacgggcgaccccggcaaaaatggcgacaaagggcacgccggcctggcaggagcaagaggcgctcccgggccggatggcaacaatggcgctcaggggcccccgggaccccagggagttcaagggggaaagggggaacaggggccaccaggtccccctggctttcaaggccttccgggaccttcaggtcctgctggtgaagtagggaagccgggcgaacggggccttcacggagagttcggtctccccgggcccgcaggtccccgaggggagaggggcccccccggcgagagcggcgccgcaggccccactgggcctatcgggtcccgaggaccttccgggccaccgggaccagatggaaataagggagagccaggagtggttggcgctgtgggaacagcaggaccatcaggaccgagcggcctgcctggggaaagaggtgcagcagggatccctggtggcaaaggagagaagggggagcccggcctgcgcggagaaatcggtaatcccgggcgggatggggctaggggcgccccaggggctgtgggagcccctgggccagccggcgctacgggggacagaggcgaagcaggggctgcaggaccagcaggacccgctgggcctcggggaagcccgggggaaagaggagaggttggccccgcgggccctaatggctttgccggcccggcaggggctgccgggcagcctggcgctaagggcgagagaggtgccaagggcccaaaaggcgagaacggcgtcgtgggacctacaggccctgttggagcagcaggtccggcaggacccaacggtcccccggggcctgcagggtctaggggggatggaggtcccccaggtatgaccggcttcccaggcgctgcaggccgaaccggccctcctggtccatcaggcatatccggtccccctggtcctcctggcccagccggaaaggaagggctccggggcccgagaggagaccagggcccggttgggagaacaggcgaagttggggccgtggggcccccaggatttgccggcgaaaaaggaccttcaggggaagccggcacagcagggccacctggaactcccggtcctcaggggctgctcggagccccagggattctgggtctgcccggtagtaggggagaaagaggattgccaggcgtggctggtgccgtgggcgagcctggacctctgggcatagccgggccgcccggagccagagggccaccgggagcagttggctctcccggcgtgaacggagctcccggggaagccgggagggatgggaaccctggaaatgacggtcctcccggcagagacggccagcctggacataagggcgagcgcgggtaccccgggaatatcggacccgtgggagcagcaggggctcctggaccacacggaccggtgggcccggccggtaagcatggcaacagaggagaaacgggccctagcggccctgtcggacccgccggagcagtgggaccacgaggaccctccggcccacaaggaatacggggtgacaagggtgaaccaggagaaaaaggtcctagaggcctgcctggccttaaaggtcacaatgggctacagggactgccgggcatcgccgggcatcacggcgatcaaggcgcccctggcagcgttgggccagctggaccacggggaccggccggaccctcggggcctgccggcaaggatggcaggacaggccaccctggtacggtgggtcctgcaggtattagggggccccaggggcatcaggggccagcggggcctcccggcccgcctggtcctcccgggcccccgggcgtttctggcggaggctatgatttcggttacgacggcgacttctaccgtgccgatcaacccaggagtgcaccgtccctgcgccccaaggattatgaggtcgacgccacactgaaatcccttaacaaccagatcgagacgctcctcactcccgaggggtctaggaagaatcccgccagaacctgccgtgatctgcggctgtcacatccagagtggtccagcggatactactggatcgatcctaaccagggatgcaccatggacgcaattaaagtatactgtgacttctccacaggagagacctgcattagagcgcagccggaaaatatacctgccaagaattggtaccgttctagcaaagacaaaaaacatgtatggctgggagaaaccattaatgccggctctcaatttgagtacaacgtcgaaggcgtgacatcaaaggagatggccacccaacttgccttcatgcgactgttggcaaattacgcctctcagaacattacgtaccactgtaaaaactctatcgcatacatggatgaagagacaggcaacctgaagaaagcagtgatccttcagggaagcaatgacgtggagctggtggcggagggaaattctcgcttcacttacaccgtgctggttgatggatgttctaagaagacgaacgagtggggaaagactattattgaatataagaccaataagccatcacggctcccctttctagacattgccccccttgatattggcggcgcggatcaggagttcttcgtggatataggaccagtctgttttaag

SEQ ID NO: 32461 - DNA, 4098 bp, Artificial Sequence
  Description of Artificial Sequence: Synthetic coding sequence
atgctgtcattcgttgacacgcgcacactgctgctgctggccgtgacgttgtgtctagccacctgccagagcctgcaagaggaaacggttcgtaagggcccagcgggtgaccgtgggccacggggggagcggggcccaccgggtcctccaggtcgagatggtgaggatggtccgaccggtccgccggggcctcctggtccaccgggaccgccagggctcggtggaaattttgcagcgcagtacgatgggaaaggcgtgggcttgggacctgggcctatgggcctgatgggtccacggggcccaccaggtgccgcgggcgcgcctgggcctcaaggctttcaggggccagcgggcgaaccgggtgaacctgggcagaccggtccagcaggcgcacgtggcccagcgggcccaccaggtaaagcaggtgaggacggccacccaggcaagccaggccggcctggagaacgcggcgttgtcggcccgcaaggtgcaagaggcttcccaggcacgcccggtctgccaggctttaaaggcatccgcggtcacaacgggctggacggcctcaagggccaaccgggcgcgccgggtgttaagggagagccaggtgcacctggcgaaaatggtaccccaggtcaaaccggtgcccgcggattgcctggcgaacggggtcgcgtgggggccccgggtccggcgggagctcgcggcagcgacggtagcgtcggcccagtggggccagccggcccgataggctcagcaggccccccgggtttcccaggtgcccccggccccaagggcgagataggggccgtgggcaatgcaggcccagcaggtcccgcaggcccacgcggcgaggtcggcctacctggtctaagcggtccagtgggcccacccggtaatccaggcgctaatggtttgaccggcgcaaagggcgctgccggcctgcctggcgtagcaggcgcacctggcttgccgggcccgaggggtatccctggccctgtcggtgcagcaggcgccaccggcgcgcgtggcctggtgggggagccaggtccggccggcagcaagggggagagcggcaacaagggtgagccaggtagcgcgggtccccaagggccgccgggcccgagcggtgaagaaggcaagcgaggtccgaacggcgaagcgggcagcgcagggcctccggggcccccaggattgcgcgggagcccgggatcgcgcggcctgcctggtgcggatggtcgcgctggggttatgggtccgccaggtagccgcggcgccagcggccctgctggcgtgcgcggtcctaatggtgacgcaggacgcccaggagagccgggcctgatgggcccgcgcggcctgccgggttcaccaggcaatattggaccagctggcaaagagggaccggtaggtctgccgggcatcgatggccgtccaggtccgattggtcctgctggtgctcgtggtgaaccaggcaatatcggttttccaggcccaaagggccctacgggcgacccgggtaaaaatggcgataaaggccatgctggcctggctggcgcccgtggcgccccaggaccggacggtaataatggggctcagggtccacctggcccgcagggtgtccaaggtggtaagggcgagcagggtccgccaggcccaccgggcttccagggcctgcccggtccgagtggcccagctggagaagttggaaagccaggtgaacggggtttgcatggagaattcggccttccgggacctgcggggccgcgcggtgaacgcggccctcctggagaatcgggcgcggcaggcccaaccggtccaatcgggtctcgaggcccatcagggcctccaggccctgacggcaataaaggtgagccgggggttgtgggcgccgtcggcacagcgggtccgagcggtccgagcggcctcccaggcgagcgaggcgcagcgggtatcccaggcggcaagggcgagaaaggcgaaccaggtctgcggggcgagatcggtaaccctggccgcgatggtgcgcgcggtgcgccaggcgccgtgggcgctccgggtccggcaggcgcgacgggagaccgcggcgaggcaggtgctgcggggccggctggtccagccggtccacgcggctcccccggtgagcgcggtgaggtggggccggccggtcctaacggtttcgcgggacccgcgggtgcagctggacaacctggagcaaagggcgagcgcggcgctaagggaccaaagggcgagaatggtgtcgtgggtccgacgggccctgttggggccgcggggccggccggcccaaacggcccccctggtccggcagggagcaggggcgacgggggccctcctggtatgaccggtttccctggagcggcgggtcgcactggcccgccgggtccttccggcatctctggtccgcctgggcctcctggccctgccggtaaagagggcctgcgcggtccgcggggcgatcaaggacctgtgggcaggacaggagaggtgggagccgtaggcccgccggggtttgctggcgaaaaaggtccatctggagaagcaggtaccgccggtccaccgggcactcctgggcctcagggtctgctgggtgcacctggcattttgggtttgccgggatctcgtggggagcgtggtctgccaggagttgctggggctgtgggtgagccaggcccgttgggcatcgcagggcctcctggagcaaggggcccccctggtgcggtggggtcccctggcgtgaatggtgcaccaggtgaagcaggacgcgatggcaatcctgggaatgacggcccgccggggcgtgatggacaaccgggtcacaagggggagcgaggctacccgggtaatatcggtccagtcggtgcggcgggtgcaccggggccgcatggtccagttggtcctgcgggcaaacatggaaaccgcggcgaaaccggtccgagcggcccggtcggtcctgcgggagcggtcggcccacgtggccctagcgggccacagggcattcgtggtgacaagggcgaaccaggggaaaagggcccgcgcggactgccagggctgaagggccataatggcctacagggtttgcctggcattgcagggcatcacggggaccaaggtgctccgggtagcgtgggcccggccgggcctcgcggcccagccggccctagcgggcctgcaggtaaagatggccgtaccggacatccaggaacagtgggccctgctggtatcagaggcccacagggccatcaaggacctgccggccctccgggtcctccgggcccaccagggccgccaggtgtgtctggaggaggctacgacttcgggtacgacggcgatttttaccgcgctgaccagccccggtctgcacccagcttgcgccctaaagactacgaagtagacgcaaccctgaaaagcctgaacaatcagattgagacgctgctcaccccggaaggtagccgtaagaatccagctaggacctgccgcgatctgaggctgtcgcaccctgagtggagcagcgggtattactggattgatccgaaccaaggctgtacgatggatgctattaaggtttattgcgacttcagtaccggcgagacttgcattagagcccaaccggaaaacataccagccaaaaactggtatcgtagcagcaaggataagaagcatgtgtggctgggcgagactatcaacgcaggcagccaattcgagtataacgtcgagggcgtgacgagcaaggagatggccacacagctggcatttatgcgtctgttggccaattatgcgtctcaaaacattacctatcactgtaaaaattccatcgcatatatggatgaggaaacggggaacctgaaaaaagcggtgatactgcaaggctccaatgacgtcgagctggtggcagagggtaatagccgttttacttacacggtgctggtggatggctgcagcaagaagaccaacgagtggggtaagaccatcatcgagtataaaacgaataagcctagcagactgccatttctggatatcgcccccctggacatcggcggcgccgaccaagaattttttgtggacatcggcccagtctgctttaaa

SEQ ID NO: 32462 - DNA, 4098 bp, Artificial Sequence
  Description of Artificial Sequence: Synthetic coding sequence
atgctgagtttcgtggatactagaacacttctattgctggcagtcactctgtgtctagctacgtgccagagtctgcaggaagaaacggtgcggaagggaccagccggagatagaggacccaggggggagagaggacccccaggcccccccgggcgggatggcgaagacggccccaccgggccgcccggccctcccggaccgcccggccctcccgggctcggcggtaactttgcagcacagtatgacggaaaaggagtagggttgggacccggccctatgggacttatgggcccacgagggccaccgggcgctgccggcgcccccgggccccagggatttcagggcccggcgggagagccaggtgaacctggccagactggacctgcgggggcccgcggcccagccggtccaccaggaaaggccggcgaggacggacacccgggaaaacctggaagacccggggagagaggcgtcgtggggcctcagggcgcaaggggcttcccaggtacgcctggtctgccaggctttaaagggatccgagggcacaacgggcttgatggcctgaaaggccagccgggggcccctggcgtcaagggggagccgggggctcccggagaaaacgggacaccgggtcaaacaggcgctcgggggctgccaggcgaacgcggccgtgtcggcgcacccggacccgctggagctcggggctccgacggaagtgtggggcccgtggggcctgccgggcccatcggatcagcaggaccaccagggttcccaggcgcccccggcccgaaaggagagattggcgccgtggggaatgctggtcctgctggaccagccggaccgcggggcgaagtgggactgccaggccttagtgggcccgtcggcccgcccggcaacccaggagccaatggtttaactggcgccaagggcgcagccggtttgcccggggtcgcaggagccccaggcttgccgggtccccgcggcataccaggcccagttggtgctgcaggagcgaccggtgccagaggactcgttggggagccagggccagccggcagcaagggagaaagcggaaataagggggagccgggtagcgcagggcctcagggcccccctggaccctctggcgaggaaggcaagcgcggacctaacggagaggccggctctgctggaccaccaggacccccaggactgaggggaagccctggatctcgcggtctgcccggggctgatgggagagccggcgtgatgggccccccgggctcgcgaggtgcatctggaccagctggggttcgcggacctaatggagacgctgggcgccccggagagccaggattgatgggaccaagagggcttccaggctcacccggaaatattgggcctgcaggcaaggaaggcccagtggggctccccgggattgatggtcggcctggtcctatcggcccagcaggggcgaggggggagcctggcaatatcggttttccgggacccaagggtccaactggcgatcccgggaagaacggggataagggtcatgctggacttgcgggagcccgaggcgcaccaggaccagatgggaacaacggggcgcaagggccccctggcccacaaggggtccaaggcggcaagggcgaacagggtccccccggtccgccagggtttcagggtttgcccggcccaagcggccctgctggcgaagtaggaaaacctggtgagcgcggtctgcacggcgagtttggtctccccggacccgctgggccccgaggtgagcgtggaccgcccggggagagcggcgcagcagggccaaccggtcccataggcagccggggcccgtctgggcccccaggacccgatggtaacaagggagaaccaggagttgtgggcgcagtaggcacagccggtccctccggcccgagtggactccctggcgagcgcggggccgccggaatcccgggaggtaagggggagaagggcgaaccggggctgcgaggggaaattggtaatcccggcagggatggcgcccgcggtgcaccaggcgccgtgggcgcacccgggcctgccggagcaaccggggaccggggggaggccggcgctgctggcccagccggtcctgccggtccgcgaggcagcccaggggagagaggtgaggtaggccccgctgggccaaatggtttcgccggtccagcgggcgctgcaggccagccaggcgccaaaggggagagaggcgcaaagggtccaaaaggtgaaaatggagtcgtcggcccaaccggccccgtgggagccgcaggtcccgcagggcctaacggaccaccaggcccagccggttctagaggggatggtggcccccccggtatgacaggctttccgggcgcagctggaagaaccggtccccccggcccgagtggcatctccgggcccccaggcccaccggggcctgccggcaaggaaggcttaaggggcccccgcggagatcaaggccctgtcggccgtactggcgaggtgggagcggtaggcccaccaggttttgccggtgagaagggacctagtggagaggccggaacagcgggcccccctgggacaccaggcccacaagggctccttggagcgcccggaatactcggtctgcctggtagccgcggagaaagaggcctccctggcgtagccggtgccgtgggcgagcctggaccgctgggcatcgctgggcctcccggggcgagagggccacccggggctgtcgggtctcctggggttaacggtgcaccaggggaggctggccgggatggaaacccagggaacgatggccccccaggacgtgatggacaacctgggcacaagggcgaaaggggctaccccggcaatatcgggcccgtaggagcggccggagcgcccggtccacatggacccgtaggcccagccggcaaacacggtaaccggggggaaaccggaccttccggccccgtaggacctgcgggggctgtcggccctcggggcccgagtgggccacaggggatcagaggagacaaaggagagcccggagaaaaagggccccgcggcctcccgggtttgaaaggacacaacggcctccaggggctgcctgggatagctggtcaccacggagatcagggagctcctggcagtgtaggcccagcaggcccaagaggtcccgccggcccgtctggccccgcaggcaaagatggacgcacagggcatcctggcaccgtcggtcctgccggaatcagaggcccccaggggcatcaggggcccgctggacccccggggcctccaggccccccaggtccacccggggtgtccgggggtggatatgacttcggatacgacggagatttttatcgggccgatcagccgcgctcggctcccagcctgcggcctaaggactatgaagtcgacgccacactcaaaagtttgaataatcagatcgagacactgctcacccccgagggaagtcggaagaaccctgcccgcacatgtagagatctgagactgtcacatccagaatggagctcgggttactattggatcgacccaaaccaaggctgtacaatggacgctattaaggtgtattgcgatttctcaactggggagacgtgtatacgagctcagcctgaaaacatcccagccaagaactggtatcggagcagtaaggataagaaacatgtgtggttgggagaaactattaatgccgggtcacagttcgaatataatgtggagggcgttacgtccaaggagatggcaactcagttagccttcatgcgactcctcgctaactatgccagtcagaatattacctaccactgcaagaattctatcgcgtacatggatgaagaaaccggcaacctcaagaaggccgtgattctccaaggctccaatgatgttgagctggtcgccgaaggcaactcccggtttacatacaccgttctggttgacggatgttctaaaaaaacaaacgaatgggggaagacaatcatcgaatataagactaataaaccatctcggctgccgtttttggacattgcccctctagatataggtggggcagatcaggaattctttgtggatataggccctgtgtgtttcaag

SEQ ID NO: 32463 - DNA, 4098 bp, Artificial Sequence
  Description of Artificial Sequence: Synthetic coding sequence
atgctctcgtttgtcgataccagaacccttctgcttttggcagtgactctttgtctggcaacctgccaatcacttcaggaggaaaccgtcagaaaaggcccagcgggggatagggggccgaggggagaaagaggtccccctgggccgccaggtagggatggggaagatgggcctactggaccgccagggcccccaggccctccgggccctcctggactcggcggtaacttcgctgcccagtatgatggcaagggcgtgggcctgggtcccgggcctatgggtcttatggggcctagaggcccacccggagcagccggtgcgccgggcccacaaggctttcaaggtcctgccggcgagcccggggagcctggacagacgggacctgccggagcgagaggaccagcaggcccacctgggaaggccggagaagatggccatcctggtaagccagggcgacccggcgaacggggcgtggtgggtccacaaggagccagaggttttcctggcactcccggtctgccgggatttaaggggatacgaggtcataatggactcgatggtttgaaaggacaaccaggagcccctggcgtgaagggtgagcctggtgccccaggcgagaacggtactccggggcaaactggagctagggggcttcctggggaacgtggtagggtgggggcaccgggtccagcaggtgcacgtggaagcgatggaagcgttggacccgtggggcctgcgggcccgatcggtagtgcaggtccccccggattccctggggcacccggtcctaaaggggaaattggggcggtggggaatgccggtccggctggccccgccggaccgcgaggggaagtgggtctgcctggactttcgggccctgtagggcctccggggaacccaggtgccaacggactgacgggagcgaagggcgcagcgggactccccggagtggccggagctccagggctgcctggtcctagaggaattcctggtccggtgggtgccgccggcgcaaccggagcgaggggactggtgggagaacccggtcccgcaggctcgaaaggagaatccggaaacaagggtgaacctggaagcgcgggaccacagggaccgccaggtccttctggagaagagggcaagagaggtcccaatggagaagcagggtccgcgggcccccctggcccacctggacttcgcggatcgccaggttctcgcggccttcctggtgcagatggacgtgcaggagtgatgggaccgcccgggtcccgcggagcatctggacctgctggggttagggggccaaacggagatgcaggtaggcccggtgaacctggtctgatggggccacggggtctgcccggcagcccaggcaacatcggcccggcaggtaaagaaggcccggttggtctgccaggtatagatggacgccctggtcccataggacccgccggagctagaggggagccaggcaacataggattccctggtccaaagggacctaccggtgacccagggaagaatggtgataagggtcatgcaggcctggcgggtgcgagaggtgcacctgggcctgacggaaataacggcgcacaaggaccccccggcccacaaggagtgcaagggggaaaaggtgaacaagggccacccggacccccaggatttcagggactgcctggcccgtcgggaccagcaggagaggtgggaaaaccaggggagcggggtttgcatggagagtttggacttcctgggcctgccggtccaagaggcgaacgaggtccgcctggagagagcggagccgcaggtcctaccggacctattggttcgcgtggcccaagcggaccccctggtccagacggaaataagggcgaacctggggtcgtcggagctgtgggtaccgcgggtccatcggggccatcgggacttccaggtgagcgcggagcagctggaattcctggaggaaaaggcgagaaaggagaacctggattgagaggagaaattgggaatcctggtagggacggagcaaggggagcgcccggtgcagtgggtgcgccaggtcctgcaggagcgactggcgacagaggggaagcaggcgcggcgggtcccgccggcccggcggggcctcggggtagccccggcgaaagaggggaggtcggaccagcgggccccaacggttttgcggggccagcaggtgccgcaggtcaacctggagccaaaggagagcgaggggcgaaaggacccaagggcgaaaacggagtcgtcggacctaccggaccagtgggggcagcgggccctgcgggacccaatggaccaccggggcctgctgggtcaagaggggacggaggcccaccagggatgaccggatttcctggagcagcaggccggaccggtccacctggaccatcgggaattagcggtcctcccggaccacccggaccggccggaaaggaaggactgcgggggccccggggagatcaaggtcccgtggggagaactggtgaagtgggagcagtggggccgcccggattcgcaggtgaaaagggccccagcggtgaagccggtaccgccggtcctccgggcactcctggtccccaaggactgcttggcgcaccggggattcttgggctgcccggttccagaggtgaaagaggcttgcctggagtggccggtgcggtcggtgagccaggaccactcggcatcgcaggtccacctggtgcaagggggcctccaggggcagtaggatccccgggtgtgaacggtgcccctggagaagccggaagagacggaaatcctgggaacgatggacctccaggtcgggatggacaacctggacataagggagaacgcggatacccaggaaacattggaccggtgggggcggcaggagccccaggtccacatggacctgtgggccccgctggtaagcatggaaaccggggagaaaccggaccatcgggtccagttggtccggcaggagcagtgggacctcgcggcccttccggtccacagggtattcggggtgataagggagagccgggagagaaggggccgcgagggcttccagggctgaagggccacaatggacttcaaggtctgcccggtatagccggacaccacggtgaccaaggcgcaccgggttcagtgggccctgcaggaccgagaggccctgcaggtccatccggccctgctgggaaagatggaagaactggacacccaggaaccgtcggtcctgccggaatcagaggcccccagggacaccaagggccggctggtccacccggcccacccgggcctcctgggcccccaggggtgtccggtggcggatacgattttggttacgatggcgatttctaccgtgctgatcagccaaggtcggccccgagcctgcgtcctaaggattatgaagtggacgcaactctgaagtcgctcaacaatcaaattgaaactcttttgaccccagaaggatcacggaagaacccagcacgcacgtgtcgcgatctccgactcagccatccggagtggtcatcgggttactactggattgatcctaaccagggatgtactatggatgcaataaaggtctattgtgatttcagcaccggcgaaacttgcatccgggctcagcccgagaatatcccagcgaagaattggtacaggtcctccaaggacaaaaagcacgtctggcttggtgaaaccatcaacgcgggttcccaattcgagtacaacgtggagggcgttacttcaaaagagatggccacccaactggcattcatgcgcctgctggcaaattacgcgagccaaaacatcacttaccattgcaaaaactcgatcgcatacatggacgaagaaaccggaaaccttaagaaagcagtgatcctgcaaggttcgaacgacgtggaactcgtcgcagagggtaattcccgatttacctacactgtgcttgtggatggatgctcaaagaaaactaacgaatggggaaaaaccataattgaatacaagaccaataagccatcaagacttccctttctggatatcgcacctcttgatatcggtggagcagatcaagagttttttgtggatattggaccagtgtgcttcaag

SEQ ID NO: 32464 - DNA, 4098 bp, Artificial Sequence
  Description of Artificial Sequence: Synthetic coding sequence
atgttatcatttgtagatacaagaactttattacttttagctgttactttatgtcttgcaacatgtcaatcattacaagaagaaacagtgcgaaaagggcctgctggtgatagaggacctagaggagagagaggacctccaggaccaccaggaagggacggagaagatggacctactggtccacctggaccaccaggaccaccaggtcctccaggattaggaggtaatttcgcagctcaatatgatggaaaaggagttggactaggacctggaccaatgggacttatggggccaagaggaccacctggagcagctggagctccaggaccacaaggatttcaaggtccagctggagagccaggagaaccaggacaaactggaccagctggggctagaggtccagctggtccaccaggtaaagcaggagaagatggtcatccaggtaaaccaggaagacctggagagagaggagttgttggaccacaaggtgctagaggatttccaggaacaccaggattaccaggattcaaaggtattagaggacataatggattagatggattaaaaggtcaaccaggagcaccaggagttaaaggagaacctggagcaccaggtgaaaatggaactccaggtcaaacaggagctagaggattgccaggagaaagaggaagagtaggagctccaggaccagcaggtgccagaggatctgatggatcagttggaccagttggtccagcaggaccaataggatcagcaggaccaccaggatttccaggtgctccaggtccaaaaggagaaattggagctgttggtaatgcagggccagctggaccagctggaccaagaggagaagttggactaccagggttatcaggaccagttggacctccaggaaatccaggagcaaatggattaactggtgcaaaaggagctgctggtcttccaggagtagcaggagctccaggattgcctggacctagaggaataccaggaccagttggtgcagctggagctacaggagcaagaggacttgttggtgaaccaggaccagctggatccaagggggaatcaggtaataagggagaaccaggatcagcaggaccacaaggaccaccaggtccttcaggagaagaagggaaacgaggaccaaatggagaggctggatcagcaggaccaccaggtccaccaggattaagaggttctccaggaagccgaggattaccaggagctgatggaagagcaggagttatgggtccacctggaagtagaggagcatcaggaccagctggtgttagaggtccaaatggtgatgcaggaagaccaggtgaaccagggttaatgggaccaagaggattacctggatcacctggaaatattggaccagcaggaaaggaaggacctgttggattgccaggaatagacggacgtccaggacctattggtccagctggtgctagaggtgaacctggaaacattggatttccaggaccaaaaggaccaactggagatccaggaaagaatggagataaaggacatgctggattagctggagcaagaggagctccaggaccagatggaaataacggagcacaaggaccaccaggaccacaaggagtacaaggaggaaagggtgaacaaggtcctcctggtccaccaggatttcaaggattaccaggaccatcaggtccagccggagaagtgggtaaacctggagaaagaggattacatggtgaattcggattaccaggaccagctggtccacgtggagaaagaggaccaccaggagagtctggagcagccggaccaacaggaccaattggatcccgtggtccatcaggaccaccaggaccagatggaaataaaggagaaccaggagttgttggagcagttggaactgctggaccatcaggaccaagtggtttaccaggagaaagaggagctgctggaattcctggtggaaaaggagaaaagggagaaccaggtttgcgtggagaaataggaaatccaggaagagatggtgctagaggagctccaggagctgtaggagctcctggacctgcaggtgcaacaggagatcgaggagaagctggagctgctggaccagctggaccagcaggtccaagaggatcacctggggaaagaggagaagttggacctgcaggacctaatggatttgctggacctgctggagctgcaggacaaccaggagctaaaggtgaaagaggagcaaaaggtccaaaaggtgaaaatggagttgttgggccaacaggtccagttggggctgctggaccagcaggtccaaacggtcctcctggaccagctggatcaagaggagatggaggtccaccaggaatgactggttttccaggtgctgctggaagaactgggcctccaggtccatctggtatttctggaccaccaggaccaccaggaccagcaggaaaagaaggacttagaggaccaagaggagatcaaggaccagtcggaagaactggtgaagttggagcagtaggtccaccaggattcgctggagaaaaaggaccatcaggagaagccggaacagccggaccaccaggaacaccaggaccacaaggacttttgggagcaccaggaattttaggattaccaggttcaagaggagaaagaggtcttccaggagttgcaggtgcagttggagaaccaggtccattgggaatagcaggtccaccaggagcaagaggaccacctggggcagttggaagtcctggagttaatggagcaccaggtgaagctggtcgtgatggaaatcctggtaatgatggaccacctggaagagatggacaaccaggacataagggagaaagaggatatccaggtaatattggtccagttggagctgcaggagcaccaggtccacatggaccagttggtccagcaggaaaacatggaaacaggggagaaaccggaccaagtggaccagttggaccagctggagctgtaggaccaagaggaccatctggaccacaaggtattagaggagataagggagaaccaggagaaaagggaccaagaggattaccagggttaaaaggacataatggtttacaaggattaccaggaattgctggacatcatggtgatcaaggagcaccaggatcagttggaccagctggaccaagaggtccagctggaccttcaggtccagctggaaaagacggtcgaactggacatccaggaacagttggacctgcaggtataagaggaccacaaggacatcaaggaccagctggacctccaggacctccaggaccaccaggaccaccaggggttagtggagggggatatgattttggatatgatggagatttttatagggctgatcaaccaagatcagcaccaagtttaagaccaaaagattatgaagttgatgctacattaaagtcacttaataatcaaattgaaactttattgactccagaaggtagtagaaaaaatccagcaagaacctgtagagacttaagactttctcatccagaatggtcatcaggatattattggatcgatccaaatcaaggatgtacaatggatgctattaaggtttattgtgatttttctactggagaaacttgtattagagcacaaccagaaaatattccagctaagaactggtatcgatcaagtaaagataaaaaacatgtctggttgggagaaactattaatgcaggatcacaattcgaatataatgttgaaggagttacttcaaaagaaatggcaacacaacttgctttcatgagacttcttgctaattacgcatctcaaaatattacatatcattgtaaaaattcaattgcttatatggatgaagaaactggaaatttaaaaaaagctgtaattttacaaggatcaaatgatgttgaattagttgctgaaggaaattccagattcacatatacagtacttgtggatggttgtagtaaaaaaactaacgaatggggtaaaacaattattgaatataaaactaataaaccttctagacttccttttttagatattgcaccattagatattggaggagctgatcaagaattttttgtagatataggacctgtttgttttaaa

SEQ ID NO: 32465 - DNA, 4098 bp, Artificial Sequence
  Description of Artificial Sequence: Synthetic coding sequence
atgctctcgttcgtagacacaaggacgttattgctacttgcagtaacgttgtgtcttgcaacgtgtcaaagccttcaggaggagaccgtccggaagggtcccgcaggggatcgggggccacgtggggagaggggtccacctgggccccctggccgagacggtgaggatggtccaactgggcctcctggtccacctggtcctcccggtccgcccgggcttggaggaaactttgccgctcagtatgacgggaaaggagtcgggctaggcccggggcctatgggcctcatgggtccgcgcggcccgcctggcgccgctggagcacccggacctcaaggctttcagggacccgctggagagcctggcgagccaggacaaacaggtcccgccggcgcgcgtgggccagctgggcctcctggtaaggcgggagaggacggtcacccgggaaagccaggacgtccgggtgagcgtggcgttgtcggtcctcagggggcgcgtggttttccagggactccgggactacccggatttaagggtattaggggtcataacggtctggacggcctgaagggccaaccaggcgctcccggggtcaagggagagcccggagcaccgggggaaaatggaaccccaggtcagaccggagcacgtggattgcccggtgagagaggacgcgtcggagcacctggaccggccggcgcccgtggatctgatggctcagtgggtcctgtcggtcccgcaggaccgatcggatcggcgggtcctcctggattccctggtgctcctggtccgaagggcgagatcggggccgtcgggaacgctggacctgctgggcctgctgggccacgcggcgaggtggggctccctggcctatcagggcctgttggtcctccaggtaacccgggagccaatggtctcactggtgccaagggcgcggccggactacccggcgttgccggagcacctggtttgccgggtcctcgtggaatcccaggcccagtcggagccgccggcgccacgggtgctcgtggactcgttggggagcccggacctgcaggttcgaagggagagagtggaaacaagggagagcctggttcagcaggaccgcagggccctcccggccccagtggtgaagagggaaagcgcggcccaaatggcgaggccggatcggctggtccacccggacccccaggactgcggggtagcccaggctcacgcggcctgccgggtgcggatggaagagctggggtcatggggcccccaggctcacgaggggctagtggtcctgctggagtgcgcggacctaacggcgatgctggccggcccggcgaaccaggtctgatgggaccccgtggactgcctggctctccgggaaatatcggcccggccggaaaagaaggcccggtcgggttgccgggtatcgacgggcggccaggcccaattggtcccgccggagcacgtggcgagcccggaaacatcggattccccggccccaagggccccacaggtgaccccggcaagaatggtgacaaaggacacgcaggtctcgcaggtgcaaggggtgcaccaggccctgatggcaacaacggagcccaaggcccccccggaccccaaggagttcaaggtggcaagggtgagcagggtccgcccggaccccccggttttcagggactgcccggaccgtcaggccctgccggtgaggtgggaaagccgggagagcgcggattacatggagagtttggcctgcccggccctgccgggcctcgcggcgagcgcgggcccccaggggagagtggcgctgccgggcccacaggacctatcggatcgcggggtccctctggccctccgggacctgatggtaacaaaggggagcccggcgtggtcggtgctgtgggaactgcaggacctagtgggcctagtggactccccggtgagagaggtgcggcaggtatcccggggggaaagggcgaaaagggagagccgggcctccgcggcgagattgggaatcctgggagagatggagcacgaggagcaccgggcgcggtgggtgctcctggccccgccggggcaacgggcgacagaggcgaggcgggcgcggccgggcctgccgggccagctggcccccggggttcgccaggcgagaggggtgaggtgggccccgcgggaccgaacggtttcgcaggtcctgcgggtgccgccggacaaccaggtgccaaaggggagcgaggcgccaagggcccaaaaggggaaaatggtgtggtagggccaactggccccgtgggagcggcggggcccgccggacctaacggcccccccggaccggccggaagtcgaggcgatggtgggccccctggcatgaccggcttcccaggggcggcgggccgcacgggaccgcccggaccctctggtatctcaggaccaccagggccgcccggccccgcaggcaaggagggcttaagaggcccaagaggggatcaggggcctgtcgggcgcactggtgaggtcggagctgttggtccacctggtttcgctggagagaaggggccgagcggggaggccgggaccgccggaccccctgggaccccaggcccccagggcttgttaggagcgccgggaatcctgggtttgcccggcagccggggcgagcgtggcctcccgggtgtggctggtgctgtgggcgagccagggcctctcgggatcgccggtcccccgggcgctcggggccctccaggagcggtcggttccccgggggtgaatggcgcacctggcgaggcaggccgggacggcaacccaggaaacgacggacccccaggtcgcgatggtcagccaggtcacaagggagaacggggatacccaggaaatataggtcctgtcggagcggcgggggcgcctgggccacacggacctgtcggacctgctggaaagcacggcaaccgaggcgaaacaggcccctctggcccagttggtccagcaggtgccgttggaccgagggggccttccggccctcagggtatccggggtgacaagggagaacccggagaaaaagggccacgtggattgccgggtttaaagggtcacaacggcctacagggcctaccaggaattgccggacaccatggggaccagggcgctccgggttctgttgggcctgcaggcccccgagggccagcgggaccctccggccctgctggcaaagatgggcggactggtcatcccggaacagttggtcctgccggaattcgcggtccccaaggacaccagggtccggcaggaccccctggccctcccggccccccggggcctcccggcgtctccgggggaggttatgatttcgggtacgacggcgacttctatcgtgcagaccaacctcggagcgccccatcccttcgaccgaaggactacgaagtcgatgctacacttaagtccctcaacaaccagatcgagactctattgaccccagagggctcccggaagaatcctgcccgaacttgccgtgacctccgattgagtcatccggaatggtccagtggttattattggatcgatcctaatcagggttgtactatggatgccatcaaggtgtactgcgatttttcgacgggcgaaacttgcattagggcgcagcctgaaaacatacccgcaaagaactggtatcgatcgtctaaagacaagaaacatgtctggctaggcgaaacaatcaacgctggctcgcaattcgagtataacgtcgaaggcgtcacgtcaaaagaaatggccactcaactggcttttatgcggctgctcgcaaactacgcgtcccagaacattacttatcattgtaaaaattccattgcatatatggatgaggaaactggtaatctaaagaaggccgtgatcttgcagggcagcaacgatgttgagctcgttgccgagggtaatagtaggtttacttacacagttctcgtcgatggttgttctaagaagaccaatgaatgggggaagacaattatcgagtataagactaacaagcccagccgcctaccgttcctcgatatcgcccctttggacattggaggggctgaccaagaatttttcgtggatatcggtccagtatgcttcaag

SEQ ID NO: 32466 - DNA, 4098 bp, Artificial Sequence
  Description of Artificial Sequence: Synthetic coding sequence
atgctgtcgttcgttgatacccggactctgttgctgctcgcggtgaccctgtgcctcgccacttgtcaatccctgcaagaagaaactgtgcgcaagggtccagcgggagatagagggccacgcggggagcgggggcctccaggtccacccggaagagacggggaagatggaccaaccggccccccaggtccaccgggtcctcccggcccaccaggactgggaggaaatttcgcagcccagtacgacgggaagggagtgggacttggaccggggccaatgggcctcatgggcccacggggcccgccaggagccgcaggagcgcctggtcctcaaggtttccagggcccggctggagagccgggtgagccgggacaaaccggaccggcgggcgcccgtggtccagcaggacccccggggaaggccggcgaggatgggcacccaggtaagcccggacgcccgggtgaacggggcgtagtcgggccacaaggtgcccggggatttccaggcaccccggggctgccgggcttcaagggcatccgaggacacaacggtttggacggactgaagggccagccaggagccccaggagtgaagggtgaacctggcgcgcctggggaaaacggtactccaggccaaaccggcgccagagggttgccgggcgagcgtggacgcgtcggcgctccgggcccggccggcgcgcgtggatcggacgggtcagtcgggccggtaggacccgccggaccgataggaagcgccggaccccccggattcccgggagccccgggcccaaagggcgagatcggcgccgtgggaaatgctggacccgcgggacccgctggacctcgcggggaggtgggcctccctggcctttcaggtccagttggacctccaggaaacccgggagcgaatggccttactggggcgaaaggtgcggctgggctcccgggggtggccggtgcccctggccttccaggcccaagaggcatccccggaccagtgggagcggccggagcaactggcgcacgaggactcgttggagaacccggcccggccgggtcgaaaggggaatctgggaacaagggtgaaccgggatccgcgggtccgcaaggccccccggggccttccggagaggagggaaaacggggaccgaacggcgaggcgggtagcgccggccctccgggaccaccaggactcagaggttccccgggtagccggggactgcccggcgcggacggaagagccggagtgatggggccgccagggtcaagaggggccagcggcccagcaggagtgcgcggaccaaacggagacgcagggcgcccaggagaaccaggcctgatgggaccacggggtctgccgggatcaccgggaaacatcggtcctgcgggcaaggagggaccggtgggcctgccaggcatcgacggcagacctggtccgatcgggcctgctggggcccgcggcgaaccggggaatatcggttttccaggaccgaaaggtccaacgggggatcccggaaaaaacggggacaaggggcatgcgggactcgcaggagcccggggtgcaccgggcccggacgggaataacggggctcagggaccgcccggaccgcagggagtgcagggaggaaagggcgagcagggacctccgggtccacctggattccagggacttcctgggccttcaggcccagccggtgaagtcggtaagccaggagagcggggcctccatggcgagttcggattgccgggtcctgccgggccgaggggcgagcggggccccccgggagagagtggtgctgccggcccaaccgggccgatcggctcgcgtggtccctcaggacccccagggccagacggcaataaaggagaacccggtgttgtcggcgcagtgggtaccgccggaccgtcgggtcctagcgggcttcctggggagcggggcgcagcgggcattccaggcggaaagggagagaagggcgagcctggactgcgcggggaaatcgggaacccgggacgcgacggagcccgcggagctccgggggccgtgggagcaccaggccctgcaggagcaactggagatcggggcgaggcaggcgccgcggggccggccggtcctgctggcccccgcggttcgcccggcgaaagaggtgaagtggggccggcaggtcccaacggattcgccggtcccgctggtgcggcaggtcagcctggtgccaaaggagaacgcggtgcgaagggaccgaagggagagaacggtgtggtgggaccgacggggccggtgggcgccgctggaccagccggacccaatggaccaccagggccagccggatcgcgaggagacggaggaccacctggcatgactggttttccgggtgcagcgggacggactggaccacctggaccgtcagggatcagcggaccaccgggcccgcctggcccagcagggaaggaaggcctccggggacctcggggcgaccaaggacctgtgggcagaaccggagaagtcggagcggtcggcccgcccgggttcgctggagaaaagggcccgtcaggtgaggccggcacggcaggtcctccgggtaccccggggcctcaaggcctcctgggagcaccgggcatcctgggcttgccgggatcgcgcggcgagcgcgggctgcctggagttgcgggagccgtcggagaaccaggtcctctgggaatcgccgggccccctggcgccagaggtccccctggggctgtgggatcgccgggtgtcaatggagctccaggcgaagcgggacgcgatggaaatccgggcaatgatgggccgccgggaagggacggccagccgggccataagggcgagaggggatatcctggaaacattggaccggtgggggcggcaggggcaccaggaccacatggacctgtgggacctgctggcaagcatggaaaccggggtgagacgggaccttccggcccagtgggccccgcaggtgcggtgggacctcgagggccttcgggcccacagggaattaggggcgataaaggggagcctggcgagaaaggcccgcgcggactcccggggctgaagggacacaatggactgcaaggcctccctggaatcgctggccaccatggagatcaaggagcgccaggatccgtcggtccagccggcccgcgggggcccgcaggcccatcaggtcccgcaggaaaagacggccgcactggccacccggggacggtcggaccggcaggcatcagagggccgcagggacaccagggacctgcgggacccccaggtcccccgggaccgccgggaccccctggagtgagcggaggcggatacgactttggatacgacggtgatttctatagggcagatcagccacgcagcgctccgagcctgaggccgaaggactacgaagtcgatgcgactttgaaatccctgaataaccagatcgagactctgctgactccagaagggtcgagaaagaacccagccaggacctgcagagatctcaggctgtctcacccggagtggtcgtcgggctactactggatcgatcccaaccagggatgcaccatggacgcgatcaaggtgtactgcgatttctccaccggcgaaacctgtatccgagcacagcccgaaaacatcccggcaaaaaactggtaccgcagcagcaaggacaagaaacacgtgtggctcggagaaaccattaacgcaggctcccagttcgaatacaatgtcgagggcgtcacctccaaggaaatggctacccagctggcgtttatgcggcttctcgccaactacgcctcgcagaacatcacttaccactgcaaaaacagcattgcttacatggacgaagaaaccggaaatttgaaaaaggccgtgatcctccaagggagcaatgacgtggaactggtggcggaaggcaacagtcgtttcacttacaccgtgctggtggatgggtgctccaagaaaaccaacgagtggggaaagactattatcgaatacaagactaacaaaccatcccggctcccgtttctggacatcgctcccctggacatcggaggcgccgaccaggaattcttcgtcgacatcgggccagtgtgtttcaag

SEQ ID NO: 32467 - DNA, 4098 bp, Artificial Sequence
  Description of Artificial Sequence: Synthetic coding sequence
atgctcagcttcgtggacacgcgaaccctgctgctcctggcggtgactctgtgtctggcgacctgccagtccttgcaggaagaaaccgtgcggaagggccctgctggagatcgcggaccgcgcggagaaagagggccaccaggaccgccaggcagggacggagaagatggaccaacgggccctcctgggccaccaggcccacctgggcctccgggattggggggaaacttcgccgctcagtacgatggaaagggggtcggtttgggacccggtccgatgggcttgatggggccgcggggaccaccgggcgccgcaggtgcaccgggccctcaagggttccagggaccagccggggagcctggcgaacctggacagactggtccagccggtgcgaggggacctgcggggcccccaggcaaggcgggagaggacggacatccaggcaagccgggcagaccaggtgaacggggtgtggtggggccgcagggtgccaggggctttccggggaccccaggccttccgggattcaagggaattcgggggcacaatggtctggacggactgaaaggtcagccgggtgccccgggagttaagggggagccgggtgcgcctggggaaaatggcactcccggacagactggagcccgtggcctgcccggcgaacggggcagagtgggggctccgggcccggcgggtgcacgcgggagcgacggatctgtgggaccggtgggccctgcgggtcctatcgggtcagccggaccacctggatttccgggggcgccaggaccaaagggggaaatcggcgcagtcggcaacgccgggccagccggaccagctggcccacgtggcgaagtaggcctcccgggtctttcaggcccagtgggaccgcctggcaacccgggagctaatggtctgaccggagccaaaggcgctgcagggctgccaggggtggccggagcgccgggactgccgggaccccgcggcattccaggcccggtcggagcggccggagccactggtgcacggggactggtgggcgagccaggcccggcggggtcgaagggggaaagcggcaacaaaggagagccgggaagcgcaggccctcagggtcctcctggaccctccggggaagagggcaaacgcggaccaaacggagaagccggatccgctggaccacccggccctcccgggctgcgggggtcaccaggaagccgagggttgccgggtgctgatggtcgggccggagtgatggggcctcctggttctcggggagcttcaggaccagctggagtgcgcgggccgaacggcgacgcaggccggccaggagagcccggcctcatgggacctcggggtctgcctgggtcgccgggcaacatcgggccggcaggaaaggagggaccagtcgggctccctgggatcgatggacgccctggaccaatcggacccgccggggcccggggagagccaggcaacatcggtttcccgggccctaaagggccaaccggcgatccgggaaagaatggagacaagggccacgcaggactggcgggggcgcggggagcacccggtcctgatggaaacaacggcgcccagggcccacccggaccgcaaggagtgcaaggcggaaagggagagcaagggccgccggggccgcccgggtttcaggggctccctggaccctctggaccggccggcgaggtcggtaaaccgggcgagcgcggccttcacggagaatttgggctgccgggtccggccggccctcgcggagagcggggccccccaggagagtcgggagctgcaggcccgactggacctatcggatcgagaggaccatccggtccgccaggacctgatggaaataagggcgaaccaggagtggttggggctgtgggtactgcaggaccttcgggaccgagcggtctgccaggagagcggggtgcagcagggatcccaggggggaagggagaaaagggagaaccgggactcagaggagagattggaaacccggggagggacggtgccagaggagcgcccggtgctgtcggagctccgggccctgcaggggccactggtgacagaggggaagctggagcggcaggacccgctggcccggctggaccgagaggaagcccaggggaacggggtgaagtgggaccggcgggacctaatggtttcgctggtcccgctggggcggccggccagcccggcgccaaaggagaacgcggagccaagggacctaaaggcgagaatggcgtcgtcggccccaccgggccagtgggagccgcaggacctgccggaccgaacggacctccgggtcctgctggatcgcgcggcgatggcggacccccgggcatgaccggttttccgggagcagcgggtagaactgggccccccggtccgtccggcatctccggaccgcctggaccaccaggtccggcaggcaaggagggactgcgcggaccgagaggtgatcaaggacccgtgggccggactggggaagtcggagctgtgggtccgccaggcttcgccggagaaaagggtccgtccggtgaggccggaactgctggtccaccagggaccccgggcccacaagggctgcttggagcaccaggaatcctcggattgccgggatcgcgcggggagcggggcctcccgggcgtagcgggagccgttggcgaaccgggaccactgggaatcgctggtccgccgggcgcgcgtggcccacctggtgccgtgggttccccgggcgttaacggggcaccgggagaggcgggccgcgacggaaaccccggaaatgacgggccgcccggaagagacggccaacctggacataaaggtgagagaggctacccgggaaacatcggtcccgtgggtgccgctggtgccccgggccctcacggccccgtgggaccggctggaaagcacggaaataggggtgaaaccggcccatcaggccccgtgggccccgctggcgcggtcggtcctcgcgggccttctggcccgcaagggatccgcggagacaaaggcgagccgggcgaaaagggaccgcgtggcctgccgggacttaagggacacaacggactgcaaggcctgcccggtatcgcgggtcaccatggcgaccagggcgcaccgggaagcgtgggacccgccggtccacgcggcccggcgggcccctcggggcctgccggcaaagacggaagaaccggtcacccaggaacggtcggccctgctggtatacgcggcccccagggacatcagggccctgccggccctccggggccccctggcccgcccggtcccccgggagtgtcgggcgggggatatgattttgggtacgacggcgacttctaccgcgccgatcaaccgcggagcgccccgtcgctgcgcccgaaggactacgaggtcgacgcgacccttaagtcgctgaataatcagattgaaactctcctcacccccgaagggtcaaggaagaaccccgcccgcacctgcagggatctgcggttgtcccatccagaatggagttcaggttactactggatcgacccgaatcaagggtgcactatggatgcgattaaggtctactgtgacttctcgacgggtgaaacctgtatcagagcgcagcccgagaatatccctgcgaagaactggtataggtccagcaaggacaaaaaacatgtgtggctgggggaaactatcaacgccggatcacaattcgaatacaacgtggaaggagtcacgtcgaaggagatggcgactcagctggctttcatgcgactgctcgcaaactacgcttcgcagaacataacctaccactgcaagaacagcatcgcatacatggatgaagaaaccggaaatctcaaaaaggcagtcatcctgcagggctcgaacgatgttgagctcgtggccgagggaaactcacgattcacttacactgtgttggtggacggatgctccaagaaaaccaatgaatggggaaagactatcattgaatacaaaaccaacaagccgtcgagactcccgttccttgacatcgctcccctggacatcggcggagcggaccaggaattcttcgtggatatcggaccggtgtgcttcaag

SEQ ID NO: 32468 - DNA, 4098 bp, Artificial Sequence
  Description of Artificial Sequence: Synthetic coding sequence
atgctttctttcgtggatactcggactctgctgcttcttgccgtaactctatgcctagctacatgtcagtcccttcaggaagaaacagtgaggaaaggacctgctggggatcgcgggccacggggagaacgagggccccccgggccccctgggagagatggggaagatgggcctacaggaccgcccgggccccctggaccacccggacccccaggactcggggggaattttgctgcccagtacgatgggaaaggggtcggactcggacccggaccaatggggttaatgggaccgcgaggacctccaggagctgctggagcaccaggacctcaggggttccaggggcctgcgggagaacctggagaacccgggcaaactgggcccgctggagctcgcggacctgcgggacctcccgggaaggccggagaagacggacatccaggaaaacctgggcggcctggggaacggggggtcgtcggaccacagggggccagaggattccccgggacaccagggctccctggattcaaaggaattcgcggacataatgggcttgatgggctaaaaggacaacccggagctcccggagtcaaaggagaacctggagctccaggagaaaatgggactccaggacagactggggctaggggattaccaggagaacgaggaagagtcggggcccccgggcctgctggggctagagggtccgatgggtcggtcggacctgtagggcccgcagggcccatagggtctgccgggccacccggattccctggagccccagggccaaaaggagaaatcggggcagtgggaaacgctggacccgccggaccagccggacctcgaggggaagtaggattaccaggattgtctggacctgtcgggccccctgggaatccaggagctaacggattaactggggcaaaaggggccgcagggctccctggggtcgcaggagcccctgggcttcccggacccagaggaatccctggaccagtgggagcagccggagctacaggggcacggggactcgttggggaacctggacctgctggatcaaaaggggaatccgggaataaaggggaacccgggagtgctggacctcagggacctcctgggccctccggagaagagggaaagagaggacccaacggagaagcagggtcagccggaccacccgggcctccaggacttagaggatcccctggatctagaggacttcctggagctgatgggcgagccggagttatgggaccacctggatcccgaggggcttctggacctgcaggggtgcgcgggcccaacggagatgccggacgtccaggagagcccggactcatgggacccagagggcttccaggatcccctgggaacatcgggcctgctgggaaggaagggccagttggactcccaggaattgatgggagacccgggcccatcgggcctgccggagcccgaggggaacccgggaatataggatttccaggacccaaaggacccactggggatcctgggaaaaatggagataaaggacatgctgggctcgccggggccaggggggcacctgggcccgatggaaataacggggctcaggggcctcccggaccccagggggttcaaggggggaaaggggagcagggaccccctgggcctccaggattccaggggctcccagggcctagtggacccgccggagaagtcgggaaacctggagaaagagggctccatggagaatttgggctgcccggacctgccggacctagaggagaacgaggacctcccggggaatctggagcagccggaccaactggacctatcgggtctaggggaccttcagggcctccagggccagatgggaacaaaggagaacccggggtagtgggagccgtggggactgcaggaccatccgggccttcagggctgccaggagaacggggggcagccgggatacctgggggaaaaggagaaaaaggagaaccagggttacgcggagagatcgggaaccctgggagggatggagctaggggggcccccggggctgtcggggcccctggacccgccggggcaacaggggataggggagaagccggagctgccgggcccgcaggacctgcgggaccaaggggaagtcccggagagcgcggggaagttggacctgcgggacctaatggatttgctgggcctgctggggcagccggacagcctggagctaaaggggaacgaggagcgaaagggccaaaaggggagaacggagttgtggggcctactggacctgtgggggccgccgggccagctgggccaaatggaccccccggacccgccggaagtcggggagacggaggacccccagggatgacagggttccccggagctgccggacgcactgggcctccagggccttctgggataagtgggcccccaggaccccccgggcccgctggaaaagaaggactgagaggacctagaggggatcaaggacctgtgggacgaacaggagaagtaggggccgtcgggccaccagggttcgccggggagaaggggccctcaggagaggccggaactgccgggccacctgggactcctggaccacaggggttactgggagcgccagggatactcggattgccaggatcacgaggagaacggggattacccggagtcgccggagctgtgggagagccagggcccctcggaatagccggaccccctggagcaagaggacctccaggggccgtgggatcaccaggagttaatggagctcctggggaagctgggagggatggaaatccaggaaacgatggaccacccgggagagatggacagcccggacacaaaggagagagggggtaccccggaaatataggacctgtgggagccgccggagcacccgggccccatgggcctgttgggcctgcagggaaacacgggaatcggggggagacagggccctctggaccagttgggccagctggggcagtggggccccggggaccttcaggacctcagggaatccggggagataaaggggaacccggagaaaaggggcccagagggttacctgggctcaaagggcataatgggctgcaggggttaccaggaatcgctgggcaccacggagaccagggagcccctggaagtgtaggaccagccgggcccaggggacctgctgggccatctggaccagcagggaaagatgggcgcacaggacatcctgggacagtcgggcccgccgggatacgggggccacaggggcatcagggacccgcaggacctccagggccccccggacctcccggaccccctggagtgagtggaggaggatatgatttcggatacgatggagatttttatcgggccgatcagcctcggagtgcaccctctcttaggcccaaagattacgaagtggatgcaacactcaaatcgttaaataaccagatagaaactcttctgacacctgaagggagtcggaagaatcctgctagaacatgcagggatttgaggttgtcccatccagaatggagttccgggtattactggattgatcccaaccagggatgcacaatggatgctataaaggtttattgcgatttttctactggagagacatgtattcgagcccagcccgaaaacatccccgcaaaaaactggtaccggtcatcaaaggataaaaaacacgtttggctaggagaaacaatcaacgccgggtctcagtttgaatataatgtagaaggagtcactagtaaagaaatggcaactcaactcgcgttcatgcgcttgcttgctaactatgcatcccagaacataacataccattgtaaaaattctatcgcttatatggatgaagagacagggaacttgaaaaaagctgtaatactacaggggagtaatgatgtcgaattagttgcggaaggaaattcaagatttacatatacagtgctagtggacgggtgtagtaagaaaacaaacgaatgggggaaaacaattattgagtataagacaaataaaccctcacgcctaccttttcttgatatagcccctcttgatatcggaggggccgatcaggagtttttcgttgatatcgggcccgtgtgcttcaaa

SEQ ID NO: 32469 - DNA, 4098 bp, Artificial Sequence
  Description of Artificial Sequence: Synthetic coding sequence
atgttgagtttcgtcgacacgaggacactgctactcttggccgtgactctatgcctggctacatgccagtctcttcaggaggagacggtcaggaagggaccagcaggcgaccggggaccccggggcgaacggggtcctccaggacctcccggccgtgatggtgaagatggaccaactgggccccccgggcccccaggtcctccaggcccccccggcctaggaggcaacttcgcagctcagtatgatggaaagggggttggcctgggccccgggcctatgggacttatgggacccaggggaccaccaggagctgccggcgcccccggccctcaaggcttccaaggtcctgccggagagcctggggaacctggccagactggccccgctggagctcgcggacccgcagggcctcccggcaaagcaggcgaggacgggcacccaggcaaacccggaaggccaggtgaaaggggagtcgtgggaccgcaaggggcccgaggattccccggtacgcccggactgccaggattcaaaggcattagggggcacaacgggctggacggcctgaagggccagccaggagcacccggggtcaaaggtgagcccggggcgcccggagagaatgggacccctgggcagacgggggcccggggcctccccggtgagcgcgggcgggtcggggcccccggcccagccggtgcccggggctctgatggaagcgtcggccccgtcggaccggccggtcccattggctctgctgggcctcccggattccctggtgctcctggacctaagggcgagatcggagccgtcgggaacgccggcccagctggacctgcaggacctagaggggaagtgggcttgccagggctgagcgggcctgtgggtccaccggggaaccctggcgcaaacggattaaccggcgctaaaggcgccgccggtctccctggcgtcgctggtgcacctggactcccagggcccagggggatacccggaccggtgggggccgcaggcgctaccggagcccgcggtcttgtaggggaacctggcccagccggcagtaaaggcgaatcgggcaataagggcgagcccgggtcagccggaccccaggggccccccggtccatccggggaggaagggaaacgtggaccgaatggtgaggccgggtccgcagggccccccgggccccccggtctccgcggcagccctgggtctcgtggcctgccaggcgcagatggacgagcaggtgtgatgggccctccgggctcgagaggggctagtggacctgcaggtgttcgcggcccgaatggcgatgccggccggcccggtgaaccgggactgatgggcccaaggggtcttcctggctccccggggaacatcggcccagcgggcaaggagggaccggtgggtctcccaggaatagacggcagacctggccccatcggtccagctggagcgcgcggcgaacccggtaatattgggtttcccgggcccaaagggccgactggcgatcctgggaagaatggtgataaaggacatgctgggctcgcaggggcccgaggggccccgggcccggacgggaacaatggggcacagggaccgccgggcccacagggcgtgcagggggggaaaggagagcagggaccacctggcccacctggttttcaggggcttccagggccttctggccctgctggagaggtggggaaaccaggcgaacgggggcttcacggtgaatttggtctacccggcccagctggcccccgcggcgagaggggtccaccaggcgagagcggagcagctggaccgactggcccaattggttccagaggccccagcggccccccaggacccgacggaaacaaaggcgaacctggagttgtaggcgccgtggggaccgccgggcctagcggcccttctggacttcccggtgaaaggggggccgcaggcataccaggtgggaagggggaaaaaggagaaccaggactccgtggcgagattgggaaccctggccgggacggagcccgaggagccccaggtgctgtgggtgcacccggtccagccggcgccactggtgacagaggggaagccggcgccgccggccctgccggaccagcaggccctagaggcagcccgggcgagaggggagaggttggcccggccgggccaaatggattcgccggccccgcaggcgccgctgggcagcctggtgcgaagggtgagcggggagccaaaggtcctaagggggagaacggcgtggttggccctaccggcccggtgggggctgctgggcccgccggacccaacggaccccccggccctgctggctcacgaggggacggcgggcccccaggcatgaccggtttcccaggcgcggcaggtcgaaccgggccaccaggcccttctggtattagtggtccgccggggccaccaggcccagcaggcaaagaaggactgcggggtcccaggggggaccagggccctgtggggaggaccggcgaggtgggagccgtgggcccaccaggctttgctggcgagaaaggtccatcaggagaggctggaaccgcgggacctcccggtacccctggcccccaaggcctgttgggggcgcccggcattctggggctgcccggatctcggggggagagggggctgcccggggtcgctggagcagtcggtgaaccaggacctttgggaatagcgggaccgcctggggccagaggtcccccgggggctgtgggctcacctggcgttaacggagcacccggtgaggccggtagagatgggaacccgggtaacgatgggccacctgggagagacggtcagccaggccacaaaggcgaacgagggtatccagggaacataggaccggttggcgcggccggggcccccgggcctcacggtcccgtgggcccagcagggaagcatggcaatcgtggggagacaggaccgtctggcccagttgggcccgcgggagccgtaggacctaggggtccaagtgggccccagggcattagaggcgataaaggggaaccgggcgaaaaaggaccgcggggacttccaggcttaaagggccacaacgggttacaaggactcccagggatcgccggccaccacggcgatcagggggctcctggttccgttggtccggctggtcccaggggcccggccggcccttccgggcctgctggcaaggatggcagaaccggccatcccggcacagtcgggccggctggaattagaggaccccagggtcatcagggccctgctggcccgcccgggccaccagggcctccaggaccgcctggagtttccggcggtggatacgatttcggttacgatggggatttctaccgagccgaccagcctagaagtgctccctctctgagacccaaagattatgaggtggacgcaaccctgaaatcccttaataaccagattgagactctgctaactcctgaggggtcgcggaagaatccggctcggacttgtagagacctcagactctctcaccctgagtggtcttccggatattactggattgacccaaaccaggggtgtaccatggatgctattaaggtttactgcgacttctcaacgggtgagacttgcatcagggcccagccagaaaacatcccagccaaaaactggtatcgatcgtcgaaggataaaaagcatgtgtggctgggggagactatcaacgcggggtcccagttcgaatataacgtcgagggagttacgtctaaagaaatggccactcaacttgcgttcatgcgtctcctggctaactatgcgtcgcagaatattacctaccactgcaagaactccattgcttatatggacgaggaaacaggcaacctcaaaaaagccgtgatattgcagggtagcaatgacgtagagttggtcgccgaaggaaacagccggttcacttataccgtgctggtggacgggtgctccaagaaaactaatgaatggggcaaaacaatcatagaatacaaaaccaacaagcccagccggctaccatttcttgacatcgctcctttggatatagggggcgctgaccaggagttctttgttgatattggcccggtgtgcttcaag

SEQ ID NO: 32470 - DNA, 4098 bp, Artificial Sequence
  Description of Artificial Sequence: Synthetic coding sequence
atgttgagtttcgttgatactagaactcttctactattggccgtgacactctgtctggccacctgccaatccttgcaagaagaaaccgtgcggaagggcccagcaggagatagagggcccaggggcgagaggggcccaccaggccctccgggacgtgacggtgaagatggacctacggggcctccagggccgcctggcccccccggaccaccaggcctgggcggcaatttcgctgctcaatacgatggaaagggggtcggactgggccctggcccaatgggcctgatgggccctcgcggacctcccggggccgccggcgccccgggaccacagggttttcagggaccagcaggcgagccaggtgaaccgggtcagacgggaccagccggcgcgcgcggccctgcaggtcctcctggtaaggcaggtgaggacggccacccaggcaaacccgggcgtcccggcgagcgaggggtggtgggacctcagggcgcacggggattccccgggacacccgggctccccggttttaaagggatccggggccacaatggcctggacggtctgaaagggcaacccggggctcctggggttaaaggagagcccggagcaccaggagaaaacgggactccaggccaaacaggggccagagggctcccaggagagaggggccgcgtgggtgccccaggacccgccggagctaggggttccgacggcagcgtaggccctgttggtcctgctgggcctattggatccgccggacctcccggcttccccggcgccccgggaccaaagggggagatcggggctgtcggtaacgctgggcccgccgggccagctggccctagaggggaggttgggctgcccgggctgagcggacccgtggggccccctggcaatccaggggcaaacggactgaccggcgctaagggcgctgccgggctgccaggcgttgctggcgctcctggcctccctggccctagaggcattcctggacccgtcggggccgcgggcgctaccggggcacgtggtctcgtcggcgagccaggcccagccggttcaaaaggcgaaagcggcaacaaaggcgaacctggttcggccggcccacaaggcccacccggtccaagcggagaagaagggaaaaggggccccaatggtgaggcgggatcggccggtcctcccggaccccctggactgcgcggcagccccggaagtcgcggactccccggcgccgacggccgagccggagtgatgggacctcccggttcccggggggcttctggcccagcgggcgtgcgtggaccgaatggcgacgccggcaggcccggggagccgggccttatggggccaagaggcctaccaggcagtccagggaatataggaccggctggcaaagaagggccagtgggccttcctgggatcgacggacggcccgggcctatcggccctgccggtgcacgcggggagccaggaaatattggatttccgggccccaaaggcccaacgggagaccccggaaaaaacggtgacaaaggtcacgccggcttggctggagctcgcggggctcccggaccagacggtaataatggtgcccaggggcctccaggaccacagggcgtacaaggaggcaagggtgagcagggacccccgggccctccaggctttcagggactcccaggtccctcgggtccggccggggaggtggggaagccgggtgaacgagggcttcacggagagtttggattaccaggcccagccggtccgcggggagagcgcgggcctcccggagagagtggggctgcagggcccaccggacccattggatccaggggccccagcggacctccagggccagacggcaataaaggagaacctggtgtagtcggggctgtgggaacagccggacctagcgggcctagtggactaccaggggagcgaggcgccgctggcatacccgggggcaaaggggagaaaggcgagccaggcctgcgtggggaaatcggcaaccccggcagggacggcgcccggggagcccctggtgcagtgggggcacccggtccagccggtgccacgggggatagaggcgaagcgggagccgctggcccagccgggcctgctggaccgaggggctcaccaggcgagcgaggcgaggttggcccagccgggccgaacggattcgctggacccgctggtgcagctggccagcctggcgcaaagggcgagcgaggtgccaaggggcctaagggtgagaatggcgttgtggggcccactggcccagtgggcgcagccgggccggccggacctaacggacctcctggccctgctggttcaaggggcgatggcggtccccctggcatgaccggatttccaggagctgctgggaggaccggcccaccaggcccctccggaatctcaggcccaccaggccccccgggtccggctggcaaggagggactgcgtggccctagaggagaccagggacctgtcggacggaccggcgaggtgggtgccgtaggtccccccgggtttgccggagagaaaggcccaagtggagaggcgggaacagccggaccaccagggacacctggccctcaaggtctgcttggcgcaccaggaattctcgggctgcctggatctcgaggcgagcggggtttgcctggagtggccggcgcagttggggaacccggccccttgggtattgctgggcctccgggcgctcgggggcctcccggggccgtaggcagtcctggggttaatggcgcccctggggaggctggacgggacgggaatccaggaaatgacggcccccccggccgggatggccagccagggcacaagggagaaaggggttaccctggaaatatcggaccggtgggtgccgctggagcccctgggccccacggacctgttggcccagccggcaaacacgggaacagaggagagaccggacccagcggccccgtgggtcctgccggcgcagtgggcccacgaggcccatcaggaccccagggtatacggggtgacaagggcgagccaggcgagaaaggcccccgagggttaccaggccttaagggccacaatggcctgcaaggacttccggggattgctgggcaccacggcgatcagggtgcgcctgggagcgttggaccagcaggaccccgtggccctgcaggccccagcggtcccgcaggaaaagacggaagaaccgggcaccccggaaccgtaggccccgcgggaatccgcggaccgcagggacaccaggggccagctggaccacctggccccccaggtcctcccggtcctcccggtgtgtccggtggcgggtacgatttcggctacgatggcgacttctatagagcagatcagccgcggtcagctcctagtctccgccccaaagactacgaggtggacgcgaccttgaaaagtctcaacaaccaaattgaaacattgctgacaccagagggctcccgcaagaaccctgctcgaacctgccgggatctgaggctgagccatccagagtggagctctggatattactggattgatcccaaccaggggtgtactatggatgctatcaaggtttactgtgatttctctacgggagaaacctgtatcagagcccagccagaaaacatccccgcaaagaattggtatcggagcagcaaagataaaaagcacgtgtggctcggagagaccattaatgccgggtctcagttcgaatacaatgtagagggcgtgacaagcaaggaaatggcgactcaactggcttttatgagactgctcgctaactatgccagccagaacattacttaccattgtaagaactcaattgcatacatggatgaagaaactgggaacctgaagaaagccgtgatcctgcagggttcgaatgatgtggaattggtggcagagggcaattcccgattcacatataccgtacttgtggacggctgttcaaagaaaaccaacgaatgggggaagaccatcattgagtataagacaaacaagccttctcgcttgccttttctggatattgcacctctggacatcggaggagctgaccaggaattcttcgtggacattggtccggtgtgcttcaaa

SEQ ID NO: 32471 - DNA, 4098 bp, Artificial Sequence
  Description of Artificial Sequence: Synthetic coding sequence
atgttgtcctttgttgacactcgcaccctgctgctgttggcagttaccctctgcctggcgacgtgccagtcgctccaggaagaaaccgtgcgcaagggaccagctggagacagaggtccgcgcggagagagagggccgcccggcccgcccggcagagatggagaggacggccctaccggaccaccagggccgccgggtcctccgggtccaccgggacttggtggaaacttcgctgcacagtacgacgggaagggggtgggcctcggaccgggacctatgggactcatgggcccacggggaccgccgggggccgcaggcgctcctgggccgcaaggtttccaaggaccagcgggtgagcctggtgagccgggccagaccggaccggcaggagcccggggccctgctggacccccggggaaagcgggtgaagatgggcatccaggcaaaccggggcgcccgggggagagaggcgtggtggggccgcagggtgcccgcggcttccctggaactcccggacttcccgggttcaagggaattcgcggtcataatgggctggatggactcaagggacagcctggagcaccaggagtgaaaggcgagcctggagccccgggcgaaaacggcaccccaggacaaaccggcgcgcgcgggctgccgggtgagcgcggacgcgtgggagccccgggccccgcgggcgcgagggggagcgatggctcagttggacctgttgggccagctggaccaattgggtcagcgggtcccccgggctttcctggggccccagggccaaaaggagaaattggtgccgtgggcaacgcaggccctgccggaccggccggacctcgcggggaggtgggacttcctggactctcgggcccagtgggacctcctggcaacccgggagccaacggtctgactggcgcaaagggcgccgcaggcctgccgggagtcgcaggagcccccggactgcccggacctcggggaatccccgggcccgtcggagccgctggagccaccggagcacggggactggtgggagaaccgggccccgctgggagcaagggcgaatccggcaacaaaggggaaccgggatcggcgggccctcaagggccgccgggaccgtccggtgaggagggtaagcggggaccgaacggggaagccgggtccgccggaccgcctggaccccccggtctgcgggggtcccctggctcacgcggactgcctggcgctgacggccgggcaggtgtcatggggccgccgggttcccggggggcttcgggaccagccggtgtgcgcgggccgaacggagatgccggacgcccaggtgaacccggcctgatgggtcctaggggactgccaggctccccgggaaacattgggccagcgggaaaggaaggaccagtgggactccctggcattgatgggcggcctggcccgatcggaccggcgggagctcgcggggagccgggcaatatcggattcccgggaccgaagggaccgactggagatcccggaaaaaacggtgataagggtcacgcaggcctggccggagcgcgcggagctcctggcccagatggaaacaatggagcgcagggaccacctggacctcaaggagtgcaaggaggaaagggagaacagggcccgccgggaccccctggcttccaaggcttgccaggaccaagcggacctgccggcgaggtcggcaagcccggcgaacggggattgcacggagaatttggtctgcccggcccagctggaccgagaggcgaacgggggccgcccggagagagcggtgcggccggaccaaccggaccgattggaagccggggtccatccggtcctccgggtcccgatgggaataagggagagccgggggtggtgggagccgtgggaaccgctggaccttcgggtccatcaggacttcccggcgaacggggcgccgccggcatccctggcgggaagggagaaaagggtgaaccggggctcagaggcgaaatcggtaacccgggaagagacggtgccagaggagccccgggagcagtgggagccccgggcccagcgggtgcgacgggagatcgcggtgaagcgggagccgctggaccagcggggccagcaggcccgagaggatcaccgggggagcgaggggaagtgggcccagccggcccaaatgggttcgccggcccagcgggtgcggctggacagcccggagcaaaaggggaaagaggcgccaaaggacctaagggtgaaaacggagtcgtgggaccaactgggcctgtcggtgccgccgggccggcgggcccaaatggaccgcctggcccggccgggagccgcggtgacggtggaccgccgggtatgaccggttttccgggagcagccggcagaaccggaccaccgggaccgagcggcatttcgggtcctcctggaccaccgggtccggcaggcaaggaaggacttcggggcccacggggcgaccaaggccccgtggggcggaccggcgaagtgggagccgtgggcccacccggatttgcgggagaaaagggaccgtccggagaagcagggactgcgggaccaccgggaaccccggggccccagggattgcttggagctcccggaatcctgggactgcctggatcacgaggagaaagagggctccctggcgtggcgggcgcagtcggagagccaggtccgctgggaattgctgggccgccgggagcgcggggccctccgggagccgtgggctcgccaggagtcaacggagcaccgggagaagcaggacgggatggcaatccaggtaacgacggaccccctggacgcgacggccagccaggccacaagggagaaagaggataccccggaaatatcggaccggtgggcgccgccggcgcaccgggaccgcatggaccggtcggtccagcaggaaagcatgggaataggggagaaactggaccgtcggggccggtgggcccggctggagcggtgggaccaagaggaccgtcgggcccgcaaggaatcaggggagataagggagagccaggagagaaaggtccgcggggactgccaggactgaagggacataatgggcttcaaggtttgccaggaatcgcaggccaccacggtgatcagggagcaccaggatccgtgggaccagccggaccacgcggaccggctgggcccagcgggcccgcgggtaaggatggacggactgggcatcctggaaccgtcggaccggcaggtatccgcggaccgcaaggacaccagggtccggcgggacctccgggaccgccgggaccaccaggaccaccaggagtcagcggaggcggatacgattttggctacgatggagacttttaccgggccgaccagccacggtccgccccgtcgctgcgcccgaaagactacgaggtggacgccactttgaagtcactgaataatcagatcgaaaccctcctcaccccggaggggtcgcgcaagaacccggcccgtacttgccgggacctgagactgtcccatccggaatggtcgtccggctactactggatcgacccgaaccaggggtgtactatggatgctatcaaagtgtactgcgacttctcgaccggtgagacttgcattagggcccaaccggagaacatcccagccaagaactggtacagatcgtcaaaggataagaaacacgtgtggttgggtgagactatcaacgccggatcgcagttcgagtacaacgtcgaaggagtgacctctaaagagatggctacgcaactcgccttcatgcggctgctggctaactacgcctctcagaacatcacttatcattgcaaaaactcgatcgcctacatggacgaggagacgggcaacctcaagaaagcggtcatcttgcaaggatcgaatgatgtggagttggtcgcggagggaaattcgcggttcacctataccgttctggtggatggatgcagcaagaaaactaacgaatggggtaagactattatcgaatacaaaactaacaagccgagccggttgcctttcctggacatcgcgcctctggacatcggaggggcggatcaggagttcttcgtggatattggcccggtgtgctttaag

SEQ ID NO: 32472 - DNA, 4098 bp, Artificial Sequence
  Description of Artificial Sequence: Synthetic coding sequence
atgctgagctttgtggatacccgaaccctgcttcttcttgccgtcaccctgtgccttgccacctgtcaatccctgcaagaggagactgtgcgcaagggacccgccggcgatcgcggcccgcgaggagagcggggcccaccaggtcctccgggtcgagatggggaagatggaccaactggtccacccggtcctcctgggccacctggaccaccaggtttgggaggcaacttcgcggcccaatacgatggaaagggtgtgggtcttggacctggccctatgggccttatgggaccccgtgggcccccaggcgccgctggagcaccagggcctcaaggcttccaaggccccgccggagaaccgggcgaaccaggccaaactggtcccgccggtgcccgaggtcctgccggaccccctggcaaggcaggggaagatggccatccaggaaagccaggacgccctggggaaaggggggtcgtcggcccccaaggagcacgcggctttcctggtaccccaggccttccaggatttaagggaatcagaggacacaatggacttgacgggctcaagggacaaccaggtgcaccaggtgtgaagggagaacccggggcgccaggagagaacggaactcccggacagactggagctcgggggctgccaggtgagcgaggaagagtgggggctcctggccctgccggtgcgagaggctccgatggatcagtgggtcctgttggtccggcaggtccgataggctcggcaggcccacccgggtttccaggcgcgcccggtcctaagggagaaattggtgcggtgggcaatgcaggaccagcgggccctgccggacctaggggagaagtggggctgcctggcctttccgggcctgtcggtccaccaggaaaccctggagcgaacggacttaccggcgcaaaaggagccgcaggccttcccggcgtggccggcgcacctggcctgcctggccctcgcgggattcctggaccagtgggggccgcaggtgcgaccggagcacgggggctggtcggtgaaccaggaccagccggtagcaagggggaaagtgggaacaaaggagagcccggttcggcgggaccacaaggacctcctggcccctcaggtgaagaaggaaagagggggcctaatggagaggcaggctcggcgggaccccctggtccgcctgggctccgggggagccctgggagcagaggcctgcccggagcagacggaagggcaggagttatgggtccaccgggatcgcggggagcctcggggcctgcaggggtgagaggacctaatggggatgccggtcgtcctggtgaacctggtcttatgggtccccgaggcctgcctggatctccgggtaatatcggcccggcaggtaaagaaggtcccgtgggacttcctgggatagatgggcgcccggggcccattggcccagcgggtgctagaggcgagcccggaaacattggattcccagggccaaaaggaccaactggagatcctggtaagaacggggacaagggtcacgcaggtctggcgggtgcccggggtgcccccggcccggacggcaataacggggcacaaggtccacctggaccccaaggtgtgcaaggaggaaagggtgaacagggaccaccaggaccacccggttttcaaggcctccctgggccttcaggtccagcaggagaggtgggtaaacctggggagcgcggactccatggtgaatttggtctgccagggccagcaggaccgcggggagaaagagggccccctggggagtccggcgcagctggaccaacgggtcctattggaagcagaggtccatcaggtccccccgggcccgacggcaataaaggagaaccgggagtggtcggcgctgtgggaactgctgggccatcaggcccttccggattgcctggtgagaggggtgccgcaggtatcccaggaggcaaaggtgaaaagggcgaacctggactccgcggggaaattggcaaccccggacgggacggagcacgcggagcacctggtgcagtgggggcgccgggtccggcgggggccactggcgaccgaggtgaagcaggggcagcagggcccgccggtcccgcgggtccacgaggctcgcctggtgagcgcggagaagttggaccggctggaccgaacggtttcgctggcccggcaggggcagccggtcagcccggtgcaaaaggtgaacgtggcgcgaagggaccaaagggagagaatggcgtcgtgggacctaccggaccggtgggagcagcaggaccggccggcccaaacggacctcctggaccggcaggcagccgtggagacggaggccctcctgggatgacgggttttcccggggcggcaggaagaaccggacctccaggaccatcaggaatatcagggccacccgggccccccggccctgccggcaaggagggtctgcggggacctcggggagatcagggccctgtggggcggactggggaagttggcgcagtagggccaccggggtttgcgggagaaaagggaccatccggagaagccggaaccgcgggtccgcctggaacgcctggacctcagggcttgctgggggcacctggaattcttgggcttcccggttcgagaggagagagagggctcccgggagtggcaggagctgtgggtgaaccgggacctctcggaattgccggtcctccaggcgcacgcgggcctcctggcgcagtcggttcacctggagtgaacggcgcccccggtgaggctggtcgggatggcaacccgggtaacgacggcccacctggaagagacggacagcccggacataagggcgagagaggataccctgggaatatcggaccagtcggagccgcaggtgcaccggggcctcatggacctgtcggccctgcgggcaagcatggaaatagaggtgaaaccgggccatctggcccagtggggccagcaggtgctgtgggtcccaggggcccatccggtccacaaggcattcgaggcgacaaaggcgagccgggtgaaaagggtcctcgtggattgccgggattgaaaggccacaacgggctccagggactccccggaatcgcaggacaccatggggatcaaggtgccccagggtcggtgggaccagcagggcccaggggtccagcgggcccatcggggcccgcaggaaaagatgggaggaccggtcatcctggcactgttggacctgcaggtatccgaggtccacaaggtcaccaggggccagctggacctcccggaccaccaggcccacctggtcccccgggagtaagcggaggggggtacgactttggttacgatggcgacttctaccgcgcggaccaaccccgctccgcgccaagcctgcgccctaaggattacgaggtcgatgcaaccctgaagtcgctgaataaccaaatcgaaacgctgctgactccggaaggttcgagaaagaaccctgcacgtacttgtagagatctcaggctgtcccacccggaatggtcctcgggctactattggattgatcccaaccagggctgcactatggacgcaataaaggtgtactgtgatttttcgaccggtgaaacttgtatccgtgcacagcctgaaaacatacctgctaagaactggtacagatcctccaaggataagaaacatgtatggctgggtgaaaccatcaacgcagggagccagtttgaatacaacgtggaaggtgtcacctccaaagaaatggccactcagctcgctttcatgagacttctggcgaattacgcatcgcagaatatcacctaccattgtaagaactcgatcgcatacatggatgaagaaaccggtaaccttaagaaggcagtgattctccagggaagcaatgatgttgaacttgtcgcagaaggaaattcaagattcacgtacacggtccttgtcgacggatgtagtaaaaagaccaacgagtggggtaagaccattattgagtataagactaacaagccgagcagactcccattcctggacatcgcacctttggatattggaggtgccgatcaggagttctttgtcgatattggacctgtgtgctttaaa

SEQ ID NO: 32473 - DNA, 4098 bp, Artificial Sequence
  Description of Artificial Sequence: Synthetic coding sequence
atgctatcctttgttgatacaaggacattgctgctccttgcggtgaccttatgcctggctacatgtcagtcacttcaagaagaaaccgtcagaaagggacccgcaggggatcggggacctcgcggagaaagaggcccccccggcccccctggacgtgatggggaggatggtcccaccggcccccctggtccccctggcccaccaggccctcccggattgggtggcaacttcgcagcgcaatacgacggaaagggggtgggcctcggccccggtcccatggggctcatgggccctcgggggccacctggggccgccggagctcccggaccccagggctttcagggccccgccggggaaccaggagaacccgggcaaacgggtcccgcaggggccagggggccagccggaccgccaggtaaggccggcgaggatggccatcccggtaagcccggccggccaggggaacggggagtcgtcggaccacagggtgctaggggctttccagggacccccggtctgcctggctttaagggtatccggggccataatggcctggacggtctaaagggacagccaggagcacctggggtgaagggcgagccgggagctccaggggaaaacgggactcccgggcagacgggagctcgaggcctcccaggcgaacgcggtagagtaggcgcccccgggccagcaggagcgagaggctccgacggatccgtgggcccagttgggccggctggaccaatagggtccgccggcccgcctggttttccgggggcaccaggtcctaaaggagagatcggagcggtcggcaatgccgggcccgcaggcccggcagggccgaggggggaagtgggtttacctggcttgtctggaccagtgggccctcccggaaatcctggtgctaatgggctgacaggcgctaaaggagccgctggtctgcccggcgtcgcgggagcccccggacttcctggccccagaggtattccgggacccgtgggtgcagcaggcgccacaggggctagggggttagtcggagagccgggcccggccggatctaagggtgaaagtggtaacaaaggcgaacctggaagcgcaggcccacagggcccccccgggcctagcggggaggagggaaagcggggcccgaatggagaggctgggtcagccggccccccaggccccccagggttgaggggatcccccggtagccggggactccctggcgctgacggccgagctggggtgatggggcctcctggttctcgcggcgcctcggggcctgcaggcgtaaggggccctaacggagatgctggtcggcctggcgagccgggcttgatgggacctagaggtctccctggctctcccgggaacatcggcccagccgggaaagaaggtcccgttggtttgcccggaattgatggcaggcccgggccgatcggtccagcaggcgccagaggcgagcctggaaacatcggcttccctggtcctaagggccccacgggtgacccgggaaaaaacggggacaagggacacgctggactcgctggcgccagaggagcgcctgggccagacggcaacaatggcgcccaaggacctcctggccctcaaggggtgcagggtggaaaaggcgagcagggcccacccgggccacccggattccagggcctgcccggcccttccggcccggctggagaggtagggaaacccggcgagcgcggactgcatggagaatttgggcttccagggcccgccgggcctcgcggtgagcggggcccccccggggaatccggtgctgcggggcctactggaccaattgggagtcgtggcccttccggacctccaggacctgatggaaataagggcgagccgggggtagtcggcgccgtaggcaccgctggtccttccggcccttctggacttcctggcgagagaggtgccgccggcatacccgggggaaaaggagagaaaggggaacccggtctgaggggggagataggtaaccctggtagggacggggcgcgaggcgcccccggagctgtcggagcgcctggaccagccggtgccacgggcgatcggggggaggccggcgccgccggccctgctggaccagccggtccacgtggaagccctggtgagagaggagaggtgggccccgccgggcccaatggttttgccgggcctgctggcgccgcaggccaaccaggagccaagggcgagaggggcgctaaggggcccaagggggagaacggagtcgtagggcctaccgggcctgtcggagccgctggtccggctggacccaacggtcctccaggcccagcgggcagccggggggacggagggcctccaggaatgactggattccccggggccgccgggcggacaggaccgcccggtccttcagggatttccggccccccggggcccccggggcctgccggtaaggaagggctgagggggccccggggtgaccaagggccagtgggccgcacaggtgaggttggcgcagtggggcccccgggattcgccggtgagaaaggaccctcaggagaagctggcactgccgggcctcccgggaccccaggaccacaaggccttctcggagctcccggcatcctcggcctacctggatctcgcggcgagcgagggctccccggtgtggccggagctgttggcgagccgggcccactgggcatcgctggaccacccggcgcccgggggccaccaggggcggtcggaagccccggggtgaatggggcccctggcgaggcaggccgggatgggaaccctggcaacgacggaccgcccggccgggatggccagcccggtcacaaaggcgaaagagggtatcctggcaatatcggccccgtgggtgcagccggcgcccctggcccacatggtcctgtgggtcccgccggcaagcacggaaatagaggggagaccggcccatcaggaccagtggggcccgctggggcagtcgggcctagggggcctagcggtccacaggggattcggggggataagggtgagcccggtgaaaaaggtccacgagggctccctggcctaaagggccataatggcctccagggactccccggcatcgccggtcaccacggcgaccagggggcgcccggttctgtgggcccagctggccctcgcggccccgccggcccctcaggccccgcaggtaaggacgggcgcacaggacacccgggtaccgtagggcccgccggcatcagaggccctcaggggcaccagggtcccgccggacctcctggaccccccggtccaccggggccccccggagttagtggaggaggatacgactttggttatgatggcgacttttacagagcggatcaaccgaggtccgctcctagtttgcgacctaaggactatgaagttgacgcaactttgaaatcgctgaataatcagatagagactctgcttaccccagaagggagccgtaaaaaccccgcacggacttgtcgtgacttgagactctcccacccggaatggagttctgggtattattggattgacccgaaccagggctgcactatggacgctatcaaagtgtactgtgacttttcaaccggcgaaacatgtattagagctcagccggagaacatccctgccaagaattggtataggtcatcaaaggataagaagcatgtgtggttaggcgaaaccatcaacgctggctcccagttcgaatataacgttgagggcgtgacttccaaggagatggcaactcagctggccttcatgagattactggccaactatgcaagtcagaatatcacctatcactgtaagaacagcattgcttacatggatgaagagaccgggaatctgaaaaaggctgttatcctccaaggctctaatgacgtcgaactggtcgcagaaggcaacagccgatttacctataccgtacttgtggatggttgctctaaaaaaactaacgaatgggggaaaactatcatcgagtacaagaccaataagccatctagactgcctttccttgacatcgcaccgctggacatcggcggtgccgatcaggagttcttcgtggacatcggaccagtgtgttttaaa

SEQ ID NO: 32474 - DNA, 4098 bp, Artificial Sequence
  Description of Artificial Sequence: Synthetic coding sequence
atgctttcattcgtcgatacccggaccttgcttcttcttgcagtgaccctgtgtcttgcgacctgccagtcactccaagaggaaaccgtgcggaagggtccagcaggtgatcggggccccagaggtgaacggggtcctccaggacctcccggccgtgacggtgaggacggtcccacgggcccacctggcccacctggacccccgggtcctcccggactgggaggtaactttgcagcccagtatgatggaaaaggagtcggtttgggacccggtcctatggggcttatgggccctagaggcccacctggggcagcaggagcccccggacctcagggattccaggggccagcgggcgagccaggtgaaccaggacaaaccggacctgctggagccagaggacccgcaggtccccccggcaaagccggggaggacggccaccctggcaagcccggtagaccaggagaaagaggtgtcgtcggtccccaaggagcacgtgggtttccagggaccccaggacttcctgggttcaagggtattagaggccacaacggacttgatggtctgaagggacagcccggcgcacccggagtcaaaggggaacctggcgccccaggtgaaaatggtactccgggccagactggtgcacggggtttgcctggcgaacgcggacgcgtgggagcgccaggtcctgcaggcgcaagaggtagcgacggtagcgtgggacctgtcgggccggctggccccatcggttccgcaggccctcccggctttcctggagcacctggaccaaaaggagaaattggcgccgtgggtaacgcgggtccagcggggcccgcaggacctagaggggaagtcggccttcctggcctctcaggaccagtaggtcccccgggaaatcctggtgcaaacgggctgaccggagccaaaggggcagcgggactccctggtgtggccggtgcacccggactgcctggccctagaggaattccagggccggtcggtgcggcaggagccaccggtgcccgcgggctcgtgggtgaaccggggcctgctggttcgaagggcgaatcaggtaataagggagagccaggttcggcaggcccccagggccccccaggaccaagcggggaggaggggaagaggggcccgaacggtgaagccggatccgcaggaccaccaggtcctccaggccttagaggctccccaggtagccggggcctcccgggtgcagatggccgcgcgggtgtcatgggaccccctggatcgcgtggtgcatccggtccggcaggcgttaggggtccaaacggagatgcaggccgaccaggcgagcctggcctcatgggcccccgagggctgcccggtagcccgggcaatatcggccccgcggggaaagaaggtccagtgggcctccccggtatcgatggtcggccagggcccattggccctgcaggagccaggggcgaacccggtaacattggcttccctggtccaaagggacctaccggggaccccgggaagaacggcgataagggacatgccggactggctggggccagaggggcccccgggcccgacggtaacaacggtgcacaggggccaccggggccacagggagtgcaaggtgggaaaggtgagcaaggtccaccggggcccccaggcttccagggcctgccagggccgagcggacctgcaggtgaagtcgggaaacctggagagcgcggccttcatggagaatttggtctgcctggacccgccgggccccgcggtgaacgggggccgcctggggagtccggagcagccgggcctacgggaccgatagggtcgcggggtccatccggacccccgggaccggacggaaataagggtgaaccaggggtggtcggcgccgttggtactgcaggaccttcgggacccagcgggctgccgggcgaaagaggcgccgccggcatcccaggtggtaagggagaaaagggcgaaccaggacttcgaggggagatagggaaccccggcagggatggggcaagaggcgctcctggtgcagtgggtgccccagggccggccggggcaaccggggaccgcggagaagcgggtgctgcaggaccagcagggccagcggggcctcgaggatcaccaggagagcgtggtgaggtaggtccggctggaccaaacgggtttgcagggcctgccggtgccgcgggacaaccaggtgcaaagggggaacgcggcgcaaagggtccaaaaggggagaatggagtggtgggccctactggaccagtcggcgcagctggcccagcgggcccgaatggccccccaggcccggctggctcccgtggggatggagggccccctggaatgactgggtttcctggtgccgcaggtcgaaccggtcctccgggtccttccggtatttcaggaccgccgggccctcctgggcctgctggaaaagagggacttaggggtcccaggggtgaccagggcccggtcgggagaactggagaagtcggagcagtgggccctccgggatttgcaggtgaaaagggaccttcaggggaggccggaacggcagggcccccaggtacccctggccctcaaggcttgctgggagcacctggtattcttggactgcctggatcacgcggtgagagagggcttcctggggtggcaggagcagtgggggagcccggccctctcggaatcgccggcccaccaggagcaagaggacctccgggggcagttggctcgccgggagtgaatggagctcctggagaagcagggagagatggaaaccctggaaacgacggtcctcctggtcgggacggtcagcctggacacaagggggaacgaggttaccctgggaacattggcccagtgggggcagcgggggcgccaggcccacatggacccgtgggccctgcaggcaagcacggaaacagaggcgagactgggccatcggggcccgtcgggccagctggggccgtggggccccgggggccttccggaccgcaaggcattaggggggataagggagaacctggtgagaaaggaccgcgtggcctgccgggtcttaaaggtcataacggacttcaaggcctgccaggcattgcaggacatcatggcgatcaaggagccccgggcagcgtggggcctgccggccctcggggtcctgctggcccaagcgggccagccggtaaggatggacgtactggtcatcctggcactgtgggtccggcaggaatacgtggaccacaaggacaccagggaccggcgggacctcccggtccccctggacctcctggacctccaggggtgtccgggggaggatacgattttggatacgatggtgatttctacagagcggatcagcctagatccgcaccatcgttgcgacctaaggattacgaagttgatgctacgctcaagtcgctgaacaatcaaatcgaaactctcctgacccctgagggttccagaaagaatcctgcacgcacttgtagggacctgaggttgtcccatccggaatggagcagcggatactactggatcgaccctaaccaaggctgcaccatggatgcaattaaggtgtactgcgacttcagtactggagaaacttgtatccgggcacaaccagaaaacattccggcaaagaactggtatagatcgtcgaaggataagaagcatgtgtggctgggtgaaaccattaatgcgggatcgcaatttgaatacaacgtggaaggagtcacctcaaaagaaatggctacccagcttgcatttatgcgacttctggcgaactacgcatctcaaaacatcacttaccactgtaagaattcgatcgcttacatggatgaagaaactggtaatctgaaaaaggcagtgattcttcaaggctcgaacgatgtggaattggtggctgaaggaaactcgaggttcacctacactgtgctggtggatggatgtagtaagaaaacgaatgaatggggtaagactattatcgagtacaaaaccaataagccatcccgcctgccctttctcgacatcgcacctctcgacataggtggagcagatcaagagttctttgtggatattggacctgtgtgctttaag

SEQ ID NO: 32475 - DNA, 4098 bp, Artificial Sequence
  Description of Artificial Sequence: Synthetic coding sequence
atgctgtcctttgtagacacccgcaccctgctcctgctggccgtcacgctctgcttggctacgtgccagagtctccaggaggagacagtgagaaaaggccccgcgggggatcgcggtccccgtggagaacgcggaccccctggaccgcccggacgcgacggcgaggatggtccgacaggtccgcccggtccgccgggcccgccaggtccgccgggcctgggcggcaacttcgcggcccagtatgacggaaagggcgtgggactggggccgggaccaatgggactcatgggccctcggggcccaccaggtgctgctggtgccccaggcccccagggatttcaaggaccagcgggagaacccggggagccaggccaaacgggtccagctggagccaggggtcctgctggcccccccggtaaggcaggggaagacggtcatccaggcaagcccggcagaccaggggagcggggcgtggtcggaccgcaaggtgcgagaggtttcccaggcacccccggcttgccaggatttaagggaattcgaggccataatggtctggacggcctcaagggtcagccgggggcgccgggggtgaagggcgagcctggtgcaccgggagaaaatggaaccccgggccagaccggagcgcgcggcttacctggtgagcgcgggcgtgtcggtgcccccggaccggccggcgccagggggagcgacgggagtgttgggccagtaggacccgcaggaccaattggttcagcggggccgcccggctttccgggagccccgggtccgaagggagaaataggagcagtgggcaacgctggaccggccgggccggcgggcccgcgtggcgaggtaggtctgccgggactcagcggaccagtcggcccacccggcaaccccggcgctaacggcttaacgggcgcaaagggcgcggccggtcttcctggcgtggccggagctcccggcctgcccggaccgcgtggcattccaggtcccgtcggcgcagccggcgcaacgggagcccgcggcctggtcggagaaccgggcccagcgggctccaagggcgagtccggtaacaagggcgagcccggctcggcaggcccacagggtcccccaggcccctccggtgaggaaggcaaacgtggaccaaacggcgaggctggatccgccggacccccaggcccgcccggactacgtggctccccgggcagcaggggactacccggtgccgacggacgcgcaggcgttatgggcccaccgggcagcaggggagcctcgggtcccgccggagtacgcggtcctaatggagacgctggacgacccggcgagccgggcctcatgggcccacggggtttaccggggtcgcctggtaatatcggcccggctggaaaggaaggccccgtgggtttgcccggtattgacggacgaccggggcccattgggccggccggagcgcgaggagaaccaggaaatatcggttttccgggtccgaagggccccaccggtgatcccgggaagaatggcgacaagggccatgccggcctcgccggagcacgcggagctcctggcccagatggtaacaatggcgcccagggcccgcccggcccacagggtgttcagggtggcaagggagagcagggcccccctggaccgccgggcttccagggattgccaggtcccagtggacccgcgggcgaagttggcaagcccggcgaacgcggcctgcacggcgaatttggactcccagggccagcaggcccacggggcgaacgcggtccgccaggcgagtccggtgcagccggccccacgggccccattggttcgcgcggaccctcgggtcctccaggccccgacggcaacaagggcgagccaggcgtggtcggcgccgtcggtacagctgggcccagcggaccatccggcctgccaggagagcgcggagcggccggcatcccgggtggcaagggagagaagggtgagcccggcctccgcggtgagataggcaatcccggacgagatggcgcacgtggagcaccgggtgccgtcggtgcccccggcccggctggcgcaaccggtgacaggggtgaagctggcgccgccggccccgccggtccagcaggtccacgcggttccccgggcgagcgaggcgaggtaggtcccgctggcccaaatggcttcgcaggtcccgccggcgccgccggacaacccggggctaagggcgaacgcggcgcgaaaggtccgaagggagaaaacggtgtcgtgggaccaacaggccccgtcggtgctgcaggccccgccgggcccaacggtccgccaggccccgcaggatcccgcggtgatggcggccccccgggtatgaccggctttccgggagcggccgggcgcacagggcccccaggtccatcgggcatctctggaccaccgggccctccgggacccgcaggaaaggagggccttcgcggcccccgcggagaccagggtccggtaggccgcaccggcgaggtgggagctgtgggccctcccggatttgccggagagaaggggcccagtggcgaagcaggtacggcaggtccccctggcacgccaggaccgcagggcctactgggcgccccaggcattctaggcctgcccggctccaggggagagagaggcctgccaggagtggcgggcgccgtgggcgaacccggccccctgggaatagctggaccgccaggcgcacggggacctccaggtgcagtggggagtccaggagtgaacggagccccaggtgaggccggtcgtgatggcaatccgggaaacgatggacctcctggtcgagatggtcaaccaggccacaagggtgagcgaggctaccccggaaatataggcccagtgggcgccgccggcgcgccgggaccccatggtccagtggggccggccggcaagcacgggaacaggggcgaaaccggacccagtggacccgttggtccggcgggcgcggtaggccctcgaggaccatcgggcccacaaggaatccgaggtgacaagggcgagcctggagagaagggccctcgaggattgccgggtctgaagggccataacggacttcagggactgcccggaatcgcgggtcaccatggtgaccaaggcgcccctggaagtgtgggccccgccggaccccgcggacccgccggcccttctggacctgctggaaaggatggacgcacaggccacccaggcacagttggtccagccggcatccggggaccgcaaggacaccaaggccccgcaggcccaccaggacctccaggacccccgggaccacctggtgtgagcggcgggggctacgatttcggctacgacggcgatttttaccgagcagaccagccccgctcagctcctagtctccggccgaaggactacgaggtagacgctaccctgaagagcctaaacaaccaaattgagactcttttaacaccagagggaagtcgcaagaaccccgcaagaacatgtagagatttgcgcttgtcgcacccggagtggtcgagtggctattactggattgatcccaatcagggctgcactatggatgccattaaggtgtattgcgacttttccacgggagagacctgcatacgtgctcagcccgagaacatacctgcgaaaaattggtatcgttccagcaaggataaaaaacacgtatggcttggagagaccatcaatgctggcagccagttcgagtataacgtcgagggcgtgacgagcaaggagatggcgacccagctggccttcatgcggctgctggccaattacgcctcccaaaacattacctaccattgcaagaattctatagcgtatatggacgaggaaacaggaaatctaaaaaaagccgttatactgcagggctctaacgacgttgagttggtggctgaaggaaattccaggtttacatacactgtcctggtcgacggttgctccaagaagaccaacgagtggggcaaaacgattatcgagtataagactaataagcccagtcgtctgccgtttctcgacatcgctccgctggatatcggcggcgccgatcaggagttcttcgtggacattggcccggtgtgtttcaaa

SEQ ID NO: 32476 - DNA, 4098 bp, Artificial Sequence
  Description of Artificial Sequence: Synthetic coding sequence
atgctctccttcgtcgatacccggactctgctgttgcttgcggtgaccctctgcctcgccacctgccagagtctacaggaggagacggtaagaaaaggccctgctggcgaccgcggacccagaggcgagcgcgggcccccggggccacccggccgggacggagaagacggcccgacggggccaccgggaccccccggccctccggggccaccaggactgggcggcaactttgctgctcagtacgacggcaaaggcgtcggcttgggacccggccctatggggctcatgggcccacgcggtccgcctggcgccgccggagcccccggcccgcagggcttccagggaccggctggagaacctggggaacccggtcaaacaggccctgcaggcgctagaggaccggcagggcccccagggaaggcaggggaagatggtcatcccggaaagcccgggaggccaggagagagaggcgtggtgggtccccagggagcccgtggattccctggcacgcccggacttccgggatttaaagggataagggggcataacgggctggacgggttgaaggggcagccgggagctcctggagtgaaaggcgaaccaggcgcccccggcgaaaacggaactcccgggcagaccggagcccggggcctcccgggcgagaggggccgtgtgggcgcccccgggcctgccggcgcccgtgggtcggacgggtcagtaggccccgtcgggccagctggaccaattggtagtgcagggccccctgggttcccaggtgctcccgggcccaaaggggagattggagccgtgggcaatgccgggccggcaggtccagcggggccaaggggcgaggtgggcctgcccgggctgagtggacccgtgggtccccccggcaacccgggggcaaacggactaacgggggcgaagggcgcggctggtttgccaggagtagcgggtgctcctggtcttcccggccccaggggcatccccgggccagtgggcgccgctggcgccactggagctcggggcttagtgggagagcccggacctgcaggaagtaagggagaaagcggcaataaaggcgagcccggcagtgccggcccccaggggccaccaggaccctcaggcgaggaaggtaagagaggtcctaacggtgaagccgggtccgcaggacctcccggtcccccaggtctacgtgggagtcctgggtctagaggcctccccggtgcagacggcagagccggagtgatgggccctcccgggagtcgcggtgccagcgggccagccggtgtccggggccccaatggcgacgcaggccggcccggcgagcctgggttgatgggacccagaggacttcctggtagccccgggaatattgggcctgctgggaaagagggccccgtgggtctacctgggatagacggcagaccggggccgattggacccgccggggcccgcggcgagcccggaaatatcgggtttccaggaccaaaaggaccgactggcgacccaggaaaaaacggcgataagggacatgcgggtttggcaggagcgaggggagcccccggccccgacgggaataacggggcacagggaccgcctggaccgcagggcgtgcaaggcggcaagggggaacaaggacccccaggcccacccggtttccaagggctaccaggaccttccggacccgctggtgaggtcggtaagccgggggagcgcgggctgcatggcgagtttggcctccccggccccgcaggcccaaggggagaacgggggccacctggggagtccggcgctgccggtcctaccggtccaatcgggagccgcggccccagcggccctccagggcccgatggcaataagggggaaccaggagtggtcggtgccgtgggcaccgccggcccaagtggtccatcaggcctacccggagagcggggtgcagccggaatccctggtggtaaaggggaaaagggggagcctggcctccgtggtgagatcggcaaccccgggcgcgacggcgcaaggggcgcacctggggccgttggcgcacctggccctgccggggctaccggcgaccggggggaagccggcgccgctgggcccgcaggccccgccggcccacgcggttcccccggcgaaaggggggaagttggacctgccggccccaacgggttcgcaggccccgctggagccgccggtcagcctggagctaagggggaaaggggtgcaaagggtccgaagggcgagaatggtgttgtgggacccaccggaccagttggcgccgctgggccagccggcccaaacggcccccccggccctgcaggcagcagaggcgatggggggcctccgggaatgactggtttcccaggcgccgccggtcgaaccgggcctcctggaccgagtggcattagtggcccccctgggcccccaggacccgccggaaaggagggtctcagaggccccaggggtgaccagggaccagtgggcagaaccggtgaagtaggagctgtgggaccacctggcttcgccggcgagaaaggcccatccggagaggcgggcacagccggcccgccaggaacccccgggcctcaggggctgttaggggcacctggaattctgggcttgcctgggtcaaggggggagagaggtctccctggggtcgcgggggccgtgggagagcctggcccattagggatcgcaggccctcccggggcacgtggaccaccaggggcggtaggctcccccggtgtcaacggggctcctggcgaggccggccgggacgggaacccgggcaacgacggaccacccgggagggatggacagccagggcataaaggtgagcggggctatcccggtaacattggacccgttggggcagctggggcccctggaccccacgggcccgtgggtcccgcgggcaaacacgggaatcgtggagagaccggtccttctggtcccgtagggcctgccggggctgtaggtccaagaggacccagtggtccccaaggcattagaggcgataagggagagcccggagaaaagggacctcgtggcctaccagggttaaagggccacaacggcttgcaagggctgcccggcatagcagggcatcacggggaccaaggcgccccaggcagcgtgggcccagccggtccgcggggcccggctggtccttccggtcctgcaggaaaagacggccggactggccatccaggaactgtcggaccggctggaataagagggcctcaggggcatcaaggcccggcgggcccccctggaccaccaggaccgccaggccctccaggggtttctggtggggggtatgatttcggttatgacggggacttctacagggcagaccaacctagaagtgccccttcgctgcggcccaaggattatgaagtggatgccacactcaagagtctcaacaatcagattgagacattgcttactccagaggggtccagaaaaaatcctgcccggacctgcagagacctccgtctttcccaccccgaatggtcgagtggttactactggatcgatccgaatcagggctgcaccatggatgcaatcaaagtctactgtgatttctcaactggagagacatgtatcagggcccagcccgagaatattcccgctaaaaattggtatcggagtagtaaagataagaagcatgtctggctgggtgagaccattaacgcggggtcccagtttgaatataatgtagagggggtaacaagtaaggagatggccacacagcttgccttcatgcgactactagccaactatgccagccagaacattacctatcattgtaagaatagcattgcctacatggatgaggagactggcaacctgaaaaaggctgttatcttgcaggggtccaacgatgtggagctagtcgccgagggcaactcgaggttcacctatactgtgctggtggacggttgtagcaaaaaaacaaacgaatgggggaaaactataattgaatataagactaataagccctctagattgccttttctggacatagcccccctcgatatcggtggcgcagatcaagagttttttgttgatattggcccagtgtgctttaaa

SEQ ID NO: 32477 - DNA, 4098 bp, Artificial Sequence
  Description of Artificial Sequence: Synthetic coding sequence
atgctttccttcgtggatactagaacactgcttctgctggctgtgacactttgcttggcaacctgccaatcactgcaagaagaaaccgtgaggaagggccctgctggagatcgcggccctcggggggagaggggacccccgggaccaccgggccgggacggagaggacgggcctacaggtcctcctggcccccccgggccacctggccccccgggtctgggcggaaatttcgctgcacagtacgacggcaaaggcgtggggcttgggcctgggccgatgggcctgatgggccctagggggccacccggggccgccggagcgccaggaccacagggattccagggccccgcaggtgagccaggcgagcccggccagaccggccctgccggagcacgtggtcccgccggtccgcccggtaaagccggtgaggatggacaccctgggaagccaggccggcctggcgaaaggggggtggtcggaccccagggcgccaggggcttccccgggacccctggcctaccaggcttcaaggggatccgagggcataacggcctggacgggctgaagggacagcctggtgccccgggcgtgaagggtgagcccggcgcccccggggagaatggcacaccgggtcaaaccggagcacgcggcttgccaggagagcgtggacgcgtgggcgcacctggccccgctggggcgagaggaagtgatggcagtgtgggacctgtgggaccagccggtccgatcggcagcgcagggccgcctggcttccctggagctccaggtccgaaaggtgagatcggtgctgtgggcaatgcagggcctgcggggcctgcggggcctcggggggaggtgggcctcccggggcttagcggccccgtggggcctcccggcaacccaggggccaacggcctgaccggggcaaagggcgctgccggcttgcctggcgtggctggggccccaggcctcccaggaccgaggggcatcccgggacctgtgggggcggcaggcgcgacgggtgcccgcggtctggtgggcgagccggggcccgctggatccaagggagagtcaggtaataagggagagccggggtctgcaggaccccagggcccgccggggccttcgggagaggaaggcaagagggggcctaacggcgaggccggttccgcgggccctcccggacctccggggctgcgagggtccccggggtcccggggcctgccaggggccgacggcagagccggcgtaatgggtccgcctgggtcacggggcgcgagcgggcccgccggggtgcgcggccctaacggcgatgcagggaggcccggtgagcctggcctcatgggaccgagaggcctgcccggatcacctggaaacatcggccctgccggcaaggaagggcccgttgggctacctggtatcgacgggcgccccggacccatcggtccggccggtgccagaggagagcccggcaacattggattccctggtccaaaaggccccaccggggacccggggaagaacggcgacaagggacatgccgggttagcgggcgcgcgaggcgcccccggacccgacggcaacaacggagcccaaggcccgcctggtccacagggcgtccagggaggaaagggtgaacagggcccacccggccctcccggctttcaagggctgcccgggccatcaggcccggcgggagaagtgggcaaaccgggcgagagggggctgcacggagagttcggactgccaggacctgctggtcctagaggggaacgtggtcctcctggcgagtccggtgctgccggtccaacggggcctatcggcagccgtggcccctcaggcccaccagggccggatgggaataaaggagagcctggagtggtcggggccgtgggcaccgccggcccatcaggccccagcggactgccgggggagcgaggtgccgctggcatccccggcggcaagggcgaaaagggggaacccggcctgagaggggagatcggaaaccctggaagagatggcgccaggggcgctcctggggcggtgggcgcccccggtcctgccggcgccactggggatcgaggggaagcgggcgctgccggacccgcgggtccggccgggcctcgagggagtccgggtgaaaggggggaggtgggacctgccggccctaatgggttcgctggtccagctggagccgcgggccagcctggggcgaagggtgaaagaggggctaagggtcccaagggagaaaatggggtggtgggccccaccgggccagtcggggccgctggtcctgccgggcctaatggtccccctggaccagctggctcccgcggggacggcgggcctccaggcatgacgggattccctggagctgcggggagaaccgggccccctggaccctccggcattagtggaccgcctggcccacccggtccagccggcaaagagggcctgaggggtccaagaggagatcaaggccctgtgggccgcacaggagaggttggagccgtcgggccaccaggttttgcgggggaaaagggcccttccggggaggccggcactgctgggcccccaggcacacctggcccacaaggactgctgggagcacctggcattctcggccttcccggcagcaggggtgaacgcggactgcccggcgtggcgggcgccgttggagaaccaggtccacttgggatcgccggcccgccaggcgcccgcggcccccccggcgctgtcggctctccaggggtgaatggagctcccggagaggcaggaagagacggtaaccctggtaacgacggccctccaggacgggatggacagcctggccataaaggggagcgaggttaccccggtaatatcggccccgtgggggcagccggggcccccggtccacacggccctgtgggccctgctggcaaacatgggaataggggcgagacaggcccaagtggtcccgtgggcccagcaggtgctgtcggacctcgggggccatctggtccccagggcattaggggcgacaagggggaacctggtgaaaaggggccgcggggtctgcccgggcttaaggggcataatggtctgcaggggctgccaggtatcgctgggcaccatggagaccagggcgcacctggaagcgtcggtcccgcaggaccgagggggccagccggtcctagtgggcctgccggaaaggacggtcggacagggcacccgggcaccgttggacctgccggcatcaggggcccccaaggccatcaggggccagccgggcctcctggccctcctgggccgcctgggcccccaggggtgtccgggggcgggtacgattttggatatgatggcgatttctatcgggccgaccagccacggtctgctccttccctcagacccaaagactatgaggtcgacgcaacactgaagtccctgaataaccagattgaaaccttgctgacccccgaaggtagccgcaagaatcccgccagaacttgccgtgatcttaggttgtcccatcctgaatggtctagcggctactactggattgaccctaaccagggttgtactatggacgctattaaggtatactgcgatttttctactggagaaacctgcatcagagcccagcctgaaaacatacctgccaaaaactggtaccgttcctctaaggacaagaaacacgtttggctcggggagactatcaatgctggttcacagttcgagtacaacgtcgaaggcgtcacaagtaaggagatggccacccagttagccttcatgaggctgctggctaactacgcttctcaaaacatcacttaccattgtaaaaactccattgcctacatggacgaagaaactgggaatctgaagaaagctgtgatcttgcaggggtccaacgacgtggagctcgtagcagaaggcaatagcaggtttacctacactgttttggtggacggctgctccaaaaagactaatgaatggggcaaaaccatcatcgagtataagacgaataagccatctaggctaccattcttggacatcgcacccctggacatcggaggggcggatcaggagtttttcgtggatatcggcccggtctgcttcaaa

SEQ ID NO: 32478 - DNA, 4098 bp, Artificial Sequence
  Description of Artificial Sequence: Synthetic coding sequence
atgctctcatttgtcgacacgagaacacttttgctgcttgcagtaacgttatgcctggcaacttgccagtccctgcaggaggaaacggtacggaaaggacctgcaggtgatcgcgggcctaggggagaacgcggtccaccaggaccgccgggaagggatggtgaagatggaccgacggggccgcccgggccgccaggacctcctggacctcccggattaggaggcaactttgccgcccagtatgacggtaaaggcgttggcttaggcccaggtccaatgggtttaatgggaccgcgtggtcccccaggtgccgctggagctcctggccctcaaggctttcagggcccagcgggggaacctggtgaaccgggtcagacagggccagccggagctcgtggccctgcgggaccgccgggtaaggctggtgaggacggtcatccaggaaaaccgggcagacctggcgagcggggcgtcgttgggcctcagggcgcccggggtttccctggaacaccaggccttccaggatttaaaggtatcaggggccataacggattagacggtcttaaaggacagccaggcgctccgggagtcaaaggcgaaccgggcgccccgggagaaaacggtacgcctggacaaacgggcgcaagaggccttccgggggagagaggccgagtcggtgctccgggtccggccggcgcgagaggttcagacgggtctgtaggcccggtcggacccgccggaccgattggttcagctggaccgccaggctttccgggagcacctggtccgaaaggagagataggcgcagtcggtaatgccggaccggccgggccggcgggtccaaggggtgaggttgggttgcctggactttcaggccctgtaggaccaccgggtaacccgggggctaatgggttaaccggagcgaaaggagccgcgggtttacctggcgttgctggcgctccgggactaccgggcccacgcggtattccaggccctgtcggtgcggccggggcgactggcgcgagaggtttggtcggggaaccgggacctgccggttctaaaggtgagtctggaaataagggtgagccgggctccgccggcccccagggtcctcctggaccgagtggcgaagagggtaagagaggcccgaacggagaagctggttctgcgggtcctccaggcccaccgggcttgagaggatcgcctgggtcacgcggcctgccgggcgcggatgggcgtgcgggagtaatgggaccgccgggctctagaggggcttccggcccggccggagttagaggcccgaacggagatgctgggcggcctggggaaccgggtctgatggggccgcgaggactccccgggtctccaggtaatatcgggcctgccggaaaggaaggcccggtaggcctgcctggaattgacggaagacctggacctatcggtccggccggcgccagaggcgagcctggtaatattggttttccaggccctaaagggccgacaggggaccctggaaaaaacggcgataaaggacatgcagggttagccggggctcggggtgcccctggcccggacggcaataacggagcacagggccctccgggccctcagggcgttcaagggggcaaaggagaacaaggcccgccgggcccaccaggcttccaggggttgcctggcccgtcaggaccggcgggcgaagttggaaaaccgggagaaagaggcctgcatggggaattcggactaccaggccccgcgggccctcgtggggaacgcggaccaccgggagaatctggggccgcggggccgacaggaccgataggctcacgcggcccgtctggtccgccggggccggatggaaataaaggtgagccgggagttgttggggccgtgggcacggcgggtccttcggggccttctgggcttcctggcgaaagaggtgcagcaggcattcccgggggcaaaggcgaaaaaggcgaaccgggacttcggggcgagattggaaatccaggcagggatggcgcgcgtggggcaccaggcgcagtgggagcgccaggcccggctggagctacaggcgaccgcggcgaggcgggggcggcgggccctgcagggccggctggcccgaggggcagtccaggtgaaaggggcgaggtgggtcccgcgggcccgaacggattcgctggtccggctggtgccgccggccagcctggcgccaagggagaaagaggagctaaaggtcctaagggagaaaatggtgtcgtcggacctacgggccccgtaggtgctgctggtcctgcaggtcctaacggaccgccaggccctgctgggtctaggggagatggaggaccgccgggcatgacgggctttccgggcgcagccggaagaacaggcccaccggggccttcaggtattagcggaccgccgggccctccggggcctgcagggaaagaagggcttcgaggacctagaggagatcagggaccggtcggaagaacgggggaggtaggcgctgtggggccgccaggttttgcgggcgaaaaagggccaagcggggaagccggcacagccggaccgcctgggacaccgggcccgcaaggcctcttaggcgctcccgggattctgggtctgccgggatcacgtggcgaaagaggcctcccaggagtcgcaggcgcagttggtgaaccgggccctctcggaattgctggcccgccgggagcgcgcggcccgccgggcgcggtcggctctcctggtgttaacggtgctccaggtgaagcgggaagagatggcaaccccgggaatgatggcccacctggccgtgacggacagccgggtcacaaaggggaaagaggatatccgggaaacatcggcccggtcggtgctgctggggcgccgggaccgcatggcccagttggccctgcagggaagcacgggaataggggggaaaccgggccatctggaccggtgggcccggcgggtgccgttggtccgcggggacctagtggaccgcagggtattagaggagacaaaggagaaccaggcgagaaagggcctcgcggcttaccgggtctgaaggggcacaacgggctgcagggtctgccgggtattgccgggcatcacggagatcagggagcaccgggttccgttggacctgctgggccgagaggacctgctgggccatcaggcccggccgggaaggacggacgaacaggacatccgggcacagtcgggccagctgggattagaggtccgcaagggcaccagggccccgctggacctccaggcccaccgggcccgccagggccgcccggggtgtccggaggagggtacgattttggctacgacggcgacttttatcgcgcagatcagcctagaagtgcgccgtctttaagacctaaggattatgaagttgatgcgacactgaagtcgcttaacaatcagattgaaactttgttgactccagaagggtcacgtaaaaacccggcgcgtacatgcagagacttacgtttatcacacccggagtggtcgtcaggatactattggatcgatccaaatcagggatgcacaatggatgctatcaaggtctattgtgacttttcgacaggagaaacatgcattcgtgcacaacccgagaacattcctgctaaaaattggtacagatcaagcaaggataaaaagcatgtctggcttggtgagacaataaatgcaggttcccagtttgaatataatgtagagggcgttacatcaaaagaaatggcaacccagctcgccttcatgcggttactggccaactatgcgtctcaaaatatcacgtatcattgtaaaaactccattgcttatatggatgaagagactgggaacttgaaaaaagcagtcattttgcaaggtagcaatgacgtggaactggtagccgaaggcaactctcggttcacgtatacagtgctggtcgatggatgttcgaaaaagaccaatgagtggggaaagaccataattgaatacaagacaaataaaccgagtcgcctgccttttttggatatcgccccgcttgacatcgggggcgcggatcaagaattttttgtcgatataggccccgtatgctttaag

SEQ ID NO: 32479 - DNA, 4098 bp, Artificial Sequence
  Description of Artificial Sequence: Synthetic coding sequence
atgttgtcttttgtggacaccagaactttactactcctcgccgtgacgctgtgcctggccacctgtcagtccctgcaggaggagacggtaagaaagggacctgccggcgacaggggccccaggggagagcgaggcccgcctgggcctccgggtcgagatggggaggatggacctacaggccctcccggtccgcccggaccacccggtccccctggacttggtggtaacttcgccgcccagtatgacggaaagggcgtggggttgggccccggacctatgggattaatggggcctcgaggtccccctggggcggctggcgcgcctggccctcagggattccaagggcctgccggggagcccggcgagccgggccagactggccctgccggcgcaaggggacccgccggccctccaggaaaagctggtgaagacggacacccaggtaaacccgggaggcctggcgaacgaggggtcgtggggcctcagggcgcacgaggatttccaggcacacccggcctccctggatttaaagggatcaggggccacaacggattggacggcctcaagggccagccaggtgctcctggagttaaaggtgaacctggtgcacctggggaaaatggcacccctggccagaccggtgcccggggcttgccaggtgaacgtgggcgagtcggcgcaccaggtccagcaggagccaggggctctgatggcagcgtcggcccagtcggtccggccggtccaattggcagtgcagggcctcccgggttccccggagcccccggaccaaagggagaaattggagctgtaggtaatgcaggcccggctggccccgccggccctagaggtgaagtcggacttcctggactgagtggccctgtgggccccccaggaaaccctggcgccaatggactgacaggcgctaagggtgcagccggcctgcccggtgtggccggggctcctggtctccctggccccagggggattcctggccccgtgggcgctgccggcgcaaccggtgccagggggctagtaggagagccaggtcccgccggttcaaaaggggagtcgggtaacaagggcgaaccgggatctgcaggccctcagggccccccaggccccagcggcgaggaggggaagcgaggacctaacggggaggctgggtcagccggcccgcccggtccacccggactgcgtggaagtcctggctcccgaggactcccaggagccgatggacgagccggagttatgggaccccctggcagtagaggtgcctccggacctgctggtgtgaggggacctaacggcgacgctggacgcccgggagagccaggcttgatggggccgagggggcttccaggtagtcccggaaacataggtccagctgggaaagagggaccggtgggactccctggcatcgacggaagacctgggcccataggccctgcaggcgcccgaggcgagcctggaaacattgggtttcctggacctaagggcccgacaggggaccccggaaaaaatggagacaagggccatgctgggctggcaggcgcccggggcgctcctgggccagacgggaacaatggagcccagggccctcccgggcctcagggtgtgcagggcggcaaaggagaacagggacctccgggtccacccggcttccaggggctgccgggaccttccggtccggcaggagaagtcgggaaacctggcgagagaggacttcacggggagtttggccttccaggacccgctggccccagaggggaacgcggtcctcccggtgagagtggggccgcaggcccaaccggcccaattggctccagggggcctagtgggcctcctggccctgacggtaataaaggtgaacctggcgttgtcggcgccgtcggaacagctgggccttctggcccctctggtttgcccggggagagaggtgctgcggggatcccaggaggcaagggagaaaagggggagcctggcctgcgaggagaaatcgggaaccctgggagggatggggctagaggagcacccggcgctgtgggtgcacccgggcccgccggagcaaccggggaccgaggcgaggcaggtgctgccggcccagccggccctgccgggccaaggggatctcctggcgagcgcggagaggtcgggcccgccggccctaacgggttcgccggacctgccggcgccgcgggtcagcctggggcgaaaggggaaaggggggctaaggggccaaagggtgagaatggcgtggtggggccgaccggtccagtcggcgcggcgggcccagccggtcctaatgggcccccaggaccggctggcagccgcggggatgggggtccaccaggcatgactggatttcctggtgcagccgggcgcaccggcccccccggaccgtctggtatctccggccccccaggcccacccggtcctgcaggaaaggagggactgagagggccacgaggtgaccaagggcccgtgggtcgtactggcgaagtaggagccgtaggaccccctggcttcgctggtgagaaggggccatcgggggaggcaggaaccgcaggtcccccaggtactccaggcccacagggcctccttggtgcccccggaatattggggctgcccggctcgcgaggcgaacgtggattacccggcgtagcgggtgctgtaggagagcccggacccctagggatcgcgggcccaccaggcgcacgaggaccgcctggtgcagtgggcagtcccggagtgaacggggcgccgggagaggcgggtagggatggtaatccagggaatgacgggcctcccggccgagacggacagcctgggcataaaggggaacggggttatcctggcaatatcggtccagtcggcgcggccggtgcacctggaccacatggccccgttgggccagctggaaagcatggaaacagaggagagacagggcccagcggaccggtggggccagcaggagcagtgggccccagaggtccatccggcccccagggcatcagaggggacaagggagaacccggcgaaaaagggccaaggggtctacctgggctgaagggccacaacggactgcagggcttgcccggaattgcaggtcaccacggtgatcagggagcacctggttcggtgggcccagctggccctcgaggcccggccgggccctcgggcccggctgggaaggacggccgtacaggccatccagggacagtgggccccgccggcatcagagggcctcagggtcaccaggggcccgcagggcccccagggcctccaggaccgcccggcccacctggggtctctgggggaggctatgattttggttatgacggtgatttctaccgcgcggaccaaccgaggtcagctccatcactgagacccaaagattatgaggttgatgcgacattaaaatcgctgaacaatcagattgagacactgctgacaccagaagggagtaggaagaaccccgcacgaacatgtagggatctccgactgtcccaccccgaatggagctctgggtactattggattgatccaaatcaaggatgtacaatggatgctattaaagtttactgtgacttctcaaccggggaaacatgcatccgagctcagccagaaaacatacctgccaaaaattggtataggtcatctaaggacaagaagcatgtttggctaggggagaccataaacgcagggtcccaatttgaatataatgtagagggcgtgacgagtaaggagatggcaactcagctggcatttatgcgtctactcgcaaattatgctagccagaacatcacataccactgcaagaacagcatcgcctatatggacgaagaaacaggaaacctaaaaaaggccgtgatcctgcagggctccaacgacgtcgaactagtcgcagaaggaaactcgcgcttcacttacaccgtgctcgtcgatgggtgctcaaaaaagacaaacgaatgggggaagacaattattgaatataagaccaacaagccctcccgactgccatttctagacattgcacccctggatatcggcggagccgatcaggaattctttgttgatatcgggcccgtgtgtttcaaa

SEQ ID NO: 32480 - DNA, 4098 bp, Artificial Sequence
  Description of Artificial Sequence: Synthetic coding sequence
atgcttagctttgtcgacactagaaccctgctgcttctggccgtgactctctgtcttgccacttgtcagagtctgcaggaggaaactgtgagaaaggggcctgcaggcgaccgaggaccccgcggagagcggggacctcccggtcccccaggcagagatggtgaggatggaccgaccggtcctcctgggccaccaggaccccctggtcccccagggcttggagggaacttcgcagcacaatacgacggtaagggtgtggggcttggaccggggccaatgggactcatgggtcctcgtggtccacccggggcagcaggagcacctggacctcaaggttttcaggggccagcaggtgagccaggggaaccaggtcagactggtccggcgggggcaaggggtccggccggcccgcccggtaaggccggagaagatggacatccaggaaaaccaggacgccctggcgagcggggagtcgtcggaccccaaggtgcacggggcttccctggaactcctgggcttcctgggtttaagggaatcaggggacacaatgggctggacggactcaagggtcagcctggcgcaccgggagtgaaaggagaacctggagcccccggcgaaaatggtaccccaggacaaactggtgctagagggctgcctggagaacggggtcgggtgggagcaccaggcccggcaggtgcaagaggctcagacggctcggtcgggccggtgggacccgcaggcccgattggatcggcaggtcccccaggattcccaggagctcccggtcccaaaggggagataggcgcggtgggcaatgctgggcctgcagggcctgctggcccacgcggagaagtcgggcttccggggctctcgggtccagtgggtccacctggcaaccctggagcaaacgggctgacgggagcaaagggtgccgccggactccccggagtggccggtgcgcctggtctgcctggtcctaggggaatccccggacctgtgggcgcggcaggagcgaccggagcgaggggacttgtgggagaacctggtccagctggatcgaaaggcgaatcggggaacaagggtgagccgggtagcgcaggaccacagggtccccctggcccgtcaggagaagaagggaagcggggtcctaacggggaggcaggtagtgcagggccaccaggtcctcctggcttgagaggttcgcctggatcaagaggccttcccggcgcagatgggagagcaggagtgatgggcccacccgggagccgcggagccagcggacccgccggagtccggggaccaaacggcgatgccggtagaccgggcgagcccggactgatgggccctaggggcctgcctggatcgccgggtaacatcgggcctgccggtaaggaaggtcccgtggggcttccaggtattgatgggcggccaggtccaataggtccggctggtgccaggggcgaacccggaaacatcgggtttcccgggccaaagggtcctacgggggatccaggtaagaatggtgacaagggccacgcaggacttgcgggtgcaagaggggcccctggtcccgatggtaacaacggggcacaaggacctcccgggccccaaggagtccaaggaggaaaaggagaacagggtccaccaggacctcctggatttcagggcctcccaggtccatccggaccggcgggcgaggtaggcaagcctggggaacgtggcctccatggcgagtttgggcttccgggtccggcgggaccccgaggtgagagagggcctcccggagaatcaggcgcagccggtcctactgggccaattggctcaagaggcccgagtggtccgcctggaccggatggaaacaaaggagaaccgggcgttgtgggagcagtgggaaccgcgggcccctcaggacctagtgggctccctggggagcggggtgcagccgggattcctggaggaaagggggaaaagggggaaccgggactgagaggtgaaatcggtaaccctggcagagatggcgcccggggagcgccaggagcagtcggtgcccctggccccgctggagcgaccggcgatcgcggcgaagcaggagccgctggtccagcaggacccgctgggcctcgaggctcgcctggtgaacgcggcgaagtaggacccgcaggacctaatggcttcgcaggcccggcgggggccgcaggacagcctggtgccaaaggcgaaagaggagcaaaaggtccgaagggagaaaatggtgtggtcggaccaacgggccctgttggtgcagcaggacctgcaggacccaacggtccaccgggtccagccgggagcagaggagacggaggtcctccgggaatgaccggattccctggagccgcaggaagaactggacctccgggcccatcaggaatctctggccccccgggaccacctggaccagctgggaaggaaggactgcgcggaccacggggagatcagggacctgtgggtcgtaccggagaggtcggcgccgtgggccctccagggtttgcaggggaaaagggacctagcggagaagcaggtacggcaggcccccctggtacccccggtcctcaggggcttcttggcgcgcctggtattcttggacttccaggttcaaggggagaacgcgggctgccgggagtggctggcgcggtcggcgagccagggcctctcggaatagccggccctcccggagcccgggggccaccgggggccgtgggatcacctggggtgaatggagcccctggggaggcgggaagggatggcaatccaggaaatgatggcccgcccggccgtgatgggcagccaggacataagggagaacgtggctacccgggaaacatcggaccagtgggggcagcaggtgcgcccgggccacacggacctgtcggaccagccggaaagcatggaaacagaggagagactggtccttccggacctgttggaccagcaggtgccgtcggaccacgcgggccctccggacctcaggggattcgaggagacaaaggagagccgggagaaaaggggccccgaggtctgcctggactgaagggccacaacggactgcaaggcctcccaggaattgccggtcatcatggtgaccagggagcccctggatcggtcgggcccgcaggccctcgcgggccggctggcccgtcgggccccgcagggaaggatggtagaaccggccacccaggaaccgtgggacctgccggaattaggggacctcagggtcatcaaggcccagcagggccacccggaccaccaggcccgccaggtccgccaggtgtgagcggcggaggatacgattttgggtacgatggagatttctacagagccgatcaaccgcggagcgctccatcactgcgcccaaaagattacgaggttgatgctacgctgaagtccctgaacaaccaaattgaaacgctcctcaccccagaagggagccgcaagaacccggcacgaacctgccgcgatttgaggcttagccatcccgaatggagctccggctactactggatcgaccctaatcaagggtgcactatggacgcaataaaggtgtactgtgatttttcgaccggtgaaacctgtattcgggcacaacccgagaatatccctgcgaaaaactggtatcggtcctccaaagacaagaaacacgtgtggttgggtgaaaccataaacgcaggttctcaatttgagtacaacgtggaaggggtgacttcgaaggaaatggcgactcaactggcttttatgcgtctgctcgcaaactatgcatcgcaaaacattacctaccattgtaagaactcgattgcttacatggatgaggagactgggaatctgaagaaggcagtgattttgcaaggatccaatgacgttgaactggtggcagaaggcaattcccgatttacttacactgtccttgtggatggatgttccaaaaagacgaatgaatggggtaagacgatcattgaatacaaaaccaacaaaccttcaagacttccattcttggacatcgccccactggacatcggtggagcagaccaagagtttttcgtggacattggcccagtgtgctttaag

SEQ ID NO: 32481 - DNA, 4098 bp, Artificial Sequence
  Description of Artificial Sequence: Synthetic coding sequence
atgctcagtttcgtggacacgcggaccctgttactcttagctgtcacactgtgcctcgccacctgtcagtctctacaggaggagaccgttaggaagggtcctgcaggagatagggggcccaggggagaacgtggcccccccgggccacctggccgcgatggtgaagatggtcccacagggccccccgggccccctggcccccctggcccccctgggttgggtggtaattttgcagctcagtatgatgggaagggcgtggggttgggaccaggacccatggggttaatgggccccagggggcccccaggtgcagcaggagctcctggtccgcagggtttccaaggaccagccggagagcctggtgagcccggccagactggaccagctggtgctcgcggacctgcgggacccccaggtaaggctggtgaagacgggcatccaggcaagcccggtaggcctggcgaacgcggcgtagtcggccctcagggggcccgcggatttcctggcacccctgggcttccaggttttaagggcattcggggacacaacggcctggacggcctcaaggggcagccaggcgcaccaggcgttaagggcgagccgggggcacctggggaaaacggaactccaggacagactggggcgaggggtctgcccggcgaaaggggccgggtgggagcacccggcccagccggagcaagaggcagtgatggaagtgtgggacccgtcggacccgccggccccattggatctgctggaccccccggctttcccggcgcccctgggcctaagggagagataggcgcggtggggaatgccggccccgccggccccgccgggccgcggggcgaggttgggcttccaggcctcagtgggccggtgggacccccaggcaatcccggcgcaaatggattgaccggcgctaagggggccgccggacttccaggagtggctggtgcccctggtttacccgggcctaggggaattcccggacctgtcggtgccgccggagccaccggtgctcgcggcctagtgggggagccaggacccgccgggtcaaagggagagagtggaaacaaaggggagccagggtcggctgggccgcagggtccccccggaccttcaggagaagagggcaagcgcggcccaaacggggaagctggctcagctggcccaccagggccccccgggcttcgaggttcgccaggttcccggggtctgcccggagctgacggtcgggccggagtgatgggtccacctgggtcaagaggagcctcaggacccgctggcgtgagaggtccaaatggcgacgccggacgcccaggcgagcctggcctgatggggcctcgcggcctcccaggcagccctggcaatattggccccgctggcaaagagggtcccgtgggacttccaggtattgatggcagacccgggcccattggccctgcaggggccaggggtgaacccggtaatatcggattccccggcccaaaaggccccacgggcgatccagggaaaaatggtgataaaggacatgcaggactggctggagccaggggagctcctgggccagacggcaataacggtgctcaaggtcccccgggccctcagggtgttcagggaggcaaaggcgagcaaggcccacctggcccaccaggattccagggactgcctggacccagtgggcccgcaggcgaggttggtaagcctggtgagagagggctccacggggaatttggacttcctgggccagccgggcctcgcggggagcggggcccaccaggcgagagcggcgccgctggtcccactggcccaataggtagccgcgggccatcgggtcccccaggacccgatggtaataaaggtgaacccggcgtggtgggagctgtgggaactgctggacccagcggcccttccggtttgcctggagaaagaggcgctgccggaatacccggcggaaaaggtgagaagggggagcctggtctccgaggagaaattgggaacccagggcgcgacggggcccgcggtgcgcccggcgcagtgggggcccccggcccagctggggcgacgggcgaccgcggcgaggcgggggccgctggcccagcaggtccagccgggccacgaggcagccctggtgagaggggcgaggtgggccccgcagggccgaacggtttcgctgggcccgccggcgcagctggacagcccggggctaaaggagaaaggggagctaaaggcccaaagggcgagaatggggtggtgggccccaccgggcctgttggagcggctggacctgcgggtcctaacgggcctcccggtccagccggctctcgtggagacgggggaccccccggcatgacaggattccctggggccgcaggccgcaccggcccacctggaccttctgggatttcgggcccccctgggcccccgggcccagccggcaaagagggcctgcgtggacctcgaggcgatcagggacccgtggggcgaaccggggaagttggtgccgtgggacctccaggcttcgcaggcgagaagggtccatctggggaagcgggcactgctggacctccggggactcccggaccgcaggggctcctgggcgcccctgggatactgggtctgcctgggagccgtggtgaacgggggttacctggcgtggcaggagcagttggggagcctggcccactcggcatcgctggacctcctggggcgcgaggcccgcctggggccgtgggtagtccaggcgtcaatggcgcgcctggtgaggctggacgagacggaaatcccggcaatgacgggccacccggaagggacgggcaaccaggtcataagggcgagcgcgggtacccaggtaatattggccctgtcggtgctgcgggcgcacccggaccccacggccccgtggggcccgcaggcaagcacggcaatcgaggtgagactggccccagcggccccgttggcccagccggggcggtgggcccgagaggtccttctggtccacaaggcatccggggagacaagggggaaccaggcgaaaaaggaccgcgaggcctgcccggactcaaggggcacaatggcttgcagggcctgcccggcatcgctggccaccacggcgatcagggcgctccaggatccgtcggtccagccggccctcggggtccggctggaccctccggccccgccggcaaggatggaaggaccggacatcctggtacagttggacccgcaggaattagaggaccccagggtcaccagggccctgcggggccgcccgggcctccaggcccgccgggaccacccggcgtttcaggcggtggctatgacttcggttatgatggtgacttctatcgcgcagatcagccgcgaagtgcacccagtctgcggccaaaggattatgaggtcgacgccaccctgaagagtctgaacaaccaaattgaaacactgttaacgcccgaagggagccgcaaaaatcctgcccgtacatgcagagaccttagattaagccaccctgagtggtcgtccggttactattggattgatcctaaccaggggtgcacgatggacgcgatcaaagtttactgtgatttcagtacaggcgaaacatgtatcagggcgcagccggagaatatccctgccaagaactggtatcgatcatcaaaagacaagaaacacgtgtggctgggcgaaactatcaatgcaggcagtcagtttgaatataacgtggagggcgtgacgagtaaagagatggcgacacagctggcgtttatgcgactgctcgccaactacgcttcccagaacattacatatcactgtaagaactccattgcatacatggatgaggaaaccgggaatctgaaaaaggcggttatcctgcaggggtcaaacgacgtggagcttgtggcggagggaaacagtcgattcacgtataccgtcttagtggatggctgttccaagaagaccaacgagtggggcaagaccattatcgagtataagacaaacaagccatcacgcctccccttcctggacatcgcacccttagacattggcggagcggatcaagaattctttgtagatatcggacccgtgtgttttaaa

SEQ ID NO: 32482 - DNA, 4098 bp, Artificial Sequence
  Description of Artificial Sequence: Synthetic coding sequence
atgctgtcctttgtggacacaaggacactgctactgctggctgttactttgtgtttggcaacctgtcagtccctccaggaagaaactgtcagaaaggggccagctggcgatcgcggccccaggggcgagagaggccctccgggtcctcccggccgtgacggagaagatgggccgacagggccccctggaccacccggacctcctgggccccctggactgggaggaaatttcgcagctcaatacgatggcaagggggtaggtttgggaccaggacccatgggcttgatggggccccggggcccccccggggcagccggtgcacctggccctcagggattccagggacctgctggcgagcctggggaacccggccagaccgggccggcgggcgccaggggcccggccggcccacccggcaaggcaggggaggacggacaccctggaaagcctgggcgaccaggggaaaggggagtagttggaccacagggcgcacgtgggttccctggtacacctgggctgcccggatttaagggcatcaggggccacaatggcttagacggcctgaagggccagccgggtgcaccgggggtcaaaggggaacccggcgccccgggtgaaaatggcaccccagggcagacaggcgcccggggcctgcccggagaaagaggacgcgtgggcgcccccgggcccgcaggtgcccgcgggagcgacggatcggtgggtcccgtggggcccgctggccctataggctctgctggcccaccagggtttccgggcgcccctggcccaaagggcgagatcggggccgtgggcaacgccggcccagccggacccgcgggaccaagaggcgaggtggggttgcccggcctctccgggcccgttgggcccccaggaaacccaggggcaaacgggctgaccggtgccaagggtgccgccgggctacctggggtggcgggagccccagggttgcccggtcctaggggtatcccaggccccgtaggggctgccggagccacaggtgctagggggctcgtgggagaacccggaccggcgggttccaagggggagtccggaaacaagggagaacccgggtccgccgggccacaggggccccccggcccaagcggggaggagggaaaacgggggcctaacggcgaggccgggtcagccggcccacctggcccccccgggttacgaggctcacccgggtcgcgaggtctaccaggggccgacggtcgggccggggttatgggcccacccggaagccgaggagcttccggacctgccggagtgcggggaccgaacggcgacgctggtagacctggtgagccagggttgatgggaccacggggcctgccaggaagccctggcaacattgggccggcgggaaaagaaggtcctgtagggctgccgggcatcgacggacggccaggacctataggtccggccggcgctagaggtgaacccggaaacatcggcttccctggtcccaagggccccacgggtgaccccgggaagaatggcgacaaaggccacgccgggctcgccggagcaagaggagcccccgggccagacggtaataatggtgcacaaggtcctcctggaccacagggagtgcagggaggaaagggggagcaaggccctccgggcccgcctggatttcagggcttacccggaccatccggtcccgctggggaagtcggaaagcctggcgagcggggtttacacggcgagttcgggctgccaggacctgccggtccacggggggaaagaggaccaccgggagagtctggcgctgccggccccaccgggccgatcggaagtcgcggcccttcggggccacctggtcccgatgggaacaaaggggagccaggggtggtgggagccgttggtactgcaggccctagtggaccatctggtctgcccggcgagcgtggggctgcaggtatcccgggagggaagggagagaagggtgagcccgggttaaggggagagatagggaaccccggacgcgatggagccaggggcgcaccgggggccgttggagcgcccggacccgccggggccaccggagacaggggggaggccggcgcagcaggccccgctggacccgccggacctagggggagcccaggggaacggggagaagtgggcccagcgggccccaacgggttcgctgggccagcgggggctgcaggccagcccggggcaaaaggcgagcggggtgctaaaggacctaaaggagagaatggcgtggtcggtccaacagggccagttggtgctgctggacctgccggccccaacggcccgccaggaccggcaggttcgcgaggcgatggcgggcctcctgggatgaccgggttccctggtgccgctgggcgaaccggcccccccggaccgtcagggattagtgggccccctggaccccccggtccagcagggaaagaaggcctcaggggccctcgcggcgatcaagggcccgtcggacggaccggagaggtcggcgcggttgggccccccggttttgccggtgagaagggcccctccggcgaggcaggtactgcgggtcctcctggaactcctggccctcaaggactcctgggggcgcccggcatcctcgggctccctggctctagaggggaacgcggattgcctggggtggcaggcgcagtgggggaaccgggccccctgggtatagcaggccctcccggagctagaggaccacctggagctgtgggttcgccaggtgtaaacggagcccctggagaggcggggcgggatggcaatcctggcaacgatggaccacctggtagagacggccagccaggacataagggcgaacggggatatcccggcaacataggccctgtgggagcggcaggcgccccaggaccgcatgggcctgtaggtcccgctggtaaacatggcaacagaggagagaccgggccgtctggccctgtaggaccagctggggctgttggacctagaggacccagcggaccacaaggcatcaggggcgataagggcgagccgggggaaaaaggtccgagaggcctccctggattaaaaggacacaacggcttgcagggcttacctgggattgctggccatcacggcgaccagggtgcacccggatctgtcggaccagccggaccaaggggaccggctgggccttcaggtcccgccgggaaggatggtaggacaggacatcctggcaccgtaggcccggccggcatccgagggcctcaggggcatcagggccccgcgggaccacctgggcctcctggcccgccggggccacccggtgtgagcggggggggctacgactttggatacgatggagacttttacagagctgaccagccgaggtcagctcccagcctccggccaaaagactatgaagtggacgctaccctcaagtctctcaataaccaaatcgagaccctattgactcctgagggcagtagaaaaaaccccgcaaggacctgtcgagacctgcgcctgtctcatccggagtggtctagcggctactactggatcgacccaaaccagggatgcactatggatgcgataaaagtatactgtgacttttcaaccggcgagacatgcatccgtgcccagcctgagaacattcctgccaagaattggtaccggagctctaaggataagaaacacgtttggctgggggaaaccataaacgctggcagtcaatttgaatataacgtggagggggttacgagcaaagaaatggccactcagcttgcctttatgcgcctcttagctaactacgcttcccagaatataacttaccattgcaaaaattcgatcgcctacatggatgaggaaacgggaaacctgaagaaggctgtgattttgcaaggctccaatgatgtggaactagttgctgaggggaactctagatttacctatacagttctggttgacggctgctctaagaaaacgaatgaatgggggaaaaccatcatagagtataagacaaataaaccgtctcggctgccatttctggacatcgccccattagacatcgggggtgctgatcaggaattttttgtggacataggtccagtgtgctttaag

SEQ ID NO: 32483 - DNA, 4098 bp, Artificial Sequence
  Description of Artificial Sequence: Synthetic coding sequence
atgctatcctttgttgacacaaggacactactcctccttgctgtcaccttatgcctagcaacctgccagagtctacaggaggagacagtgcggaaggggcctgcaggagatcgtggacccagaggcgagcggggcccccctggacctcctggtcgcgatggagaagatggaccaacaggccctcctgggcctcccgggccgcctggaccgcccggtttgggggggaattttgctgctcaatacgacggcaagggtgtcggtttagggcccgggcccatgggtcttatgggaccccggggccctcccggcgcagcaggtgccccgggcccccagggattccagggccctgcaggagagcccggcgagccaggccagactggacctgcaggagctagaggcccagctggcccgcctgggaaagccggggaggatggccaccccggcaagcctggccggcccggtgagaggggagtggtgggtcctcagggcgctagagggttccctggtactcccgggctaccaggttttaaagggatacgggggcacaatggcttggatgggcttaaaggtcagcccggagcccccggagtcaagggggagcccggcgcccctggggaaaacggcaccccaggtcagactggtgcccggggattgcccggtgagagaggcagggttggtgcacccggtccagcgggcgcaagggggtctgacggctcagtgggccccgttgggccggccgggccaattggcagtgccggccccccgggattcccaggggctcctggaccaaagggcgagattggggcggtcggtaatgcgggccccgccggaccagccgggcctcgtggagaggtaggtcttccaggtctctccggtcctgtcgggccaccaggtaacccaggggcaaacggactgactggcgcaaagggtgcagccggactccctggcgttgcaggggcccccgggctgcctggaccccgagggataccagggcctgtgggggccgccggggctaccggagcccggggattggtgggtgaacccggacccgcggggtctaaaggagagtcaggtaataaaggcgaaccaggcagtgccggacctcagggtcccccagggccatcgggggaggaaggcaagaggggacctaatggtgaggctgggtctgcgggaccccccgggccaccaggtctgcgtggaagccccggcagcagggggctgccgggcgcagacgggcgagctggggtcatgggcccaccaggatctagaggcgcgtctggccctgcaggggtcagggggccaaacggagatgccggcaggcccggtgaacccggattgatgggcccacggggactgcccgggtcgcctggcaatatcggacctgccggtaaggagggtcccgttggcttaccagggattgacggaagacccggacccattggccccgccggcgcacggggggaaccgggaaacattgggtttcccggaccgaaaggccccaccggggatccagggaaaaacggagataaagggcatgcgggcctcgctggtgcccgcggcgcccctgggcctgatggcaataacggagcgcagggtccccctgggcctcagggagtgcaggggggaaaaggggagcagggaccacctggcccacctgggtttcagggcctgcccgggccgagtggtccagcaggggaagtaggcaagcctggggaacgcgggctgcacggcgaattcggtctcccaggacccgcgggtccacgcggcgagcgagggccaccaggagagtctggggcagccggacctacaggccctataggctctaggggcccttccggccctcccggaccagacgggaacaaaggcgagccaggcgtagtgggggccgtgggcactgccggcccatcggggccatcaggtcttcctggtgaacgaggagccgcaggtatcccaggagggaaaggagagaaaggagaaccagggctgcgcggcgaaataggtaatcccgggcgagacggcgcaaggggagcgcccggtgcggttggagctccagggcccgccggtgctaccggggatcgaggcgaggccggagcggcgggacccgccggcccagccggacctaggggcagtcccggagagaggggtgaggtagggcccgctggacccaacggctttgcagggccagctggcgcggctggccagcccggtgctaaaggcgagaggggcgctaagggccctaaaggtgagaacggcgttgtcggacccaccgggccggttggcgcggctggcccagcaggcccaaatggcccgccaggaccagccggctcccgcggtgatggagggcctccaggcatgaccggatttcccggcgctgcaggacgcactgggcccccggggccaagcggaatttctggccctcctggaccgccaggcccagcaggcaaggaaggattgagaggtcccaggggcgaccaggggccagtgggccggaccggggaggtgggtgctgtggggccacctggatttgctggagagaagggccctagcggagaggccggcacggctggtcctccgggaacccctggtccacagggactgttgggagccccagggatcctcggactgcctggatctagaggggagcgcgggctgccaggggtagcgggcgccgtgggcgagccagggccgctggggatcgcaggcccaccgggagctagaggcccaccaggggcggtgggatcgcctggggtaaacggggcccctggcgaggcaggaagggacggtaatcccgggaatgacggacctcctgggcgtgacggacagcccggacataaaggagaacgtggttacccgggcaatattggccccgtgggagcagccggcgcccctgggcctcatggccccgtagggcctgcagggaagcatgggaatagaggtgaaacagggcctagcggacctgtaggccccgccggagcagtggggcccagaggcccgagcggccctcaaggcattaggggcgacaaaggggaacccggggagaaggggccaagaggactgcccggacttaagggtcataatggactgcagggccttccagggatcgcagggcatcacggagaccagggtgcgcctggatcagtgggccccgccggaccccgggggccagcgggtccttccggaccagctggtaaggacggtcggactggccatccagggactgtgggtcccgccgggatccgcggtccccagggccaccagggccccgcaggcccccctggccccccaggtccccctgggccaccgggtgtgtcggggggcggttacgacttcggatacgatggcgatttctatcgcgcggatcaacctcggagtgccccatcactacggccaaaagactacgaggtcgatgcaaccttgaagtctctgaacaatcagattgagactctgttaacacccgaaggctcacggaaaaaccccgctcggacctgccgggatctgcgtctgagtcaccccgagtggagtagcggatactactggatcgacccgaatcaaggctgcaccatggacgctatcaaggtgtattgtgatttttctaccggagaaacctgcatcagagcccagcccgagaacatccctgccaagaattggtacagaagctcaaaggacaagaaacatgtgtggctgggcgagaccataaatgctggcagtcaattcgagtacaatgtggagggagtaactagcaaggagatggctacacagttggcttttatgcgattgctcgcgaactatgctagtcaaaacatcacctaccactgcaagaattctattgcttacatggatgaggagaccggcaatttaaaaaaagccgtcatattacaggggagcaatgacgttgaactcgttgctgaagggaacagccgctttacctacaccgttctcgtggatggctgctctaaaaagacaaacgaatggggaaagaccatcatcgagtacaagacgaacaaaccaagccgacttcccttcctggatattgcccctttggatattggtggggccgatcaggaattctttgtggacattgggccagtgtgttttaaa

SEQ ID NO: 32484 - DNA, 4098 bp, Artificial Sequence
  Description of Artificial Sequence: Synthetic coding sequence
atgctgtcctttgtggacacgcgcactcttctcctgcttgccgtcactctttgcctcgctacctgccagtcgctgcaagaggagactgtgcgcaagggaccggccggcgatcgcggacctcgcggcgaacggggtccaccgggacccccgggaagggatggggaggacggacctactggtccccctggaccgccagggcctccgggcccgccgggcctcggaggaaatttcgcggcacaatacgatggaaagggcgtgggcctgggaccgggtccaatgggactgatgggaccacgggggccgccgggggccgctggagcaccgggcccgcagggcttccaaggcccggcaggagagccaggagaaccgggacaaaccgggccggccggagctcgaggtccagcagggccgccaggaaaagccggagaagatggacacccgggtaaaccgggacgccccggagagcgcggtgttgtgggaccgcagggagcccggggctttccggggacccctgggctcccaggcttcaagggaatcagagggcataacggtctggacggactgaagggacagccgggcgcaccgggcgtgaagggcgaacctggggcgcctggtgaaaacggaactcctgggcagaccggagccagaggactgcctggagagagggggcgcgtgggagcgcctgggccggccggtgccagggggtcagacggaagcgtcgggccagtcggtccagccgggccgattggctccgctgggcctcctggatttccgggggcacctggaccgaagggagaaatcggcgcggtcggaaatgcgggcccagcagggccagcgggaccaagaggagaagtgggactccccggtttgtctggaccagtgggaccaccaggcaatccgggggcaaacggactgactggggccaagggagctgcgggcctgccgggcgtcgccggcgcccccggactcccgggtccgagaggaatcccaggtccggtaggcgcagcaggcgcgaccggcgcgcggggtctggtgggggagcctgggccagcaggttcaaagggggaatcgggaaacaagggtgaaccaggatcagccggacctcagggacccccaggtccgagcggagaagaagggaaacgggggccgaacggtgaagctggcagcgccgggccgcccggtccgccgggactgcgcggatcccctgggagtcgcggcctcccaggtgccgacggtagagctggtgtcatgggccccccaggatcccgaggcgcctccggccccgccggggtgcgagggcccaatggagacgcgggtaggccaggcgagccaggtctgatgggtccacggggcctgccaggtagcccgggtaatatcggacctgcagggaaggaaggaccggtcggcctgccaggcatcgacggacgcccgggtccaatcggcccagccggagctcgtggcgaaccgggcaacatcggcttcccgggccccaaaggccctaccggggaccctggaaagaatggagacaaaggacacgcaggactcgctggagcgcgcggagcgccgggccctgatggaaataacggagctcaggggcctcctgggccacaaggtgtgcagggtggaaaaggcgaacaaggacccccaggcccgccgggattccagggactcccgggaccttctggcccggccggagaggtgggaaagccgggagagcggggactccacggcgaattcggcctgccgggtcccgccggacccaggggcgagcgcggaccgcccggagagtcgggcgccgcgggtcccacgggcccgattggaagccgggggccatccggcccacctgggccggacggaaacaaaggagaacctggcgtggtgggcgctgtgggaacggccgggccaagtggaccgtccgggcttccgggtgaaagaggtgccgcaggcatcccgggaggtaaaggcgagaagggagagcctggactcagaggagagatagggaatcctggacgggacggagcgcgaggagctccaggtgctgtcggagctccggggccagcgggggctaccggtgaccgcggagaggcgggcgcagcggggcccgctggaccagcgggtccacgcggctcccctggcgaacggggagaagtgggtccagccggcccgaacggattcgccggtccggcaggtgcggccggacagccgggagctaagggtgaacggggggctaagggcccaaagggcgagaacggagtggtggggcccacgggtccggttggcgccgcagggccagctggtccaaatggacctccagggccggccggctcaagaggcgacggaggaccgcctggaatgactggctttcctggagcagcgggccgcaccggacctccgggccctagcggcatctcaggacctccgggtccaccagggcctgcaggtaaggaggggttgcggggcccgcgcggcgatcaagggcctgtgggaagaacgggcgaggtcggagcagttgggccccccggtttcgctggagaaaagggaccgtctggggaggcgggcactgcgggaccgccggggaccccgggtcctcaggggctgttgggagccccgggcatcctgggtctgccaggctcgcgcggagaacgtggcctcccgggggtggccggagccgtaggagagcctgggccgctgggaatcgccggaccacctggggccagagggccgcccggagccgtgggaagcccaggtgtgaatggggcaccgggagaagcaggaagagacgggaacccgggaaacgacggccctccaggacgggatgggcagcccggacataagggggaacgcggatacccaggcaacatcggtcctgtgggtgcagccggagcccctggcccccacgggcctgttggaccggcgggcaagcacggcaacagaggcgaaaccggaccgtcagggccggtcggaccggccggggccgtcggccctagaggtccctccggaccgcagggtatccgcggcgataagggggagcccggagaaaaaggaccgcgaggtttgcccggcttgaagggacataatggacttcaaggccttccaggaatcgcagggcaccatggagatcagggagcccctggatcggtgggaccagctggaccccggggaccagcgggaccgagcggccccgcggggaaggacgggcgaacgggacacccgggaactgttggacccgcgggtatccggggtcctcaaggccaccaaggaccggccggaccgcctggcccacctggtccaccgggccctccaggcgtctccggtggaggatatgacttcgggtacgacggagacttctaccgagcagatcagccaaggtccgccccgtcactgcgaccaaaggactacgaggtggatgcaactttgaagagcctcaacaatcaaatcgaaactctgctgactccggagggatctcggaaaaaccctgctagaacctgcagggatctgcgcctctcgcacccagagtggtcgtcgggatactactggatcgatccgaaccagggctgcaccatggatgcgatcaaggtgtactgcgacttttcaaccggggaaacctgtatccgggcgcagccggaaaacattccggcaaaaaactggtatcgctcaagcaaggataagaaacacgtgtggttgggagaaaccatcaacgctggatcgcaatttgaatacaacgtggagggggtgacttcgaaagaaatggcaactcagctcgcgttcatgcgcctcttggctaactacgcctcccagaacataacttaccactgtaaaaactcaattgcctacatggatgaagaaaccggtaatctgaagaaggccgtgatcttgcagggctccaatgacgtcgagctcgtcgcagagggaaatagccggttcacttacaccgtactggtggatggatgctcgaagaaaactaacgaatggggaaagactattatcgagtacaaaacgaacaagccatcccggctcccattcctggacatcgccccactggatatcggcggagctgaccaagagttcttcgtcgacattggaccagtgtgtttcaag

SEQ ID NO: 32485 - DNA, 4098 bp, Artificial Sequence
  Description of Artificial Sequence: Synthetic coding sequence
atgttgagcttcgtggatacgaggactcttcttctcctcgctgtgacgctgtgcctggctacctgtcagtcactccaggaagagacagttaggaaaggcccagcaggagatagaggcccaaggggagagcgcgggcctccaggccctcctggtcgggatggagaagacggcccaaccgggccccccggcccaccaggaccaccggggccccccgggcttggcgggaactttgcagcacagtacgacggaaaaggcgtgggactgggccctggcccaatgggcctcatggggcctaggggaccccctggcgctgccggcgcacctggcccccaagggttccagggacctgctggcgagcccggggagccagggcaaacaggacctgccggagctcgaggccccgcaggccctccagggaaggccggagaggatggtcatcctggcaaaccgggcaggcccggtgagagaggtgtagtaggcccccagggggctaggggcttccctggcacacctggcctccccgggttcaaaggcattcgtggacataacggtttggatggactgaaaggacaaccaggcgcacctggcgtgaagggtgagcccggtgcacccggtgagaacggtactcctgggcaaaccggtgcacgcggcttaccaggggagcgcggaagggtgggcgcccccggcccagcgggggctcgcggctctgatggcagtgtaggacccgtgggacctgctggtccaatcggcagtgcgggacccccaggctttcctggagctcctggccccaaaggagaaatcggagcggtcggtaacgcaggacctgccggccccgcagggccaaggggcgaggtcggcctgcccggtctgtcaggccctgttggcccccccggtaatcccggcgctaacgggctgaccggggctaagggcgctgctggtctccccggagtggctggggctcccggactgccagggccacggggaattcctggccctgtcggggcagctggggcaaccggagccagggggctcgtcggagagcctggaccggccggctcaaagggggagagcggaaacaaaggcgagcctggatcagccggccctcagggcccccctgggcctagtggcgaggaaggaaaacgaggtccaaacggagaggcaggcagcgctggaccacctggacctcccggacttagaggcagcccaggcagcaggggcctgccaggggccgatggaagagcaggagtgatgggtccaccggggagccggggcgctagtggccccgcaggcgtacgcggccccaatggagacgctgggaggcccggagagcccgggctcatgggcccacgtggactgccagggagtccaggcaacattggccccgctggcaaagaaggacccgttgggctgcccggcatcgacgggaggcctggacctataggcccagctggcgcaaggggagaaccaggcaacattggcttcccgggaccaaagggtccaaccggggaccctgggaaaaacggagacaaaggccatgccggactggctggcgctaggggggcccctggacctgacggaaataacggcgcacaagggccaccaggaccccagggagtgcagggaggtaagggcgaacagggccctcccggcccgcctggtttccagggactccctggaccaagtgggccagcaggcgaggtgggcaaaccgggcgaacgcggcttgcatggagagttcggactaccaggacctgctggtcctagaggagaaagaggcccacctggggagtcaggagcggccgggccaacaggaccgattggatcacgcggccctagcggccccccaggccctgatggtaacaaaggggaaccaggagtggtcggggctgttggaacagcaggccctagtggaccgtcaggtctccctggcgaacggggagctgctgggatcccgggcggtaaaggcgaaaagggggaaccaggcttacgcggggaaataggcaacccgggcagagatggagcccgcggagctcctggagccgtgggagctcctggcccagcaggcgctaccggggacagaggcgaggctggcgctgcagggcccgcagggccagccggaccccgtgggagtccaggggaacgcggagaggtgggcccggctgggccaaacggatttgcgggaccagcaggagcagcaggccagcctggagctaaaggcgaacggggagcaaaaggtccaaaaggggaaaacggtgtggtgggcccaaccggaccggtcggcgcagcaggacctgccgggccaaacggtcctcccggtcctgccggaagcaggggggacggtggtccgcccgggatgaccggctttcctggggcagctggacgaacggggccaccaggcccatccggcatttctggtccgccgggtcccccaggacccgctggaaaggaaggattgagagggcccaggggagaccagggaccagtgggacgcactggagaggtgggcgctgtggggccaccaggattcgcgggtgaaaaaggcccgagcggcgaggccgggacagcaggtccacctggaacacccggcccccaagggctgctgggagcaccgggcatattaggactcccgggatctagaggtgaaagaggacttcctggggtggcaggtgctgtcggggaacccggccctcttggcatagctggaccccctggggcccgcggaccgcctggagcggtgggcagtcccggagttaacggagcccccggagaagcgggccgagatggtaaccccggaaacgacggtcctcctggaagagatggacaaccaggacacaaaggagagcgcggttaccccgggaacatcggacctgtaggcgctgctggagcaccaggacctcatggccctgtgggccctgcagggaagcatggcaaccggggtgaaacaggccctagtggtcccgtaggacccgctggggctgtcggaccacggggtccatcaggtccacagggtattaggggcgataaaggagaacccggggaaaagggcccaagaggcctgccaggcttgaagggccacaacgggttgcagggactacctggaatcgcaggacaccacggtgatcagggagctcctggcagcgtgggtccagcgggaccaagaggaccagcaggacctagcggaccagcaggaaaagatgggaggaccggacatcctggaacggtcggtcctgctgggatccggggccctcaggggcaccaaggacccgctggaccccccggccctcccggccctcccggtccacccggagtgtctggtggtgggtatgattttgggtacgatggggatttctatagagccgatcagccccgcagtgccccgtcgctgagacctaaggactatgaggtggatgctacgcttaagagcttgaacaaccagatcgagaccttactgacacccgagggctccagaaagaacccagcgagaacctgccgtgatcttaggctgtcacatccagagtggagttctggatactactggatcgatccaaaccagggatgtacaatggatgctattaaagtgtattgtgacttctctaccggtgagacttgcatcagagctcaaccagaaaacatccccgcaaaaaattggtacaggagcagtaaggataagaagcacgtctggctcggagagacaataaatgctggcagccagtttgaatacaatgtcgaaggagtgacaagtaaagagatggcgacccagttggcattcatgcggcttctggcaaactacgcatcccaaaacattacataccattgtaaaaactctatcgcttatatggatgaggagaccgggaacctgaaaaaagcagtcatcctgcaaggcagcaacgacgtcgagctggtcgctgaagggaactcccgcttcacttacaccgtcctggtggatggctgtagcaagaaaaccaatgaatggggaaaaaccataatagagtacaaaaccaacaagccttctagacttccatttctggatatcgccccattggacatcggtggagctgatcaggagttctttgtcgacatcggacctgtgtgctttaaa

SEQ ID NO: 32486 - DNA, 4098 bp, Artificial Sequence
  Description of Artificial Sequence: Synthetic coding sequence
atgctgtcattcgtggatactcggacgctgctgctgttggctgtgactctctgccttgccacctgccaaagcctccaggaggagactgtgcgcaaaggccctgcgggtgatcggggcccgcgtggtgaacggggaccccccggccctccgggacgggacggagaggatggccctaccggtccaccagggccgccgggtccccccggaccaccaggattgggagggaacttcgcagcccaatacgatgggaaaggagtcggcctcggcccagggcctatgggactcatgggtccaagaggtccccctggcgcagcgggagcgccaggaccacagggattccaaggacctgcgggagaaccgggggagccgggacagactggcccggccggcgccagaggcccagccggcccacccgggaaagcgggagaggacggtcatccaggcaagcctggacgccccggtgagcgtggagtggtgggaccccaaggagcgcggggtttcccgggaacgccgggactgcctggttttaagggaatccgcggccataacggactggatggattgaaagggcaaccgggggcgccgggtgtgaagggcgaaccgggagcaccaggagagaacggcaccccgggtcagaccggagcgaggggacttccaggtgagcggggccgcgtcggtgcgccagggccagcaggggctcgcgggtccgacggcagcgtcggaccagtgggtcctgccggaccaatcggctctgctggaccacccggctttcccggagccccgggaccgaaaggtgaaattggagcggtcggcaatgccggaccagcgggccccgccggcccgcgcggtgaagtgggactgcccggtctgtccggaccggtcggtccaccggggaacccgggagcaaatggactcacgggggctaaaggcgcggcgggattgcctggagtcgctggagccccaggcttgccgggaccacgcggaatccctggaccggtgggagcagccggagctactggcgcccgcggtctggtcggagaacccggacccgccggctccaagggtgaaagcggaaacaagggagagcctgggtcggccggcccgcaagggcctccgggaccgagcggagaagagggcaagcgaggacccaacggagaagccggctcggcagggccaccaggtcccccagggctccgcggttcgccaggcagcagagggctgcccggagcagacggacgggcaggtgtgatgggacccccggggtcacgtggggctagcggccctgcaggcgtgcggggaccgaatggcgacgctggccgccctggcgaacctggactcatgggacctcgagggctcccgggctctccaggaaacattggacccgctggtaaggagggcccggtgggcctcccaggtatcgatgggcgcccaggaccaatcgggcctgcgggcgcgcgcggcgaaccgggcaatataggcttccccggaccgaagggtccaacgggggacccggggaaaaatggcgacaagggacacgctggactcgccggggcccggggtgccccgggccctgacggcaacaacggagcacagggcccgccaggaccccagggagtacagggcgggaagggagagcaaggcccgcctgggcctccgggctttcagggactcccaggaccgagtggaccagcgggggaagtcgggaagccaggcgaacgagggcttcacggcgaattcggactgcctggaccggcgggaccgaggggagagcggggtccgcccggtgaatcgggggccgccggcccgaccggcccgatcggatcgcggggcccatccggaccacctggaccggatgggaacaaaggtgagccaggagtcgtcggcgcggtcggaactgcaggaccatcaggaccatctgggctgccgggagagaggggagcggccggaatccccggaggaaagggtgaaaagggtgaacccgggctgcggggagaaatcggaaatcccggcagggacggagcccgcggagcaccaggcgctgtgggagcccctggaccggctggagcaactggtgatcgcggagaggcgggtgccgcaggcccagcaggacccgctggcccaagagggtccccaggagagcgaggtgaggttggacctgccggtcctaatggatttgctggacccgccggagccgctggtcagccgggagccaaaggggaaagaggagcgaaaggccctaagggcgaaaacggcgtggtcggccctaccgggccagtgggggcagccggacctgcaggacctaacggaccgccggggccagctggatcccggggagacggaggaccccctggtatgaccggcttcccaggagccgccgggcgaactggcccccctggaccctcgggcatcagcggtcccccaggcccgccaggtccagccggcaaggagggccttcgtggcccgagaggggatcaaggtccagttggacgcaccggagaagtcggagctgtcggtccgccaggatttgcaggtgagaagggaccatcgggagaggccggaaccgctggcccgcccgggaccccgggaccacaggggctgctgggagccccgggcatcctcggcctcccgggctcgaggggggaaagaggtttgcctggagtggcgggcgcagtgggggagcccgggccactgggcatcgcgggaccgccaggagcccgcggtcctccgggggccgtgggatcccctggggtgaatggcgccccgggcgaagcgggccgcgatggaaacccaggaaacgacgggcctccggggagggatggacagccggggcataagggcgagcggggctatccgggtaacatcggtccggtgggtgctgcgggagctcctggcccgcacggtcctgtgggtccagccgggaagcatggaaatcggggagaaaccggacccagcggtccagtgggtcccgcaggggccgtcgggccacgcggaccttccgggccgcaggggattcggggagacaagggggagccaggtgagaaaggcccgagaggactgcccggccttaaaggacacaatggcctccagggtctgccgggaatcgcggggcaccatggagatcagggggcaccaggttcagtcggtccggccgggccgcgggggccagcaggaccatccgggccggccggaaaggacggaagaaccggtcacccgggaactgttggcccggcgggcatcaggggcccccaaggacaccagggtccagctggtccccctggtcccccaggaccgccaggtcctccaggagtgagcggaggaggctacgacttcggatacgacggagacttctaccgggcggatcaaccgcgttcagcgccgagtctgcgccctaaggattacgaagttgatgctaccctgaagagcctcaacaatcagatcgagactctgctgactccggaaggatcgagaaagaatcctgcccgcacttgccgcgaccttcgcctctcccatccagaatggtcgtccggatactactggatcgacccgaaccaaggatgcactatggacgcaatcaaggtgtactgtgacttcagcaccggtgaaacctgtatccgggcgcaacctgaaaacattccggccaagaattggtaccgctcgtcaaaggacaagaaacacgtctggctgggggagactatcaacgctgggtcacagttcgagtacaacgtggaaggagtgacgtcgaaggagatggctacccagctggcctttatgaggctgctggccaactacgcctcgcagaatatcacctaccactgcaagaacagcattgcctacatggacgaggaaactggaaacctgaagaaagcagtcatactccagggctctaacgatgtcgaactggtggctgaaggcaattcaagattcacgtataccgtgctggtggatgggtgctcgaaaaagactaatgaatggggaaagaccatcatcgaatacaagactaacaagccatcgcggctgccgtttcttgatattgctccgctggacatcggtggcgctgaccaggaattcttcgttgacatcggaccagtgtgctttaag

SEQ ID NO: 32487 - DNA, 4098 bp, Artificial Sequence
  Description of Artificial Sequence: Synthetic coding sequence
atgctcagctttgttgacactaggaccctgctgcttttggctgtgactctttgtctggcaacctgccagtccctgcaggaagaaaccgtgcggaaaggtcctgcgggagatcgggggcctcggggtgaacgcgggccaccaggcccacctggccgggacggagaggacggacctaccggaccacccggccctccggggcctccagggccacccggactcggaggaaatttcgcggcccagtacgacggcaagggtgtgggactgggcccgggaccgatgggactgatgggtcctcggggccccccgggagcagccggggccccaggcccacagggtttccagggtcccgctggcgagcccggtgagccgggccaaaccggaccggctggggctcgcgggccggccggaccgcctggaaaagccggcgaggatggacatccgggcaagccgggacgaccgggcgagcggggagtcgtgggacctcagggtgccagaggattcccaggaacgccaggcctgcccggattcaaggggatcagaggacacaatggcctcgacgggctgaaggggcaacccggagctcccggcgtcaagggggagccgggcgcaccgggggaaaatggtaccccgggacagactggagcccgtggtctgccgggagaacgcggacgcgtgggtgccccgggaccggccggagcccgcggaagcgatggctccgtggggcccgtgggaccggcaggcccaatcggtagcgccggccctccaggtttcccaggggccccagggccgaaaggcgagatcggagctgtgggcaatgcgggccctgccggaccggcggggccacgcggtgaggtgggcctgccaggcctgtccggaccggttggtccgccagggaatccaggggcgaacggtctgaccggagctaagggtgccgctggactgcctggagttgccggagcgcccggactgcctggtcctcgcgggattccgggcccggtgggtgccgccggcgcgacgggtgcccgcggcctggtgggagagcccggcccggccggatcaaagggagaatctggaaacaaaggggagccaggaagcgcgggaccccagggaccgccgggtccatcgggcgaagaaggcaagaggggacctaacggcgaagccggatccgcaggacctcccggtccacctggactccggggctcgccggggtcgagaggactccctggcgcggacggaagggctggagttatggggccgccaggctcccggggagcgtcaggaccggccggcgtgcgcggccctaacggcgacgcaggacgcccaggagaaccagggctcatgggaccccgcggcttgccaggatctcccggtaacattggacccgcaggaaaggaaggcccggtcggattgccgggaatagacggtcggcccggcccgattgggccggctggtgcccgtggcgagccggggaacatcggctttccaggtccaaagggcccgaccggcgatcccggaaagaatggcgataaaggtcatgccggcctggcgggcgcccgtggagcccccggaccggacggaaataacggggcccaagggcccccgggaccgcaaggcgtccaagggggcaaaggggagcagggaccgcctggcccccctggatttcagggcttgccgggaccatcaggtcccgccggagaagtcggaaagccgggggagcgcggactgcacggtgaattcggacttccaggtccggcaggccctagaggcgagagaggtcctcccggagaatcgggagctgccggccctactggaccgatagggtcacgcggcccgtcgggaccgccaggacctgatggaaataagggagaaccgggcgttgtgggcgccgtcggtactgcaggaccatccggcccaagcgggcttccgggcgagcgcggtgcagctggaatcccgggtggaaagggggagaaaggagagcccggtctgcggggagaaattggaaatccaggacgggatggagcccgcggcgcccctggagcggttggcgcccctggtccagcaggcgcaacgggcgacaggggagaagcaggcgctgccgggccggcgggaccagccgggccccggggttccccgggcgaaaggggagaggtaggcccagcgggaccgaacggattcgccggcccagccggcgctgctggtcagcctggagccaagggtgaacggggtgcgaaaggaccgaagggtgaaaacggtgtcgtgggcccgactggccctgtgggcgcggcaggaccggcaggaccgaacggtccgccgggaccggctggtagtcgcggagatggaggcccacccggaatgacgggtttcccgggggccgccggccgcactggcccgcctggaccgagcgggatctcgggacctccaggcccaccagggcctgcgggaaaggagggcctgcgaggaccgcgcggggaccaaggcccagtgggacgcaccggcgaggtgggggcagtcggcccgccgggatttgccggggaaaagggaccgtcaggagaggccggaaccgcgggtcccccaggaaccccaggaccgcaaggactgcttggagcgcccggtatcctcggacttcccggatctcgcggagagagaggcctgccgggggtggcaggagcggtcggcgaaccgggaccgctgggaattgccggccctcctggcgctagagggccgccgggggcggtgggatcaccgggagtgaacggagcgccgggagaagccggacgggacgggaatcctggaaacgatggtccccccggtcgggatggacagccagggcataagggggaaagaggctacccgggaaacatcggaccagtcggggcggcgggagcaccgggaccgcacggtccggtggggcctgctggtaaacacggcaacagaggagaaactggaccgtctggacctgtgggtccggcgggcgcagtgggaccacgggggccgtccggaccacaaggtattcggggggacaagggagagccaggagaaaagggcccacggggactcccgggactcaagggacataacggactgcagggactccctggtatcgcgggacatcatggtgaccagggagcacccggcagcgtgggacccgcagggccgagggggccagcagggccctccgggccagcgggaaaggatggtaggaccggacacccgggcaccgtcgggccggctggaatcagagggccgcagggacaccaggggcccgcaggtccccctggacctcctggaccgcccggtccgccaggagtatccggtggaggctatgactttggctacgacggggacttctaccgcgcggatcagccgcgctcagcaccaagcctgcgccctaaagactatgaagtagacgctaccctgaagagcctcaacaaccaaattgaaactctgctcacgccggagggttcgcggaaaaacccggcccgcacttgtcgagatcttagactgtcgcacccggaatggtcgtcggggtactactggatcgacccaaaccaaggatgcaccatggatgccatcaaggtctactgtgatttctccaccggagaaacgtgcatccgggctcagccagaaaacataccagcgaagaattggtacaggtcctccaaggacaagaaacacgtctggctcggcgagactatcaatgccggcagccagttcgaatacaacgtcgaaggagtgacttcgaaggagatggccactcagctggccttcatgaggttgttggcgaattacgcttcacaaaacatcacctaccactgcaagaacagtatcgcatacatggacgaagaaaccggcaacctgaaaaaggctgtgatcctccagggatcgaacgatgtggagctcgtggccgaaggaaactcgcgattcacctacactgtgctggtggacgggtgcagtaagaaaactaatgagtggggtaagaccatcatcgagtacaagaccaataagccgtcacgcctcccattcttggatatcgcgcctctggatatcggaggagccgaccaagagttcttcgtggacatcgggccggtgtgctttaaa

SEQ ID NO: 32488 - DNA, 4098 bp, Artificial Sequence
  Description of Artificial Sequence: Synthetic coding sequence
atgttgtcatttgtggacactcgaaccctgcttctgttggccgtcactttatgccttgcaacatgtcagagtctacaggaagaaacagtgagaaagggacctgccggtgatagaggtccgagaggagaacggggaccgcctggaccgccaggaagggatggagaagatggacctactgggccaccgggaccacctggacccccgggaccaccaggacttggaggaaacttcgcagctcagtacgatgggaagggggtcggtcttggtcctggtcctatgggattaatgggacctcgagggccgcctggagccgctggagctcctggaccgcagggatttcaaggtcccgcaggagaacctggagaaccgggacaaacaggaccggccggagcacgaggacctgctggacctcctggaaaagccggagaggatggtcacccaggaaaaccaggaaggccgggagaacggggagtagttggaccccaaggagccagaggattccctggcactccgggcttgccaggatttaagggcattagaggtcacaacgggttggacggattgaagggacaaccaggcgcgccaggtgtcaagggagaaccaggagcaccaggagaaaacggaactccaggacaaacgggagcacggggcttgcctggtgagcgcggaagagtcggcgcgccaggaccagcgggagctagaggatcggatggatctgtgggtcctgttggacccgctggaccaattgggtcagctggaccgccaggtttcccaggagcacccggacctaaaggtgaaataggcgctgtcggaaatgcaggaccagcgggtccagctggaccacgaggcgaagtaggactgccagggctttctggtccggttggtccaccaggaaatccaggggctaatggtttgacaggcgcaaagggagctgctgggttgccaggagttgcgggagcgccaggtttgccgggtccacgaggcattccaggaccagtaggagctgcaggagcaaccggagcccgcggactggttggagaacctggacccgctggctctaaaggagaatctggaaataagggagagccaggatccgcgggaccgcagggacctccaggaccgtcgggagaggagggtaagcgtggtcctaacggagaagcagggagtgctggaccgccaggaccacctgggctccgcggatcaccgggttctagaggtctgccaggagcagatggacgtgctggagtaatgggtccaccgggatcgagaggggcttcaggtccggcgggtgtgcgaggacctaacggtgatgctgggcggccaggtgagcctggcttaatgggcccaaggggacttccaggatcaccaggtaacattggaccagccggaaaagaaggtccagttggcctccctgggatcgatggacgcccaggaccaattggaccggcgggtgctagaggagagccgggaaatatcggatttccaggaccaaaaggaccaacaggagatccaggaaaaaatggagacaagggtcacgcaggattggctggggcacgtggagcaccaggacccgacggaaataacggcgcccaaggaccgccgggaccacaaggtgtccagggaggtaagggagaacaaggaccaccaggaccacccggattccaaggactcccagggccatcgggacccgcaggtgaggttgggaagccaggagagagaggtcttcatggcgaatttggacttccaggtccggccggacctcgtggcgagcgaggacctcctggcgagtctggagcagctgggccaacaggtccgatcggaagtcgtggtccgagtggccccccaggtccagatggaaataaaggcgaacctggtgttgttggagctgtcggaacggctggaccatcgggtccatcagggttgccaggtgagaggggtgctgctggtataccaggaggaaagggtgagaagggagagcctggtcttaggggagaaatcggtaaccctggacgagatggagctcgtggtgcaccaggagcagtcggagccccaggaccagccggagcaactggggatcggggagaggcaggagctgcggggccagcaggaccagcaggacctcgtggttcgccgggtgagaggggtgaagtggggcctgctggaccaaatggattcgctggtccagctggtgcagcaggacagcctggtgcaaagggtgaaagaggtgcaaaaggaccaaaaggagaaaatggtgtagtcggacctactggaccagttggcgctgctggaccagcggggccgaacggaccaccaggaccagctggatcacgcggagatggaggacccccaggtatgactggatttccaggagctgcgggacgaaccggtccaccaggacccagtgggattagtggtccaccaggaccacctggccccgcaggaaaggagggtctgcgtgggcctagaggtgatcaaggtcccgttggacgaacaggagaagtcggagccgtgggcccaccgggatttgctggtgaaaaaggaccatcaggagaagcgggaacagctggaccgccgggaacaccgggaccccaaggattgcttggagccccaggaattctaggacttcctgggtctcgtggagaaagaggactcccaggagtggctggagctgtcggagagccgggacctttgggaattgctggaccaccaggagcacgaggtccaccaggagctgtcggatccccgggagttaatggagcaccgggagaggctggtcgagatggaaatccgggtaatgatggaccaccaggtcgtgacggccagcccggccacaaaggagaaagaggctatccagggaacatcggaccagtgggtgcagcaggtgcaccgggccctcatggaccagttgggccggcaggaaagcacggaaatcgcggagaaaccggcccatcgggtccagtggggccagcaggtgccgtgggcccgcggggaccttcgggtcctcagggaataaggggggataagggcgagcctggcgagaaaggaccgcgcggattgccaggattaaaaggacataacggtttgcaaggccttccaggaattgctggccatcatggagaccaaggagctccaggaagcgttggaccagcgggtccacgtggacccgcgggtccttctggaccggccggaaaagacggacggacaggccacccaggtacggtcggtccagcaggaattagaggtccgcaaggccatcagggtcctgcaggccctccaggcccgccaggcccaccaggacccccaggagtttccggtgggggatatgacttcggatatgatggagatttctaccgagctgatcagccgcgatcggcaccgtctcttagaccaaaagattacgaagttgacgccactctaaagtctctcaataaccaaattgaaacacttttgactccagagggatcgagaaaaaatccggcgcggacgtgccgtgatctccgtctcagtcatccggaatggtcatcaggttactattggatcgaccctaatcaaggctgcacgatggacgctatcaaggtttattgtgacttcagtacgggagaaacatgcattagagcacagccagaaaatataccggcaaaaaactggtaccgatcttcaaaagataagaagcatgtgtggttaggggaaaccatcaatgctggttctcagttcgaatacaatgttgagggtgttacaagtaaggaaatggcaacacaactggccttcatgaggctgctagctaactacgcttcccaaaatattacttatcattgtaaaaattccatcgcttatatggatgaagaaacaggaaacctcaaaaaggcagttattctacagggtagcaacgatgtagaattagtcgcagaaggaaactcacgatttacgtatactgtccttgtggatggatgttcaaagaagacgaatgaatggggcaaaaccataattgaatataaaacaaataagccctcgagactgccattccttgatattgctccactcgatattggaggggcagaccaggaatttttcgttgacattggacctgtgtgttttaaa

SEQ ID NO: 32489 - DNA, 4098 bp, Artificial Sequence
  Description of Artificial Sequence: Synthetic coding sequence
atgctcagcttcgttgacacacggacactgctgttactagcagtgactctttgcctagctacctgccagagtctccaggaggagaccgttaggaaagggcccgcaggggatagaggacctcggggggagcgcgggccccccggacccccaggcagggacggcgaggatgggcccactggaccgcctggtcccccagggccccccggcccccctggtctgggaggtaattttgcagcgcaatatgacggtaagggcgtaggactcgggcctggcccgatggggttgatgggacccaggggacctcccggtgctgccggtgcgccaggcccacagggcttccagggacctgccggagagcccggggagcccggacaaactgggcccgctggcgctaggggacctgcaggaccgccaggaaaagctggcgaggatggacatccaggaaagcctgggaggcccggagaacgcggggtggtgggcccccagggcgcacgtggctttccaggaacaccgggtttacctggatttaagggaattcgcggccataatggccttgacggattgaagggacagccaggagctccaggcgtgaagggcgagcctggggccccgggggaaaacggtacacctggacagactggcgctagagggctgcctggcgaaaggggccgcgtgggcgcaccggggcctgcaggcgcaagaggttctgacgggagtgtcgggcccgtcggccctgctggacctataggttctgctgggcctcctggatttcccggagctcccgggcccaagggcgagattggagcagtgggtaacgccggacctgctggtcccgccgggcccagaggcgaggtcggccttcctggactgagcggccccgttggcccacctggaaacccaggtgctaacggccttactggcgctaagggagcggcaggcttgcctggggtggcaggcgccccagggttgccaggacctcggggaatccccggacctgttggtgcagcaggagcaactggagcacgcggcctcgtgggggagcctggaccggccggcagtaaaggagagtcgggcaacaaaggagaacccggttcagccggccctcagggcccccccggcccttcaggcgaggaaggcaagagaggcccaaacggagaggctgggagtgcgggaccaccaggccccccgggcctcagaggatctcctggctcgcgcggtctgccaggagcggacgggcgcgcgggcgtcatgggccccccaggcagccgaggagctagcggaccggcaggtgtgcggggccctaatggagacgccggccgccccggagaaccgggtctgatgggaccccggggcctccctggatcgcctggcaacattggccctgccggcaaagaggggcccgtaggacttcccggtatcgatggaaggccaggccccattggacccgccggagcgagaggcgagcccggaaatatcggttttcctggccctaagggacctacgggcgatccaggaaagaatggtgacaaaggacacgctgggctcgccggagcgagaggggctcctggacctgacgggaacaatggcgctcagggccccccaggaccacagggggtccagggcggcaaaggcgaacaaggcccaccagggccacccggcttccaggggctgcccggtccaagtggacctgcaggagaagtcggcaagcccggggagagaggattgcacggggagtttggcctgccaggccctgctgggccacgtggagaaagaggcccccccggggagagcggggctgctgggccaacaggacctattgggagtcgcgggccctctgggccccctggaccagacggtaacaaaggcgaaccaggggtggtgggcgccgtagggaccgcaggaccctctgggccttctggcctgccaggtgagcgcggagccgctggaattccaggagggaagggcgaaaagggtgagcccgggttgagaggcgaaatcggcaacccaggtagagacggcgcccgtggcgcccccggagctgtaggcgcacctggacctgccggtgccacgggagacaggggcgaggctggagccgcaggccctgctggaccagccggaccccgcggaagtccgggagagcggggtgaggtggggcctgcagggcccaacggctttgccggcccagctggggccgcagggcaacccggggccaaaggagagcggggggcaaaaggccctaagggagaaaatggagtggtgggtccaacaggcccagtcggcgccgcaggtccagccggaccaaacggacctcctggtcctgctggaagccgcggagatggcgggccaccgggcatgaccggcttcccaggagccgccggcagaaccggacctccgggaccaagtggaatatcaggccccccggggccgccaggtccagctggaaaagaaggcttgcgaggccccaggggcgatcaagggcctgttggaagaacaggggaggtgggagctgtgggacctccaggctttgcgggagaaaaagggcctagcggagaagcaggcaccgccggccctcctggcacaccaggcccacagggcctcctgggggctccaggaattctgggactgccaggctctcggggcgagagaggccttcctggcgtggctggagctgtcggtgaacctggcccacttggcattgcgggcccaccaggggctagggggccccctggagctgtcgggtctcccggagtgaatggcgcccctggagaagctggacgggacgggaacccaggcaacgacggcccacccggcagagatggtcaacctggacacaaaggcgagagaggttacccaggcaatatcggcccagttggcgcagcaggtgcccctggcccacacggcccggtcggacctgcgggaaaacacggaaaccggggcgagaccggcccttcaggcccagtggggccagccggggccgttggaccgagaggcccatcagggccacaaggtatcagaggcgataaaggcgaacctggggagaagggtccgagaggtctccccggtttgaagggtcataacggacttcaaggactccctggtatcgcaggccaccacggggaccaaggagcacctggcagtgtcggtcccgcaggacctaggggaccagcaggcccctcaggccctgctgggaaggacggcagaacagggcaccctggaaccgttggaccagccggcattaggggcccccaaggacaccaaggccctgccggtccacccgggcctcctggacctcccggccctccaggagttagcggtgggggttacgatttcgggtacgacggcgatttttacagggccgatcaacctcgctccgcccccagcctcaggcctaaggattacgaagtcgacgccaccctgaagtccctcaacaaccagatcgaaaccctgcttacccctgaggggagtcgaaagaacccggctcggacatgtagagatctgagattatctcatcccgagtggagtagtggttactactggattgacccgaatcaaggatgcacaatggatgcaattaaagtgtactgcgattttagcactggagagacatgtattagggcacaacccgagaatatccccgcaaagaactggtaccgatcttccaaggacaaaaagcatgtctggctcggcgagactatcaatgctggtagccaattcgagtacaatgtggagggagtcacaagcaaggagatggccacccagttggcctttatgcgcctgcttgctaactacgccagtcagaacattacctatcattgcaaaaactccatcgcttacatggatgaagaaaccggaaacctcaaaaaggccgtcattttgcaaggttcaaatgacgtggagcttgtggccgaaggaaactcgcgcttcacatacaccgtcttggtcgacggctgtagtaaaaaaaccaatgagtggggcaaaactatcatcgagtacaagactaacaaaccttcacggctcccctttttagacatcgcccctctggacatcggaggtgcagatcaagaattctttgtggatattggaccagtgtgctttaaa

SEQ ID NO: 32490 - DNA, 4098 bp, Artificial Sequence
  Description of Artificial Sequence: Synthetic coding sequence
atgttgagcttcgttgatactcgcaccctgctgctgcttgcggtgactctttgcctggccacttgtcaatcactgcaggaggaaaccgtaaggaagggccccgccggagatagaggacctcggggcgagcgcggtccacctggtcccccgggacgggatggagaggacgggccgactgggccacctgggcctccagggccgcctggaccccctggtcttggtggcaacttcgctgcccagtacgacgggaagggtgtgggtctgggaccagggccaatgggtctgatgggacctcgaggcccaccaggagcagccggggctccagggccccaagggtttcaagggcctgctggggaaccaggcgaacccggccagactgggcctgcaggagcaagaggtcccgccggtcccccaggtaaagccggtgaagatggacacccaggtaagccagggaggccaggagaacggggcgtcgtggggccgcagggagcccgtggttttcctggcactccagggctgccaggtttcaaaggcattaggggacacaacggacttgacggactgaagggacagccaggagcaccaggcgtgaaaggggaacccggggcacccggcgagaatggaacccctggtcaaaccggtgcacgaggactgcccggcgaaaggggacgggtgggtgcccccggaccagccggcgcaagaggatccgacggttcagtcggccctgtcggacctgcgggaccaattgggtccgctggtccgccgggctttccgggcgcacctgggcccaagggagaaatcggggcggtgggaaatgccgggcccgcgggaccagccggtccacgcggggaggtgggacttcctggactttccggacccgttggacctcctgggaaccctggcgcaaatggattgactggagccaagggtgcagccggcctgcctggagtcgcaggtgcaccaggcctccccggtccaagaggaatccctggaccggtcggcgcagcaggggctactggggcaagagggcttgtgggtgaaccgggacctgccggatcaaaaggtgaatccggcaacaagggcgagccaggctccgctgggccccaaggacccccaggacctagcggagaagagggcaagagaggaccaaatggagaagccggatcggccggaccgcccgggccgcccggactgcgaggctccccgggatctcgcggcctcccaggtgctgatggaagggcaggtgttatgggacctcctggttcaagaggcgcatcgggcccagcaggagtgcgcggccccaatggagatgccggcaggcctggagaaccagggctcatgggccccagaggcctgcccggctcgcccggtaacattggacctgcgggcaaggagggtccagtgggcctcccgggtatcgacggccgacctggtccaatcggccccgcaggtgcacgcggtgagcctggtaacataggattccccggccctaaaggacctactggggatcctggaaagaatggcgataaggggcatgccggattggcaggtgcccgcggtgcacctggccctgatggaaataacggagcccagggtcctcccggcccccaaggcgtgcaaggtggcaagggcgaacagggtcctccggggccgcccgggttccaagggcttcctggcccctcgggcccagcgggagaagtaggaaaacctggagaaagaggtctgcatggtgagtttggtctgcccggaccagcgggtcccagaggagagcggggaccacccggtgaatctggggcggcaggtccaactggacctattggtagccgtggtccctccggacctcccggaccagacggtaacaagggtgaaccaggcgtggtgggtgccgtgggaactgcagggcctagcggaccctccggcctgccgggtgagagaggagccgccggaattcccggcgggaaaggtgaaaaaggtgaacccggactccgaggagaaattggtaacccaggtcgagacggagcacggggggcacctggggcagtgggggcgcccgggccagcgggagcaaccggggatcgtggagaggcaggcgctgcaggtccggcaggcccagcagggccgcgcgggagccccggagagagaggcgaagtcggacccgcaggaccaaacggctttgcaggcccagctggagctgcgggccagcccggtgctaagggggagcggggggcgaagggaccaaagggtgaaaacggagttgtgggacctaccgggccagtcggcgcggccggtccagctggtccaaacggcccgccagggcccgcagggagcagaggagatggaggcccacccggcatgactggctttccaggagctgcgggacggaccggaccaccaggcccatcggggatatcaggccctcctggccctccaggaccagctgggaaagaggggcttcgcggtccccgcggtgatcagggcccggtgggacgcactggcgaagtgggtgcagtgggaccgccaggcttcgcgggggaaaagggaccttccggagaggctggaaccgcgggaccaccaggaacgcctggccctcagggtttgcttggtgcgcccggcatcctgggtctgcctggtagccggggtgaacgtggacttcctggcgtggcaggcgccgtcggagaaccaggaccgcttgggattgccggaccccctggcgcacggggcccgccgggagcagttggtagtcctggtgtgaatggagcacccggtgaagctgggagagacggaaatcccggtaatgatggacctccaggaagggatggtcaaccgggtcacaaaggggaacgtggttacccaggaaacattggccccgtcggcgcagccggcgcaccgggaccacatggaccagtgggcccggccggcaaacatggaaacagaggtgagactggtccatcgggccctgtaggtccagcaggcgcagtcgggcctcggggaccttcgggtcctcagggaatcaggggtgataaaggggagccgggagaaaaagggcctcgaggactcccaggacttaagggtcataatggacttcaaggcctccctggaatcgcaggacatcatggagatcagggggcaccaggctcggtagggcctgcgggtcctcgggggccggctgggccgtccggaccagcaggaaaagatggacgtaccggacaccctgggacggtggggcccgcaggaattagaggtcctcaaggccaccagggaccagcaggtcccccaggaccacccgggcctccgggtccccccggagtgagcgggggcggttacgattttggatacgatggggacttttaccgcgcagaccaaccaaggagcgcaccttcgctgcgtcccaaggattacgaagtcgatgcaactctcaagtcgcttaacaatcaaatagagactctcctgacccccgaaggttcgcgcaagaaccctgcgcgaacttgcagagatcttcgcctgtcacacccagagtggtcaagcggatactactggatcgaccccaaccagggttgcaccatggacgcaattaaggtgtattgtgacttttccaccggggaaacctgtattagggcccaacctgagaatataccagcaaagaactggtacagatcgtccaaggacaagaagcatgtctggcttggagaaaccattaatgcagggtcacaatttgaatacaacgtcgagggtgtcacctcgaaggaaatggcaacccaattggcattcatgagactgctggcaaactacgccagccagaacattacgtaccattgtaagaacagtattgcctacatggatgaagaaaccggaaacctcaagaaagcggtgatcctccaaggttcaaatgacgtggagctcgtggcagaaggtaacagccggtttacctatacggtgcttgtggacggatgttccaaaaagactaacgaatggggtaagacgataattgaatacaagaccaataaaccgtcccgtttgccctttttggatatcgcacccctggacatcgggggagcagatcaagaattcttcgtggatattggccctgtgtgttttaag

SEQ ID NO: 32491 - DNA, 4098 bp, Artificial Sequence
  Description of Artificial Sequence: Synthetic coding sequence
atgctaagtttcgtggatacaagaactttattattgctggcggtaactctttgtctggcaacttgtcagtcacttcaggaagagacagtgcgcaaggggcctgctggggataggggaccaaggggggaaagggggccccccgggcccccagggcgagacggggaagacggacccactggaccccctggacctcccggaccacccgggccccctggactgggagggaactttgcggcccagtatgatgggaaaggggtgggactcgggcccgggcctatggggttgatgggaccaagggggcctcctggagcagctggagcccccggaccacagggatttcaggggcctgcgggagaacccggggaacccggacagactggacccgccggagcccgcgggcccgctgggccaccaggaaaagccggggaagatgggcaccccgggaaacccgggcgcccaggggaaaggggagtcgtcgggccccagggagccagggggttccccggaactccaggactccctggattcaaagggataagaggacacaacgggctagatgggttaaaaggacagcctggagcaccaggagtgaaaggggaacctggagctcctggggaaaatggaactccagggcagactggggcccggggattacctggagaacgaggaagggtgggggcccctgggccagccggggcacggggaagtgacggaagtgtgggacccgttgggcctgctgggcccataggaagtgctgggccccctggatttcctggggccccagggcctaagggggaaatcggagccgtcggaaatgcagggcccgccggaccagctgggccgcggggggaggtgggactgccagggttatctggacctgtcggacctcccggaaatccaggggctaatgggctgacaggagcgaagggagcagccggactaccaggggtcgcaggagcacctggactcccaggaccacgcgggataccaggaccagtgggagcagccggggctacaggggctaggggactggtgggggaacctggacccgccggatccaaaggagaatccggaaacaaaggagagcctggatcagcagggcctcagggaccccccgggccttccggggaggaaggaaaacgcgggcccaacggagaagctggaagtgccgggccgccagggccaccagggctgcgaggatcccctggatcacgcgggttgcctggagcagacggaagagctggagtaatgggacctcccggatcacggggggcctctggaccagccggggtacgagggcctaacggagatgccgggcgacccggggaacccgggctcatgggaccccgcggattacccggatctccagggaacatagggcctgcaggaaaggaaggaccagtggggttgcccgggatagatgggaggcctgggcccatcggacctgcaggggcaagaggggaaccagggaacataggattccccgggcctaaagggcctacaggagaccctgggaaaaatggagataagggacatgccggattggccggggctaggggggcccctggacctgatggaaataatggggcacaggggccccctggaccccagggagtgcagggaggaaaaggagaacaggggccccccgggccacccggattccagggactgcccggaccttctggaccagccggggaagtgggaaaacctggggaacgcgggctgcacggagaattcggactgcctgggccagctgggccacgcggggaacgaggaccacccggggaatctggagccgctggacccactggacctatcggatctcggggaccatctggaccacccggacccgatggaaataaaggagaaccaggggtcgtcggagctgtaggaactgcagggcctagtgggccctcagggttacccggagaacggggagcagcaggaattccaggagggaaaggggaaaaaggggagcctggactgagaggggaaataggaaatcccggacgagatggagcccgcggagctcccggagctgttggagcacccggacccgctggagccactggggataggggagaagcaggggcagcagggcctgctggaccagccggacctaggggatcccctggagaaagaggggaagttgggcctgctgggcctaatgggtttgcagggccagccggagcagctggacagcctggagcaaagggggaaagaggagctaaagggcctaaaggagagaatggagtcgtgggacccactgggcccgtcggagcagcaggacccgctgggccaaacggacctcccgggccagccgggtccagaggggatgggggacctcccgggatgacagggtttccaggagccgctggacgtacaggacccccagggccatctggaataagtgggcctccggggcctcccggacccgccgggaaagagggactgcggggacccaggggggatcagggacccgtcgggcggacaggggaagtgggagcagtgggaccacctggatttgcgggagagaaaggaccatccggagaggcggggacagcaggaccacccggaactcccgggccccaggggctcctgggggccccaggaatcctaggactccccggatcccggggggagcggggactcccaggagttgccggagctgtgggggaacccgggcccttagggatcgctggaccacccggagccagggggcccccaggggcagtaggaagtcccggggtgaatggagcccccggggaggctgggcgggatggaaaccctggaaacgatggaccacccgggagagatggacagcccgggcataaaggggaaagaggatatcccggaaatataggacctgtgggagccgctggagcccccgggccccatgggccggtagggcctgctgggaaacatgggaacaggggggagacagggcccagtgggcctgttgggcccgcaggggcagtagggccaagagggccatcgggacctcaggggatcagaggggataaaggggaaccaggggaaaaaggacctagggggttgcccggacttaagggacacaatggacttcagggattacccgggatcgcagggcaccatggggaccaaggggcccctggatctgtcggaccagctgggcccagggggcccgcgggaccatcagggcctgccggaaaagatggacggactgggcaccctgggacagtggggcctgccgggattcggggacctcaagggcaccaggggccagctgggcccccagggccccctgggccccccgggcctccaggggtctcaggaggagggtacgactttgggtatgatggggatttttaccgagctgatcagcctcggtctgcaccctcactccgacctaaagattatgaagtggatgccacactaaaatccctaaataatcagattgaaacactgctaacacccgagggatctcggaaaaatcccgctaggacttgccgcgatctaagactttcccaccccgaatggtcttccggatattactggatcgaccctaatcaggggtgcactatggatgctattaaagtgtattgtgatttttcaactggggaaacttgtatccgggcccagcccgaaaatatcccagctaaaaattggtatagatcctccaaagataaaaaacatgtgtggctgggagagacaataaacgcagggagtcaatttgaatataacgttgaaggggtcacttcaaaagaaatggctactcaattggcatttatgaggctcctggccaactatgctagtcagaacatcacatatcactgcaaaaattctatcgcctacatggatgaagaaacagggaacctcaaaaaagctgtaatactccaggggagtaatgatgtggaactggtagctgaaggaaactcaagattcacatatacagtgctcgttgatggatgctctaaaaagacaaacgaatgggggaaaacaataatagaatataaaacaaataaacctagtcggctcccattcctggatatcgcgcccctggacattggaggagcagatcaggaattctttgtggacattggaccagtttgtttcaaa

SEQ ID NO: 32492 - DNA, 4098 bp, Artificial Sequence
  Description of Artificial Sequence: Synthetic coding sequence
atgctatccttcgtcgacacccgtactctgctactgttggctgtcactctgtgtctggccacctgccagtccctccaggaggaaacggtgagaaaagggcccgccggcgatcgaggtcccagaggagagcgtggaccgcccggaccgccaggaagggacggcgaagatggtcccactggccctccaggcccaccagggcctccaggacctcccgggctggggggcaatttcgcagctcagtatgacgggaaaggagttggcttgggtcctggccccatgggtttaatgggacccagggggcctcctggtgcagcaggcgctcctggtcctcaggggttccagggcccagccggggagcctggggaacccggtcagacgggacctgcaggtgcaagaggacccgccggccctcctggcaaggctggcgaagacggtcaccccggaaaacctggaaggcctggtgaacgaggagtggtgggaccccaaggagctcgaggatttcccggtacaccaggtttaccgggttttaagggaatccgtggacacaatggtcttgacggactcaaaggccagccgggagctcctggggtgaagggcgagcctggcgccccaggcgagaatgggacaccaggccagactggcgcaagagggctgcctggcgaacgcgggcgagttggcgcacccggcccggccggtgctagaggttcagatgggtcagtcggccccgtgggcccggcaggtccgatcggatctgctggccctcccgggttccctggagcccctggcccaaaaggcgaaatcggggccgtgggcaatgcagggccagccgggcccgctggcccccgtggggaagtgggtctgcctggcctctccggccccgtgggccctcctggcaatccaggagcaaacgggctgactggcgccaagggagcagccggtctcccaggagtggccggcgccccaggacttcctgggccacggggcattcctggacctgtgggggcagctggtgccaccggggcaagggggcttgtaggggagcccgggcccgcggggtctaaaggggagagtggaaacaagggcgaaccaggctccgccggcccccagggccccccgggcccctcaggagaagaaggcaagcggggccctaacggggaagccggctccgctggtccgcctggaccgccagggttaagggggtcacccgggagtcggggactgccgggagcagacggcagggccggagtaatggggccacccggcagtagaggcgcctccggtcccgccggtgtgagaggaccaaacggtgatgcgggaagacccggtgaacctggattgatggggcctagaggcctgccggggagtcctggcaacattggacctgccggaaaggaagggccagtggggctgccggggatagacgggcggcccgggcccatcgggccagctggcgcacgcggtgagccagggaacatcgggtttccaggacctaaaggaccgacaggggaccctgggaaaaatggggataagggccacgcggggctggcaggggcccgtggcgccccagggcctgatgggaacaatggagcccaaggccctcctgggccccagggcgtgcaggggggtaagggcgagcagggtcccccaggcccacccggatttcagggcttacctggaccgtcagggccggccggtgaggtgggcaaaccaggcgagaggggactccatggagaatttgggctgccaggccctgctggacctcgaggggaaagggggcccccaggcgaatccggagcagccggccctaccgggcccatcggcagccgaggacccagtggaccgccgggccccgatgggaacaaaggagaacccggagtggtgggcgccgtgggcactgctggcccatccgggccatctgggctgcccggggaaagaggagccgccggaatccctggtggcaaaggtgagaagggtgaacctggactccggggagaaatcgggaatcccggcagggacggcgcacggggggctccgggagcagtcggagccccagggcccgccggcgcaacgggcgacagaggcgaggctggtgcggcgggacctgctgggcccgcaggcccaagaggatcccctggggaaaggggtgaagtgggaccagcgggtccaaacggttttgccggccctgctggcgcagccggccagcccggcgctaaaggcgagagaggagcgaaaggacccaagggggaaaacggtgtggttggaccaactggccctgtgggagccgcagggcccgcaggacccaacggaccacctggtcctgccggatctcggggcgatggggggcctcccggaatgactggatttcctggggccgccggcagaaccggtccccccggaccttctggtatctccggaccgcctggcccgccaggccccgcgggtaaagagggtctacgaggaccaagaggcgaccagggcccggtggggagaacaggagaggttggtgctgtcggacctcctggatttgccggcgagaaggggccttctggggaggcgggcacagcggggcccccaggcacgcctggcccacaggggttgctgggagctccgggcatcctgggcctgcctggtagtagaggggagcgagggctgcccggagtcgctggtgctgtgggcgaaccaggccctctgggtatagccggccccccaggcgcccgtgggcctcccggtgccgtgggcagtcctggagtaaatggcgccccaggggaagctggccgagacggaaacccaggcaacgatgggccaccgggccgcgatggccaaccagggcataagggtgagcgcgggtaccctggaaacatagggcccgtaggcgcagccggtgcgcctggaccgcacggtcccgtgggccccgctggcaaacatggtaatcgaggggaaaccgggccaagtggccccgtgggccccgccggcgccgtgggccctcgtgggccctcaggcccccaaggaattagaggtgataagggcgagcccggggagaaggggccgagagggcttcccgggctgaaggggcataacggcctccaggggctccctggaatagcaggccatcatggggatcagggcgcacctgggtcagtcggacccgccgggccccgggggcccgccggcccgtccggacctgccggcaaggacggaagaaccggccatccaggaacagtggggcctgcagggattagggggcctcagggccaccaagggcctgccggccccccaggaccccctggacctccaggccctcccggggtgagcggtggcggatatgactttgggtatgatggcgacttctatcgagccgaccagccccgaagtgccccctctctcagacccaaagattacgaggtagacgctacactgaaatccctgaacaaccagattgagaccctcttgacccccgaagggtcaagaaaaaacccagcacgaacctgcagggatcttcgattgtctcatccagaatggtcctccggctactactggatcgatcctaatcaggggtgcactatggacgccattaaggtgtactgtgacttttctaccggtgagacgtgcattagggctcagcccgaaaatattcccgctaagaactggtaccggtcttctaaggacaaaaagcacgtgtggctgggagagaccatcaacgcaggatctcagttcgagtacaacgtggaaggcgtgacatccaaagagatggccacgcaattggctttcatgagactcctggcgaactatgcatcacagaacataacctatcattgtaagaatagcattgcctatatggacgaggagactgggaatttgaagaaggccgtcatcctgcaggggtctaacgacgtggaactggttgcagaagggaactctcgtttcacctataccgtgcttgtggatggatgctccaagaagacgaacgaatgggggaagaccataattgagtataagactaacaagccctcccgactgcccttcctggacatagcgcctctggacattgggggggctgatcaggaattcttcgtcgacattggccctgtatgtttcaaa

SEQ ID NO: 32493 - DNA, 4098 bp, Artificial Sequence
  Description of Artificial Sequence: Synthetic coding sequence
atgctcagctttgtggacacacggaccctgctgttgctggcggttacactgtgcctggcaacatgccagtcactgcaggaggaaactgttcgaaaggggcccgctggagatagaggtccccgcggcgaacgagggccccccgggccccccgggcgagacggagaggacgggcccacagggccccctggcccccctggccccccaggcccgcccggactgggaggcaatttcgccgcgcagtatgatggcaaaggcgtcggcttaggcccaggcccaatggggctcatgggccccagaggccctccgggggcagcgggagctcccggcccgcaagggttccaggggccagctggcgaacctggcgagcctggacaaaccggacctgcgggcgcgcggggcccagccggacctccaggaaaggcaggggaagatggtcaccctgggaagcccggccgccctggagaaagaggggtggtgggcccccagggcgcccgcgggttcccaggcacccctggactgccaggctttaaaggtatccgtggtcacaatggtctggacgggttgaagggacaacctggagcccctggagtgaaaggcgagcctggcgcccctggggaaaatgggactcccggacagactggcgctcgggggcttccgggagagcggggacgggtaggggcacctgggcctgccggcgctagaggtagcgacggaagcgtgggtccagtgggccccgctggccctatcgggtctgcgggtcccccgggcttccccggcgcccccggaccaaaaggagaaataggtgccgtgggaaatgccggaccagccggccccgctggacccaggggagaggtaggtttgcccggcctatcaggcccggtgggcccacccggcaacccgggggcgaacggtctgacgggggctaagggagcagcaggtctgccaggtgttgcgggagcacccggtctgccagggccaagggggatccccggccccgtgggagccgctggcgcgacaggggctagggggttagtgggcgagccagggcctgctgggtccaaaggggagagtggtaacaaaggagaaccgggcagcgccggaccacagggaccccctggaccttccggggaggaaggcaagaggggccctaatggagaggctgggtcggctggtccgccgggcccccccggactgagaggctctcctgggtctcgaggcctgcccggcgcagacggaagggccggtgtgatgggcccacctggctccagaggggctagcggacctgccggcgtaagaggacccaatggcgacgccgggcgcccaggtgaacctgggctgatggggccacgaggcctgcccggaagcccaggcaacatcggtccagcaggaaaggagggcccagtgggcctccccggaatcgatggacgccctggtcccattggtcccgccggggcacgtggggagcctgggaatatcggcttccctggccctaaaggccccacaggcgacccggggaaaaacggagacaagggccatgccggactggctggagccaggggagccccagggccggacggaaataacggggctcaggggcctccaggtccgcagggcgttcaggggggtaaaggggaacagggccctcccggccctccaggattccagggacttccagggccttcagggcccgctggggaagttggcaaaccaggagagcgcgggctgcacggcgagttcggcctgcccgggcccgctgggccacgtggcgagcgagggcctcccggcgagtcgggtgccgcaggaccaactgggcctatcggatcccgaggcccaagcggcccaccaggccctgacgggaacaagggcgagcccggcgtggttggcgcagtgggcacagctgggccttctggaccatccggtctcccgggcgaacgaggcgccgcagggatccccggcggtaaaggagaaaaaggagaacctggactgaggggcgagattggaaatcccggtcgggacggtgcccgcggtgccccaggcgccgtcggtgctcccggcccagccggagccactggtgaccgtggtgaagccggcgccgcagggccagctggccctgccgggccccgaggatctccgggtgaacggggagaggtaggaccagctggacctaacggattcgccggcccggccggagctgccggtcagcccggtgccaaaggagaacgaggggccaagggaccaaaaggtgagaatggagtggttggtcccactgggccagtgggcgcggccggccctgcagggccgaacgggccaccggggccagctggctctcgaggggatggaggtccccctggtatgaccggcttccctggggccgcaggtaggacaggcccccctggtcccagtggcatcagcgggccccccgggccaccaggccctgccggtaaggagggtctcagagggccccgaggagaccagggccccgtgggccggacaggcgaagtgggagccgtcggcccaccagggtttgcgggggagaaaggcccgagtggagaagccggaacagccggtcctccaggaacacctggacctcaaggactgctgggagcccctgggattctgggattaccgggctctcgaggagaacgcggccttccgggtgtggccggcgctgtgggcgagccaggacctcttgggattgctgggcccccgggagctcgtggcccccccggcgcagtgggatctcctggcgtgaatggcgctcctggggaggccggcagagacggaaatcctggtaatgacggaccccctggtcgggacggccagccgggacacaagggggaacggggatatccaggcaacatcggacccgtaggggccgccggcgcccccggtccacacggtcccgtcggtccagcaggaaagcacggaaatagaggcgaaacgggcccctccggacccgtgggtccagccggtgcggtcgggccaagagggccttcagggccccaggggattcgaggcgataaaggggagccgggtgagaaagggccacgtgggttaccaggtcttaaggggcacaatgggttgcagggcctccctggtatcgcagggcaccacggcgatcagggtgctccggggtctgtagggcccgctgggccacggggacccgctggaccatccgggccggctggaaaagacggccgcactgggcaccctgggacagtcggaccggcaggaatccgagggccacaaggtcatcaaggaccggcagggccacctggtcctccagggcccccagggccgcctggcgtgtctgggggcggttacgattttggttacgacggagatttttatagggctgatcaaccgcgcagcgctccttcgctgcggccgaaggactatgaggtggatgctacactgaagagcctgaataatcagattgagacactcctgaccccagagggctctcggaaaaatcctgccaggacctgtagagacctacgtctgtcccacccagagtggtcctccggctattactggatcgatccgaaccaaggctgcacaatggatgctatcaaggtgtattgtgattttagcaccggcgaaacatgtataagagctcaaccggaaaacattccagctaagaactggtaccggtcttctaaggacaaaaagcacgtgtggctcggggagactattaatgcagggagtcagttcgaatacaatgtggagggcgtcacttctaaggaaatggctactcaactggccttcatgcgcctgctggctaattacgcttctcagaacattacctaccactgtaaaaattcgatagcctacatggatgaggaaaccgggaacctgaagaaggcggtgattctccagggctccaatgacgtcgagttggtagcagaagggaactctcgtttcacatatacggtcttggttgatggctgcagcaaaaaaacaaatgaatggggtaagaccatcatagagtacaaaacgaataaaccttctagactacctttcctcgatatcgctccactcgacatcggcggagcagatcaggagttcttcgtcgacataggaccggtgtgctttaag

SEQ ID NO: 32494 - DNA, 4098 bp, Artificial Sequence
  Description of Artificial Sequence: Synthetic coding sequence
atgctgtcctttgtagacacccgcactcttttacttctcgctgtgacactgtgtctcgcaacatgccaatcattgcaggaggagaccgtgagaaaaggacctgccggggaccggggacctcgcggagagaggggtccccctggccctcccgggcgggatggcgaggacggtccgacaggcccacctggaccacccggtcctcccggtcctcctggacttgggggcaactttgcggcccagtacgacggtaaaggcgttgggcttggcccgggccctatgggacttatgggcccccgtgggccacccggcgctgccggggcccctggccctcagggatttcaagggcccgcaggggagccgggagaaccaggccagactgggcccgccggcgccaggggcccggccggcccccctgggaaggccggggaagatggccaccccgggaagcccggaaggccaggagagagaggggtcgttgggccacagggtgctagaggcttcccaggcacccccggcctgccagggtttaagggcatccgcggtcataatggtctggatgggttgaaggggcagccaggcgcccctggtgttaagggagagccaggcgcacctggagagaatggtacgcccggccagactggagcgcgagggctgcctggcgagagagggagggtgggagctcccggccccgcaggggcaagaggatcagacggctcagtcgggcccgttggtcctgccggtcccataggaagtgctggccccccaggatttcccggcgcgcctgggcctaaaggggaaatcggcgccgtaggcaatgcggggcctgctggaccagccggacccaggggcgaggttggactcccggggctgtcaggtcctgtcggccctccaggaaaccctggtgctaacggcctgaccggagctaagggagccgccggactgccgggtgtggctggcgctccaggtttgcctgggccccggggcatccccggtcctgtcggggcggcaggagcaacaggcgccaggggactggttggcgaacctggccccgccgggtccaagggtgagtcaggcaataaaggtgaacctggcagcgctgggccccaggggcctcctgggcctagcggagaagagggaaaacgtgggcctaatggcgaggccgggtctgccgggcctcctgggccacccgggctcaggggttccccgggttcccgtgggcttcccggcgccgacggaagagccggcgtgatggggcctcccgggagtcgtggtgccagcgggcctgcgggtgtccgaggtcctaacggagacgctggccgacccggcgagcccggcttgatgggcccccgagggctgcccgggagtcccggcaatatcggaccggcggggaaggagggtccagtgggcctaccgggaatcgacggaagaccaggacctattgggcccgccggagcaagaggtgagccgggaaacatcggctttcccgggccaaaggggcctactggcgatcccggaaagaacggcgataaagggcacgcggggctcgcaggagcgcggggggccccaggacctgatgggaacaatggcgctcaaggcccgccaggcccgcagggagtgcaaggaggtaagggggagcagggtcctcctggcccacccggattccaaggtctccccggccccagtggacccgccggtgaagtcgggaaaccaggcgagcggggcctgcacggcgagttcggacttcctggccccgcgggcccacgaggggagcgtggcccccccggcgagtcgggagctgctgggcctacagggcctatcgggtctagagggcctagtggcccccctgggccagatggaaacaagggagagcctggggtagtgggagccgtagggactgccgggccctccgggcctagcgggttacccggcgaaaggggagccgcggggataccgggggggaaaggagagaagggggagccaggtctgcgcggcgaaattggaaatcccggccgcgatggtgccagaggcgccccaggcgcagtgggagctccaggacctgccggggcgaccggggaccggggcgaagcaggagctgccggcccagcgggacctgcgggcccgcggggctcgcctggagaaaggggcgaagtcggtcccgccggaccaaatggctttgctggacccgccggcgcagctggccaaccgggtgccaagggcgagaggggagctaaggggcctaaaggggagaacggggtggtgggaccgaccggcccagtgggggcagcgggaccagcaggacctaatggccccccaggccccgccggcagcaggggcgacggcggaccaccagggatgacgggcttccctggagccgcaggaaggaccggaccacccggaccaagcggaatctctgggcctcccggcccccctggacctgctggaaaggaaggcctccgggggcctcgtggcgatcagggccctgtgggccggacaggcgaggtaggcgcagtggggcctcccgggtttgcaggcgagaagggccccagcggtgaggcggggaccgccggtccaccagggaccccaggaccgcagggactcctgggggcccctggcatcctggggttgccggggtcacggggagagaggggactccccggcgtggccggggcagtcggtgagcccgggcctctcggaatcgcgggaccgccgggtgctcgggggccgcccggcgcagtcggctcaccaggagtaaatggggcccccggtgaagccggccgggacggaaaccccgggaatgatggtcctccaggacgagatggtcagcctggccacaagggcgagcgaggttatcccggcaacattgggcctgtcggagcggcaggcgcaccaggtccgcacgggcctgtgggtcccgcgggtaagcatgggaatcgcggtgaaacggggccaagtggccccgtgggaccggccggcgcagtcggccccagaggcccgagtgggccccaaggcatccggggcgataagggtgagccgggcgaaaaagggccccggggtctgccgggattaaaggggcacaatggtcttcaaggcttgccaggtatcgccgggcatcatggtgaccagggtgcgcccggttctgtgggaccagccggccctagaggacctgccggtccctccgggccggcaggtaaggacggtcgtacggggcatccgggcacggtgggcccggccggcatccgcggaccgcagggccaccagggtcccgcaggacctccaggcccacccggtcctccagggccccccggcgtgtctggtgggggttatgactttggatacgacggcgatttctatagggcagatcagcctcgctccgccccttccctgaggccaaaagactatgaagtagacgccacgctgaaatccctgaataaccagatcgaaacactgctcactcctgaaggctctcgcaaaaacccggctagaacttgcagggacctacggttatcacatcccgagtggagtagtggttactactggatagatcctaatcaaggctgcacaatggacgcaattaaggtgtattgtgatttctccaccggcgaaacctgcatcagggcacaacccgagaatatcccagctaagaattggtaccgatcttccaaagacaaaaaacacgtgtggctaggagagactataaatgctggaagtcagtttgagtataacgttgagggcgtgacttccaaggagatggccactcagctggcattcatgcgcctgttagccaactacgcatcccagaacatcacctatcactgcaagaactctattgcttatatggacgaagagactggcaacctcaagaaagctgtcattttgcagggtagcaacgatgttgaactggtcgcggaaggcaattcaaggttcacttatactgttctggtcgatggttgctccaagaagaccaatgagtggggtaaaacaattattgagtataagaccaacaaaccttcccgactgccatttctcgatattgctcccctggatattggaggcgccgaccaggagttctttgtcgacatagggcctgtatgtttcaag

SEQ ID NO: 32495 - DNA, 4098 bp, Artificial Sequence
  Description of Artificial Sequence: Synthetic coding sequence
atgctgtcgttcgtggatacccgcaccctgctgctgctggccgtcaccctgtgtctggcgacgtgccagtccctgcaggaggaaactgtccggaagggcccggcgggcgaccggggaccaagaggtgaacgcgggcctccgggcccgcccggccgcgacggtgaagatggtcccacgggaccgccaggaccaccaggtccaccgggccccccaggactcggaggaaatttcgccgcgcaatacgacgggaaaggagtgggcctgggccctggtccgatgggactcatgggaccgaggggacccccaggtgcggctggggctcctggaccgcagggattccaaggccctgccggcgagccgggcgaaccggggcagactggaccggccggcgcacggggacccgctggaccacctggtaaagccggtgaggacgggcacccggggaagccgggtaggcccggcgaacgcggagtggtcggaccacagggagctagaggctttccgggcaccccgggcctgccgggcttcaagggtatccgtggacacaacggactggacggtcttaagggccaaccaggggccccaggagtgaagggcgagccaggcgcccctggggagaacggcactccgggtcagactggggcccgcgggttgccgggggagcgaggtcgcgtcggcgcccctggcccggcaggagcacgcggatccgacggatcagtgggacccgttggcccagccgggccgatcggatcggcaggaccgccaggcttccctggagcgccaggtcctaaaggtgaaatcggcgcagtgggaaacgccggtccagcaggtccagctgggccgaggggagaagttgggcttcccggcctttccgggcctgtgggccccccgggtaaccctggtgcaaacggccttaccggcgcgaagggggccgccggcctgcctggggtggccggtgctcccggcctcccaggtccgcgaggcatccccggtccagtgggagcagccggcgctacgggagcgcggggactggtcggagaaccagggcctgcaggttcaaaaggtgaaagcggcaacaagggggaaccaggctcggctggcccgcagggtccgccgggcccgtcgggcgaagagggaaagcggggtcctaatggagaggcaggctcggccggacctccagggcctcccgggctgcggggatcccctggaagcaggggcttgccaggtgccgatggacgggccggagtgatgggtcctcctggttcccgcggagcgagcggaccggctggagtccgcggcccgaacggagacgcgggccgcccgggtgagccgggactgatgggccctcggggcctgcctggaagcccaggtaacattggtcccgcgggaaaggaaggcccagtcggactcccaggcattgatggtagaccagggccgattggacctgccggtgcacgtggggaacccggcaatatcggattcccgggaccgaagggtccgaccggggatcccggcaaaaacggagacaaggggcacgccgggctcgctggagcaaggggagcaccgggaccggacggcaataatggagcccagggtccgccagggccccagggagtgcagggaggcaagggagagcaggggcctccgggaccaccgggatttcagggactcccaggacccagcggacccgcgggtgaggtggggaaaccgggagagcgtgggctccacggggaattcggattgcccgggcccgcaggccctcggggggaacgcggaccgcctggtgaatcaggagctgcgggtccaactggacctattggctcaagagggccgagcggacctcctggtccagatggaaacaagggcgagcctggcgtagttggagcggtcgggaccgcaggtccatcaggcccgtcggggctcccgggcgaaagaggcgccgccggcatccctggcggtaaaggagaaaagggggagcccggtctgcgcggagagatcggaaatccgggacgcgatggcgcgagaggcgctccgggagctgtgggagcgccgggaccggcgggggcaaccggagatcggggcgaggcaggggcagcaggtccggctggacccgccggaccgaggggtagcccaggagaacgcggagaagtaggtcctgcgggacctaacggatttgcaggaccggctggcgcagctggacaacctggagccaaaggcgaacggggagccaagggaccaaagggcgagaatggtgttgtcggcccgactggaccggtgggcgccgctggcccggctggccctaacgggccaccgggtcctgcgggttcgagaggcgacggaggaccgcctggaatgactggatttccgggcgcggccggtcggactggaccgcccggcccctcaggcatctcaggtcccccgggcccgccagggcctgctgggaaggagggactcagaggcccacggggcgaccaaggtccagtgggccggactggcgaggtgggagcagtggggccgccaggattcgctggggagaagggcccgtctggcgaggcgggaaccgctggtccaccagggacccctggcccacaagggctgctgggagcgccaggaattctcggacttcctggatcgcgaggagagcgggggttgccgggagtcgccggagcagtcggcgaaccagggccactgggaatcgccggtccgcccggagcccggggcccaccaggagccgttggatcccccggagtgaacggagccccaggcgaggcgggcagggatggaaaccctggcaatgacggaccccctgggcgggatggccaacccggccataaaggggagcggggttaccccgggaatataggtccggtgggggcggcaggggcaccaggcccgcatgggccggttggaccagcagggaaacatggaaaccgcggcgaaactggaccttccggaccagttggaccggcaggcgcagtgggtccacgcggaccaagcggaccgcagggtatcaggggagacaagggagagcctggagaaaaaggaccgcgcggcctgccaggactgaagggacataacggattgcagggtctgccaggtatcgcggggcaccacggcgaccagggagcaccaggatccgtggggcctgccggcccccgcggtccagcggggccgtcgggccccgctggtaaggacggacgcaccggacaccccggaaccgtcggccctgcgggaataagaggtccgcaaggacaccagggccccgccggcccccctggcccgccggggccgccgggacccccgggagtgtccggaggcggatacgacttcggctacgatggagacttctaccgcgccgaccagcccagatctgccccttccctccggccaaaagattacgaagtggacgctaccctgaaaagcctgaacaaccagatcgagactctcctcactccggaaggatcgcgcaaaaaccctgcgcgcacttgccgagatctgagactgtcccatccggaatggtcctccggatactactggatcgatccgaaccaaggatgtaccatggacgccattaaggtgtactgcgatttctcgactggagaaacctgcatcagagcgcaaccagaaaacatcccggcaaagaattggtacagatcatcaaaggacaagaagcatgtgtggctgggagagactatcaatgcaggttcgcaatttgaatacaatgtcgaaggggtgacttcaaaggaaatggcgactcagctcgcgttcatgcgcctgctggccaattacgcgtcccagaatatcacctaccactgcaaaaactcgatcgcttacatggatgaggaaactggaaatttgaagaaggctgttattctccaagggtcgaacgatgtcgaactcgtcgctgaaggtaatagcagatttacgtataccgtgcttgtggacggctgctcaaaaaagaccaacgaatggggaaagaccatcatcgagtataagacgaacaagccgtcccgactccccttcctcgacatcgctcctctggacatcggtggagccgaccaggagttcttcgtggacatcggtcctgtctgtttcaag

SEQ ID NO: 32496 - DNA, 4098 bp, Artificial Sequence
  Description of Artificial Sequence: Synthetic coding sequence
atgctttccttcgtggacacccgcaccctgctgctgcttgcagtcaccctctgcttggcgacctgtcagagcctccaagaagaaaccgtgcgcaagggtccagcaggagacagaggaccccggggagagagaggccctcctggtccgcccggaagggacggagaagatggacccactggcccgccagggccaccaggtccgccggggccaccaggactgggcggaaacttcgcagcccagtacgacggaaagggagtgggacttggaccaggaccgatgggtcttatggggccaagaggaccgccaggtgccgctggagcaccgggaccgcaggggttccaaggaccggctggcgagccgggggaaccagggcaaaccgggcctgcaggtgcgcgggggcccgctggcccacctggtaaggccggagaggacggacatccaggaaaaccgggtcggccgggagagagaggtgtggtcgggccgcagggagctcgaggattcccgggaacgccaggactgccaggattcaagggcatcagagggcacaatggactcgacggcctgaaaggacaaccgggcgcgccgggcgtgaagggcgaaccaggcgcccccggagaaaacggaactcctggccaaaccggtgcccgcggactccctggagaaagaggccgcgtcggggcccccggccctgcaggggcgcgcggtagcgatggttccgttggacctgtggggcctgccggtcctatcggtagcgcgggccctccgggattcccaggggccccggggccgaaaggagaaattggtgccgtgggaaatgctggcccggccggacctgccggtccgcggggcgaagtgggactgccaggcctgtctgggccagtagggccaccgggaaacccgggcgcgaatggcctgacgggagccaagggagcggccggcttgcctggcgtcgcaggagccccaggcttgccaggcccgaggggcatcccggggcctgtcggagcagctggagccaccggcgcccgggggctcgtgggagaaccaggcccagcaggatccaagggcgagtcgggcaacaaaggggaacccggatccgcgggacctcagggaccacccggaccttcaggagaggagggaaagagggggccgaacggagaggccggcagcgccggaccgcctgggccgcccggactgcggggaagcccggggtcgagaggtctgccaggagcggatggacgcgcgggtgtcatgggaccgcccggatcgcgaggagccagtggtccagccggtgtccgtggccccaatggagacgcgggacgccctggtgagccaggactgatgggaccgcggggattgccgggatcacctgggaatataggtccagcagggaaggagggacctgtgggactgcctggaatcgatggtcgccctggaccgatcggtccggctggcgcacgcggggaaccaggcaacatcggtttccctggaccaaagggcccgaccggtgacccgggaaagaatggagacaagggccacgccgggctggctggcgctcgcggcgctcccggtccggacggtaataacggagcacagggacctcccggccctcagggcgtgcagggaggcaagggggaacagggcccgcccggccccccgggatttcaaggactgccgggaccttccggaccagcaggtgaagtgggtaagccaggtgagcggggtctgcatggtgagttcgggctgcccgggccggcaggccccagaggagagaggggtcctccgggggagtccggagcagccggcccgacgggcccaatcggatcgaggggtccaagcggccctccgggaccagatggaaacaagggagaacctggagtcgtgggggccgtcggaactgcgggtccgtccgggccctcaggactccccggcgaacgcggtgccgctggaattccgggaggaaagggagaaaaaggggagccgggactcaggggagaaatcggaaatccaggacgggatggcgccagaggggcacctggggccgtcggtgcgccgggacccgccggagctactggcgacagaggagaagcgggtgcggctgggcccgccggaccagctggcccgcgtggatccccgggagaacggggagaagtggggccagccggccctaacggcttcgcaggcccagccggcgcggcagggcagccgggagctaaaggtgagagaggagcgaagggcccaaagggcgagaacggagttgtcgggccgaccggaccggttggggcagctggaccagcgggaccgaacggacccccgggtccggctggatctcggggagacggcggaccacccggcatgactggctttcctggagccgcaggtcgcaccggaccccccgggccgtccgggatctcaggaccgccaggaccacctggacctgccggaaaggaaggcctccgcgggccgcggggagatcagggcccagtcggacgcaccggagaagtgggagctgtgggacctccgggatttgctggagagaagggaccgtcaggtgaagccggcactgcgggcccaccaggcactccgggaccacagggactccttggagccccggggattcttggcctgcccggaagcaggggggagcgaggcctgccaggcgtggcgggagcagtcggggaaccgggtccgctgggaatcgcgggtccgccaggagcgcggggaccaccgggagccgtcggctcgccgggagtgaatggagcccctggcgaggccggacgggacggtaaccctggaaacgatggaccaccgggtcgcgacggacagccgggacataagggagagcgcggatacccgggcaacattggccctgtgggagcggcgggcgccccaggaccgcacggtccggtgggtcccgcagggaagcacggcaatcgcggagaaaccggaccaagcggtcctgtgggaccggccggcgcagtcgggcctaggggcccttcaggtccgcaaggaatccgcggagataaaggcgaaccgggggaaaaagggccgagaggattgccgggactgaagggacataacggattgcaagggctgccggggatcgcgggacaccacggcgaccagggtgcaccgggatcggtgggaccagccgggcccagggggccggccggaccgtcgggaccggcggggaaggacggccgcactgggcacccaggcaccgtgggccccgccggaatccgggggccgcaaggtcaccaggggcctgctggtccaccgggaccgccgggaccccctggacctccaggcgtttcggggggcggatatgacttcggatacgacggagacttctatcgcgccgatcagccgcgcagcgcaccgtcgctccgcccgaaggattacgaagtggacgctaccctgaagtcgctgaacaaccagatcgaaactctgctgacgcctgagggctcccggaagaatccggcccggacctgccgcgatctgcggctctcacatcctgaatggtcctcgggctactactggatcgatccgaaccaaggttgcacgatggacgccatcaaggtgtactgtgacttctcgactggagaaacttgtatccgtgcccagccagaaaacatcccagccaaaaactggtaccggtcatccaaggataaaaagcacgtgtggctcggcgagactatcaacgctggaagccaattcgagtacaatgtggagggcgtgacctccaaagagatggccactcagctcgcttttatgcggctgctggccaactacgcgtcgcagaacatcacctaccattgcaaaaactcgatcgcctacatggacgaggagactgggaatctcaagaaggcggtgatcctccaaggcagcaatgacgtggagctggtcgcggaaggaaactccagattcacttacactgtgctcgtggacggatgctcaaagaaaaccaatgagtggggaaaaactatcatcgaatacaagaccaacaaaccgagcagactgccgttcctcgatattgcgcctcttgacatcggcggggcggatcaggaatttttcgtggatattggaccggtgtgctttaaa

SEQ ID NO: 32497 - DNA, 4098 bp, Artificial Sequence
  Description of Artificial Sequence: Synthetic coding sequence
atgctgagcttcgtggatacccggaccttgctcttgctcgcagtgaccctctgcctggcaacgtgccagtccctccaggaagagactgtgcgcaaagggccggccggagacagaggaccacgcggggagaggggccctcccggaccacccggccgagacggtgaggacggcccaaccggcccgccaggacctccagggcctccgggccccccaggtttgggaggcaactttgctgcccaatacgacggaaagggagtggggctcggtcctggcccgatgggactgatggggcctcggggccctccgggggcagcaggagcaccgggaccgcagggattccagggtccagccggagaaccgggcgaaccaggacagactggaccagcaggagcccgaggcccggccggtcccccgggtaaagccggcgaagatggacatccgggaaagccgggccgcccaggggagcggggtgtggtggggccacaaggggcccgcggtttcccaggcactccggggctcccgggattcaaaggcatcaggggacacaacggactcgatggcttgaaggggcagccgggcgcaccgggagtgaagggggagccgggtgcccctggggaaaatgggaccccagggcagactggagcacgcggactgccgggggaaagaggtcgggtcggagccccgggaccggcaggcgccagagggagcgacggctcggtgggaccggtcgggccagctggaccaattggatcagcaggccctcctgggtttccgggcgctcccggaccgaaaggcgaaattggagctgtgggaaacgcaggcccagccgggccggcgggaccgcgcggggaagtgggactcccgggactttcaggaccagttggcccgcctgggaacccaggtgccaacggccttactggagctaagggagctgctggcctgccgggcgttgcgggtgcgccaggactgccgggacctcggggaatcccgggcccggtcggcgcagcgggagcaaccggggcgagaggcctcgtcggcgaaccgggcccagcagggtcaaagggcgagtccggaaataagggagaacctggatcagcgggcccacagggaccaccgggaccgagcggggaggaaggaaagcggggcccaaacggcgaggcgggatctgcgggtccacctggaccacccggtctgaggggcagcccaggatcgcgcggactgcccggagctgatggacgggctggagtgatgggccctccaggctcccgcggcgcgtcgggacctgcgggagtccggggtccaaacggagacgctggacgcccgggtgaaccaggactcatggggccgcgcggattgccgggttcgcctggaaatatcggccccgctgggaaggagggccccgtgggtttgccaggaatcgatggcaggccgggaccgatagggcctgcaggtgcgcgtggggaaccgggaaacataggtttcccgggaccgaagggccccaccggcgatccgggtaagaacggggacaaaggtcacgcgggtctggctggagcacggggagctcccgggccggacggaaataacggggcgcagggaccgcccggcccacaaggtgtgcagggaggcaagggagaacagggaccgccgggacccccagggttccaggggctgcccggaccgtcgggccctgcgggggaagtcgggaaaccaggtgaacggggtctgcacggcgagtttggactccctggcccggcggggccaaggggcgagcgcggtccccctggcgagtcaggcgctgcaggtccgactggaccgatcggatcgcggggacctagcggcccgcctggtcctgacggcaataaaggagaaccgggtgtcgttggtgccgtgggcaccgccggcccatctggaccttccggcctgccgggagagcgcggcgccgctggaatcccaggaggcaagggggagaagggagagcctggactccggggcgagatcggcaacccgggtagagacggagcccgcggagcccctggagccgtaggtgcacctggcccagcaggtgcaactggagatcgcggggaagccggcgccgcaggccctgcaggaccagcaggcccgaggggatctcccggagaacgaggcgaagtgggtcccgctgggcctaacggattcgccggacctgcaggggccgcgggccagccaggggccaagggagaacgtggagcgaaggggccgaaaggggaaaacggcgtggtcggaccaactggacctgtaggtgcagccggacccgcgggcccgaacggaccaccggggccggccggcagccgtggagacggagggcctcccggaatgactggctttccgggtgccgctggcaggaccggccccccgggtccgtcgggaatctccggaccgcctggccccccgggacctgcaggcaaagagggactgcgaggcccgcggggggaccaaggcccagtgggacgcacgggcgaggtgggagcagtggggccgcctggatttgcgggcgagaagggaccaagcggagaagcaggtaccgcgggtccaccaggcactccaggaccgcaaggactcctgggggctccgggaatcttgggcctgcccggatccagaggtgaacgtggattgccgggcgtcgccggagctgtgggcgaacctggaccactgggcatcgcgggtcccccaggagccagaggacctcctggggccgtggggagccctggagtgaacggagcgccaggcgaagctgggcgcgacggaaatccgggtaacgatggaccaccgggccgagacggacaaccggggcataagggggagagaggataccctgggaacattggacctgtgggagccgccggcgccccaggcccgcacggtccggtgggaccagccggtaagcacggaaaccgcggtgagactggcccgagcggtccagtgggcccggctggagccgtgggccccagggggccatccgggccgcagggaatccggggagataagggcgaaccgggagaaaagggccctcggggactgccaggcctgaagggtcacaacggactgcaaggccttcctggaatcgcgggccatcacggagatcaaggagccccagggtccgtgggccccgccggaccgcggggccctgctggacccagcggaccggcgggaaaggatggacgcaccgggcacccaggaaccgtgggtcctgctggcatcagaggtccgcagggtcatcagggcccggcaggacctccggggccgccgggcccaccggggcctcctggcgtgtcaggaggagggtacgacttcggatacgatggagacttctaccgcgctgatcagcccagatcggcgccatcgctgaggcctaaggactacgaggtggatgccactctcaagtcgttgaataatcagattgagactctcctcacgccggagggcagcagaaagaacccggcaagaacctgccgcgatctccggctgtcccatccggaatggtcgtccggatactactggatcgacccgaatcagggctgcactatggacgccatcaaagtctactgcgacttcagcactggagaaacttgcattagagcacagccggagaatatcccggcgaaaaactggtatagatcgagcaaagacaaaaaacacgtgtggctgggagaaaccatcaatgcgggatcgcagtttgaatacaacgtggagggtgtgactagcaaggagatggcgacgcagttggccttcatgcgcctgctggcgaattacgcctcgcagaacatcacttaccattgcaaaaactcaatcgcgtacatggacgaagaaaccggaaacctgaaaaaggcagtcatcctgcaggggtccaacgatgtcgagctggtggcagaaggcaactcgcgcttcacctacaccgtgttggtcgacgggtgtagcaagaaaaccaacgagtggggaaagactatcatcgagtacaagacgaacaagccatctcggctgcctttcctggacatcgcccccttggatatcgggggtgccgatcaggaattcttcgtcgacattggaccggtgtgcttcaag

SEQ ID NO: 32498 - DNA, 4098 bp, Artificial Sequence; identical to SEQ ID NO: 32454
  Description of Artificial Sequence: Synthetic coding sequence

SEQ ID NO: 32499 - DNA, 4098 bp, Artificial Sequence
  Description of Artificial Sequence: Synthetic coding sequence
atgctgtctttcgtggacactcggacccttctccttctggccgtcactctgtgtctggcaacctgccaaagtcttcaggaggagacggtgagaaaaggtcccgcaggtgatcgaggtcctagaggcgaacggggaccacctggtccccccggcagggacggggaggatggtccgaccggccccccaggcccaccgggtcctcccgggccccccggccttggagggaactttgctgcgcagtatgatggcaaaggtgtgggactcggacctggccccatggggttgatgggacccaggggacccccaggagcggctggcgctcctggaccccagggttttcaaggcccagccggcgaacctggtgagcccggacaaaccggacctgctggagcccggggaccggctggcccgccaggtaaggcgggcgaagacggacacccgggcaagccaggccggcccggagaacgcggggtcgtcggacctcaaggagcgcggggctttcctgggaccccagggctgccaggctttaaaggtatccggggccacaacggactcgacggattgaaaggccagcctggagctccgggtgtcaagggggagccaggcgctccaggcgaaaatgggacacccggccaaactggcgccaggggactgccgggggagagaggaagggtcggcgctccaggcccagcaggagctcggggctctgacgggtctgtcggtcccgtcggacccgccggacccatcggatcagccggtcctcccgggtttcccggcgcccccgggccaaagggcgaaatcggggccgtaggcaacgctggacccgcaggtccagccggcccccgaggagaggtcgggctgccggggctcagtggccccgtcggaccccccggaaacccaggagccaacggcctgacaggcgccaaaggagccgcaggcctgccaggagtggccggcgctcccggcctgccagggccgcgcggcattcccggccctgtcggtgctgctggagccactggtgcaagaggacttgtaggggaaccaggccctgccggctcaaaaggtgagagtggcaacaagggggaaccaggcagtgccggcccacagggacctcccggaccttcaggcgaagaaggcaaacgcggaccaaacggggaagcgggaagtgcgggacctcccggaccccccgggctgcggggatcccccggcagcagaggtctgccaggcgcggatggtagggcaggggtcatgggacctcctggatctcggggcgcctccggaccagccggagttcggggtcctaatggcgatgccggacggccaggagaacccggtctgatggggccccgggggttgcctgggagcccgggaaacatcgggcccgcgggaaaggaaggtcccgttgggctccctggcattgacggacgacccggtcctataggcccagccggcgctcgaggcgaaccagggaacatcggtttccccgggccaaagggacctacgggggatcctggaaagaacggtgataagggacacgcgggtctcgccggggctaggggagccccagggcctgacggaaacaacggggcccaaggtccgcctggccctcaaggcgtgcagggcgggaagggggaacaggggccccctggaccaccggggtttcaggggttgccaggtccatccggccctgccggagaagtggggaagcccggcgaaaggggcctgcacggggaattcgggctgcccggcccagccggtccacggggcgagcgcggccctccaggcgaatccggcgctgccgggccaacgggtccaatcggatctagaggaccctccggccccccagggcccgacggcaacaaaggcgagccaggggtggttggcgcagtgggtaccgctggcccctctgggccctcaggactccccggagaaaggggggctgccggcattcccggtggaaaaggcgagaaaggcgagcctgggttgcggggagagattggcaatcccggccgggacggcgcccgcggtgctccaggagctgttggcgctcctggacccgctggagctaccggggaccggggtgaggcaggggcagcgggacctgctgggccagccgggccacgagggtcaccgggcgagcgaggcgaagttggacccgctggccctaacgggtttgccgggcctgcgggagcagctggacagccgggcgccaaaggcgaacgcggcgcaaaaggcccaaaaggggagaatggcgtcgtgggccctacaggtccggtcggagctgccggtcccgccggccctaacgggccgcccggccccgccggtagtaggggcgacggcggcccaccagggatgacagggttccccggagccgccgggcgaacaggaccacctggcccaagcggcatttcaggtcctcctggtcccccaggccctgccggcaaggagggcctccgggggccaagaggggatcaaggcccggtggggcgcactggcgaggtgggtgctgttggacctccaggctttgccggtgagaaggggccttcaggggaggctggcactgccggaccaccagggaccccaggtccgcagggcttgctcggcgctccgggcatcctcggcctgccagggagtcgcggagagcgaggactgcccggggtcgctggtgctgtcggggagccaggacctttgggcatagcaggcccacctggggctaggggccccccaggcgcagtgggatcccctggggtaaatggagcgcctggcgaagccggaagagacggtaacccaggcaatgatggacctccgggaagagacggacagcccgggcataagggtgaaagaggatatcctggcaatattggccctgtcggagctgcgggagccccaggtccacacggtcctgtcggccctgcagggaagcatggaaacagaggcgagaccgggccatctgggcctgtggggcccgctggagccgtggggccacgagggccaagtggtcctcagggaatccgcggcgacaagggggagccaggagagaagggcccaagaggcctccctgggttgaaggggcacaacgggctgcagggattgccagggattgccggccatcatggtgatcagggcgcgccaggatctgtgggcccggcggggccaagaggtccggccggccccagtggaccagcaggaaaggacgggaggaccggccaccctggaaccgtcggcccggctggtattcgcggcccacaggggcatcaaggtcccgccggccctcctggaccccccggaccacccgggcctcccggagttagcgggggtggctacgattttggttacgatggagatttttatcgcgcagatcaaccaagatctgccccatcactgcggcctaaagattatgaggtggacgctacactcaaatctcttaataaccagattgagacacttctcacgcccgaaggaagtaggaagaaccccgctcgaacttgtagggatctcaggctgtcacaccctgaatggtctagcgggtactactggatagatcccaatcagggatgtaccatggacgctataaaggtctattgtgacttttcaacgggggagacttgtattcgggctcaaccagagaatatcccggcaaagaactggtacagatcaagcaaggacaagaagcatgtatggctgggggaaactataaacgctggcagtcagttcgagtacaacgtggagggcgtcacctctaaagagatggccacccagttggccttcatgcgactcttggccaactatgccagccagaacattacataccactgcaagaacagtattgcctatatggacgaggagaccggtaacctcaaaaaggccgtgatcctccaggggtctaacgatgtggagctggtggcagagggcaatagtcggtttacctacactgttctggtcgatgggtgcagcaagaagaccaacgagtggggtaagacaatcatcgagtacaaaaccaacaagccctctcgcttgccatttctggatatagcccctctcgacataggcggcgcagatcaggagtttttcgtcgacatcgggcctgtttgtttcaag

SEQ ID NO: 32500 - DNA, 4098 bp, Artificial Sequence
  Description of Artificial Sequence: Synthetic coding sequence
atgttgtcattcgtggacacccgcacacttcttctgctcgcggttacgctgtgccttgctacctgtcaatcattgcaggaggaaacagtgagaaagggacccgctggagacaggggccctaggggcgagagaggtccgcccggccccccaggacgcgacggtgaggatggaccgactggcccacctggtccccccggccctccaggaccacctggcctgggaggcaacttcgcggcacagtacgatggcaagggagtcggtctgggtccgggacctatgggcctgatgggacccagaggcccccctggagctgccggagctccaggaccccaaggctttcaaggtccagccggagagccaggcgagcctggccagaccggtccagcaggcgccaggggaccagccggtccgcctggtaaagccggtgaggatggccacccgggcaaacccggtaggcccggtgaaagaggagtagttggaccacagggtgcccgcggcttcccgggtacgcccggattgcctggattcaagggcatcagaggacacaatggactggacggactgaagggacagccgggcgcgccgggagtaaaaggcgagcctggcgcaccgggagaaaacggaaccccgggtcagaccggcgcaagaggcttgccaggtgagagaggccgcgtaggcgcccctggtcccgctggagcgcgcggtagcgacggatcagttggtcctgtcggcccggctggtcctataggatctgcgggaccccccggtttccccggcgcgccaggaccgaagggcgagatcggagcagttggcaatgcaggccctgcgggccccgctggacccaggggcgaggtgggcctgcctggactgagcggtccggttggacctcccggtaatcctggcgcaaatggactcacaggcgctaaaggagctgcgggcctccctggagtagccggcgcccctggactgcccggccccagaggtatacccggcccagttggagccgccggtgcgacaggagctagaggcttggttggcgaacctggacccgctggttccaagggagagagcggaaacaaaggtgaaccgggatcagcgggcccgcaaggaccccctggaccgtctggtgaagagggtaaacgcggtccaaatggagaggcaggctccgcgggtccacccggcccaccgggcctcaggggttctcctggaagtaggggtttgcctggtgcagatggaagggccggagtcatgggtcctcccggaagcagaggcgcctcaggacccgcgggtgttaggggcccaaatggtgacgcaggtagacctggcgagcccggactgatgggacccaggggattgccaggaagccccggcaacatcggtcccgctggcaaagaaggacctgtgggactcccgggcatcgacggccgccccggtccaataggccctgccggcgctagaggtgagcccggaaacataggcttcccaggtccgaagggaccaacaggagaccccggcaaaaacggcgacaagggtcatgcaggccttgctggagctcgcggcgcacctggcccagatggaaataatggcgctcagggtccccccggaccccagggtgttcaaggaggtaaaggagaacagggccccccgggcccaccaggtttccaaggccttcccggaccctcaggtcccgctggagaagtgggaaaaccaggtgagaggggacttcacggcgagttcggccttcctggaccagccggcccgaggggcgaaagaggcccgcccggtgagtccggcgcggcaggtcctactggaccaatcggctcaagaggcccatccggtccaccaggtccagacggcaataaaggtgagcccggtgtagttggcgctgtgggtacagcgggtccatctggccccagcggtctcccgggcgagagaggtgctgcaggaattccgggtggcaagggagagaaaggcgagcccggactcagaggcgagatcggaaaccccggccgcgatggagcaaggggtgctcccggcgcagttggcgccccaggtcctgctggcgcaaccggcgacaggggagaggcaggcgccgctggccccgcgggtcctgctggccctaggggttcccctggtgagcgcggtgaagtcggaccagcgggccccaacggtttcgcaggacctgccggcgctgcgggccagcctggcgcaaaaggcgaaagaggagccaagggacccaagggcgaaaatggagtggtgggcccaaccggtccggtgggcgcggcgggcccagcgggtcctaacggccctccaggccctgcaggatccagaggagacggcggaccccccggtatgactggattcccaggtgcagccggcaggacgggacctccaggcccgagcggtatcagtggtcctccaggccccccgggacccgctggtaaggagggcctgcgcggtcccaggggagaccaaggtcccgttggtcgcacaggcgaagttggcgctgttggccctcccggattcgcaggtgagaagggaccttctggagaggcaggtaccgcgggaccaccgggaacacctggacctcagggtctgctgggtgctcctggcatactgggactgcccggcagtagaggtgagcgcggcctcccgggagttgcgggtgcagtcggtgagccaggccccctcggcatagctggccctccaggtgcccgcggccctcctggtgcggtcggatctcctggagtcaatggcgctccaggagaggcgggaagagacggtaatccaggcaacgacggcccgccgggcagagatggacaaccaggtcataagggcgagagaggttatcccggcaatatcggcccggtgggcgccgccggagctccaggaccccacggtcccgtgggcccggctggaaagcatggtaataggggcgagacgggtccatccggccccgtgggaccagccggcgccgtgggtcccaggggaccgtccggtccccagggaatcaggggagataagggtgagcccggtgaaaagggaccgcgcggtctgccgggacttaagggtcacaatggcctgcagggacttcccggaatagccggccaccatggagaccaaggtgcaccaggaagtgtgggtcccgccggcccgagaggacctgcaggaccctccggacctgctggaaaggatggcagaaccggccatcccggaactgtgggtccggccggtattagaggtcctcaaggacaccaaggtcccgccggtccacccggacctcctggccctccaggtcctcccggcgtgtctggaggtggctacgacttcggatatgacggcgatttctatagggctgatcaacctaggagtgctccttcactgaggcctaaggactacgaggtcgacgccacactgaagtccctcaataaccagatcgagacgctgctgacccccgagggttccaggaaaaaccccgctaggacgtgtcgcgacctgcgcctgtcacatccagagtggtcttcaggctattactggatagaccccaaccagggatgcacaatggatgctatcaaggtatactgcgacttttctactggcgagacttgcatacgcgctcagcctgagaacatccccgccaagaactggtacagatcctctaaggataagaagcatgtatggctgggcgagacaattaatgctggttcccagtttgaatacaacgtggagggtgttactagcaaggaaatggcaacccagttggcttttatgaggttgttggccaattacgccagtcagaacataacttaccactgcaagaactctattgcttatatggacgaagagactggtaaccttaagaaagcggttattctgcagggaagtaacgatgttgagttggtggcggagggtaactctagattcacatatacggtccttgtggacggatgctctaaaaagacgaacgaatggggaaaaacaatcatcgaatataagaccaacaagccctccaggcttcctttcctcgacattgctcctttggatatcggaggtgctgatcaagaattctttgtagacatcggtccggtttgtttcaag

SEQ ID NO: 32501 - DNA, 4098 bp, Artificial Sequence
  Description of Artificial Sequence: Synthetic coding sequence
atgctgtcattcgtggatacccgtactctcctcctgttggccgtgaccttgtgcctcgccacctgccagtctcttcaggaagaaacggtcagaaaaggaccggccggtgatagaggcccacgcggggaaagaggtccgccgggccctccaggccgcgatggggaggatggtcctacgggccctcctgggcccccgggtcccccaggaccgcctggtctggggggcaacttcgcggcccagtacgatggcaagggcgtgggcctgggaccagggccaatgggactcatgggaccgagagggcccccaggcgccgctggtgccccgggcccgcaaggatttcagggtccggcgggagagccgggggaaccgggacagactggtcccgcaggtgctcggggtcccgcaggaccgccgggtaaggccggggaagatggacatccgggaaagccaggacgcccgggcgaacgtggggtggttggaccccaaggcgcacgcggattcccgggaacgccgggcctccctggcttcaagggaatccggggacataatggactggacggactcaaggggcaacctggcgcaccgggcgtgaagggggagcctggcgcacctggagaaaacggaactcctggacagaccggagcgcgagggctgccaggcgagagaggacgggtgggagcacctggcccggcgggagcgcggggaagcgatggcagcgtgggccctgtcggtcccgcgggtccgatcggctcggctggaccgccaggattccccggagctcccggcccgaaaggagagatcggcgccgtgggaaacgcaggaccggcggggccggcgggcccgagaggagaagtcggtttgcctgggttgagcggaccagtagggcctccaggaaacccgggagcaaacggcctgaccggtgccaagggggctgcgggactgcccggtgtggctggtgctccaggactcccaggtccacgcggaattcccggtccagtcggagctgcaggtgccaccggcgcgcgcggacttgtaggcgagccgggccctgctgggtcgaagggggagagcggaaataagggtgaacccggttcagcgggcccgcagggacctcctggaccttcaggggaagaaggcaagcgcggaccgaacggtgaagctggttccgcgggacccccaggcccacctggccttcggggttcgccgggctcccgcggactcccgggggccgacggtcgtgcaggggtgatgggccctccgggctcgcgcggagcgagcggacccgccggagtgcggggaccgaacggggatgccggtagacctggagagccaggactgatgggaccccggggccttccggggagccccgggaacattggaccagcaggaaaagaggggccggttggcttgccaggaattgacggtcggcctggaccaatcggaccagccggcgcccgcggagagccgggcaatattggcttcccagggcctaagggaccgactggagatccgggaaagaatggcgataagggacatgcgggactggccggagcacgcggtgctccagggcccgacggaaataacggagcccaggggccgcccggaccgcagggtgtccaggggggaaagggcgagcagggaccgccggggcccccggggttccaagggcttcccggaccgtctggccctgcgggagaggtcggaaagccgggagaaagggggctgcacggggagttcggcctccctggaccggcaggcccccgcggagagagaggacccccgggcgagtccggcgccgccggaccaactggaccgatcggctccagagggccgtccggaccacctggaccggacgggaacaagggcgagccaggggtggtcggagctgtcggaaccgctggaccctcgggaccaagcgggctcccgggagagcgaggggctgccgggattccgggaggcaagggggaaaagggtgaacctggccttaggggtgagatcggaaacccgggccgcgatggcgctcgcggcgcgccgggtgcggttggggcacccggtcctgctggagcaactggcgaccgcggcgaagcgggtgccgccggcccagcaggtccggcaggtccgcggggttcacctggagaacgcggcgaggtgggcccagccgggcctaatggttttgcaggtcccgccggtgcggcgggccagcctggggccaagggggagcgtggagccaaaggaccaaagggcgaaaatggagttgtgggaccaaccggaccggtgggagccgcagggccggcaggaccgaatggaccaccgggaccagcgggaagtaggggtgacggaggtccgcccggaatgactgggttccccggtgcggcaggcagaaccggaccgcctgggccgtcgggaatctcgggcccaccaggtccacctgggccagcgggaaaggaaggactgcggggacccagaggagatcaaggccctgtgggacggactggcgaagtgggagcggtcggccctcctggttttgccggcgaaaaaggcccatccggggaggcggggaccgctggcccgcccgggacccctggtccgcagggactcctgggcgccccaggtatcctggggctgcctggctcccgcggtgaaaggggtctgcctggtgtggctggagcagtcggagaacctggacctctggggatcgccggtccgccgggggcgaggggtccgccgggagccgtgggaagcccgggggtgaacggagcccctggcgaagccgggcgggacggtaatccaggaaatgacggtcctccagggcgagacggacaaccaggacacaagggagaaagaggatacccaggaaacattggcccggtcggagccgccggcgccccgggaccacatggtccagtcggccctgccggcaagcacggaaacagaggagaaactggaccgtcgggaccggttggtcctgctggcgctgtgggaccgcggggaccttccggtccacaaggaatccgcggagacaaaggcgagccaggagagaagggacccaggggattgccggggctcaaaggacataacggactccaaggactgccgggaatcgcaggccaccacggcgaccagggggcccccggcagcgtcggccccgctggaccgaggggcccggcaggtccctcgggaccggcgggaaaagatggaagaactggacacccgggaactgttggaccggccggcattcggggacctcaaggacaccaagggccggccgggccccctggcccaccaggcccaccagggccaccaggcgtgtccggagggggatacgacttcggatacgacggcgatttctaccgggcggaccagccacgctcagccccgtcgctgcgtccgaaggactacgaggtcgacgccacccttaagtccctgaacaaccaaatcgaaacgctcctgaccccagagggatccaggaagaacccggcaagaacctgtcgtgacctccgcctttcacacccggaatggtcgagcgggtactactggattgaccctaaccaaggatgcactatggacgcgatcaaagtgtactgcgatttctccactggagaaacttgtatccgcgcccagccggaaaacatcccggcgaaaaactggtaccggagctcgaaagacaaaaaacacgtctggctgggagaaactatcaacgccgggtcccagttcgaatacaatgtggaaggagtgacctcgaaggaaatggccacccagctcgctttcatgcgactcctggccaactacgcctctcagaacatcacctaccattgcaagaactcaatcgcctatatggacgaggaaaccggaaatctgaagaaggctgtgatactgcagggatcgaatgatgtagaactcgtggccgagggcaactcaaggttcacctatactgtgctggtcgacggttgctcaaagaaaactaatgagtggggtaagaccatcatcgaatacaagacgaataagccgagccgcctgcctttcctggatatcgctccgctggacatcggaggagcggaccaggagttttttgtggacataggcccggtgtgttttaag

SEQ ID NO: 32502 - DNA, 4098 bp, Artificial Sequence
  Description of Artificial Sequence: Synthetic coding sequence
atgctctcattcgtggatactcgcacccttctgctccttgcagtgactctttgtctcgcaacctgccagagcctgcaagaggaaactgtcaggaagggtccagccggtgacagaggcccacgaggagaacgagggcctcctggaccgcctggaagagacggggaagatggacctaccggacctccaggtccccccggcccccctggtccccctgggctcggcggtaactttgcagcgcaatacgacggtaagggagtcggtctgggacccggaccgatgggcctgatgggtccacggggaccacctggtgcagccggcgcacctggtccgcaaggtttccagggacctgcgggcgaacctggagaacctggacagaccggtcctgcaggggctcgaggaccagcagggccccctggcaaggcaggtgaggatggtcacccaggaaagcctggcagacccggagaacgaggagtggtgggtcctcaaggtgcacgcggttttcctggcacgcccgggcttcctggatttaagggtatcagagggcataatggcctcgacggcctgaaaggacaaccaggagcaccaggcgtcaagggagaacctggtgcacccggagagaacggaactccagggcagaccggggcacgcggcctgccgggggaacgtggaagagtgggtgcccccggtccggctggagcaaggggtagcgatggatcggtcggaccagtcggcccggcggggccaatagggtccgcaggcccgcctggcttcccaggcgcgcccggccctaagggcgagattggggctgtgggaaacgcaggaccggctggtccggcggggccgcgcggtgaagtcgggttgccaggactctcgggaccagttgggcctccggggaatcctggcgcgaacgggcttacgggtgcaaagggtgccgcaggcttgccaggagtggccggagcaccaggacttcccgggccccggggcattcctggccccgtgggggcggccggggccaccggtgcgcgcggtctggtgggtgagccaggacccgctgggtcgaaaggagagtccggaaacaagggggagccaggctccgcgggcccccagggccccccgggcccttcgggagaagaggggaagcggggacctaatggggaggcgggctcagctgggccacccggcccacccggcttgcggggctcacctggttcaaggggactgcctggggcggatgggagagctggtgtcatgggacccccagggagcagaggggcatcggggcccgctggagttagagggccaaatggagatgcaggtcgccctggtgaaccaggcctcatgggaccaagggggcttcccggatcgcctggcaacatagggcctgccggtaaggaagggcctgtgggccttcctggtattgacgggcgtccgggccccatcggtcccgcgggcgcacgaggcgaacccgggaatattggctttcctggcccaaagggacccaccggagatcctggaaaaaacggtgataagggtcatgctggtctggcaggagcgcgaggtgctccaggccccgatggaaacaacggggcacagggacctcctggacctcagggcgtgcaagggggaaagggagaacaagggccaccaggtccgcccggattccaaggcctgccagggccttctgggcctgcgggggaagtgggcaaacctggcgaacgtgggctccatggtgaattcggcctgcctggcccagccggaccacgcggagaaaggggacccccgggtgaatccggtgccgcgggtcctactggacctattggatcgcgggggccctcgggaccgccagggcctgatggaaacaagggtgaacctggagtggtgggagccgtcggtaccgcaggtcccagtggaccaagtggtctgccgggagaacgcggggcagcaggcatccccggaggtaaaggagagaagggggagcctggcttgagaggagagatcggaaaccctgggagagacggcgcacgcggcgcacccggtgctgtcggggcgccagggccagcgggagcaaccggagatcgaggcgaagcaggagccgcaggcccggcagggcctgctggcccgagaggatcgccaggtgagaggggggaggtgggacctgcagggcctaacggatttgctggaccggcaggagcagccggacaacccggcgctaagggagagcgcggagccaagggacccaagggagagaacggtgtcgtcgggcccactggaccagtgggtgcagcaggaccggcggggcctaatggtccacctggacctgcgggatccaggggtgacggcggccccccggggatgaccgggttcccaggggcagcagggcggacggggccaccagggccgagcggtattagcggacctcccggtcctccaggacctgccggtaaagaaggtttgcgtggcccccggggtgaccagggaccagtggggcggactggcgaagtgggggccgtgggaccacccggattcgcaggggagaaaggaccttccggggaagcgggtaccgcagggccgcccggtacccctggaccacaagggctcctgggcgcaccaggaattcttggcctccctggatcaagaggtgaaagaggacttccaggtgtggcaggcgcagtaggggaaccaggaccactcggaattgcagggccacctggagcacgtggtcctcctggggccgttggtagccccggggtgaacggagctcccggagaggccggacgggatggtaaccccggtaatgacggccctcctggacgtgatggtcaaccaggacataaaggggaaagaggttaccccggcaacatcggtcctgtgggagcagcaggtgcaccgggccctcacggccccgtgggcccagccggtaagcatgggaaccgcggtgaaactggtccttcaggtcctgtcggacctgcaggtgcagtcggtccaagaggtccaagcggtccacaaggaatcagaggcgataagggcgagcccggggaaaagggacctcgtggactgcctggacttaagggccataatggacttcagggactcccgggtattgccgggcaccacggtgatcaaggggcaccgggatcagtcgggccggccggacctagagggccagccggtccctcggggcccgccggtaaggacggacgcaccggacatcctggaaccgtgggccctgcaggaatacgggggccacaaggtcaccaggggccagcaggaccacctggcccgccgggaccgccggggcctccaggtgtgtccggtggaggatatgattttggctacgatggagacttttaccgggcagaccaacctaggagcgccccttcgctgaggccgaaggattacgaggtggatgcaactcttaagagcctcaataaccaaatcgaaactcttctgacccctgaaggttcaaggaaaaatcctgcccgcacctgccgtgatttgcggctgtcacacccagagtggtctagcggatactactggattgaccctaaccagggatgtaccatggatgctattaaggtgtactgtgatttttccactggagaaacttgtattcgggcacagccagagaatatccctgcaaagaattggtatcgctcctcaaaggacaagaaacatgtgtggttgggcgaaaccatcaacgcggggagccagtttgaatacaacgtagaaggggtgacttcgaaggaaatggcaacgcagcttgcatttatgaggctgcttgccaattacgcatcccagaacatcacttaccattgtaaaaactcgattgcgtacatggatgaagaaacggggaatctgaaaaaagccgtgatcctgcaagggtccaacgacgtggaactggtggcggaagggaacagccgtttcacgtacacggtccttgtcgatggctgctctaagaaaactaacgagtggggtaaaactatcattgaatacaagaccaataagccatcgagacttccatttcttgatatcgcgccactggacataggcggagcagaccaagaattctttgtggatattggtcctgtttgttttaag

SEQ ID NO: 32503 - DNA, 4098 bp, Artificial Sequence
  Description of Artificial Sequence: Synthetic coding sequence
atgctgtcattcgtggacaccagaactcttctgctgctcgctgtgaccttatgtctggccacttgccagagtcttcaggaagaaacagtaagaaaagggccggccggtgatcgcgggcccagaggcgagagaggacctccagggcctccagggcgggacggggaggacggtcctacgggaccacccggtcctccgggccccccaggtccaccaggcctgggggggaacttcgcggctcagtatgacgggaaaggagtgggactgggcccaggtcctatgggactcatgggcccccggggaccacctggagctgccggggctcctggcccacagggcttccaaggcccagctggcgaacccggagaaccagggcagaccggcccagccggtgcaaggggccctgctggtcccccaggcaaagcaggtgaggacgggcaccccggtaagcctggccgacctggggagagaggggttgtaggacctcaaggcgccagaggatttccaggtacacctggtctgccaggatttaagggaatacgaggccataacgggctggatggcctgaaaggccaacccggggctcccggggtgaaaggggagcccggggctcccggcgagaacggcacccccgggcagacaggagctcggggtctgcctggggagcggggacgagtcggagcacccggtcccgccggtgctagggggtctgatggttccgtggggcctgtgggccccgccggaccaataggctctgccgggccccctggtttccccggcgctccagggcccaagggagagatcggcgccgtcggcaacgccggtcccgctgggccggcgggtccaaggggtgaggtgggtctgcccgggctctcgggcccagtgggtccccctggcaaccccggcgccaacggacttacaggcgcgaaaggggccgcaggcctccccggagtggccggtgcacctggtctgcctgggcctaggggcattccaggacctgtgggagcagccggagcgactggtgctagagggttggtgggtgagccggggcccgctggcagtaagggagagagtggaaacaagggtgagccagggtccgccggaccgcagggtccacccgggcctagtggcgaggaagggaagagggggcctaatggggaagccgggtcagccgggcctcccgggcctccgggcctgagggggtcacctggctcccgcggacttcctggagccgacgggagagcgggggtcatggggccgccagggtcccgcggggcctccggtcctgcaggcgtcagaggccccaatggcgacgctggacgtcctggcgagcctggccttatgggcccacgaggacttcccggcagtcccggaaacatcggtcccgcgggaaaagagggtcctgtcggcctgccaggtattgatggaagacctgggccgatcggtcccgctggtgcacggggtgagcccggcaacatcggcttccccggccctaagggaccaacaggcgatcccggcaagaacggtgacaagggtcatgctggcctggctggggcccggggggcacctggcccagacgggaacaatggcgctcagggcccacccgggcctcaaggtgttcagggcggaaagggcgagcagggcccccccgggccccctgggttccaaggactaccagggcctagtggcccagccggcgaggtggggaaaccgggagaaaggggcttacatggtgaatttggtctccccgggcccgcggggccaaggggcgaaagaggccctcctggcgagagcggcgctgcagggcccaccggaccgattggctccagggggccctctggcccaccaggccccgacggaaataaaggcgaacccggggttgtgggagcagtgggtaccgctggaccttctggcccttctggcctgcccggtgagcggggcgctgctgggataccaggcggtaagggcgagaagggggagcctggactgcgtggagagattggaaatcccggtcgagacggtgctcgtggtgcacccggcgcggtcggcgcgcccggccctgctggtgcaactggggaccgaggcgaagctggcgccgcgggacccgctggccccgccggaccgagaggatcacctggcgagaggggagaggtcggacctgccggaccgaacgggtttgcaggaccagccggtgctgcgggccaacctggtgcaaagggggaacggggagcaaaaggccctaaaggagagaacggtgttgttggccccactggcccagtaggcgcagcaggcccggcgggacccaacggacccccagggccagccggctctcggggggatggagggccacccggaatgacggggtttccgggcgcagcggggagaactgggcctcctggtccctctgggattagtggccctcccggcccccccggacccgctggcaaggagggactacgaggaccacgtggagatcagggacccgttggacgcaccggcgaagtcggtgcggtcgggccccctgggtttgctggggagaaggggccctcaggggaggctggtacggcaggcccccccggaacgcctggcccgcagggcctcctgggagctcccggaatcctgggcctgcctggctccaggggagaaaggggccttccaggggtagccggagcagttggagagccaggaccactgggcatcgcaggacctcctggagctagagggcccccgggcgcagtgggaagccctggcgtgaatggcgcaccaggtgaggctgggagagatggtaatccgggtaacgacggtcccccaggtcgggatggacagcctggccataagggcgagcgtggctacccgggcaatattggacccgtgggagccgccggagcccctggtccccacggaccggtggggccagccgggaaacacggcaacagaggcgagaccggtcccagcgggcctgtcggtcccgctggagccgtgggtcccagaggacccagcgggcctcagggcataaggggtgacaagggggagcctggggagaaaggcccgaggggtttgccaggcctgaaaggacacaatggtctgcaaggcctcccaggaatagctggccatcatggtgaccagggagcccctggatctgttggacccgccggccctcggggaccagcagggccctcaggccctgccggtaaggacggtcgtactggccatccaggtaccgtggggcccgcaggcatccgaggcccacagggacaccagggaccggccggccctccgggcccccctggacctcctggcccccctggggtgtcaggtggcggatatgacttcggttatgacggggacttttaccgggctgaccagcctcgttccgctccctccctgcggcccaaggactacgaggtggatgcgactcttaaaagcttgaacaaccagatcgagactctgttgacccctgagggctccaggaaaaatccagccaggacatgcagagacttaaggctttctcatccggaatggagctcaggctactactggattgaccccaaccaggggtgcactatggatgccataaaagtgtactgcgattttagtaccggcgaaacctgcatcagggcccaaccagaaaacattcccgccaagaactggtatagaagtagtaaggataagaagcacgtgtggctcggcgaaaccattaacgcagggtcccagttcgagtacaacgtcgagggtgtgacaagcaaggaaatggctacacagctggcattcatgagattgttagccaattacgcctcacagaatataacatatcactgcaagaacagcatagcatacatggatgaagaaacaggcaaccttaaaaaggcagtgatcttacagggctccaacgacgtggagcttgtagctgaaggtaacagtcggtttacgtacacggtgcttgtcgacgggtgttcgaagaagacaaatgaatggggcaaaacgatcatagagtataaaaccaacaaacccagcagactgccatttctggacatagcccccttggacataggtggggcagaccaagagttcttcgtcgatattggacccgtgtgctttaag

SEQ ID NO: 32504 - DNA, 4098 bp, Artificial Sequence
  Description of Artificial Sequence: Synthetic coding sequence
atgcttagcttcgtggatactagaactctgttgctgctcgccgtgaccctctgtctcgcgacctgccaaagcctccaagaagaaaccgtgcggaaaggcccggcgggagatcggggccccaggggcgaacgcggaccgcctgggccaccggggagggatggcgaggacgggcccactggaccgcctggtccgccaggccccccgggcccccctgggctcggagggaattttgcagcgcagtacgacggaaagggggtgggactcgggccaggaccaatgggtctgatgggccctcgggggcctccgggggctgccggcgcccctggaccgcaggggttccagggtccagctggagagccaggagaaccaggtcagacgggcccggccggggcgcgcgggccagccggtcctcccggaaaggccggagaagatggtcacccgggaaaacccggccggcctggtgagaggggggttgtgggcccgcagggggcccgaggatttccgggcaccccaggtctgccaggattcaagggcattcgcgggcacaacggtctggacggccttaaggggcagccaggtgcaccgggagtgaaaggagaaccgggagcacctggcgaaaacgggaccccgggacagacgggcgccagaggacttccaggggagcggggacgggtgggagcaccggggcctgctggcgcccgcggttccgacggaagcgtgggaccggtaggacctgcaggcccgatcggaagcgcaggacccccgggatttcccggcgccccgggcccgaaaggtgagatcggagcggttggcaacgccggacccgcgggaccagccggccctcgcggcgaggtcggcctgccaggactgtcagggcctgtcggacctccggggaaccccggtgccaacggactgactggagcaaagggtgctgcggggcttccgggagtggctggggctcctggtctgcccggaccgcgtggaatacctggaccggttggagccgctggtgcaacgggtgcgcgaggcctcgtgggcgaacccggaccggcagggtcgaaaggagagtccggcaacaagggagagccagggtccgcgggaccacaaggtcccccggggccgtcaggagaagagggaaaaagaggaccaaacggcgaagcaggatccgccgggccgcccggtccgccgggtctgagaggttcaccgggttcgagaggactgccaggcgcagacgggcgggctggagtcatgggaccacctggtagccggggagcgtcgggtccagccggagtcagaggaccgaacggtgacgcggggaggcctggcgaacctgggcttatgggaccgagagggctgccgggctcaccgggcaacattggaccggctggaaaagaaggaccggtgggcctgcccggcatcgatggccggccaggaccgattggcccagcaggagcccggggggaaccgggcaatattggattcccgggaccgaagggacctaccggcgatccggggaagaacggggataaaggacatgccgggctggctggcgcgcgaggagcgccaggaccagacggaaataacggtgcccaaggtccgcctggaccccaaggcgtgcagggaggcaaaggcgagcagggaccgccaggtcctccagggttccaggggctgcctggtccgagcgggccagcgggtgaggtaggtaagccaggggaacgcggactccatggagagttcggactcccgggcccggcagggccacggggtgagcgcggtccacctggcgaatcaggcgccgctggaccgactggaccaatcggatcgcggggtccgtccggtccccccggtcctgacggaaacaaaggggaaccgggagtggttggggccgttggaaccgctggcccgtctggaccgagcggcttgccgggtgagagaggtgccgcgggaatcccaggaggaaagggagaaaaaggagagcccggactgcgcggtgagattgggaatcccggacgcgatggagcccgtggagctccaggggcggtgggagctcccgggccggcaggggccactggcgaccggggcgaggccggcgcggccggacctgcaggaccggcggggcctcggggcagccccggcgaacgcggtgaggtcggacccgccggccctaatggcttcgcaggaccggccggggctgctggccaaccaggggcgaagggagaacgcggagccaagggccccaagggagagaacggcgtcgttgggcctaccggacctgtgggcgctgctggccccgcagggccaaatggacccccaggcccagcggggtcgcgaggagacggcggtcctccggggatgaccggattcccaggtgccgccgggcgcaccggcccgccaggaccttcgggaatctcgggaccgccggggcctcctggccctgcagggaaggaaggcctccgcggtccgagaggagatcagggcccagtcggccgcactggtgaagtgggagcagtgggtcctcctggattcgccggcgagaaaggtccttcaggagaagctggtactgctgggcccccgggaaccccaggaccccaaggtcttttgggcgctcctggtatcctcgggctgcctggctcgagaggggaaaggggactgccgggagtggccggtgctgtgggcgagccgggaccactcggcatcgcgggcccgccgggagcaagaggaccccccggcgctgtgggatccccaggcgtgaatggagcgccaggcgaggcgggacgcgacgggaacccaggtaacgacggacccccgggtcgggacggtcagcctggacacaagggcgaacggggttacccaggaaatatcggaccggtgggagcagctggggcgccgggtccccacgggccagtggggccggccggaaaacacggcaacagaggcgaaaccggcccgtcggggccagtcggccctgcaggcgccgtcggaccgcggggacctagtggtccgcaaggcatccgcggggataagggtgaaccaggggaaaaggggcctcgtggacttccggggttgaaaggccacaatggtctgcaggggctccccggcatcgctggacatcatggggaccagggagccccaggatccgtcggcccagcgggaccaaggggaccggcaggacctagcggtcccgcaggaaaggatggaagaacgggacacccgggtaccgtcggaccagcaggtatccgcggcccacagggccaccaaggacctgcggggccgccggggccgcccgggcctcccggaccgccaggagtgtcaggcggtgggtacgacttcggatacgacggagacttctaccgcgccgatcagccgcggtccgccccaagcctccgcccaaaggactacgaagtcgacgccaccctgaagtcactgaacaaccagatcgagactctgctgactcctgaagggtcacgcaagaatccagcccggacttgccgcgacttgcgcctgtcccatccagaatggtcctcgggatactactggattgacccgaatcagggatgcaccatggatgcgatcaaggtgtattgtgatttctcgactggagaaacgtgcatccgtgcccaacccgagaacattccagctaagaactggtacagaagctctaaggacaagaagcacgtctggctgggagaaactatcaacgcaggatcacagttcgagtataatgtggaaggagtgaccagcaaggaaatggccactcagctcgcgttcatgaggctcctggcaaactacgcctcgcagaacatcacctaccattgcaagaactcgatcgcctacatggacgaggagactggtaatctgaaaaaggcggtcatcctgcaaggctcgaatgacgtcgagctggtggcagaaggaaactctcgcttcacctacaccgtacttgtggacggctgttccaagaaaactaatgaatggggcaagaccatcatcgagtacaagactaataagccgtcccgattgccgtttctggacatcgcaccactggatatcggaggagcagatcaagagtttttcgtggatatcgggccggtgtgctttaag

SEQ ID NO: 32505 - DNA, 4098 bp, Artificial Sequence
  Description of Artificial Sequence: Synthetic coding sequence
atgttgtcatttgtggacacaagaactctgctgctgctggcggtgaccctttgcctggcaacttgccaaagcctgcaggaagagaccgtgcgcaaagggccagctggggataggggccctagaggtgaaaggggccccccaggccctccgggaagagatggcgaggacggacctactggaccacctggaccaccaggacctcctggacccccagggctggggggcaatttcgccgctcagtatgatggaaagggggtgggcctggggccaggtcccatgggactgatggggccccgaggccctccgggagccgcaggcgcaccagggccccagggcttccaggggccagcaggggaacctggagagcctggacagactgggcccgccggtgctcgaggtcctgccggtccccctggtaaagccggagaagacgggcacccgggaaaacccggccggccgggcgaacgcggtgtggtcggccctcagggagctcgaggattccctggcactcctgggctgccagggttcaagggaattaggggccacaacggcttggacggcttgaagggacaaccgggggctccaggggtgaagggagaaccaggtgctcccggtgagaatgggacgcccggccagacgggcgcccggggactgcctggagagcgcgggagggtaggtgcccctggtccagcaggcgctcgaggctctgacggatccgtcggacccgtgggccccgccggaccaattggatccgctgggccccccggcttcccgggagctccaggacctaagggagagattggagctgttggaaacgcaggccctgcgggacccgcaggccccagaggcgaggttggactgccaggcctgtccggacccgtagggccacctggaaatcctggcgccaacggcctcacaggagctaaaggagccgctgggcttccgggggtcgcgggtgcacccgggctccccgggcccagaggcatcccgggtcccgtgggagccgctggcgctacaggggcgcgggggcttgtcggcgagccgggtcctgccggatccaagggtgaaagtggcaacaagggcgagccaggcagtgcgggtccacaagggcctccgggaccatctggggaagaggggaagagaggacccaacggggaggctggcagcgctggaccaccagggccgcctggcctgcgaggaagccccggttctcgcgggttgccaggcgctgacggcagagccggggtcatggggcctccaggatccagaggcgccagtggacctgcaggagtaagagggccaaatggcgacgcaggacggccaggcgaaccgggactgatggggccaagggggttgcctggtagtccagggaatattggaccagcagggaaggaaggccctgtgggtctcccgggaattgatggacggcccggacccattggtcccgctggggcccgaggagagcctggcaatataggattccctggccccaaaggacccaccggagatcccggcaaaaatggcgacaaagggcatgctggactcgccggtgcacgcggcgcaccgggcccagacggcaacaacggcgcccagggccccccaggcccacagggggtccagggcggaaaaggcgagcagggcccccccggccctcctgggtttcagggattgccgggccccagtggccctgccggcgaagtgggcaagcctggtgaacgggggctccacggtgagtttgggttgccagggcccgcagggccaaggggagaacgggggccacctggtgaatccggagcagctgggcccaccggccccattggcagtcgggggccatccggtccccctggaccggatggtaataagggcgagcccggggtagtaggagcagttggcacagctggcccatcaggcccttccgggttgcctggcgaaaggggggccgccggcatccctggtggcaagggggagaaaggggagccagggctgaggggcgagataggcaacccaggtcgggatggtgcccggggtgcaccaggggcggtcggggctccaggacctgcaggggccactggggatagaggggaagccggcgctgcgggcccagccggtcccgccgggcctcgggggagcccaggggagagaggcgaagttgggcccgcagggcccaatggatttgcaggaccggccggagccgccggacagccgggggcaaaaggagaacgaggtgctaaaggccctaagggagagaacggtgtcgtgggcccaaccgggccagtgggcgccgctggaccggccgggcctaatggcccgcccggccctgcgggatcccgaggtgacggtgggccccctggcatgactggatttcctggcgcagccggccgcacggggcccccgggaccttctggtattagcgggcctcctggtccccccggcccggcaggcaaagagggactccggggcccgaggggtgatcaggggcctgttggtaggactggcgaagtaggcgcggtgggaccacccggattcgctggtgagaaggggcccagtggagaggcggggaccgcggggccccctggaacgccaggaccacagggactgcttggcgcccctggcatactgggtttgccaggaagccgcggtgagaggggtctgccaggggtggcgggcgccgtgggagaacctggccccttgggaatcgcaggcccccccggagcccggggtccaccaggggctgtgggctcccccggcgtgaacggcgcgccaggggaggccggtagggacgggaatccaggcaacgatgggccgcccgggagagatggccagcccgggcacaaaggcgagaggggctaccccggtaacatcggacctgtgggcgctgccggcgctccaggacctcacgggcctgtgggacccgccggaaaacacggcaacaggggggaaacaggccctagtggacctgtgggcccggccggcgcagttggccctaggggcccctcaggaccccagggtataagaggagataagggcgagcctggagaaaaagggccccgcgggcttccaggtcttaaggggcataatggcctccagggcctgccaggtattgctgggcaccacggagaccagggcgcccccggtagtgttgggcccgccggacctagggggccagccgggccttcagggcctgccggtaaagacgggcggacagggcaccccggcacagtggggccggccggcatccggggaccgcagggtcaccagggtcctgccggtccccccgggcctccgggacccccaggacctccgggcgtgtccgggggcggttatgactttggctacgacggagatttttaccgggccgatcagcccagaagcgctccttctcttcgacctaaagactacgaggtggacgccacactcaagagcctgaataatcaaatagaaactctgttgactccagagggatctaggaagaacccagcccgcacttgccgcgacctgcggctgagtcacccagaatggagtagtggatactattggatcgatcccaatcaggggtgcacaatggatgctatcaaggtctattgtgattttagtaccggtgagacgtgtattcgggcccaaccggagaacattccagccaaaaattggtaccgctcctccaaggacaagaaacacgtgtggttgggggaaaccatcaacgccggatcccagtttgagtacaacgtcgaaggagtaactagcaaggagatggctacacagcttgcattcatgaggctgttggcgaattatgcaagccagaatataacctatcactgcaaaaactccattgcatacatggacgaagaaaccgggaaccttaaaaaagccgtgatcttgcaaggaagtaacgacgtcgagctggtcgccgagggcaacagccgctttacctacacagtcttggttgatgggtgctctaaaaagacaaatgaatggggaaagacgatcatagagtacaagaccaataagccgagtaggctgccatttctcgatatcgcacctctggatatcggaggggccgaccaagagtttttcgtggatattggtccagtatgcttcaaa

SEQ ID NO: 32506 - DNA, 4098 bp, Artificial Sequence
  Description of Artificial Sequence: Synthetic coding sequence
atgctctcttttgttgacacccgcactctcctcctcttggccgtaaccctatgcctggcaacctgccagagtctgcaggaggagactgtgcggaaaggcccggccggtgaccggggcccgcgcggtgagcgggggccacccgggccacccggacgcgatggcgaggatggccccacagggcccccgggtccacctgggccacctggtccgcccgggctgggtggaaattttgctgcccaatacgacggcaagggagtcgggttaggccccggccccatggggcttatggggcctcgcggtcccccgggggccgccggagcaccagggcctcagggtttccagggccccgccggggaaccgggtgaaccggggcagacgggccccgccggcgcccgaggccctgctgggcctcctggtaaggcgggtgaggacgggcaccctggtaagcccggacggcccggggaaagaggggtggttggtccccagggggccaggggcttcccgggtacgcccggtctgcccggcttcaagggcattcggggacacaatggtctggacggactgaaaggccagcctggcgcccccggggtaaaaggagaacctggggcgccaggggagaatggcacccccggtcagacgggagcgcggggcctgccaggcgaaagaggaagggtcggcgctccaggaccagctggtgcccggggctccgatggatcggtgggacctgtgggaccggctggtccgattggtagtgccgggccccctgggtttccaggcgcaccgggacctaagggcgaaataggcgccgtgggaaacgccggccccgctgggcctgctggacctagaggtgaggtgggactgcctggcctatccggccccgtcgggcctcccggtaatcccggggcgaatggcttaaccggagctaaaggtgccgccggcttgcccggcgtcgccggcgcacccggcttacctggccctagaggaatcccaggtcctgtgggggcggcgggcgccactggagctcgggggctggttggagagccagggccggctggctccaaaggggagagcggcaacaagggcgagcccggaagcgccgggcctcagggaccgcccgggccctctggcgaggaaggaaagcgcggacctaacggggaggccggcagcgccggccccccgggaccccccgggctgagaggcagcccaggatctcgcggactgccaggggccgatggaagggcgggcgtgatgggacctcctggcagcaggggcgcaagcggcccagccggcgttcgggggcctaatggggacgcaggaagacctggtgaacctggtctgatgggcccgagagggctcccgggctcgccagggaatatcgggcccgccgggaaggagggtcctgtggggctgccgggtatcgatggtcggccaggtcccattggcccagccggcgccagaggagagcccggaaatatcggcttccccggcccgaaggggcccacgggtgatccaggaaaaaatggcgataagggccacgccggactggccggagcgcggggcgcccctggcccagatggcaataacggggcgcagggtcccccaggtcctcagggcgtgcaaggcggcaagggggagcaaggcccccctggtcctccaggcttccagggcttgcctggcccaagcggtcccgcgggagaagtcgggaaacccggggagcgcggtttgcacggtgagtttggactgccaggacccgccggtccccggggagagcgcggcccaccgggggagtccggcgctgctggcccgacaggcccaataggtagcaggggacccagcggcccgcccggccctgacggcaacaagggggagcctggagttgttggagcggtcggtacggcaggccctagtggtccaagtgggctcccgggagagcgtggagctgcaggcattcctggagggaaaggcgaaaaaggtgagcctggattgcgcggcgaaattgggaatccaggtcgggacggtgcccgtggggccccaggagctgtcggtgcgcccggacccgcaggggctacaggtgatcggggggaagcaggcgcggcagggccagccgggcctgccggccccagaggaagtccgggcgagcgtggggaggtgggaccggctggtccgaacgggtttgccggccctgccggtgctgccggccagccgggcgccaaaggcgagcgaggcgccaaggggcctaaaggcgaaaatggcgtcgtgggcccaaccgggccggtcggggcggctggacctgccgggcctaacggacccccaggccccgcagggtctcggggcgacggaggacctccaggcatgacgggtttcccgggcgccgcgggcaggaccgggccacccggcccttctggcatttctggcccccccgggccacccggacccgctggcaaggaaggcctaaggggccctaggggggatcagggtcccgttggtcgaactggcgaagtgggggctgtcggaccaccaggctttgccggagaaaagggcccctccggagaggcgggaactgccggcccgcccgggactcctgggccccagggtcttctgggtgcaccagggatcctggggttacctgggtcccgcggcgagagaggattaccaggggtggccggcgcagtgggtgagccgggtccgcttggtattgcgggcccacctggcgctcgcggaccaccaggggctgtgggaagccctggggttaatggcgcccccggtgaagccgggcgcgacggtaatcccggtaacgacgggccccccggccgtgacggccagccagggcacaagggtgagagagggtaccccggcaacatcgggcccgtaggcgcagcgggagcccctggcccacatggaccagttggacccgccggcaagcacggaaatcggggggaaaccgggccttcaggcccggtggggccagcaggggcagttgggccgagaggaccgagcggacctcagggtatacggggggacaagggagaacctggtgaaaaggggccccgaggacttcccggcctgaaagggcataatggactccagggccttccaggaattgctggccatcatggagatcagggggcccccggcagtgtgggtcccgccggaccccgggggccagctgggccctctggccctgcgggcaaggacgggaggaccggccatccaggtaccgttggacctgcaggtattagagggccacagggtcatcaaggacccgccggaccccccgggccaccagggcccccggggccacctggcgtcagcggaggaggttacgacttcggttatgatggcgacttctatcgggccgaccagcctcggagcgcccccagcctgcgtcccaaggattacgaggtggatgcaactctcaagtcgctcaataatcagatcgaaaccctcttgacaccagagggctcccgtaagaatcccgccaggacgtgccgtgatctgaggctgagccaccctgaatggagtagtggctactactggatcgatcctaatcagggatgcaccatggatgccatcaaggtttactgtgatttctccacaggtgaaacatgcatccgggcacagccagagaacattccggccaagaattggtaccggagctctaaggacaagaaacacgtgtggctcggagaaacgatcaatgcaggttcacagtttgagtacaacgtagagggagttacttcaaaagagatggccactcaactggccttcatgagactgctagcaaattacgcctcacagaacattacgtatcactgcaagaacagcatcgcatacatggatgaggaaacgggtaatttgaagaaagccgtcatcctccaggggtctaacgatgtggagctggtggctgagggcaacagtcgattcacttacactgtcctggtcgatggttgctcgaagaagactaatgagtggggcaagactataatcgagtacaagacaaataagccaagtcgacttcccttccttgatatagcacctctggacataggcggagctgaccaggagtttttcgtggacatcgggcctgtctgcttcaaa

SEQ ID NO: 32507 - DNA, 4098 bp, Artificial Sequence
  Description of Artificial Sequence: Synthetic coding sequence
atgctttccttcgtggatactagaactctcctccttcttgccgttaccctctgcctggccacttgtcagtctttgcaagaggaaaccgtgaggaaggggcccgcaggggatcgtgggcctagaggggagcgcggtccccccggcccacccgggagagacggcgaagatgggccgaccggcccccctggaccacccgggcccccaggccctcccggtctgggtggtaactttgcagcacagtacgacggaaagggggtgggtcttggacctggacctatgggcctgatggggccaaggggacctcctggtgccgccggggcgcctggccctcagggatttcagggccccgccggtgaaccaggtgagcctggacaaaccggaccagctggagccagaggtcctgcggggccacccgggaaagcgggagaggacgggcatcccggtaaacctggtcgtccgggagaacgcggagtggtgggcccccagggtgcacgcggtttcccaggaaccccagggctccctggttttaagggtattcgtggtcacaacggtcttgacggacttaaaggacaacctggagcaccgggagtgaaaggggaacccggggccccaggcgagaatggtactcctggacaaactggcgcgagaggactccctggcgagcgtggcagagtgggtgcacctgggccagcaggcgcacgcggttcggatggatcggtcggaccagtcggaccggctggtcctataggatcggcaggtccacctggattccccggggcacccgggcctaaaggggaaataggtgcagtaggtaacgcaggcccagcgggccctgccggccctagaggcgaagtcggactgccaggattgtctgggcccgtgggacccccgggaaaccctggtgctaacggccttactggtgcaaagggcgcggctgggctgcctggcgtggcaggcgcccccggtctgcctggtcctaggggcattccaggtcctgtgggtgcagctggcgcaactggtgcacgcggccttgtgggagagcctggaccggcaggatccaaaggagaaagcggcaataaaggcgaacctggctcagcagggcctcaaggacctcccgggcctagcggggaagagggtaagagagggccaaacggtgaggcaggctcagcgggaccacctggaccaccgggactgaggggtagccctggaagcaggggtttgcctggtgccgacggtagggctggggttatgggtcccccgggttcaagaggggcatcgggtcctgccggagtccggggacctaacggagatgcaggcagacctggagaaccagggcttatgggccctcgcgggttgcctgggagcccaggtaacattggaccagccggcaaagagggtcctgtgggactcccgggaattgatggcaggccaggccctatcggtccggccggagctcgcggcgaaccgggcaacataggatttccaggaccaaaaggacccactggtgatcctggtaagaacggggacaaggggcatgcaggacttgccggcgcccgaggcgcacctggccctgatggtaataacggggcccaaggccctcctggtccacaaggagtacagggaggtaagggcgagcagggccctccaggaccaccggggttccaaggccttccaggtccatcaggtcccgctggagaagtcgggaagcctggagagcgcgggctgcacggtgagtttggactgcctggacccgcaggcccgcgcggtgaacgaggtcctccaggagaatcgggggcggctgggcctaccggtccaattggttcccgtgggccctccggaccccccggaccagacggcaacaagggagagccaggtgtggtgggagcagtgggtaccgcaggtccatccggacccagcggattgccaggagagcgcggtgcagctggaatcccgggagggaagggcgaaaaaggagagcctgggcttagaggagaaatcggcaatcccggaagagatggcgcacggggggcgcccggcgcggtgggcgctccagggcctgcgggggcaaccggcgacagaggagaagcaggtgccgcaggtcctgctggtcccgccggtccaaggggctcgccaggtgaacgcggtgaagtggggccagcagggcccaatggatttgccggtccggcaggtgcggcaggtcaaccgggggccaagggcgaacggggggcaaaggggcccaagggtgaaaacggggtggtcggacctaccggcccagtcggagccgcgggtcctgcaggtccaaacggccctccggggcccgccggttcgcgtggagacggcgggccgccaggtatgaccggatttccaggtgccgcgggcagaaccggacctcctggaccatcaggaatcagcgggccacctggtccaccaggaccagctggtaaggaaggtctgcgggggccacgaggggaccaaggtcctgtcgggcggactggcgaagttggtgcagtcgggcctccaggttttgcaggagaaaaaggcccatccggtgaggctggaaccgctggtccgcctggcaccccaggaccacaggggcttctcggcgcacctggaatcctggggctgcccggatccagaggtgaaaggggacttccaggcgttgctggcgctgttggagagcctggccctctcggaatcgcaggtccgcccggagctcggggtccgcctggtgcagtgggaagcccaggcgtgaatggtgcaccgggcgaagcagggcgggatggaaatccaggaaacgatgggcctccagggagagacggtcaacctggccacaagggtgaaagaggataccccggtaacatcggtcctgtaggggcggccggcgcgccaggcccgcacggacccgtgggtccagctggaaaacacggaaaccgaggagaaactggcccttcgggtccagtcggacccgcaggagcggtgggtccccgcggtccatcgggaccgcaaggaatccggggtgacaagggggaaccaggagaaaagggcccccggggcctgccggggctcaaggggcataatggtctgcaaggactgccgggaatcgccggtcatcatggcgatcagggagcacctggttccgtggggcctgcagggccgagaggcccggcagggccttctggcccagcaggaaaagacggacggaccggtcatccaggaacggttggacccgccggaattagggggccacagggacatcaagggccggcgggacctcccggaccccctggaccgcctggtccccctggagtgagcggaggagggtacgattttggttacgatggcgatttctatcgagcagatcaacctaggagtgcaccttcattgcgtccaaaggactatgaggtcgacgcaactttgaagtcactcaacaatcaaattgaaaccctgcttactcccgagggatctcgcaagaacccagcccgaacttgtcgtgatctgagactttcccacccggaatggtcgagcggatactactggatagatcctaatcagggttgcacgatggatgcaattaaggtctactgcgatttctccaccggcgaaacgtgcattcgcgcacagcctgaaaacattccagcaaagaattggtaccggtccagcaaggataagaaacacgtctggctgggcgaaaccataaacgcaggctcccagtttgagtacaatgtggaaggtgtgacctcaaaggaaatggccacccagcttgcatttatgagacttcttgcgaattacgcatcccaaaacattacttaccattgcaagaactcgattgcatacatggatgaggaaactggtaaccttaagaaggccgtcatcctccagggttcgaatgacgtggagctcgtggccgagggtaactcgcggttcacctacacggtgctcgtggacggatgttctaaaaagactaatgaatggggaaagacgatcattgaatacaagacgaacaagccatcccgactgccttttcttgatatcgcgcctctcgatattggaggggccgatcaagaattctttgtcgatattggacctgtgtgtttcaaa

SEQ ID NO: 32508 - DNA, 4098 bp, Artificial Sequence
  Description of Artificial Sequence: Synthetic coding sequence
atgctgtctttcgtggatacccgaacgctgttgctactagccgtgaccctgtgtctcgccacgtgtcaatctttgcaggaggagaccgtgcgcaaagggccagccggagaccggggcccacgcggcgagagggggcctcctggacctccgggccgcgacggagaagatggacctacaggccctccgggcccacctgggccacctggaccacctggccttggaggcaatttcgccgcacagtacgacggcaagggcgttgggctgggtccaggccctatgggtttgatgggccctcgggggccgcctggtgcagcaggagctccgggccctcagggctttcagggcccagcaggcgagccaggtgagccggggcagacaggtccagccggggctcgaggcccagctggcccccctggcaaggcgggggaggatggacaccccggtaagccgggccgaccaggcgagcggggcgtggtggggcctcagggagctcgtggctttcctgggacacccgggcttccagggtttaagggcattagggggcataatgggctcgacgggttgaaaggacagccaggagcacccggcgtgaagggtgagccaggagcgcccggggaaaacggcacacccggtcaaactggagcacgcgggctgccaggtgagcggggccgcgtgggggcccctggccctgcaggtgctcgaggaagcgatgggtccgttgggcccgtcggtccagctgggccaattggtagtgcgggcccccctggatttcctggggcgcctggacctaaaggagagatcggggccgtgggtaacgcaggtcctgccggccccgccggacctcggggagaggtgggtttgcccgggttaagtgggcctgtgggcccacctgggaatccgggggctaatgggctgactggcgcaaagggcgcggcaggcctcccgggcgtggctggagctccaggcctacctggcccaagaggtatcccaggaccagtcggcgctgctggagcaacaggtgccaggggattggtgggcgaaccgggtccggcagggagtaagggggagtccggcaacaaaggcgagcctggtagcgccggacctcaggggccacctggcccctcaggagaggagggcaagcgaggtccaaatggagaggccggtagcgcaggccccccaggccctccagggcttcggggatcaccaggttcaagaggtctgccgggagcggacgggagagcgggagtgatgggtcctccagggagcaggggcgccagcggccctgcaggcgtgagggggcctaacggggatgcgggccgcccgggtgaacctggactgatggggcctagaggcctccccggatcacccggtaacattgggcccgctggaaaagagggtcccgtaggacttcccggcatagatggcagacccggcccaattgggccggccggagccaggggggagcctgggaatatcggtttccctggaccaaaaggccctaccggcgatccaggaaagaacggggataaaggtcacgccggcctcgccggtgcgcgtggcgctcccggtcctgatggcaataacggtgctcagggtccccctggacctcagggagtccagggcggaaagggcgagcagggcccccctgggccccctggttttcagggcctgccaggaccaagcggacccgccggggaggtgggcaaacccggggaaagagggcttcacggggagttcgggctgccaggacccgccggcccaagaggggagagaggcccgcccggcgaaagcggtgcagccggaccaactggacccatcggcagcagagggccatcaggtccaccgggccctgacgggaataaaggagaaccaggcgtggtgggagctgtcggcactgcgggaccctcaggacccagtggcttgcccggtgaacggggagccgcgggaattcccgggggaaagggtgaaaagggcgaacctggtctgcgtggggaaatcggcaatccagggcgcgatggcgcccgcggagccccaggcgcagtaggtgcccctggaccagcaggggctaccggagacaggggtgaggccggtgcagccggccccgccggtcccgcggggccccgaggcagcccaggagagcgaggggaagtgggaccggccggccccaatggatttgctggacccgctggcgctgcaggacagccaggcgccaagggagaaaggggcgccaaggggcctaagggcgaaaacggagtcgtgggtccaaccgggccagtaggagccgccggacctgccggccccaatgggccgccaggacccgccggatctagaggtgatggaggtccccctggcatgactgggtttccaggcgctgcgggtcgtacaggacctcccggccccagcggcatctcagggccaccggggcccccggggcctgctggaaaggagggcttgcgaggtcctagaggagaccaaggtcccgtgggtaggaccggggaggtcggcgccgtgggccccccgggctttgctggagaaaaggggcccagcggcgaagccggaacagcgggtccccctggaactcccggaccgcaggggctcctcggcgccccaggtattctcgggttgccggggtcgcggggtgagagggggcttccgggcgttgcgggagccgtcggcgaacccggaccactcggcatcgctggcccccccggagctcggggcccacccggggccgtcggatcacccggagtcaacggcgcccccggcgaggccggaagggacgggaatccaggtaatgatgggccaccaggccgggacggccagcccgggcataaaggcgagcgaggctatccagggaatatcgggcctgtgggggccgctggcgcccctggcccccacggccccgtgggccctgccggtaaacacgggaatagaggcgaaaccggaccgtcaggcccagtgggccccgctggtgcagtcggaccacgagggccttccggaccccaagggattagaggggacaagggggaaccaggagagaaggggccgcgcggactgcccggattaaaggggcataatggcctgcagggcctgcctggcattgccggacatcacggggatcagggagcgccggggagcgtcggaccagcaggccctcgggggcccgccggacccagcgggccagctggcaaggatggccgcaccggacacccaggaaccgtgggcccagctggcatacgaggcccacagggtcatcagggtcctgctggcccgccaggcccacctggtccccccggccccccgggagtgagcggagggggatatgattttgggtacgatggcgacttttatcgggccgaccagccacgctctgctcccagcctccgcccaaaggattacgaggtggatgccaccctgaaatcccttaataatcagattgaaaccctgctgactcctgagggctcccggaagaatcccgctcgaacctgccgggacctccggctgtctcatccggaatggagttcaggctattactggatcgatccgaatcaggggtgtacaatggatgctattaaggtatattgtgacttttcaacaggcgaaacttgtatcagagctcagcccgagaatataccagccaagaactggtacagatcttcaaaggataagaaacacgtttggctaggggagaccatcaacgcaggatctcaattcgaatataatgttgagggtgtcacctcaaaggagatggctactcagctggcctttatgaggctgctggcaaactatgcttctcaaaatattacgtatcattgcaagaactcaattgcttacatggatgaggaaacaggtaacctcaagaaagccgtcatactacaggggagtaacgatgtcgagttggtcgctgagggtaattcccggttcacttatacggtcctggtggacgggtgttctaagaaaacaaacgaatgggggaagacaattatcgagtacaagacaaataagccatccaggctcccgtttctggatatagcgcccctcgacatcggcggtgcagatcaggagttcttcgtggatattggacctgtctgcttcaaa

SEQ ID NO: 32509 - DNA, 4098 bp, Artificial Sequence
  Description of Artificial Sequence: Synthetic coding sequence
atgctaagcttcgtcgatacaaggacgctcctcctgctggccgtaacactctgcttggctacatgccagtcactgcaagaggagacagttcgaaaagggcctgctggcgatcgggggcccaggggggaaagaggccctccgggcccaccaggccgggacggtgaagacggtccaaccggccccccgggtccgcctggcccacctggtccgccagggctgggcggtaacttcgccgcacagtatgatggaaaaggtgtcgggcttgggcccggccccatggggctgatgggtcctaggggcccgccgggagctgccggcgcccccggaccacagggcttccaggggcccgctggggagcccggcgagccaggccaaactgggccagctggggcgagaggacctgccggcccgcctggcaaggccggagaggacgggcaccccggaaaaccaggccggccaggagaacgtggggtcgtgggtccgcagggtgcacggggattccccggaaccccaggacttcccggtttcaaaggaatccgtgggcacaatggtctcgatggcctaaaggggcaacctggcgctcccggcgtgaaaggagagcctggggctcctggggaaaacggaactccggggcagacgggcgctcggggcttgcccggcgaacgcggcagggtcggcgcccccggacccgcaggagccaggggctccgacgggagtgtcgggccagtcgggcccgccggacccattggaagcgctggccccccaggcttcccaggcgcacctggacctaagggcgagattggcgctgtgggaaacgccggacctgctggacctgcaggaccccgcggcgaggtgggcctgccaggactgtcggggcccgtgggcccccctggcaatccaggagcaaatggtctaaccggggccaagggagcagctggattgcccggagtggcaggtgcccccggacttcccggtccgcggggaataccagggcccgtgggcgccgctggtgccactggggctcgaggtctcgtaggtgagcccgggccggccggaagcaaaggagaatccggaaataagggtgaacctggatctgcaggccctcagggccctcctggtccatcaggggaggaagggaaacggggcccgaatggagaagcaggcagcgcgggaccccccggaccccccggattgcggggcagccctggctcacgaggattgccaggtgctgacggcagagcgggagtaatgggacccccaggtagccgcggtgcatccggccctgccggagtcaggggccctaacggagatgccggccgccctggcgagcctggactgatgggcccccggggtttgcccgggagcccaggaaacatcggaccggccgggaaagaagggcccgttggactgccgggaatagacggtcgcccaggcccaattgggcccgctggagcccggggagaacccggcaacattgggttcccgggacccaaggggcctaccggtgatcctggcaagaatggagacaaggggcatgcgggactggcaggcgctaggggagcgcctggccctgatgggaataatggtgcgcaaggaccaccaggaccccagggggtgcagggagggaagggcgaacagggacctcccggcccaccaggctttcagggcctgcccgggccgagtggacctgcgggagaagtgggcaagcctggtgagcgggggctgcacggagaattcggactccccgggcccgctggccctagaggcgagagggggccccccggggaaagcggtgcggctggccctaccggcccaatcgggtcacgcgggccaagtggcccgccaggccctgacgggaataagggagagcccggggtggtgggggcagtgggaacagccggaccatcaggcccgtcaggcctgccgggcgagcgaggagcagccggaataccagggggcaaaggagaaaaaggtgaacccggcttgagaggagaaatcggcaatccagggagagacggcgcgcgaggcgcacccggcgctgtcggagcccctggacctgcgggagccaccggtgaccggggagaagccggtgctgcgggccctgcaggtccagctggcccccgtggcagccctggagagaggggcgaggtcgggcccgccggacctaacgggtttgcaggacctgccggcgctgcaggtcagcccggagctaaaggggaaaggggtgccaagggtcccaagggtgagaacggcgtcgttggtcccacaggccctgttggtgctgccgggccggcgggccctaatggtcctcccgggcccgctggaagccgaggggacggaggaccaccagggatgacgggcttcccaggcgccgccggacgtactggcccccccggcccctcgggcatttctggaccacctggccccccggggcccgctggaaaggaagggcttcgcggaccgcgtggggatcagggaccggtgggtaggacgggggaagtcggcgcagtgggtcccccgggcttcgccggtgagaaggggccaagcggcgaagccggaactgcggggcccccaggaacgccaggccctcaggggctgttaggtgcgcccgggatcctcgggctcccaggttcgaggggcgagcgcggcttacctggcgtcgcaggggctgtgggagagccgggacctctaggcatagccggcccccctggcgcccggggtcccccgggtgcagtcgggtccccaggcgtcaatggggcaccaggcgaggctgggagagatggcaacccagggaatgacggcccacccggacgggatgggcaacccggtcacaaaggagagagaggctatcccggaaatatcggacccgtgggagcagcaggcgcccctggcccgcacggtcctgtaggccctgccggcaaacatggcaaccgtggggaaacaggcccaagtggcccggttggcccagcgggagccgttggcccccgcggaccaagcgggccgcagggaattcgcggggataagggggagcccggagaaaagggacctcgcggcctgcccggtctgaaaggccacaacggccttcaggggctgcctggcatcgcaggacaccatggggaccaaggggcacctggaagcgtcgggccagccggcccccgaggacccgcagggccttctggtccagctggaaaggatggcagaactgggcacccagggaccgtggggcctgcgggaatcagaggaccacagggtcatcagggacctgcaggcccccctggaccaccagggccgcctggcccccctggagttagcggtggcggctacgacttcggctatgatggggacttctacagagcagaccagcctaggtctgcaccatcattacgaccaaaggattatgaggtggatgccaccctgaaatcactgaataatcagattgagacgctgttgaccccggaaggatcccgcaaaaaccccgctcgtacttgccgggatcttcggttgtcacaccccgaatggagctcaggatattactggatcgaccctaatcagggctgtactatggacgcaataaaagtctactgcgactttagcactggggaaacctgcatcagagcccagcccgaaaacattccagccaaaaactggtaccgttcttccaaggataagaaacacgtgtggttgggggagaccataaacgccgggagtcagtttgaatataacgtagagggggtgacgtccaaggaaatggccacccagctcgcgtttatgagacttctggccaattatgcttctcagaacatcacttatcactgcaaaaatagcattgcatacatggatgaggagacaggaaacctgaaaaaagctgtgatactgcaagggtccaatgacgtggaactggtcgccgaaggtaactccagatttacatacacagttctagtggacggctgtagtaagaaaacgaatgagtgggggaaaacaataatcgagtacaagacaaataagccttcccggctcccatttttagatattgctccactggacattggcggagctgaccaggaatttttcgtggatatagggccggtgtgtttcaaa

SEQ ID NO: 32510 - DNA, 4098 bp, Artificial Sequence
  Description of Artificial Sequence: Synthetic coding sequence
atgctttcatttgtggatacccgtacgctcctgttacttgccgtgacattgtgcctcgctacctgccagtccttgcaagaggagactgtccggaagggccctgcgggagatagaggcccacggggggaacgcgggccaccgggtccgcctgggagggatggtgaagatggcccaaccggacccccagggcctcccggccccccaggcccacctggactgggcgggaacttcgcagcccagtacgatggtaagggcgttggcttgggaccaggcccgatgggtttaatggggcctcgaggtccccccggagctgctggggccccaggtcctcaggggttccaggggcccgcgggtgagcctggcgagcccggacagacggggcctgccggcgctcggggacctgctggtccccccggaaaagcaggtgaggacgggcatcccgggaagccgggacggccgggagagcggggtgtcgtgggcccacagggcgccagaggcttcccagggacccctggactcccggggttcaagggaatacggggccacaatgggctggacggcctgaagggccaacctggcgcgccaggagtaaagggggaacctggcgccccaggggagaacggaaccccaggccaaaccggcgcccgggggttgccaggagaacggggccgggtcggtgctcccgggccagccggggctagagggtctgatggcagtgtgggtcccgtgggaccagcgggtcctatcggtagcgcaggcccgcccggtttccctggggccccagggcccaaaggtgagataggcgctgtgggcaacgcaggtcccgccggccccgccggacctcggggggaagtgggcctgcccggcctctctggccccgtggggcctcccggcaaccctggagccaacggattgaccggagctaagggggccgccggcttgcccggagtagctggagcccccggccttccaggccccaggggtatacctggccctgtgggggctgcgggcgccacaggcgcccgaggcctggtgggcgagcctggaccggctgggagcaaaggtgaaagtggcaataagggagagcccggtagtgctggcccccagggccctcctggccccagcggtgaagaaggtaagcgcggcccaaacggcgaagccgggagcgccggcccacctggaccccccggactgcggggctcaccagggagccggggactccctggagcggatgggcgtgccggggtaatgggcccccctgggagtcgaggtgcgagtggacccgccggcgtccgggggcctaacggtgacgccgggcgaccaggggagccgggcctgatgggtccgcggggcctgccgggtagccctggcaacataggcccagcagggaaagaaggaccggttggattgcctgggattgatggccggcccggccccatcgggcccgcgggggctaggggagaaccgggaaacatcggctttccaggcccaaaagggccaactggagatcctggcaagaacggagataagggccatgcaggcctggccggcgctcgaggagccccgggaccagacggaaataatggggctcagggtccgcctgggccccagggagttcagggtggcaagggcgaacaggggccacccggacctcctggattccagggtctgcccggcccatccgggcctgcaggagaggtaggaaaaccaggtgagagaggactgcatggcgagttcggccttcccgggcccgcagggcctagaggcgagcgtggtccccctggcgaatcaggggcggccggtcccaccggtccaataggatctagaggcccgtctggccctccgggtccagatgggaataaaggagaaccaggagttgtcggagcagttgggaccgcaggccctagcggccctagcggcttgcccggggaacgtggggctgccggcattcctgggggtaaaggagagaagggtgaacccggattgcggggcgagatcggcaatcccggccgcgacggggcacggggcgccccgggggcagtcggagcccctggtcctgccggcgcgaccggggacagaggagaagcaggagccgccggtcccgccggtccagccgggccaagagggtcccctggcgaaaggggtgaagtggggccggccgggcctaacggattcgcgggaccagccggcgcagctggtcagcccggggctaaaggggagagaggagctaagggacctaaaggcgagaacggggtggtcggtccaaccggcccagtgggtgccgcaggaccagccgggcctaacggcccccccgggcctgccggaagcagaggtgacggcggccctcccggaatgacgggtttccctggggccgctggacgcacaggaccaccgggaccttctgggattagcggccctcccggccccccaggtcctgcagggaaggaaggacttcggggtccccggggagaccagggtcctgtcggcagaacaggagaagttggggccgtaggccccccagggttcgcaggtgaaaaagggccgagtggcgaggccggaaccgcagggccaccaggcacacctgggccacagggcctcttgggagccccaggcatcctgggtctgcccggatctagaggagagcgaggcctgcccggcgtggcgggagccgtcggtgagcccggcccactcggcattgctggaccacccggggccagggggcctcccggggccgtggggtctcccggtgtcaacggcgcccctggggaagcaggaagagacggcaaccctggaaatgatggccctcctggccgagacggacagcctggccacaagggggaaagaggctatcccggtaatatcggacccgtgggcgccgccggcgcccctggacctcatgggcccgtcgggcccgccgggaagcatggaaaccgcggagagaccggcccctccggaccagtgggcccagccggtgctgtcggccccagaggtccgagcggaccccagggaatacggggagacaagggagagcccggggaaaaggggcctcgtggcctcccaggattaaaaggccacaacggccttcaaggacttcctggcatcgccggacaccacggggaccagggagctcctggttcagttggcccagccggtccaagaggccccgctggaccaagcggacccgccgggaaggatgggaggaccggtcatcccggcaccgtggggccagcaggaatccgcgggccacagggccatcaaggccccgccggaccccctgggccgccaggtcctcccggccctcctggtgtttctggcggaggctatgattttggctatgacggggatttctaccgggccgaccaaccccgttccgcaccatccctccgtcctaaagattacgaggtcgatgcgacgctgaagagcctcaacaatcaaatcgagacgctgctcacacccgagggatcccgaaaaaatcccgctagaacttgccgtgatctgcgcctgagccaccccgaatggtcatccggttattattggatagaccctaaccagggttgcacaatggatgcgattaaggtatactgtgatttcagtaccggtgaaacctgtataagagcgcagccagaaaatatcccagccaaaaattggtaccggtcaagtaaagataagaaacatgtgtggctgggggagactattaatgcagggtcacagtttgaatataatgtggaaggagtgacgtcgaaggagatggctacccagcttgcattcatgcgtctgttggccaattatgcatcgcaaaacataacctaccactgcaaaaattccatcgcctacatggacgaggagacagggaatctgaaaaaggccgttatcctccaagggtcaaatgatgtggaattggtcgctgagggaaactcaagattcacttacactgtgcttgttgacggttgcagcaaaaagacaaatgagtggggcaagaccatcatcgagtacaaaactaataagccctcccgcctaccttttcttgacatcgcaccactagatatcggcggcgcggaccaagaattcttcgtggatatcggacccgtgtgcttcaaa

SEQ ID NO: 32511 - DNA, 4098 bp, Artificial Sequence
  Description of Artificial Sequence: Synthetic coding sequence
atgctgtcctttgtggacaccaggactctgttgctcctcgccgtcactctgtgcctcgccacctgtcaatcgctccaagaagagactgtgcgcaaggggcctgctggagatcgcggcccgcgcggggagcgcggccccccgggcccaccaggtcgcgatggcgaggacggaccaactggaccgccgggtccaccgggcccgccgggccctcctggactggggggtaatttcgcagctcaatacgatggaaaaggcgttggactcggacctggtccaatgggactgatgggaccgcggggaccacccggtgccgcaggagctccgggaccgcagggatttcagggacctgctggcgagccgggtgaaccaggccagacgggtccggccggtgcaagggggccggcgggtcctcccggaaaagcaggtgaggatggacatccgggcaagcccgggcgccccggagaacgcggagtggtgggacctcagggtgccaggggattcccgggaactccggggctgccaggcttcaagggtattcgaggacacaacggcctcgacggactgaagggacaacccggggccccgggcgtcaagggtgagccgggtgcgccgggagagaacggcaccccgggccaaaccggagctcgcggactgcccggggaacgcggccgggtcggagctccgggaccggccggagcacggggaagcgatggctcagtcggtccggtgggaccagccggaccaatcggatcggcagggccaccgggcttccccggggccccaggtccaaagggtgagattggtgcggtggggaacgccggccccgccggcccggcaggaccacggggagaggttggcctgcccggactctccggaccagtgggacctcccggtaacccgggagccaatgggctcactggggccaaaggggccgcaggcctcccgggggtggcaggcgcccctggcctgccgggacctagaggaatcccgggcccagtgggggcggccggagcgaccggagccagagggctggtcggcgaaccaggacctgccggatcgaagggcgaatcgggaaataagggagagccgggcagcgcgggaccgcaggggccaccgggacccagcggagaagagggaaagcgcggccccaatggcgaggccgggtcggcgggaccaccgggcccgcccggactgcgggggagcccgggatcacggggccttccgggagccgatggcagagccggagtgatgggacctccgggaagccggggcgcttcaggaccggcgggagttcgcgggcctaacggagacgcaggacgcccaggggaacccggcctcatggggccgcgtggactgcctggttccccgggcaatatcggacccgccggaaaggaggggccggtcgggctgcctggcatcgacggaaggccaggcccaattggaccagcaggtgcccggggagagcctggtaatatcggattccctggacctaagggacctaccggggacccgggaaaaaacggagataaagggcacgcaggactggcaggtgcgcggggagccccgggacccgacggcaacaacggggcgcaggggccgccggggccacagggagtccaaggaggaaagggtgaacagggaccgccggggcctccgggattccagggattgccaggcccgtccggcccggccggggaagtgggaaagccgggtgagcggggcctccacggggaattcggacttcctggcccagccggcccccggggagagaggggaccaccgggggagtcgggagctgccggacctaccggtcctattggttccaggggcccgtctggaccgcctggacctgacggaaacaagggtgaaccgggcgtcgtgggagccgtgggaactgctggaccatcggggccgtccggactgcccggcgaacgcggtgccgccggaatcccgggaggcaagggggaaaaaggagaaccggggctgaggggcgagatcggaaatccgggtagagatggagcccggggggccccgggagccgtgggagctccgggaccggcgggagcaactggcgaccgtggggaagccggggcggcaggcccagcaggaccggccggaccgcgcggatctcccggagaacggggcgaggtggggccggctggtcctaacggcttcgctggcccggccggtgcggctgggcagccaggggctaagggcgaacgcggcgcaaaaggaccgaaaggcgaaaacggagtcgtcggtccgaccggaccggtcggagccgccggcccggcgggacccaacggaccgccaggaccggcgggatcgcgcggcgacggcggcccaccgggcatgaccgggtttccgggcgcggcgggccggactggccccccggggccgtcaggaatttcgggccctccgggaccaccgggacccgccggtaaggagggccttcgcggaccgcggggggatcaggggcctgttggtcgcaccggagaagtgggcgccgttggaccgcctggttttgctggagagaaggggccgtcgggagaagcgggaactgcagggcctcctggtacccccggaccgcagggactcttgggagctccgggcattctcggtctgcctggttcacgcggagaacgcggactccccggagtggcgggtgcggtcggagagccgggacctctgggaattgccgggccaccaggtgccagaggaccgccgggggccgtggggtcgccgggagtgaacggggcgccaggagaagccggacgggacggaaatccaggcaatgacgggcccccgggacgcgacggccagcccggacacaagggcgagagaggctacccgggcaatatcggtccggtcggagcagcaggtgcgccgggcccacatggaccggtgggcccagcgggaaagcacgggaatcgtggagagacggggccgtccggccccgtgggacctgccggcgcggtgggaccacggggaccgtccggtccccaaggtatccgcggtgacaagggggagccaggggagaagggacccagaggactgcctggtctgaaaggacacaatggtctgcaaggtctgccaggaatcgcaggacatcatggagatcagggagctccgggctcggtgggtcctgccggaccccgcggaccggccggtccatcaggaccagcaggaaaagacggacggacgggtcatccaggcaccgtgggccctgctggaattaggggaccgcagggacatcaggggccggcgggtccgcctggcccgccaggtccgccgggaccgccgggagtgtcggggggaggatacgatttcggttacgatggcgatttctaccgggcggatcaacctcggagcgcgccgagcctgcggccaaaggactacgaggtcgatgccactcttaaatcgttgaacaatcaaatcgaaaccctgttgaccccggaaggcagccgaaagaaccctgcacgcacttgccgcgacctgcggctctcccacccggaatggtcatcgggctactactggattgaccctaaccaggggtgcacgatggacgctatcaaagtgtattgtgacttcagcactggcgaaacctgtatccgcgcacaaccagagaacatcccagctaagaactggtaccggagcagcaaggacaaaaagcatgtgtggctgggagagactatcaacgcgggttcccagttcgaatacaatgtggagggagtgacctcaaaggagatggcgactcagctggcgttcatgcgtctgctcgccaactacgcgtcgcagaacataacctaccactgtaaaaacagcatcgcgtatatggacgaggaaactggaaacctcaagaaggctgtcatcttgcaaggatccaatgatgtggaattggtcgccgagggcaattcgagattcacctacaccgttctggtggacggatgctccaagaaaaccaacgaatggggcaaaaccatcattgaatacaaaactaacaaaccttcacgcctgccctttctggatatcgccccactcgatataggaggagctgaccaagagttcttcgtggatatcggacctgtgtgctttaag

SEQ ID NO: 32512 - DNA, 4098 bp, Artificial Sequence
  Description of Artificial Sequence: Synthetic coding sequence
atgttgtcgtttgttgatacccgcactcttcttcttctcgcggtcactctgtgtctggccacttgccaatcgctgcaggaggaaactgtccgcaagggcccggcaggggaccgtggtccgagaggggaacgtggccctcccggccctcctggtcgtgacggtgaagatggtccaaccggaccacccggcccgcccgggccaccaggcccgcccggtcttggagggaatttcgcagcgcaatacgatgggaagggtgtcgggctcgggccgggtccgatggggctcatgggcccaagaggccctcctggggccgcgggggcacccggtccacaggggtttcaggggcccgccggcgagccaggcgagcctggccaaaccgggcctgcgggcgccagagggccggccggtcctccaggtaaggccggagaggacggtcatcccggcaagccaggccgtcccggagagcggggcgtggtgggtccacagggagcaaggggatttccaggaaccccaggacttcccggttttaagggaattagaggtcacaacggactggacgggcttaagggtcaacccggagcacccggagtcaaaggggaacctggggcgcctggagagaacggcaccccggggcagaccggcgcgagggggctccctggagagaggggacgcgtgggagctcccgggcctgccggcgcacgagggagcgatggatccgtgggaccagtcggacccgcgggcccgatcggttccgctggtccaccaggcttccccggcgctcctggccctaaaggggaaatcggagccgtgggaaacgccggtcctgcggggcccgctgggcctcggggtgaagtcggactccccggtctttcgggaccggtggggccacccggtaatcctggtgcaaatggacttactggagcaaaaggagctgctgggcttcctggagtggctggagcaccgggactccctggaccgcgcggcataccaggtccagtgggggccgcaggagccaccggggcaagagggctggtcggtgagccaggccccgctggttccaagggagaatcgggaaacaaaggtgaaccgggatcggcaggaccccaaggtccaccgggaccttcgggtgaagaaggaaaacgcggacctaacggtgaggcaggttccgctggaccgcctggtcccccaggcctcaggggatctccgggctctaggggacttccaggagcggatggtcgcgcaggcgtgatgggaccgccagggtcgagaggagcatccgggcctgcaggagtgcgaggcccaaacggagatgcaggacgccctggcgagccaggactgatggggccacgggggcttccaggatcacctggcaatataggaccagctgggaaagaaggacccgtggggctcccaggtatagacggacggcccggtcctataggcccagctggcgccagaggcgaacctggaaacataggttttcccggacccaaagggccaaccggtgatccgggaaaaaacggtgacaagggacatgcaggtcttgcaggagcccgaggtgcaccgggtcctgatgggaacaacggggcgcagggcccacctggaccacaaggggtccaaggtggcaaaggagaacaaggacctccggggccgccaggcttccagggattgcctggcccttccggccctgcgggcgaagtgggcaagcctggagaacgtggcctgcacggagaatttggacttcctggtccggcgggcccgagaggagagagaggcccgccgggagagtcgggagctgcgggcccaactgggccgatcggttcacggggtcctagcggccctccaggtcctgacggtaacaagggggagcctggcgtcgtcggagccgtcggcaccgcgggtccatcaggaccttcgggactccccggcgagaggggggcagcaggaatccctggcgggaaaggggaaaagggggaacctggactgagaggggaaattggtaacccgggacgagatggtgccaggggcgcgccaggagccgtcggtgcccctggtccggcaggcgcaactggtgacaggggagaagccggggcagccggaccggcaggtccggcagggcctcgggggtcgccaggagaacggggcgaggttggccctgctggtccaaatggtttcgcaggccctgctggagctgcagggcagcctggcgcgaagggagaaaggggggcaaaaggacccaagggagagaacggagtcgtgggccctaccgggccagtgggagccgccgggccggctggaccaaatggtccccccggccctgccggctcgagaggagacggcggacccccaggtatgactggcttccctggagcagccggcagaaccgggcctccaggaccctccggaatcagcggccccccaggaccaccaggtcctgcaggtaaggagggccttagaggtccccgcggagatcagggtccagttggcagaactggagaagtgggagcagtcggtccccctggttttgccggagagaaagggccatcaggagaggcaggcactgctggtcctcccggtacccccgggcctcagggtttgctgggagcgcctgggattctgggccttcctggtagcaggggtgaaagggggcttcccggagtcgcaggcgcagtgggagagcctggtcctctgggtattgccggaccacctggtgctcggggtcccccaggtgcagtgggatcgcctggggtgaacggggcccctggtgaagcagggagagatggaaatccaggtaacgatggacctccaggcagagatggacaacctggtcacaagggagagcggggttatcctgggaatattggacccgtgggtgccgccggggcacctggccctcatggacctgtgggcccagccgggaagcacggaaaccggggagagacgggcccctcaggaccggttggaccggctggtgcggtgggtcctcgtgggccatctgggccacagggaatccgaggggataaaggagaaccaggggagaagggccctcggggactcccgggattgaagggacataatgggctgcaaggtctgcctggcattgcagggcatcatggggatcagggtgcacctggttcggtggggccagcaggccctcgaggtcccgcaggaccatccggcccagccggcaaagacggccgcaccggacatccgggtaccgtgggacccgcgggaattaggggtccccaaggtcaccaaggtccagccgggccgcctgggcctccgggaccccccgggccccccggcgtgagcggaggtggttacgatttcggatacgatggagacttttaccgggcagatcaacctagatccgcgccatcactcagacccaaggactacgaagtggacgcgactctgaagtccttgaacaaccaaatcgagacgcttctcacccccgaaggttcccggaagaatccagcgcgaacttgcagagatctgcgcctttcacatcctgaatggagttccggatactactggattgaccctaatcagggctgcaccatggatgcaattaaggtttactgtgatttttcaaccggcgaaacctgtatccgcgcgcagccagaaaacatccctgcaaagaactggtaccgatcatccaaggataagaagcacgtgtggctgggagaaaccattaatgcaggcagccagttcgaatacaacgtcgaaggtgtgacgtcgaaggaaatggccactcagctggcattcatgcgtctcctggcaaactacgcgtcgcagaacatcacctaccattgtaagaactcgattgcatacatggacgaagaaaccggaaatctgaagaaggcagtgatactgcaaggaagcaacgacgtggaactcgtggcagaaggtaactcgcgttttacctacaccgtgttggtggacggctgttcgaagaaaactaatgagtggggcaaaactatcatagaatacaagaccaacaagccatcgcgcctgccattcctggatattgcccctcttgatatcgggggagcagaccaagagttttttgtggatatcggtcctgtgtgttttaag

SEQ ID NO: 32513 - DNA, 4098 bp, Artificial Sequence
  Description of Artificial Sequence: Synthetic coding sequence
atgctgagcttcgtggacactcgaacgcttcttctccttgcggtgaccctctgcctggctacttgtcagtcacttcaggaggaaaccgtgaggaagggacccgcaggggatcgcggaccccgcggggagcgcggaccacccggacctcctggtcgggatggagaggatggtccgacgggaccccctggacctcccgggccaccgggccctcctggacttggcggtaactttgccgcacaatacgatgggaagggtgtgggactcggtccgggacctatgggcctcatgggtccccgcggtcctcctggtgctgcaggggcaccaggtccacaggggtttcaggggcccgccggtgagcccggtgaaccaggtcagaccggccctgcaggcgcaaggggacctgctggtccacccgggaaggcaggtgaagatgggcaccctggaaagccaggtcgcccaggagagcgcggtgtggtcggcccacaaggagcaagaggatttccgggtacccctggcctgcctggatttaagggaatccgaggccataatgggctcgatgggcttaaaggccaacccggggcccccggtgtcaaaggcgagcctggagcaccaggagagaatggtactcccggacagacgggcgcccgcggcctcccaggtgagagaggacgtgttggagctcctggacctgccggagccagaggttctgatggatcagtgggtcctgttggccctgcggggcctatcgggtcggcaggccctcctggtttccctggagcacctggtcctaagggggaaatcggtgctgtgggtaacgcaggtccggccgggcccgctggcccccgtggagaagtggggctgcccgggctcagcgggccggttggtccgccggggaatccaggagcgaacgggttgaccggtgcaaaaggggcagccggccttccaggcgtggcaggggcgccgggtctgcctgggccaagaggcattcctgggcctgtcggtgccgccggagcaactggcgcccgtgggctcgtgggggaaccaggaccagcaggatcaaagggcgagtccggaaacaaaggagagcctggttccgcaggccctcaaggtcccccagggccttccggggaggaaggcaagagaggacccaatggtgaggcaggctcggccggcccgccgggccctccgggacttcggggaagcccaggctcgaggggtctgcccggtgccgacggacgagccggagtgatgggaccacccgggtcacgcggcgcgtcaggaccagccggagtgaggggaccgaatggtgacgcaggacgccctggtgaaccaggactgatgggacctagaggtttgccgggctcccccggaaacatcggtccagccgggaaggaaggacctgtgggactgccgggaatagacggacggcccggacccattggtcctgcgggggcgagaggagaaccgggtaatatcggtttccctggtccaaagggtccaaccggtgatccaggaaaaaacggtgataagggacacgccggacttgcaggtgccaggggcgctcccgggcccgatggaaataacggggcacaaggaccacccggtccacaaggtgtccaggggggaaagggagaacagggcccaccaggaccaccaggattccaaggactgcctggtccgtcaggtccggcaggtgaagtgggaaaacctggggaacgcgggcttcatggagagtttggcctgccaggaccggccgggccgaggggggaacgaggtccaccgggagaatccggagcagcaggacctactgggcccattggatcccggggaccctcaggacccccaggccctgatgggaataaaggggaaccaggtgtcgtgggtgcagtcgggactgcaggaccttcgggcccttctggactcccaggcgagcggggcgcagccggtatccccggtggtaaaggcgaaaaaggagaacctgggctgcgaggcgaaattggcaaccctggacgcgacggagccaggggggcacctggggccgtgggcgcacccggccccgcaggcgcaaccggcgacagaggagaagcaggagcagccggaccggctggcccggcaggtccccgtggctcgcctggagaacgcggcgaagttggtcctgcaggccctaacggattcgccggtcccgctggggccgcaggacaacctggtgcaaagggcgagcgtggagcaaaaggcccaaaaggcgaaaacggcgtcgtgggtcctactggtcctgtcggagcagcgggtccggcggggcctaacggaccacctggtccagccggttcgcgtggagatggaggcccgccaggcatgactgggttcccaggtgcagcaggtcgtaccggacctccaggacctagcggcattagcggaccccctggtcctcctggccctgctggcaaagaaggactgcggggtccacgcggggatcagggtccggttggtagaacgggagaagtaggggcagtgggtccccccggttttgcaggggagaaggggccctcgggagaggcagggaccgccgggcctccgggaaccccaggaccccaaggcctcctcggcgcaccaggaatactgggattgcccggatcccgtggagagcggggcctcccaggggtcgccggagcagtgggcgaacctggcccactcggaattgcaggacctcccggcgccagagggccgcctggagcagtcggcagcccaggtgtgaacggagcgccgggagaagccggacgggatggaaatcctggaaatgatgggccccccggccgggatggtcaaccaggacataagggagaacgcggatacccgggaaatatcggtcccgtgggagcagctggagcgcccgggccccatgggccagtggggcctgctggtaagcacgggaatcgcggcgaaaccggacccagcgggccagtcggtcccgccggggcagtcggacccagaggtccttccggcccacagggtattaggggagacaaaggtgaacccggggaaaaaggaccacgcggactgccggggctgaaaggtcataacggccttcaaggacttccaggcatagcgggacatcacggagatcaaggcgcacctggatccgtggggcccgcgggtccaagagggccagcggggccttcaggcccagcaggtaaggacggaaggactggacatcccggtactgtcggacctgctggcattagaggacctcaaggtcatcaaggaccagcggggccgccaggcccacctggaccaccaggccccccaggagtctcgggaggcggctacgattttggttacgacggagacttttacagggccgatcagccacgatccgcaccttcgcttagacccaaggactacgaggtcgacgcaaccttgaaatcattgaacaatcagattgagactctcctgactccagaaggttcgagaaagaacccggcacggacctgtagggacctccgtctgtcacacccagaatggtcaagcggttattactggattgacccaaaccagggctgtaccatggacgcaatcaaggtctactgcgatttttccactggggaaacctgtattcgggcacaaccggagaatattccagcaaagaactggtaccgctcttccaaggataagaagcatgtgtggctgggggagactataaacgctggttcgcagtttgagtacaacgtggaaggagtgacttctaaggagatggccactcaacttgccttcatgaggcttctcgcaaactatgcgtctcagaacatcacctaccactgcaagaatagcatagcatacatggacgaagagactggtaatcttaagaaggcagtgatactgcagggatccaacgatgttgaacttgtggcagaaggtaattccagatttacctacaccgtgctggttgatggatgctccaaaaagacgaacgagtgggggaaaaccatcattgagtacaaaaccaataaaccatcgcgtctgccattccttgatatcgcaccactcgatataggaggagctgatcaggagttttttgtcgacatcggaccagtctgttttaag

SEQ ID NO: 32514 - DNA, 4098 bp, Artificial Sequence
  Description of Artificial Sequence: Synthetic coding sequence
atgctctctttcgtggacacccggaccctccttctgctggccgtaaccctttgcctcgcaacttgtcaatcactgcaggaggaaaccgtgaggaagggtcccgcaggagacaggggacctaggggagaaagaggaccacctgggccgccagggagggacggtgaagatggaccgaccggacctcctgggccgcctggcccacctggcccgcctggacttggagggaattttgctgctcaatacgatggtaaaggcgtggggctgggacctggaccgatgggattgatgggtccacgcggtcctccaggagctgccggagcaccaggccctcagggatttcagggacccgctggcgagcctggagaaccaggtcagactggtccagctggggcgagaggtcctgctggaccccccggaaaggccggggaagatggccatccggggaagccagggcgaccaggagaacgaggcgtcgtgggacctcagggcgcaagaggatttcccgggactcctggccttccgggctttaagggcattagaggccataatggactcgacggactcaaagggcagccgggagcaccaggtgtcaagggcgaacctggagcaccaggggagaacggaacccctggccaaaccggtgcgcgtggacttccaggcgagcgcggcagagtgggggcaccagggcctgctggcgccagaggctcggacggtagcgtcgggccagtcggtccggccggcccaatcggttcggcaggaccgccaggctttccgggagcacctggacccaaaggtgagattggggctgttggtaacgccggcccagccggacccgccggaccacggggagaagtggggctccccggtctgtcaggaccagtgggcccgcccggtaatcctggtgcgaatggccttaccggagcaaagggagccgcaggtttgcccggggtggccggcgctcccggccttcccggccctcggggaatccccggccctgtcggtgcagcaggtgcaaccggcgcgcgaggtcttgttggtgagccaggaccggctggctcaaagggcgaatctgggaacaagggagaacccggtagcgcaggtccacagggaccacccggaccttccggtgaagagggcaagcggggtccaaacggagaggcagggtcggcagggccacctggacctccagggttgcgtggatcacctggcagcagaggactgccgggggcagatggacgtgccggagtaatgggccctccagggtcccggggagcttcggggcctgcaggggtccgcgggcctaacggtgacgccggcagacccggcgaacctggtctgatgggaccgaggggactgcccggatcccccgggaacattggtcccgctggaaaagaaggacctgtgggactcccagggattgatggacggcccggtcctattgggccagccggagcacgcggtgaacctgggaacataggtttccctggacctaaaggcccaaccggtgatcccgggaagaatggcgataagggacacgcaggcctggcgggagcacgcggcgctcctggtccagatggcaataatggcgcacaaggcccaccagggccgcaaggtgtgcagggaggaaagggggaacaagggccgcctggacctcctggttttcaggggcttcctggaccctctggcccagcaggtgaagtcggtaagcctggggagcgcggtctgcatggagaatttggactgccaggtccggccggtccacgaggtgagaggggtccacctggggaatcaggtgcagcaggccctactggcccaattggtagccgcgggccttcgggtccaccaggaccagatggtaacaagggggaacccggggtggtcggagccgtgggtactgcaggtccgtcaggaccgagcggtttgccaggagaacgtggggccgcaggcatccctggtggcaagggcgagaagggcgagcccggactgcgaggtgaaataggcaatccaggacgcgacggggccagaggtgcacctggcgccgttggtgcgcctggaccagctggagcaaccggggatagaggagaagcaggcgcggcggggcccgcaggaccagccggtccaagaggatcccccggtgaacggggcgaagtgggtcccgccggaccgaacgggtttgcaggacccgccggtgcggccggacagcccggggcaaagggggagagaggtgcaaaaggccccaagggcgaaaacggggtggttggccctacgggtcctgtcggcgcggccggtcctgcaggcccaaatggaccccctggacccgcgggttcccggggcgatggaggaccaccaggaatgaccggattccctggagctgcagggcgaactggtcccccaggtccatcggggatatcgggcccacctggtcccccggggcctgccgggaaagagggactccgaggaccacgtggagatcaaggacccgtgggaagaactggggaagtgggggctgtaggacctccaggctttgcaggggaaaagggaccttcgggagaagcaggtacggccgggccaccagggacccccgggccacaaggtctgctcggggcacccggtatacttggccttccaggttcccgaggcgaaaggggactgcctggggtggcaggtgccgtgggtgaaccgggtccccttggaattgcgggaccgccaggagcgaggggaccgcctggagccgtgggctcccctggagtgaacggtgcaccgggagaggctgggcgtgatgggaatcccgggaacgatggtccccccggtagagacggccaacctggacataaaggagagagagggtaccctggaaatatcggtccggtgggggcagcgggtgcgccgggacctcatggacccgtggggcctgctggtaaacacggtaatagaggagagactggaccaagcggacctgtgggccctgccggtgctgtgggcccgagaggccctagtggtccccaggggatccggggtgataaaggggagcctggcgaaaaggggccgcgcggactcccaggacttaaaggacacaatggtctgcaaggtctgcctggtatagcgggtcatcacggagatcagggcgcaccgggatcggtgggtccggcaggtcctcgcggtccggcaggcccttcaggtcctgccggtaaggacggtcggacgggacatccagggactgttggaccggcgggaatccgtggcccccaagggcatcagggacctgcaggaccccctggcccaccaggcccgccaggacctcccggcgtctcgggagggggatacgattttggctacgatggcgacttctatcgggcagatcaacctagatccgccccttcgctcaggcccaaggattacgaagtggacgcaactctgaaaagcctcaacaatcaaattgaaactcttctcactcccgagggatcacggaagaacccggcaagaacgtgcagagacttgagactttcacatcccgagtggagctcgggatactactggattgatccaaatcaaggatgtaccatggatgcaatcaaagtgtactgtgacttctccactggagaaacctgtattagggcacaaccagaaaacatccctgcaaaaaactggtaccggtcctccaaagataagaagcacgtgtggctgggagagactattaacgctggctcacaattcgaatacaacgtcgaaggcgtgaccagcaaggagatggccacccaactggcatttatgagactgcttgcaaactacgcgtcccagaacatcacttatcactgtaagaactcgattgcatacatggatgaagaaacgggtaaccttaagaaggcagtgattctgcagggatccaacgacgtggagcttgtggcagaaggaaacagccgctttacctacacggtcctcgtggatggctgctcgaaaaagactaacgagtggggaaagaccatcattgaatacaagaccaacaagccaagccgcctgccattcttggatatcgcacctctggacattggaggcgcggaccaagagttttttgtagacatcgggccagtgtgtttcaag

SEQ ID NO: 32515 - DNA, 4098 bp, Artificial Sequence
  Description of Artificial Sequence: Synthetic coding sequence
atgttatcatttgtagacacaagaacgctgctgctcttggcggttactctttgtctggctacatgtcaaagcttgcaggaggagactgtgcgaaagggaccagcaggagacaggggaccgcgcggtgagcgcgggcctccaggccctcccggaagggatggagaggatggccccactgggccgcctggccctccagggccccccggccctcctggcctaggcgggaatttcgcggcgcaatatgatggcaagggggttggactcggcccagggcctatggggctgatggggccccgagggcctccgggcgccgccggggcacctggtccacagggcttccagggtcctgcaggcgagccaggggagcccggccaaacagggccagcaggggccagagggcctgcaggtccccctggcaaagccggggaggatggacaccccggtaagcctggacggcccggagagcgtggagtcgtgggcccgcaaggtgcgcggggcttccccggtacccccggtctgcccgggttcaagggcatacgggggcataacgggctggacggactgaaaggacagcctggtgcccccggagttaaaggagagccgggagcacccggggagaatggaacacccggccagacgggagctcgtgggctgcccggagagagaggcagagtgggcgcaccgggtcctgcgggagctcgagggtccgacggatctgtgggacctgtgggccctgccggtcccataggatccgcgggcccccctgggttccccggcgctccaggtcccaaaggcgaaatcggagccgtgggcaacgctggacctgccggtccagccggtcccagaggggaggtgggactgcccggccttagtggacccgtaggacccccgggcaatcctggtgctaacggtctcactggagcgaagggggctgctggcttacccggcgttgccggcgcccctgggctgcctggccctagggggattccaggtccagtgggggcggccggtgctaccggagcccgcggcctggttggggagccggggccagctggttctaagggagagtccggaaataagggggagcctgggtcagctggtccgcaaggcccacctggtccctccggggaggagggaaaacggggccctaatggcgaggcaggcagcgccgggccccctgggccccccggcctgcggggcagccccggatccagaggtctgcctggggccgacggaagggctggtgtcatgggaccaccgggcagccggggagcatctggaccagctggcgtccggggcccaaacggtgatgccggcaggcctggcgaacctggcttaatggggcctcgtggactccccggctcgccgggcaacatcggtccagccggcaaagaggggccagtagggctccccggcatcgatgggaggcctggtccaatcggtccagcgggcgctaggggagagcctggcaacattggcttccctggaccaaaaggcccaaccggggaccccggtaagaacggggacaaaggacatgcgggccttgcaggcgcaaggggtgctccggggccagacggcaacaacggagcccagggtccaccaggtcctcagggtgtgcaaggcggtaagggagagcagggaccccccggccccccaggatttcaggggctcccaggacctagtggccccgctggcgaggtaggtaagcctggcgagcgaggcctgcacggagagtttggactacctgggccagcgggaccgcgaggcgagagaggacctccaggggaatcaggagcagctggcccaactgggccaattggttcacgcggaccatctggtccaccaggacccgacggaaacaagggagaacccggcgtggtaggagctgttggaaccgctggtccatctggcccctccggcctaccaggagaacgcggcgcagcaggcatccccggagggaaaggcgagaagggagagcccggcctacgaggggaaatagggaacccagggagagacggcgcccggggagctcccggagcggtgggggcacctggacctgcgggggctaccggtgaccgcggcgaagctggggcggcggggcctgctggacccgctggtcctagggggagtcctggagagaggggcgaagttgggccagccggtcctaatgggtttgccggccccgctggcgcagcaggccaaccaggggcaaaaggcgaacggggggcgaagggacccaaaggcgagaatggtgtggtcggcccaactggccctgtcggcgccgccggaccagcggggccgaacggccctcctggccccgcaggaagccgcggtgacggaggaccaccaggtatgacagggtttccaggcgcagctggcaggacgggtccccccggtccaagtgggatctccggaccgcccgggcccccaggtcccgccgggaaggaggggttacgtgggccaagaggggaccaaggcccagtgggaaggaccggcgaagtgggcgctgtgggacctcccggcttcgcaggagagaaggggccatcaggtgaggcaggaaccgccggccctccagggacaccaggaccgcagggtctcctaggcgctccaggcatcctggggctgccaggcagccgtggcgagcgggggctccctggagtcgcgggagcagtgggagagcctggccctctgggtatagccggccctcccggagcacggggaccgcccggcgcagtaggctccccaggagtgaacggagcacccggcgaggccggacgggacggaaatcccggcaatgatgggcctcccgggcgggacggtcagcccggccacaagggggagagaggatacccggggaacatcgggcccgtcggcgccgccggcgctcccggtccacatggccctgttggcccagctggcaagcacggcaaccgaggcgaaacagggccttcgggccccgtgggaccagccggcgctgtgggccctagaggtccttccgggccacagggaatccgaggagataagggagaacctggtgaaaaaggaccaaggggactgcccggccttaaaggacataacggactccagggactaccaggaatagctggacatcatggggatcaaggcgctcccggcagtgttggcccagccgggccgcgcggaccagctggcccttccggcccagccgggaaagatggccggaccggccaccccggcaccgtgggtcctgccggcattcggggcccccagggacatcagggccccgccggcccaccaggcccgccaggcccccccgggcctccaggggttagtgggggtggatatgactttgggtacgatggcgacttctacagggccgaccaaccccggtcagccccctctctccggccaaaagattacgaagtggatgcaacactgaagtctctgaacaaccagattgaaacgcttctcacgcccgaaggatctcgaaaaaatccggcgcgcacctgccgcgatctgagactctctcacccggaatggtcatcgggatactactggattgacccaaatcagggttgtaccatggacgccatcaaggtgtattgcgacttttccactggggaaacatgcattagggcccaacccgaaaacatccctgccaagaattggtataggtcatctaaggacaagaaacatgtctggctaggtgaaaccattaacgcgggaagtcagtttgaatataacgtggagggggtgacaagtaaggagatggcaacccagctggcctttatgcgactgctggcgaactatgccagccagaatattacatatcactgcaaaaatagcattgcttatatggacgaagaaacaggaaatctgaagaaagccgtgattctgcaaggctccaacgatgtcgagctagtcgccgaggggaactctagattcacctacactgtgttggtcgatggatgctctaagaaaactaacgagtggggaaaaacaattatcgaatataagactaataaaccttcccggctccccttcctggatatcgccccgctggatatcggtggggcggatcaagagttcttcgtggatattggccctgtgtgcttcaag

SEQ ID NO: 32516 - DNA, 4098 bp, Artificial Sequence
  Description of Artificial Sequence: Synthetic coding sequence
atgctgtcgttcgtggacactcgcactctcctcctgctcgccgtcaccctgtgtctcgcaacctgccagtccctgcaggaagagactgtacgaaaaggacctgctggagatcgcggaccacgcggagaacggggaccgccaggtccgcctggtcgggacggcgaagatggaccaacggggccaccaggtccaccgggccctccaggccctccggggctcggaggcaattttgccgcccagtatgacggcaagggagtgggactcggaccgggcccgatgggtcttatggggcccagagggcctccaggtgcggcaggggctcccggtcctcaaggattccagggccctgcaggggagccgggcgagccggggcaaaccggaccggccggggcccgtggacccgccggccctcctggcaaggccggagaggacggtcacccgggaaagccgggtcggccaggagagaggggcgtggtgggaccgcagggagcgcggggtttccccggaaccccagggttgccggggtttaaggggatccggggacataacggcctcgatggactcaaggggcaacctggggcgcctggagtcaagggagaacccggcgcgcccggagaaaatgggacccctggtcagactggagcacggggactcccgggggaaaggggacgcgtgggtgcaccaggtcctgcaggcgcccgcggcagcgacggctccgtcggccctgtggggccggcgggacccatcggatcggccggacctccgggttttccgggagcgcctgggccgaaaggcgaaatcggagccgtgggaaacgccggccccgcgggacctgccggtccccgaggcgaagtgggactcccaggtctttcgggacctgttggccctccgggaaatccgggcgctaacggcctgaccggcgccaaaggtgcggcggggctgccaggagttgcaggagcccccggactgccaggccctagggggattcccggacccgtgggtgccgccggagcaaccggcgctaggggcttggtcggagaacctgggccagccgggtccaagggagagtcgggaaacaagggggaaccgggctcagctggcccacagggacctcccggcccatcgggagaagagggaaagcgcggccctaacggcgaggccggctcggcaggtcctccaggtccccctggactccgcggatcccccggatcccggggacttccaggtgccgacggacgagcgggggtcatgggccccccggggtcaaggggagcgtccgggccggccggcgtgcgcggacctaacggcgacgcaggaaggccaggagagcctggactcatgggaccgcgcgggctccctggatcgccaggaaacatcggcccagctggaaaggaaggaccagtgggcctgcctggaatagatggacgccccggcccaatcgggccagcaggagccagaggggagccagggaacatcggatttcctggacctaagggcccgactggcgatccgggcaaaaacggagataagggacatgccggactggccggggcaagaggagctccaggaccagacggcaataatggcgcccagggacctccagggccccagggagtgcagggcggaaagggagagcaaggaccaccgggaccacctggtttccagggactgccaggaccaagcggaccagccggggaggtcggcaaaccgggcgagagaggtttgcacggcgagttcgggctgccgggacctgcagggccgcgcggagagcgcggccctcccggcgaatcaggtgcagctggacctacgggaccgatcggaagcagaggtccgtccggcccccctggacctgacggcaataaaggtgagcccggagtggtgggcgcggtcggaactgcaggaccctctggaccgtccggccttccgggggaacggggcgccgccggaatccctgggggaaagggagaaaaaggagagccgggactgcgcggcgagatcggaaacccagggcgggatggcgcacggggagcaccgggagcagtcggtgccccgggtccggcaggtgcaaccggtgaccgaggcgaggctggtgcggccggccctgccggtccagctggtccaagaggctcacctggcgagcgaggtgaagttggccccgccggaccaaacgggtttgctggacccgcgggagctgccggacaacctggagcaaagggcgaacgcggtgcaaagggacccaagggagagaacggagtggttgggcccaccgggcctgtgggagccgctgggccggcgggcccaaatggtcccccggggcctgcgggtagccgcggcgatggaggaccgcctgggatgactggcttcccgggagcggcgggtcggactgggccgccgggcccgagcggaatctccggtcctccgggcccaccaggaccagcgggaaaggaagggctgagaggaccgcgtggcgaccaaggccccgtggggcgtaccggggaagtcggagcggtgggcccgcctggtttcgctggagagaagggaccttccggtgaggctgggactgcgggaccaccaggcactcctggtcctcagggactgttgggtgccccaggaatcttgggtttgccggggagcaggggagaacgcggactccctggagtggcaggggcggtgggagagccggggcctctgggaatcgcgggaccccctggagcgcgcggtccgcccggagccgtcgggtcgccgggagtcaatggcgctcccggcgaagcaggcagagacggaaacccgggaaatgacggaccgccaggacgggatggacagcctggccataagggtgagcggggctacccgggcaacattggaccggtgggggctgctggagccccggggccgcatggcccggtaggaccggcgggaaagcacggaaaccgcggagagactggaccgagtggaccggtcggtcccgcgggcgccgtcggaccccgtgggccctcgggacctcaagggattcgaggagacaagggcgaaccaggtgagaagggaccacggggcctgccgggcctgaagggacacaacgggcttcagggattgcctggaatcgcgggccaccacggtgatcagggagctccgggatcggtggggccagcaggtccacgcggaccggcgggtccttccggacctgcaggaaaggatgggaggactggacacccgggaaccgtggggccagcgggaattcggggcccgcaaggacaccagggcccagccggacctcctggacccccgggacccccgggtccccccggtgtttccggagggggctacgacttcggatatgatggcgacttctaccgcgccgaccaaccgcgcagcgccccttcgcttcggcctaaggactacgaagtcgacgcaactctgaagtcgctgaacaatcagatcgaaactctgctgaccccggaaggctcgcgcaaaaatccggccaggacttgccgggatctcagactgtcgcatccagaatggtcatcgggctactactggattgatccgaaccagggatgcacgatggacgcaattaaggtgtactgtgacttctctaccggggaaacgtgtatccgcgcacagccggaaaacatcccggccaagaattggtaccggtcatcaaaagacaaaaaacatgtctggctgggagaaaccatcaacgccggatcacaattcgaatacaacgtggaaggggtgacttcaaaggagatggcgacccaactggctttcatgaggctcctcgccaattacgcaagtcagaatatcacctaccactgcaagaacagcatcgcatacatggacgaagaaacgggaaatctgaagaaagcggtgattctgcagggatctaacgatgtggaactggtggcggagggaaactcacgcttcacctacacggtgcttgtcgacgggtgctccaaaaagaccaacgaatggggtaagactatcatcgaatacaaaacgaataaaccctcccgcctccccttcctggacatcgcgcctctggatatcggaggagccgatcaagagtttttcgtggacatcggaccggtgtgcttcaaa

SEQ ID NO: 32517 - DNA, 4098 bp, Artificial Sequence
  Description of Artificial Sequence: Synthetic coding sequence
atgctctcgtttgtggacactcgcaccctgctgctgctggccgtgactctctgtctcgcgacctgccaatcactgcaggaagaaaccgtgcgcaagggccctgctggagacagaggaccccgcggtgagcggggaccgcctggcccaccgggacgcgatggcgaagatgggccaactggaccacctggtccaccaggacctccgggtccgcctggtctgggcggcaacttcgcggcccagtacgatggaaaaggagtgggactgggcccgggtccaatggggttgatggggcccagaggcccgccgggtgcagcgggagctccgggacctcagggattccaaggcccggcaggggagccaggcgaacctgggcagactggtcctgcaggagctcgtggccctgccggaccaccaggtaaagccggagaagatggtcacccgggtaagcctggaaggcccggtgagaggggggtggtcgggccgcagggtgcacggggattcccgggaactcccggattgccaggattcaaagggattagaggccataacggactcgatggcctgaaggggcagccgggagctcctggcgtgaagggtgaaccaggagcccctggcgaaaacggaacgccggggcagactggggcgcgcggactgccaggagagcgcgggcgggtcggggccccgggccccgcgggagcacgggggagcgatggtagcgtcggtcctgtgggcccggctggaccaatcggatcagccggtcctcctggatttcctggagcgccagggccgaagggagagatcggagcagtgggaaacgcaggaccagcgggcccagcgggcccccgtggagaagtgggtctgccggggctgtcgggacctgttggtcccccagggaacccgggagccaacggactgactggagcgaagggggctgctggcctgcccggagtggccggtgcccccggcctgccaggaccccggggaatcccggggccagtgggagctgccggcgccaccggagcccgcggactggttggggagccaggaccggccggatccaagggggagtccggaaacaagggtgaaccgggttcagctggaccgcaaggaccgccaggaccttcgggagaagaaggcaagagaggacccaacggtgaggcaggttccgctggcccgcctgggccgccaggtctgcgcggctcgcccggatcccggggacttccaggcgctgatggacgagccggagtgatggggccacctggaagcaggggagcgtccggcccagccggcgtgagaggtccgaatggagatgccggacgaccgggggaaccgggcctcatgggaccgagaggactcccagggtccccgggtaacatcggccctgcaggtaaggaaggacccgtgggcttgccgggcatcgacgggaggcccggcccaatcggtccagcaggggcacggggggagccggggaacatcggattcccgggccctaaaggacctactggggacccgggaaagaatggggacaaaggacacgctggattggccggagcgcgtggggccccgggaccggatggaaataacggtgcccaggggccgcccgggccgcaaggcgtccaaggaggcaaaggggagcaaggcccgcccggcccacctggcttccaaggcctgccggggccgtctggcccggccggcgaagtgggcaagcccggcgaacgcgggcttcacggagaattcggtctgccaggtcctgcaggcccccggggagagcgggggcctccaggcgagagcggcgcggccgggcctactggacccatcggttcgcgcggtccaagcggaccgccgggacccgatggaaacaaaggcgaaccaggagtggtgggcgcggtgggaaccgctggaccgtcgggaccgagcgggcttccgggtgagcgcggtgccgcgggaatccctggaggtaagggtgaaaagggagagccgggactgcgcggagaaatcggtaaccctggtcgggacggggccaggggcgcaccgggcgcagtgggagccccaggaccggctggagccactggcgaccgcggcgaggcgggagcagccggcccagcaggtccagccggacctcgcgggtcaccaggagaaaggggtgaagtagggcccgcaggacccaatgggttcgctggccccgcaggtgcagccggtcaaccgggggccaagggcgagaggggagccaaggggccaaaaggagaaaatggcgtggtagggccaactggtccagtcggagccgctggacctgcgggaccgaacggcccgcctggtccagctgggtcgcgcggggatggcgggccgccgggcatgaccgggtttccgggagccgctggtcggactggccctccaggaccgtctggaatctccggaccacccggtccgcctggccctgcggggaaagaggggctgagagggccacgtggcgaccagggacctgtcggtcgaaccggggaggtcggagccgtggggcctcctggtttcgcaggagaaaaggggccctccggagaggcaggaaccgcgggtccaccaggcaccccgggaccgcagggattgctcggagccccgggcattttggggcttccgggatcgagaggagaaagagggctgcctggcgttgctggagcagtcggggagccgggaccgcttggcatcgctggaccaccaggcgcgcgcggcccaccgggtgcagttggatcgccaggagtgaatggtgccccgggcgaagcgggacgggacggaaacccgggaaatgacggacctccggggcgggacggtcagccgggacacaagggagaacggggctacccaggcaatattggacccgtgggagcggccggagcccccggcccgcatgggccggtcggccccgccggcaagcacggaaaccgcggggaaacgggaccatcgggtccggtaggtccagcaggagctgtggggccgcgaggtccctcaggtccgcagggtatccgaggcgacaaaggtgagccgggggagaaaggcccgcgcggtttgcctggcctcaaaggtcataacggactgcagggcctcccgggaatcgcgggacaccatggggaccagggagcacctggatcagtgggaccagcaggccctcgcgggcccgcaggcccttccggtccggcgggaaaggatggacgcaccggccaccctgggaccgtgggtccagctggaatcaggggcccacagggacatcaggggcccgcgggtccgccgggtccacctggaccaccgggccctccgggggtttccggaggggggtacgactttggttacgacggagacttctaccgcgccgaccaaccgaggtcggcgccgagcctgaggccgaaggattacgaggtcgacgccaccctgaaatcccttaacaatcagatcgaaaccctgctgacccctgagggatcgagaaagaacccggcgcggacctgccgggacctgcggctcagtcatccagaatggtcaagcggctactactggatcgatccgaatcaaggatgtactatggacgccatcaaagtctactgcgacttcagcaccggagaaacctgcatcagagcccagccagagaatatacccgcgaagaactggtaccgctcgtcgaaggataagaagcacgtgtggctcggagagacgatcaatgccgggtcacaattcgaatacaatgtcgagggcgtgacttcaaaagaaatggcgacgcaactcgcttttatgagacttctggccaactacgcgtcccagaacatcacctatcactgcaagaattctatcgcctacatggatgaggaaaccgggaacctgaagaaggctgtgattctccagggaagcaacgacgtcgagctcgtggctgagggaaacagccggttcacttatacggtcctcgtggacggatgctccaaaaagactaatgaatggggtaagactatcatcgaatacaagaccaacaagccatccagactcccgttcctggatattgccccgctggacattggcggcgcggaccaggagtttttcgtcgacatcggtcctgtgtgtttcaag

SEQ ID NO: 32518 - DNA, 4098 bp, Artificial Sequence
  Description of Artificial Sequence: Synthetic coding sequence
atgttgtcatttgtcgacacacggactctgctgctgctggcagtaacactgtgtctagccacttgccagtctcttcaggaggaaaccgtgcggaagggccccgctggggacagggggccacgaggagagcgaggcccaccgggtcctcctggaagggacggcgaggatggacctaccgggccccctggcccacccgggcctcctggcccaccgggcctgggcggcaatttcgccgctcagtatgatggcaaaggggttggcttgggacccgggcctatggggcttatgggaccgaggggaccccccggggctgctggcgctcctgggccgcaagggtttcagggacctgccggcgaacctggagaacccgggcaaacaggtccagcaggcgctagagggcccgctggtcccccggggaaagccggtgaagacggccatcccggtaagcccggaagacccggcgagcgaggtgttgtcggaccccagggcgcaaggggcttcccaggaactcccgggctgccggggtttaaagggatccgaggacataatgggctggatggactgaaagggcagccaggcgctcctggagtcaaaggtgagcccggagcacccggtgaaaacggcactcccggccagaccggggcaagagggttgccgggtgagcgtggacgagtcggcgcaccagggcccgcaggagctagaggctctgacggaagtgtggggccagttggcccggccgggccaataggcagcgctggacctcctggcttccctggagccccgggacctaagggggagattggcgccgtgggaaacgctggccccgcaggacccgccggcccccggggagaggtaggcctcccaggcctttccggcccagtcggccccccaggaaatccaggggccaatggcctgacaggcgcaaaaggtgccgccgggctgcccggcgtggcaggggctcccggactccctggacctagaggcatccccgggcctgtcggtgccgctggggccactggcgcccgggggctggtgggcgagcctggcccagccggcagcaagggggagtcaggcaacaagggagagcccggaagcgccgggccacagggtcctcccggaccctccggggaagaagggaagagaggtcccaatggcgaggcaggaagcgcaggtcctccagggccacccggtctgcgagggtcaccaggaagccggggcctgcctggtgctgatgggagagccggggttatggggccacctggttctcgtggtgcaagtggaccagcgggcgtgcgcggccccaatggcgatgctgggcggccaggtgagcccggtctgatgggcccgagagggctcccgggatcgccaggtaacatcgggcctgctggaaaagaaggtccggtcgggctgcccggaatcgacggaagacctgggccgattggtcctgccggagctcgaggtgagcctggcaatatcgggttcccggggccgaaggggccaactggggaccctggaaagaacggtgacaaggggcacgcggggcttgctggagctcgtggggccccaggccctgacggaaacaacggagcccaaggtccaccggggccccagggagtgcaaggcggcaaaggtgagcagggccctcccggcccacctggattccaaggcctaccaggcccatccggcccagctggcgaggtgggtaaacccggtgagcggggtctgcacggcgagtttggtcttcccgggccggctggaccccggggcgagcgaggaccgcccggtgagagcggggcagccgggcctaccggacctattggctctagagggccaagtgggccaccagggcctgacggcaacaagggagaaccaggggttgtcggcgctgtgggcacggccggtcctagtggcccaagcggactgcccggtgagcgcggcgccgctggcatccccggcggaaaaggggagaagggagaacccggtctgcggggagaaataggcaacccgggtcgtgatggcgccaggggagcgccaggtgccgtgggagcccccggaccagcgggagctacaggagaccggggtgaagctggcgccgcaggaccagccggtcctgccggaccgcggggtagtcctggagaaagaggcgaagtgggtccagccggccctaacgggtttgctgggcccgccggggcagctggacagccaggcgcaaaaggagagaggggcgccaagggccccaagggcgaaaatggcgtggtcggaccgactggaccggttggtgcagcggggcccgcaggacccaatggacccccaggccctgccggctctcggggcgacggcgggcctcccggaatgactgggtttccgggcgcagccggtcggacaggcccaccgggtccgagcggtatatcgggacctcctggccctcccggcccggctgggaaggaaggccttcgcggcccgcgaggcgatcaggggcctgtcgggcgtactggcgaagtcggagcagtggggccacccgggttcgccggggagaagggtccatctggtgaagccgggacagcaggcccgccagggacccccggcccccagggcctgttgggagcaccagggatacttggcctgcccggctcccgcggtgaacgaggactgcccggtgttgctggagccgtgggtgagccgggccctctgggaatcgccgggcctccgggagcgcgcggccctcccggagctgtggggtcccccggtgtcaacggcgccccaggagaagcgggccgcgacggaaatccgggaaatgacggcccaccgggacgtgatggacagcctggacataaaggcgaaagggggtatcctgggaatatcggacccgtaggggctgctggggcacccgggccgcacgggccagtgggacctgccggaaagcacggtaatcgcggggaaaccggcccaagcggaccagtggggcctgccggtgcagtgggaccgaggggaccatctgggcctcagggaattcgaggagataagggcgagccaggagagaagggtcctcgcggcctgcccgggctgaagggacataacgggttacaaggacttcctgggatcgcaggacaccatggggatcagggtgcaccagggtccgtcggccccgcaggtccacggggtccagccgggccctccggacctgccggcaaggatggacgaacaggacaccctgggacggtgggaccagccggaattagagggcctcagggccaccaggggcccgccggtccaccgggccctcccggccccccaggaccccccggcgtcagcggaggcgggtatgattttggttacgacggcgatttctatagggccgatcagcctcgtagcgccccgagcctgcgcccaaaggattacgaggtggatgccacactaaaaagcctaaacaaccagatcgaaaccctgttaactccagaagggtctcgaaagaatccggctaggacctgccgcgacctgcgcctgtctcacccagaatggagctccggttactattggattgatcctaaccagggatgcaccatggatgcgataaaagtctactgtgatttctccaccggagagacttgtattcgtgcccagccagagaacattcctgcaaagaactggtacaggagctctaaggacaaaaagcacgtctggctgggcgagaccattaatgccggatcacaatttgagtataacgtagagggcgtcaccagcaaagagatggcaactcaactggcgtttatgaggcttctggccaactacgcctctcagaatatcacatatcattgcaaaaattctatagcttatatggacgaggaaactggaaacctgaaaaaggcggtgattctccaggggtctaatgacgtggaattagttgcagagggaaactcgaggtttacctataccgtactcgttgatggctgttctaaaaagaccaacgagtggggaaagacaataatcgaatacaaaaccaacaaaccatcaaggctgccattcctcgacattgcccctctcgacattggaggtgctgatcaggagttttttgtggatatcggacctgtgtgttttaaa

SEQ ID NO: 32519 - DNA, 4098 bp, Artificial Sequence
  Description of Artificial Sequence: Synthetic coding sequence
atgcttagtttcgtggacactcgtaccctgctcctcctggctgttacgctatgtcttgctacctgtcagtctttgcaggaagagactgttaggaagggacctgctggggaccggggaccgagaggtgagagaggccctcccggccctccaggccgcgacggcgaggacggtcccactggccctcccggcccacccggccctccggggcctcccgggctgggcggtaactttgcagcacaatacgatggtaagggtgtcggtcttgggcctggccccatggggctcatgggcccccgcggccccccaggtgcagctggtgcccccggaccgcaaggttttcagggacccgcgggtgagcccggcgagcccggccagaccggccccgcaggagctcggggccctgctggacctcccggtaaggctggtgaggacggccatcccgggaagccaggcagacccggtgagaggggcgtcgtcggaccgcagggagcccgcggcttccctgggacacccggtctgcccggcttcaaaggcatccgcggtcacaacggtttggatggcctcaagggccaaccgggcgcccctggggtcaagggtgaacccggcgctccgggtgagaacggtacacctggccagaccggcgcccgtggcctcccaggtgagcggggacgcgtcggggctcccggacctgcaggtgcccgcggctcggatggttccgtcggcccagtggggccggccggcccaatcggctccgcaggacctccaggatttcccggtgctcctggtcccaagggtgagatcggtgctgtcggcaatgccggtcccgctggccccgctggtccgcgtggtgaggtgggtctcccgggattgtcgggacctgtcggtcctcccggtaaccctggtgccaacggcctcaccggggctaagggcgccgctggtttgcccggcgtcgccggtgcccctggtctccccggcccccggggaatcccgggcccggtcggtgctgctggcgctactggagcgcgcggtttggtcggtgagcccggcccggctggctcgaagggggagtccggtaacaagggcgaacctggctctgctggaccccaaggcccaccaggtcctagtggcgaggaaggtaagcggggaccgaacggtgaggccggtagcgcgggtcctccaggaccccctggtcttcgtggttccccgggttctcgaggcctcccgggggctgatggccgtgcaggcgtcatggggcctcctggcagtagaggggcctccggacccgccggtgtccgtggtcccaatggcgatgccggccgcccaggcgagccggggctgatgggaccccgcggtctgccgggtagcccaggcaacatcggacctgctggaaaagagggccccgtcggtctacccggtatcgacggacgtcccggtcccatcggcccagccggagccagaggtgagcccggaaacatcggcttccctggccccaagggtcctactggtgacccgggaaagaacggtgataagggtcacgctggcctcgccggtgcccgtggcgctcctggccccgatggcaacaatggtgcccagggtccccctggtccccaaggtgtgcagggtggcaagggtgaacagggtccccccgggccgcctggattccagggactccctggcccgtccggccccgccggggaggtcggtaagcccggcgagcgcggtctccacggcgagttcgggctgcccggacccgcaggccctcgtggtgagcgtgggccccctggcgagagcggagccgccggcccgaccggccctatcggctcccgcggtccttctggccctccgggaccagatggtaacaagggagaacccggagttgtgggagccgtgggcacggcgggtcctagtggaccctcgggattgcctggtgagcgtggagccgctggcatcccgggcggtaagggagagaagggcgaacctggcctccgtggcgaaattggcaaccctggacgcgacggtgctcgtggagcgccgggtgctgtgggagctcctgggcccgcgggagccacaggggatcgtggagaagccggagctgcgggccccgctggtcctgccggtccgcggggaagcccgggtgagcgtggtgaggttggccccgcgggcccgaatgggttcgctggccccgccggcgctgctgggcagcccggcgctaagggggagcggggtgccaagggtcccaagggcgaaaacggggtcgtcggccctaccggccccgtcggtgcagcgggcccggctggtccgaacggtcctcccggaccagctgggtcacgcggtgatggtggaccccccggcatgaccggctttcctggcgctgcagggcgtaccggacccccgggccctagcggaatctccggacctcccggacctcccggccccgccgggaaggagggtttgcgcggtccccgtggggaccaaggtccagtggggcgtaccggtgaggtcggcgccgttggtccccccggattcgcaggggagaagggcccctcgggtgaggccggcaccgcgggacctccgggaactccaggcccccaaggtctgttgggagccccgggaatcctggggcttcccggttcccggggcgagcgtggcttgcccggagtcgcgggtgcggttggcgagccaggcccgctgggcatcgccggcccgcccggcgcacgcgggccgccgggagctgtgggctcccctggagtgaatggggctcctggagaggctggccgcgatggcaaccctggtaatgacggacccccgggccgtgatggacagccgggccacaagggtgagcgtggctacccaggcaacatcggtcccgttggtgcagctggtgctcccggtccacacggtccagtgggaccagcgggcaagcacggcaatcggggtgagactggcccgtccggcccggtgggtcctgccggcgctgtcggtccccgtggaccttctggtccccaaggtatcagaggtgataagggagaaccgggcgagaagggccctcgcggcctcccaggcctaaagggtcacaacggcctccagggactccctggtatcgccgggcatcacggtgaccagggtgcacctggatcggttgggccggcagggccccgcggacccgctggcccttctggtcccgcgggcaaggatggccgcactggccatcccggcactgtgggcccggcgggtattcgtgggcctcagggccaccagggccccgccggccctccgggcccccccggcccccccggcccacccggtgttagcggtggcggctacgacttcggctacgacggcgatttctacagagccgaccagccccgtagtgctccctccctgcgtcccaaggattacgaggtcgacgccacgcttaagagtcttaacaaccagatcgagactctgctcacccccgaaggttcccgtaagaaccctgcccggacctgtagagatttgcggctttctcaccccgagtggtcctcgggttactactggatcgatcctaaccagggatgcaccatggatgctatcaaggtgtattgcgacttctctaccggagagacgtgcatccgcgcgcagcccgaaaacatccccgctaagaactggtaccgttcgagtaaggacaagaagcacgtgtggctcggcgaaacgattaacgctgggagccagtttgaatataacgttgagggcgtcacatccaaggaaatggccacgcagcttgcatttatgcgcctccttgccaactacgcctcgcagaacatcacgtatcactgcaagaattccatcgcctacatggacgaagagaccggcaacctcaagaaagcggtgatactccagggatccaacgatgtggagctcgttgccgagggcaatagtcggttcacatacacggtccttgttgacgggtgtagtaagaagaccaacgaatggggcaagacaatcatcgagtacaaaacaaacaagccctctcggctgccattcctggacatcgctcccctggacatcggcggtgccgaccaggagttcttcgttgatatcggccccgtctgtttcaag

SEQ ID NO: 32520 - DNA, 4098 bp, Artificial Sequence
  Description of Artificial Sequence: Synthetic coding sequence
atgctctctttcgtcgatacccggaccctcctgcttctggcagtgaccctttgccttgcaacctgccagtcacttcaagaggaaactgtcaggaaaggtcccgcaggcgaccgaggcccacgcggtgaacgcggtccaccaggccccccgggtagagatggcgaagatggtccaaccggaccaccgggccccccgggaccgcctggacctccaggattgggaggtaactttgccgcacaatacgatggcaaaggagtcggactcgggcccggacctatgggtcttatggggccacgtggaccgcctggtgcagcaggagccccgggcccacagggatttcaaggtcctgctggagaaccaggagaacctggccaaactggtcctgcaggggcacgcgggcctgcgggtccgccaggtaaggctggggaagatggtcatcccgggaagcctggtcgtccaggagagagaggggtcgttggtccacaaggagcccgcggattcccaggaactccaggactgcctggttttaagggcattagaggtcataacggtcttgatggcctgaagggtcagcctggagcacccggagtgaagggcgaaccaggagcaccaggggaaaacggcactcccggtcaaaccggcgcccgaggattgcccggagagagaggtagggtgggagccccaggtcctgcaggagcgcggggctcagacgggtcagtcggacccgtgggaccggccggaccgataggaagcgcgggtcctccaggtttccctggagctcccggacctaagggagaaattggtgctgtgggaaacgctggacctgcaggccctgccggtcctagaggcgaagtgggactccctggtctttcgggtcctgtggggcctcccggtaaccctggtgcaaacggactgactggcgcaaagggggcagccggtctgccgggggtcgccggagcgccgggccttccaggaccccgggggatcccaggcccagtgggcgcagcaggggcaacgggtgccagaggcttggtgggcgaacccggcccggctggatcgaagggcgagtcggggaataagggcgagccaggatcggcgggtcctcaagggcctcctggcccatcgggtgaggaaggaaagcgtggcccaaatggtgaagccggcagcgccggtccccctggtccgcctggcctgcggggcagccctgggtcgcgcggattgcctggtgcggatggacgcgcaggtgtgatgggtccacctgggagccggggtgccagcgggccggcaggagtgcggggacctaacggagacgcagggcgaccaggcgaacctggcctcatggggccccgtggacttccgggatcgcctgggaatattggaccggccgggaaggaagggcccgtgggactcccaggaattgacggtagacccggcccgataggccctgcaggagctaggggtgagcccgggaatatcgggttcccgggaccgaaaggtccaactggtgatccgggcaagaacggagacaaggggcatgcaggacttgcaggagcaagaggggcaccgggacccgatggaaacaatggggcacagggaccaccaggcccacaaggtgtgcagggcggcaagggcgagcagggaccccccggaccacccgggttccagggccttcccgggccttcggggcccgcgggagaagtaggaaagcctggggaacgaggcctgcacggtgagttcggattgcccggtccagcaggtccacgcggtgagcgaggacctcccggtgaatccggtgccgcagggccgacgggacctattggttcaagaggcccatcaggccctcctggcccggacgggaacaaaggagaaccgggggtggtgggcgcggtgggaactgcaggtccaagcggaccttctggactgcctggagaaagaggagccgcgggcattccaggcggaaaaggcgaaaagggagagcccgggctgagaggagagatcggaaatcctgggagggacggggcacgtggggcacctggcgccgtgggagcaccaggcccggcgggagctactggagacagaggtgaagccggtgcggcaggtcccgctggcccggcgggccctcgggggtcgcctggtgaacgtggggaggtcggccctgccggacctaatggattcgcaggaccagctggtgctgccgggcagccaggagcaaaaggtgagagaggggccaagggtcccaaaggagaaaacggagtcgtgggaccgaccggtccagtgggtgccgccggaccagcgggccccaacggacccccaggcccagctggttcacgaggtgatggcggcccacccggtatgactggttttccgggtgcggcaggaagaacgggcccccctggacctagcggaatctccggacctcctggtccccccggtcctgctggcaaggaagggctcagaggtcctcggggagatcaggggcctgtgggccgcaccggagaagtgggtgcagttgggccaccaggatttgcaggagagaagggtcctagcggtgaagcaggtactgcgggtccaccgggcacccctggtccccaagggctcctgggagcaccgggtattctggggctgcccggatcccggggtgaaagaggcctgcctggtgttgcaggtgcagtcggggagcccgggccgcttggaattgcaggcccaccaggtgctagagggccacctggggctgtcggatcccctggagttaacggggcaccaggagaagcggggagggatggtaatcctgggaatgacggtcctccgggacgtgacggtcagccaggacataaaggagagcgtggataccctgggaacatcggcccggtcggggcagctggtgcacctggtccccatggtcctgtagggccggcagggaagcacggcaaccgtggcgaaaccggacctagcggtccggtgggtccagcgggcgcagtcggacctagaggaccgtcagggccccaaggcatcaggggagataaaggtgaaccgggagaaaagggaccacgggggctccctggtttgaaggggcataatggcctgcaggggctcccaggtatagcaggccaccacggggatcaaggagcgccaggctcagttggacccgctgggccgcggggtccagcaggcccatctggacccgcaggaaaggatggaagaactggtcaccctggaactgtcggcccggccggtatcaggggaccccagggacaccaaggtcccgccggaccccctgggcctcccgggccaccaggcccgccaggagtgtccggaggtggttacgatttcggctacgatggtgacttttaccgagccgatcaaccacgcagcgcaccgagcctccgcccaaaagattacgaggtggacgcaaccctgaagtcccttaacaatcaaattgaaacgcttcttactccagaaggatccaggaagaacccagctcgtacctgtagggacctccgactttcccatccagaatggagctcgggttactactggatcgacccaaatcagggctgtaccatggatgcgattaaagtgtactgtgatttttcgaccggggaaacctgtatcagagcacaacctgagaacattcctgctaagaactggtaccgtagtagcaaggacaaaaagcatgtctggctgggtgaaactatcaacgcaggctcgcagtttgaatacaacgtggagggggtgacttccaaagaaatggcaacccaacttgcatttatgcggctgctggcaaactacgcgtcacagaacattacctatcattgcaagaattccattgcttacatggatgaggaaaccgggaaccttaagaaggcagtgatacttcagggttcgaacgatgtggagctggtcgccgaagggaattcgaggtttacttacaccgtgctcgtcgatggttgttcaaagaaaaccaatgagtggggaaagaccattatcgagtataagacgaataagccttccagactgccttttcttgatattgcacctctggacatcggcggagcggatcaagagttttttgtggacattggtcccgtgtgtttcaaa

SEQ ID NO: 32521 - DNA, 4098 bp, Artificial Sequence
  Description of Artificial Sequence: Synthetic coding sequence
atgctctcatttgtggatactcggacccttctgctgctggctgtgaccctgtgtctggccacctgtcaaagcctccaagaagaaaccgtgagaaagggtcctgcgggtgatagaggtcctcggggagaacgtggacctccgggtccgccaggacgagacggtgaggatggacccaccggtcctcccgggccccctggtcctcccggtcccccgggtctgggaggaaacttcgcagcccaatacgacggtaaaggagtgggacttggtcccggccctatgggactcatgggtccacggggaccgcccggggcagcgggggcacctggccctcagggctttcaaggacctgccggcgagccaggggaacctgggcaaactggcccggctggagctaggggtcccgccggccctcctggaaaggcaggagaagatggacacccggggaagcctggccgacccggggaacgcggagtggtgggaccacaaggtgcacgcggctttcccggtacgcccggcctcccagggtttaaaggtatcagaggtcacaatgggctggatggtcttaagggacagcctggagccccaggtgtcaagggcgagcccggcgccccaggtgaaaatgggactccgggccaaaccggcgcccggggactgcctggcgaaaggggcagggtgggtgcacctggcccagctggagctcgcggatctgacggatcggtgggacccgttggcccagcggggccaattggttcggcaggtcccccaggctttcccggagccccagggccaaagggtgaaattggagcagtgggaaacgcgggcccggcaggacctgcgggaccgcgaggagaagtgggacttccaggcctttccgggccagtcggaccgccgggaaatccgggagctaatgggctcactggtgcaaagggtgcagcaggtctgccaggcgtggcaggggcaccgggccttcctggcccacgcgggatccccggacctgtgggtgccgcaggtgccacgggtgcacgcggtcttgttggcgaacctggcccggcaggttcaaaaggcgaatcagggaataaaggggaaccaggttccgcgggtccacaaggtcctcctggtccatccggtgaagaaggaaagcgcggccctaacggagaagcaggatccgcaggtccgccgggacctccaggcttgaggggctcccccgggtcgagagggcttccaggggcagatgggcgggcaggcgtgatgggaccccccggatcaaggggtgcctcggggccggctggggtgcgtggacctaatggtgacgccggacgaccaggagagccaggtcttatgggacccagaggcctgccaggatccccaggtaatatcggaccggcggggaaggagggacccgtcggtttgccaggtatcgatgggaggcctggcccgatcggacccgcgggtgcgaggggcgaaccagggaacatcgggttcccaggccctaagggacctacgggagatccaggaaagaacggggataaagggcatgcaggactcgccggcgcaagaggtgcaccaggtcctgatggcaataacggagcacaagggccgccagggccacaaggagtgcagggcggcaagggggaacagggtccacccggtccacctgggtttcaagggctccctggtccatcaggtccagcaggtgaagtcgggaagccaggtgaacgtggcttgcatggtgaatttggactgccgggaccagccggaccacgtggagagagagggccacctggagaatctggagccgcaggccccactggacccattggctcccgtgggccgtcgggaccgcctggtccggatgggaacaaaggagaacctggtgtcgtcggtgcagtgggaaccgcgggaccatccggaccctcaggacttcccggagaaaggggtgccgccggtatacccgggggtaagggcgagaagggtgagcccggtctgagaggggaaataggcaacccgggccgtgacggggccagaggcgctcctggagccgtgggcgcccccggacctgctggtgccactggagacagaggtgaggccggagcggctggtccggccggccctgccggacctcgggggtcccccggagagaggggtgaagtgggacccgcgggaccaaacggattcgctgggcctgctggggcagcaggacagcctggtgcaaaaggagagagaggtgccaaaggtccaaaaggcgaaaatggcgttgtggggcctaccggaccagtgggcgcagcgggtcctgccggtccgaacggcccaccgggtccagcgggttcgagaggagatggcgggcctccaggtatgacgggattccctggagcagcgggacgaaccggtcctccgggccctagcggcatttctgggccaccggggcctcctggacctgcaggcaaagaaggactcagagggccccggggagatcagggtcctgtgggtcgtactggagaggtcggggcagtgggaccacccggttttgcaggagagaaaggtccttcgggggaggcagggactgcggggccaccgggtactccaggaccgcagggacttctcggagcaccagggatcctgggattgcctggatcgagaggagaaagaggtctgcctggcgtagccggagcagtcggagaaccgggaccgttggggatcgccgggcctcccggtgcgagaggaccgccaggcgcagtcggctccccaggagtgaacggagctccgggggaagccgggcgcgatggaaaccctggaaacgacggccctccaggtagagatggacaaccaggacacaagggggagcgggggtatcctggtaacattgggcctgtcggagccgcgggtgcgcccgggcctcatggtcctgtgggaccagcgggaaagcatggtaaccggggagaaaccggcccaagcggcccggtggggcccgccggtgcggtaggaccaaggggaccctccggacctcagggaattaggggagataagggcgaaccgggtgagaaaggcccccgcggtctgcccggcctcaagggacataacggccttcaggggcttccaggtattgcaggccaccatggcgatcaaggggcccccgggtccgtcggacctgcagggcctcgcggaccggctggcccttcgggaccggctggtaaggacggacggacgggacatcctggtactgtcggacctgcggggattcgaggaccgcaaggacaccagggacctgctgggcccccaggaccacctggacctcctggtcctccaggagtgtcgggtggtggatacgatttcggttacgatggcgacttttacagagcagatcagcctagaagcgcccctagcttgcgcccaaaggattacgaagtggacgctacccttaagtccctcaataaccagattgaaactctcctgactcctgagggaagccggaagaaccccgcacggacttgtcgcgacctgagactgtcacatcctgaatggtcaagcggttactactggattgatcccaaccagggctgtaccatggatgcgattaaggtgtactgcgacttcagcactggggaaacttgcatcagagcccaacctgagaacatcccggcaaagaattggtacaggagctcgaaggataagaaacacgtctggctgggagagacgattaatgcgggaagccaattcgaatacaatgtcgaaggtgtgacttcgaaagaaatggcgacccagcttgcatttatgcgcctgcttgctaactacgcgtcccaaaacataacctaccattgcaagaactcgattgcctacatggatgaggagacgggtaacctgaagaaggcagttatactccagggctcaaacgacgtggagcttgtggcagaagggaatagccggtttacctacactgtgcttgtcgacggttgttcgaagaaaaccaatgagtggggaaagaccatcatcgagtataagaccaacaaaccttcgcgtctgccttttctggatattgcacctcttgacattggcggtgcggaccaagagttctttgtggacattggtcctgtttgttttaag

SEQ ID NO: 32522 - DNA, 4098 bp, Artificial Sequence
  Description of Artificial Sequence: Synthetic coding sequence
atgctttcattcgttgatactaggactcttttgctgttggctgtcactttgtgtctggctacttgccaaagcctgcaagaagagactgttaggaaaggtccagctggggaccgcgggcctcgtggcgagcgtggaccaccaggtccgccgggccgtgatggtgaagatggtcctacaggtcctcctgggcctcctggaccaccaggtccacccggattaggcggtaatttcgcagcacaatatgatggtaagggtgtgggtctaggacccggtccaatgggactaatgggtcccagggggcctccaggagctgccggggctcctggtccacaggggtttcaggggcctgctggagagcccggggagccaggacagacaggtcctgctggcgccaggggaccagcaggaccgccaggaaaggcaggagaagacggccaccctgggaagcctggaagacctggtgaaagaggagttgttggccctcagggggctcgtggttttccaggaaccccaggtctgccaggtttcaaagggattagaggtcataatggtctcgacggtttaaaaggtcagcccggtgcgcctggagtaaaaggtgagcctggggcgcctggagagaatggaactcctggacagactggcgctcgtggtcttccgggagaaagagggagggtcggagcgccaggccctgcaggggcccgcggcagtgacggtagtgtggggccggtcggaccggcaggccctattggttcagcaggaccccctgggttccctggagcaccagggccgaagggggagattggggccgtggggaacgccgggccagcggggcccgcaggtcctaggggagaagttggtttaccaggtttgagtggccctgtgggtcctccgggaaatccaggtgccaatggacttaccggtgctaagggagccgctgggcttcctggggtagcaggcgctccaggtctacccggaccaaggggaattcctggtccggtgggagcagctggtgctacaggtgcaaggggtttggtgggtgaacctggacctgccggatccaaaggagagtccggaaacaagggggaacccggatcagctggacctcagggacctcctgggccatcaggtgaagagggtaagcgaggtcctaacggtgaggcaggttcggcaggaccacctggtccccccggacttcgcggctctcccggttctcgtggattaccaggcgcagatggtagggccggcgttatgggaccaccaggctccagaggagcctctggtccagcaggtgtacgaggtccaaacggtgatgccgggaggcccggtgagccaggtctaatggggccacgaggactaccaggtagtccggggaacataggaccagctggtaaggaggggcccgttgggctgccgggcatcgatggaaggccaggcccaattggacctgcaggtgctaggggtgaacctggcaatatcggctttccaggtccaaagggccccacgggagatcctggtaaaaatggagataagggtcacgccggacttgcaggggcaaggggcgctccaggtcctgatggaaataatggagcgcaggggcctccaggaccacaaggtgtgcagggtggtaaaggagaacagggacctcctggtccgcccgggtttcaaggtttacccggaccttccggccctgccggtgaagtgggcaagccaggcgaaagaggtcttcacggggagttcggtcttcccggaccagcagggccccgtggagaacgtggccctcccggcgaatcaggcgctgctggacccaccggtcctattggaagtcgtggaccgtccggacccccaggacctgatggaaataaaggcgagccaggggttgttggggcagttggtaccgccggtccttctggaccctctggtcttcctggagagcgaggtgcggctggaatccctggaggaaaaggagagaaaggagagcctggtcttaggggagagattggaaacccaggtagagatggtgctagaggcgctccaggggcggtgggtgccccaggtcctgcaggggcaactggtgacaggggcgaagctggagccgctgggcctgctggtcccgcaggcccacgaggtagcccaggtgaaaggggtgaagtaggaccagctgggcctaatggtttcgctggtcccgctggggctgctgggcaacccggagctaagggggaaagaggtgcaaagggacctaagggtgaaaacggtgtcgttggacctacggggcctgttggtgcagcaggaccagccggtcctaacgggccacctggacctgctggtagcaggggagacggcggcccacctggtatgacaggttttccgggtgctgcgggaaggaccggtccccctggtccaagcggaatctccggcccacctggtcctcccggcccagctgggaaggagggcctgcgggggccacgcggtgatcagggtcctgtgggccgaacaggtgaagttggagccgttgggccacctggtttcgccggagagaaggggcccagtggagaggcaggcacagccgggccgcctggtacacctggaccacagggactgctcggcgccccaggaattttggggttgccgggttctcgtggggagagaggtctcccaggagttgctggagctgttggagaaccaggacctttagggatcgctggcccaccaggtgctcgaggtccaccaggggcagttggttcccctggagtaaacggagctcctggtgaggccggaagagatggcaaccctggaaatgacggtcctccaggacgagacgggcaaccggggcataagggggaaagaggatacccaggtaatatcggacccgttggcgcagccggagctcctggacctcatggtccagtcggtcccgcgggaaagcacggaaacagaggggagactggcccttcaggacctgtaggcccagctggtgctgttggaccaagaggaccatcaggtcctcaggggattcggggtgataaaggggagcccggagagaaaggaccaaggggcttgcccggactgaagggacacaatgggcttcaaggcctcccgggcattgctggacatcatggtgatcaaggtgcgcctgggtctgttgggccggctggtcccaggggtcctgccggccctagcggtccagcaggtaaggacggccggacaggtcatcctggtaccgttggtccggcaggaatcaggggaccacagggacatcagggtccagccgggccacctggacccccagggccacctggtccacctggggtaagcggtggaggatatgattttggttacgatggagacttttacagggcagaccaacctaggtccgccccaagtttgagacctaaagactacgaggtggacgcaactcttaagtctctcaacaatcagattgagacacttttaacccccgaaggttctaggaagaatcccgctaggacgtgcagagatcttagactgagtcaccccgaatggtcgagtggatattattggattgatccaaaccaaggttgcaccatggacgctattaaggtttattgcgacttttctaccggtgaaacttgtattcgggcccagcctgagaatatccctgctaagaattggtataggtctagtaaggataaaaagcatgtgtggctcggagaaaccatcaacgctggttcacagttcgagtacaatgttgaaggtgttacttcaaaggagatggctacccagttggcttttatgaggcttctcgctaattatgcatcccaaaatatcacctaccattgtaaaaactccattgcttatatggatgaggaaactggcaacttaaagaaggctgttatcctgcagggttcaaacgacgttgagctcgttgcagaagggaacagtcgcttcacatacacagttctagtggacggatgttcaaagaagactaatgaatggggaaaaacaattatcgagtacaaaaccaataaaccttcccgtcttcctttcttggatattgcccctctcgacatcgggggtgcagatcaggagttctttgttgatataggccctgtatgtttcaaa

SEQ ID NO: 32523 - DNA, 4098 bp, Artificial Sequence
  Description of Artificial Sequence: Synthetic coding sequence
atgctttccttcgtcgacactaggaccctcctgcttttggccgttactctttgtctcgccacctgccaatcgctgcaggaagaaactgtgagaaaaggtccagcaggtgataggggaccacgcggggaacgaggtccccctggtccccctggccgtgatggagaggacggtcccactggaccaccggggccacccggacctcccggtccaccagggctgggagggaacttcgctgcacaatacgatggaaagggagtcggactcggaccagggcctatgggactcatgggacccagaggccctcccggagccgcaggtgcacccgggcctcagggtttccagggccccgcaggtgaacctggggagcccggtcagaccggaccggcaggggcaagaggcccagcgggccccccgggtaaggcaggagaggacgggcatccaggaaaacccggccgacccggtgaacggggtgtcgtcggaccacaaggtgcaagaggattcccgggaaccccaggacttccgggttttaagggaattcgcggccataacggactggacggcttgaagggccaacctggagcgccaggagtgaagggagaaccaggcgcaccaggtgaaaacgggaccccaggtcagacgggagcaagaggccttccaggagagcgagggcgcgtgggcgcgcccggacccgcaggcgcaagaggttccgatgggtcagtgggtcctgtgggcccggcagggcccatcggatctgcaggaccacctggatttccgggggcaccaggccctaagggagagatcggagcagtgggcaacgcaggccctgcgggccccgcgggacctcggggtgaggtgggtctgcctggactttccggaccagttgggcccccaggaaaccctggagcgaacggactcacgggcgcgaagggtgccgcaggattgccaggagtcgcaggagcacctggacttccgggaccgcgcggtatacccggtcctgtcggagctgccggcgcgaccggtgccagaggcctggttggggaacccggcccggccgggtcgaagggggaatcgggcaataagggagagccgggttcggcagggccacaaggtccacctggtccttcgggagaagaaggaaagagggggccaaacggcgaggcaggttccgcggggcccccaggcccccctggtctgagggggtcaccaggctccagaggattgcctggggcagatggcagagcgggtgtaatggggccgcctggtagccgtggcgcgtcaggacccgctggggtgcggggacctaatggtgatgccgggcgtccaggagagcctgggttgatgggtcctcgcgggctccctgggtcgcccggtaacattggccctgctggtaaagaaggacctgtgggactgcccggcattgatggtcggcctggacctataggaccggctggggcacgtggagagccgggcaatattggatttcctggtcccaagggacctaccggtgatccaggtaaaaacggagacaaggggcatgcaggtctggccggtgcacggggagcacctggcccggatggaaacaatggagcacagggccctccgggaccccaaggagtccaaggtgggaagggagagcaaggccctccaggaccgccaggcttccagggcttgccaggacccagcggccccgcaggcgaagtgggaaagccaggggaacggggactgcacggagagtttggcctgccgggacccgccgggcctcgcggtgaaaggggcccccctggagaatcaggagcggcaggacctaccggccctattggctcgcgtggaccgagcggcccacctggcccagacggtaacaaaggagaacctggagtggtcggcgcagtcggaactgctggcccatcaggcccctccggcctccctggtgagcggggtgcagccggaattccaggtggaaaaggggagaagggggaaccaggtttgcgaggagagatcggtaaccctggacgcgatggagcgcgtggggctcccggtgcagtcggcgcaccggggccggcaggtgcaacgggcgaccgcggggaagctggtgctgcaggacccgccggtccagccgggccccgggggagcccaggggaacgaggagaagtgggccccgctggtcctaacggttttgccgggccagccggcgcagcaggccagcctggcgcaaagggagaaaggggagcaaaaggtccgaagggcgaaaatggagtcgtcgggccaaccggtcctgtaggagcagccggacccgcgggaccaaatggtccaccaggtcccgctggttcgagaggagatggtggtccgccaggaatgacgggctttcctggtgccgcaggtaggaccggacccccaggtccttccggcatttcgggtcctcccggaccgccagggccggcgggtaaggaaggacttcggggccctcgcggtgaccaaggtccggtcggcagaactggcgaggtgggggctgtgggacctcctggcttcgcaggagaaaagggcccttcaggagaagcaggcactgcaggcccaccaggaaccccgggacctcagggccttctgggtgcaccaggaattcttggtctgccagggtcgcggggcgaaaggggtttgccaggagtggcaggcgccgtgggtgaacctggacctcttggaatagcaggtcctcctggtgctcggggccctccaggcgccgtcgggagccctggagtgaatggtgctcccggggaggcaggtcgggatggtaatcctggtaacgatggtccacccggtagagacggtcaacctggccataaaggagaaagaggataccccggcaacattggtcctgtgggagccgcgggtgcgccgggaccacacgggccggtcgggcccgctggtaagcacggaaacagaggggagactgggccttcaggtccggtaggcccggcaggcgcagtgggcccccgaggaccaagcggcccgcaggggatccgcggggataagggagaacccggagaaaaaggacctcgaggactgccaggcctgaagggacataacgggttgcagggcctccccggaatcgcgggtcatcacggcgaccagggcgcccctggtagcgtaggtccggcaggccctcgaggacctgctggtccttcaggtcctgcgggtaaagatgggagaactggacatcctgggaccgttgggcccgctggaatccgaggtcctcaaggacatcagggaccggccggaccacctggtccccccggtcctccagggcctcctggagtgagcggcggaggttatgatttcggctatgatggtgacttttaccgagcagaccaacctaggtccgctccgagcttgcgcccgaaggactacgaggtggacgcaaccctgaaaagcctgaataaccaaattgaaaccctccttactccagaggggtccagaaagaaccccgcacggacttgcagagatctcagactctcccacccagaatggtcctccgggtactactggattgatccaaatcaagggtgtactatggatgccattaaggtgtactgtgacttttctacgggtgaaacctgtatacgcgcccaaccagagaacatccccgcaaagaactggtaccgcagcagtaaggacaaaaagcacgtctggcttggagaaaccattaatgcaggttcgcaatttgaatacaacgtcgaaggagtcacttcaaaggaaatggccactcaactcgcgttcatgcgccttcttgccaattacgcaagccagaatatcacttaccattgcaagaactcaatagcctacatggatgaagaaaccggaaacctgaaaaaggccgtcatcctgcagggttcgaatgatgtcgaacttgttgcagaaggtaactcgagatttacttacaccgtgctggtggatggctgttccaagaaaaccaacgagtggggaaagactatcattgaatacaagaccaataagccttccagactgccatttctggatatcgccccacttgatatcggaggtgcggatcaagagttttttgtggacattggaccagtgtgtttcaaa

SEQ ID NO: 32524 - DNA, 4098 bp, Artificial Sequence
  Description of Artificial Sequence: Synthetic coding sequence
atgctgtcattcgtcgacaccagaaccctgttgctgctggccgtgactttgtgcctcgctacttgccaatccctacaggaggaaacagtacgcaagggcccagcaggtgacagagggcccagaggtgagcgtgggcctcccgggccgcctgggcgtgacggtgaggacggacccacagggccacctggaccccctggaccacctggcccgccaggtcttggcggaaacttcgcagcgcagtatgacggcaagggggtcggactggggccgggtccgatggggctcatgggccccagagggccacccggcgccgccggagcccctggaccccaggggttccagggccctgctggcgagccgggagaaccagggcagaccggaccggctggagctagaggcccagccggaccgcctggaaaggccggggaagatggacacccaggtaagccgggcaggcctggcgaaagaggggtcgtcggtccacagggggcccgtggattcccaggtacaccaggacttcctggatttaagggaattcgaggtcacaatgggcttgacggactgaaaggacagcccggcgctcctggcgtgaagggagagccgggggctccaggagaaaatggaacccctggacagactggggcaagaggcctgccaggagagcggggcagggttggcgctcctggtcctgccggagcccgaggaagtgatggatcagtggggccagttggacctgcaggtcccatcggatccgcaggacctcccggtttccccggggcacctggccccaaaggtgagataggggccgtgggcaatgcaggaccggcaggcccagccggcccaaggggtgaggtaggtctacctgggttgagtgggcctgtgggcccacctggcaatccaggcgccaacggcttaacgggcgctaagggggctgccggtctcccaggcgtcgcaggggcgcccggactgccagggccccggggaatccccgggccagtaggcgctgccggcgcaacaggggcacgcggactggttggtgaaccgggtcctgccggatccaagggtgaatccgggaacaagggggagcccggatccgcaggccctcagggccctccaggaccatctggggaggagggaaagagaggacctaatggagaggcagggagcgcagggcccccagggcctccaggcttgcggggctcaccaggatcaagaggtttgcctggcgctgacggacgagcaggtgtgatgggacccccagggtcccggggcgccagtgggcctgccggagtccgcggacctaatggtgacgccgggcgtccaggggaaccgggcctcatgggaccgcggggtctgcctggctctccaggaaatatcggacctgccggcaaagagggaccagtcggattacccggcatcgacggaaggcccggcccgatcggccccgcaggtgcccggggcgaacccggaaatataggcttccctggccctaagggcccgacaggcgatcctggcaaaaatggtgacaaagggcacgccggtctagcaggggcgcgaggagcccctggtccagacgggaacaatggagcccagggaccaccgggacctcagggagtgcagggaggaaaaggggagcaggggccacccgggccacccgggttccagggcctgcctggaccatctggccccgccggcgaggttggtaaacccggcgaacgagggcttcatggcgaattcggacttcccgggccggccggcccacgtggagagagaggacccccaggcgagtccggcgcggctgggcctaccggtccaatcgggtcaaggggacccagtggaccacccggaccagacggtaacaaaggtgaaccgggcgtggtcggcgccgttggcactgcaggtcctagcggcccaagtgggcttcctggagaaaggggtgctgcgggaatacctggcgggaaaggcgagaaaggcgagccagggctcagaggggaaatcggtaacccaggccgcgatggggctcgaggtgctcccggtgccgtcggagccccagggcctgccggcgccaccggagataggggtgaagctggtgcggcgggtcccgcaggtccggctggaccccgcggtagcccaggagagagaggcgaggtcggaccagcgggcccaaatggcttcgctgggccagcgggagctgccggccagccgggcgcaaagggtgagaggggggccaaaggaccaaagggcgagaacggtgtggttggacccaccgggcccgtcggtgccgccggcccagcgggtcctaatggcccccctggacctgccggctccagaggtgatggcgggccccccggcatgaccggattcccaggggcagcaggacgcactggaccccctggtccctccggtatctctggaccccccgggccgccaggaccagcgggcaaggagggcctccgggggccacgaggtgaccagggacctgtcggtaggaccggagaagtcggtgccgtgggtcctcccggattcgccggcgaaaagggcccttcgggagaagcaggcacggccggccccccaggaacaccaggtccacagggcctgctgggggcacccggaattttagggctgccaggcagccggggagaacgtgggctccctggcgttgctggcgctgttggcgagcctggaccactgggaatagctgggccaccaggtgccaggggacctcctggagccgtaggttctcccggagtgaatggagcccctggtgaggccggccgcgatgggaacccggggaacgacggcccccctggccgcgatgggcagcccgggcataagggcgagcgcggctacccgggtaatatcggtcctgtgggtgcagcaggagctccaggaccacacgggccagtcgggccggcagggaaacacggaaatcgcggagagactgggcccagcggcccagtcgggcctgccggggccgtggggccacggggacctagcggaccccagggcatcagaggcgacaagggggagcctggagaaaagggccctcgcggcttacccgggttgaaaggtcacaatgggctgcagggactgcccggcattgctggtcaccatggtgaccagggcgcacctggttcagtcgggccggcaggcccccgcggccccgcgggtccatccggaccagcaggcaaagatggacggacgggccaccccggtaccgtcggcccagccggtatccggggcccccagggccaccagggccccgccggtccacccggaccaccaggacccccaggcccgcccggagtgtctggcgggggatacgactttggctacgacggagacttttatcgcgcagatcaaccaaggagcgcccctagtctgagaccaaaggactacgaagtggatgcaactttgaaatccttgaacaaccagatcgagacactgctaacgcccgaggggagtcgcaagaaccccgcccggacttgccgagacctgcgtttgagccatccagagtggtcatctggatactactggattgatcccaatcagggttgcaccatggacgcaatcaaagtgtactgtgatttcagtactggcgagacatgtatacgcgcgcaaccagaaaacattccggctaagaattggtatagaagtagtaaggataaaaagcacgtgtggcttggggagaccataaatgctgggtcccaattcgagtacaacgtggagggagtgacaagcaaggagatggccacccagctggcttttatgcgcctgctggccaactacgcaagccagaacatcacgtatcactgcaagaattcaatcgcttatatggacgaagagacaggaaatctgaagaaagccgtcattctccagggctcaaacgacgtagagctagtcgctgagggcaactcaagatttacctatactgttctcgttgacggctgctccaagaaaacaaatgaatgggggaagactattatagaatacaagacgaataaacctagcagactccccttcttggatatcgcaccactagatattggcggtgccgatcaagaattcttcgtcgacatcgggccagtgtgtttcaaa

SEQ ID NO: 32525 - DNA, 4098 bp, Artificial Sequence
  Description of Artificial Sequence: Synthetic coding sequence
atgctatctttcgtggatacgagaactctgctgctgcttgcggtaacgctgtgtctggcgacgtgccagtcactgcaggaagagactgtcaggaaaggcccagccggtgaccggggcccccgtggcgagcgtggccccccaggaccccctgggagggacggcgaagatggacccactgggccccccggacccccaggacctcccggcccccctggactggggggaaatttcgcagcccaatacgacggcaaaggggtggggctgggccccgggccaatggggctgatggggcccagaggtcctcccggcgccgcaggtgcacctgggcctcagggcttccaggggccggcaggcgagccaggtgaaccaggccagaccgggcctgcgggagcccggggccccgccggaccacctgggaaggctggggaagatgggcacccagggaagcctgggagaccaggtgagcgcggcgtggtgggccctcaaggcgcccgagggttccccggcactccaggcctgccaggctttaagggcattagagggcacaatgggctggatggtcttaagggtcagcccggggcacccggggttaagggagagcccggggcccccggggagaacggaacaccaggccagaccggggccagaggactgcccggcgagcgcggacgggtaggagccccggggcccgcaggcgcacgaggctcggatggctctgttggacctgttgggcccgccgggcccatcgggtccgctgggcctccaggattcccaggggcacctggacccaagggagagataggcgccgtcggcaacgcaggtccagcaggtcccgcaggccctcgaggggaagtgggattgccaggactttccggccctgtgggaccccccggaaatccaggcgccaacggcctgaccggcgcgaagggcgccgctggcctaccaggggtagctggtgctccaggactgccgggcccaaggggaatccccgggcccgtgggtgctgccggcgcaacaggcgcacggggacttgtgggagaaccgggtcccgcaggaagcaaaggcgagtctggcaacaagggagagccaggctctgccggcccacaggggcctcctggaccttcgggcgaggaggggaaacgcggacccaatggcgaagccgggagtgcgggcccccctggacccccagggttacggggtagcccgggttctagagggctgcccggcgccgatgggagggctggcgtcatgggtccaccaggctcaagaggcgccagcgggcctgccggcgtcagggggcctaatggcgacgcgggccgccccggggaacctggcctgatggggccacgcggcctgcccgggagcccaggaaacattggacctgcaggcaaagaaggacctgtgggtctgcccgggatcgatggccgacccggtcccatcggacccgccggtgctaggggggaaccgggaaacattggcttccccgggcccaagggccctactggggatcccggaaaaaacggggacaagggccacgcaggactcgccggtgccagaggcgcacccggccccgacggtaataatggcgctcagggacctccaggcccacagggggtccagggcgggaagggcgagcaaggccctcctggaccccccgggttccagggtttaccgggcccatccgggcctgccggggaagtcggcaagccaggggagcgcggtctgcacggcgaatttgggctgcccggacccgccggaccccgaggggagaggggtccaccaggggaaagcggagctgcgggacccacaggaccaatcgggtccaggggacccagcgggccacctggtccggacggcaataaaggagagcctggcgtcgtcggtgccgtgggtactgcagggccatcaggtccgtcgggtcttcctggagaacgaggcgccgccggcattcctggcggtaagggagagaaaggtgagcctggactacgcggggagattgggaatcctgggagagatggggctcgcggggccccaggagctgttggggctcccggtccagcgggcgctaccggagaccgaggtgaggcaggggctgccgggccagccggacccgccggtcctagggggtcccccggggagaggggcgaggttggccctgccggacctaacgggttcgccggccctgctggggccgcgggacagcctggagccaaaggcgagcgcggagctaagggcccaaagggtgaaaacggcgttgtgggtcctaccggtcccgtgggcgctgccgggcccgctgggcccaatggacctcccgggccagcaggaagccggggggacggtggcccccccggcatgactggtttccccggcgcagctggccggacaggtcctccgggtccttcggggatttcgggtccccctggaccacctggacctgccggaaaggaaggtctcagaggccccaggggcgaccagggcccagtgggccgtacaggtgaggtgggggccgtaggcccacccggatttgccggagaaaaaggcccaagtggggaggctggcacagcaggcccacccgggacgcccggtccccagggacttcttggtgcccctggtattctggggcttcccggtagtcgcggggaaagaggtttaccaggtgtggccggtgctgtcggcgagcccggacctctggggatcgctgggcctcccggtgcacgcggcccaccaggcgccgtgggcagccctggggtcaatggggcaccaggagaagcaggacgagatggaaatccaggcaacgatggtcccccagggcgtgatggccagcctggacacaagggtgagcgcggttacccaggtaatatcggacccgtgggggcggctggagcccccgggccccatgggcctgttggacccgccgggaaacatgggaaccgtggcgagacaggtccctcaggccccgttgggcctgccggcgccgttggccctagagggccatctggtccacagggcatcaggggggacaaaggcgagcccggagaaaagggcccccggggactgccggggctgaaaggccacaatggactgcaagggctgcctggtatagccggtcatcatggagaccagggagcccctgggtctgtcgggcctgcagggccacgcggccccgccggccctagcggacctgcggggaaagatgggaggactggccaccccggcacggttggccctgccggtattcggggtccgcagggccaccaaggccccgcagggcctccggggccgccaggaccaccgggtcctccaggcgtttctggggggggctacgactttggatacgacggcgacttctaccgtgccgaccagccaagatcagcaccttcccttcggcccaaagactatgaagttgatgccacattgaagagtctgaacaatcagatcgaaacactcttgacaccagagggcagtagaaagaatccagctagaacctgcagagacctgcggctcagccatcccgagtggtcatccgggtattattggattgatcccaaccagggatgcaccatggacgccattaaagtttactgcgatttttcaaccggagaaacctgtattcgcgcacagcccgaaaacatccctgctaaaaactggtaccgctctagcaaggacaagaaacatgtttggctgggagaaacaatcaatgccgggagccaattcgagtacaacgtagaaggagtgactagtaaggagatggcgactcagttagctttcatgaggcttctggctaactatgcctctcagaacatcacgtaccattgtaagaattccattgcgtacatggacgaggagaccggcaacctgaagaaggccgtcattctgcaggggagtaacgatgtggagttggtcgcagaagggaactctagatttacctacacagtcctcgtggatgggtgttcaaagaagacaaacgaatggggtaagactataatagaatataaaacaaacaagcccagccgcctgccgttcctcgacatcgccccactggacattggcggcgccgaccaggagttctttgttgacatcgggccggtgtgtttcaag

SEQ ID NO: 32526 - DNA, 4098 bp, Artificial Sequence
  Description of Artificial Sequence: Synthetic coding sequence
atgctcagttttgtcgataccaggactttgcttctactagcggttaccttatgtctcgctacttgtcaatcactgcaagaggagactgtgagaaaaggccccgccggcgaccgaggtcctcgaggtgagagaggacccccaggcccccctgggagggatggcgaggacgggcctacaggcccgcccggcccccccggcccccccggaccccctggcctagggggcaactttgcagcccagtacgatgggaaaggagttggcctgggccccggacccatggggcttatggggccacgtgggccaccgggcgccgcaggagccccgggcccacagggctttcaaggcccggccggagagccaggcgagccaggtcaaaccggacctgccggggctcgggggcccgctggaccacctggaaaggccggggaggacggtcaccctggcaagccaggtaggcccggtgagcgtggcgtggtcgggcctcaaggagcaagagggttcccaggcacacccgggctgccaggatttaagggaatcaggggacataatggcttggacggactgaaagggcagcctggggctcccggtgtaaagggggagccaggtgcacccggcgaaaatggtacgcccggacagaccggagccaggggcttaccaggcgaaagaggccgagtgggggcacctggcccagccggtgcccgcggctctgatggctccgtgggccctgttggacctgccggtccgattggatcagccggacctcctggtttcccaggagctccaggccccaaaggcgaaataggagccgttggcaacgcaggccccgcaggacccgcaggcccacgcggggaggttggtttacctggtctgagtggccctgtgggacccccgggcaatcccggcgccaacggcctgaccggagctaaaggggccgccggcctgccgggagttgccggagcccccgggctcccaggaccccgtggcataccaggtccagtaggagcggccggcgccaccggagcccgcggtctcgtgggagaaccgggacccgcaggttccaaaggtgagtcaggcaataagggagagccgggcagcgctgggccacagggacctccaggacccagcggagaagaaggcaaacgtggacccaatggagaggctggtagtgccggaccccctgggccaccgggtctgaggggctctccaggcagcagggggcttccaggggccgacggtagggctggcgttatgggcccccccggatctaggggggctagtggaccggcgggagtgcgagggccaaatggcgatgcaggccgacctggtgagcctgggctgatgggacctcgcggcctgcctggctcccccggcaacataggccccgctggtaaagagggccccgtggggttgcccggtattgatggtaggccagggcctattggtccggccggcgcccgaggggagcccgggaacattgggttccccggtcccaaaggccccaccggcgaccctggaaagaatggagataagggccatgcaggactggccggtgccaggggtgcccccggccccgatggcaataacggcgcacaggggcctccaggcccacagggagtgcagggtgggaagggagaacaagggccccccggcccacccgggttccaggggctccctggaccaagtggaccagccggcgaagtagggaaacctggggaacgcgggctgcacggtgaattcggactgcccggtcctgcggggccccggggtgaaagaggtccccctggggagtcgggtgcagccggtccaaccggaccaatcggctcacggggtccctcaggccctcctggcccagacggcaataaaggagaacctggtgtggtcggagctgtagggaccgccggtcccagtggcccttcagggctgccaggggagagaggcgccgccggaataccagggggtaagggcgaaaagggggaaccggggctgcgcggagagattggcaaccctgggagagatggcgctcggggggctcctggggctgtaggcgccccggggccagcaggggccaccggggaccgaggcgaagcgggtgccgccggtcctgctggccctgccggcccacggggaagcccaggagaacgtggagaggttggccccgcaggtcctaacggttttgctggccccgccggcgcagcaggacagccaggtgctaagggggagcggggcgctaagggtcccaaaggtgaaaacggggttgtgggccccaccgggccggtgggagctgcaggacctgccgggcccaacggcccgcctgggccggcaggatcccgcggggatggtgggccacctggaatgaccggctttcctggagccgcgggtcgcaccggcccccctggaccttcaggtatctctggtcccccaggtcctcctgggccggccggcaaggagggtctcaggggcccacgaggagatcagggaccagttggaaggacaggggaagtgggggctgttgggccacccggattcgctggagaaaagggcccttccggcgaagctgggactgctgggccgcccgggacaccgggcccgcaggggctgctgggcgcccctggtatcctcggacttcctggcagcaggggcgaacgcggccttcctggagttgctggagcagtgggcgaacctggtcctcttgggattgccgggccaccgggcgcccgaggcccccctggagccgtagggtcccctggagtgaatggcgctcccggagaggctggccgcgatggaaacccaggaaatgacggcccaccaggcagagatggccagcccggccataagggcgaaagaggttaccccggcaacatcggccctgtgggggctgccggcgcccccgggccccatggaccagtcgggccagccggcaagcacggaaatcggggggagaccggtcccagcggcccagtaggtccagccggcgcagtggggccaaggggacccagcggccctcaaggtatcaggggggataaaggagaaccaggcgagaaaggcccccgcggcctgccaggcttgaaagggcataacggcctgcagggcctccccggaatcgctggtcaccatggggaccaaggcgccccggggtccgtgggccccgccggccccagagggcctgccggaccaagcggtcccgcgggtaaagatggccggacaggacaccctggaaccgtaggaccggcaggtatacgcgggcctcaaggtcatcaggggcccgctgggccaccgggaccacctgggccacccggacctccaggggtgagtggtggcgggtatgactttggatatgacggggatttctaccgggctgaccagcctcgctcagccccctctctgagacctaaggactatgaggtggatgctacactgaagtccctgaataatcagattgaaactctgttgacccccgagggaagtcggaaaaatccggctcgaacatgtagggatttgaggttgtcacatcctgagtggtcctccgggtactactggatcgacccaaaccagggatgcaccatggacgccataaaggtgtactgcgacttctctactggggagacatgtataagggctcaacctgagaatatccctgcaaagaactggtatagatcgagcaaggacaagaagcatgtctggttgggcgaaaccataaacgccgggtcccagttcgagtacaatgtggagggagtaacgtccaaggaaatggcaactcaactggcgtttatgaggttactggcaaattacgcttcccagaacattacataccactgcaagaactccatagcatatatggatgaggaaacaggaaatctgaagaaggcagtgatcctccagggatcaaacgacgtagaactggttgcggagggcaatagtcggttcacctatacggtcttggtggatggctgttccaagaagacgaatgagtgggggaaaactatcatagaatacaagaccaataaaccatctagactgccatttctagacattgcccccctggacatcgggggcgctgatcaggagttttttgttgatattggccctgtgtgttttaaa

SEQ ID NO: 32527 - DNA, 4098 bp, Artificial Sequence
  Description of Artificial Sequence: Synthetic coding sequence
atgctgtcctttgtcgacactcgtacgctgctgcttcttgcggtgactctgtgtctggccacctgtcaatcgctgcaggaggagacggtgcggaagggtccagctggtgatcgcggccctaggggagaacgcggaccgcctggacctccgggtcgcgacggcgaggacgggcctaccgggcctcctggtcctcccggcccccctggtccacctggactgggaggcaactttgcagctcagtacgatggtaagggagtgggtctgggacctggtccaatgggacttatgggacccagaggcccaccaggcgccgccggtgcacctgggccgcagggatttcaagggccagcaggtgagcctggcgagcccggacagaccgggcctgccggtgcaagaggaccagcgggaccaccgggaaaagcaggagaggacggccatccaggaaaacccgggcggcccggcgaacgcggcgtggtgggcccgcaaggggcaagagggtttccgggtaccccaggactccccggttttaagggaatcagaggccacaatgggcttgatgggcttaagggacagcccggcgcccccggggttaagggagaaccgggagcacctggcgaaaacggtacccctggacaaaccggagctcgtggtctgcctggcgaacgcggccgggtgggagcgccaggaccagctggggctcgaggaagcgatggctccgtgggtcccgtcggcccagcaggccctattgggtcggcaggcccgcctggatttcctggagctcccggacctaagggtgaaattggagcggtcggcaatgctggtccagcaggaccggcaggaccacgcggcgaggtggggctgcccgggttgagcggaccagtgggaccgccaggtaaccctggggcaaacggccttacgggggccaaaggagcagccggtctgcctggggtggcaggcgcacctggcctccctggacctcgtggcattcctgggccagtcggggcagctggagcaactggtgccagaggacttgtcggagaacctggaccagcaggttccaagggagaatcaggaaataagggcgaaccaggatccgccggcccacaaggtcctcctggaccatcaggcgaagaaggaaagagaggtcctaacggagaagctggcagcgcgggacctcctggaccccccggtttgagaggctcacctgggtcgagagggctcccgggagctgatggacgtgccggcgttatgggaccgccaggatcgagaggagcgagcggtcctgctggagtgaggggaccaaacggggacgcggggcgtcctggtgaaccgggtctgatgggacctcgaggccttcctggatcaccgggcaacatcggaccagcaggtaaggaaggaccagtggggctgccaggcatcgatggtcgcccggggcccatcggtccagcgggcgcacgcggcgaacccggcaacattgggtttcctggtccaaaaggacctaccggcgatcccggtaagaacggagataaagggcacgcaggtctggcgggagccagaggtgcccctggaccagatggcaacaatggtgcccaggggccaccaggacctcaaggcgtgcaaggaggcaaaggtgaacaaggacctccgggcccacctggatttcagggactccccggaccctcgggaccagcaggagaagtcgggaagccgggagaacgagggttgcacggagaattcggtttgccgggacctgccggaccaaggggtgagcgtgggccaccaggagagagcggagcagcaggcccaaccggacccattgggtcccggggacctagcggtccacccggccctgacggcaacaagggtgaaccaggagttgtcggagctgtgggtactgcaggtccttccggcccgagcgggcttcctggtgaacgcggagcagcgggtattcctggcggaaagggagaaaagggtgagcctgggctgcgtggcgaaattggaaatccaggacgagatggagcacggggtgccccaggagcagtgggtgcacctggacccgctggtgcaactggcgataggggagaagcgggcgccgcaggccctgccggcccagcgggaccacgaggttcacctggtgaaaggggtgaggtgggtccagccggaccaaacggattcgctggtcctgctggagccgcaggacagcccggagccaaaggcgagcgtggtgcgaagggacccaagggagaaaacggggtcgtgggtcctaccggccccgtgggcgcagcaggtccagcaggccctaacggccctcccggtcctgccggatctcgcggagatggtggaccaccaggcatgactggatttcccggtgccgccggaagaaccggcccaccaggcccttccggcatatcaggaccacccggtccaccagggccggcgggaaaggagggtctgcggggacctcggggagatcaagggcctgtcggtaggactggtgaggtgggggcggtggggccgccgggatttgcgggggagaagggcccttcgggcgaagccggtactgcagggccacctggtacccctggtccacaaggactgcttggagcgcctggtatacttggactgcctggttcgcggggggagcggggccttccgggtgttgcaggggcagtgggagaacctggacctttgggtattgcaggtccgccaggcgcaagaggaccccccggagccgtgggatcgcctggagtcaacggcgcaccaggtgaagcagggagggacggaaatcccggtaacgatggtcctcccggacgagatggccagcctggtcataagggcgaacgcggataccccggtaacataggacctgtcggagcagcaggggcacctggccctcatgggcccgtggggcctgctgggaagcacggcaaccgaggtgaaaccgggccttctgggccggtgggtccagcgggcgcagtggggcctcggggtccctccggaccgcaaggtatcaggggcgacaaaggtgaacccggagaaaaaggaccgcgtgggctgcctggattgaaaggtcataatgggctccaaggattgcccggaatagccggacatcacggcgaccaaggggcgcctggttcagtgggccctgccgggccacggggcccggcaggtccttcgggtccagcaggaaaggatggacgaaccggtcatccaggtaccgttggcccagcaggtatacggggtccacaaggacatcagggcccagcaggaccacccggcccacccggacctccgggaccacccggtgtgtcggggggtggatacgatttcgggtacgacggcgacttctacagagcggatcagccacggtccgctccctcccttagaccaaaggactacgaagttgacgcaactctgaagtcccttaacaaccaaattgaaactctcctcactccagaaggctcccggaagaacccggcacggacgtgcagagatcttaggctctcgcatcctgagtggagctcgggatactattggattgatcctaaccagggctgtacgatggatgccattaaggtgtactgtgatttttccactggcgaaacttgcataagagcacaaccggaaaacattccggcaaagaattggtaccggtcgtccaaagacaagaaacatgtgtggttgggagagactatcaatgccggtagccaattcgaatacaatgtggaaggagtgacctcgaaggagatggcgacccagctcgcattcatgcgcttgcttgccaattacgcctcccaaaacattacttatcactgtaaaaactcgatcgcatacatggatgaagagacgggtaaccttaagaaggcagtcattctgcaagggtcaaacgacgtcgagcttgtcgcagagggtaattcgaggttcacttacaccgtgctggtcgatggttgttcgaaaaagactaatgagtggggcaagacgattattgaatacaagaccaataagccctcacgccttccttttcttgacattgcacctctggatataggtggtgcggatcaggaattctttgtggacatagggcctgtctgcttcaag

SEQ ID NO: 32528 - DNA, 1434 bp, Artificial Sequence
  Description of Artificial Sequence: Synthetic coding sequence
atggacaggagtttgggatggcagggcaacagtgtccccgaagatagaaccgaggccggcattaaacgattcctagaggataccactgatgatggcgaattgtcaaaattcgtcaaggacttttctggaaacgcgtcctgtcaccccccggaggctaaaacctgggccagtaggccgcaggtgccagagccccggcctcaggcgccagacctctacgacgacgatcttgaattccgcccacctagtcggccacagtcatctgacaatcagcagtatttttgtgcacctgctccactttcaccttcggcccggcctaggtcaccttggggcaaactggatccctatgattcaagtgaagacgacaaagaatacgtgggcttcgccacgctgccaaatcaagtccatcgtaagagcgtgaagaagggcttcgattttacactcatggtggccggggaaagtggcctgggaaaatctactctcgttaattctttgtttctgactgacctgtaccgagacagaaaactgctcggggccgaggagaggattatgcagacagtggaaattacaaagcacgcggtggacatagaggaaaagggggtgaggttgcgtttgactatcgtcgatactcctgggttcggcgacgcagtcaataacactgaatgttggaaacccgttgctgaatatattgaccaacagttcgagcagtattttagagacgaatccggactgaacaggaagaacatccaggataacagagtgcattgttgcctctatttcattagtccctttggccatggactgcggcccctagatgttgaattcatgaaagcccttcaccagagggtaaacatcgtgcctattttggctaaagcagacactctaactccaccagaggtcgatcataaaaagaggaagattagagaggagattgagcactttggcatcaagatctaccagttcccagattgcgatagcgatgaagatgaggatttcaagctgcaggatcaggcattgaaagagagtattccttttgcagtgataggttccaacaccgtggtagaggctcgcggaaggcgggtgaggggtaggctgtacccttggggtatagtggaagtcgaaaacccaggccactgcgactttgtcaagctcagaacaatgctggttcgtacccacatgcaggaccttaaagacgtaacgcgggaaactcattacgagaactacagagcgcagtgcatccagtcaatgacaaggctcgtggtcaaagaacgaaacagaaacaaactcactagggagtctggtacggattttccaattcccgcagtgccccccggtacagaccccgaaaccgaaaaactcatccgggagaaggatgaagaactgagacggatgcaggagatgctccacaaaatccagaaacagatgaaagaaaactat

SEQ ID NO: 32529 - DNA, 1434 bp, Artificial Sequence
  Description of Artificial Sequence: Synthetic coding sequence
atggaccggtccttgggctggcaggggaacagcgtgcctgaagaccggaccgaggccgggatcaagaggttcctggaagacactacagacgatggcgagcttagcaagttcgtcaaggacttctcagggaatgcgagttgccaccctcccgaggcaaaaacatgggcttcaaggccccaggtgcctgagcctcgcccacaagcccccgatctgtatgatgacgatcttgagttccggccaccctcaaggccgcagagctcagataaccagcagtacttctgcgcccccgcccccctgagtccctctgctcgtcccagatccccttgggggaagctggacccatacgattcctcagaagacgacaaggaatacgtcggatttgcaactctgcccaaccaggtacatcggaagagtgtcaaaaaagggtttgatttcaccctgatggtcgcaggggaatctggactgggcaaatccacactcgttaattccctcttcctgacggacttgtatagagacagaaagctgctgggcgcagaggaacggatcatgcagaccgttgagatcactaaacacgctgtcgacattgaggagaagggggtaagacttcgtctgactattgtggacactcctggtttcggcgacgccgtaaataatacagagtgctggaagcccgtggcggaatacattgatcaacagtttgagcaatatttccgggacgaatcgggcctcaaccggaaaaatatccaggacaatcgtgtgcactgttgcctgtatttcatctctcctttcggacatggtctgagaccactggatgtagagttcatgaaggctttacaccagagggtaaacatcgtccccatcctggccaaagctgacactcttacgcctcctgaagttgaccacaagaagcgcaaaattagagaagagatcgagcattttggtattaagatttatcagttccctgattgcgatagtgacgaggatgaagatttcaagttgcaggaccaggccctaaaggaaagtatacccttcgcagtcattgggtctaacacagtcgtagaggccaggggaagaagagtccggggacgcctttacccctgggggatcgtcgaagtagagaaccctggacactgcgattttgtaaagctgaggacaatgctagttcgcacccacatgcaggacctgaaagatgtcaccagagagacccactacgagaattatcgggcccagtgcatccagtccatgactcgacttgtagtgaaggaaaggaacaggaacaagctgacacgagaaagtggaaccgattttcctatccccgccgttccacccggtacagatcctgaaacagaaaagcttattcgcgaaaaagacgaggagctcagacgtatgcaggagatgctgcacaagattcagaagcagatgaaggagaattac

SEQ ID NO: 32530 - DNA, 1434 bp, Artificial Sequence
  Description of Artificial Sequence: Synthetic coding sequence
atggaccgaagcctgggctggcagggcaactccgtgcccgaagacagaacagaagcaggaattaaaagattcctagaggacactactgatgacggggaactctcgaagtttgtgaaggactttagcgggaacgctagttgtcatccacctgaagcaaagacctgggcctccagaccacaagtgcctgagccccggcctcaggcgcctgatttatatgatgatgatcttgagtttaggcctcctagtcgccctcagtcttctgacaaccaacagtatttctgcgcccccgcacccctgagtcccagtgctagaccccgatccccatggggaaagctggatccatatgacagtagtgaggacgataaggagtacgtcggtttcgctacgcttcccaatcaggtgcaccgcaagagcgtaaagaagggcttcgactttacactaatggttgccggggaaagcggtctagggaaatccaccctagtgaactctcttttcctaaccgatctgtaccgggacagaaagctgctcggagccgaggaacgtattatgcagaccgtggagatcacaaaacacgccgtggacatagaagaaaaaggcgtgcggctccggctgacaattgtcgacacaccggggttcggcgatgctgtgaataacactgagtgctggaagcccgtcgccgagtacatcgaccagcaattcgaacagtacttcagggatgaaagcgggctcaaccgcaaaaacattcaggataaccgggtgcactgttgcctctactttatctcaccgttcggtcatgggctgagacccttggacgtcgagtttatgaaggctctacaccagcgggtcaacatcgtgcccatcttggcaaaggccgatacgcttaccccccccgaggtggatcacaaaaaaagaaagattcgagaggagattgaacattttggaatcaagatttatcagttccccgattgtgacagcgatgaggacgaagacttcaaactccaagaccaagccttaaaggagagcattcccttcgccgtgattggcagcaacacggtggtggaagccaggggaagacgcgttaggggcaggctatacccttggggtatagtggaggtcgaaaatccaggccactgcgatttcgtcaagcttcggaccatgctagtccgcacccatatgcaagacctcaaggacgtgactagagaaacgcactacgagaattaccgcgcccagtgcattcagtcgatgacaaggctggtggtgaaggaaaggaacaggaataaactcacacgagagtcaggtacagactttccaattcccgcagtgccaccagggaccgaccccgaaactgagaagctgatccgtgaaaaggacgaggagctgaggcggatgcaagagatgcttcacaaaatccagaagcaaatgaaagaaaactat

SEQ ID NO: 32531 - DNA, 1434 bp, Artificial Sequence
  Description of Artificial Sequence: Synthetic coding sequence
atggatcggtcgctggggtggcagggcaactcggtgcctgaggatagaaccgaagcaggaattaagagattcctcgaagatactaccgatgatggcgaactgtcaaaattcgtgaaggacttttcgggtaacgctagctgtcaccctccggaagcaaaaacctgggcctcgcgtcctcaagtgcctgaaccaagaccccaggcacccgatctctacgatgatgatcttgagttcagacctcctagccgtccacaatcgtccgataaccagcagtacttttgtgcaccagccccgctctccccttccgccagacctcgttcaccttggggaaaacttgatccatacgattccagcgaagatgacaaggaatacgtgggctttgcaactctgcctaaccaggtgcaccggaagtccgtcaagaagggttttgattttaccctgatggtggcaggtgaaagcggacttggaaagagcactctcgtcaactcgctctttctcaccgacctgtaccgtgatagaaaattgctgggcgccgaggagcgcatcatgcaaaccgtggagattaccaagcatgcagtcgatatcgaggaaaagggagtgcggttgcggcttactatcgtcgacacccctggattcggcgacgctgtgaacaacacggagtgctggaagccagtggccgagtacatcgaccagcagtttgaacagtactttcgtgatgaatcagggctcaatcgtaagaacatacaagataatagggtgcattgttgtttgtactttatctcgccctttggtcatggattgcgacctttggatgtggaattcatgaaagcacttcaccagcgtgttaacatagtcccaatcctggcgaaggccgatacccttaccccaccagaagttgaccataagaagcgcaaaattcgggaagagattgaacatttcggaattaagatttaccaatttccggattgtgattctgatgaagatgaggactttaagctgcaggatcaagcactcaaggaatcgatcccatttgcagtcatcggatccaacactgtcgtggaagcaagaggtcgacgcgtgagaggacgcctttacccatgggggattgtcgaggtggaaaacccagggcattgtgactttgtcaagctcagaaccatgcttgtccggacccacatgcaggatctgaaggacgtgaccagagagactcattacgaaaactaccgagcccaatgcattcagtccatgactcgcttggtcgtgaaggagcgtaacaggaataaacttactagggaatcagggaccgactttcctattcctgcagtgcccccaggaaccgatccagaaaccgagaagttgattcgggagaaagatgaggaactgcgccgaatgcaagagatgctgcataagatacagaagcagatgaaagaaaactac

SEQ ID NO: 32532 - DNA, 1434 bp, Artificial Sequence
  Description of Artificial Sequence: Synthetic coding sequence
atggatagatccctgggatggcagggcaactccgttcctgaagacaggaccgaggcgggtataaagaggttcctggaggatacgacagatgacggggaactgtccaaatttgtaaaagacttcagcggtaatgctagttgccatccaccagaggcgaagacctgggccagccgcccacaagttccagaaccccggccacaggctcctgatctgtatgacgatgacctggagttccgccccccgtcccgtcctcagagttccgacaaccagcagtacttttgcgccccagcacctctttccccatccgcccgccctagatctccgtggggtaagctcgatccttacgatagttcagaggacgacaaagaatatgtgggctttgctacgctgcctaatcaagtccataggaagtctgtcaagaagggctttgacttcactttaatggtggccggtgaatctggtctagggaagtccaccttagttaatagcttattcttaaccgacctgtatcgagaccgtaaactcctgggggctgaagagcgcatcatgcaaactgtagagataaccaagcatgctgttgacattgaagagaaaggggtaaggctgcggcttaccatagtagacactccaggcttcggggacgctgttaataatactgaatgctggaagcccgtggcggaatacatagaccagcagtttgagcaatattttcgggacgaaagcggactgaacaggaagaacatccaagacaatagagtccattgctgtctgtattttatcagcccctttggccacggactgaggccgctcgacgtggagtttatgaaggccttacaccagcgagtaaacatcgtgccgatcctcgccaaagccgacacattgactcctcctgaggtagaccacaaaaaacgaaaaattcgtgaagaaattgagcacttcggaatcaaaatttaccagtttcccgactgtgatagcgacgaggacgaggactttaagctacaggaccaggcgcttaaggagagcatcccttttgcagtaatagggagtaatactgtggtggaagcaagaggacgcagggttagagggagactctatccatggggcattgtcgaggtggagaatcccggacattgtgactttgtgaaacttcggacaatgctggttagaactcatatgcaggatctgaaggacgtaaccagagaaactcactatgagaactaccgcgctcagtgcatccagtcaatgacccggctggtggtaaaggagcggaaccggaacaaactgacccgggagtcagggaccgactttccgattcctgcagtcccacctgggaccgatcctgaaaccgaaaagctgatccgcgaaaaggatgaggagttgaggaggatgcaggagatgctgcacaaaatacagaaacagatgaaggagaattac

SEQ ID NO: 32533 - DNA, 1434 bp, Artificial Sequence
  Description of Artificial Sequence: Synthetic coding sequence
atggaccggtctcttggatggcagggaaactctgtgccggaggatcgaacggaggcgggcattaaaaggttcctcgaagacactacagatgacggagaattgtctaaatttgtgaaggatttcagcgggaatgcttcgtgccacccgccggaggctaaaacatgggcgagtcgccctcaggtccctgaacccagacctcaggcccctgatctctatgatgacgacctcgaattcagacccccttcacgcccacagtctagcgacaatcaacagtacttttgtgctcccgccccacttagcccgagtgctagacctcgatcaccatgggggaaacttgacccatatgactcctccgaggacgataaagagtacgtcggcttcgctacactgcctaatcaggttcatcgaaagtctgtgaaaaagggctttgatttcactttgatggttgccggcgaatctgggctcggcaagtccacactggttaattcgctgtttctcacagacctgtatagggaccggaagttgcttggcgccgaagaaagaataatgcagacagttgagattaccaagcatgcagtggatatagaagaaaaaggtgtccggctccggctcacgattgttgacactcccggttttggcgatgcagtgaacaatactgaatgttggaaaccagtcgccgagtacattgatcagcagttcgaacagtatttcagagatgaatcaggccttaataggaagaatattcaggataacagggtccattgttgcctctactttattagcccgttcggccacggcttaagacccctggatgtcgaatttatgaaagccctgcatcagcgtgtgaatatagtaccaatactcgcgaaggcagatacactgactccccccgaggttgaccataagaaacgcaaaatccgggaagagatcgagcacttcggaattaagatctatcagtttccggactgcgactccgacgaggatgaagacttcaagctccaggatcaagccctcaaggaaagtataccttttgccgttatcggctctaacactgtcgttgaagcccgcggccgccgggtgcgtgggcggctgtacccttggggaatcgtggaggtggagaaccccggacactgcgactttgttaagctcaggacaatgttggtgcgaactcacatgcaggacctcaaggacgtgacgagagagacccattacgaaaattatcgggctcagtgtatacagagcatgactagactcgtggtgaaggagcggaatcggaacaagttaacccgggaaagcgggaccgatttccccatcccagcggtgcctcccggaactgatcctgagacagagaaactgattcgtgagaaggacgaggaactcaggaggatgcaggagatgctgcacaaaattcagaagcagatgaaagagaattat

SEQ ID NO: 32534 - DNA, 1434 bp, Artificial Sequence
  Description of Artificial Sequence: Synthetic coding sequence
atggaccgatccctgggatggcagggaaatagcgtgcccgaggaccggactgaggccggaatcaagcgctttcttgaggacacaacagacgatggcgagttgagcaagttcgtcaaggacttttctggaaatgcaagttgtcaccccccggaggctaaaacttgggccagcagaccacaggtgcctgagccccgaccccaggcccccgatctctacgacgacgacttggagttcaggcctcctagccgcccccagtcgagcgacaatcagcaatacttctgcgccccagcccctctgagcccatccgctcgaccacgttccccctggggaaagctggacccttatgactcctcggaagatgacaaggaatatgtgggcttcgctaccctgccaaatcaggtgcataggaagtccgtgaaaaagggattcgatttcacactgatggtggcaggagagagtggccttggcaagtccaccctcgtgaattccctgtttttgaccgacctttatagagaccgcaagctactgggcgcagaagaaaggattatgcagacagtggaaattaccaagcacgcggtcgacatcgaggagaaaggcgtacgtctgagactcacaattgtggacacccctggtttcggcgacgccgtgaacaacacggagtgttggaagccggttgccgagtatatagaccagcagtttgagcaatatttccgagacgaaagtggactaaatcgaaagaacattcaagacaaccgtgttcattgctgtttatatttcatatccccattcgggcatgggctgcgcccccttgatgttgagtttatgaaggcccttcatcagcgagttaacatagtccccatactggcgaaagcggacactctgactccacccgaggtggatcataagaaaaggaagatcagggaagagattgaacacttcggtataaagatttatcagtttcccgattgtgacagcgacgaggatgaagactttaagttgcaggatcaagctctgaaagaaagtatccctttcgcggtcattggaagcaacacagttgtagaagctagaggaagaagagtccgagggagactctatccttggggaatcgtggaggtggagaatcccggccactgtgattttgtgaaactccgaactatgttggtacggactcacatgcaggacctgaaggacgtcacaagagaaactcactacgaaaactatagagcgcagtgcattcaaagcatgactaggctagtggtgaaagaaagaaaccgaaacaaacttacgagggagagcggtacagattttcccatccctgcagtgcctccaggaacggaccccgagaccgagaaacttatccgagagaaagacgaggaactgaggagaatgcaagagatgctccacaagatccagaagcagatgaaagaaaactac

SEQ ID NO: 32535 - DNA, 1434 bp, Artificial Sequence
  Description of Artificial Sequence: Synthetic coding sequence
atggaccgctcgctgggttggcagggaaactcggtgcctgaggatcgtactgaggccggcatcaagcgctttctggaggataccactgacgacggtgaactgagcaaatttgtgaaagatttttcaggcaatgctagttgtcatccgcccgaagccaagacctgggcgagcagaccgcaagtgccagagccgcgccctcaggcccctgacctttacgacgacgacctggagtttcgcccaccgtctaggccacagtcaagtgataatcagcagtacttttgtgcgccagctccactctcgccgagtgcgcgcccgcggtccccgtggggaaaactggatccgtacgactcctcggaagatgacaaggaatacgtggggttcgctactctgccaaaccaagtgcacaggaaatcagtcaagaaggggttcgacttcacgctcatggtggcgggggaatctggactgggcaagtcgaccctcgttaattccctgttcctgaccgacctctatagagatcggaaactgctgggcgctgaggagagaatcatgcagactgtggaaatcactaaacacgcagtggacatcgaggagaagggagtgcggctccgcctgaccattgtggatacccccggcttcggggacgccgtgaacaacactgaatgctggaagccggtcgcggaatacatcgaccagcagttcgaacagtacttccgggacgaaagcggattgaatcgaaagaacatccaagataaccgagtgcactgctgcctgtacttcattagccctttcggacacggactgcggccgcttgatgttgaattcatgaaggccttgcaccagcgcgtgaatatcgtcccgattctggcaaaggcagataccttgactccccccgaggtcgaccataagaagagaaagatcagggaagagatcgagcatttcggtatcaaaatctaccagttcccggattgcgattccgatgaggacgaggacttcaaactgcaggaccaagcccttaaggagtcgataccatttgccgtaatcggttcgaacaccgttgtggaagcacgcggaaggcgcgtccggggacggttgtatccttggggcatcgtggaggtcgagaatcctggacattgcgacttcgtgaagttgaggaccatgctggtccgcacgcacatgcaagatcttaaagacgtgacccgcgaaactcactacgagaactaccgcgcgcagtgcatccaatcgatgactaggctggttgttaaggaacggaaccgcaataaacttactagggaaagcggaacggacttccctatccccgccgtgcctccgggaactgatccggaaaccgaaaagctgattcgggaaaaggacgaggaactcagaagaatgcaagaaatgctgcataagatccaaaagcagatgaaggagaactac

SEQ ID NO: 32536 - DNA, 1434 bp, Artificial Sequence
  Description of Artificial Sequence: Synthetic coding sequence
atggatcggagtctgggatggcaggggaattctgtccctgaagatcgcacggaagccggtattaagaggttcctagaggacacgacggatgatggcgaactgtctaagttcgtcaaagattttagcggcaatgcttcttgccatcctcccgaagcaaaaacatgggcgtcacggccgcaagttccagaacctagaccgcaagcacctgacctttacgatgacgatctcgaatttcggccgccgtctagaccgcagtcatccgataaccaacaatatttttgtgcaccggcccctctttcaccttcggctcgtcctcgttccccgtggggaaagctggatccctatgacagctccgaagatgataaagaatacgtcggatttgccaccttgccaaaccaagtgcataggaaatccgtgaaaaaaggttttgacttcacgctgatggttgcaggagagtcaggtcttggaaaatccacgctggtaaatagtttgtttttaacggacctgtatagggatcgcaagttattaggcgcggaggagcgtatcatgcaaacggtcgaaatcacaaagcatgcggtcgatatcgaagaaaaaggcgtcagactgcgcttaactattgttgatacacctggctttggcgatgcggtcaacaacaccgagtgttggaaacctgtggctgaatatattgatcagcaattcgaacaatatttccgggacgaatctgggctaaaccgtaaaaatatacaggataatcgagtgcattgttgcttatactttatttcaccgtttggacacggtttacggcctttagatgttgaatttatgaaagcgcttcatcaacgggtgaatattgtgcctattttagcgaaagccgatacgctgacaccgccagaggttgatcataaaaagagaaaaatcagggaagaaatagaacacttcggaatcaaaatttaccaattcccggattgcgattcagatgaggacgaggatttcaaactacaggatcaggcgctcaaggaatcgatcccgtttgcagtaatcgggagtaacactgtggtagaagcacgggggagacgcgttagagggagattatacccttggggtattgttgaagtagagaatccaggacactgcgattttgtcaaattgcggacgatgctggtccgtactcatatgcaggatctgaaagacgtaacccgtgaaactcactacgaaaattatcgtgcccagtgtattcagagtatgacacggctggtagtcaaagagagaaacagaaataaattgacgagagaatctggcacggattttcctattccggccgtacctccgggtactgaccctgagactgagaagttgatccgggaaaaagatgaagagttgcggcgcatgcaggaaatgctgcataagattcaaaagcagatgaaagaaaattat

SEQ ID NO: 32537 - DNA, 1434 bp, Artificial Sequence
  Description of Artificial Sequence: Synthetic coding sequence
atggaccggagcctcgggtggcagggaaactcagtgcccgaagacaggacggaggcaggcatcaagagatttctcgaggacactacagatgatggagagctttctaagtttgtaaaagactttagtggtaatgcatcctgccacccacctgaagctaagacttgggccagtcgtcctcaggtacccgaaccaaggccccaggcacctgatctttacgacgacgacctggaattccgaccaccgtcccgtcctcaaagctctgacaaccagcagtacttttgcgcccctgcacccctgtctcctagtgccagaccacggtcaccctggggcaagctagatccttatgacagttccgaagatgacaaggagtacgtgggtttcgccacgttgccgaatcaagtccacaggaaatctgtcaagaaggggtttgatttcacattgatggtggccggcgagtccggactggggaagagcactctcgtgaattcactgttcttgaccgacctgtatagggacagaaagctcctaggagccgaagaaagaattatgcagactgtcgaaatcaccaaacatgccgttgatattgaagaaaagggtgtgcggctgcgtctgacaattgtcgatacgcctggctttggagacgctgtgaacaacacggaatgctggaagcccgttgccgagtatatcgatcagcagttcgagcaatactttcgtgacgagtctggcctgaatcgaaagaatattcaggacaatagagtgcattgttgcttatactttatcagcccatttggtcacggccttcgccctttggacgtggagttcatgaaggctctccaccagagagtcaatattgtacccatcttggccaaagcagatacactgactcctcctgaagtcgatcacaaaaaacgaaagatcagggaagaaatcgaacacttcggaattaagatctaccaattcccagattgcgattctgatgaggacgaggattttaaattacaggatcaggccctgaaggagagtattcctttcgctgtgatcgggtccaatacagtggtggaggcgagaggtcgtcgagtcagggggcgtttgtatccctggggaatcgtggaggtggagaaccctggtcactgcgactttgtgaagctgaggacaatgctggtgcgtactcacatgcaggatttgaaggatgttactagggagacgcactatgagaattaccgcgctcagtgcattcagtctatgacgagactggtggtaaaggagaggaaccgcaacaagctgacgcgcgaaagtggaacagacttccctatccccgctgtgcccccgggcaccgaccctgagaccgaaaagcttattcgcgaaaaggacgaagaactccgtaggatgcaggagatgttgcataaaatccaaaagcaaatgaaagagaattat

SEQ ID NO: 32538 - DNA, 1434 bp, Artificial Sequence
  Description of Artificial Sequence: Synthetic coding sequence
atggacaggagcctgggctggcagggaaattctgttcccgaagaccggactgaagctggaattaagcggtttttggaagataccaccgatgatggggagttaagtaaatttgtgaaggacttctccggcaacgccagttgtcacccacctgaagctaaaacatgggcaagtcgccctcaggtcccagaaccccgaccacaggcccctgacctctacgatgacgatcttgagttccggccaccaagtcggccccagtctagcgacaaccaacaatacttttgtgcacccgctcctctcagccccagcgcaagaccacgcagtccttggggcaaactcgacccttacgatagctctgaagacgacaaagaatatgtgggcttcgccactcttcccaatcaggttcaccgaaaatcagtcaagaagggcttcgacttcaccctgatggtggctggggagtccggcctcggaaagagcacactggttaatagcctgtttctcaccgatctgtaccgagatagaaaactgctgggcgcagaagaaagaattatgcagactgtggaaatcacaaaacatgccgtggacatagaggaaaagggtgtcaggctgcgactgacaatagttgacacaccaggatttggtgatgcagttaataatactgagtgctggaagccagtcgcagaatatattgatcagcaattcgaacagtacttcagagacgaaagcggcttaaacagaaagaatatacaggataaccgggtgcattgttgcttatacttcataagcccctttgggcatggtttgaggccactggacgtggaattcatgaaggctctccatcagcgggtgaacatagtgcccatactggccaaggcagacactctgaccccccccgaggtggatcataagaaacgcaaaatccgtgaagagatcgaacacttcgggatcaaaatttatcagttccctgactgtgattccgacgaggacgaagattttaagctacaagatcaggcactaaaggagagtattccattcgctgtcattggatctaatactgtggtggaagcaagaggccgaagagtgcgcgggaggctctacccctggggtatcgttgaggtagaaaacccagggcattgtgactttgtcaagctccgcacaatgctcgtgcggacccacatgcaggatctcaaagatgtgacccgcgaaacacactacgagaactaccgggcacagtgtattcagtccatgacacgtctggtggtgaaggaacggaatcgaaataagctgacccgggaaagtggcactgatttcccaattcccgctgttccacctggcactgatccagagacagaaaaactgatacgcgagaaagacgaggaactgcggcgcatgcaagaaatgttgcataaaattcagaaacaaatgaaagaaaactat

SEQ ID NO: 32539 - DNA, 1434 bp, Artificial Sequence
  Description of Artificial Sequence: Synthetic coding sequence
atggatagaagcctgggatggcaaggaaactccgtgccggaagatcggacggaagctggcatcaagcgctttttggaggataccactgacgacggcgagctgtcgaaattcgtgaaggactttagcggaaatgcatcatgccatcctccggaggccaagacttgggcatcacgtccgcaagtgccggaaccacgccctcaggccccggatctttacgatgatgacctcgagttccgcccaccgagccggccacagagcagtgataatcagcagtatttctgcgctccagcgccactgtcaccatccgcgcgcccccgctcaccttggggcaagctcgatccctacgattcgtccgaggacgacaaagaatacgtgggtttcgcgactttgccaaaccaagtccacaggaagtccgtcaaaaagggattcgatttcacccttatggtggcaggggagtcgggcctcgggaaatcaactctcgttaattccctcttcctgaccgacctctaccgcgacagaaagctcctgggggcggaggagcgtatcatgcagacggtggaaattaccaagcacgccgtcgacattgaagaaaagggtgttcgcctgcgattgaccattgtggacacgccgggctttggagacgccgttaacaataccgaatgctggaagcctgtcgcggagtacatcgatcaacagtttgaacaatacttcagagacgaatcgggcctcaaccgcaagaacatccaggacaatagagtgcactgctgcctgtacttcatctccccgttcggacatggactccgaccgctggatgtagagttcatgaaagcactgcaccagagagtgaatatagtgccgatcctggccaaagctgacactctgactcctcccgaagtggaccacaaaaagagaaaaatccgcgaagagatcgagcattttggaataaagatctatcaattccctgactgcgactctgatgaagatgaggatttcaagctgcaggaccaggcccttaaagaatcaatccccttcgcagtcattggcagcaacaccgtagtggaagcccggggacgcagagtgaggggaagattgtacccgtgggggatcgtggaggttgagaacccaggacactgtgactttgtgaagctccgcactatgctggttagaactcatatgcaagacctcaaggatgtcacccgagaaacccattacgaaaactaccgagcccagtgtatccaatctatgaccagactggtcgtgaaagaacgcaatcggaacaagctgacccgggagtccggcaccgacttcccaatccccgcggtccccccgggtaccgacccggagactgagaagctgatccgggaaaaggacgaggagctgaggcgtatgcaggaaatgctccacaagatccagaagcaaatgaaggaaaactac

SEQ ID NO: 32540 - DNA, 1434 bp, Artificial Sequence
  Description of Artificial Sequence: Synthetic coding sequence
atggaccgatccttgggttggcaaggaaacagcgtgcctgaagaccgaaccgaagctggaataaagcggtttctggaagatacgacagacgatggcgaactgtccaagtttgtgaaggacttctcaggtaacgctagttgccacccccccgaggcaaaaacctgggcatccagacctcaagttccggagcctaggcctcaggcccctgacctgtatgacgatgacctggagtttaggcccccaagcaggccccaatcctctgacaatcaacagtatttttgtgcccccgcccctttgagcccatcggcccgacctcgcagcccctgggggaagctggacccgtacgacagctcagaagatgataaagagtacgttgggttcgctaccttacctaaccaggtccatcgcaagtccgtcaaaaagggctttgattttacactcatggtggctggagagagcggcctggggaaaagtaccctggtgaatagcttgtttctgactgatctatatagggaccgtaagctgctgggagccgaggaacggattatgcagactgtcgagataacaaagcatgccgttgatattgaagagaagggggttaggctgcgtctaacgatagtggacaccccaggatttggagacgcggtgaacaataccgaatgctggaagcctgttgcagagtatatcgatcagcagttcgaacaatatttcagagacgaaagcggattaaacaggaagaatatacaggacaacagggtccactgctgcctttatttcatcagtccattcggtcatgggttgcggccactcgacgtggaatttatgaaggcgctgcaccaacgcgtgaatatcgttcctatcttggcgaaggctgacacgctgacccctcccgaagtggatcacaagaagcgcaagatcagggaagaaattgagcatttcggaattaaaatctaccagttccccgactgtgactcagatgaggatgaggactttaagctccaggaccaggcgcttaaagaaagcatcccctttgccgtaatcgggtccaacacagtcgtggaggcgaggggaagaagagtgagggggagactgtacccgtggggtatcgtggaagtagagaaccctgggcactgtgactttgtaaaactgcgtaccatgctcgttaggacgcacatgcaagatctgaaagacgtgaccagggagactcattacgaaaattacagggcccagtgtatccagtctatgacacgcttagtcgtgaaggaaaggaataggaacaagttgacgcgggaatcaggtactgatttccccatacccgccgtcccccccggaacagaccccgagaccgagaagctaatcagggaaaaagacgaagagctccgccgcatgcaggagatgctgcataagattcaaaaacaaatgaaagaaaactac

SEQ ID NO: 32541 - DNA, 1434 bp, Artificial Sequence
  Description of Artificial Sequence: Synthetic coding sequence
atggatcggtcgctgggttggcagggaaacagcgtccccgaagatcggaccgaagcaggtatcaagcgcttcctggaggacaccacggatgacggcgaattgtccaaatttgtgaaagacttctccggaaacgcctcctgccaccctccggaggccaagacttgggcttcaagacctcaagtgcctgaaccgaggccacaagcgcccgacctctacgatgacgatctggagtttcggccgccaagccgcccgcaatcatcggataaccaacaatacttctgcgcgccggctcctctgtcgccgagcgcccggcctaggtcaccgtggggaaagctggacccatatgattcgtcggaggacgacaaggagtacgtgggattcgccaccctgcccaaccaggtgcacagaaagtcagtcaagaagggtttcgacttcaccttgatggtggcgggcgaatcaggactgggcaagtccaccctcgtcaattcgctgttcctgactgatctctaccgcgatcgcaaattgttgggcgcggaggaacggatcatgcagactgtggagattaccaaacatgccgtggacatcgaggagaaaggagtgcggctgcggctgaccatcgtggatacccctggtttcggtgacgcggtgaacaatactgagtgttggaagcccgtggcagagtacatcgaccaacagtttgagcagtacttcagagacgaatcgggcctcaacaggaagaatattcaggataatcgcgtgcattgctgtctgtacttcatctccccgttcggacacggtctgaggcctctggatgtggaattcatgaaggcacttcaccagagagtcaatatcgtgccaatcctcgctaaggccgacactctgacgcccccagaagtcgaccacaagaagcgcaagatccgggaagaaatagagcatttcggaatcaagatttatcaatttccggactgcgattcagacgaggatgaagatttcaagctgcaggatcaagccttgaaggagtccattcctttcgcagtgatcgggagcaatacggtcgtggaagccaggggacgccgggtgagaggacggctgtacccgtggggaatcgtcgaagtggagaaccctggccattgcgacttcgtgaagctgagaactatgctcgtccgcacccacatgcaggacttgaaggacgtcactcgcgagacgcactacgaaaactaccgggctcagtgcatccagagcatgactcgcctggtggtgaaggagcgcaaccgcaacaagctcacccgcgaatccggcacggactttccgatcccggcggtcccaccgggaacggatccggaaaccgaaaagctgatcagagagaaggacgaggagctgcggagaatgcaggaaatgctgcacaagatccagaagcagatgaaggagaactac

SEQ ID NO: 32542 - DNA, 1434 bp, Artificial Sequence
  Description of Artificial Sequence: Synthetic coding sequence
atggacaggtcactcggttggcagggcaactccgtcccggaggatcgcacggaagccggtatcaagcgcttcctggaagataccaccgacgacggagaactttcaaagttcgtgaaagatttctcgggcaacgccagctgccacccacctgaagcaaagacttgggcctcccgcccacaagtgccggaaccgcgccctcaggcccctgacctgtacgacgacgatttggaattccggccgccgagccggccgcagagttcggacaaccaacagtacttttgtgcaccggcccctctgtcgccgtccgcacggccgagaagcccgtggggaaaactggacccgtacgactcatcggaagatgataaggaatacgtgggtttcgcaactctccctaatcaggtccaccggaaaagcgtgaagaagggattcgacttcaccctcatggtggcaggcgaatccggtcttggaaagtcaactctggtgaactcgctgtttctgacggatttgtacagggaccgcaagctgctgggcgcggaggagcggatcatgcagaccgtggagattaccaagcatgctgtcgatatcgaagagaaaggagtgagactgcggctgaccatcgtggatacgccaggctttggtgacgcggttaacaatactgaatgctggaagccagtggccgaatacatcgatcagcagttcgagcagtacttccgggacgagtcaggcctgaatcggaagaacattcaagacaaccgagtgcactgctgcctctacttcatctcaccctttgggcatggactcagaccgctggacgtggagttcatgaaagcattgcatcagagagtcaatatcgtgcccatcctcgcgaaagccgacactctgactcctccggaagtggatcacaaaaagcggaaaattcgggaagaaattgagcacttcggtatcaaaatctaccagttccctgattgcgactctgatgaggacgaggacttcaagctccaagatcaagcgctcaaggaatcgatcccgtttgctgttatcggttcgaacaccgttgtggaagcacgcggccggcgcgtcagaggacggctgtacccatggggcatcgtcgaggtcgagaacccaggacactgcgacttcgtgaagttgcgcactatgctggtgcggacccacatgcaggacctcaaggacgtcaccagggaaactcactacgagaattaccgcgcccagtgcatccaatcaatgacccggctggtcgtgaaagagcggaaccggaacaaactgaccagggagagcgggacggactttcctatccctgccgttccacctggtaccgatccagaaacggaaaaactcattcgggagaaggacgaagagctgcggagaatgcaggaaatgctgcacaagatccaaaagcagatgaaggagaactac

SEQ ID NO: 32543 - DNA, 1434 bp, Artificial Sequence
  Description of Artificial Sequence: Synthetic coding sequence
atggatcggagcctgggatggcaaggtaactcggtccccgaggatagaactgaagcgggaatcaagcgttttctggaagatacgactgacgatggtgaactgtccaaattcgttaaggatttttcgggaaatgcgtcgtgtcatcccccagaagctaagacctgggctagccggccccaggtgccagaaccgcgtccacaagcaccagatctttacgatgacgatcttgagtttagacctccttcccgccctcaatcatccgataatcagcagtacttttgcgcacctgctccactttcaccatccgcccgccctaggtcgccctggggtaaacttgatccatacgacagctccgaggacgataaagagtacgtcggatttgctaccctgccgaaccaggtccatcgaaagtctgtgaagaagggatttgattttaccctcatggtggccggagaatcaggccttgggaagtccaccttggtgaattccctctttttgacggacttgtacagagatagaaaactcctgggtgccgaagaaagaattatgcaaaccgtcgaaattaccaagcacgcagtggatatcgaggaaaaaggagtccgcctgcgtcttactatagtcgacactcctggatttggtgatgcagtcaacaataccgaatgttggaagcccgtcgccgagtacattgaccagcaattcgagcaatactttcgagatgaatcaggtcttaacaggaagaatattcaagataaccgagtgcattgttgcttgtacttcatctccccttttgggcacggacttcgccccctcgatgtggaattcatgaaggcactgcatcagcgggtgaacatcgtgccgatcctcgcaaaggcagatactcttactccacctgaagtcgatcacaaaaagagaaagatacgtgaagagattgagcattttggaatcaagatataccagtttcctgactgcgacagcgacgaggatgaagatttcaagctgcaggatcaggcgcttaaagagtccatacccttcgcagtgattggatcaaacaccgtggtcgaagcaagaggccgtcgggtgagaggtcgcctctatccctggggcattgtggaggtcgaaaaccccggtcattgtgactttgtgaagctcaggactatgttggtgcgaactcacatgcaggatctcaaggatgtgactagagaaacccattatgagaactaccgggcacaatgtatccagtcaatgactagactcgtcgttaaagaaaggaatcggaataagctgacgcgagagagcggcactgatttcccaattcccgcagtgcctcctggaactgatcctgaaactgagaaactcattcgggaaaaggatgaagaacttcgtcggatgcaggaaatgttgcataagatccaaaagcagatgaaagagaactac

SEQ ID NO: 32544 - DNA, 1434 bp, Artificial Sequence
  Description of Artificial Sequence: Synthetic coding sequence
atggatagatctctgggttggcagggcaacagtgtccccgaggaccgtaccgaggcaggtatcaagcgctttcttgaggacaccaccgatgatggcgagctttccaagttcgtcaaggatttttccggcaacgcctcctgtcaccccccggaagctaagacctgggcctctcgcccccaggtgcccgaaccccgaccgcaagcccccgacctgtacgatgacgatcttgagttccgcccgccatcccgtccgcagtcttcggacaaccagcagtatttctgcgcgccggcccccttgtctccctcggcccgcccacgttcgccgtggggaaagttggatccttacgatagctccgaggacgataaggaatacgtcggtttcgcgactcttccgaaccaggtccacaggaaatccgtcaagaagggtttcgatttcaccctgatggtggccggcgaatccggactcggcaagagtacgctggttaacagccttttcctgacggatttgtaccgggaccgcaagctgctgggcgcggaggagcgaatcatgcaaaccgtcgaaataacgaagcatgctgttgatatcgaagagaagggtgtccgtttgaggctgaccatagtggatacaccgggttttggtgacgccgtgaacaataccgagtgttggaagcctgttgccgagtacatagaccagcagtttgaacagtacttccgcgatgaaagtggtctcaaccgaaagaacattcaggacaaccgtgtccactgctgcttgtacttcatcagcccgttcggtcacggtctcaggccccttgatgtagagttcatgaaggctcttcaccagcgcgtgaacatcgtgccgatcctggccaaggccgacactctcactccgccggaagtggaccacaagaagcgcaaaatccgcgaggaaatcgaacacttcggtatcaagatttatcagttcccggattgcgattccgatgaagacgaggactttaagctacaggatcaggcgctcaaagagtctatcccctttgctgttatcggaagcaacaccgtggtggaggctcgtggccggcgagtgcgcggcaggctctacccctggggtatcgtggaggtggagaaccccggccattgcgattttgtcaagctgcgcaccatgctcgtccgtacacatatgcaggacctgaaggacgttacccgcgaaacccattatgaaaactatcgtgcccagtgcattcagtctatgacgcgcttggtggttaaggagagaaaccggaacaagttgacccgggagtctggaacagatttccccatcccagcagtccctcccggtactgaccctgagaccgaaaagctgatccgtgaaaaggacgaggagctccgccgtatgcaagagatgctccataaaatccagaagcagatgaaggagaactat

SEQ ID NO: 32545 - DNA, 1434 bp, Artificial Sequence
  Description of Artificial Sequence: Synthetic coding sequence
atggacagatctctgggatggcaagggaactcagtgcccgaagatagaacggaggccggtatcaagcgcttcctggaggacaccactgatgacggtgaactcagtaagttcgtgaaggatttttctggcaacgcttcctgccacccgcccgaagctaaaacatgggctagccgaccccaggtacccgagcctcggcctcaggccccggatctgtacgacgacgatctggagtttcgacccccctctaggccacagagttccgacaatcagcagtacttctgtgcccccgcccctttgagcccgagtgcgcgcccacgatccccttggggcaagcttgatccgtatgactcttctgaggatgacaaggagtacgtcggcttcgccacgctgccaaaccaggtgcatcgaaaatcagtgaaaaaaggcttcgacttcaccctcatggtggctggggaaagcgggctgggtaaatcaaccctcgtgaattctctgtttctgactgacctttacagggatcgaaagctgctgggggccgaggagcgaatcatgcagactgtggaaattactaagcacgctgtggatattgaagaaaagggagtacggctgaggctcacaatcgtggacacaccgggcttcggcgacgccgtcaacaacactgagtgctggaaacccgtcgcagaatacattgaccagcagtttgaacaatacttcagagacgaaagcgggcttaataggaagaatatccaggataatcgggttcattgttgcctctactttataagtccgtttggccacgggctcagacctctggacgtagaatttatgaaagcactgcaccagcgcgtcaacatcgttccaatactggcaaaggcggatacacttacaccacccgaggttgaccacaagaagcggaagatacgcgaggagattgaacatttcgggattaagatctaccagttcccagactgtgattccgatgaagatgaggactttaaactgcaggaccaggcgctgaaggagtccatccccttcgcagttatagggtcaaataccgttgtggaggcgcgggggcggagagtcagaggaaggctgtatccatggggcattgtggaagtggaaaaccccggccactgcgacttcgtgaagctccggaccatgttggtcaggacccacatgcaggaccttaaggacgtcacccgggagacgcattatgaaaactaccgcgcgcagtgcattcagtccatgacgcggctcgtggtgaaagagagaaacagaaataaattgacccgagagagtggcactgactttccaatacctgccgttccacctgggactgacccagaaaccgagaaactcattagggagaaagatgaggagttgcgcagaatgcaggagatgcttcataaaatccagaagcagatgaaggagaattat

SEQ ID NO: 32546 - DNA, 1434 bp, Artificial Sequence
  Description of Artificial Sequence: Synthetic coding sequence
atggatagaagcctgggatggcagggaaactccgtccctgaagatagaactgaagccggaatcaaacgcttcctcgaggataccacggacgatggcgagctttccaagtttgtgaaggatttttcgggaaacgcaagctgtcatcctcctgaggcaaagacctgggcctcccggcctcaagtgccagaaccgaggcctcaggcaccagatctgtacgatgatgacctggaatttcggccaccttcgaggccacaatcgtcagataaccaacaatacttttgtgctccagcacctctcagcccctcggcaagacctaggagcccctgggggaagctggacccatacgattcctcggaagatgataaggagtacgtggggtttgcaactttgcctaatcaagtccacaggaagtcggtgaagaaaggatttgattttactcttatggtggcaggagagtcgggactcggcaagagcactcttgtgaattcactgttcctgaccgacttgtacagggatcgcaagctgctgggagcggaagaacggattatgcaaaccgtcgaaatcactaaacatgcagtagacattgaggagaagggcgtgcgacttaggctcactatcgtggacaccccaggatttggagacgcggtgaacaacacggagtgttggaaacctgttgccgaatacattgaccagcagttcgaacaatactttcgagatgaatcaggactcaatcgcaagaacatccaagataaccgagtgcactgctgtctttacttcataagcccttttggccatggactgcgccctctcgatgtggaattcatgaaagcactgcatcaaagagtgaatattgtgcccatccttgcaaaggctgatacccttacccctccagaagtggaccataagaagagaaagattagagaggaaattgaacacttcggaattaagatctaccagttccctgattgtgattcggacgaagatgaggatttcaagctgcaggatcaagccctgaaagaatccatccctttcgcggtgataggatcgaataccgtggtcgaagcccggggaagaagagtgcgggggcggctttatccttggggaatagtggaagtggagaacccgggacattgtgattttgtgaaacttcgcaccatgctggtgagaactcacatgcaggatctgaaggatgtgacccgagaaacccactacgaaaactaccgcgcacaatgcatccagtccatgaccagactggtggtgaaggaaaggaaccgcaataagctcacccgtgagagcgggacggatttcccaattccagcagtcccacctggaaccgaccccgaaaccgagaagctgattagagaaaaggatgaggagctgagaagaatgcaagaaatgctccataagattcaaaaacaaatgaaagaaaactac

SEQ ID NO: 32547 - DNA, 1434 bp, Artificial Sequence
  Description of Artificial Sequence: Synthetic coding sequence
atggatagaagcctcggatggcagggaaacagcgttccggaggacagaactgaggcagggatcaagcgattcctggaggacaccactgatgacggagaattgagcaagttcgtcaaggacttttccggtaacgccagctgccacccgcctgaggccaaaacctgggcctcgcgtccccaggtcccagagcctcgcccacaagcgccggacctctacgatgatgatttggagttccggccgccaagccgcccgcaatcgtccgacaaccagcagtacttttgcgcacccgcccccctgtcaccttcggcacgcccaaggtccccgtggggcaagctggacccatacgactctagtgaagatgataaggaatacgtcggatttgccacccttcctaatcaggtccaccggaaaagcgtgaagaaaggattcgatttcactttgatggtggccggagagagcggtcttggcaagtcgacgttggtgaattctcttttccttaccgacctctaccgggaccgcaagttgctcggagcagaagaacgtatcatgcagactgtggaaatcactaagcacgccgtggacattgaggaaaaaggcgtgcgcctgcggctgaccatcgtcgacactccgggcttcggcgatgcggtgaacaacaccgagtgttggaagccggtggcggaatacatcgatcaacaattcgagcaatactttagggatgagagcggtctgaaccgcaaaaacattcaggacaaccgggtgcattgttgcctgtatttcatcagccctttcggacatggtctgcgcccactggacgtggagttcatgaaagcccttcatcagcgagtcaatatagtcccaattctcgctaaggctgacactctcacgcctccggaggtcgaccacaaaaagcggaagatacgggaggaaatcgaacactttggaataaagatctaccagttcccggactgcgattcagatgaggacgaggactttaagctgcaagaccaggccctcaaagaatcaattccgttcgcggtaatcgggtccaacactgttgtggaggcccgcgggagacgggtgcgcggccgcctgtacccctggggaatcgttgaagtggaaaatccgggacactgcgatttcgtgaagctccggaccatgctcgtgcggactcatatgcaagaccttaaggatgtcacccgagaaacccactatgaaaactaccgggcacagtgcattcagagcatgactcggctcgttgtcaaggagagaaatagaaacaaactgacccgcgaatcggggacggacttccctatccctgctgtgccgccgggaaccgatcccgagacggaaaagctgatccgggaaaaagacgaagagcttcggcggatgcaagagatgttgcacaaaatccagaagcaaatgaaggaaaactac

SEQ ID NO: 32548 - DNA, 1434 bp, Artificial Sequence
  Description of Artificial Sequence: Synthetic coding sequence
atggatcggtcgcttgggtggcaaggaaatagcgtgcctgaagatcggactgaggccggtattaagagatttcttgaagatactactgacgacggagaactctcgaaatttgtgaaggatttttcgggaaacgcaagctgtcatcctcccgaagccaagacgtgggcatcacgccctcaagtgcccgagcctagaccacaggcaccagacctttacgacgacgaccttgagtttcgtccaccttcgcgaccacagtcctctgataaccaacagtacttttgcgcaccagcccctctttcaccatcggcaaggcctcggtcgccctggggaaagctggatccttacgactcgtcggaagatgacaaggaatacgtggggtttgcaacccttcccaaccaagtccatcggaaaagcgtcaagaagggattcgatttcacccttatggtggcaggagaatccggacttggaaagtcgacccttgtgaattcgctctttttgactgacctttaccgggataggaagctcctgggagcggaagagagaatcatgcaaaccgttgagatcactaaacacgcagtcgatatcgaagagaagggagtgagactgcgcctcaccattgtcgatacccctggatttggtgacgcagtgaacaataccgaatgctggaaacctgtggcagaatacatcgatcaacaatttgaacaatacttccgcgatgaaagcggtctgaaccgtaagaacattcaggacaatagagtgcactgttgtctttacttcattagtccttttggtcatggacttcggccactcgatgtcgagtttatgaaggcgctgcatcaaagggtcaacattgtgcctatactggcaaaagccgacactctcaccccacctgaagtcgatcacaaaaaacggaagattcgggaggaaattgaacattttggtatcaagatctaccagttccctgactgtgattctgatgaggatgaagatttcaagctccaagaccaggcactgaaggaatccattcccttcgcagtgattggatcaaacacggtggtggaggctcgtgggcgcagagtgcgcggcagactttatccctggggcatcgtggaagtggagaatccgggtcattgcgactttgtgaagctgcggaccatgctggtgcgaacgcatatgcaggacctcaaagacgtgactagggagactcactacgaaaactacagagcccaatgcattcaatcgatgacgcggcttgtggtgaaggaaagaaaccgcaacaaattgaccagggagtcgggtaccgattttccaatcccagcagtgcctcctggaaccgatcctgagactgaaaagctgattcgggaaaaagatgaggaacttcggcggatgcaagagatgctccacaagatacaaaaacaaatgaaagaaaactat

SEQ ID NO: 32549 - DNA, 1434 bp, Artificial Sequence
  Description of Artificial Sequence: Synthetic coding sequence
atggatagatcgctgggatggcaaggaaacagtgttcctgaggaccgcaccgaagcaggaatcaaacggtttctggaggataccactgatgacggtgagttgtcaaagtttgtgaaagacttcagcggaaatgcatcctgccacccccctgaagcaaagacctgggcttcccgtccacaagtgcccgaacctcggcctcaagctccggatctttacgacgacgatctggaatttcggcctccttcacggccccaaagctcggacaaccaacagtacttctgcgcacccgcaccactgtcaccatccgccagaccaaggagcccctggggtaagctcgacccatacgattcctctgaggatgataaagaatacgtggggtttgccacccttccaaaccaggtccatcgcaagtcggtgaagaaaggctttgatttcaccctcatggtggcaggcgagtcgggactgggtaagtctactctcgtgaatagcctgtttctgactgatctgtacagggatcgtaagctcctcggagcggaagagcgaattatgcagactgtggaaattaccaagcatgcagtcgatattgaagaaaagggtgtgagactgaggctgacgattgtggatactcccggtttcggagatgcggtgaataacaccgaatgttggaagccagtggcggaatacatagatcagcaatttgagcagtatttcagggatgaaagcgggcttaatagaaagaacatccaagacaacagagttcactgttgtctttacttcatcagtccttttggtcatgggctgcgtcctctggatgtcgagtttatgaaagcgctccatcagagagtcaatatagttcccattcttgcaaaggcagacacgctcaccccaccggaggtggatcataagaagagaaagatccgggaggaaatcgagcattttggtatcaagatctaccagtttccagactgtgattccgatgaggacgaggacttcaagctgcaagatcaagctcttaaggaaagcataccgttcgccgtcattggaagtaatacggtcgtggaagcacgcggcagacgagtgcgcggccgcctgtacccttggggcattgtggaagtagagaatccaggacattgcgattttgtgaaactccgcaccatgctcgtcagaacgcatatgcaagatcttaaagacgtgactagggaaactcactacgaaaactaccgcgcccaatgtatacagtctatgactcggctcgtggttaaggagcggaaccggaacaaacttactagagaatcgggtaccgacttccctattcctgccgtgcctccgggaaccgaccccgaaactgaaaaacttattagggaaaaagatgaagaacttaggcgaatgcaggaaatgctccacaagattcagaagcaaatgaaggagaactat

SEQ ID NO: 32550 - DNA, 1434 bp, Artificial Sequence
  Description of Artificial Sequence: Synthetic coding sequence
atggatcgctctttgggctggcagggcaactctgtccctgaagacagaacagaggccggcataaagagattcctggaagataccactgacgatggagagctgagtaagtttgtaaaggactttagcggaaacgcatcatgtcaccctccggaggctaaaacctgggcaagcaggcctcaggtgcctgagccccgcccacaagcacccgatctctatgacgacgaccttgagtttagaccaccatctcgcccgcagagttccgacaaccagcagtatttttgcgctccagcacccctctccccaagcgcacgccctcgctccccatggggaaaactggacccctatgatagctctgaagatgacaaggaatatgttggcttcgccacactcccaaatcaagtgcataggaaatctgtcaagaagggcttcgacttcaccctgatggtagcaggagagagcggcctgggcaagtctacgctcgtgaattctttgttcctgaccgacctctatagggaccgcaaactcttgggtgctgaagagcgcatcatgcagacagtagaaatcactaagcacgctgtcgatatcgaagaaaagggagtaagacttagactgacaattgtcgacacccccggcttcggagatgctgtgaacaatactgaatgttggaagcctgtagctgaatatattgaccagcaatttgagcagtatttcagagacgagtcaggactgaaccgcaagaacatacaggataaccgcgttcactgttgtctctacttcatttcacctttcggccacggactcaggcctttggatgtggagttcatgaaggctctccaccagcgcgtcaatattgtgccgatcctcgccaaggcggacaccctcaccccacccgaagtcgaccataaaaagaggaagatcagggaggagatcgagcattttggcattaagatctatcagttccctgactgtgactcagacgaggatgaggacttcaagttgcaagatcaggcgctcaaggagtccatcccatttgcagttatcggaagcaacactgtagttgaagccaggggcagacgcgtccgcggcaggttgtatccatggggtatagtggaggtcgagaatccgggccattgcgacttcgtgaaacttagaacaatgcttgttaggacccatatgcaagacttgaaggacgtcaccagggaaactcactacgaaaattatagggcccaatgcatccaatccatgactcgcctggttgtcaaggagcgcaaccgcaacaaactgactagagaatctggcacagacttcccaattcccgccgttccgcctggaacagatccagagacagagaagctgatcagggagaaggacgaagagcttagaaggatgcaggagatgctgcacaaaattcagaagcagatgaaggagaactac

SEQ ID NO: 32551 - DNA, 1434 bp, Artificial Sequence
  Description of Artificial Sequence: Synthetic coding sequence
atggatagaagcctcggctggcaaggtaactccgtccctgaggacaggacagaagcaggtatcaaacggtttctcgaagacacaactgacgatggagaattaagcaagttcgtcaaggactttagcggcaatgcctcttgccacccgcctgaggctaagacatgggcatcacggccacaggtgcctgaaccaaggccccaggcccctgacctctatgatgatgacctggagttccggccacctagtaggccacaatcctctgacaaccaacagtacttttgcgcaccagcacctcttagtccaagtgccaggccaaggagcccatgggggaaattagacccttacgacagttctgaagatgataaagagtatgtgggtttcgcaacattgccgaatcaggtgcatcggaagagtgttaagaaaggatttgacttcacattaatggtggcaggggagagcggcctgggaaaaagtactttggttaattcactgttccttactgacctgtatagggatagaaagctgctgggagccgaggagagaatcatgcagaccgtggaaatcacgaaacacgccgttgacatcgaagagaagggcgtgagacttcgcctcacaattgttgatacacctggcttcggcgacgccgtgaacaataccgagtgctggaagcctgtagcagagtacatcgaccaacagttcgaacagtactttcgggatgaatccggcctcaaccggaagaacatacaggacaatagggtgcactgctgcttgtatttcatctccccttttggtcacggtctgcgtcctctggacgttgaattcatgaaggctcttcaccagcgggtgaatatagtgccgattttagctaaggctgatacgctgacgccgcctgaagttgatcacaaaaaaaggaagatccgggaagagattgagcactttgggataaagatctatcagtttcctgattgtgactctgacgaggatgaggacttcaaactgcaggatcaagcactgaaagagtccattccgttcgctgtgattggctcaaatacggtagtggaggctcggggccgtcgagtgcgcggtaggctgtatccttggggaattgttgaagtggaaaaccccgggcattgtgacttcgttaaactgaggaccatgttagtgcgcactcacatgcaagaccttaaagacgtcactcgtgaaacccactacgagaactacagggctcagtgcatacagagtatgacccggctcgtcgtgaaggaacggaaccgcaacaaattgaccagggaaagcggcacagattttcctataccggccgtcccacctggcaccgaccccgaaaccgaaaaacttatcagggagaaagatgaagagctcagaaggatgcaagaaatgctccataaaatccagaagcagatgaaggagaactat

SEQ ID NO: 32552 - DNA, 1434 bp, Artificial Sequence
  Description of Artificial Sequence: Synthetic coding sequence
atggatcgtagtcttggatggcaaggaaatagtgttccagaagatagaactgaagcagggataaaacgtttccttgaagacacaacagatgatggtgaattatctaaatttgttaaagacttttccggtaatgcatcatgtcatcctccagaagctaaaacttgggcctctagaccacaagttcctgaaccaagaccacaagctccagatctttatgatgatgacttagaatttagaccaccatcacgaccacaatcaagtgataatcaacagtatttttgtgcacctgcaccactttcaccaagtgctagacctcgaagtccatggggtaaacttgatccatatgattctagtgaggatgataaagaatatgttggattcgctactttaccaaatcaagtacataggaaaagtgttaaaaaaggatttgatttcacattaatggttgcaggagaatcaggacttggtaagagtactcttgttaatagtttatttcttactgatctttatagagatagaaaattgttaggtgctgaagaaagaattatgcaaacagttgaaataactaaacatgctgttgatattgaagaaaagggtgttagattaagattgacaattgttgatacaccaggatttggagatgcagttaataatactgaatgttggaagcctgttgcagaatatatagatcaacaattcgaacaatattttagagacgaatcaggtttaaacaggaaaaatattcaagataatagagttcattgttgtttatattttatttcaccttttggtcatggacttagaccattagatgttgaatttatgaaggctttacatcaacgtgttaatattgttccaattcttgctaaagctgatactttaactccacctgaagtggatcataagaagagaaaaattagagaagaaatagaacatttcggaattaaaatttatcaatttccagattgtgattcagatgaagatgaagatttcaaattgcaagatcaagcattaaaggaatctattccatttgcagttattggttcaaatactgttgttgaagctagagggagaagagttcgtggaagattgtatccatggggtattgtcgaagtagaaaatccaggacattgcgattttgttaaacttagaactatgttagttagaactcatatgcaagatttaaaagatgttacacgtgaaacacattacgaaaattatagagcacaatgtattcaatctatgactagattagtggtaaaagaaagaaatagaaataaattaacaagagaatcaggaacagattttccaattccagctgttccaccaggaacagatccagagactgaaaagttaattcgtgaaaaagatgaagaacttagaagaatgcaagaaatgttacataaaattcaaaaacagatgaaagaaaattac

SEQ ID NO: 32553 - DNA, 1434 bp, Artificial Sequence
  Description of Artificial Sequence: Synthetic coding sequence
atggaccggtcactgggttggcaaggaaactcggtgccagaagatagaactgaagcagggattaagaggttcttggaagataccaccgacgacggtgaactgtcgaaatttgtgaaggactttagcggaaatgcaagctgtcaccctccagaggcgaaaacgtgggcaagcagacctcaagtgccagaaccccgcccccaagcgcctgacctctacgacgacgatctggaattccgccctccatcccgcccgcagtcatccgataatcaacagtacttttgtgcgccggcgccactttccccctcagcacgtccgcgctcgccctggggtaagctggatccatacgattcgagcgaagatgacaaggaatacgtgggttttgcgacccttcccaaccaggtccaccgcaagagcgtgaagaaagggttcgatttcactctgatggtggcaggcgagtcgggactcgggaaatcgacccttgtgaacagtcttttcctcaccgatctgtacagggatcgcaagctcttgggtgcggaggagaggattatgcaaaccgtcgaaattaccaagcatgcagtcgatattgaagaaaagggagtgaggctgcgacttaccatcgtggatacccctggttttggagatgcggtgaacaacactgaatgctggaagccagtcgctgaatacatagatcagcagtttgagcaatacttccgtgacgaatcagggctgaacaggaagaatatacaggacaacagagtgcactgttgtctctacttcatctccccatttgggcatggactccggccgctggacgtcgaattcatgaaggctcttcaccaacgggtcaacatcgtccctatactggccaaagccgatactctgacccctcctgaagtcgatcacaaaaagcggaagatccgagaggagattgagcatttcggcattaagatttatcagttccccgattgtgatagcgacgaggatgaggactttaagctgcaagatcaggctcttaaggaatccatcccatttgcagtgataggctccaacaccgtggttgaggcccgcggaaggcgagttagaggacgtctctacccatggggtatcgtcgaagtggagaatccgggccactgtgactttgtgaaactgcgcactatgctggtcagaacccatatgcaagacctgaaggacgtcactcgcgaaacccactacgagaactatagggcacagtgtattcaaagcatgacgcggcttgtggtgaaggagcggaatcgtaataagctgacccgggaaagcggaactgattttcctataccagcagtgcccccaggaaccgacccggaaaccgaaaagctgattagagaaaaagacgaagaactccggaggatgcaagaaatgctccacaagattcagaaacaaatgaaggaaaactac

SEQ ID NO: 32554 - DNA, 1434 bp, Artificial Sequence
  Description of Artificial Sequence: Synthetic coding sequence
atggatcgaagcctaggttggcagggcaattccgttccagaagataggaccgaagccggtattaaacggttcctggaggatacaactgacgacggggagttgtcaaaattcgtgaaagatttctctgggaacgctagttgccaccccccagaagctaaaacctgggctagccggccccaggttcctgagcctcgaccccaggcgccagatttgtatgacgatgatctcgaattccggccaccatcacgtccacagtccagcgataatcagcaatacttctgtgccccggccccactttctccatcagcacgcccccgttcaccttggggtaagcttgacccttacgacagctctgaggatgacaaggagtacgtcggattcgctacactgcccaatcaggtccaccgaaaaagcgttaagaaagggtttgatttcaccctgatggttgcgggtgagtctggcctcggcaagtcaaccttggttaactccctgttcctcactgacctataccgggaccgcaaactgcttggggccgaggagcgcattatgcagactgtcgagataaccaagcacgcagttgacatcgaggaaaagggggtccgtctgcgactgacaattgtggatactcccggattcggagatgccgtgaataacaccgagtgttggaagcctgttgcggaatatatcgatcagcagttcgaacaatattttagggacgaaagtggcctcaataggaaaaacatacaagataatcgcgttcattgctgcctctattttatatccccattcgggcacggtctccgcccattggatgttgaatttatgaaggcactccaccagagagtcaatatcgtgcctatcttggctaaagccgatacacttacaccacctgaggtcgatcacaagaagcgcaagattagggaggagatcgaacacttcggcattaaaatttaccaattccctgattgcgatagtgacgaggacgaagactttaagcttcaggaccaggccctgaaagagtccatacctttcgcagtgatagggtccaacactgtcgtggaggcacgcggccggcgcgtacgaggacgcctctacccctggggcatagtcgaagtggagaatcccggccactgtgatttcgtcaaactgcggacaatgttggtccggacccacatgcaggacctgaaggacgtgactcgcgagacacactacgagaattatcgcgcgcaatgcatacagtctatgacccgccttgtggttaaggagcgtaaccggaacaaattgacccgggagtcaggcacagactttcccattccggcagtcccacccggaactgatcccgagactgagaaactcatacgcgaaaaggatgaagagctgcgccgaatgcaggagatgcttcacaagatccaaaagcagatgaaagagaactat

SEQ ID NO: 32555 - DNA, 1434 bp, Artificial Sequence
  Description of Artificial Sequence: Synthetic coding sequence
atggaccggagtctggggtggcagggcaacagtgttcctgaagatcggaccgaggctgggataaaacgattcctagaagacacaacagacgatggcgaactgtcaaagtttgtgaaggatttttcgggaaatgcctcctgccaccccccagaggccaaaacctgggcaagccggccacaagtgccagagccacgccctcaggcgccagacctgtacgacgacgacctggagttccgaccaccttccagaccccaatcttctgacaaccaacagtatttttgcgcccccgctcccctgtcaccctcggccagaccaagatcaccttggggcaaacttgacccatacgatagttctgaagacgataaggaatatgtagggtttgcaaccctgccaaaccaggtgcatcggaagagcgtgaaaaaggggttcgattttactcttatggtggcaggagagagcgggctgggcaagtccaccctggtgaactcactgttccttaccgatctctaccgagaccgtaaactgcttggtgccgaagaacgcataatgcagaccgttgagataacaaagcatgccgttgatattgaagagaaaggcgttaggctcaggttgacaattgtggatactcccggattcggcgatgcggttaataacacagagtgctggaagcctgtggctgaatatatcgatcaacagtttgaacagtacttccgagacgaatcaggcctgaatcgcaagaacattcaggacaacagagtccactgttgtctctacttcatctcccctttcggtcacggcctcagaccacttgacgtagagttcatgaaagccttgcaccaaagagtgaacattgtgcccattcttgctaaagccgacactcttacgcctcccgaggtggatcacaaaaaacgtaagatcagagaggaaatcgagcacttcggcattaaaatttatcaattcccggactgcgattccgacgaagacgaagatttcaagctgcaggaccaggccttaaaagaatctatccctttcgcagtaatcggctccaatacggtcgttgaagctcgcgggcgaagggtgcgtggtaggctctacccatggggaatcgtggaggttgaaaatccaggtcactgcgactttgtaaagctgcggactatgctggtgcgtacccatatgcaggaccttaaggatgttactagggagacacattacgagaactacagggcacagtgtatccagagcatgactaggctggtggttaaggagagaaacagaaataagttaacccgcgagtccgggacggacttcccaattcccgcagtgccgcccgggacggaccccgaaacggagaaactgatcagggagaaggatgaggaattgagacgaatgcaggagatgctgcataaaatccagaagcaaatgaaggagaactat

SEQ ID NO: 32556 - DNA, 1434 bp, Artificial Sequence
  Description of Artificial Sequence: Synthetic coding sequence
atggaccgctctctcggttggcagggaaacagtgtgcctgaggacaggaccgaggctggcataaagcgctttctggaggatacaaccgatgatggtgaactgtccaagttcgtgaaggacttttcaggaaatgcctcttgtcatccgccggaggccaaaacatgggccagtagaccgcaggttccagaaccaaggccacaagctccagacctttatgatgatgacctggagttccgccccccttcacgcccccagagcagcgacaaccagcagtatttttgtgccccggcccctctgtcgccgagtgccagacccagatccccctggggaaagctggacccttacgactcttcagaagacgacaaggagtatgtgggttttgctacgctgccaaatcaggtgcaccggaaatccgtgaagaaaggttttgatttcaccttaatggttgcgggggagtctgggctaggcaagagcacattggtgaacagcttattcctgacagatctgtatcgtgataggaagttgctgggtgccgaagaaaggatcatgcagaccgttgagataactaaacacgccgtagacatcgaggagaaaggggtccgcctgaggttaacgatagtggacaccccgggattcggtgatgctgtgaacaataccgagtgttggaagcccgttgcagagtatatagatcagcagttcgagcagtactttagggacgagagcggtctcaaccgcaaaaatatccaggataatcgggtccactgttgcctgtactttatctcgcccttcggccacggcttgagaccacttgacgtggaattcatgaaggctctgcaccagagggttaatatagttcccatactggccaaggcagacaccctgacacctcccgaagtggaccacaagaagaggaagattcgcgaggaaattgaacacttcggtattaaaatctaccaattccctgactgtgattcagatgaggatgaggattttaagctgcaggaccaggccttgaaggaaagcattccgtttgccgtcatcggaagcaataccgtcgtggaggccagagggagacgggtcagaggtcgtctatatccttggggtatcgtggaagttgagaaccctgggcactgtgatttcgtgaagctaaggacaatgctggtacggacccacatgcaagacctgaaggacgttactcgcgaaacccactacgaaaattatagagcccagtgcattcagtctatgacgcgactggtggtaaaagaacggaatcgaaacaagctaacacgagaaagtggcactgatttcccaattccagctgtgccccctggaacagacccagaaaccgagaagctcatccgcgagaaagacgaagagttaaggaggatgcaggaaatgttacataaaatccagaagcagatgaaagaaaattac

SEQ ID NO: 32557 - DNA, 1434 bp, Artificial Sequence
  Description of Artificial Sequence: Synthetic coding sequence
atggataggtcactgggatggcaaggcaactcagtgccagaagatcggaccgaagcgggaatcaagcggtttttggaggacactaccgacgatggagaactgtcgaaattcgtgaaagacttctcgggcaatgcaagctgtcacccgcccgaagcaaagacttgggcgtcccggccgcaggtgccggaaccgaggccgcaagctccggacctgtacgatgacgatctggaatttaggccgccttccagaccgcaaagttcggacaaccaacaatacttttgcgcccctgccccgctctccccgtccgctagacctagatccccgtgggggaagctggatccatatgactcatccgaggatgataaggagtacgtgggtttcgccacgcttccaaaccaggtgcatcggaaatctgtcaaaaaagggttcgacttcaccctgatggtggctggagagagcggactgggaaagagcactttggtgaattcactcttcctcaccgacctttacagagataggaaactgctcggcgcagaggaacgaatcatgcagactgtcgagatcaccaaacatgcagtggacatagaagaaaagggcgtgcgcctccggctgaccatcgtcgatacgccgggattcggcgacgcggtcaataacaccgaatgttggaagccggtggctgaatacatcgaccagcaattcgaacaatacttcagggacgaatcgggtcttaaccgcaagaatatccaggacaaccgagtccactgctgcctgtacttcatctcgcccttcggtcatggactccgtccattggacgtcgagtttatgaaggcgctccaccaaagagtgaacatcgttccaattctcgcaaaagccgatacgttgacccctccagaggtagaccataagaagcgcaagatccgcgaggaaatcgagcacttcggaatcaagatttaccaatttcctgactgcgacagcgacgaagatgaggacttcaaacttcaggaccaggcactcaaggaatcgatcccatttgcggtgatcggttcgaatactgttgtcgaagcgagaggacggcgcgtccgtgggagactctatccttggggaatcgtggaagtcgaaaatccggggcattgcgatttcgtgaagctccgcactatgctggtgaggacccacatgcaagacctgaaagatgtcactcgagaaacccactacgaaaactaccgggcgcagtgcatccaatctatgactcggctggtggtgaaggagagaaacagaaacaagctgactcgggagtctggaaccgatttcccaatcccggctgtaccgccgggcactgaccctgagactgagaaactgatccgtgaaaaggatgaggagctgcgcagaatgcaggagatgctgcacaaaattcagaagcagatgaaggaaaactac

SEQ ID NO: 32558 - DNA, 1434 bp, Artificial Sequence
  Description of Artificial Sequence: Synthetic coding sequence
atggaccggtcccttggttggcagggtaacagtgttccagaagaccggacggaggcagggattaagagatttctcgaggacactacagatgacggagaactgtctaaattcgtcaaggacttcagcgggaatgcctcgtgccacccacccgaggcgaagacatgggcgtctagaccccaggtgcccgagccaagaccacaggccccagacctgtacgacgatgacctggagttccgacccccatctcgtccacagtcatcagacaatcagcagtacttttgtgctcccgcccctcttagcccctctgccagacctcggtctccatggggcaaattagatccctacgacagctctgaagacgacaaagagtatgttggatttgccacgctccctaatcaagtgcacagaaaaagcgtgaaaaagggtttcgattttaccttaatggttgctggcgaaagtgggctaggaaaaagcacattggtcaactcgctgttcctgactgacttgtatcgtgacagaaaacttctcggggccgaggaacggatcatgcagactgtggagatcactaagcatgcagtggacattgaagagaagggcgtacggctgagattgactattgtggacacccctggctttggtgacgcagttaacaatacagagtgctggaagcccgtcgccgagtatatagaccagcagttcgagcagtacttccgggacgagtcaggactgaaccgcaagaatatccaggacaatagagtccactgctgtctctactttatcagccctttcgggcacgggctgcggcctctcgatgttgagttcatgaaagccttgcaccagagggtaaacattgtaccaatcctggcaaaggcggacaccctcacccccccggaggtggaccacaaaaaaaggaagattcgtgaggagattgagcattttggtattaagatttatcagttccctgattgtgacagcgacgaggacgaggacttcaagctgcaagatcaagcactgaaggaatcaattcccttcgcagtgatcggcagtaataccgttgtggaagcacgtggccgtcgagttcgagggaggttgtacccttggggtatcgtcgaggtcgagaatcctggccactgtgatttcgtgaagcttcgcaccatgctggtgaggacccacatgcaggacctcaaggacgtgacaagggagacacactatgagaattatagggcacagtgtatccagtctatgaccaggcttgtggtcaaggaaagaaacaggaacaaactgaccagggagtctggcaccgatttccctatcccagctgtgccccctgggactgacccagagacggagaagttgataagggagaaagacgaagagctcagaaggatgcaggagatgctgcataagatccagaaacagatgaaagagaattac

SEQ ID NO: 32559 - DNA, 1434 bp, Artificial Sequence
  Description of Artificial Sequence: Synthetic coding sequence
atggaccgcagtctggggtggcagggcaactccgtgcccgaggacaggactgaggcaggcattaagaggtttcttgaagatacgacagatgatggtgaactgtcaaaattcgtgaaggacttcagcggaaacgccagctgccatcccccagaagcaaagacctgggctagtcggcctcaggtgcccgagcctagacctcaggcaccagatctctacgacgatgacctggaattcaggcccccttctcgaccccagagcagcgataaccaacaatacttctgtgcccccgctcctctatctccttcagctcgcccccgttctccttggggtaaattggatccatacgactcaagtgaagatgacaaggagtatgtgggattcgcaactctcccaaatcaggtccaccggaagtctgtgaagaagggatttgacttcaccttgatggtcgcaggcgagagcgggcttgggaaatcgaccctcgtgaattcactttttctgaccgacttgtatcgggaccgtaagcttcttggtgctgaggaacggatcatgcagacggtcgagatcacaaagcacgccgtcgatattgaggagaaaggcgtccgccttagattaactatcgtggacacacctgggtttggcgacgctgtgaacaatacagagtgttggaaaccagtggccgagtacatcgaccagcagtttgaacagtatttccgggatgagtcaggcctgaatcgcaaaaacattcaggacaatcgtgtccactgttgcctgtactttattagccccttcggccatggcctgagaccccttgacgtggagtttatgaaggcactccaccagcgggtgaacattgtaccaatcttggccaaggcagataccctcacaccgcccgaggtcgaccacaagaaacgtaaaattcgagaggaaatcgagcattttggtataaaaatataccagttccccgactgcgacagcgatgaagatgaggatttcaaactgcaggaccaggccctgaaggagagcataccatttgccgttataggcagtaacacagtggtcgaggcgcgcggacggcgagtacgcggcagattgtacccctggggaattgtggaggtcgagaatcccggacactgcgatttcgtgaagctcagaaccatgctcgtccgaacacatatgcaggacctaaaggatgtaacgcgggagactcactacgaaaactaccgcgctcagtgcattcagtccatgacccgactggtggtaaaggaacgaaatcgcaacaaactgacacgtgagagcggcaccgattttccaattcctgcagttccaccgggtacggaccctgaaactgaaaagcttatccgggaaaaagacgaggagcttcgccgaatgcaagagatgctccacaaaatccagaagcagatgaaggagaattac

SEQ ID NO: 32560 - DNA, 1434 bp, Artificial Sequence
  Description of Artificial Sequence: Synthetic coding sequence
atggacaggtctttgggatggcaagggaactccgtgccggaggacaggaccgaagctggaatcaagcgctttctggaagataccaccgacgatggcgaactttccaaattcgttaaggacttctccggaaacgcatcctgtcatccgccagaagccaagacctgggcgtcccgcccgcaggtccctgaaccgcgcccacaggccccagacctgtacgacgacgatctcgaattcaggccaccgagtcggccgcagagctcagataatcagcagtacttctgcgccccggctccgctgtccccttcagcacgtccccgctcaccctggggaaagctggatccgtacgacagctcagaggacgataaggagtacgtgggattcgcgactctgccgaaccaggtccatagaaaatcagtcaagaagggattcgacttcactctgatggtggcgggagagtcgggcttgggaaaatcaaccctcgtgaactccttgttcctcaccgacctgtacagagatcggaagctgctcggagccgaagaaagaatcatgcaaaccgtggagatcaccaagcacgcggtcgacatcgaggaaaaaggagtgcgcctgcgcttgactatcgtggatacccccggcttcggggatgccgtgaacaacaccgaatgttggaaacctgtcgcggagtatatcgatcagcagttcgaacagtactttcgggacgaatccggattgaacaggaagaatattcaggataatcgggtgcactgttgcctctacttcatctccccatttggacacggactccgaccgctggatgtggaattcatgaaagccctgcaccagcgcgtgaacatcgtcccgatcctggcgaaggccgacaccctgaccccacctgaagtcgatcacaagaagcggaagatccgggaagaaatcgaacatttcggtatcaagatctaccagttcccggactgtgattcagatgaggacgaggacttcaagctgcaggatcaagcgctgaaggaaagcatcccgttcgcagtgatcggatcgaatactgtggttgaggcgagagggcggcgagtccgcggacggttgtacccgtggggaatcgtggaggtggaaaacccggggcactgcgactttgtcaagctccggacgatgctggtgcgcactcacatgcaggacctgaaggacgtgacgagagagactcattacgagaactaccgcgctcagtgcatccaatccatgaccagactcgtggtgaaggaacgtaatagaaacaagctgactagagaatcgggcaccgacttcccgatcccggccgtgcctccgggaactgacccggaaacggagaagctcattagagaaaaagatgaggaactccgacggatgcaggagatgctgcataagatccaaaagcagatgaaagagaactac

SEQ ID NO: 32561 - DNA, 1434 bp, Artificial Sequence
  Description of Artificial Sequence: Synthetic coding sequence
atggaccggtccctggggtggcagggaaattcagttcctgaggacagaaccgaggctggcatcaaacgcttcctggaagacactactgatgatggggagctgtcaaaattcgtcaaggatttttctggaaatgccagctgtcaccccccagaggctaaaacgtgggccagtagaccccaggttcctgagccacgaccgcaggcacccgacctgtacgacgatgacctggagtttagaccaccgtccagacctcaaagttctgataaccagcagtacttctgcgcaccagcaccccttagtcctagtgccaggcccagatccccatggggaaagttggacccgtacgacagcagtgaggacgacaaagagtatgtgggcttcgcaaccctcccgaatcaagtccaccgaaagtcagtcaagaagggcttcgactttactctgatggtggcaggcgagtcagggctggggaagtccacactggtgaattctctgtttctgacagacctttacagggataggaagctgctgggggctgaagaacgcattatgcagaccgtggagataaccaagcacgctgttgatatagaggagaaaggagtgcgcttgcggctcacgattgtggacacacctggctttggggatgccgtcaacaacacggagtgttggaagcctgtcgccgagtacattgatcagcaatttgagcaatactttagagatgagtccggactcaatcgaaaaaacattcaggataaccgggtgcactgctgcctgtactttatcagcccatttggtcacgggctgagaccacttgacgtagagttcatgaaggcgctgcatcaacgagtaaatattgttcctattcttgccaaggccgacacgctgactccaccagaagtagaccacaaaaagagaaagatccgcgaagaaattgagcacttcggaattaaaatctaccagttcccggattgtgatagcgacgaggacgaggacttcaaactccaggaccaggccttgaaagagtctataccatttgccgttattggttccaatacggtcgtcgaagctagaggtcggcgcgtcagagggcggctgtatccctggggaattgtggaggtcgagaacccaggccactgcgattttgtgaaactgcgaaccatgctggtgaggacccacatgcaggatctgaaagacgtcacacgcgagacacattacgagaactatcgcgctcagtgcatccagtctatgacccggcttgttgttaaggagagaaatagaaataagctcacccgagagtccggcaccgacttccccatacctgctgtccctcccggcactgaccctgagaccgagaaactgataagagagaaggacgaggaactgcgcagaatgcaggagatgctgcacaagatccagaaacagatgaaggagaactat

SEQ ID NO: 32562 - DNA, 1434 bp, Artificial Sequence
  Description of Artificial Sequence: Synthetic coding sequence
atggacaggtctctaggctggcagggcaactccgtccccgaagatcgaaccgaggccggtatcaagcgcttcttggaagacaccaccgacgatggcgagctgtcaaaatttgtcaaagacttttcaggcaatgctagttgtcacccaccagaagccaagacctgggcttccagaccccaagtacccgaacccaggccgcaggctcccgatctgtatgatgatgatctggaattcaggcctccatcccgcccacagagctctgataaccagcagtacttttgcgcccctgcacctctgagcccctcagcaaggcccagaagcccttggggtaagttggacccttatgattcttcagaggatgataaagaatacgtagggttcgcgacactgcctaatcaggtgcatcggaaatctgtgaaaaaggggttcgactttacactgatggtcgctggagaatccgggctcggaaagtcaacactggtgaactctctgttccttacagacctgtacagggatcgcaaactgctcggggccgaagagagaatcatgcagaccgtggaaatcacgaagcacgctgtggacattgaggaaaagggggtgagactgcgcttaacgattgtggacaccccgggattcggcgacgcagtcaataacaccgagtgctggaaaccagttgcagagtatattgaccaacagttcgaacagtatttcagggacgagtcgggcctcaacaggaaaaatatacaggacaaccgtgtgcattgctgcctgtacttcatatcaccattcggccatggtctcagacccctagatgtagaattcatgaaggccctacaccagagggtcaacattgtgcctattttggctaaggccgacaccttaacccctcccgaggtggatcataaaaagcgaaagatccgtgaggaaattgaacacttcggaatcaagatttaccagtttccagactgcgattcggacgaggacgaagactttaagctgcaggaccaggccttgaaggagtcaattccttttgccgtcataggatctaatacggtggtggaagccaggggcagacgagtcagaggtagactgtacccctggggaatcgtagaggtggaaaacccaggacactgcgatttcgtgaaactacgaaccatgcttgtaagaacccacatgcaagacttgaaagacgtaacccgcgaaactcattacgaaaactatcgggcgcagtgtattcagagcatgaccaggctggtggtgaaagagaggaaccgaaataagctcacccgagaaagtggcacagatttcccaatccccgcagttcctcctggaacagaccctgagacagagaaactaattagagagaaagacgaggagctccgcagaatgcaagagatgctacacaagatacagaagcagatgaaagaaaactat

SEQ ID NO: 32563 - DNA, 1434 bp, Artificial Sequence
  Description of Artificial Sequence: Synthetic coding sequence
atggaccgcagccttggctggcagggaaacagcgtgccggaagatcgtaccgaggctggaatcaaacgctttctcgaggataccactgatgacggagaactgagcaagttcgtcaaggacttctcgggaaatgcctcctgccatcctccagaagcaaagacgtgggcctccagaccgcaagtgccagagcctcgcccgcaggcgcctgatctgtacgacgacgacctggaattccggcccccatcgcggccgcagtcgtcagataaccagcagtacttttgcgccccggcgcctctgtctccgtcggcccgccctcggagtccctggggtaagctcgacccttacgattcgtcggaggacgacaaagagtacgtgggttttgccacgctgccgaaccaagtccacaggaagtctgtgaagaaagggtttgatttcacccttatggtggccggcgaatccggtttgggaaaaagcaccctcgtcaacagcctcttcctcaccgatctctacagagatagaaaactgctgggagcggaggaaagaatcatgcagactgtcgaaatcactaaacacgccgttgacatcgaagagaagggtgtccggttgcgcctgactattgtcgatactcctgggttcggcgacgctgtgaataacaccgagtgctggaagcccgtcgcggaatacatcgaccagcaattcgagcagtactttcgggacgagtcggggctcaaccgcaagaacatccaggacaaccgcgtgcactgctgcctgtacttcatctctcctttcggtcatgggctcagacctcttgatgtggaattcatgaaggcccttcatcaacgagtgaatatcgtgccaattcttgccaaggcagatacgttgacccctcccgaagtggatcacaagaagcggaaaatccgcgaagaaatcgagcatttcgggataaagatctaccagttcccggactgtgattcggatgaggacgaggactttaaacttcaagaccaagcattgaaggaatcaatcccattcgcggtgatcggatcaaatactgtggtggaggcgcgcgggagacgggtgcgcggaaggctgtacccgtggggaatcgtggaggtcgaaaatccggggcactgcgacttcgtgaaactgcgcaccatgctggtaagaacccacatgcaggaccttaaggatgtcactcgggagacgcactatgaaaactacagagcccagtgcatccagtcgatgactcggctcgtggttaaagaacgcaaccggaataagctgactcgcgaatccggaaccgatttcccaatccccgctgtcccccctggaaccgacccggagactgaaaagctgatccgcgagaaagacgaggagttgcggcgcatgcaggagatgctgcacaagatccagaagcagatgaaggagaactac

SEQ ID NO: 32564 - DNA, 1434 bp, Artificial Sequence
  Description of Artificial Sequence: Synthetic coding sequence
atggacagaagcttggggtggcaaggcaatagcgtccctgaagataggacagaggccgggatcaagcggtttctggaagacactactgatgacggcgagctgagcaaattcgtgaaagatttctcaggcaatgcgtcctgccaccctcccgaggccaagacatgggcctcgagacctcaggttccagagccacggccacaggccccagacttgtatgacgacgatctggaattccgacccccgtcccgtcctcagtcctccgacaaccagcagtacttttgtgcacccgctcctctgtctccttccgctaggccaaggagcccatggggaaagctcgatccatatgattctagcgaagacgataaagaatatgtgggctttgctacacttcccaatcaagttcacaggaagtccgtgaagaaggggttcgattttacactcatggtggcaggggagtcaggcctgggcaaatcgacactggttaacagcctcttcttgaccgatctgtaccgggacaggaagctcctgggagccgaggaaagaataatgcaaaccgtggaaattacgaagcacgccgtggacattgaggagaaaggagttcgactgcgcctcaccattgtcgacacccccgggttcggtgatgccgtcaacaataccgaatgttggaaacctgtagctgaatatatcgatcagcagtttgagcagtactttagagacgagagcggtctgaacaggaaaaacatccaagataatcgggtgcactgctgcctgtacttcatttcacccttcggccacgggcttaggcccctcgatgtggaatttatgaaggctttacaccagcgcgttaatatcgtcccgattttagccaaagctgatactctgacaccacctgaggtcgatcataagaagagaaaaattagggaggagatcgagcattttggtattaaaatatatcagttccctgactgcgattcagatgaagacgaagactttaaacttcaggaccaggccctgaaggaatctattccctttgccgtgatcggctccaatacagtggtcgaggctaggggaaggagagtgcggggacggctttacccgtggggcatcgttgaggtcgagaaccccggacactgcgattttgtgaaactaaggacgatgctggtgagaacacacatgcaggacttgaaagacgtgacgagagagacacactatgagaattatcgggcacagtgcatacaatccatgactagacttgtggtgaaggaacgcaaccgaaataaactgaccagggaatccgggactgattttccaattccagctgtaccccccggcactgacccagagacagagaaactcattagggagaaagacgaggaactgcgtcggatgcaggagatgctccataaaatccaaaagcagatgaaggagaattat

SEQ ID NO: 32565 - DNA, 1434 bp, Artificial Sequence
  Description of Artificial Sequence: Synthetic coding sequence
atggacaggtcactgggttggcaaggtaattcagtgccagaagaccggaccgaagcgggcataaaacgatttttagaggatactaccgacgacggggagttgagtaaatttgtaaaggacttcagcgggaatgcttcttgccatccccccgaagctaaaacatgggcgtcaaggccgcaagtacctgaaccgaggccccaggcccccgacttgtacgatgatgatctggaattccgccctcctagccgcccccagtcttcagacaatcaacagtacttttgcgcccccgcacctttgtcaccctctgcaaggcctagaagcccctgggggaagctggatccttacgatagttcagaagatgacaaggagtacgttggcttcgctacactcccaaaccaggtacaccgcaagtcagtcaaaaagggatttgatttcacgctgatggtagccggagaaagcgggttgggtaaatccacgctagtaaactcattattcttgaccgatctgtatcgggatcgtaagctgctgggtgccgaagaaagaatcatgcagaccgtcgaaatcactaagcacgccgtagacatagaggaaaaaggcgttagactccgcttgacaattgtagatacacccggcttcggcgacgctgtcaacaatacggagtgttggaaacccgtcgccgagtatattgaccaacagtttgaacaatactttcgagatgagagtggcctaaacagaaagaacatccaagataatcgcgtgcactgctgcttatatttcatttcaccttttgggcatggactacggcccctagatgtggagtttatgaaggccctgcaccaacgcgtaaacatagtaccgattctggcaaaggccgacactctgactccaccagaagtagatcacaagaagaggaagattcgagaggaaatcgaacactttggaataaaaatctaccagtttccggactgcgattcagacgaagacgaggactttaaactgcaggaccaagcgctaaaagaatccattccttttgccgtaatcggctcgaacacagtggtggaagcgcggggcagacgcgtgaggggcagattgtacccgtggggcattgtggaagtcgagaatcccggccattgtgattttgtgaagctgcgcactatgctggtcagaacccacatgcaggatctgaaagacgtgacccgggaaacacattacgaaaactatagagcacagtgtatccaatcaatgacccgcctggtggtgaaagaaaggaacagaaacaaactcacccgggagtcgggaactgatttcccgatcccagcagtgccgcccggaactgaccccgaaactgagaagctgatcagggaaaaagacgaggagctgcgcagaatgcaggaaatgcttcacaagattcagaagcagatgaaggagaattat

SEQ ID NO: 32566 - DNA, 1434 bp, Artificial Sequence
  Description of Artificial Sequence: Synthetic coding sequence
atggaccgctctctggggtggcagggaaattcagtgccggaggatcgcacggaagcaggcattaagaggtttctggaagatactaccgacgacggagagctgagcaagttcgtgaaggacttctccggcaacgccagctgccaccctccggaagccaagacctgggcgagccggcctcaagtgccagagccgcggccacaagcgccggacctctacgacgatgacctcgagtttcgcccaccatcccgcccgcaatcgtcagataaccaacagtatttctgcgccccggctcctttgtcacctagcgccagaccgcgaagcccttggggcaagctggacccgtacgactccagtgaggacgacaaggaatacgtggggttcgcaactcttcccaaccaggtccaccggaagagcgtgaagaagggatttgacttcacccttatggtcgctggagagtcaggactcggtaagagcaccctcgtgaacagcctgtttcttactgacctctaccgcgatcgcaagctcctcggggcagaggaacgaattatgcagactgtggaaatcactaaacatgcagtcgacatcgaagagaaaggcgtgaggcttaggctgactatcgtggatacccctggcttcggagatgcggttaacaacaccgaatgttggaaaccagtggccgaatacatcgaccaacagttcgagcaatactttcgggatgagagcggactgaaccgcaaaaacatccaagataatcgcgtgcattgctgcctgtacttcatttccccattcggtcatggtttgcgcccgctggatgtggaattcatgaaggctctgcatcagcgggtgaatatcgtgccgatcctggccaaggctgataccctcacgccaccggaggtggatcacaagaagcggaagatccgggaggagatcgagcacttcggcatcaagatctaccagttcccggattgcgacagcgatgaagatgaagatttcaagctccaagatcaggccctgaaggagtcgatcccttttgcagtgatcgggtctaacacggtcgtcgaagcacggggccgcagagttcggggacggctctacccctggggtattgtcgaggtggaaaaccctggtcattgtgacttcgtgaaactgagaaccatgttggtgcgcactcacatgcaggatctgaaagacgtgactcgcgaaacccactatgagaattaccgcgcacaatgcatccaatcgatgactcggctggtcgttaaggaacggaaccgcaacaagctgactcgcgaatccggcactgacttccccataccggctgtgcctccggggactgacccggaaactgagaagttgatccgggaaaaggacgaagaactgcgccggatgcaggaaatgctgcacaagatccagaaacaaatgaaagaaaactac

SEQ ID NO: 32567 - DNA, 1434 bp, Artificial Sequence
  Description of Artificial Sequence: Synthetic coding sequence
atggatagatctctgggatggcaaggtaactcggtgcctgaggatagaactgaggcaggtattaagcgtttcctcgaggatactaccgatgatggtgaacttagcaagtttgtgaaggatttttcaggtaacgcatcgtgtcaccccccagaggcaaagacgtgggcatcaagacctcaagtcccagaaccccggccgcaagcaccagatctgtatgatgatgatcttgaatttcggccgccttcgaggccccaatccagcgataatcaacagtacttctgtgcgccggccccgttgtcgccatctgccaggccgcgttcaccttggggaaaactggacccgtacgattcctcggaagatgacaaagaatatgttggatttgctactctgccaaatcaggtccatcgcaagagcgtcaaaaagggttttgattttaccctgatggtcgcaggggaatctggtctgggaaagagcactcttgtgaactccctgttcctgaccgatctgtacagggataggaaacttcttggtgctgaagaacggatcatgcaaaccgtggagatcactaagcatgcagtggacatcgaagaaaagggagtgcgcttgagacttacgattgtggatactcctggctttggagacgcagtgaataacactgaatgttggaaacctgtggcggagtacatagatcaacaatttgagcagtacttccgggacgaatccggcctcaaccgcaagaatatccaggataatcgggtgcactgttgtctttacttcattagccccttcgggcatggactgcgcccgttggatgttgagtttatgaaagcactgcatcaacgcgtcaacatcgtgcccattcttgctaaggcggacacccttacccctcctgaagtggatcataagaagagaaagatccgcgaagagattgaacatttcgggataaagatttaccagtttccagattgcgattcagatgaggacgaggacttcaaactccaggaccaggcactcaaagaatctatcccatttgctgtgattggaagcaataccgtggtggaagcacggggacgccgcgtccggggtcgtttgtacccttggggcattgtggaggtcgaaaaccccggacactgtgactttgtgaagctgagaactatgcttgtgcgaacccacatgcaagaccttaaagacgtgactagagaaacccactacgaaaactatcgggcccagtgtattcagtccatgacccggctggtcgtgaaagaacgtaatagaaacaaactcactcgagaatcaggtactgatttccctattcctgcggtgccacccgggactgaccctgaaacggaaaagctgataagggagaaagacgaagaacttcgtcgcatgcaggaaatgctgcataagatacaaaaacaaatgaaggagaattac

SEQ ID NO: 32568 - DNA, 1434 bp, Artificial Sequence
  Description of Artificial Sequence: Synthetic coding sequence
atggaccggtcccttggttggcagggaaactcggtccctgaagatagaacggaggcagggattaagcggttcctggaggacaccactgacgacggtgaactctcgaaatttgtgaaggatttttcgggaaacgcgtcctgtcacccgcctgaggccaagacctgggcgagccggccgcaggtgcctgaaccccggcctcaggcccctgatctgtacgatgacgacctcgagtttcgtccaccttcacgcccacagagctcagataatcagcaatacttttgtgctcccgcaccactgtccccatcggcaagacctcgatctccttggggaaaactggacccttacgattcatcggaggacgacaaggagtacgtgggatttgcaacgctgcctaaccaagtgcatcgtaagagcgtgaaaaagggtttcgattttaccctgatggtggcgggagagagtggacttggaaagtccacccttgtgaatagcctttttctgactgatctctacagggacagaaagttgctcggggcggaagaacggattatgcagaccgtcgagattaccaagcatgcagtggacatcgaagaaaagggcgtgaggctccgcctgacgatcgtcgatactcctggattcggggatgccgttaacaacactgagtgctggaagcctgtcgcggaatacattgaccagcaatttgagcagtactttcgtgacgagtcaggccttaaccgcaagaacattcaagataaccgggttcattgttgcctgtactttatcagcccttttggacatggtttgaggcctcttgacgtggaattcatgaaagcccttcatcaaagggtgaacatcgtccctatactggcaaaagcagacactctgactccacctgaagtggaccataagaagcggaagatcagagaagagattgaacacttcggaatcaagatctaccagtttcctgattgcgactcggacgaagatgaggatttcaagctccaggaccaagccctcaaagagagcatcccctttgccgtaattggttcaaatactgtcgtcgaagcacgcggtcgacgcgtgagaggacggttgtatccatggggaatcgtggaagtcgaaaacccgggacattgcgattttgtgaaacttaggactatgcttgtgaggacccacatgcaggacttgaaggacgtcactagagaaacccattacgaaaactatagagcacaatgcattcagagcatgacccggcttgtcgtgaaggagaggaatagaaataagctcactagagagtccggcactgattttcctattccagcagtgccccccggaaccgatcctgaaaccgaaaagctcattagggagaaggatgaggagcttcgacgtatgcaagaaatgctgcacaaaatccagaaacagatgaaggaaaactat

SEQ ID NO: 32569 - DNA, 1434 bp, Artificial Sequence
  Description of Artificial Sequence: Synthetic coding sequence
atggatcgttcgctaggttggcaaggtaattcggttccggaagatcgaacggaagcgggtataaaacgatttttagaagatacgacggatgatggtgaactatcgaaatttgtaaaagatttttcgggtaatgcgtcgtgtcatccgccggaagcgaaaacgtgggcgtcgcgaccgcaagtaccggaaccgcgaccgcaagcgccggatctatatgatgatgatctagaatttcgtccgccgtcgcgtccgcaatcgtcggataatcaacaatatttttgtgcgccggcgccgttatcgccgtcggcgcgtccgcgttcgccgtggggtaaattagatccgtatgattcgtcggaagatgataaagaatatgttggttttgcgacgctaccgaatcaagtacatcgtaaatcggttaaaaaaggttttgattttacgttaatggtagcgggtgaatcgggtctaggtaaatcgacgctagtaaattcgttatttttaacggatctatatcgtgatcgtaaactactaggtgcggaagaacgtataatgcaaacggtagaaataacgaaacatgcggtagatatagaagaaaaaggtgttcgtttacgtttaacgatagtagatacgccgggttttggtgatgcggtaaataatacggaatgttggaaaccggtagcggaatatatagatcaacaatttgaacaatattttcgagatgaatcgggtctaaatcgtaaaaatatacaagataatcgagttcattgttgtctatattttatatcgccgtttggtcatggtctacgtccgttagatgtagaatttatgaaagcgttacatcaacgtgttaatatagtaccgatattagcgaaagcggatacgctaacgccgccggaagttgatcataaaaaacgaaaaatacgtgaagaaatagaacattttggtataaaaatatatcaatttccggattgtgattcggatgaagatgaagattttaaattacaagatcaagcgttaaaagaatcgataccgtttgcggtaataggttcgaatacggttgtagaagcgcgaggtcgtcgagttcgtggtcgactatatccgtggggtatagtagaagtagaaaatccgggtcattgtgattttgttaaattacgaacgatgctagttcgtacgcatatgcaagatttaaaagatgtaacgcgagaaacgcattatgaaaattatcgagcgcaatgtatacaatcgatgacgcgattagtagttaaagaacgtaatcgtaataaactaacgcgagaatcgggtacggattttccgataccggcggtaccgccgggtacggatccggaaacggaaaaactaatacgtgaaaaagatgaagaactacgtcgaatgcaagaaatgttacataaaatacaaaaacaaatgaaagaaaattat

SEQ ID NO: 32570 - DNA, 1434 bp, Artificial Sequence
  Description of Artificial Sequence: Synthetic coding sequence
atggaccggtctctgggttggcagggcaatagcgtgcccgaggatcgaacagaggcgggcatcaaaagattccttgaggacaccacggatgatggggaactgagcaagttcgtcaaggatttttctggtaatgccagttgccaccctccggaggccaaaacatgggccagcagacctcaggtgcccgaaccccgtccccaagctcctgacctctatgatgatgacctggaattccgaccaccaagccgcccccaatcatcagataatcaacagtatttctgtgcaccagcacctctctcccccagtgcccggccacgcagcccatggggcaagttggatccttacgattcttcagaggatgacaaagaatacgtcggctttgccacacttccaaatcaggtgcacaggaagtcggtgaagaaagggtttgactttactctaatggtggctggcgagtcgggcctaggcaaatcaacgctagtcaatagcctgtttctgaccgatctgtacagagaccggaaactcctgggggcagaagaaaggatcatgcagacagttgagattactaaacacgcggtggatattgaagaaaaaggggtgcgactgagattaactattgtcgacactccaggcttcggcgacgctgttaacaacactgagtgttggaaaccagtagcagagtacatcgatcaacagttcgagcaatactttcgggatgagagcgggctgaaccgcaagaatattcaggataaccgggtccactgctgtttgtatttcattagtccttttggccacggcttgcggcccctggatgtggagtttatgaaggcactccatcagcgtgtaaatatagtacccatactcgcaaaggccgacactctgacaccacccgaggtggaccacaagaagaggaagattcgtgaggagatcgagcacttcggaataaagatataccagttccctgactgcgactcagacgaggatgaagactttaagcttcaggatcaggcccttaaggaatccatccccttcgccgttatagggtccaataccgtggtcgaggctaggggccggagagtccgtggacggctctatccatgggggattgtagaggtggagaatccaggacattgtgatttcgtcaagctccggacaatgttggttcgaacgcatatgcaggatctgaaggacgttaccagagaaacccactatgagaactacagggcgcagtgcatccagtccatgactcgcctggtggtgaaggagcggaacaggaataaactgacacgcgaatcgggaaccgacttcccaatccccgctgtcccgcctggaaccgaccctgagaccgagaagctcatccgggaaaaagacgaagaactccgccgaatgcaggaaatgctccacaaaatccagaaacagatgaaagagaactac

SEQ ID NO: 32571 - DNA, 1434 bp, Artificial Sequence
  Description of Artificial Sequence: Synthetic coding sequence
atggaccgttcccttggttggcagggcaacagcgtgccagaagatcgaactgaggcgggaatcaagcgcttcttggaggacacgactgatgatggagaactgtcgaagttcgtcaaggatttctcgggaaacgcatcgtgccatcctccggaagctaaaacttgggcctcaaggccacaggtgcctgagccccggccacaagccccggacctgtacgacgatgacctggagtttagacctccctccagaccgcaatcctccgataaccaacaatacttttgcgcgccagcgccgcttagcccttcggctcgcccacggagcccttggggaaagctggatccctacgactcctcagaagatgacaaagagtacgttggattcgccactctcccgaaccaggtgcacaggaagtccgtgaagaaggggtttgacttcactctgatggtcgctggcgagtctggactcggaaagtctactctcgtcaactctctcttcctgaccgacctgtaccgcgatcgcaaactcctcggggccgaagaaaggataatgcagacggtggaaattaccaagcacgcagtggatatcgaggaaaaaggagtgcggctgcggctgaccatcgtggacactccgggtttcggtgacgctgtcaacaataccgaatgttggaagcctgtggcggagtatattgaccagcagttcgagcagtacttccgcgacgagagcgggctgaatcgcaagaatatccaggacaatcgcgtgcattgctgcttgtatttcatctcgccattcggacacggtctgaggcctttggacgtggaattcatgaaagctctccaccaacgcgtcaacattgtgccgatcctggccaaggccgataccctgaccccgccggaggtcgatcacaaaaagcgtaagatccgggaggaaatcgaacatttcggaatcaagatctaccagtttccggactgcgactcggacgaggacgaggatttcaaactgcaggaccaagcgttgaaggaaagcatcccctttgcagtgatcggatcaaacaccgtcgttgaggcacggggacgacgcgtgagaggccggttgtacccttgggggatcgtggaagtggaaaatcccggccactgtgatttcgtgaagttgagaaccatgctcgtgcggacccatatgcaggacctcaaggacgtgactcgcgaaacccactacgagaattaccgggcccagtgcatacaatcgatgaccaggctcgtcgtcaaagagagaaacagaaacaagctcactagagagagcgggaccgattttccgatccccgccgttccgccaggcactgacccggaaactgagaagctgattcgtgaaaaagatgaggaacttcgtcgcatgcaagaaatgttgcacaagatccagaagcagatgaaagaaaactac

SEQ ID NO: 32572 - DNA, 1434 bp, Artificial Sequence
  Description of Artificial Sequence: Synthetic coding sequence
atggatagatcattgggttggcaaggaaactcggttcctgaggacaggactgaggcgggaataaaaaggtttcttgaggatactactgatgatggagaactttcgaagttcgtcaaagacttctccgggaatgctagctgccatcctcctgaagcgaaaacatgggcctcccgcccacaagtgcctgaacctcgtcctcaagcacctgacttgtacgatgatgatctcgagttcagacccccctctagaccgcagagcagtgataaccaacaatatttttgcgcgcctgcccccttatccccgagtgctcgcccaaggtcgccctggggaaaattggatccgtacgatagttcggaagatgataaggaatatgtcggtttcgccacgttgccaaatcaggtccatcgtaaatccgtaaagaaaggatttgacttcacacttatggttgcaggcgaatccgggttgggtaagagtaccttggttaacagcttgttcttaactgatctctacagggaccggaagcttctaggtgctgaggagagaattatgcaaactgtggagattacaaaacacgcggttgacatcgaggaaaagggtgtgcggcttagattgactatcgtggacaccccgggtttcggagatgcagttaataatacagaatgctggaaacctgtcgccgagtatatcgatcaacagttcgaacaatattttcgcgatgaaagtggacttaatagaaaaaatatccaagataaccgtgtccactgctgtctttactttattagtcctttcggtcatgggttacgccctctcgatgtggagttcatgaaggccctccaccagcgcgtcaatattgttcctattttagccaaagctgataccttgaccccaccagaagtcgatcacaaaaagcgcaagattcgtgaggagattgaacattttggcattaagatttaccaatttcccgattgcgactccgatgaagatgaggacttcaagcttcaagatcaagctcttaaagagtctattccgttcgcagtcattggatccaacacagttgtcgaagctaggggacgcagagtcagaggaaggctttacccttgggggatcgtcgaagtggaaaatccgggtcattgcgattttgttaagttgcgtaccatgctggttcgaactcatatgcaagatcttaaggatgttactcgtgagactcattatgagaactacagagctcagtgtattcaatctatgacgcgactggtggttaaggagcgaaataggaataagctgacacgggaaagcggtacagatttcccaattccagcagttccccctggaactgaccccgaaaccgagaagttaattcgcgagaaagatgaggaattacgtaggatgcaagaaatgctccataagatccagaagcaaatgaaagaaaattac

SEQ ID NO: 32573 - DNA, 1434 bp, Artificial Sequence
  Description of Artificial Sequence: Synthetic coding sequence
atggacagaagcctcggttggcaaggaaattcggtgcctgaggaccggaccgaagcaggaatcaaacgcttcctggaagataccacggacgacggggaactctccaaatttgtcaaagacttttcaggaaacgcgagctgccacccgcctgaggccaaaacttgggcctcgcggcctcaggtgccagaaccaaggccgcaggcgcctgacctctacgatgatgacctggaattccggcccccgtcccgcccgcaatcatcggataaccaacagtacttttgcgcaccagcgcctctgagcccaagcgctcgcccccgctcgccctggggcaagttggacccatacgactcaagcgaggatgacaaggagtatgtcggcttcgcaactctgccgaatcaagtccatcggaagtcagtaaagaaaggattcgacttcaccctcatggtggctggcgagagtggactgggaaagtccactcttgtgaactccttgtttctgacggacctgtaccgagatcgaaagctccttggtgcggaagaacggatcatgcagactgttgaaatcactaagcacgcagtcgacatcgaagaaaaaggcgtcaggctgcgcttgaccattgtggacaccccaggatttggggacgccgtgaacaacactgagtgctggaagccagtcgcagaatacattgatcagcaattcgagcaatacttcagggatgagagcggtcttaatcgcaagaatatccaagacaatagggtgcattgttgtctgtacttcattagcccttttggacacggactccgcccgctcgacgtggaattcatgaaagcccttcatcagcgagtgaatatcgtgccgatcctcgcgaaggccgatactctgaccccgccggaggtggaccacaagaagcgcaaaatcagagaggaaatagaacacttcggaatcaagatatatcagtttccggactgcgatagcgacgaagatgaggacttcaagctgcaggaccaagctctcaaagaatccatcccattcgctgtgatcggctccaacaccgttgtcgaggcccggggtcgcagggttagaggtcgcctgtacccgtgggggatcgtggaagtggagaacccgggccactgcgacttcgtgaagctgcggactatgttggtgaggacccacatgcaggatctgaaagacgtgacccgcgagactcattacgagaattatcgggcacagtgcatccagtcaatgaccaggcttgtggtaaaggagcgaaacaggaacaagctgaccagagaatctgggaccgatttcccgatccccgcagtgccgccgggaacggatcccgaaacggaaaagctcatccgcgagaaagatgaggaactcaggcgcatgcaggagatgctccataagattcagaagcaaatgaaggaaaactac

SEQ ID NO: 32574 - DNA, 1434 bp, Artificial Sequence
  Description of Artificial Sequence: Synthetic coding sequence
atggatcgctctctgggatggcaggggaactctgtgccagaggacagaaccgaagccggaataaagcgctttcttgaagacacaacggatgacggcgagttgtccaagttcgtcaaagacttttccggcaacgcctcctgccacccgcctgaagcgaagacatgggcatcacggccccaagtgcccgaaccaaggccacaagcccctgacctctatgacgatgacctggaatttagacccccttccagacctcagtctagtgataatcagcagtacttttgtgcaccggccccactgtcaccctccgctcgccccagaagtccatggggaaaactggatccatatgacagcagcgaggacgataaggaatacgtcggcttcgctactttacctaaccaagtgcatcgcaaatcagtgaaaaaaggatttgacttcaccctcatggtggccggtgaatccgggttgggcaaaagcactctggtaaattccctatttctcactgatttatacagagatcgaaaactgctgggagccgaggagagaatcatgcaaaccgtggagattactaagcacgctgtagatatcgaagagaaaggcgtgagactacgtctgaccattgtagacacccctgggtttggcgatgctgtcaataatactgagtgttggaaacccgttgctgagtatattgaccagcagttcgagcaatatttccgcgacgagagcgggctcaaccgcaagaatattcaagataatcgcgttcactgctgtttgtacttcatctcgcccttcggccacggcctgagacctctagatgttgagttcatgaaagcgctgcaccagagggtaaacatcgtgccaattctggctaaggctgacacccttacgccgcctgaggttgaccacaaaaaaagaaagatacgggaggaaattgaacactttggtattaagatctaccaattcccggattgtgattccgatgaggacgaggatttcaaacttcaggaccaggctttaaaggagtcaatacctttcgcagttataggatctaatactgtggtggaggcccgcggacgccgggttagaggtcggctgtatccgtggggtattgtagaggtggaaaatcccggccattgtgacttcgtgaaactgagaaccatgctcgtacggacacacatgcaggatttgaaagatgtcaccagggaaacccattacgaaaactaccgcgcccagtgtatccaaagcatgacacggctggtcgtgaaagagcgcaaccgcaataaactgactagagagtccgggacagacttcccaatacccgcggttcccccaggcaccgatccggagactgaaaagctcattcgggaaaaagatgaagagctgagacggatgcaggagatgttgcacaagatacagaaacagatgaaggaaaactac

SEQ ID NO: 32575 - DNA, 1434 bp, Artificial Sequence
  Description of Artificial Sequence: Synthetic coding sequence
atggatcggagtctgggctggcaagggaacagcgttccagaagatcggactgaagcagggatcaagagatttctcgaggatactactgatgatggagaattgtctaagttcgtcaaggatttctcaggaaacgcgtcctgccatccaccagaagctaaaacctgggccagcaggccccaagtgcctgaaccaaggcctcaggccccagatctgtacgacgatgatctggagtttcgccctccgtcgcggccgcagtcatcagataatcagcagtatttctgcgcaccagcccctctgtccccttcggcccgccctcgctcgccttggggaaagctggatccctacgactccagtgaagatgataaggagtacgtcggatttgctacgcttccaaaccaagtgcaccggaaatcggtcaagaaaggctttgactttaccttgatggttgcaggcgagtcggggcttggaaagtctaccctggtgaattccctttttctcactgacctctacagagacaggaaacttctcggagcagaagaacggattatgcaaaccgttgagatcaccaagcatgcagtcgatattgaagaaaagggagtgaggctccggctcactattgtggacacccccggatttggcgacgcagtgaacaatactgagtgttggaaacccgtggcagaatacatcgatcaacaattcgaacagtatttcagagacgaatccggtcttaacaggaagaacattcaagacaatagagtgcattgttgcctgtacttcatatcgcctttcggccacggacttcgtcctctcgacgtggagtttatgaaagccctgcaccagcgggtgaacatcgtgcctattctggctaaggccgacacccttactccccctgaggtcgatcacaagaagaggaaaattcgtgaggagattgaacatttcgggataaagatataccagtttccggactgtgacagtgatgaggatgaagatttcaagttgcaggatcaagcgcttaaggaatcaatcccatttgcagtaataggtagcaacacggtggtggaggcacgcggccgccgcgtgcgtggtagactttacccgtggggaattgtggaagtggaaaatccaggtcattgtgactttgtcaagctgagaactatgctggtgagaacgcatatgcaggaccttaaagatgtgacccgggagacgcattacgaaaactaccgtgcgcaatgtatccagtccatgaccaggcttgtggtgaaggaacgcaataggaacaagctgacccgagagagcggtaccgattttcctatccccgcagtaccccctgggactgacccggaaaccgagaaactgattcgagaaaaggatgaagaactccgaagaatgcaagagatgcttcacaaaatccaaaagcagatgaaggagaattac

SEQ ID NO: 32576 - DNA, 1434 bp, Artificial Sequence
  Description of Artificial Sequence: Synthetic coding sequence
atggaccgctccctgggatggcaggggaactcggtgcccgaagataggaccgaggccggaatcaagagatttctggaagataccaccgacgatggggaactgtcaaagttcgtgaaggatttcagcggaaacgcctcctgccacccgccggaggcaaagacctgggcctcccggccgcaggttccggagccgaggccacaagccccggacctgtatgacgacgacctcgagtttagaccaccaagccggccacagagcagcgataatcaacaatacttctgcgcaccggctccgttgtcaccttcggctagacctcgcagcccgtggggaaagctggatccatacgacagctcggaagatgacaaagaatacgtgggattcgccactttgccgaaccaggtccatcgcaagtcggtgaaaaagggttttgacttcaccctgatggtcgcgggcgaaagcggccttggaaagagcacccttgtgaacagcctgtttcttaccgacctctaccgcgatcggaaacttctgggggcagaggagcgcataatgcagaccgtggaaatcaccaagcacgccgtggacatcgaggaaaaaggggtgcggctgcgcctgactattgtcgacaccccgggattcggagacgcagtgaataacaccgagtgttggaaacctgtggctgaatacatcgatcagcaatttgagcaatacttccgagatgagtcagggctcaaccgaaagaacatccaagataaccgggtgcactgctgtctctactttatctcaccttttggccacggactgcggccgctggacgtggagttcatgaaggcgctgcatcagagggtgaatatcgtccctattctggcaaaggctgacaccctcactccaccagaagtggaccacaagaagcggaagatccgggaagaaatcgaacacttcgggatcaaaatctatcagttccccgactgcgattccgatgaagatgaggactttaaactgcaggaccaagccctcaaggagtcgatcccatttgccgtcatcggcagcaataccgtggtcgaggcaaggggcaggcgggtgcgcggacgtttgtacccgtggggaatcgtcgaagtggagaatcctggacattgcgatttcgtcaagctgcgcactatgctcgtgcgcacgcacatgcaagatctgaaggatgtgaccagggaaactcattacgaaaactacagagcgcagtgcatccaatcgatgaccagactggtggtgaaggaacgcaatcggaacaaattgacccgcgaatcgggaactgactttccgatcccggcggttccgccgggcactgacccggaaactgagaagttgattcgcgagaaagatgaagaactgagaagaatgcaggagatgcttcataagatccaaaagcagatgaaggaaaactac

SEQ ID NO: 32577 - DNA, 1434 bp, Artificial Sequence
  Description of Artificial Sequence: Synthetic coding sequence
atggatcggtcattaggttggcaaggaaatagtgttcctgaggaccgaacggaggcaggcatcaaacgttttttggaggataccacagacgatggtgagctgagcaaattcgtgaaagacttctcaggaaacgcttcatgccatccacctgaggccaagacatgggcatccagaccgcaggttccggagcctcgtccccaggcgcccgatttgtatgacgatgacctcgagttccgcccaccaagccggccacaatcgtcagacaaccaacagtatttctgtgctcccgcgcccctgtcgccatctgccagaccacgaagcccatggggaaagctggatccttacgattcatccgaagacgacaaggagtacgtgggttttgcaacgctacctaatcaggtacatcgaaaatcggtgaagaagggatttgatttcactctcatggttgctggcgaatcagggctcgggaaatcaacactcgttaactccttgttcctcaccgacctataccgggaccgtaagttactaggagccgaggaacgtattatgcagaccgttgagataactaaacacgcagtagacattgaagaaaaaggagtacgattacgattgacgattgtcgacacccctggattcggtgatgctgttaacaacacagaatgctggaagccggtggctgagtatatcgatcagcaattcgagcaatacttcagggacgaaagcggattgaatcgaaagaatattcaggacaaccgcgtgcactgttgtctctacttcatatccccttttggacatggactgcgcccactcgacgtggaattcatgaaggccctccaccagagggttaatatagttccgatactggcgaaggctgacacgttgacgcccccggaggtggaccacaagaagcgcaagatacgcgaggaaatagagcatttcggaattaaaatttatcagttccccgactgcgattccgatgaagacgaagatttcaagcttcaagatcaagccctgaaagagtcaattccgttcgcagtgattggtagcaacactgtggtcgaggcacgaggccgacgcgtgcggggccggttgtatccgtggggtattgtggaagtcgaaaaccccggccattgtgattttgtaaaactccgaactatgcttgtgcgtactcatatgcaggacttgaaggatgtgactcgagagacccactatgaaaactacagagcccagtgtatccagtcaatgactcgcctcgtagttaaggagcgtaatcgaaataaacttaccagagagtcgggcacggactttccaattccggcagtgcctccgggcacggatcctgagaccgaaaagttgattcgggaaaaagacgaggaacttcgcaggatgcaagagatgttacacaagatccagaaacaaatgaaggaaaactac

SEQ ID NO: 32578 - DNA, 1434 bp, Artificial Sequence
  Description of Artificial Sequence: Synthetic coding sequence
atggatcgatcgctgggatggcagggtaattcggttcccgaagaccggaccgaggccggaattaagcgtttcctggaggatacaacagacgatggcgagctcagtaaatttgtgaaggacttttctggcaacgcctcatgccatccccctgaagccaagacgtgggcctcccggccacaagtgcccgagcccaggccacaggcccccgatctatacgacgacgatttggaatttcgtcctccttccaggccacagtcatctgataaccagcaatatttctgtgctcccgctccactgtcgccttcagccagacctaggtcaccttggggaaagctggatccatatgatagctctgaggacgacaaagaatacgtcggattcgctacactacctaaccaggtccacaggaagtcggtcaaaaagggcttcgactttaccctcatggttgccggtgagagcggcctagggaaatctactctggtgaactctcttttccttactgacctatatcgcgaccgcaaactgcttggggccgaggagcggatcatgcagacggtggaaattaccaagcacgccgtggacattgaagaaaagggcgtccgactacggctgacgattgtagatacgccaggctttggagatgctgtgaacaatacagaatgctggaagccggtggctgagtacatcgatcagcaatttgagcagtactttcgggatgagagcggactgaataggaagaacatccaggataatcgcgttcattgctgtttgtatttcataagtccctttgggcacggattgcggccgctcgatgtggaatttatgaaagccctgcaccagcgggttaacatcgttccaattcttgcaaaagccgacactctgacaccgccggaagtcgaccacaagaagcggaagatcagggaagaaatcgaacacttcggcataaaaatttatcaatttcccgactgcgactctgacgaggatgaggactttaaactccaggatcaagccctgaaagagtcaatccccttcgcagtgatcggtagtaacacagttgtggaggccagggggaggcgcgttagaggtagactttacccctggggcatcgttgaagtggaaaatccgggacattgtgacttcgtcaaactgagaacaatgttggtacgaacacatatgcaggatctgaaagacgttacacgagagacacactacgaaaactaccgggcacagtgcatacagtctatgaccagactggttgtaaaggagagaaatcgaaataaactgacccgagagagtggaacggactttcctattcccgccgtgccccctgggactgacccagagacggagaaactcatcagggagaaagatgaggaactgagacgtatgcaggagatgttgcacaagattcagaaacagatgaaggaaaattat

SEQ ID NO: 32579 - DNA, 1434 bp, Artificial Sequence
  Description of Artificial Sequence: Synthetic coding sequence
atggatcgctcccttgggtggcaggggaattccgttccagaggaccggaccgaggctgggatcaaacggttcctggaagacaccaccgacgatggggaacttagtaaatttgtgaaggatttttcaggcaacgctagttgccacccccccgaggccaaaacatgggcttctcgaccccaagtgcctgagccgaggccccaggctcccgatctgtatgacgatgacctggaatttcggccccctagtcggcctcagtcatccgacaaccagcagtatttttgtgcacccgcccctcttagtccttccgcccggcctaggtccccttggggtaagcttgatccctatgactcttctgaggacgacaaggagtacgtggggtttgccacattgccaaaccaggttcatcggaagtctgtgaaaaagggcttcgatttcactctgatggtcgcgggcgaaagtggtctgggaaagtctacactggtcaactccttgtttctcacagatctctatcgagatagaaaactgctcggcgctgaggagcggatcatgcagacagtggaaattacaaagcatgccgttgatatcgaagagaagggggtccggctgcggctgacaattgtggacactccggggttcggggacgcggtgaacaacacagaatgttggaagcccgttgctgagtatatagatcagcaattcgagcagtactttcgggatgagtccgggcttaaccgtaagaatatacaggacaaccgtgttcactgttgtctgtattttatctcgccctttggacacggtctgaggccactcgacgtggaatttatgaaggcactgcaccagagggtaaacatcgttcccatcctggccaaagcagacaccctcaccccccctgaggtggaccacaagaagcgaaagattcgagaagagattgaacactttggcataaagatttaccagttccctgactgtgactctgacgaggatgaagactttaagcttcaggaccaggccttgaaagagtcaattccttttgcggtcatcggtagcaatacagtggttgaagcaaggggacggagagtccggggcagattgtatccctggggaattgtcgaagtagagaatccgggtcattgtgattttgttaagttgcgcacaatgcttgtacggacgcatatgcaggacctcaaagacgtaactagggagacacactacgagaattatcgggcacagtgcatacagtcaatgacgagattggttgtgaaggagagaaacagaaacaaactaaccagggaatctggtactgactttcccatcccagctgtacccccaggaaccgaccccgaaacagagaagctaataagggaaaaggacgaggagttgaggagaatgcaggagatgctacacaagattcagaagcagatgaaagagaactac

SEQ ID NO: 32580 - DNA, 1434 bp, Artificial Sequence
  Description of Artificial Sequence: Synthetic coding sequence
atggacagatcgctgggctggcagggcaactccgtcccggaagataggactgaggctggaattaagcggtttctggaagatacaactgatgatggtgagctgtctaaatttgtcaaggatttctcaggcaacgcctcctgtcatccgccagaagccaaaacttgggctagtaggccacaggtacctgaaccgagacctcaggcgcccgatctatacgatgatgacctggagtttaggcctccaagtcgcccccagtcatcagacaaccagcagtatttttgcgcaccagccccccttagccccagtgccaggcctcggagcccctggggtaagctggatccttacgatagcagtgaggacgacaaggaatacgttggatttgctacactgccaaaccaagtccaccggaagagcgtcaaaaaaggttttgattttaccctgatggtcgcaggtgaaagcggacttgggaagagcacactagtcaactctctgttcctgaccgacctctatcgggaccgaaaattgttaggagctgaggaaagaataatgcaaacagtggagataaccaagcatgcagtcgatatcgaggagaaaggagtgaggcttcgcctgaccatcgtggataccccagggttcggcgacgcagtgaacaataccgaatgctggaaaccagttgccgaatacattgaccagcagtttgaacagtattttcgggatgaaagcgggctgaatagaaaaaacattcaagataacagagttcactgttgtctgtatttcatttcacccttcggacacggtcttcgcccactggacgtggagtttatgaaagcactccatcagcgagtgaacattgtcccaatcctcgctaaggctgacacacttacacctccagaggtggatcacaagaagcgcaaaataagagaagaaatcgagcattttggcatcaagatctaccagttccccgattgcgatagtgatgaggatgaggacttcaagctccaggatcaagccctgaaagagagcatccctttcgctgtgattgggtccaacactgtggtggaggccaggggaagacgtgtccgcggcagactttacccctggggaatcgtggaagttgagaatccagggcattgtgattttgtgaagttacgaacaatgctggtgaggactcacatgcaagatttaaaggacgtgaccagggagacacattatgaaaactacagggcccaatgcatccagtcaatgacacgattggtggtaaaagagcggaacaggaacaagctcaccagggaatctgggaccgatttccctatccctgccgtccctccaggcacagatccagagaccgaaaaactgatcagagaaaaggatgaagagctccgaagaatgcaagaaatgcttcacaaaatccagaagcaaatgaaggaaaactac

SEQ ID NO: 32581 - DNA, 1434 bp, Artificial Sequence
  Description of Artificial Sequence: Synthetic coding sequence
atggatcgttcacttggatggcaaggaaactccgtgcctgaagatcgcacggaggcaggtatcaagcgcttcctcgaagatactacggacgacggcgagctgtcaaagttcgtaaaagatttctcgggaaacgcctcgtgtcatccacctgaggccaagacgtgggcctcccggccgcaagtccccgaaccccgccctcaggcaccagacctctacgatgatgacctggagtttcggcctccatcgaggccccaaagctccgacaaccagcaatacttttgtgcacccgctccactttcaccgagcgcaagaccacgatcgccttggggcaagttggatccttacgattcgagcgaagatgataaagaatacgtgggctttgccaccctgccaaaccaagtgcacagaaagagcgtgaaaaaaggttttgattttactctgatggtcgcaggagaatcggggctgggaaaatcaactttggtgaattcgttgtttttgaccgatctttatagagatcgcaaactgctgggggccgaggaaagaattatgcaaaccgtcgaaattacgaaacatgcagtcgacattgaagaaaaaggtgtcagactccgtcttacgatcgtcgatactcctggatttggagacgcagtgaacaatacggagtgttggaaaccagtggcggagtacatagatcagcagttcgagcaatactttcgggacgagtccggtctgaacagaaagaatatccaggataatagggtgcactgctgtctttacttcattagcccgttcgggcacggactccgcccgctcgacgtggaattcatgaaggcactgcatcagcgtgtcaacatcgtgcctatcctcgcgaaagcagatactcttactccaccagaagttgatcacaagaagcggaaaatccgggaagaaatagaacattttggaataaagatctatcaattcccagactgcgattcggatgaggatgaagatttcaaactgcaggaccaagcactgaaagaatcgattccattcgcagtgattggttcgaatactgtcgtggaggcgagagggcgtagagtgagaggcagactttacccttggggtatcgtggaagttgagaatccgggccattgcgactttgtgaaacttcggaccatgctggtgaggactcacatgcaagatctgaaggacgtgactcgcgagactcattacgagaactaccgcgcacaatgcattcagagcatgaccagactggtggttaaggaaagaaacaggaataaactcacgcgggagagcgggaccgactttcctattcccgcagttcctcctggaactgacccggagacggaaaagctgatacgggaaaaggatgaagagctgcgacgcatgcaagagatgcttcataagattcaaaagcaaatgaaggagaactac

SEQ ID NO: 32582 - DNA, 1434 bp, Artificial Sequence
  Description of Artificial Sequence: Synthetic coding sequence
atggataggtccctgggctggcagggcaattcggttccagaggacaggaccgaggctggaatcaaacgttttctggaggacaccaccgacgacggtgagctgagcaaattcgtcaaggacttctcggggaatgcgagctgccatccacctgaggcaaagacgtgggcatccagaccccaagtgcctgagcccagacctcaggcaccagatctgtacgatgatgatctcgagtttagacctccctcgaggccccaatctagcgataaccaacagtacttttgtgcacctgcccccctttcgccatctgcacgtccacgatcgccttggggaaaacttgatccctacgacagcagcgaagatgataaggaatacgtcggtttcgccactctccctaaccaagtgcatcggaagtcagtcaagaagggtttcgactttactctgatggtcgcaggggagtcaggactgggaaaatcgacccttgtgaactcactgtttttgaccgatctgtatcgcgatcggaagctgctgggtgcagaggagaggatcatgcaaactgtggagataaccaagcacgccgtggatattgaagaaaagggagtgaggctgagactcaccattgtcgacacccctggttttggcgacgcagtcaacaacaccgaatgttggaaacctgtggcagaatacatcgatcaacaattcgaacaatacttccgcgatgaatcgggccttaatagaaagaatatccaagataaccgcgtgcactgttgtctttacttcatctccccttttggacatggtctgcgccccctggacgtggagtttatgaaggcactccaccaaagggtgaatatcgtgcctattctggccaaggccgacacgctcaccccaccagaggtcgatcacaagaaaagaaagatccgcgaggaaattgagcattttggtatcaagatttaccagttccctgactgcgattcggatgaagatgaagatttcaagttgcaggatcaagccctgaaagaatcgatcccatttgcagtcatcggttcgaataccgtcgtggaagcccgcgggcgccgagtgcggggcaggctgtacccctggggaattgtggaggtggaaaaccctggacattgcgactttgtgaaactcaggactatgttggttaggacgcatatgcaggatctgaaggacgtgactcgtgaaacccactacgagaattaccgagcccagtgtattcagtccatgacccgccttgtagtcaaggaacgcaaccgaaacaaacttaccagagagagcgggaccgatttccctatacccgcagtccctcccggcaccgaccctgaaactgaaaagctgattagagagaaggatgaagagctcagacgaatgcaggagatgctgcataagattcaaaagcagatgaaggagaactac

SEQ ID NO: 32583 - DNA, 1434 bp, Artificial Sequence
  Description of Artificial Sequence: Synthetic coding sequence
atggataggtccctcggatggcagggtaatagcgtccctgaggatcggaccgaagccggaattaagcgctttctcgaagataccaccgacgacggggaacttagcaagtttgtgaaggatttctccggaaacgcaagctgtcatcctccagaagcgaaaacgtgggcttcacgaccacaggtcccggaacccagaccccaagcgccagacctttacgacgatgatcttgagtttaggcctcccagccggccccagagctctgataatcagcaatacttctgcgcacctgctcctctttcgcccagcgctagaccacggagcccatggggaaagctggacccgtacgactcctccgaggatgacaaggagtacgtcgggtttgcgactctcccaaaccaggtgcatagaaagagcgtcaagaaaggctttgattttaccctgatggtggcaggagaatccgggctggggaaaagtacgttggtgaactccctgtttctgactgatctctaccgggatagaaaactcctgggtgcagaagaaagaatcatgcaaactgtggaaatcaccaagcacgctgtggatattgaagaaaagggcgtgagactcaggctgactatcgtggatacccctggatttggcgacgcagtgaacaataccgagtgttggaagcctgtggcagaatacattgaccaacagttcgaacagtattttcgtgatgagtccggtctgaaccggaaaaacatacaagataatagggtccactgttgtctgtatttcatctcaccatttgggcatgggctgaggccactggatgtggaattcatgaaggcgctgcatcagagggtcaatatcgtgcctatacttgcaaaggcagacacgcttacccctcctgaggtggaccataagaaaagaaagatcagagaagaaatcgaacatttcggaattaagatatatcaatttccagactgtgattcggacgaggatgaagatttcaaacttcaagatcaggccctcaaagagtccattccattcgcagtgatcgggtcgaacaccgtggtggaagcacgaggtcgacgggtgagaggacggctttacccttggggaatcgtggaggtggaaaacccaggccattgcgattttgtgaaacttcggaccatgcttgtcagaacccatatgcaggacctgaaggacgtgaccagagaaacccactacgagaattaccgtgcccagtgcatacaatccatgactaggctggtggtgaaagaaagaaacagaaataagctgacgcgagagtcgggtactgattttcctattcccgccgtgccacctggtactgatccagagactgaaaagctcattcgcgaaaaggatgaagaactcagacggatgcaggaaatgttgcacaagatccagaagcagatgaaggagaattac

SEQ ID NO: 32584 - DNA, 1434 bp, Artificial Sequence
  Description of Artificial Sequence: Synthetic coding sequence
atggataggtcactcggatggcaggggaattccgtgcctgaagataggactgaagcaggaataaaaagatttctggaagatacaacagacgatggggagctatctaaattcgtaaaagatttcagtgggaacgcgtcgtgtcacccacctgaagctaaaacttgggcatctcggccacaggtacccgagcccagacctcaggctcccgacctttacgatgatgatctcgaattcaggccaccctcgcggcctcagtcttccgataatcagcagtatttttgcgcccccgccccactctcacctagtgccaggcctagatctccatggggaaaactggatccctacgattcctctgaagatgataaagaatacgtggggttcgctacactacccaaccaggtgcaccgaaagtccgtcaaaaaaggatttgactttacacttatggtcgcaggagaatcggggctcggaaaatctactctagtaaacagtttattcctcacagatctttatcgggatcgaaaactgctgggagctgaagaaagaatcatgcagacagtggaaataacaaaacatgccgttgacattgaagaaaagggagtacggctgcgactcactattgttgacactccaggatttggggatgctgtgaataatactgagtgttggaaaccagtcgccgaatatatcgaccagcagttcgaacagtatttccgtgatgaatctggacttaaccgcaaaaatatacaagataatagagtgcactgttgcctatacttcatctcccccttcgggcatgggctaagaccccttgatgtggaattcatgaaagctctacaccagcgggtcaatattgttcccatattggccaaagctgatacacttactccacctgaagtggaccacaaaaaaaggaagatccgggaggaaatagaacattttggaataaaaatttatcagtttccagattgtgactccgatgaagatgaagatttcaaactccaagaccaagctctcaaagaatcaatcccattcgccgttatagggagtaatactgtcgtggaagctcgggggcgccgggtgaggggaagactgtacccctgggggatagtagaagtggaaaaccccgggcattgtgatttcgtcaaacttaggacaatgctggtgcgcacacacatgcaagatttgaaagacgtgacaagggaaactcattatgaaaattatagggctcagtgtatccagtctatgacaagactggttgtgaaagaacgaaataggaacaaactcacacgagaatccggaacagatttcccaattcctgccgtgccccccggaacagatccagaaacagaaaaattgatacgcgaaaaggatgaagaattaagaagaatgcaggaaatgctccataaaattcagaaacagatgaaggaaaattat

SEQ ID NO: 32585 - DNA, 1434 bp, Artificial Sequence
  Description of Artificial Sequence: Synthetic coding sequence
atggaccggagtcttggctggcaggggaatagcgtacctgaagacaggacagaggcaggcataaagagattcctcgaagatactactgacgacggtgaactgtctaaattcgtcaaagatttcagtggaaacgctagctgccacccgccggaggctaaaacatgggccagcaggccacaggtccccgagcctcgaccacaagccccagacttgtacgatgatgaccttgagtttaggcctccttctaggccacagtctagcgataatcaacagtatttctgcgcaccagctcccctgtcccctagcgcgcgcccccggtcaccatggggtaagctggatccttacgatagctctgaggacgacaaggagtacgtgggtttcgctaccctaccaaatcaagtgcaccgcaaatccgtcaaaaaaggctttgattttacactgatggttgctggcgaaagtgggcttgggaagtctaccctggtcaactcactcttcctgacagatctgtatagagatcgcaaacttcttggagcagaggaacgcattatgcagactgtcgaaatcaccaaacacgccgtagacattgaagagaaaggcgttaggcttaggctgaccatcgtggatacaccgggctttggagatgctgtgaacaacactgagtgttggaaacctgtcgcagaatacatagatcagcagttcgagcaatactttagggatgagtctggattgaaccgaaaaaacatccaggacaatagagtacattgctgtttgtactttatcagccctttcggccacggtctcaggcccctggacgtggagttcatgaaggctctccaccaaagagttaatatcgtacctatcttggcaaaggcagatacattaacccccccagaggttgaccacaaaaaaaggaagatcagagaagagattgaacactttggtatcaagatctatcaatttcctgattgcgactctgacgaggacgaagattttaagcttcaggaccaggctctaaaagaatcaattccctttgccgtcatcggcagtaacacagtagttgaggccagaggtcgcagggtcagggggcggctgtatccatggggcatcgtcgaggttgagaaccctggacattgcgatttcgtgaaactaagaacgatgctggttcgcacccatatgcaagatttgaaagatgtcacgcgggagacccattacgaaaactatagggctcagtgcatacaatctatgactagactggtcgtgaaggagagaaacagaaataaactgactcgggagtctggcaccgatttcccgattcctgcagtgccgcccggtactgacccagagacagaaaaacttatccgcgagaaggatgaagaactcaggaggatgcaagagatgctgcacaagattcaaaaacaaatgaaagaaaactac

SEQ ID NO: 32586 - DNA, 1434 bp, Artificial Sequence
  Description of Artificial Sequence: Synthetic coding sequence
atggacagaagtttaggctggcaaggaaatagtgtcccagaagatagaacggaggctggaataaagcgtttcctcgaagatacgactgatgatggagaattgagtaagtttgttaaggatttctctggtaatgcgagctgccatccaccagaagctaagacatgggcttcaagaccacaagtgccggaaccacgcccccaggctccagatctctacgatgacgaccttgagtttcgcccaccatccagaccacaatcttctgataaccagcaatatttctgtgcaccagcaccactttctcctagtgcacgcccgcgatcaccatggggtaagctggatccatacgattcatccgaagatgacaaggagtatgtcggattcgctacgttaccgaatcaagtacaccgaaagagtgttaagaaaggttttgatttcactttgatggtcgccggcgaatcaggacttggtaaaagcacactggtaaatagtctattccttactgatttataccgtgatagaaaacttctcggagcagaagaaagaatcatgcaaactgtggaaataacaaaacatgccgtagatattgaagaaaaaggtgtccgcttgcgattaacaatcgtagataccccaggttttggagatgcagttaacaatacagaatgctggaaaccagtcgccgaatatattgatcaacaatttgagcaatattttcgcgatgaatccggacttaaccgtaagaatattcaagataatagagtacattgctgtttgtatttcatctctcccttcggtcatggattgcgaccacttgatgttgaattcatgaaggcactgcaccaaagggtgaatattgttccgatccttgccaaggctgacacattaacaccgccagaggtcgaccataagaaacgaaaaatacgagaagaaatcgagcatttcggaattaaaatataccaatttccggattgcgatagcgatgaggatgaggattttaagcttcaggaccaggctttaaaggaatcgattccttttgctgtgattggatccaatacggttgtagaagcacgggggcgacgagtgcgcggaagactttatccctggggtatcgtagaagttgaaaatcctggacattgtgatttcgtgaaactccgtacaatgttggtccgaacccatatgcaagatctcaaagatgtaactcgggagactcattatgaaaattatcgagcccaatgtattcagtcaatgaccaggttggtcgttaaggaacgcaatagaaataaactcaccagagagtcgggaacggacttccctatcccggccgttccaccgggtacagatcctgaaacggagaaattaattagagagaaagatgaggaattacgcagaatgcaagagatgcttcacaagattcagaagcaaatgaaagaaaattat

SEQ ID NO: 32587 - DNA, 1434 bp, Artificial Sequence
  Description of Artificial Sequence: Synthetic coding sequence
atggatcgctccctgggatggcaaggtaacagcgtgccggaggacagaaccgaggccggaatcaagcggttcctggaagacactaccgacgacggagaactgtccaaattcgttaaggacttctcgggaaacgccagctgtcacccgccggaagccaagacctgggcttcaaggccgcaagtgccggaaccgaggcctcaggccccggatctgtacgacgacgaccttgagtttagaccaccgtcacggccgcaatcatccgataaccagcagtacttctgcgctccggcgcctctgtcaccctcagcgcgcccgcggtcgccatggggaaagctcgacccgtacgattcgtctgaggacgataaagagtacgtgggcttcgcaaccctgccaaatcaagtccatcgcaagagcgtgaagaagggattcgattttactctgatggtggcaggagagtctggactcggaaagtccacgctcgtcaattcattgttccttactgacttgtaccgggaccggaagttgctcggtgccgaggaacgcatcatgcaaaccgtcgagattaccaaacacgcagtggacatcgaagagaagggagttagactgcggctgactattgtggacacccccggtttcggcgatgctgtcaacaatactgaatgctggaagccggtggcggagtacatcgaccaacaattcgagcagtattttagagacgaatcgggccttaatcgtaagaacatccaggataaccgggtgcactgttgcctgtacttcatcagcccgttcggccatggtcttaggccgctggacgtggaatttatgaaggccctgcaccagagagtcaatatcgtgccgatactggcgaaagctgacaccctgactccgccggaggtggaccataagaaaagaaagattcgcgaagagatcgaacacttcggaatcaaaatctaccaatttccagactgtgactctgatgaggacgaggactttaagttgcaagatcaggctctcaaggaatccatccccttcgccgtcatcggatcgaacacggtcgtcgaagcgagaggccgccgcgtgcgaggaagactgtacccgtggggaattgtggaagtggagaatccaggccactgcgatttcgtgaaacttaggactatgctcgtccgcactcacatgcaggacctcaaggacgtcaccagggaaactcactacgaaaactaccgcgcccaatgcatccaatcaatgacccggctggtcgtgaaggagagaaacagaaacaagctgactagggaatccggcaccgacttcccaatccctgcggtgccgcctggaaccgacccggagacggaaaagctgatcagagaaaaggacgaggaactccgaaggatgcaggaaatgctccacaagattcagaagcagatgaaggagaactac

SEQ ID NO: 32588 - DNA, 1434 bp, Artificial Sequence
  Description of Artificial Sequence: Synthetic coding sequence
atggatcgcagtttagggtggcagggaaactccgtgcccgaagatcgcactgaggcagggatcaaacggttcctggaagatacaactgacgatggagaactatccaaattcgtgaaagatttcagtgggaatgcatcatgccacccccccgaggctaaaacttgggcctcacggcctcaggtgcctgaaccacggccacaggcccccgatctttatgatgatgatcttgaatttagacctccttcaagacctcagtcctccgataaccaacagtacttctgtgctcccgcccccctgtctccatctgcgaggcctcgaagtccctgggggaaactcgatccatatgattcttccgaagatgataaagagtatgtgggattcgccactttgcctaatcaggtgcacaggaaaagtgtaaaaaaagggttcgactttacactgatggtggccggggagtctggactgggaaaaagtacactcgtgaactctttattcctgacagacctatacagggacaggaaactacttggagccgaagaacggattatgcagactgtggaaataactaaacatgccgtcgatatcgaggagaaaggagtacgcctcagactgacaatagtggacactccaggattcggagatgcagtgaataatactgaatgctggaaaccagtagcagaatacatagatcagcagtttgaacagtatttcagagatgaatcggggctcaacaggaaaaatatacaggacaatcgcgtgcattgctgtctctatttcatctctccattcggacatggactgcggcccctggatgtcgaattcatgaaagccctgcatcaaagggtaaatatagtcccaattcttgctaaagcagatactctgacaccaccagaagtcgatcacaaaaaaagaaaaatacgggaagaaattgaacacttcggaataaaaatttaccagtttccagattgtgattccgatgaggacgaggatttcaaactccaggatcaggctttaaaagaatctatacccttcgctgtgataggaagtaacacagtggttgaagcacgcggaagacgagtgcgagggcgactgtatccatgggggattgtagaagtagaaaaccctggacattgtgattttgtcaaattaaggactatgttagtacgaactcatatgcaggatctgaaagatgtgacacgagaaactcattatgagaattacagggcccaatgcatacagtctatgacaaggctcgtagtgaaagagcggaaccgaaacaaattaactcgagaatctgggacagatttcccaatccctgccgttcctcctgggactgatcccgaaacagaaaaactgatccgggaaaaagacgaagaacttcggcgtatgcaggaaatgctgcacaaaatacaaaaacagatgaaggagaattat

SEQ ID NO: 32589 - DNA, 1434 bp, Artificial Sequence
  Description of Artificial Sequence: Synthetic coding sequence
atggatcgaagtcttggatggcagggcaactctgtgccagaagatcgcactgaggccggaattaagcggttcctggaggacaccaccgatgacggagagttgtccaagttcgtcaaggacttcagcgggaacgcatcctgccatccgcccgaggctaagacgtgggcatcaagaccgcaggtgccggaacctcgtccacaggcgccagacttgtatgatgacgacctcgaatttcgtccaccgtcaaggccgcaatcatcggacaatcagcagtatttctgcgctccggccccactctcaccgtcggccaggcctagaagcccgtggggaaagctggatccttacgactcatccgaagatgataaagaatacgtcggatttgctaccctgccgaaccaggtacaccgcaagtccgtgaagaagggatttgacttcactctgatggtggccggggagtccggtcttggtaagtcgaccctggttaactccctctttctgactgatctttaccgcgacaggaaactcctcggggccgaggaacgaatcatgcaaaccgtggaaatcacgaagcatgcggtggacatcgaagagaagggcgtgcgcctccggctgaccattgttgatactccaggattcggagacgctgtgaacaataccgaatgctggaagcccgtcgcagagtacatcgatcagcagttcgaacagtacttcagagacgaatcgggtctgaacagaaagaatattcaagacaaccgcgtgcactgttgcctctacttcatctcgcctttcggccatggacttcgccccctcgacgtagaattcatgaaagcacttcatcagcgcgtgaatatagtgccgatcctggccaaagcggacaccctcactccaccggaagtcgaccacaaaaagcgaaagatccgggaagaaatcgagcattttggcatcaaaatctaccagtttcccgattgcgactccgacgaggatgaggatttcaagctgcaggaccaagccctgaaggaatctatcccattcgcagtgatcgggtccaatactgtcgtcgaagcgcggggccgtcgggtgcgcggccgcctgtacccttggggaatcgtcgaggtggagaacccgggacactgtgacttcgttaagctgcggaccatgcttgtgcgcactcacatgcaggacctgaaggatgtaactcgcgagacgcactacgagaactaccgtgcccaatgcatccaaagcatgacccgcctggtcgtgaaggaacggaacaggaacaaactgactagagaatctggcaccgatttccctatccccgcggtgccacctgggactgatccggaaaccgagaaattgatccgggaaaaagatgaggaactgcgccggatgcaagagatgttgcacaagattcaaaaacaaatgaaggagaattac

SEQ ID NO: 32590 - DNA, 1434 bp, Artificial Sequence
  Description of Artificial Sequence: Synthetic coding sequence
atggataggtctttgggatggcagggtaacagcgtgccggaggacaggactgaggccgggatcaaacggttccttgaggatacaacagatgatggggagttgtctaaattcgtcaaggactttagtggtaatgcaagctgtcaccccccagaggcaaaaacctgggcttcacggcctcaggttcctgagccaagacctcaggctcccgacctgtatgatgacgatctggaattccgaccgccatctaggccacagagctcagataaccagcagtacttttgcgctcctgctccactctcaccaagcgcccgaccccggtccccttggggcaaactggacccttacgattcttctgaggatgataaagagtacgtcgggttcgctacccttcctaatcaggtacaccgaaagtccgtgaagaagggattcgacttcaccctcatggtcgccggggagagcggtctcggaaaatctactttggtcaattccctgttcctgactgacctttacagagacagaaaactgctgggcgctgaggaaaggatcatgcagacagtggaaataaccaagcacgccgtggacatagaggaaaagggtgttaggctgcgcctgactatcgtagacactccagggttcggagatgcggtgaacaataccgagtgctggaagcccgttgctgaatacatcgaccaacagttcgaacagtactttcgcgatgaatctggattgaatcggaagaacatacaggataaccgagtccactgttgcctgtatttcatttcccctttcggccacggcctgcgccctctggatgtggaattcatgaaggccctgcaccagcgggtcaacattgtgcctattttggccaaggccgacacacttactccgccagaggtggatcacaaaaaacgcaaaatccgggaggagattgaacattttggtatcaagatttaccagtttccggactgcgactccgatgaggatgaggacttcaagttgcaggaccaggcccttaaagaatcaatcccttttgctgttattggatctaataccgtggtagaggctagagggcggcgagtgagggggcggctttacccttggggaattgtggaggtcgaaaacccggggcactgcgattttgtgaaactgaggacgatgctggttagaactcacatgcaagaccttaaggatgtgaccagagaaacacactacgaaaactacagggctcagtgtattcaaagtatgacccggcttgtggttaaggaacgcaataggaacaagctcacacgggaatcaggaacagatttccctatccccgccgtgccgccaggtacagacccagagacggagaagttgattcgggagaaagacgaggaactgcggaggatgcaagaaatgttgcataaaattcagaagcagatgaaagaaaactac

SEQ ID NO: 32591 - DNA, 1434 bp, Artificial Sequence
  Description of Artificial Sequence: Synthetic coding sequence
atggatcgctcattgggctggcagggtaactcggtgcctgaggacaggactgaagccggtatcaagaggttcctggaagataccaccgacgatggtgagctgagcaaatttgtgaaggactttagcggcaacgcatcctgccacccgcctgaagctaagacctgggcttcgcggccgcaggtgcccgaacctcgcccgcaagcgccggacctctacgatgacgatctggaattccgccctccgtcgcgccctcagagctcagacaaccagcaatacttctgcgccccggcaccgttgtcgccttctgcccgtccacggtccccgtgggggaagctggatccgtacgactcgtcagaggatgataaggagtacgtgggatttgctacccttccgaaccaggtccatcgcaagagcgtgaagaagggctttgatttcaccctgatggtggctggagagtctggactgggaaagagcactctcgtgaattcgctcttcttgacggatttgtatagagatcggaagctgctgggcgcggaagagagaatcatgcagaccgtggagatcactaaacacgccgtggacattgaagagaagggagtgcgactccgcttgacgattgtggacactcctggtttcggagatgctgtgaacaacacggaatgctggaaaccggttgcggagtacatcgatcaacagttcgaacagtacttccgcgacgagtcgggactgaatcgcaagaacatacaggataacagagtgcactgctgcctgtactttatctcaccattcggccacggcctgcggccactggacgtcgaattcatgaaggcccttcaccagagagtcaacatcgtgcctattctcgccaaggcagataccctcaccccgcccgaggtcgaccacaaaaagcgcaagatccgcgaagagatcgaacactttggtatcaaaatctaccagttcccggattgtgactctgatgaggacgaggacttcaagctccaggaccaggcactcaaggaatcgatccctttcgccgtgatcggatcaaataccgtggtggaagcacggggcaggcgggtgcggggcaggctctacccatgggggatcgtggaagtcgaaaatccgggtcactgcgacttcgtgaagctgcgcactatgcttgtcaggactcatatgcaggatctgaaagacgtgacccgggaaacgcactacgaaaactacagagctcaatgtatccagtcaatgactcggctggttgtgaaagaaaggaatcgcaacaaattgacccgtgaatccggcactgatttcccgatcccagccgtccctcccggaactgatcccgaaactgagaagctgatcagagagaaagatgaggagctgcgcagaatgcaggaaatgctgcacaagatccagaagcaaatgaaagaaaactac

SEQ ID NO: 32592 - DNA, 1434 bp, Artificial Sequence
  Description of Artificial Sequence: Synthetic coding sequence
atggatcgaagcttgggctggcagggaaactccgtgcccgaggaccggaccgaggccggcataaaaaggttcctcgaagacactacagacgacggggagttatccaaatttgtgaaagatttttctggtaatgcctcctgtcatcctcccgaagccaagacctgggcatctcgccctcaggtcccggagcctcggccccaagcccccgatttgtacgatgacgatctggagttcagacctccgtccagaccccagtcaagcgacaaccagcagtacttttgtgcaccagcaccattgagtccgtcagcacgtcctcgctccccatggggaaaactagacccttacgatagtagcgaagacgataaggagtatgtgggcttcgccacgctgccaaatcaagtccaccgtaagtcagttaagaagggattcgattttacactcatggttgcgggtgaatcgggattggggaagtccaccctcgtcaattccctctttctgactgacctgtatcgcgacagaaaacttctcggtgccgaggagagaatcatgcagactgtggaaatcacaaagcatgctgtggatatcgaggagaagggggtgagattgcggctcaccatcgtggatacgcccgggttcggagatgctgttaataacactgaatgttggaagcctgtcgctgagtatatcgatcagcagttcgagcagtactttagggatgaaagcgggctgaatcggaaaaacattcaggataatcgcgtgcactgctgtctttactttatttctcctttcggtcatggactgcgtccactggacgtagagtttatgaaagccctgcaccagagggtaaacattgttcccatattggcaaaggcggacacattaacccctccggaggtggaccataaaaagaggaagatcagagaggaaatagagcattttggcattaagatctaccaatttccagactgcgacagcgacgaggatgaggattttaaactccaggaccaagcccttaaagaatccataccatttgctgtcatcggtagcaatacagttgtggaagcccgcggaagaagagtgcgcggtcgactgtacccatggggcatcgtggaagtcgagaatccgggacactgcgattttgtgaagctgaggacgatgctcgtgcgaacccacatgcaggatcttaaggatgttacgcgcgagacgcattacgagaactacagggctcagtgcatccagagcatgaccagactggttgtaaaggaacgaaacagaaacaaactcacgcgtgagagcggaactgatttccccattcccgcagtccccccaggcaccgaccctgagacggaaaagctgatccgtgagaaggatgaagagctccgcagaatgcaggagatgcttcacaagatacaaaagcagatgaaagagaactat

SEQ ID NO: 32593 - DNA, 1434 bp, Artificial Sequence
  Description of Artificial Sequence: Synthetic coding sequence
atggaccggtccctcggctggcagggcaacagtgttccagaggaccggacagaggctggaatcaaacggttcctggaggataccactgacgatggggagctttccaagttcgtgaaggacttctcggggaatgcgtcctgccacccacctgaagctaagacttgggcttccaggccgcaggtgccagaaccgagaccacaagccccggacttgtacgacgacgatctggagttccgacctccttcacgtccacagtcctcagacaatcagcagtatttctgtgccccggctcccctgagtccatctgctagaccacgcagtccatggggaaagctggatccctatgacagttccgaagatgacaaggagtatgttgggttcgccaccctgccgaatcaagtccataggaagtcggtgaaaaagggcttcgattttaccttgatggtcgcaggagagagtggcctggggaaatcaacccttgtgaattcattattcctcactgatttataccgcgatcgtaaactcttaggagcagaagaaagaattatgcagacagtggaaataaccaaacacgccgtcgatatcgaagagaagggcgtgcgcctgaggctgaccatagttgacacccctgggttcggtgatgccgtaaacaataccgagtgctggaagcccgttgccgagtacatagatcaacaatttgagcaatacttccgagacgagtctggactgaacagaaaaaacattcaggacaatcgagtacactgctgtctttactttatctcccctttcggtcacgggctgcgcccactggatgtagaatttatgaaagccctgcaccagcgggttaatatagttcctattcttgcaaaagccgacaccttgaccccaccagaggtagatcataagaagaggaaaatcagagaagagatcgagcattttgggatcaagatttaccagttcccagactgtgatagtgatgaggacgaagacttcaagctccaggaccaagccctcaaagagtctatcccgttcgctgtaattggttcaaacacagtcgttgaggctcgtggtcgtcgggttcggggccgtctctacccctgggggattgtggaggtcgagaatccaggccactgtgacttcgtgaagctgcggactatgcttgtccggacccacatgcaagatctcaaagacgtgacacgcgagacccactatgagaattaccgcgcacaatgcatccagagcatgactagactagtggtaaaggagcgcaatcgtaacaagttgacccgagagagcggaactgatttcccaatcccggcggtacctccgggcactgaccccgaaacagaaaagctcatccgggagaaggacgaggaactgaggaggatgcaggagatgttgcataaaatccagaagcagatgaaagaaaattac

SEQ ID NO: 32594 - DNA, 1434 bp, Artificial Sequence
  Description of Artificial Sequence: Synthetic coding sequence
atggacaggagcctcggatggcaggggaactcggtgccggaagatcgcacggaggcaggcatcaagcggtttctggaagataccactgacgatggggagctgtccaagtttgtgaaggatttctcaggtaacgcctcttgccaccctccggaggccaagacatgggcttctcggcctcaggtgccagaaccaagacctcaagcacccgatttatacgacgatgacttggagtttcgaccaccatcaaggccccagagtagtgataaccaacagtatttttgcgccccagctcccctaagccccagcgcgagaccccgatctccctggggcaagctggacccctatgacagcagtgaagacgacaaagaatacgtgggtttcgctacgctgccgaatcaagtgcatcgcaaatctgtcaagaaggggtttgacttcaccttgatggtagccggtgagtcagggcttggtaagagtaccctcgtgaactccttgttcttgaccgatctgtatcgggaccggaaactgctgggtgcggaggagaggattatgcagacagtggaaattactaaacacgctgtggatattgaagagaagggagtgaggctgcggcttactattgtggatacccccggctttggggacgccgtgaacaataccgagtgctggaagcctgtggcagagtatatagaccaacagtttgaacaatacttccgagatgaaagcggtctgaatcgcaagaacatccaagacaaccgcgtccattgttgcctgtattttatcagtccgttcggacacgggttgagacctctggatgtggagttcatgaaagccctccaccagagggtcaacatcgtccctattctcgccaaggccgataccctgacaccccctgaagtggatcacaaaaaacggaaaatacgcgaagagatcgagcacttcggcatcaagatatatcagttcccggactgtgattccgacgaggacgaggactttaaattacaggaccaggcgcttaaggaatctatcccttttgctgtgatcggatcgaatacggttgtggaggctcgaggccgcagggtaaggggcagactctatccctggggcatcgtagaggttgaaaatcccgggcactgcgacttcgtgaaactgagaactatgctcgtgaggacacacatgcaagatttaaaggacgtcaccagagaaacccactatgaaaattaccgggcacaatgcatacaaagtatgacgaggcttgtggttaaggagaggaaccgcaacaaactgacgcgggaaagtggtaccgactttcctatccctgctgttccgcccggcacggatccggaaactgaaaagctgattcgcgaaaaggacgaggagctccggaggatgcaggaaatgttgcacaagatccagaaacagatgaaagagaattac

SEQ ID NO: 32595 - DNA, 1434 bp, Artificial Sequence
  Description of Artificial Sequence: Synthetic coding sequence
atggacaggtcattgggctggcaaggaaatagtgtgcccgaagatcgtaccgaagcaggtattaagcgcttcctggaggacactactgacgatggcgaactgagtaagttcgttaaggacttctcgggcaatgcctcctgccatcctcctgaagccaaaacctgggccagtaggccccaagtcccagaaccacggccccaggctcctgatttatatgacgacgacctggagtttcggcccccaagtcggccgcagtcttccgataaccagcagtacttctgtgcacccgcccctttgagcccatcagcaagacctcgatctccctggggaaaactggacccctatgatagcagtgaggatgacaaggagtatgtgggcttcgctactctgcccaatcaggtgcatcgtaagtcggtgaagaaagggttcgactttacacttatggtcgctggggaaagcggactggggaagagtactctggtgaattccctattcttgacagacctgtatcgcgaccggaagctgctgggcgctgaagagagaatcatgcagacagtggagatcaccaagcatgcagtggatatcgaggagaaaggggtaagacttcggttgacgattgtggacacgccagggttcggcgatgccgtgaataatacagagtgttggaaacccgtagcggaatacatcgaccagcagtttgaacagtatttccgagatgagtccggactcaatcgcaaaaacatccaggataaccgcgtgcactgctgcttgtactttatcagtccctttggtcatggattgagacctctcgatgtcgagtttatgaaggccctgcatcagcgtgtgaacattgtgcccattcttgccaaggccgatacccttactcccccagaggtggatcataagaagagaaaaattcgcgaggagattgagcacttcgggatcaaaatctaccagttcccggactgtgactcagacgaggacgaggatttcaagttacaagaccaagccctaaaagaaagcatcccattcgcggtaattggtagcaacaccgtggtggaagcccgcggacgtagggtcagagggcgcctatacccctggggaattgtagaggtcgagaatccaggccattgcgacttcgttaagcttcgcactatgttggtgcgtacccatatgcaggatcttaaggatgttacacgtgaaactcactatgagaattaccgcgctcagtgtatccagagcatgacaaggctggtcgtgaaggagcgcaacaggaataaattgacacgggagtctggtacagatttcccgatcccagctgtgcccccaggcaccgatccagagactgaaaaattgattcgggaaaaggacgaagagctgaggcggatgcaggaaatgctccacaagatacaaaaacagatgaaagaaaactac

SEQ ID NO: 32596 - DNA, 1434 bp, Artificial Sequence
  Description of Artificial Sequence: Synthetic coding sequence
atggacaggagccttggttggcagggaaacagtgtgccagaagacagaacagaagctggaattaagcgttttctcgaagatacaaccgacgatggtgagcttagcaagttcgtcaaagacttcagcggtaatgcaagttgccacccaccagaggctaagacttgggccagccgccctcaggtacccgaaccacgtcctcaggctccagatctctacgatgatgacctggagtttcgtccacctagccgccctcagtcctcagacaaccagcaatatttctgtgcccctgcaccattgagcccatccgcacgtccacgctccccctggggtaaactggacccctatgacagtagcgaggacgacaaagaatatgttggcttcgcaaccctgcccaaccaagtccataggaaatcagttaaaaagggattcgattttaccctgatggtggccggtgagtccggcctgggcaagagcacccttgtaaactctctttttctcactgatctctaccgtgatagaaaactcctcggagcagaggaacgcattatgcaaacagtggagattacaaaacacgccgtggacattgaggagaagggtgtccgcctgcgcctgaccatagtcgatacacccggatttggtgatgctgtcaacaacactgagtgttggaagcctgtggctgagtacattgatcaacagttcgaacaatatttccgtgatgagtctggtctgaacaggaagaacatccaagacaacagagtccattgttgcctgtattttatcagccccttcggacacggcttgaggccactggatgttgagttcatgaaagctctccatcagagagtaaatatcgttcctattttggctaaagctgatacattgaccccccccgaggtcgatcacaagaagcgtaagatacgtgaggaaatcgagcacttcggaattaagatttaccagtttcccgattgcgactctgacgaggatgaggatttcaagctccaggaccaggctctcaaggaatctatccccttcgctgtcattggcagtaataccgtggtcgaagctagaggacgccgcgtccgcggccgcctttacccatggggtattgtggaggtagaaaaccccggacactgcgactttgtgaaactgaggactatgttggtgaggacccatatgcaggacctcaaagacgtcacccgcgagacacactatgagaactatcgcgcacaatgcatacagtctatgacaagactggttgtgaaggaacgtaatagaaataaattgacccgcgaatccggaacagacttccctatacccgcagtgcctccaggtaccgatccagagactgaaaagctgatcagggagaaagacgaggagctgaggaggatgcaagaaatgctgcataaaatacagaagcagatgaaggagaattac

SEQ ID NO: 32597 - DNA, 1434 bp, Artificial Sequence
  Description of Artificial Sequence: Synthetic coding sequence
atggacaggtcccttggatggcaaggcaatagcgtgccggaagatagaaccgaagcaggtataaagagatttctggaagataccactgatgatggcgaactttccaaatttgtgaaggacttttcggggaacgcatcctgtcatccgccagaggcaaagacttgggctagtagacctcaagtgcctgagccgcgtcctcaggcaccagacctctacgacgacgaccttgagtttaggccacctagccggccacaatcatccgataatcaacaatacttttgtgccccagcaccccttagcccttccgctcgcccaagatccccatgggggaaacttgatccctacgattcgtcagaggacgacaaggaatacgtcggatttgctaccctgcctaaccaagtgcatagaaaatccgtgaaaaagggttttgactttactctgatggtcgcaggagaatcgggtcttggcaagagcacgctcgtcaattccctttttctgaccgacctttaccgggataggaagctgctgggtgctgaggaaagaatcatgcaaaccgtcgaaattaccaagcacgccgtcgacattgaagagaagggtgtgcgactccgactcaccattgtggataccccaggattcggagacgcagtgaacaacactgaatgctggaagcctgtggcagaatacattgatcagcaattcgaacagtactttagagacgagtcaggactcaacaggaagaatatacaggataaccgcgtgcactgttgtctgtactttatctccccatttgggcacggcctgaggcccctggatgtggagttcatgaaagcacttcaccaacgagtgaacatcgtgccaattctcgcaaaggctgacactcttactcctcctgaagtcgaccataagaagcgcaaaattcgggaagagattgagcatttcggaataaagatttaccaatttccggattgcgattcagatgaggatgaggactttaaactccaagatcaggcactgaaagaatccattcccttcgcagtgatcggatcgaataccgtcgtcgaagcgcgcgggagacgcgtgcgaggacggctgtacccctggggcattgtcgaggtggaaaaccccggccattgcgactttgtcaaactgcgaactatgctggtccgtacccatatgcaagatctgaaggatgttactagggagactcattacgagaattacagggcacaatgtatacaatctatgactcggcttgtggtgaaggaaaggaaccgtaacaaactgacccgtgagagcggcactgactttccaataccagccgtgccacctggaaccgatccagagactgagaaactgatcagagaaaaggatgaagagcttcgtagaatgcaggaaatgctgcataagatacagaagcaaatgaaggaaaactac

SEQ ID NO: 32598 - DNA, 1434 bp, Artificial Sequence
  Description of Artificial Sequence: Synthetic coding sequence
atggaccgctcgttgggatggcagggaaattcagtgccagaggaccgcactgaagctggcatcaaacgcttcttggaggatactaccgatgatggagagctgtcaaagtttgtgaaagacttctcgggtaacgcttcctgccaccccccggaagccaagacttgggccagccgcccacaggtcccggaaccaagaccacaggcccctgacctttacgatgatgatctggaattccgacctccgagcagaccacagagctcggataaccagcagtacttttgtgcgccggcacccctgtcaccgtcagctagaccacgcagcccgtggggaaagctggatccctacgattcgagcgaggatgacaaggagtacgtgggatttgccaccctcccgaatcaggtgcacaggaagtcggtcaagaagggattcgacttcaccctgatggtggccggagaaagcgggctggggaaatcgactctggtcaactcgctgtttctcactgacctctaccgcgatcgcaaactgctgggagcggaagaaagaatcatgcaaaccgtcgaaatcacgaagcatgccgtggatatcgaagaaaagggtgtcaggctgcggcttaccatcgtggacaccccgggatttggcgacgccgtgaacaatactgagtgctggaagcctgtggctgagtacatcgatcaacagttcgaacaatactttcgggacgagtcgggcctgaacagaaagaatatccaagacaatcgggtgcactgctgcctctactttatctcgccctttgggcatggactgcgcccgttggatgtggagtttatgaaggctctgcatcagcgcgtgaacattgtgcccattctcgcgaaggccgacacccttaccccacctgaggtggaccataagaagcgaaagatcagggaggagatcgaacacttcggaatcaaaatctaccagttcccggactgcgattccgacgaggacgaggacttcaagctgcaggatcaggcactgaaggaatctatcccgttcgcagtgatcggctcgaacaccgtcgtggaagcacgcgggcggagggtgcggggccggctgtacccctggggaatcgtggaggtggagaacccgggacactgcgactttgtgaaactccgtaccatgctggtccggacccacatgcaggatctgaaagatgtgacccgcgaaactcattacgaaaactaccgcgctcagtgcattcagtccatgacgcggctggtggttaaagaaagaaatcgcaacaaactcacccgggagtcaggcactgattttccgattcccgccgtgcctccaggtactgatccagagacggagaagctgatccgcgaaaaggacgaagagttgcggcggatgcaggagatgctgcacaagatccagaaacaaatgaaggaaaactac

SEQ ID NO: 32599 - DNA, 1434 bp, Artificial Sequence
  Description of Artificial Sequence: Synthetic coding sequence
atggatcgttcccttgggtggcagggaaatagtgtgcctgaagaccgaacagaggccgggatcaaacgattccttgaggacacgacagatgacggggaactgtctaaatttgtcaaggacttctcagggaatgcatcctgccaccccccagaggccaagacatgggcttcaaggccccaggtgcccgaacccagaccccaggcccctgatctatatgatgatgacctggaatttcgccctccttctaggccacagtcgtctgataatcagcaatatttctgcgccccggcccctctgtcgcccagcgcccgacccaggtccccctggggcaagttagatccatacgactctagcgaggacgacaaggagtatgtagggttcgccacgctgcctaaccaggtgcatcggaagtcggtcaaaaagggcttcgattttactctgatggtggctggggaaagcggactgggcaaatccacactggtgaattctcttttcctgaccgacctgtacagagatcgcaagttgctgggtgcggaggagcggattatgcagaccgtcgagattacaaagcacgcagtggatatcgaggaaaagggggtccgcttgcgtctgactatcgttgacactcctgggttcggagatgcagtgaacaacacagaatgctggaagccggtggccgaatacattgaccagcaatttgagcagtatttcagggacgaatctggtctcaatcggaagaacatccaggataacagggtgcactgttgcctgtacttcatttcaccctttgggcacggcctacggcctttggatgtggagttcatgaaggcactgcatcagcgtgtgaatattgtcccaatcctagcgaaagcggacactttaaccccccccgaggtcgatcacaaaaagagaaaaatacgcgaagagattgagcacttcggaattaaaatatatcagtttccggactgcgactccgacgaggatgaggactttaagctccaggaccaagcactgaaagagtccataccgtttgccgtcatagggtctaacacagtagtggaagccagagggaggcgggtgcgcggccgcctgtacccatgggggatagtggaagtcgagaatccaggtcactgcgatttcgtcaaattacggaccatgttggtccggactcatatgcaagatctcaaggatgtaactcgtgaaacccattatgaaaactatcgcgctcagtgcatacagtccatgacccgcttggtggtcaaagagcgcaaccgcaataagctaaccagggagagtggcacagacttcccgatcccagccgtccctcctggaactgaccctgagacggagaagctaattagagagaaagatgaggagctgagacggatgcaggagatgctccacaaaattcagaaacaaatgaaggaaaactat

SEQ ID NO: 32600 - DNA, 1434 bp, Artificial Sequence
  Description of Artificial Sequence: Synthetic coding sequence
atggatcggtcgctgggctggcagggcaatagcgtccctgaggaccgcaccgaggcaggaatcaagcggttcctggaggacaccactgatgatggagagctgagcaagttcgtgaaagacttctcaggcaacgcttcctgccatcccccagaagccaagacgtgggcgagcaggccgcaggtgccggagccacggccacaagctccggacctttacgatgacgacttggaattccggccgccgtcgcgcccacagtcctcggataatcagcaatacttctgcgcgccggcccctctctcccctagcgcaaggcctcgcagcccgtggggaaaactggacccctacgactcgtcggaggatgacaaggaatacgtgggatttgccactctcccgaatcaggtgcaccgcaagtcggtcaaaaagggtttcgattttactctcatggtcgcaggggaatccggactggggaagtcaacgttggtgaactctctgtttctcaccgatctgtaccgggatagaaagctgctgggagctgaggagagaataatgcagactgttgaaatcactaagcacgccgttgacatcgaagaaaagggagtccgtctccggctgaccatcgtggatactccaggatttggcgacgcggtcaacaacacggaatgctggaaaccagtggcggaatacatcgatcagcaattcgagcagtacttccgcgatgagtcaggactcaaccgaaaaaatatccaagacaaccgcgtgcactgctgcctgtacttcatctccccttttggtcatggcctgaggccactggacgtggaattcatgaaggccctgcatcagagggtgaatatcgtgccgatcctggccaaagccgataccctcaccccaccggaagtggaccataaaaagcgcaaaattcgcgaagaaatcgaacactttggaattaagatctaccaattccccgactgtgacagcgacgaggatgaggacttcaaactccaagaccaagcgctcaaggagtccattccattcgccgtgattggttccaacactgtcgtggaagctagaggacgccgggtccgcggcagactgtatccctgggggatcgtggaggtggaaaacccgggacattgcgacttcgtaaagctgcggaccatgcttgtgcgcacccacatgcaggacttgaaggatgtcaccagagagactcactatgaaaactacagagcacagtgtatccagtcgatgactaggctcgtcgtgaaggaaagaaatcggaacaaacttactcgcgaatcagggaccgatttccctatccctgccgtgccgccgggcaccgacccggaaaccgaaaagttgatccgagagaaggacgaagagctgcggcggatgcaagagatgcttcacaagatccagaagcagatgaaggaaaactac

SEQ ID NO: 32601 - DNA, 1434 bp, Artificial Sequence
  Description of Artificial Sequence: Synthetic coding sequence
atggaccgttcgttgggatggcaaggcaatagcgtgcccgaagaccgcacggaggccgggatcaagaggttcctggaggacactactgacgacggcgaacttagcaagtttgtcaaggatttttcgggcaacgcttcctgccacccacctgaagccaagacctgggcatcgcgcccccaggtgcccgagccaaggcctcaggctcctgatttgtatgacgatgatctggagtttcgcccgccgtcccgccctcaatcctctgataaccagcagtacttctgcgctccggcccccctgtcgccctctgctcggccgcgttctccgtggggaaaactggacccttacgattccagcgaagatgataaggagtatgtaggttttgccacgctcccgaatcaggtccacaggaagagtgtgaagaaaggctttgatttcactctgatggttgctggcgaaagtggcctaggcaagtcgaccctggtgaacagcctgttcttaacagatctgtatcgagatcggaagctcctgggggcggaggagaggattatgcagaccgtcgaaattaccaagcacgcggtagatatcgaagagaaaggtgttagattgcgcctgacaatcgtcgacacccccgggttcggagacgctgtcaacaacaccgaatgttggaagccggtcgcagagtatatcgatcaacaatttgaacagtattttcgcgacgaaagcggattaaatcgcaagaacatacaagataatcgcgtgcactgctgtctttactttattagccctttcgggcatggactccggccgcttgatgtcgaattcatgaaagctctgcaccagcgggtgaacatcgtgccgatattggccaaggcggataccctgacgccgccagaagtggaccacaagaagcgaaagatcagagaagaaatcgaacacttcggcattaagatctaccaattccccgactgtgatagcgacgaggatgaagattttaagctgcaggatcaagcactgaaggagagtattcccttcgccgtgatcggatctaatactgtcgtggaagcgcgtggtcgtcgagtccggggacgcctctacccgtggggcatcgtggaggtggaaaacccgggtcactgcgattttgtgaaactccgcactatgctggtgagaacccatatgcaagacctcaaagatgtcacacgcgagacgcactacgagaactaccgcgcgcaatgtatccagtcgatgacacgactggtcgtgaaggagcgaaacaggaacaagctcacgcgcgagtcgggtaccgatttcccgatacccgcagttccgcctggaacggatccggaaactgaaaaactaatacgtgaaaaggacgaggaacttcgacgcatgcaggagatgcttcacaaaatccagaagcaaatgaaagagaactac

SEQ ID NO: 32602 - DNA, 1434 bp, Artificial Sequence
  Description of Artificial Sequence: Synthetic coding sequence
atggatcgctcactgggatggcaaggcaattcggtgcccgaagatagaaccgaggcgggaatcaaaaggttcctggaagatactactgacgacggcgaactgtccaagttcgtcaaggatttttcgggaaacgcctcgtgccatccaccagaagcaaagacctgggcgtcgcggccccaggtcccggagccgcgcccgcaagctccagatttgtacgacgacgatcttgagttccggccaccgtcgcgtccgcaatcgtccgataatcaacagtatttctgcgcaccggccccactctccccctccgctcgcccacgctcaccgtggggaaagctggatccgtatgatagctcggaggacgataaggaatacgtcggatttgccaccctgcccaatcaggtccacaggaagtccgtcaagaagggcttcgacttcactctcatggtggctggcgagagcggactcggaaagtcgactctcgtgaattccctctttctcactgacctgtaccgcgatcggaagctgctgggagcggaagagagaatcatgcaaaccgtggagatcaccaagcatgcggtcgatatcgaagagaagggagtgcggctgcggcttactatagtggacaccccgggattcggggacgcagtgaataacaccgaatgctggaagccggtcgcggagtatattgaccaacagttcgaacagtacttccgcgacgaatccggacttaacaggaagaatattcaggataatagggtgcactgctgcctgtacttcatttcccctttcggtcacggcctgaggcccctggatgtcgagtttatgaaggccctgcatcaaagggtgaacatcgtccctattttggccaaggccgacactctgactccgcccgaagttgatcacaagaagcggaaaattcgggaagagatcgaacacttcggaatcaagatctaccaattcccggactgtgactccgatgaagatgaggacttcaagttgcaggatcaagccctcaaagaatccatcccgttcgcagtcatcgggtctaacacggtcgtcgaagctaggggacgacgcgtgcggggacgcctctacccgtggggaatcgtcgaggtggaaaatccaggacactgcgactttgttaagctgcgcaccatgctcgtccgcacgcacatgcaggacctgaaggacgtgacccgagagactcattacgagaactacagagcccaatgcatccagtcaatgactcgcctggtggtgaaggagcgcaacaggaacaagctgacccgggaatcgggtaccgactttccaatcccggcggtgccgccgggaacggacccggaaaccgaaaagctgatccgggagaaggacgaagagctccggagaatgcaggagatgctgcacaagatccagaagcagatgaaagaaaactac

SEQ ID NO: 32603 - DNA, 1434 bp, Artificial Sequence
  Description of Artificial Sequence: Synthetic coding sequence
atggaccgctccctgggttggcaaggcaacagcgtgccagaggaccgcactgaggcgggtattaaacgcttcctggaagacacgacagacgacggtgaattgtccaagttcgtgaaggatttcagcggcaacgcttcttgccaccctccagaagcgaagacttgggccagccgccctcaagtgcctgagccacgtcctcaggctcctgacctgtatgatgatgacctagaattccgccccccgagccgcccccaaagcagcgacaaccaacagtacttctgcgctccagcaccactgagcccaagcgctcgcccgcggtccccatggggtaagttggacccatacgatagctcagaagatgacaaggaatatgtggggtttgcaaccctgcctaatcaagttcatcgtaaatctgtgaagaagggttttgattttactctcatggttgccggcgaatccggtctgggtaaatccaccttagtgaactcactgttcctaacggacctctaccgcgatcgcaaactgctgggtgcagaagaacgcatcatgcagacggtggaaattacgaaacacgccgtggacatcgaggagaagggtgttcgcctgcgattgactattgtggacactccgggattcggagatgcggttaataataccgagtgttggaaaccggtggcggaatatatcgaccaacaattcgaacaatactttagggatgagtctggcctaaatcgcaaaaatatccaagacaatcgcgtgcactgttgcctttactttatttcgccgtttggccacggcttaaggccactggacgttgagttcatgaaagccctgcaccagagagtcaacattgtaccgatcctggccaaggccgatacgctcactcctccggaagtggaccacaaaaagcgcaagattcgggaggaaattgagcacttcgggatcaaaatataccagttccctgattgtgacagcgatgaagacgaggactttaagctgcaggatcaagcactgaaggagagcattcctttcgcagtgattggcagcaacaccgtcgtcgaagcacgtgggcgtcgtgtcagaggcaggctgtatccgtggggtattgtggaggtcgagaacccaggtcactgcgacttcgttaaactgagaactatgctggtgcgcacacacatgcaagatctgaaggatgtgacccgtgagacgcattatgagaactacagagcacagtgtatccagtctatgactcgcctggtagtcaaagaacgcaacaggaacaagttgacccgcgagagcggtaccgatttcccaattccggcagttcctccgggtaccgatccggaaacggaaaagctgattcgtgagaaggatgaggagctacgccgaatgcaggaaatgctgcataagattcagaagcagatgaaggagaactac

SEQ ID NO: 32604 - DNA, 1434 bp, Artificial Sequence
  Description of Artificial Sequence: Synthetic coding sequence
atggatcgatcccttggatggcaaggaaattccgtgccagaggataggactgaggctgggattaagcgatttctcgaagataccactgatgatggagaactctcgaagttcgtgaaggacttttccggaaatgcaagctgtcacccaccagaagcaaagacctgggcaagcaggccacaggtgccagaacctcgaccacaagcacctgacctttacgatgatgaccttgaatttagacccccgagccggcctcagtcatccgacaaccagcagtacttttgcgcacctgcacctctctccccttcagctagacctagatccccctggggcaagctcgacccatacgattcaagcgaagatgataaggaatacgtcggtttcgcaactctgccaaatcaggtgcacaggaagtcagtgaaaaaggggttcgatttcacgcttatggtggccggtgaaagcggactgggaaagtcgactcttgtcaactccctctttctgaccgatttgtacagagatcgaaaactccttggagcagaagagagaattatgcaaaccgtggagatcaccaagcacgcggtcgatatcgaggagaagggtgtgagactgcggctgactattgtggatacccctggctttggcgatgcagtgaataacaccgaatgttggaagccagtggccgagtacattgatcagcaattcgaacaatactttagagacgagtcgggccttaaccgcaaaaacatccaagacaatcgggtccattgctgtttgtactttatcagcccttttggacatggactccggcctctcgatgtggaattcatgaaggctcttcatcaacgcgtgaatattgtgccaatccttgccaaagccgataccctgactccccctgaggtggaccataagaaaagaaaaatccgggaggaaattgaacacttcggcattaagatatatcagttcccagactgtgactctgacgaagatgaggactttaagctgcaagatcaggcccttaaagaaagcataccttttgccgtgattggatcaaataccgtggtggaagcgagaggccggcgagtcagggggagactttacccgtggggaatcgtggaagtggagaaccctgggcattgtgattttgtgaagctcagaaccatgctggtgagaactcatatgcaggatctgaaagacgtgacgagggaaacccactacgagaattaccgcgcccaatgtatccaaagcatgactcgcttggttgtcaaggaacgcaatcgcaataagctgactcgggaatcaggtacggattttcctatccctgcagtgccccctggaactgatcctgaaaccgagaagctgattcgagagaaagatgaagagctccggaggatgcaggaaatgctgcataagatccaaaagcagatgaaggaaaactac

SEQ ID NO: 32605 - DNA, 1434 bp, Artificial Sequence
  Description of Artificial Sequence: Synthetic coding sequence
atggatagatcgctgggctggcagggcaactctgtgccagaagatcgaacagaggcaggcatcaagcggttcctcgaagacactaccgatgacggcgagttgagcaagttcgtgaaagattttagtgggaatgcatcctgtcaccctcctgaagccaagacctgggcgagcaggcctcaagttcccgaacctcgaccacaggcccccgacctttacgatgacgacctcgagtttcgtcctccttcaagaccacagagttccgataatcagcagtacttttgtgctcctgcccctcttagccctagtgcaaggccgagaagtccttgggggaaactggatccatatgactcgtccgaggatgacaaggagtatgtaggtttcgcaactctccccaaccaggtgcacagaaagtccgtgaaaaagggctttgattttaccctcatggtcgccggggagagtggtctcgggaagtctaccctcgtgaactcgttgttcctgactgacctttatagggacaggaaattgctcggggccgaggaaaggatcatgcagaccgtggagattaccaagcatgctgtcgatatcgaggagaaaggtgtgagactgaggctgaccattgtggatactcctgggttcggagacgctgtgaacaacactgaatgctggaagcctgtagcggagtacatagatcagcagtttgaacagtactttcgagacgagtcagggctcaacagaaagaatatccaagacaatagggtgcattgttgcctatatttcatttctccttttggccacggcctgcggcccctggatgttgaattcatgaaggctctgcatcagcgagtaaatatcgttccaatcctggctaaagcggataccctcaccccccctgaggtggaccataagaaacggaaaatcagagaggagatcgagcattttggtatcaagatctaccagtttccggactgtgacagcgatgaggatgaggattttaagctccaggatcaagcattgaaggaaagtattccgttcgcagtgatcgggtcgaatacggtggttgaggctcgtggacgtagagtccgcggtcggctgtatccatggggtatcgttgaggtggagaacccaggacactgtgatttcgtcaagctgagaaccatgctcgttcgcacccacatgcaggatttgaaggatgtcacacgggagactcactacgagaattatcgcgcccagtgtattcagagcatgacccggctggtggtgaaagaaaggaaccggaacaaattgactagggaaagcggaaccgatttcccaatccctgctgttccacccggtaccgaccccgagaccgagaagcttatccgcgagaaggatgaagagctgagaagaatgcaggaaatgctgcataagatccagaagcagatgaaagagaattac

SEQ ID NO: 32606 - DNA, 1434 bp, Artificial Sequence
  Description of Artificial Sequence: Synthetic coding sequence
atggaccggtcgctgggctggcagggtaattcggtaccggaagatagaactgaggccggcatcaagcggttcctggaggacactactgacgacggggaactgtccaagtttgtgaaggatttctccggaaacgccagctgccacccacctgaggctaaaacttgggcgtccagacctcaggtcccggaaccgcgcccacaagcgcccgacctctatgatgatgacttggaattcagaccgccatcgcgcccgcagtccagtgacaatcagcagtacttctgcgctccggcgccgctgtccccaagcgcacgccccaggagcccttgggggaaactggacccgtacgatagttcggaggatgacaaagaatatgtgggattcgcgacccttcctaaccaggtgcacaggaagtctgttaagaaggggtttgatttcactctcatggtggctggagaatcaggactgggtaagagcaccctcgtcaactccctcttcctgacggatttgtaccgcgaccgcaaattgctgggcgccgaggagcgcatcatgcaaacggtcgaaatcactaagcacgccgtggatatcgaagagaagggcgtgagactgaggctcacgattgtcgacaccccggggttcggtgacgccgttaacaatactgaatgctggaaaccagtggcggaatacatcgaccaacaattcgagcagtacttccgcgatgaatccggattgaatcggaagaatatccaggataatcgggtccattgctgtctgtacttcatctcaccattcggtcatggactccgacccctggatgttgagtttatgaaggcactccaccaacgggtgaacatcgtgccgatactggccaaagcagataccctgacgccgccagaagtggaccataagaaacgcaagatcagagaagaaatcgaacactttggaatcaagatttaccaatttcccgattgcgactcggacgaggacgaggacttcaagttgcaggaccaggcccttaaggaatcaatcccattcgctgtcatcggttcaaacactgtagtggaagctcgaggaaggcgcgtgcggggcagactgtacccgtggggtatcgtcgaggtggagaacccagggcattgcgacttcgtcaaattgaggaccatgcttgtcagaacgcacatgcaggatcttaaagacgtgaccagagaaacccattacgaaaactaccgcgcacagtgtatccaaagcatgacccggctcgtggtgaaggagcggaacaggaacaagttgactagagaatctggaaccgactttccaatccccgccgtgccgccaggcaccgatcctgagactgagaagctcattcgggagaaagacgaagagctgcggagaatgcaagaaatgctgcacaagatacagaagcagatgaaggaaaactac

SEQ ID NO: 32607 - DNA, 1434 bp, Artificial Sequence
  Description of Artificial Sequence: Synthetic coding sequence
atggatcgatcactggggtggcaggggaattcggtacctgaagataggacggaagcgggcatcaagaggtttctggaagataccacagatgacggtgagctatcaaaattcgtgaaagatttttcaggtaacgcttcatgccatccgccagaggcaaagacgtgggccagcagaccccaggtcccagagccacggcctcaagcgccagacctgtatgacgacgatctcgaattcagacctccgagcaggccgcagtcctcagataatcagcaatacttctgtgccccggcaccgttgagcccatccgctaggcctcgctctccatggggtaaactggatccctacgatagtagcgaggatgacaaggaatatgtgggcttcgctacactccctaatcaggtgcatcgaaaatcggtcaaaaagggcttcgactttactctcatggtggccggtgagagtgggctcggcaagtctaccttggtgaactccctgttcctgacagatctgtacagggacagaaaactcctcggcgccgaggagcgaatcatgcaaactgtcgagattaccaagcacgctgtcgatatcgaagagaagggcgtgcggctgcggctgacaatcgtggacacccctggtttcggggatgcagtcaataacaccgagtgttggaagccagttgctgaatatatcgatcagcagtttgagcagtacttccgcgacgagtccggactgaatagaaagaacatccaggataatagagtacattgttgtctgtacttcatatccccatttgggcatggcctgcgacctcttgacgtggagttcatgaaggccctgcaccaaagggtgaatatcgtgcccatccttgcaaaggctgacactttgacgccaccggaggtcgatcataagaagcggaaaattcgggaggaaatcgaacacttcggaatcaagatctaccaatttcccgactgcgactctgacgaggatgaagatttcaagctccaagatcaggccttgaaagagagtatcccttttgctgtcattggctctaacaccgtcgtcgaagctcgaggtcgacgcgtgcgcggaagattgtacccttggggaatcgtagaagtcgaaaaccccgggcattgtgattttgttaagttgcggacgatgttggtacggacccacatgcaagatctcaaggatgtgaccagagagacgcactatgagaactaccgagcccagtgcatccagagcatgactcgcttggttgtgaaagaaaggaatcgaaataaactgacaagggagagcggaactgatttccctatacctgccgtccctcccggaactgatcccgaaacggagaaactgatcagggaaaaagatgaggagttacgaaggatgcaggagatgcttcataagatccaaaaacagatgaaggaaaactat

SEQ ID NO: 32608 - DNA, 1434 bp, Artificial Sequence; identical to SEQ ID NO: 32599
  Description of Artificial Sequence: Synthetic coding sequence

SEQ ID NO: 32609 - DNA, 1434 bp, Artificial Sequence
  Description of Artificial Sequence: Synthetic coding sequence
atggaccgatcgctgggatggcagggaaatagcgtgccagaggataggaccgaagctggaatcaaacggtttcttgaagatactactgatgatggcgaactttccaagttcgtgaaggatttttccggaaacgcctcatgtcatcccccagaggcaaagacctgggcctcccgcccacaggtgcctgagcctcggccacaagctcctgatctgtacgatgatgacctcgaatttcggcctccatcacgcccccagtccagcgataatcagcaatacttttgtgcacctgcccctctgtctccaagtgcccgaccaaggtcgccctggggaaagttggacccttacgatagcagcgaggatgataaggaatacgtgggcttcgcaactttgcctaaccaagttcatagaaagtccgtgaagaagggttttgactttacccttatggttgcaggggagtcggggctggggaagtccacccttgtgaatagcttgttccttaccgacctctatcgggatcggaaactccttggtgcggaagaaagaattatgcaaacggtggaaattaccaagcatgccgtggacatcgaagaaaagggggtgagactccggttgactattgtcgatactcccggtttcggtgatgccgtgaacaacacggaatgctggaagcccgtggcagaatacattgaccaacaatttgaacagtactttagggatgaatcgggtcttaaccgcaaaaacatacaggacaaccgggtccattgttgcctgtactttatcagccctttcggacatggtctgcggccgctggacgtggagtttatgaaggccctccatcagcgagtgaatatagtccctattctcgcaaaggcagataccctgaccccacctgaagtggaccataagaagcgcaagattagggaagaaattgagcatttcggaatcaagatttaccagttcccagattgtgacagcgatgaagatgaggatttcaaactccaagatcaagcgcttaaagaatcgattccatttgccgtcattggctcaaataccgtggtggaagcacgggggagaagggtcaggggacggctgtatccttggggtattgtggaagtggagaaccctggccattgtgatttcgtgaaattgcgaacgatgcttgtgagaactcatatgcaggatctcaaggatgtcaccagggaaactcactacgaaaactacagggcccaatgtatacaatcgatgacgcgtcttgtggtgaaggagaggaacagaaacaagctgacccgagaatcgggaacggacttccctatacccgctgtccctcctgggaccgaccccgagactgagaagctgattcgtgaaaaagacgaggaactgcggcgtatgcaggaaatgttgcacaagatacagaaacaaatgaaggagaactac

SEQ ID NO: 32610 - DNA, 1434 bp, Artificial Sequence
  Description of Artificial Sequence: Synthetic coding sequence
atggatcgtagcctgggatggcaggggaacagtgtacccgaggacagaactgaagcaggaatcaagcggtttctggaagacacaacggatgatggggagctgagcaaattcgttaaggatttcagtggtaacgcctcttgtcacccccccgaagctaaaacttgggctagccgaccacaggtgccagaaccacggccccaggcacccgacctttacgatgatgatctagaatttagacccccctctcggccccagagctcagataaccagcagtacttttgcgcccccgctcctctgtctccatctgcccgtcctcggtctccctggggaaagctcgatccgtacgactcgtctgaggatgataaagaatacgtaggctttgcaaccttgcccaatcaggtgcaccgtaagtcagttaaaaaaggcttcgattttaccctcatggtcgccggagagtcaggattaggaaagtcaacactggttaatagcctgttcctgaccgatctttatagggatagaaaactgttaggcgccgaagaacgaataatgcagactgttgaaattactaagcacgccgtggatattgaggaaaaaggcgtccggctgcgcctcaccatcgtggacactccggggtttggcgatgctgttaataacaccgaatgttggaaaccagtggcggagtacattgaccaacagttcgaacagtatttccgagacgaaagtggtctcaaccgaaaaaatattcaggataatcgggtgcattgctgcctgtatttcatcagcccgtttggccacggcctaaggcccctggacgtggagttcatgaaggctctgcaccagcgagtgaacattgtacccattcttgcaaaggctgacacccttactccacccgaggtcgatcataaaaaaaggaaaatcagagaggaaattgagcactttggtatcaagatttaccaattcccggactgcgactctgatgaagatgaggatttcaagctgcaggaccaagccctcaaagaatcaattccctttgctgtgatcggctcaaacactgtcgtggaggcaagaggcaggagagtgagggggcgcttgtacccatggggtatcgtcgaagttgagaaccccggccattgtgattttgtaaagctcagaactatgctagtgcgcactcacatgcaggatcttaaggacgtcacccgggagactcactacgagaattaccgcgcacagtgtattcagtcaatgactcggctggtggttaaggagcgcaacagaaataaactcacccgcgagtctggtactgacttccctatacctgctgttcccccagggaccgatccagagaccgaaaagctaattcgagagaaggacgaggagctgaggagaatgcaggagatgctccataagattcagaagcagatgaaggagaattat

SEQ ID NO: 32611 - DNA, 1434 bp, Artificial Sequence
  Description of Artificial Sequence: Synthetic coding sequence
atggacaggagcctgggatggcaaggtaattccgtgcctgaggataggaccgaggcaggaattaagcggttcttggaagataccaccgatgacggcgaattgtcgaagttcgtcaaggactttagtggtaatgcatcatgtcatcctccagaagcgaaaacttgggcatcaaggccacaggtgcctgagccacgcccgcaagccccagatctctatgatgatgatttggaattcagaccaccctcaagaccacaatcgtcggacaaccagcaatacttttgcgcgcctgcacccctttccccctccgccaggccacgcagcccttggggcaagctggacccgtatgattcatcggaggatgataaggaatacgtgggatttgcaacccttcctaaccaggtgcatcggaagagcgtgaagaaggggttcgactttacgctgatggtggcaggtgagagcggactcggcaaatcaaccctggtcaactcactttttctcactgatctgtatagggacagaaaacttcttggagcagaggaaagaatcatgcaaaccgttgagatcactaagcacgcagtggatatcgaagagaaaggagtgcgacttagacttaccattgtcgatacccccggattcggtgatgcggtcaataacactgaatgctggaagccagtagcagagtacatcgatcagcagttcgaacaatactttcgagatgaatctggtcttaaccgcaagaatatccaagataaccgcgtgcattgttgtctctacttcattagtccctttggacacggattgcgcccacttgatgtggaattcatgaaggccctccaccagagagtcaatatcgtgccaattctggcaaaggcggatacccttacccctcccgaagtggatcataagaagcgtaagattcgcgaggagattgaacactttggtatcaagatttaccaatttcctgactgtgatagcgacgaggatgaggactttaaacttcaagatcaagcccttaaagaatccataccattcgcagtcatcgggtccaacactgtcgtggaagcacgcggtcggagggtgagagggcgactgtacccctggggcattgtggaagtggaaaaccccggacactgcgactttgtgaaacttagaacgatgctggtgcgcactcatatgcaagatctgaaagatgtgactagagaaacccattacgagaattacagggcacaatgtatccaatcgatgactcgcctggttgtcaaggaacgaaacaggaataagctgacgagggaatctggcactgattttccgatcccagcagtccctcctggtaccgatccggaaactgagaagttgattcgggagaaggacgaagagctgcgaagaatgcaagaaatgctgcacaaaatccagaagcagatgaaggaaaactac

SEQ ID NO: 32612 - DNA, 1434 bp, Artificial Sequence
  Description of Artificial Sequence: Synthetic coding sequence
atggatcgcagcctgggatggcaggggaatagcgttccagaggacaggaccgaagccggaattaaacggtttctggaggacactacagatgatggggagctgtccaagttcgtgaaagatttctctggtaatgccagttgccacccaccggaggctaagacatgggcttcacggccccaggtgcccgagcccaggccgcaggcacctgatctgtacgacgatgacctggaattccgtccaccgagtcgcccgcagtctagtgataatcagcagtatttttgtgctcccgcccccctgtcaccttccgccagacccagatccccctggggcaaactggacccatacgattcttccgaagacgataaagagtacgttgggttcgccactctgcctaatcaggtccaccggaagtctgtgaagaaaggttttgacttcacacttatggtagctggtgaatccggcctgggcaaaagcactttagtgaattcgctcttcctgaccgacctctacagagaccggaagctcctgggagcagaggagaggattatgcagaccgtggagatcaccaagcacgcagtggacattgaggaaaagggcgtgcgcctgagactaaccatagtggatactcccgggtttggcgatgccgtcaacaacactgagtgctggaaacccgttgcggagtatattgatcagcagtttgagcaatattttagggatgagtcaggactgaaccggaagaatattcaggataatcgggtgcattgttgcttgtacttcatctcacccttcggtcatggcctgagaccactcgatgtggagtttatgaaggcgctacaccagcgagtcaatatcgtgcctatactggcaaaggccgataccctgacacccccggaggtggatcataagaagagaaagatccgggaggaaatcgaacattttggaattaagatctaccagttcccggactgcgattctgacgaggacgaagattttaagctgcaggaccaggctctgaaggaaagtatccccttcgccgtgattgggtccaacaccgtggttgaggccaggggcaggcgcgtcagagggcggttgtatccgtggggaatagtggaggtagaaaatcccgggcattgcgacttcgtgaagcttcgtaccatgctggtgagaactcatatgcaggacctcaaggatgtgactcgagagacgcattacgaaaactacagggcgcagtgtattcagagcatgaccagactggtggtaaaagagcgaaacagaaacaagttgacccgagagagcggaacggactttcctatacccgccgtcccaccaggcaccgaccctgagaccgaaaaactaatacgagagaaagacgaggagctcaggcggatgcaagagatgttgcacaaaattcagaagcagatgaaagagaactat

SEQ ID NO: 32613 - DNA, 1434 bp, Artificial Sequence
  Description of Artificial Sequence: Synthetic coding sequence
atggatagatcactcgggtggcagggaaactccgtgcccgaggatcgaactgaggccggcataaaacgatttcttgaggatacgaccgacgacggggaacttagcaaatttgtcaaagatttttccggaaatgcgtcctgtcaccccccagaggcaaaaacctgggcaagcagacctcaagtgccagaacccagaccgcaggcacctgacctgtacgatgacgatctggaatttcgcccgccttcgcgtccacaaagctcagacaaccagcaatacttttgtgcaccagcgcctctttcaccctccgctagacccagatcaccatggggaaagctggatccttacgatagctcggaagatgataaagagtacgttggatttgccaccctgccaaaccaggtgcacagaaagtctgtcaagaaaggttttgattttaccctgatggtggcaggagaaagcggtcttgggaaatcgacccttgtgaactcgctgtttctgactgatctgtacagagatcgaaagctgcttggagccgaagagcgcattatgcaaaccgtcgaaatcaccaagcatgcagtggatatcgaagagaagggtgtccgacttcgcctgacgattgtggatactcctgggtttggagatgcagtgaataacaccgaatgttggaagcctgtcgcagaatacattgaccaacagtttgaacaatacttccgtgacgaaagcggattgaaccgaaagaatatccaggacaatcgtgttcattgctgtctctactttatctcgccattcggacatggccttcgtccactcgatgtggagttcatgaaggcacttcatcaaagagtcaacatcgtccccattctggcaaaagcagataccctgactccacccgaagtggatcataagaagcggaagattcgggaggaaattgaacattttggaataaagatctaccagtttccagattgcgattcggatgaggacgaggatttcaaactgcaagatcaggctcttaaggaaagcattccatttgctgtgatcggctctaacacggtggttgaggcaagaggcagacgtgtgcgcggaaggctgtacccgtggggcattgtcgaagtcgaaaatcccgggcactgtgactttgtgaagctccgtaccatgctggtgcgcactcatatgcaagaccttaaggatgtgactcgagagactcactacgagaattaccgtgcacagtgcatccagtcgatgactagactcgtggtcaaagaacggaaccgaaacaagttgactagagagtcgggaaccgattttcccattccagcggtgccgcccgggactgaccctgaaacggaaaagctgattcgcgaaaaggatgaggaactgcgccgaatgcaagaaatgcttcataagattcaaaaacagatgaaggaaaactat

SEQ ID NO: 32614 - DNA, 1434 bp, Artificial Sequence
  Description of Artificial Sequence: Synthetic coding sequence
atggataggtcgctcggctggcagggcaacagcgtgcccgaggaccgcactgaagctgggataaaacgctttctagaggataccactgacgacggtgagctgtccaaatttgtgaaagacttcagtgggaacgcctcatgtcaccccccagaagccaaaacgtgggctagccggccccaggtgccggaaccacgcccgcaagcgccggacctgtacgatgacgaccttgaattccggccaccctcccggccccagagtagtgacaaccagcagtatttttgcgcgccagccccattaagcccatctgccaggcccagaagcccttggggcaaactggatccctacgattcttccgaagacgataaggaatacgtgggcttcgcgaccctgccaaatcaggtgcatcggaagtccgtgaagaaaggcttcgacttcacactgatggtagcaggcgaaagcgggctgggaaaatccacgctggtgaattctctgtttctgactgatctgtaccgcgatcgcaaacttctgggcgcagaagagaggattatgcaaaccgtcgaaatcacaaagcacgcggttgacattgaggaaaagggtgttcgccttcgcctcactatcgtagatactcctggatttggggacgctgtcaacaatactgagtgttggaagcccgtggccgagtatatcgatcaacagttcgaacagtactttcgcgatgagtccggactcaaccgcaaaaacatacaagacaatcgcgtccactgttgtctgtattttatttctccttttggacatggcttacgtcctctggacgtggagttcatgaaagcattacaccaaagggtgaatatagttcccatcctggccaaagcagatacactgaccccccccgaggtcgaccacaaaaagaggaagatccgggaggaaatagagcatttcggcattaaaatctatcagtttcccgattgtgatagcgatgaggatgaggacttcaaactccaggatcaggcactaaaggagtccatcccttttgccgtcataggttctaacactgtggtcgaggcacgggggcggagagtcagaggtcgcttgtacccgtgggggattgtggaggtagaaaatccggggcattgtgattttgtcaaactacgtacaatgttagtccggactcatatgcaggacttgaaagacgtgacaagagaaacccactacgagaattaccgggcccagtgtatccagagcatgacgcggcttgttgtaaaagagagaaacagaaacaagctgacccgggagagcggtaccgattttccgattccggcagttcctccgggaaccgacccagaaacagaaaagctcatcagagagaaagacgaagagcttcggcgcatgcaggagatgttgcataaaattcaaaagcagatgaaagagaattat

SEQ ID NO: 32615 - DNA, 717 bp, Artificial Sequence
  Description of Artificial Sequence: Synthetic coding sequence
atggctgcccttaaatcttggctgtcacgcagtgtcacatctttctttcggtacagacagtgcctttgtgtgccagtggtagccaatttcaaaaagaggtgcttttccgaactcattcgcccctggcacaaaaccgtgactattgggtttggcgtgaccctttgcgcagtccctatcgcccagaaaagtgagccacatagcctgtcctccgaagcgttaatgagacgggccgtaagcttggttactgattcaacgagtacattcctcagtcagacaacctacgctttgatcgaagcaatcaccgagtacactaaggctgtgtacaccctcacctctctgtatcggcagtacactagcttgctggggaagatgaatagcgaagaggaggatgaggtgtggcaggtgattatcggagcccgggcggagatgacgagtaaacaccaagaatacttgaagctagaaacaacctggatgacagctgttgggctctcggagatggcagcagaagcggcttaccagaccggcgctgatcaagcctctatcacagcacgcaatcacattcagttggtgaaactgcaggtggaggaggtacaccagctgagcaggaaggccgagacaaagctcgcggaggcccaaattgaggagctcagacagaagactcaggaagagggggaggagcgcgctgaaagtgaacaggaggcgtacctgcgagaagat

SEQ ID NO: 32616 - DNA, 717 bp, Artificial Sequence
  Description of Artificial Sequence: Synthetic coding sequence
atggccgctctcaaaagttggttatctcgctctgtgacaagtttctttagatatcggcaatgtctctgcgttcctgtagtcgccaacttcaaaaaacgctgcttctccgaacttatacggccatggcataaaactgttactatcggattcggagtgacactgtgcgcggtgcccatcgcacagaagagtgaaccacattccctttcatccgaagctctgatgaggagagctgtatcccttgttacagactctacttctacatttctgtctcagactacatacgcccttatcgaagccatcactgagtatacaaaagctgtatacacgctgacatccctatatcggcagtatacttcgctgctcggaaagatgaattccgaagaagaagatgaagtatggcaggtcatcataggagccagggctgagatgacttctaaacatcaggaatatctgaaattagaaacaacttggatgacggcagtagggttatctgaaatggcagcagaagccgcatatcagacaggagcggatcaggctagtataactgctagaaatcacatacaactggtcaagttgcaggtcgaagaagttcatcagctatcacggaaagcagaaactaaactggctgaagctcaaattgaagaactcaggcaaaaaacacaagaagagggagaagaacgagcggaatcagaacaagaagcgtatctacgggaggat

SEQ ID NO: 32617 - DNA, 717 bp, Artificial Sequence
  Description of Artificial Sequence: Synthetic coding sequence
atggcggcactcaagtcttggctgtcacgctcggtgacttccttcttccggtatagacagtgcctgtgtgtgcccgtggtggctaatttcaaaaaacgatgcttctccgaattgatcaggccgtggcacaagactgtcaccattggatttggcgtgactctttgcgcggtgcccatcgcccaaaagtcagaaccacattccctgtcatccgaggcacttatgaggcgcgcggtgagcctcgttaccgactccacgtccaccttcctctcgcaaactacctacgcactcatcgaggcaatcaccgagtacaccaaagctgtgtacactctcacttcactgtatcggcagtacacctcgctgctggggaagatgaacagcgaagaagaagatgaggtctggcaagtgatcatcggggcaagagcggagatgacctccaagcaccaggaatacctgaagctcgaaactacttggatgaccgccgtgggactttccgaaatggccgcagaggctgcctatcaaaccggagccgaccaggcctcgatcaccgcccggaaccacattcagttggtgaagctgcaggtggaagaggtccaccagctgtcccgcaaagcagagactaagctggcagaagcccagatagaagagttgcggcagaaaacccaggaggaaggagaagagagagcggaatccgagcaggaagcatacctcagagaggat

SEQ ID NO: 32618 - DNA, 717 bp, Artificial Sequence
  Description of Artificial Sequence: Synthetic coding sequence
atggccgctctcaaatcctggttgagtcggtcggtgacctctttctttcgctatcggcagtgtctgtgtgtaccggtggttgcgaatttcaagaaaagatgcttttcagaacttataagaccatggcataaaactgtgactatcggctttggggtgactctgtgtgccgtgcctattgcgcagaagagcgaacctcattctctgagctccgaggcactcatgcggagagccgtgtctctcgtgactgacagcacctctacgtttctcagccagactacgtatgcccttatcgaggcaattacagagtacactaaggcggtgtacaccctcacctccctttaccgccagtacacatctctgttaggaaaaatgaattccgaagaggaggacgaggtctggcaggtgataatcggcgcccgggccgagatgacatctaaacaccaagagtacctaaaactggaaaccacctggatgacggcggtggggctctccgagatggccgcggaggccgcataccagaccggggcagaccaggctagtatcaccgcgcgcaatcacatccagctagtgaaactgcaggttgaagaggtacatcagctgtcccggaaggctgagaccaagctcgccgaagcccagattgaggagcttaggcagaagacccaggaggaaggagaggaaagggctgagagtgagcaagaagcctatctcagagaggat

SEQ ID NO: 32619 - DNA, 717 bp, Artificial Sequence
  Description of Artificial Sequence: Synthetic coding sequence
atggcagcccttaagtcctggctgtcccgttccgtgacctcgtttttcagatacagacaatgtctttgtgtgccagtcgtggcgaactttaagaagcgatgcttctcggaactgatacgcccatggcataagaccgtgactattggttttggtgtgaccctctgtgcggtgcctatcgcacaaaagagcgaacctcattcgctgtcctcagaagccctgatgcgcagagcagtgtcacttgtcaccgatagcacgtcgacttttctgagtcaaacgacttacgcgctcatagaagccatcaccgagtatactaaggccgtgtacactctgacttcactttaccggcagtacacctcactgctcggaaagatgaactccgaagaagaagatgaagtgtggcaagtgattattggtgcacgggcagaaatgacttcaaaacatcaagaatacctgaaactcgaaactacttggatgaccgcagtggggcttagcgaaatggctgcagaagcagcataccagacgggggcagatcaagcgtcaattaccgctcggaatcatatccagctcgtgaagctccaagtggaagaagtccatcagctctcaagaaaggcagagactaagctcgcagaggcgcagatcgaggagttgcgtcagaaaacccaagaggaaggagaagagcgcgcggagtctgaacaagaggcatacctccgagaagat

SEQ ID NO: 32620 - DNA, 717 bp, Artificial Sequence
  Description of Artificial Sequence: Synthetic coding sequence
atggcagcactcaagtcctggctgagccggagcgtgaccagttttttcagataccgccaatgtctgtgcgtgccagtggttgccaactttaaaaagcgctgtttcagcgagctgatccgcccttggcataagaccgtcactattggctttggggtgactctttgtgcagtgcctattgcccagaagtcagaacctcatagccttagcagtgaggccctgatgaggcgcgccgtgagcctcgtgaccgactccactagcaccttcctttctcaaacgacctacgctctcatcgaggccattacagagtatacaaaagccgtgtacaccctcacgtccctgtacagacagtacacgagcctgctcggcaagatgaatagtgaggaagaagacgaggtatggcaggtgattatcggagcccgggccgagatgacttccaaacatcaggagtatttgaagctcgagaccacatggatgaccgcggtgggtctcagtgagatggctgccgaggcggcttatcagaccggtgctgaccaggcctccatcacagcaaggaatcacatccaactggtgaaacttcaagttgaggaggttcaccagctctcaaggaaagccgagacgaagctggcagaggctcagatagaagagctgaggcagaaaacccaagaagaaggagaagaaagagcggagtccgagcaagaggcctatctccgggaggat

SEQ ID NO: 32621 - DNA, 717 bp, Artificial Sequence
  Description of Artificial Sequence: Synthetic coding sequence
atggctgcccttaaatcatggctgtccaggtccgtgactagcttctttaggtatcgccaatgcctgtgtgtcccagtcgtcgccaacttcaagaaaaggtgcttcagcgagctgattagaccatggcacaaaacagtaaccatcggctttggagttacactttgtgccgttccaatagctcagaagtcagaacctcacagtctgtcttctgaagccctgatgcgcagggctgtatctctggtgaccgactcaaccagcacttttttgtcccagaccacttatgcactgattgaggccatcacagagtacacaaaggctgtgtacaccttgacttccctctaccgtcagtacacttccctcctcggtaagatgaattccgaggaggaggacgaagtgtggcaggtgatcattggtgcaagagccgagatgactagtaagcatcaggagtatcttaagcttgagactacttggatgaccgcagtgggtttgtctgaaatggctgcagaggccgcctaccaaaccggagctgatcaagcctcaattaccgctcgtaaccatattcagctcgtgaagctccaagtggaggaagtccaccagctgagcaggaaagcagagaccaagttggctgaggcacagatcgaggagttgagacagaaaacccaggaggaaggcgaagagagagcagagtctgagcaggaggcttatctcagggaagat

SEQ ID NO: 32622 - DNA, 717 bp, Artificial Sequence
  Description of Artificial Sequence: Synthetic coding sequence
atggccgctttgaagtcgtggctctctcggtctgtgacctctttttttcggtaccggcagtgtctttgcgtgccggtggtcgcaaacttcaaaaagcgttgctttagcgagcttattcgaccatggcacaagaccgtgactatcggctttggcgtgaccctttgcgcggtccctattgcacagaagagtgagcctcactccttgtcatcagaagctctcatgcgtcgggcagtcagcttggttacagactcaacgagtacattcctgagccagacaacatatgccctaatcgaggcgattacagagtatacaaaggccgtgtacaccctaaccagtctctaccggcagtatacttcgctgctggggaaaatgaattcagaggaagaagatgaagtttggcaggtaattattggagctcgcgccgaaatgacgtccaaacatcaggagtaccttaagttagagacaacctggatgactgcagtcggcctgtcagaaatggccgccgaggctgcttaccagaccggcgctgatcaggctagcataacagcgcggaaccacatccagctcgttaagttacaggtggaagaggtccaccagctcagcaggaaagctgagaccaaactggctgaggcccaaattgaagaacttcggcagaaaacacaggaagagggtgaggaacgggcagagtccgaacaggaagcatacctgcgcgaggat

SEQ ID NO: 32623 - DNA, 717 bp, Artificial Sequence
  Description of Artificial Sequence: Synthetic coding sequence
atggccgctctcaaatcctggctgtcgcgctcagtgacttcgtttttcagatacagacagtgcctgtgcgtgccggtcgtggcgaacttcaaaaagcgctgcttcagcgaattgataagaccatggcacaaaaccgtcaccatcggattcggagtgacgctctgcgccgttccgattgcccaaaagagcgagcctcatagcttgtcctcggaggctctgatgaggagagctgtgtccctcgtgactgattctaccagcaccttcttgtcgcaaaccacctacgccctgattgaagccatcacggaatacactaaggccgtgtacactctgacctccctgtaccggcagtacacttccctcctgggaaaaatgaactcagaagaggaagatgaagtgtggcaggtgattattggggcccgcgccgaaatgacgtccaaacatcaggagtacctgaagttggaaaccacttggatgactgcggtcggactgagcgagatggccgctgaggccgcgtaccaaaccggcgcagaccaggcatccatcaccgcacggaaccacatccaactggtcaaactgcaggtggaggaggtgcatcaactcagccgcaaggccgagactaaactcgcggaggcccagatcgaagagctccggcaaaaaactcaggaagaaggcgaagaaagggcagagtcggaacaggaagcctacctgagggaagat

SEQ ID NO: 32624 - DNA, 717 bp, Artificial Sequence
  Description of Artificial Sequence: Synthetic coding sequence
atggccgctttgaagagctggcttagcaggtccgtgacttcattcttccgatataggcagtgtctatgcgttcccgtagtggctaacttcaagaaacggtgcttcagtgaactcatcagaccatggcacaagacagtgacaataggttttggagtcaccctctgcgccgtccccattgcccagaagtccgagccgcacagcctgtctagtgaggccctgatgagacgtgcggtgtcactcgtgacagattctacctcgacatttctgtctcagaccacatacgcgctcatcgaagccattaccgagtataccaaagccgtatacactctcaccagtctgtatcggcaatatacttccctcctcggcaaaatgaactccgaggaggaggacgaggtgtggcaggtaatcatcggggctagggccgagatgacttcaaagcaccaggagtacctgaaactagaaactacgtggatgactgctgtgggcctatctgagatggcagcagaggccgcatatcagactggggcagaccaggcctccatcacggcaagaaaccatatccagctggtgaagttgcaggtggaggaggttcaccagctgtcaagaaaggcggagacaaaactagccgaggctcagattgaagagctgcgccagaagacacaagaggagggcgaggagcgcgcagagagcgagcaggaggcatatctgcgagaggat

SEQ ID NO: 32625 - DNA, 717 bp, Artificial Sequence
  Description of Artificial Sequence: Synthetic coding sequence
atggcagccctgaaaagctggctgtcccgaagcgttacgtctttttttcgctatcgtcaatgtctgtgtgtgccagtagtggctaactttaaaaagcgctgcttctcagagctgatccgcccgtggcacaaaaccgtcaccataggctttggtgtcaccctctgtgctgtccctatcgcgcagaagtctgagccccactcactctctagcgaggcactgatgagacgtgcggtgagcctggtgacggattctactagcacctttctgtcccaaaccacctacgccttgatcgaagccatcaccgaatatacgaaggcagtgtatacactgacgagcttgtacaggcagtacaccagcctgctcgggaaaatgaatagcgaggaagaggacgaggtctggcaagtcataataggcgcccgtgccgagatgacaagcaagcaccaggagtacctgaaactggagaccacgtggatgaccgcggtgggcctcagcgagatggctgcggaagctgcttatcagacaggcgctgatcaggcgagcatcaccgcgcgcaaccatatccaactggtgaaactgcaggtggaagaagtgcaccagctttcaaggaaagccgaaaccaaactggctgaggcccaaattgaagaactccgccagaaaactcaagaggaaggtgaggagcgggcagagagcgagcaggaagcctatttgcgggaagac

SEQ ID NO: 32626 - DNA, 717 bp, Artificial Sequence
  Description of Artificial Sequence: Synthetic coding sequence
atggcggccctgaaatcatggctcagccgtagcgtcacgtccttcttcagatacaggcagtgcctgtgcgtcccagtggtggcgaactttaagaagcgctgctttagcgaacttatcaggccgtggcataaaactgtgactattggatttggggtgacgctgtgcgccgtcccgatcgctcagaagtccgaaccacattcactgtcatcggaggcccttatgcggcgggcggtgtcgcttgttacggactccacttccaccttcctgtcacaaaccacctacgcactcatcgaggctattaccgaatacactaaggcagtgtacaccttgaccagcttgtaccggcagtacactagcctgctgggcaagatgaattccgaggaagaggatgaagtctggcaagtcatcatcggagcacgggccgagatgacttcgaaacaccaggagtacttgaaactggaaaccacgtggatgactgcagtcggactgtccgagatggccgcagaagccgcataccaaaccggagccgaccaggcctccatcaccgcccgaaaccatattcaattggtgaaactgcaggtggaggaagtgcaccagctctcgagaaaggcggagactaaacttgcagaggcccagatcgaagaactgcggcaaaagacgcaagaggaaggtgaagaaagggctgagtctgagcaggaggcctatctcagagaagat

SEQ ID NO: 32627 - DNA, 717 bp, Artificial Sequence
  Description of Artificial Sequence: Synthetic coding sequence
atggcagccctcaagagttggttgagccggtccgtgacatcctttttcaggtataggcagtgcctttgcgtacctgtggtggcgaacttcaagaagcgttgtttctctgaactgatcaggccttggcacaaaacggtgaccatcggtttcggagttaccctatgcgctgtacccatcgctcaaaagtccgagcctcattccctgtcttcagaagctcttatgagaagagctgtttcgctcgtgaccgatagtacctctacctttctttcccagacaacatatgcactaatcgaggctattacagaatacaccaaggccgtttatactctcacaagtctctacaggcagtatacctcgctcctgggtaaaatgaattctgaagaggaagacgaagtctggcaagtgattattggcgcccgggccgaaatgacaagcaaacatcaggaatatctgaagctggaaaccacttggatgaccgccgttgggcttagcgagatggcggccgaagctgcatatcaaaccggagccgatcaggcgagcataacagcgcgcaaccacattcaactggtgaagctccaggtggaggaggtccaccagctgagcaggaaggctgaaacaaagctagcagaagcacaaatagaggagttacgacagaagacacaagaagaaggagaggagagggccgagtccgaacaggaggcctacctgagggaagac

SEQ ID NO: 32628 - DNA, 717 bp, Artificial Sequence
  Description of Artificial Sequence: Synthetic coding sequence
atggcagcgctgaagagctggctctcaagatcggtgactagcttcttccgctacaggcaatgcctgtgcgtcccggtcgtggccaacttcaaaaagcggtgcttttcggagctgattcgcccttggcacaaaaccgtcaccatcggatttggagtgaccctgtgcgccgtgcccatcgcccagaaatcggaaccgcacagcctctcgagcgaggctcttatgagaagagcagtgtcgctggtgaccgactccactagcaccttcctgtcgcagaccacctacgcgctcattgaagccatcaccgaatacactaaagcagtgtataccctcaccagcctgtaccggcagtacacttcgctcctgggaaaaatgaattccgaggaagaggacgaagtatggcaagttatcattggcgcccgcgccgaaatgacctcaaagcaccaggaatacctcaaactcgagactacgtggatgactgcagtgggcctgagcgagatggctgccgaagccgcctaccagaccggggcagatcaggcgagcatcacggcccgaaatcacattcaacttgtgaagctgcaagtcgaagaagtccatcagttgtcaaggaaggccgagactaagttggccgaggcccagatcgaggaactgcgccaaaagactcaggaggagggagaggaacgggccgagagcgaacaggaggcttacctccgggaggac

SEQ ID NO: 32629 - DNA, 717 bp, Artificial Sequence
  Description of Artificial Sequence: Synthetic coding sequence
atggctgcattgaaatcatggctgtcacggtccgtgacttccttttttcgctacagacaatgtctgtgtgttcctgtcgtcgcaaacttcaaaaagcgatgtttttccgaactgattaggccatggcataagactgtgaccatcggctttggagtcactctgtgtgcggttccaatcgcccaaaagagcgagccgcactccctttcgtcagaggccctcatgagacgagccgtgtccctggtcactgattccactagcaccttcctgtcccagaccacctacgcacttatcgaagccatcaccgaatataccaaggcggtctataccctgacctccctttaccgccaatacacgagccttctcggaaaaatgaattcggaagaagaagatgaggtctggcaagtgattatcggcgcccgagctgaaatgactagcaagcatcaggaatacctcaagctcgaaaccacttggatgaccgcagtgggcctgagtgaaatggcagcagaagcagcttatcagactggagccgaccaggcgtcaattactgctcggaatcacatccagctggtgaaactccaagtcgaagaagtgcaccagctgagccgcaaggcggaaaccaagctggcagaggcacaaattgaggagcttagacaaaagacgcaggaagagggagaggaacgcgcagagtcggaacaagaagcatacctgcgggaggac

SEQ ID NO: 32630 - DNA, 717 bp, Artificial Sequence
  Description of Artificial Sequence: Synthetic coding sequence
atggcggctctgaagtcttggctctctaggtcagtgactagtttcttccgctatcgccagtgtctgtgcgtgccagtggtggcaaacttcaagaaaaggtgtttttccgagcttatccgcccatggcataagaccgtcacaatcggttttggcgttactctctgtgctgtgccaattgcacaaaaatcagaaccacacagcctgagctctgaggccctgatgaggagggccgtctctttggtcacggattctacctccactttcctgagtcagaccacatatgctcttatcgaggccatcaccgagtatactaaagccgtctacacgctgacctctctgtacagacagtatacctcactgctgggaaagatgaatagcgaggaggaggatgaggtctggcaagtgatcatcggagccagagccgaaatgacctctaaacatcaagagtacttgaaattggaaacaacatggatgaccgcggtaggactgtctgagatggcggccgaagctgcctatcagaccggcgcggaccaggccagcattaccgcaaggaaccatattcagctcgttaagctccaagtggaggaagtgcatcaactgtccagaaaggcggaaacgaaacttgcggaagcacagattgaggaacttcgccaaaagacgcaggaggagggagaagagagggccgagagcgaacaggaagcttacttgagagaggat

SEQ ID NO: 32631 - DNA, 717 bp, Artificial Sequence
  Description of Artificial Sequence: Synthetic coding sequence
atggccgcacttaaatcgtggctgtccaggtcagtgacctccttctttagataccgacaatgcctttgtgtgccggtggtcgcaaactttaagaaacgctgtttctcggagttgataagaccttggcataagaccgtgactataggcttcggagtcaccctttgtgcagtgcctattgcacagaagtcagagcctcactcgctctcgagcgaggccctcatgcggagagccgtgtcgcttgtcactgactcgacctcaaccttcttgtcccaaactacctatgccctcattgaagcaatcactgaatacactaaggcagtgtataccctcactagcctctaccggcaatacactagcttgcttgggaaaatgaactctgaggaagaagatgaagtgtggcaggtgatcattggggcacgcgcagaaatgacgagcaagcatcaggaatacctcaagctcgaaacgacctggatgaccgcagtgggactgagcgaaatggcggcagaagccgcataccagaccggggctgatcaagcatcaatcacggcacgtaaccatattcaactggtcaaacttcaagtggaagaggtgcatcaactttcgcggaaggctgaaaccaagctggccgaagctcaaatcgaagagctccgccaaaagactcaggaagaaggggaagaaagagcagaatccgagcaagaagcgtacctgagagaggac

SEQ ID NO: 32632 - DNA, 717 bp, Artificial Sequence
  Description of Artificial Sequence: Synthetic coding sequence
atggcagcacttaagtcttggctctccagaagtgttacaagtttcttccgctatcggcagtgtctttgcgtgcctgtggtggctaatttcaaaaaacggtgcttctctgaactgatccgaccatggcacaagacagtcacgattggcttcggcgtgacactgtgtgccgtgccgattgcccagaaaagtgagccacacagtctatcctcagaagccctgatgcgacgagccgtttcactcgtgacggattcgacgtcaaccttcctttcacagacaacctatgcactgattgaggcaattaccgaatacacaaaggctgtgtacactcttacctccctctatcggcaatacaccagtctgttgggcaaaatgaattcagaggaagaggacgaagtttggcaggtcatcattggcgctcgggcagaaatgacaagcaagcaccaggagtacctgaaactggaaaccacctggatgacggccgttggacttagtgaaatggccgctgaggctgcttaccagaccggcgccgaccaggcgagcatcaccgccagaaaccacattcagctggtgaaactccaggtggaggaggtccaccaactctccagaaaggcagaaaccaagcttgctgaggcccagatcgaagagctgagacagaagacgcaagaggaaggcgaagaacgggcagagtccgagcaggaggcttatctacgcgaagat

SEQ ID NO: 32633 - DNA, 717 bp, Artificial Sequence
  Description of Artificial Sequence: Synthetic coding sequence
atggccgccctgaagagctggcttagcagaagtgtgacttctttcttcaggtaccgccagtgtctttgcgtccccgtggtcgccaactttaagaaaaggtgcttctccgaacttataagaccgtggcacaagacagttacaatcggttttggcgttaccctctgtgctgtccctatcgctcaaaaatccgaaccacacagcctcagctctgaggccttgatgagaagggctgtctctctagttactgatagcaccagcactttcctgtctcaaacaacctacgccctgatcgaagcaattaccgagtataccaaagcggtgtacacgctcaccagcctgtataggcaatacactagcctattgggcaagatgaattctgaggaagaagacgaggtgtggcaggtcattatcggcgcaagggccgagatgacgagtaagcaccaagaatacttgaagttggagaccacatggatgaccgcagtgggcctcagcgaaatggctgctgaggccgcataccaaaccggcgcagaccaagcctcgatcaccgctcggaaccatatacagttggtcaagctgcaggtcgaggaggtgcaccagctgtcaagaaaggccgaaaccaagctcgctgaagctcagattgaagagctgaggcagaagactcaagaagagggcgaagagagggctgaatccgagcaagaggcctatctgagagaggat

SEQ ID NO: 32634 - DNA, 717 bp, Artificial Sequence
  Description of Artificial Sequence: Synthetic coding sequence
atggcagccctcaaaagctggctgtccagatcagtgacttcgttcttccgctaccgccagtgcctgtgcgtcccggtggtggcgaactttaagaagaggtgctttagcgagctgatcagaccgtggcacaagaccgtcacgatcggattcggagtgaccctgtgcgccgtgcccatcgcacagaaaagcgagccgcacagtctttcctccgaggcgctgatgcggagggctgtgagcttggtcacggactcaacctcgactttcttgtcacaaactacctacgcgctgatcgaggcaattaccgaatacactaaggctgtgtacaccctgactagcctgtacagacagtacacctccctcctggggaagatgaactccgaagaggaggacgaagtatggcaagtcatcatcggagctagagcagaaatgacttcaaaacatcaggagtacttgaaacttgagactacctggatgaccgcggtgggactgtcagaaatggctgccgaggcggcctatcagaccggcgccgaccaagcctcgattacggcacgcaaccatatccagctcgtcaagctccaggtggaagaggtgcaccagttgtcccgcaaggccgaaaccaagctggctgaagcccaaatcgaagaactgcggcaaaaaactcaggaggagggcgaagagcgggccgagtcagagcaggaagcctacctgcgggaagat

SEQ ID NO: 32635 - DNA, 717 bp, Artificial Sequence
  Description of Artificial Sequence: Synthetic coding sequence
atggccgcactgaaatcctggcttagtcgatccgtgacgtccttctttagatatcgccaatgcctatgtgtgccagttgtggccaacttcaagaaaaggtgcttcagcgaactgatcagaccgtggcacaagacagtaaccattggattcggggtcaccctgtgtgcagtgccgatcgcgcagaaatcagagccacattcactgtcatcagaggcccttatgcgaagggccgtgtcgctggtgacagattccacgtctacatttttatcgcagactacctacgcccttatcgaagccatcactgaatacaccaaagctgtgtatactctcacctctctctaccggcagtatacctcacttctgggaaaaatgaattctgaggaggaggatgaggtatggcaagtgatcatcggcgcacgtgctgagatgactagcaaacatcaggagtacctcaaactggaaactacgtggatgaccgctgtcggtctgagcgagatggccgccgaagccgcttaccagaccggggctgaccaggcatcaattaccgcccgaaatcacatccagctggtcaagctgcaagttgaggaggtccaccagctctcacggaaggccgagacaaaactcgctgaggcacagatagaagaattaagacagaagacccaggaagagggcgaggaacgggctgagtctgagcaggaggcatacctcagggaggat

SEQ ID NO: 32636 - DNA, 717 bp, Artificial Sequence
  Description of Artificial Sequence: Synthetic coding sequence
atggccgcattgaagtcctggttgtcccgctcggtgacttcgtttttccggtaccggcagtgtctctgcgtccccgtggtcgctaacttcaagaagaggtgcttttctgagctgatccggccgtggcacaagactgtcacgattggtttcggggtgactctgtgcgcggtgcctatcgcgcagaagtcggaaccgcacagcctgagctcagaagcccttatgaggagggctgtctcgctcgttactgacagcacctccacttttctctctcaaactacctacgcactgatcgaagctatcactgagtacactaaggcggtgtacaccctcacctccttgtacagacaatatacctccctgctgggaaagatgaattcggaagaagaggatgaagtgtggcaggtgatcattggagcccgggctgaaatgacgtcgaaacatcaggaatatctcaaactcgaaaccacctggatgaccgccgtcggactttccgagatggccgccgaagcagcgtaccagaccggagctgaccaggcgagcataaccgcgcgcaaccatattcagctggtgaagctgcaagtggaggaggtgcaccagctgtctcgtaaagcggaaactaagctggccgaagcacaaatcgaggagctgagacagaaaactcaagaagagggcgaggaacgcgccgaatcggaacaggaggcatatctgcgagaagat

SEQ ID NO: 32637 - DNA, 717 bp, Artificial Sequence
  Description of Artificial Sequence: Synthetic coding sequence
atggccgctctcaagtcctggttgtcccgctccgtaacatcatttttccgatatcgtcagtgtctgtgtgttccggtggtcgccaattttaagaaacgttgtttcagcgaactcatccgaccgtggcacaaaacagtgacaattggcttcggggtcactctgtgtgcagtaccgatagcacagaagagcgagccacactctttatcctctgaggccctaatgcgtcgagctgtgagcctggtcaccgattctacttcgacattccttagtcaaaccacctatgctctcatagaggctatcaccgagtatactaaggcagtttacaccttaaccagtttgtatcgccagtacacttctctcctgggtaagatgaacagcgaggaagaggacgaggtttggcaggtgatcatcggagcgcgggcagaaatgacgtcgaaacatcaggagtacttaaaacttgagacgacctggatgactgcagtgggactttcggaaatggccgccgaggcagcgtatcaaaccggtgccgaccaagcaagtatcacagcgcggaaccatattcaacttgtcaaattacaagtagaagaagtacaccaattatcacgcaaggctgagactaagctcgccgaagcgcagatcgaggagttaagacagaagacccaggaagaaggcgaggagcgtgcggagtccgaacaagaggcgtacctgcgggaggac

SEQ ID NO: 32638 - DNA, 717 bp, Artificial Sequence
  Description of Artificial Sequence: Synthetic coding sequence
atggcagcactcaaatcgtggctgtcgcgtagcgtcacttcgttctttagatacaggcagtgtctttgtgtgcccgtcgtcgcaaatttcaagaagagatgcttttcagagctcattcggccatggcataaaactgtcactatcggatttggcgtcaccctgtgcgccgtccctattgcacaaaagtcggagccacattcgttgtcatccgaagcactcatgagaagagcggtttccctggtgaccgactccaccagcacctttctgtctcagactacttacgctttgatcgaagcaattaccgaatacactaaggcagtgtacaccctcacttccctgtaccgtcaatacacgtcgctgctcggtaagatgaattcggaagaagaagatgaggtgtggcaggtgattatcggtgcccgcgcagaaatgacttcgaagcatcaagaataccttaagttggaaacgacttggatgaccgcagtgggcctttccgaaatggcagcagaagcagcataccaaaccggggccgatcaggcatcgatcactgcacggaaccacatacaactggtgaagctccaggtcgaggaggtgcaccaactctcgcggaaggctgagactaagctggcggaagcacagattgaagagcttagacaaaagacgcaagaagagggggaagaaagagcagagtcggaacaagaggcctacttgagagaagat

SEQ ID NO: 32639 - DNA, 717 bp, Artificial Sequence
  Description of Artificial Sequence: Synthetic coding sequence
atggcggcccttaagtcttggctatcccggagcgtgaccagcttttttcgctatcggcagtgtttgtgtgttcctgtcgtggccaattttaagaagcggtgcttctcggagcttattagaccatggcacaaaacagtgaccattggctttggtgtgaccctgtgcgccgtcccaattgcgcagaagagcgaacctcattcactgagttccgaggccctcatgaggcgcgccgtcagccttgtgacggatagcacatcgactttcctgtcccagacaacatacgccctgatcgaagccatcaccgagtacactaaggcagtctacaccctgaccagtttgtatagacagtatacaagtctgctaggaaagatgaatagtgaagaagaagacgaagtgtggcaggtgatcattggtgccagagcagaaatgacatcgaagcatcaggagtacctgaagttggaaactacctggatgacagcggttggactgtccgagatggctgctgaggcggcttaccagacaggcgctgatcaggcctccatcaccgctcgtaatcatatacagctggtgaagttacaagtggaagaggttcaccagctgagcagaaaagctgagactaagcttgctgaagctcagatagaagagttgagacagaaaacccaggaagaaggtgaagaaagggcggaaagcgagcaggaagcttatctgcgggaggac

SEQ ID NO: 32640 - DNA, 717 bp, Artificial Sequence
  Description of Artificial Sequence: Synthetic coding sequence
atggccgccctgaaatcctggctgagccgctctgtgacatcttttttccggtataggcagtgcctgtgcgtgccggtcgtggccaattttaagaaacgctgcttcagcgagctgattagaccctggcacaagaccgtcacaatagggttcggtgtaaccctgtgcgctgtccctattgcacaaaagagcgagccccatagcctgagctccgaggcgttaatgaggcgggccgtgtcattggtgacggactccacctccacatttctgtcacagacaacttatgcattgattgaggctatcacagagtatacaaaggcagtctatacactgacctccctctatagacagtacacctccctgctcggcaagatgaattccgaggaagaagatgaggtgtggcaagtgatcataggagccagagcagagatgacgtcgaagcaccaggaatacctgaaactggagaccacttggatgacagccgtcggactcagcgagatggcagccgaagcagcgtatcaaaccggcgccgatcaggcaagtataacagcaagaaatcatatccagctggtgaagctgcaagtagaggaagtccaccagctgagccgcaaggccgagaccaagctcgccgaagcccaaatcgaggagcttcgacagaagactcaggaagaaggggaggaaagggcagagagtgagcaagaggcctatctgcgtgaggac

SEQ ID NO: 32641 - DNA, 717 bp, Artificial Sequence
  Description of Artificial Sequence: Synthetic coding sequence
atggccgccctgaagtcctggctgtcgcggtcagttacgtcgttttttcgctaccgtcagtgcctctgcgtccctgtggtggccaatttcaaaaaacgatgcttctcagaactgatcaggccgtggcataagactgttacgatcggatttggagtgacgctgtgcgccgtcccaatcgcgcagaaaagcgaaccacactctctcagcagtgaagcgctgatgcggcgggcagttagcctggtgactgattcgacttcgaccttcttgagccagactacttacgcgttgatcgaggcaatcactgagtataccaaggccgtgtacactctgacctccctgtacaggcagtacaccagcctcctcggaaagatgaactccgaagaagaagatgaggtgtggcaggtcatcattggagcccgcgcagaaatgacttccaagcatcaagaatacctcaagctggaaaccacctggatgactgcggtgggcctctcggagatggcagcagaagccgcctaccagactggagcagaccaagcatccatcactgccagaaaccatatccagcttgtgaagttgcaggtcgaggaagtgcaccagctcagccggaaggcggagacgaagctggccgaggcccaaatcgaagagcttcgacagaaaacccaagaagaaggcgaagagagggccgagtctgagcaggaggcctacctgcgcgaggac

SEQ ID NO: 32642 - DNA, 717 bp, Artificial Sequence
  Description of Artificial Sequence: Synthetic coding sequence
atggctgcattgaagtcatggttatctcgaagtgtgactagttttttcagatatagacaatgtctttgtgttccagttgttgctaattttaaaaaaagatgtttttcagaacttattagaccatggcataaaacggtaacgattggatttggagttacattatgtgctgttccaattgctcaaaagtctgaacctcactctttatcctcagaagctcttatgaggagagcagtatcgttggttacagattcaacatcaacgtttttgtcacaaaccacttatgcattaattgaagcaattacagagtatactaaagctgtttatactttaacatcattatatagacaatatacctctttattaggaaaaatgaatagtgaagaagaagatgaagtatggcaagttattattggtgcaagagctgaaatgacttcaaaacatcaagaataccttaaactagaaacaacttggatgacagctgtcggacttagtgagatggcagcagaagcagcatatcaaacaggagctgatcaagcatcaatcactgctagaaatcacattcaattggtcaaattacaagtagaagaggtacatcaattgtctagaaaggcagaaacaaaactcgctgaagcacaaattgaagaattgagacaaaagacacaagaagagggtgaagaaagagcagaatctgaacaagaagcttatttaagagaagat

SEQ ID NO: 32643 - DNA, 717 bp, Artificial Sequence
  Description of Artificial Sequence: Synthetic coding sequence
atggcggccctgaaaagctggctcagcagaagcgtgacaagcttctttaggtatcgtcagtgcctctgtgtcccggtcgtggcaaatttcaagaagcgatgtttctcagagctcattagaccctggcataaaaccgtaaccatcggcttcggggtgaccctctgtgctgtccctatcgcccaaaaatccgaaccacattcgttgtcatccgaggccctcatgcgccgcgccgtttccctggtgactgattccacttcgacctttctctctcagacaacatatgcactgatcgaagctatcaccgaatacaccaaggctgtctatacgctgacatccctgtaccgccaatatactagcctattgggtaaaatgaatagcgaagaggaggatgaagtgtggcaggtgatcatcggagccagagcagagatgacatctaagcaccaggaatatcttaaactcgaaactacatggatgactgccgtaggactgtccgaaatggcggccgaggccgcctatcaaacaggtgcggaccaggctagcattaccgcgcggaatcacatccagttagttaagcttcaagtggaggaggtacatcagctgtccagaaaggcggagacaaagctcgcagaggcgcagatagaagagttacggcaaaagacgcaggaagaaggcgaggaaagggctgagtctgagcaagaagcctacctccgagaagac

SEQ ID NO: 32644 - DNA, 717 bp, Artificial Sequence
  Description of Artificial Sequence: Synthetic coding sequence
atggccgccctgaagtcatggttgtctcggagcgtcacttcattcttccggtacagacagtgcctctgcgtgcccgtcgtggcgaacttcaaaaagagatgcttctcagaactgatccggccttggcataaaaccgtgacgatcgggttcggcgtcactttgtgcgcagtgccaatcgcgcagaagtcagaaccacactccctgtcgagcgaagcgctcatgcggagggcagtgagcctggtgactgacagcacttcgacgtttctgagccagactacttacgccctgatcgaagcgataactgagtacacgaaagccgtgtatactctcacttcgctgtacaggcaatacacctccctgttgggtaagatgaattcggaggaggaagatgaagtctggcaggttatcattggcgccagagcggaaatgacctctaagcaccaagagtacctcaaactggaaaccacctggatgaccgccgtggggctgtcagaaatggcagcagaagcagcctaccaaactggagcagaccaagcgtcaatcaccgcccgcaaccatatccaacttgttaagctgcaggtggaggaagtgcaccaactgtcacgcaaggcggagactaagctcgcggaagcccagattgaagaactccgccagaaaacgcaagaggagggcgaggagagggcagagtcagaacaggaggcgtacctccgcgaagat

SEQ ID NO: 32645 - DNA, 717 bp, Artificial Sequence
  Description of Artificial Sequence: Synthetic coding sequence
atggccgcactcaagagctggctgtctcggagtgttacctcttttttcaggtatcgacagtgtttatgcgtccccgtggtggccaacttcaagaagagatgtttttcagagctgattcgaccctggcataagacagtcacaataggctttggcgtgaccctctgtgccgttcctatcgcacaaaaatcagagccccatagccttagttcagaagcgctgatgaggcgcgcggtttccctggtgacagactcgacatccacgttcctgtcccagaccacgtacgcactgatagaggcaatcactgagtacacaaaggccgtatacacactgacgagcctctatcggcagtatacaagcttgctggggaagatgaacagcgaggaagaggacgaagtgtggcaggtgatcatcggggcccgggcggaaatgacaagcaagcaccaggaatacctgaagctggagactacgtggatgactgctgtcggactgagcgaaatggcagcagaggccgcttaccagactggcgccgaccaggcatctataacagcgagaaaccatattcagctggtgaaactacaggtggaggaggtgcaccagctgtctcggaaggccgaaactaaactggccgaggcccagatcgaagaacttagacagaagactcaggaggagggagaggagcgtgcagagtccgaacaagaagcttatctgcgggaggac

SEQ ID NO: 32646 - DNA, 717 bp, Artificial Sequence
  Description of Artificial Sequence: Synthetic coding sequence
atggctgctctcaagtcgtggctttcccgcagcgtgacctcattctttcggtacagacagtgcctgtgcgtccctgtcgtcgcaaatttcaagaaacgctgcttctcggaactgattagaccgtggcacaagaccgtgaccatcggatttggtgtcactctgtgtgccgtgccgatcgcccaaaagagcgaaccacactccctcagctcggaagctctgatgcgccgcgctgtgtcgttggtcactgactccacttcaacgttccttagccaaactacctacgcgctgatcgaggcaattactgagtataccaaggccgtgtacaccctcacttcactgtaccgacaatacacttcgttgctcgggaagatgaactccgaagaggaggatgaggtgtggcaggtgatcatcggagcccgtgcggagatgacctctaaacatcaggaatacctgaagctggagacgacttggatgacggccgtgggcttgtcagaaatggccgccgaggccgcgtaccaaaccggcgcagatcaggcgtcgatcaccgcacggaaccatatccagctcgtgaaactgcaggtggaggaagttcaccaactcagccggaaggcggaaaccaagctggcagaagcgcagatcgaggaactgcggcaaaaaactcaggaagaaggagaagagagagccgaatccgaacaggaggcctacctgagggaggac

SEQ ID NO: 32647 - DNA, 717 bp, Artificial Sequence
  Description of Artificial Sequence: Synthetic coding sequence
atggctgctttgaaatcttggctatccaggtctgtaacttcattcttcaggtatcgacagtgtttgtgtgtgcctgtcgtcgctaattttaagaaaagatgcttttcagagctcatccgaccctggcataaaacagttacaatagggttcggggttacactttgcgcagtgcctatcgcccagaagagtgagccacactcactctcgagtgaagcgttgatgaggagggccgtctctttggtaactgactccacatccacatttctgtcacagactacttatgccttaatcgaagccattactgaatatactaaagcagtttatacacttacatccctatatcggcagtacacttctctactcgggaaaatgaactcagaggaagaagatgaagtgtggcaggtcataatcggggcccgggccgaaatgacttccaaacatcaggaatacttgaaactagaaactacttggatgacagccgttgggttatcagaaatggccgcagaagccgcctatcagacaggagccgatcaggctagtatcactgcccgaaatcacatacagctcgtaaaactccaagtggaagaagtccaccaattgtcaaggaaagcggaaactaaattagccgaagctcagatagaagagctgcggcagaaaacacaggaagaaggagaagaacgcgctgaaagtgagcaggaggcctacttaagagaagat

SEQ ID NO: 32648 - DNA, 717 bp, Artificial Sequence
  Description of Artificial Sequence: Synthetic coding sequence
atggcggccctgaaaagctggctgtcccgttccgtgacgtcgttttttcgataccggcaatgcttgtgtgtgcctgttgtggcaaacttcaaaaagagatgtttttcagagcttattagaccctggcataagactgtgaccattggcttcggagtgactttgtgtgccgtgccgatcgcacagaagtccgaaccgcactcgctttcgagcgaagcacttatgagacgcgccgtctccctcgtgactgattctacctcaacgttcctttcgcaaaccacttacgcacttatcgaagctatcactgaatacaccaaggccgtgtacactctcacttcgctctacaggcaatacacctccttgcttgggaagatgaactcagaggaggaggatgaggtgtggcaagtgataattggagctcgcgcagagatgacttcaaaacaccaagaatacctgaaactggaaaccacgtggatgactgcagtgggtctgtccgaaatggcagcagaagcagcgtaccagaccggcgcagaccaagcgtcgattactgcccggaatcacattcagcttgtgaagttgcaagtcgaggaggttcatcaactctcaagaaaagcagaaactaagctggcagaagcacaaattgaagagttgagacaaaagactcaagaggaaggagaagaaagagcagagagcgagcaagaagcatacctccgtgaggat

SEQ ID NO: 32649 - DNA, 717 bp, Artificial Sequence
  Description of Artificial Sequence: Synthetic coding sequence
atggccgcactcaagagctggctgtcccgaagcgttacctccttctttcgctacaggcagtgcctgtgcgtcccagtggtggctaacttcaaaaaacggtgcttctccgaactgattagaccctggcataagaccgtcaccatcggctttggagtgaccttgtgtgcagtcccaatagcccaaaagtcggagccgcactcactttcgagtgaagctctcatgcgccgcgccgtgtccctcgttactgactcgacttctaccttcctcagccaaactacttatgccctgattgaagccatcactgagtacaccaaggccgtctacactctgacttcgctgtacagacagtacacttcactgctcggcaagatgaattccgaagaagaagatgaagtgtggcaggtgatcatcggtgcccgcgcagaaatgacctcgaagcaccaagaatacctgaagctggaaaccacctggatgacggcggtgggactcagcgaaatggcggccgaagcggcgtaccagacgggagccgatcaggccagcatcaccgcccggaaccacatccaactggtgaaattgcaggtggaggaggtgcatcagcttagccggaaggctgagacgaagttggcggaagcccagatcgaagaactgcggcagaaaacccaagaagaaggagaggaacgggctgagtcggagcaggaggcctacctgagagaagat

SEQ ID NO: 32650 - DNA, 717 bp, Artificial Sequence
  Description of Artificial Sequence: Synthetic coding sequence
atggcagccttgaaaagctggctttccagatcagtgaccagcttttttcgctacaggcagtgtctttgcgtccccgtggtggccaatttcaagaagcgctgtttctcagagttgattagaccgtggcataaaactgtgaccataggatttggggtgactctttgtgcagtgccaattgcccaaaagtcggaaccccatagtctgtcctcggaggctttgatgaggagagcagtctctcttgtgaccgatagcacttccacctttctttcccagaccacgtatgccctgattgaagcgataactgaatacactaaggccgtctacacccttacttcattgtacagacagtacacctcacttctcgggaagatgaactccgaggaggaagatgaagtgtggcaagtgatcattggagcacgcgcggagatgacttcaaagcatcaagagtacctcaaactggagactacctggatgaccgcggtgggattgtccgaaatggctgcagaggcagcataccagaccggtgcagaccaggcatcgatcacggctcgaaaccatatccaacttgtgaagctccaagtggaagaggtgcatcaactctcgcggaaggccgaaaccaagctggcagaagcacaaatcgaagaactgagacaaaaaacccaagaagaaggtgaggaacgtgcggagtccgagcaagaggcgtacttgagagaagat

SEQ ID NO: 32651 - DNA, 717 bp, Artificial Sequence
  Description of Artificial Sequence: Synthetic coding sequence
atggccgccctgaagtcctggctttctcgctctgtcacaagttttttcagataccgccagtgtctgtgtgtgccagtcgtggcgaacttcaagaagcggtgcttctccgagctgattagaccgtggcataagacggtgacgatcggctttggtgtgactctgtgcgctgtgcccatcgctcagaagtccgagccccacagcttgagctctgaggccctcatgcgtagagccgtgtccctcgtgacagactccacctcaaccttcctgtcccagactacttacgcgctaatcgaagccattacggaatacactaaagccgtttatacgctgactagtctgtacagacagtatacctcattgctcggaaagatgaacagtgaggaggaagatgaagtgtggcaggtcatcattggcgctagagccgaaatgaccagcaagcaccaggagtacttgaagctagagaccacctggatgacggcagtcggcctgtcagagatggctgcggaggccgcctatcagaccggcgctgaccaggcttcaatcaccgctcgcaaccacatccagctggtgaagctccaggtcgaagaagttcaccagcttagtcgtaaggccgagaccaagctggccgaagcgcagatcgaggaactccgccagaaaacccaggaagagggggaggaacgagctgaatctgagcaggaggcatatttgagggaggac

SEQ ID NO: 32652 - DNA, 717 bp, Artificial Sequence
  Description of Artificial Sequence: Synthetic coding sequence
atggccgcactcaagagctggttgagccgctcagtgacctccttctttagatacagacaatgcctctgtgtcccagtggttgccaactttaagaagaggtgtttcagcgagcttattcgtccttggcataagactgtgaccattggatttggagtcactctgtgtgccgtgcccatcgcgcagaagtctgaacctcattcgctgtcgtccgaagcattgatgcggcgggccgtctcccttgtgaccgacagcacctctacgtttctgtcgcagactacttatgcacttatcgaggcaataacggaatacactaaggcggtttacacgcttacgtccctttaccgccagtacacctcactgctggggaagatgaactctgaagaagaagatgaagtctggcaggtgattatcggagcgcgagctgagatgactagcaagcaccaagagtacttgaaacttgaaaccacctggatgactgcggtgggcctgtcggaaatggcagcagaagcagcctaccagaccggcgctgaccaagcatcgatcacggctagaaatcacattcagctggtcaaactccaggtcgaggaggtgcatcaactgagccgcaaagctgaaacgaagctcgcagaagcacaaattgaggaactccgacaaaaaactcaagaggagggtgaagagagagccgaatccgaacaggaggcatacctccgggaagat

SEQ ID NO: 32653 - DNA, 717 bp, Artificial Sequence
  Description of Artificial Sequence: Synthetic coding sequence
atggccgcattgaagtcgtggctttccaggtcagtgacctccttctttcgttacagacagtgtctgtgcgtgccagtggtcgctaatttcaagaagcggtgtttctccgagctcatcaggccctggcataagaccgtgacgataggatttggtgtgactctgtgtgccgttccgatcgcacaaaagtcggagcctcactcgctttcatctgaagcattgatgcggcgggcagtcagcctcgtgactgactccacttcgacctttctgtcccaaaccacgtatgccctgattgaggccattactgagtacaccaaggcagtgtacacgcttacctccctgtaccgtcaatacacctcgctccttggaaaaatgaactcggaagaagaagatgaagtgtggcaagtgatcatcggagcacgagctgaaatgacctcgaagcaccaggaatatctgaaattggaaacgacgtggatgactgcagtgggcctgagcgagatggctgcagaagccgcttaccagaccggggccgatcaggcatcgattaccgccagaaaccatatacaactggtgaagctccaggtggaagaagtccaccagctgtccagaaaagctgaaacgaagctggccgaggcccagatcgaggagctgcgtcagaaaacccaagaagaaggagaagaacgggccgagtcagaacaggaagcgtaccttagagaggat

SEQ ID NO: 32654 - DNA, 717 bp, Artificial Sequence
  Description of Artificial Sequence: Synthetic coding sequence
atggcagcgctgaaaagttggctgagccgctcagtcacttcctttttccggtatcgccaatgcttatgtgtacccgtcgttgccaatttcaagaagcgctgtttttccgaactgatccgcccgtggcacaaaaccgtgactattggtttcggcgttaccttgtgtgcagtcccaattgcccagaagagtgagcctcacagcctgtcgtctgaggccctcatgcgacgggcggtgtctttggtcaccgactctacgtccacatttctgagccaaactacgtatgccctgatagaggccatcactgagtacacaaaggccgtgtatactcttacttctctgtacagacagtacacatctctgcttggcaagatgaacagcgaggaggaagacgaggtgtggcaagtgattattggggcgcgggcagagatgacttccaagcatcaggagtatctgaagctggaaactacatggatgaccgccgtggggctgagtgaaatggcagctgaagccgcataccagactggcgccgatcaggccagcataacggctaggaaccacattcagttggtgaagctccaagtggaggaagtccaccaactctcccgaaaggcagagacaaaactggccgaagcccaaatagaggaactgcgacagaaaacacaagaggaaggtgaggagcgcgcagagtccgagcaggaggcgtacctgagagaggat

SEQ ID NO: 32655 - DNA, 717 bp, Artificial Sequence
  Description of Artificial Sequence: Synthetic coding sequence
atggccgccctgaaaagctggctttcacgttcggtcacttccttttttcggtaccggcagtgcctctgtgtgccggtcgtggcaaactttaagaaacggtgcttttcggaactcatcagaccttggcacaaaacggtgaccattggatttggagtcaccctttgtgcggtgcctattgcacagaagtctgaacctcactccctttcgtcggaagcacttatgagaagagcagtgagcctggtgactgattcgacctccacgttcctgtcacaaactacctacgcgctgatcgaggcaattactgagtacacgaaggcggtctacactctgaccagcctttatcgacagtacacctccctccttgggaaaatgaactccgaagaggaagatgaggtctggcaggtcattataggtgcacgcgcggagatgacgtctaagcatcaggagtacctcaagttggaaaccacctggatgactgccgtgggcctttcggaaatggcagcagaggcggcgtaccaaactggtgcagatcaagcatcgatcaccgcgagaaatcacattcagctggtgaagctgcaggtggaagaggtccatcagctgtcaaggaaggcagaaaccaagctcgccgaggcacagattgaagagcttcggcaaaagactcaagaagaaggcgaagagcgcgctgaaagcgagcaggaagcatacctccgcgaagat

SEQ ID NO: 32656 - DNA, 717 bp, Artificial Sequence
  Description of Artificial Sequence: Synthetic coding sequence
atggccgccctgaagtcttggctgtcaaggagtgttacttccttcttccgctatcggcagtgcctgtgtgtccctgtggtggccaatttcaaaaagcggtgtttcagcgagctgatccgcccctggcataagactgtgacaatcggctttggcgtgacactgtgtgctgttccaatcgcgcagaagagcgaaccccatagcctctcaagcgaggccctaatgcgaagggccgtatccttggtcaccgactctacaagcactttcttgagccagacaacatacgctctgatcgaggcgattactgagtacacaaaggccgtttataccctgacgagtctctatcgacaatacacatctctgctcggcaagatgaacagcgaggaagaagatgaggtatggcaggtgattattggggctcgagcggagatgacatccaagcaccaggagtaccttaaacttgagacaacatggatgaccgctgttggcctgagcgagatggccgcggaagcggcttatcagaccggggccgaccaggcgtctatcacggcccgcaaccacatccagctcgtgaaactccaggtggaggaggttcaccaactgagcagaaaagcggaaacaaagctcgcagaggcccagatcgaagagctgagacaaaagacccaagaggagggtgaagaaagagctgagtctgagcaggaagcctacctgcgggaggat

SEQ ID NO: 32657 - DNA, 717 bp, Artificial Sequence
  Description of Artificial Sequence: Synthetic coding sequence
atggcggctctgaagtcctggctgtcccggtctgtgacttctttttttagatataggcagtgcttgtgcgtgccggtggtggcaaacttcaaaaagcgctgtttttctgagttgatcagaccctggcacaaaacagtgacaatcggattcggagtcacactttgcgccgtccccattgctcagaaatctgaacctcacagtctgagttcggaggcccttatgcgaagagccgtttccctggtgactgattctacttccacctttttgtctcagacgacatatgcccttatcgaggcgataacagagtatacaaaagccgtctatacgctcacatcgctgtaccgtcagtatacttctctattgggtaaaatgaattctgaagaggaggacgaagtgtggcaggtgatcatcggagcaagggcggagatgacatcaaagcaccaggagtatctgaaactggaaacgacttggatgaccgccgtcggcctgtctgagatggccgcggaagccgcctaccaaacaggagctgatcaggcatcgataacggcccgtaaccatattcagctggtcaaactgcaggtagaggaggtgcaccagttgtcaaggaaggccgaaaccaagctggctgaggctcagatcgaggaactcagacagaaaacccaggaggagggtgaggaacgcgccgaatcagaacaagaggcgtacctgcgagaggac

SEQ ID NO: 32658 - DNA, 717 bp, Artificial Sequence
  Description of Artificial Sequence: Synthetic coding sequence
atggcggcactgaagtcgtggctgtcacggtccgtgacctcgtttttccgctatcgccagtgcctgtgtgtgcctgtcgtcgcgaacttcaagaaaaggtgctttagcgagttaatccgtccctggcacaagacagtgacaataggcttcggcgtaaccctctgcgcggtgccgatcgctcaaaagtcggaaccccactctctgagctccgaagctctgatgaggcgcgcggtcagtctcgttaccgactcgacatccactttcctgtcgcaaacgacctacgccctaatcgaggctatcaccgagtacactaaggccgtatatactctaacaagcctgtatcgacaatacaccagccttttgggtaagatgaactcagaagaagaagatgaagtctggcaggtgatcattggagcgagagccgagatgacgtcgaagcaccaagagtatcttaagctggagaccacctggatgactgcggtgggcctgtcggagatggctgccgaagctgcctatcagacaggagcagatcaggcgtctatcacagcccgtaaccacatccaactggtgaaacttcaggttgaggaggtgcatcagctgtctcgtaaggccgagacaaaattagccgaagcccaaatcgaagagctgcgccaaaagacgcaggaggagggtgaggagcgcgccgagagtgagcaggaggcgtatctaagagaagat

SEQ ID NO: 32659 - DNA, 717 bp, Artificial Sequence
  Description of Artificial Sequence: Synthetic coding sequence
atggctgcgcttaaaagttggttaagtcggagtgtgacctcttttttcagataccggcaatgtctgtgtgtcccagtggttgccaatttcaaaaagcggtgcttcagcgagcttatcaggccgtggcataagactgtgacgattggatttggggtgacactatgcgcagtccccatcgcacagaaaagcgaacctcacagcctgtcctccgaggcacttatgcgtagggccgtgagcttggtaaccgattcgactagcacatttttgagccagaccacctatgcgctaattgaagcaataacagaatacacaaaggctgtatatacactgactagcctttacaggcagtatacctccctcctgggcaaaatgaacagtgaggaggaggacgaagtctggcaggtcattatcggagctagggctgaaatgacaagcaaacatcaggaataccttaagctggagactacttggatgactgcagtcggcctttcagagatggcggctgaagctgcatatcaaacgggcgctgatcaggcgagtataaccgccaggaaccacattcagcttgtgaaactgcaggtggaggaggtacaccaattgtccagaaaagccgagacaaagctcgcggaagcgcagatcgaggaacttagacagaaaacgcaggaggaaggtgaggaacgcgccgagtcagagcaggaggcctatcttcgtgaggac

SEQ ID NO: 32660 - DNA, 717 bp, Artificial Sequence
  Description of Artificial Sequence: Synthetic coding sequence
atggctgctctgaaaagctggttgtcaagatctgtgacgtccttctttagataccggcagtgtctctgtgttccagttgtcgccaacttcaaaaagcgatgtttttcagagctaatcaggccgtggcataagactgttactatcggattcggagttaccctctgcgctgtgcctatcgcacagaaatccgagccgcattccctctcgagtgaagccctgatgaggcgcgcagttagtcttgttaccgactctacctccacattcctctctcagaccacctacgctcttatcgaggcaatcaccgagtacacaaaagccgtttacaccttgaccagtctgtatagacagtatacatctcttttgggaaaaatgaacagtgaggaggaggatgaagtgtggcaggtgatcatcggagctagggccgaaatgactagcaagcatcaagagtacctaaagctggaaaccacttggatgaccgctgtgggactctcagagatggctgcagaggcagcatatcagacaggcgcagatcaggcatctatcactgctagaaatcatatccaactagtaaagctgcaggtggaagaagttcatcaactttcccgtaaggccgaaactaagctcgccgaagctcagatcgaggaacttcgtcaaaaaactcaggaggagggagaagaaagggcagagagcgagcaggaagcttatctgcgtgaagac

SEQ ID NO: 32661 - DNA, 717 bp, Artificial Sequence
  Description of Artificial Sequence: Synthetic coding sequence
atggcggctctcaagagttggctgagccggagcgtgacatcatttttccgctatcgccagtgcttatgtgttcctgtggtggctaattttaaaaagcgatgcttcagtgaactgatcagaccctggcacaagacggttaccataggttttggggttaccctctgtgctgtgcccattgcccagaagagtgaaccccatagcttatcttccgaagccctgatgcgtagggcggtctctctggtgaccgattccacaagcacttttctgagccagaccacttacgccctcatcgaggcaataaccgaatatacgaaggctgtttatactttaacctccctttatcgacaatatacaagcctgctagggaagatgaattctgaagaagaagacgaagtgtggcaggtgatcattggggcaagagcagaaatgacttccaaacaccaagaatatctgaagctggagaccacttggatgacagcagtcggactttcagagatggcggcagaagctgcgtaccagacgggagctgaccaggctagcatcaccgctaggaaccacatccagctggtgaagctccaggtggaagaggtgcaccagctgtctcgcaaggctgagaccaagctcgctgaagctcagatagaagagctgagacaaaagacccaggaagagggagaggaaagggccgagtccgaacaagaagcttaccttagagaagac

SEQ ID NO: 32662 - DNA, 717 bp, Artificial Sequence
  Description of Artificial Sequence: Synthetic coding sequence
atggctgccctcaaatcatggctgtcccggagcgtcacctctttctttcggtaccgccagtgcctgtgcgtgccggtggtcgcgaacttcaagaagcgctgtttcagcgaactcatccggccgtggcacaaaactgtgacgatcggattcggagttacgttgtgcgccgtcccaattgcacaaaaatcagaaccgcattcattgtcatccgaagcgctgatgagacgcgcggtgtcgcttgttacggattccacttccacttttctgagccaaactacttacgcccttatcgaagccatcactgaatacactaaggccgtgtacacgctgacctccctctaccggcagtacacttcgctcctcggtaagatgaactcagaggaagaggacgaggtctggcaggtgatcatcggagcccgcgcagaaatgaccagcaagcaccaggaatatctgaaattggaaactacctggatgaccgccgtgggcctgagcgagatggccgcagaggcagcgtaccagactggcgccgatcaggcgagcatcaccgcgcggaaccatatccagctcgttaagctgcaggtggaggaggtccatcagctctcgaggaaagcagagactaagctggcagaggcacaaatcgaggaactgcgccagaaaactcaggaagagggagaggaacgagcagaatcagaacaagaagcctacctccgcgaggac

SEQ ID NO: 32663 - DNA, 717 bp, Artificial Sequence
  Description of Artificial Sequence: Synthetic coding sequence
atggccgctctcaaaagttggctgtcccggtccgtaacgtctttcttcagatatcgacaatgcttatgtgtgcccgtcgtggccaatttcaagaagcgatgtttttctgagttaattcgcccgtggcacaagacagtcaccataggcttcggagttacactgtgcgccgtacccatcgcgcagaaatcagaaccccattccctgagtagtgaggccctcatgagaagagccgtctccctcgtgactgactcaacctcaaccttcctgtctcagaccacctacgcactgatagaagccatcacagaatacaccaaagccgtttacaccctgacctccctgtaccggcagtacacaagtttgcttggcaagatgaattcagaagaagaggatgaggtgtggcaggttattatcggggctcgcgccgaaatgaccagcaaacatcaggagtatttgaaattggaaaccacatggatgactgcggttggactgtcagagatggctgcggaggctgcataccagacgggtgcggatcaggcctctatcactgcacgcaaccatattcagttagtgaaactgcaggtcgaagaagtgcatcagctgtcacggaaggccgagactaagctggccgaagcgcagattgaggagttgaggcagaagacgcaggaggaaggagaggagagagccgaaagtgaacaagaggcgtacctgcgtgaggac

SEQ ID NO: 32664 - DNA, 717 bp, Artificial Sequence
  Description of Artificial Sequence: Synthetic coding sequence
atggcggctctgaagtcatggttgtctcgcagcgtgacctcattcttccgatacaggcagtgtttgtgcgtacctgtggtggccaacttcaaaaaacgatgcttttccgagctgatcaggccctggcacaaaacagtgaccataggattcggagtgaccctttgcgctgtgcccattgcccagaaatccgagccacactcactgtcgtccgaggccttgatgcgcagagctgtgagtctcgttacggatagtaccagtacatttttgagccagactacatacgctctaattgaggctatcacagaatacactaaggcagtatatactctgactagcttatacagacagtatacatctctgctagggaaaatgaattcagaagaggaagacgaggtatggcaggtcattatcggagccagggccgaaatgacctcaaaacatcaggagtatctgaagctggaaaccacctggatgacggccgtgggactcagtgagatggccgcagaggccgcctatcagacaggggccgaccaggcaagtatcacagcccggaaccatatccagcttgtaaaactacaggtggaagaagttcaccagttatctaggaaggctgagacaaagttggctgaggcgcagatcgaggagctgagacaaaagacacaggaagagggcgaagaacgagcagagagcgagcaagaagcctatctccgggaggac

SEQ ID NO: 32665 - DNA, 717 bp, Artificial Sequence
  Description of Artificial Sequence: Synthetic coding sequence
atggccgccctcaagagctggttgtcgcgttctgtgactagcttctttcggtaccggcaatgcctgtgcgttcctgtcgtggcgaatttcaagaagcggtgtttcagcgaactgatccgcccgtggcataagaccgtgactattggctttggagtgaccctgtgcgcagtgccaatagcgcagaagtcagagccgcactcactgagctcggaggcactcatgcgcagagccgtctccctggttaccgactccacgtccaccttcctctcacagactacgtacgccctgatcgaagcaatcactgaatacaccaaagcggtctacacgttgacctccctctatcggcaatacacttcgctcctggggaagatgaacagtgaggaagaagatgaagtctggcaggtgatcatcggtgcgcgcgctgaaatgaccagcaaacaccaggagtacctgaagctggaaaccacctggatgaccgcggtcggcctgagcgaaatggcagctgaagcggcctatcagactggagccgatcaggcgagtatcaccgcccggaaccacattcaactggtgaagctgcaggtggaagaggtccatcagttgtccaggaaagccgaaactaaacttgccgaggcccaaatcgaggaactccggcaaaagactcaggaggagggagaggagcgcgcagagtccgaacaagaagcatacctcagagaggat

SEQ ID NO: 32666 - DNA, 717 bp, Artificial Sequence
  Description of Artificial Sequence: Synthetic coding sequence
atggctgctttgaaatcttggctttccagatcggtcacgtcattctttcggtaccgacaatgcctgtgcgtacccgtggtggcaaatttcaagaaaagatgttttagcgagcttattcgaccttggcataagactgtcacgattgggttcggtgtcaccttgtgcgccgtccccattgcgcaaaagagcgagccacattctctgtcctctgaagcactgatgcgccgtgcagtgtcactagtgactgactccacttccaccttcttaagccaaactacatatgccctgattgaggcaatcacagagtacacgaaagctgtctacaccttgactagtctctaccggcagtatacttccttgctgggcaagatgaattcagaggaggaggatgaagtgtggcaggttatcattggggcacgcgctgagatgacctccaaacatcaggagtacctgaagctggagaccacatggatgactgccgtcggtctgagtgagatggctgctgaagctgcataccagacaggtgccgaccaggcttcgatcactgcccgcaatcatatccaacttgtcaagttacaggtcgaagaggtccaccagctatcaagaaaagctgagactaagctggctgaggcccagatagaggaactgcgccagaagacacaggaagagggcgaagaacgggccgagtccgagcaggaggcctatctgcgagaggat

SEQ ID NO: 32667 - DNA, 717 bp, Artificial Sequence
  Description of Artificial Sequence: Synthetic coding sequence
atggccgcacttaagagttggctgagccggagcgttacctcttttttccgctatcgacagtgcttgtgcgtcccagtcgtcgcgaatttcaagaagcggtgttttagtgagctgatacggccctggcataaaacagtgactatcggtttcggcgtcacgttatgtgcggtccctattgcgcagaaaagcgaaccccatagtctgtcaagcgaggcactgatgcgacgggccgtttcacttgtgaccgatagcacgtcaacctttctgtcacagacgacctatgcactgatagaagctatcaccgagtatacgaaggccgtgtatacccttacctcactgtacagacagtatacgtctctgctgggaaagatgaacagtgaggaagaagacgaggtgtggcaggttatcatcggggcccgagctgaaatgaccagtaaacaccaggaataccttaagttggaaaccacttggatgacagccgtgggtttaagcgaaatggccgctgaagctgcataccaaacaggggctgaccaggcaagcattacagcgcgcaaccatatacagttggtgaaacttcaggtggaggaggtgcatcaattaagcaggaaggctgagacaaaactcgcggaggcccagatcgaagagctgagacagaaaactcaagaggagggcgaagaaagagccgagagcgaacaggaggcctacctacgtgaagat

SEQ ID NO: 32668 - DNA, 717 bp, Artificial Sequence
  Description of Artificial Sequence: Synthetic coding sequence
atggcggcgcttaaaagttggctatccagatccgttacttcattttttcgctatagacaatgcctctgtgtccctgtcgtggccaacttcaaaaagcggtgcttttccgagctcattagaccatggcacaagactgtgacgatcgggtttggagtgactctgtgcgcagtgccgattgctcagaaatcagaaccccactcactgagtagtgaggccctgatgcggcgggccgtgagcttagtcacggactccactagcaccttcctctctcagacaacttatgctctgatcgaagcaatcacagagtacacgaaggccgtgtacaccttaacctctctgtacaggcagtatacatctttactgggaaagatgaacagtgaagaagaggatgaggtgtggcaggtaatcatcggagccagagccgagatgacctctaagcatcaggagtatttaaaactcgaaactacatggatgacagccgtggggttgtcagagatggctgcagaggcggcctaccagaccggggctgatcaggcctctatcacagccaggaaccacatccagctggtaaagctacaggtggaagaggtacaccaactctccagaaaggctgaaacaaagctggcagaggcccagattgaagagcttcgtcagaaaacacaggaggaaggtgaggagcgggctgaaagtgagcaagaagcctatttgcgcgaggac

SEQ ID NO: 32669 - DNA, 717 bp, Artificial Sequence
  Description of Artificial Sequence: Synthetic coding sequence
atggcagctttaaaaagttggttgtctcgttcagttacctctttcttcagatatagacagtgtctttgcgtcccagtcgttgcaaacttcaaaaaaagatgtttctctgaattgattagaccctggcacaagactgtaacaattggttttggtgttactttatgtgccgtccccattgctcaaaagagtgaaccgcactctctaagttctgaagcccttatgagacgtgccgtttcgctcgttactgactcaacttctacctttctgtctcaaactacgtatgcgttgattgaagcaatcactgaatataccaaggctgtttacacactcacctctctttatcgtcaatacacttctcttctgggcaagatgaactccgaagaagaagatgaagtttggcaagtaatcattggggcacgtgctgagatgacatcgaagcatcaagaatatctgaaacttgaaacaacttggatgacggcagtggggctgtctgaaatggccgctgaggcagcctatcaaactggagcggatcaagcttccattactgcgcgaaatcatattcagcttgttaagttacaagtggaagaagtccatcaattgagtagaaaagcagaaacaaaattggcagaagctcaaattgaagagctacgccagaagacacaggaggagggagaagagcgagccgagtcggagcaagaggcgtacttgagagaagat

SEQ ID NO: 32670 - DNA, 717 bp, Artificial Sequence
  Description of Artificial Sequence: Synthetic coding sequence
atggcggcacttaaatcttggctttcacggagcgttacttctttcttcaggtatagacagtgcctctgcgtcccagtagttgcaaactttaaaaaaagatgctttagcgaacttatcaggccctggcataaaaccgtaaccattggatttggcgtaaccctttgcgctgtgcccatcgctcaaaaaagcgaaccccacagcctttcttctgaggcccttatgcggcgcgcagttagcctggtcaccgactccacttctaccttcctcagccagaccacttatgctctgatcgaggctatcactgaatacactaaggcagtgtacacactgacctcgctgtatcgtcagtacacttctctactgggaaaaatgaatagcgaggaagaggacgaggtctggcaagtcattatcggggccagggccgaaatgacttcgaagcatcaagaatatcttaagcttgaaactacttggatgaccgcagtgggactgtctgagatggcggctgaagcagcctatcagaccggcgcggaccaggcttctataaccgccaggaaccatatccagcttgttaaattgcaagtggaggaagtgcatcaactcagtagaaaagctgagactaagctggcagaagctcaaattgaagaacttcggcagaagacccaggaagagggagaagagagagcagaatccgaacaagaggcctacctgagggaagac

SEQ ID NO: 32671 - DNA, 717 bp, Artificial Sequence
  Description of Artificial Sequence: Synthetic coding sequence
atggccgccttgaaatcctggctgtcccgttctgtgacttccttcttcagataccgccagtgcctttgcgttccagtcgtggctaatttcaagaagcgctgtttttccgaactgattcggccgtggcataagaccgtgactatcggcttcggcgttaccctgtgcgcggttcccatcgctcagaagtctgagccgcactcgctctcttccgaggctctgatgagaagggccgtttccctggtgaccgatagcacctccactttcttgagccagaccacatatgctctaatcgaagcaatcaccgagtacacaaaggcagtgtacaccctgactagtctgtaccggcagtatacttcactcttggggaaaatgaactcggaagaggaggacgaggtatggcaggtgattattggagctcgtgccgagatgacctccaagcaccaagagtatctgaagctggagaccacgtggatgacagccgtggggctgtctgagatggcggcggaagctgcctatcagacaggcgccgaccaggctagtatcacagcccgcaatcacatccagctcgtcaagttacaggtggaagaggtgcatcagctgtctagaaaggctgaaacaaaactcgccgaggcacagatcgaagagctgaggcagaaaacacaagaagaaggcgaagagcgagctgagtctgagcaagaggcctatttgcgcgaggac

SEQ ID NO: 32672 - DNA, 717 bp, Artificial Sequence
  Description of Artificial Sequence: Synthetic coding sequence
atggccgcattgaagtcctggctttcacggtccgtcactagcttcttccggtaccgtcaatgcctgtgtgtgcccgtcgtcgcaaactttaagaaaaggtgtttctctgaacttatccggccctggcacaaaaccgtgaccattggctttggagtgaccctctgcgcagtgccaattgcacaaaagagcgagcctcatagcctgagctcagaggcgctgatgcggagggctgtgagcctggtcaccgattcgacctcgacttttctgtcacaaaccacctacgcgctcattgaagcaatcaccgaatacaccaaagctgtgtacactctcacctcgctttaccgccaatacacttccctgctgggaaagatgaattccgaggaggaggatgaggtctggcaggtgattatcggggcgagggcagagatgacttccaagcaccaagaatacctgaagctggagacgacgtggatgactgcagtgggactttccgaaatggcagccgaagcggcataccaaacgggagcagaccaagcatcgattaccgcgaggaatcatatccagcttgtgaaattgcaggtggaagaagtgcatcagttgtcccgaaaggccgaaaccaagctcgcagaagcccaaattgaagagctgagacagaaaactcaggaagagggagaagaacgtgcagaatcggaacaagaagcctacctgcgagaggac

SEQ ID NO: 32673 - DNA, 717 bp, Artificial Sequence
  Description of Artificial Sequence: Synthetic coding sequence
atggcagcacttaagtcctggctgtccagaagcgtcacctccttctttaggtaccgccaatgcctctgcgtgcccgtggtcgccaactttaagaagcggtgtttttcggaacttatccggccttggcataagactgtcactattggttttggggtgactctctgtgcagtgcctattgcccagaagtcagaaccgcactcactctcgtccgaggccctgatgagaagggcggtgagcctggtgaccgactccacctcaaccttcctgtcgcagacgacttatgccttgatcgaggcaatcactgagtacaccaaagcggtctataccctgacgagcctgtaccgacaatatacgtcgttgctggggaagatgaacagcgaagaggaggatgaagtctggcaagtgataatcggagcaagagcggaaatgacctcaaaacatcaagagtaccttaagctggaaaccacttggatgactgctgttggtctgtcggagatggccgccgaagcagcttaccaaaccggagcagaccaggctagcattacggcacgcaatcatattcagttggtgaagttgcaggtggaagaagttcatcaactgtcgaggaaggcggagactaaacttgcggaagcccagatagaagaacttcggcaaaaaacccaggaagaaggcgaggaacgcgcggagtcagaacaagaggcatatctgcgagaggat

SEQ ID NO: 32674 - DNA, 717 bp, Artificial Sequence
  Description of Artificial Sequence: Synthetic coding sequence
atggctgcactgaagtcctggctgtccagatctgttacatctttcttccgatatcggcagtgtctctgcgtgccagtggtagccaactttaagaaacgctgcttttcagaactgattcggccatggcataagaccgtgacaattggtttcggagtaacattgtgcgcagttcctatagcacagaagagtgaaccacattcactgagttccgaggcccttatgcgaagggccgtgtccctcgtgaccgactctactagtactttcctttctcagaccacctacgccttgattgaagccatcacggaatacacaaaggctgtttacacactgacttctctttatcgacagtacacctccttgctgggcaagatgaattcagaggaggaggacgaagtgtggcaagtgatcattggcgcgagagctgaaatgacctctaaacaccaagagtaccttaaactggagactacttggatgacagctgtggggctctctgagatggcagccgaggcggcctaccaaacgggcgcagaccaggctagtatcactgcaagaaatcatattcagctggtcaagctccaagtagaagaggtgcatcagctgtctcggaaggccgaaacgaagctggccgaggcccaaatagaggagcttagacagaaaacgcaagaggagggggaagaacgggccgaatccgaacaggaggcctatctgcgggaggat

SEQ ID NO: 32675 - DNA, 717 bp, Artificial Sequence
  Description of Artificial Sequence: Synthetic coding sequence
atggccgcgcttaagagctggctgagccggagcgtgacctcttttttccgctaccgccaatgcttgtgcgtccctgtggtagctaacttcaagaagcggtgcttttctgagctgatccggccgtggcacaagactgttaccatcggattcggggtaaccctctgtgcggtgccaatcgcccagaaatcagagccgcattcgttgtcgtcggaggcactcatgagaagagccgtgtcgctcgtcacggactcaaccagtactttcctttcacaaacgacttacgccctgattgaagccatcaccgaatacaccaaggctgtgtacaccctcacctccctgtaccggcagtacacttcactgctgggaaagatgaatagcgaggaagaggatgaagtgtggcaggtgattatcggggcaagggccgagatgacgagcaagcaccaggagtatctgaaactcgagactacttggatgaccgccgtgggactgtccgagatggcggcggaagctgcctaccagaccggcgcagaccaggcctcaatcaccgcccgcaaccatatccaactcgttaagctccaggtcgaagaggtgcaccaattgtcgcgcaaggcggagactaagctggcggaagcgcagatcgaagagttgcgccaaaaaactcaggaagaaggcgaggagcgagcagaatccgaacaagaagcatacctccgtgaagat

SEQ ID NO: 32676 - DNA, 717 bp, Artificial Sequence
  Description of Artificial Sequence: Synthetic coding sequence
atggcagcgctcaagtcgtggctgtcccgctcggttacttcgttcttccgctaccgccaatgtctctgcgtaccggtggtcgcgaacttcaagaagcgctgtttctcagagctgattaggccatggcacaaaactgtcaccatcggatttggagtgactctgtgcgccgtcccgattgcacaaaaatcagagccacatagcttgtcgtctgaggcgctgatgcgaagggccgtgtcgctcgtgaccgacagcacctcgacctttctttcacagacgacctacgcgctcatcgaggccatcactgaatatactaaggcagtatacaccctgaccagcttgtaccgccagtacacttcgctgctggggaagatgaattcagaggaagaagatgaagtgtggcaggtgatcatcggtgcccgcgcggaaatgacttcgaaacatcaagaatacctgaagttggagacgacctggatgaccgctgtcgggctgtctgagatggctgccgaagccgcctaccagaccggagccgaccaagcctcaatcaccgccagaaaccacattcagctcgtgaagctgcaggtggaagaagtgcaccaactgtcgcgcaaagcagaaactaagctggcagaagcacagatcgaggagctccggcaaaagactcaagaggagggagaagagcgcgcggagtcagaacaggaggcgtacctgcgggaggat

SEQ ID NO: 32677 - DNA, 717 bp, Artificial Sequence
  Description of Artificial Sequence: Synthetic coding sequence
atggcagcacttaaatcatggctgtcccggagcgtcacctcatttttcagatacaggcagtgcttgtgtgtgcccgtggtggcaaactttaagaagagatgtttttccgaacttattagaccatggcataagaccgtcactattggctttggagttactctttgtgccgtgccaatcgcccagaaatcagaaccacactccctttcaagcgaagctctgatgcggcgggccgtgtcgcttgtgactgactcgaccagcacttttctgtcgcagactacctacgcactcattgaggcaattaccgagtacactaaggcagtgtacaccctgacctcgctttaccgccaatacactagccttttgggtaaaatgaatagcgaggaagaagatgaagtctggcaagtgatcattggggcacgggctgagatgactagcaagcatcaggaatacctgaagctggaaactacctggatgaccgcagtgggactgtcagaaatggcagctgaagcagcataccagactggagccgatcaagcatctatcactgcacgaaaccacattcaactggtcaagctgcaagtcgaagaagtccatcagctctccaggaaggcagaaactaaactcgccgaagcacagatcgaagagcttcgacagaaaactcaggaggagggagaggaacgcgcggaatcagaacaggaggcatacttgagagaggac

SEQ ID NO: 32678 - DNA, 717 bp, Artificial Sequence
  Description of Artificial Sequence: Synthetic coding sequence
atggccgcgctgaagtcctggttgtccaggagcgttacttctttcttccgatacaggcagtgtctgtgcgtaccagtggtggccaattttaaaaagcgttgcttttcagagctgatccgtccctggcataagacagtgacaatagggttcggagttaccctctgtgccgtccccatcgcgcaaaaatccgagccacattctctctcttcagaggcccttatgagacgcgccgtgtccctggttacagattccacatccactttcctgagccagacgacttatgccctgattgaggcaatcacagaatacaccaaagcagtgtatactttgacaagtctctataggcagtacacttctctgctcggaaagatgaattctgaagaagaggacgaggtttggcaggtgattattggagctcgggctgagatgacaagcaagcatcaggagtatctgaaactggagactacctggatgacagctgttggactgtctgagatggcagccgaagcggcataccagaccggcgccgaccaggcttccataaccgcccggaaccacatacagcttgtgaagctccaggtcgaggaggtacatcagctttcgcgcaaggctgagacgaaactcgctgaggctcagattgaggagctgagacagaaaactcaggaggagggggaggaacgggccgagagcgagcaggaggcctacctgagagaggat

SEQ ID NO: 32679 - DNA, 717 bp, Artificial Sequence
  Description of Artificial Sequence: Synthetic coding sequence
atggccgcgcttaagtcttggctgagtcgatctgtcacgtcgtttttccggtacagacaatgcctctgtgtgcccgtggtcgctaactttaagaagagatgttttagcgaactgataagaccatggcataaaactgtgactatcggttttggagtgacgctgtgtgccgtgcctattgcccagaagagcgaaccgcattctctctcaagcgaggcactcatgcgtcgggcggtgagcttggtgactgattccaccagtaccttcctctcgcagacgacctacgcgctcatagaagcgattactgaatacacgaaggctgtttacactctgacttccctttataggcagtacacctcgcttcttggtaagatgaacagcgaagaagaggatgaagtgtggcaggtgattattggtgccagggcagaaatgacctcaaaacaccaggaataccttaaactcgagactacctggatgaccgcagtcgggctgtcagaaatggcagccgaagcggcctaccaaaccggagcagaccaggctagcatcactgcaaggaatcatattcaacttgtcaagctgcaagtcgaggaggtgcaccaattgtcacgcaaggcggaaaccaaacttgcagaagcacagatagaagagttgagacaaaagacccaagaagagggagaagaacgagccgaaagcgagcaggaggcatacctgcgggaggac

SEQ ID NO: 32680 - DNA, 717 bp, Artificial Sequence
  Description of Artificial Sequence: Synthetic coding sequence
atggccgcattgaaaagctggctgtccaggtcagtaacttccttcttccgctaccgccaatgcttatgcgtccccgtagtcgccaacttcaagaaaaggtgtttcagcgagctgattaggccttggcacaaaaccgtaacgatcgggttcggggtgaccctatgcgcagtcccaatagcccagaaaagcgaaccccattccctgtcctctgaagctcttatgcgcagagccgtttctctcgtcaccgattccacctcgacattcctgagtcagacgacatatgctctcatcgaggctataactgaatacacaaaggcggtgtacaccctaacatccctgtataggcagtacaccagcctactgggaaagatgaactccgaggaagaggatgaagtttggcaggtgatcattggcgctagggcggagatgacttccaagcaccaggaatacttgaaattggaaacaacctggatgacggccgtggggctgagcgagatggctgcagaggctgcataccagactggggctgaccaggccagtatcaccgctcgtaaccatatccagctcgttaagttacaggtagaggaggtgcatcagctcagccggaaagccgagactaagctggctgaggcacaaatcgaggagctcagacagaagacacaggaagagggagaagaaagagcggagtcagaacaggaggcctatcttagagaggac

SEQ ID NO: 32681 - DNA, 717 bp, Artificial Sequence
  Description of Artificial Sequence: Synthetic coding sequence
atggccgcactgaaatcctggttgtcgaggtccgtgacctccttcttcagatatcgccagtgcttgtgcgtcccagtggtcgccaactttaagaagcgctgtttctctgaactgattagaccctggcataaaacagtgaccatagggtttggggtgacactgtgcgcggtgccaatagcccagaagagtgagcctcacagtctgtcaagcgaagctctaatgcgacgggctgtctcattggtcaccgattccacatctaccttccttagtcagactacctacgctctcatcgaagctataacggagtataccaaagctgtttataccctaacatccctgtatcggcagtatacgtccctgttagggaaaatgaattcagaggaggaggacgaagtgtggcaggtgatcataggcgcacgagctgagatgaccagcaagcatcaggaatatctgaagctggagaccacatggatgactgctgtcggactgagtgagatggccgccgaagccgcctaccagaccggagcggatcaggcctccattactgctcggaatcacattcagctggtgaaactgcaggttgaggaggtacaccagctttcccgcaaggcggaaacgaagctggccgaggctcaaatcgaagagctccgacagaaaacccaggaagagggtgaggaacgagccgaaagcgaacaggaggcctaccttagggaggac

SEQ ID NO: 32682 - DNA, 717 bp, Artificial Sequence
  Description of Artificial Sequence: Synthetic coding sequence
atggccgctctcaaatcctggctgagccggtctgtgacatctttcttccgatacagacagtgcctctgcgtcccagtggtcgctaattttaagaaacggtgttttagcgagttgattaggccttggcacaagaccgtgaccattggatttggagtcacactctgcgcagttcctatcgcacagaagagcgaaccacactccctgagtagcgaagcactaatgcgaagggctgttagtctggttaccgattccacaagcacttttctaagccagactacctacgctctgatcgaagctatcacagagtacaccaaggccgtttatacactgacctcactatacaggcagtacacatccctgctagggaagatgaattccgaggaagaggatgaagtctggcaggtgataataggggctcgtgccgagatgacctcaaagcaccaggaataccttaagttggaaaccacatggatgaccgccgttgggctaagcgaaatggccgcagaagctgcttatcaaaccggggctgaccaggcttctataacagctcgcaatcatatccaattggtcaagttgcaggtggaagaggtgcatcagctcagtagaaaagctgaaaccaagctcgcagaggcccagatcgaagaactccgacaaaagacacaggaggagggggaagagagagctgaaagtgagcaggaggcttacctgagggaagac

SEQ ID NO: 32683 - DNA, 717 bp, Artificial Sequence
  Description of Artificial Sequence: Synthetic coding sequence
atggccgcgctgaaatcgtggctctcccggtccgtcacctccttcttccggtacagacagtgcctttgcgtgccggtggtggctaacttcaagaagagatgtttctccgagctcatccgtccgtggcacaaaactgtgaccatcggattcggagtgactctgtgtgctgtgccaatcgcacagaagagcgaaccgcactcactttcttcggaggcgttgatgcgccgcgccgtcagcctcgtgaccgactcaaccagcacctttctgtcacagaccacttacgcactcatcgaagccatcactgagtacaccaaggccgtgtacaccctgacttccctgtaccgccagtataccagcctgctgggaaagatgaactcagaagaagaagacgaagtctggcaggtgatcatcggagcccgcgccgagatgacttccaaacaccaagagtacctgaagctcgaaaccacctggatgacggcggtgggcctgtcagaaatggccgcggaggcggcctaccagactggagccgaccaagcgtcaatcactgcccgaaatcatatccaactggtgaagctgcaggtggaagaagtccatcaattgagcaggaaggcggaaactaagctggcggaggcgcaaatcgaggagttgcggcagaagactcaagaagaaggcgaagaacgcgccgagagcgaacaggaggcttacctccgggaagac

SEQ ID NO: 32684 - DNA, 717 bp, Artificial Sequence
  Description of Artificial Sequence: Synthetic coding sequence
atggcggcgctgaaaagctggctgagtagatctgtgacgagctttttccggtacaggcagtgtttgtgcgtgcccgtggtcgctaattttaaaaaaaggtgcttctctgagctaattaggccttggcacaaaaccgtgactatagggtttggcgtaaccctttgtgccgttccgatcgcccagaaatcagaaccacactctctgtccagcgaagccctcatgcgccgagcggtcagcttggtcacggattcaacaagcactttcttaagtcagaccacatatgccctaattgaggcaatcacagaatacaccaaagcggtgtatacactgacctccctatatcggcagtacacctccctgctgggaaaaatgaactccgaggaagaagatgaggtgtggcaggtcatcatcggcgctcgagctgagatgacatcaaagcatcaggagtatttgaagttggagaccacttggatgacggcagtgggactttctgagatggccgccgaggccgcttatcagacaggtgcggatcaagcatccatcaccgctaggaaccacatacaactggtaaaacttcaggtggaagaagtgcaccagctgtcaaggaaagctgagacaaagctggcagaagcccagattgaggagctcaggcagaaaacccaggaagaaggagaagaacgcgcagaaagtgagcaagaggcttatctccgggaagat

SEQ ID NO: 32685 - DNA, 717 bp, Artificial Sequence
  Description of Artificial Sequence: Synthetic coding sequence
atggcagccttgaagagctggctgtcgagaagcgtgactagcttctttaggtaccggcagtgcctgtgcgttccggtggtggcgaatttcaaaaagcgctgcttttccgaactgatccggccctggcataaaaccgttaccatcggcttcggagtcactctgtgtgcagtcccgattgctcagaagtcagaaccgcattcattgtcatccgaggcgctcatgcgccgggctgtctccctcgtcaccgacagcacttctacgttcctttcgcagactacgtacgcgctgatcgaagcgatcaccgaatacactaaagccgtgtacacgctgacctcgctgtacagacagtacacgtcactgctcggcaagatgaatagcgaagaggaggacgaagtctggcaggtgatcatcggtgcgagagcggagatgacctcgaaacatcaggagtatcttaagctggaaacgacttggatgacggcagtgggactctccgagatggccgcggaggccgcataccagactggggccgatcaggcgtcaattacggcgagaaatcacatccaacttgtgaagctgcaagtggaggaagtgcaccagctctcccggaaggccgagacgaagctcgctgaagcccagatcgaagaactgaggcaaaagacgcaggaagagggagaagagcgagcagaatcggaacaagaggcatacttgcgggaggat

SEQ ID NO: 32686 - DNA, 717 bp, Artificial Sequence; identical to SEQ ID NO: 32663
  Description of Artificial Sequence: Synthetic coding sequence

SEQ ID NO: 32687 - DNA, 717 bp, Artificial Sequence
  Description of Artificial Sequence: Synthetic coding sequence
atggcggcgctaaaatcgtggttatcgcgatcggtaacgtcgttttttcgatatcgacaatgtttatgtgtaccggttgtagcgaattttaaaaaacgttgtttttcggaattaatacgaccgtggcataaaacggttacgataggttttggtgttacgctatgtgcggttccgatagcgcaaaaatcggaaccgcattcgctatcgtcggaagcgctaatgcgtcgtgcggtttcgttagtaacggattcgacgtcgacgtttctatcgcaaacgacgtatgcgttaatagaagcgataacggaatatacgaaagcggtatatacgttaacgtcgttatatcgacaatatacgtcgttattaggtaaaatgaattcggaagaagaagatgaagtttggcaagtaataataggtgcgcgtgcggaaatgacgtcgaaacatcaagaatatttaaaattagaaacgacgtggatgacggcggttggtctatcggaaatggcggcggaagcggcgtatcaaacgggtgcggatcaagcgtcgataacggcgcgaaatcatatacaactagtaaaactacaagttgaagaagtacatcaattatcgcgtaaagcggaaacgaaactagcggaagcgcaaatagaagaattacgtcaaaaaacgcaagaagaaggtgaagaacgagcggaatcggaacaagaagcgtatctacgagaagat

SEQ ID NO: 32688 - DNA, 717 bp, Artificial Sequence
  Description of Artificial Sequence: Synthetic coding sequence
atggcggcgttgaagagctggctttcaaggagcgtcacgtcattttttaggtaccgtcaatgcttatgcgtcccagttgttgctaactttaaaaagagatgcttttcagaactcatacgaccatggcacaaaacagtgacaatcggttttggagtaacactgtgtgctgtgccgatcgctcagaaatctgaaccgcattccctcagctcagaggctcttatgcgccgggcggtgtccttagtcaccgattcaacgtcgacattcctttcacagacgacttacgctctaatcgaggctatcacagaatatacaaaggcagtttataccctgacttctctttatcggcagtatacatctctcctgggcaaaatgaacagtgaagaggaggatgaagtctggcaggttataatcggtgctagggcggaaatgacgagcaagcatcaggaatacctgaaacttgagactacttggatgacagcggtcggtctctctgaaatggcagcagaagccgcctaccagactggtgccgaccaagcctcgattactgcacgtaatcatattcaattggttaaactgcaagtagaggaagttcatcagttatccaggaaagccgaaaccaaattggctgaggctcaaatagaggagcttagacaaaagacgcaggaggagggcgaagaaagagcagaatcagaacaagaggcatatctccgggaggac

SEQ ID NO: 32689 - DNA, 717 bp, Artificial Sequence
  Description of Artificial Sequence: Synthetic coding sequence
atggccgctctaaagagctggctcagtaggtccgtaacatccttttttcgatatcgacagtgcctctgcgtgcctgtggtcgccaacttcaaaaagcgatgctttagcgaactgattagaccttggcacaagacggtgacaatcggcttcggagtgactctgtgtgcagtccctatcgctcaaaaatcggaacctcattctctgtcctcagaagcgctgatgaggcgcgctgtatctctggtaacagactctacttccaccttcctcagtcagaccacatatgccctaattgaggccattacggagtacaccaaggcggtctatacattaacatccctgtataggcaatatacaagtttgctgggaaaaatgaattctgaggaggaggatgaagtgtggcaagtaatcatcggagcaagagcagagatgacatccaaacatcaggaatacctgaagctcgaaaccacatggatgaccgctgtgggactgtcggagatggctgcggaggccgcatatcaaaccggcgcagaccaggcctccattacagcgcgcaaccacattcagctggttaagctgcaagtggaggaggtgcatcaactctcccgcaaggctgagactaagcttgccgaggcgcagatcgaggaattgagacagaagacccaggaggagggggaggagagggcagagtctgaacaggaggcctacctgcgggaggat

SEQ ID NO: 32690 - DNA, 717 bp, Artificial Sequence
  Description of Artificial Sequence: Synthetic coding sequence
atggccgcgctgaagtcctggctctcccggtcggtgacttcctttttccgatatcgccagtgtctctgtgtgcctgtcgttgccaatttcaagaagcggtgcttctcggagcttatccggccttggcataagaccgtgactatcggttttggagtgaccctgtgcgccgtcccaatcgcccagaaatcagaaccgcatagcctgagctcggaggcgctcatgcgccgggcagtctcgctggtcactgatagcacgagcaccttcctgtcgcagaccacctatgctctgattgaagctatcaccgaatacaccaaagcagtgtatactctgacctcgctgtaccgacagtacacctccttgcttggaaagatgaactcggaagaggaggatgaagtctggcaggtcattatcggtgcacgtgcagagatgacgtcaaagcaccaggaatacctcaagctggagacgacgtggatgaccgccgtgggcctgagcgaaatggctgctgaagcggcataccagactggggctgatcaggcctcaatcaccgcccgcaatcacatccaacttgtgaagctccaagtggaagaagtccatcaactctctcgaaaggccgaaactaaattggccgaagcgcagattgaagaattgagacagaaaactcaagaggagggggaggaacgcgcagagtcggaacaagaagcatacctgagagaggac

SEQ ID NO: 32691 - DNA, 717 bp, Artificial Sequence
  Description of Artificial Sequence: Synthetic coding sequence
atggccgccctcaaatcttggctgtctcggagtgtaacatcgttcttccgataccggcaatgtttgtgcgtgccagtggttgccaacttcaaaaaacgctgtttcagcgaactcatcagaccgtggcacaagactgtgactatcggatttggcgtcacattatgtgcggtgcccatcgcccagaaatcagaaccccatagcttgagtagtgaagctctcatgcggcgtgcagtaagcctggttaccgactccacaagcacttttttaagccaaacgacctatgcccttattgaggccatcacggagtataccaaagccgtctataccctgaccagtctgtaccgtcaatacactagcctcttagggaaaatgaactcggaggaggaggatgaagtctggcaggtcatcatcggagcaagagccgagatgacgagcaaacaccaggaatatctgaaacttgagacaacttggatgactgctgtcgggctgtctgaaatggccgccgaggccgcgtatcagaccggcgccgatcaggcctctattaccgcccgcaatcacatccagctcgttaagctgcaggtggaggaggtacatcagttgtctagaaaggctgagacaaaattggcagaggcgcaaatcgaggagctgagacagaagacgcaggaggaaggagaggagagggcagagtccgagcaggaagcttatctgcgtgaggac

SEQ ID NO: 32692 - DNA, 717 bp, Artificial Sequence
  Description of Artificial Sequence: Synthetic coding sequence
atggctgctctgaaatcgtggctgtcccgttccgtgacttcattctttaggtaccgtcaatgcctgtgcgtccccgtggtggcaaatttcaagaagcgatgtttttccgaattgatccgaccctggcataaaactgtgaccatcgggtttggggtcactctttgtgcggtcccaattgcacagaagtccgaacctcactcactctcgtccgaggcactgatgcgccgtgccgtgtcactggtcactgactcaacctcgactttcctgtcccagaccacctacgcattgattgaggcaattaccgaatacactaaggccgtctacacccttacgtcgctttaccgccagtacacctccctgctcggtaagatgaactcagaggaagaagatgaagtctggcaggtgattataggagcaagagcggaaatgacttcaaagcatcaagagtacttgaaattggaaaccacttggatgaccgcagtgggcctgtcggaaatggcagcagaagcagcctaccaaaccggggccgatcaggcatcgatcacggctcggaaccacatacagttggtgaagctgcaggtggaggaggtgcatcaactcagtagaaaagctgaaaccaagttggcggaggcacaaattgaagaacttcgacaaaagactcaggaggaaggtgaagagcgcgcagagagcgaacaggaagcctatctcagagaagat

SEQ ID NO: 32693 - DNA, 717 bp, Artificial Sequence
  Description of Artificial Sequence: Synthetic coding sequence
atggcggcgttaaagtcctggctctcgcgtagtgttacctcctttttccggtacaggcaatgcctctgcgtacctgttgtcgccaactttaagaagagatgcttctcggagcttatccgtccctggcacaagacagtgaccattggtttcggtgttaccctgtgtgctgtgccaatcgcccagaagtcggagccccactccctttcatcggaggctctgatgcgccgcgctgtttctctcgttaccgatagcacttctacgttcctgtcacagacaacatatgctctgatcgaggcgatcaccgaatacactaaggctgtctacactctcacctccttgtatcgtcagtacaccagtctactgggtaagatgaactccgaggaagaggacgaagtgtggcaggttatcattggtgcccgggctgagatgacctccaagcaccaggagtacctgaaactcgagactacctggatgaccgcggtcggtctcagcgagatggccgccgaggcggcgtatcaaaccggtgcagatcaggcatctatcactgcgcgcaaccatatccagcttgtcaagctccaggtggaggaggtgcatcagctgtcccgaaaggcagagaccaaactggctgaggcccagatcgaggaactccggcagaagactcaagaggagggcgaggaaagggctgagtccgagcaggaagcctatcttcgggaggac

SEQ ID NO: 32694 - DNA, 717 bp, Artificial Sequence
  Description of Artificial Sequence: Synthetic coding sequence
atggcggcccttaagagctggctctcccggtcagtcacttcctttttcaggtacagacaatgcctttgtgtcccagtggtggcgaactttaagaaaagatgcttctccgaactcatccggccttggcataagaccgtgaccatcggcttcggtgtgaccctctgcgcggttcctatcgcgcagaaatcggagccgcactcactgtccagcgaagcattgatgcgccgcgcagttagcctcgtgactgactcaacgagcactttcctgtcgcaaactacctacgccctgatcgaggctattacggagtacaccaaggccgtgtacactcttacctcactttaccgacagtacacctccctgctgggtaaaatgaatagcgaggaggaggacgaagtgtggcaggtgatcatcggagcgcgcgcagagatgacctcgaaacaccaggagtaccttaaactggaaaccacctggatgactgccgtcggcctgtcggagatggccgccgaggctgcttaccagactggtgccgaccaggcaagcattactgccagaaatcacatccagctggtcaagctccaagtggaagaagtgcatcaactcagccgcaaggctgaaactaaactggctgaagcgcagatcgaggaactgcgccagaaaacccaggaggaaggagaggagcgagccgagagcgagcaagaggcctacctcagggaagat

SEQ ID NO: 32695 - DNA, 717 bp, Artificial Sequence
  Description of Artificial Sequence: Synthetic coding sequence
atggctgcactgaagtcatggcttagccgatctgttaccagcttcttccgatatcggcaatgcctttgcgtgccagtggtggccaacttcaagaaaaggtgtttttctgaactcattcggccttggcacaaaacagtcacaatcgggttcggtgtcacactgtgtgctgttccaattgcacaaaaatccgaaccgcactccctgagttcagaggccctcatgcgccgcgccgtcagcctcgtaacagattcaactagtacgtttctcagccagacaacttatgcactgattgaggcaattactgaatacacaaaggcagtctacaccctgacctccctctacaggcagtacacttcattgcttggcaagatgaacagtgaggaggaagatgaggtgtggcaggttattataggtgcaagggccgagatgacatctaagcatcaggagtacttgaagcttgagacgacctggatgaccgccgtgggactgagtgagatggccgcagaagctgcttaccagacaggcgccgatcaggcctccataactgctcgcaatcacatccagctggtcaagctccaggtcgaggaggtgcaccagctgtctcgcaaggctgagaccaagcttgcggaagcccagatcgaagaactgcggcagaaaactcaggaggagggagaagagcgggcagaatcagagcaggaggcttacctgagggaagac

SEQ ID NO: 32696 - DNA, 717 bp, Artificial Sequence
  Description of Artificial Sequence: Synthetic coding sequence
atggccgcgctgaagtcatggcttagccgcagcgtgacctcgttttttcggtacaggcagtgtctgtgcgttcctgtggtcgccaatttcaaaaagaggtgcttttccgaattgataaggccgtggcataagaccgtgactattggttttggtgttaccctctgtgccgtgccaatcgcacagaagtcggagcctcattccctgtcatcagaagcacttatgagaagagcagtttcccttgtgaccgactcaacttccaccttcctgtcccagaccacctacgctcttattgaagccattaccgaatacactaaggcagtctacacgctgacctcgctctaccgtcaatataccagccttctgggcaagatgaactcggaagaggaagatgaagtctggcaagtgataattggcgcaagagccgaaatgacctccaagcatcaagagtacttgaagttggagactacctggatgactgcagtcggtctttccgagatggccgcagaggcagcataccagaccggagcagatcaggcaagcatcaccgcgaggaaccacatccaactggtgaaacttcaggtggaggaagtgcaccaactgtcgagaaaggcagaaactaagctggccgaagcgcaaattgaagaactgcggcaaaagactcaagaggaaggggaggagagggccgaatcagaacaagaggcgtacctgcgggaagat

SEQ ID NO: 32697 - DNA, 717 bp, Artificial Sequence
  Description of Artificial Sequence: Synthetic coding sequence
atggctgccctgaaatcatggctgtcccgcagcgtgacctccttttttcgctacagacagtgcctgtgtgtccctgtggtggccaatttcaagaaaagatgcttttcggagcttatccgcccctggcataagactgtcaccataggctttggtgtgactctgtgtgccgtccctattgcacagaaatcggaaccacactctttgagctcggaagcgctcatgcgtagggctgtgtcgcttgtcaccgactcaacttccacctttttgtcacagactacttacgccttgatcgaagccatcaccgagtacaccaaggccgtctacaccctgacctcactctaccgccagtacactagcctgctgggaaaaatgaacagtgaggaagaggacgaagtctggcaagtgattattggagccagagcggaaatgacctcaaaacatcaggaataccttaagttggagacgacctggatgactgccgtggggctgtccgaaatggcagcagaagcagcttatcagaccggagcggatcaggcatcaatcactgcaagaaaccacattcaactcgtcaagctgcaagtggaagaggtgcatcagctgtcgcgcaaagccgagactaagctggcagaggcacaaatcgaggaactccgccaaaaaacccaagaagaaggtgaagaacgggcagaatcagagcaagaagcctacctgagagaagat

SEQ ID NO: 32698 - DNA, 717 bp, Artificial Sequence
  Description of Artificial Sequence: Synthetic coding sequence
atggccgctttgaagtcttggctcagccggtctgtaacctctttctttcgttaccgtcaatgcctgtgtgttcctgtggttgcgaattttaaaaagaggtgttttagcgaactcataaggccatggcataaaactgtcactataggttttggtgtgaccctgtgcgcagtgcccatcgcgcaaaagtctgagccccactccctttctagcgaggctttaatgcgaagagccgtttcgctggtgaccgacagtactagtacttttctctcccaaactacttacgcactgattgaagctatcactgagtacactaaagccgtatatacgttgactagcttatacagacagtacacatcactactgggtaagatgaattcagaagaagaggacgaggtctggcaggtcattataggcgctagagcggagatgacctccaaacaccaggagtacctgaagctcgaaaccacatggatgacagcagtcgggttatcagagatggccgcggaggcagcctatcagaccggcgcagatcaagccagcataaccgccagaaaccatatccaattggtgaaactgcaagtggaagaagtgcatcagctttctcgcaaggcggagactaagcttgccgaagcccagattgaagaactaaggcagaagacccaggaagagggcgaagaaagagccgagtccgaacaggaggcctacctcagggaggat

SEQ ID NO: 32699 - DNA, 717 bp, Artificial Sequence
  Description of Artificial Sequence: Synthetic coding sequence
atggcagccctgaaatcatggcttagcagatcggttacctccttcttccggtaccgtcagtgtctgtgtgtgccagtggtcgcgaacttcaagaagagatgtttcagcgagttgatccgtccctggcataaaactgtcaccatcggatttggtgtgaccctttgtgcagtgcctatcgcacagaagtcggagccgcactcgctctcgtcggaagccctgatgcgaagagccgtgtcccttgtgactgactcgacttcgaccttcctctcgcaaaccacctacgcgctgattgaggcgatcactgaatacaccaaggccgtctacactctcacctccctgtaccggcaatacacttcgctcctgggcaagatgaatagcgaagaagaggacgaggtgtggcaagtgattattggggcacgggctgagatgacctccaagcaccaagagtatctgaagttggagacgacctggatgactgcagtcggtcttagtgagatggcagccgaggcagcctaccaaactggtgcggatcaggcatctatcacggcccggaatcatattcagctggtgaagttgcaggttgaagaagtgcatcaactttcaaggaaggccgaaaccaaactggcagaagcgcagatcgaggagcttagacagaaaacccaggaagaaggtgaggaaagagcagagagcgaacaagaagcatacctcagggaggat

SEQ ID NO: 32700 - DNA, 717 bp, Artificial Sequence
  Description of Artificial Sequence: Synthetic coding sequence
atggcggccctgaaatcatggctctctcggtccgtcacctctttcttccggtacaggcagtgcctttgcgtcccggttgtagcgaacttcaagaagaggtgtttttcggagttgatcagaccatggcacaaaaccgtgacgatcggatttggcgtcaccttgtgcgccgtcccaatcgcccagaagtcggagccgcacagcctgtcgtcagaggcactgatgcgcagagcagtcagtttggtgaccgattccactagcaccttcctgtcgcagactacttacgctcttatcgaggccatcactgagtacaccaaggcagtgtacaccctgactagtctgtatagacaatatacttcactgcttggaaagatgaactccgaagaagaggacgaagtgtggcaggtgatcatcggggcgagagccgaaatgacctctaagcatcaggagtaccttaaactggaaaccacttggatgactgcagtcggactcagcgaaatggcggccgaggctgcataccaaacgggtgcagatcaggctagtattactgcccgaaatcacattcaactcgtgaagctgcaagtcgaagaagtgcatcaactctcgcgcaaggccgagacgaaactggcggaggcgcagatcgaagaactgcgtcaaaagacccaggaagagggagaggaacgggccgaatcagaacaagaagcctacctgcgggaggac

SEQ ID NO: 32701 - DNA, 717 bp, Artificial Sequence
  Description of Artificial Sequence: Synthetic coding sequence
atggctgcactgaagtcttggcttagccgcagtgtcactagcttcttcaggtataggcagtgtctgtgcgtgccagtggtagcaaatttcaaaaaaagatgtttttccgagctaatacggccctggcataagacggtgacgatcgggttcggagtcaccctatgtgcagttcccatagctcagaaaagcgaaccccactcgttgtcgtccgaagcattgatgcgcagagccgtttctctggtaacagacagcactagtacgtttctcagccagacaacctatgccctcatcgaggccataaccgagtacacaaaggcagtgtataccttgacaagcttgtatcgacagtatacctctctgctaggcaagatgaactcggaagaggaggacgaggtgtggcaagttatcattggcgcacgcgccgaaatgactagcaagcaccaggaatacctcaagctcgaaacgacttggatgaccgccgttggcctgtcagagatggctgccgaagcagcttaccagacaggggctgatcaagcatctatcaccgcccggaaccacattcagctcgtaaagttgcaggttgaggaggtgcaccagctctctcgcaaggccgagacaaaactcgccgaagcccagattgaagagctgagacagaaaactcaggaggaaggcgaagagcgcgctgaaagcgaacaagaggcctacctcagggaagac

SEQ ID NO: 32702 - DNA, 582 bp, Artificial Sequence
  Description of Artificial Sequence: Synthetic coding sequence
atgcacaagtggatcctcacatggattctgccaacactgctctatcgatcttgtttccacatcatctgcttagtaggcacgatttctctggcctgtaatgatatgacccccgagcagatggcgacgaatgtgaactgttcttccccagaacgccacactcggagctatgattacatggaaggaggggatatacgagtccgcaggcttttctgtcggacccagtggtatctgcgtatcgacaaacggggcaaggttaagggaacccaggagatgaagaacaactataatataatggaaatccgaactgtggcggttggcattgtggccattaaaggtgtagaatctgaattttatctggctatgaacaaagaggggaaactgtatgcgaaaaaggaatgtaatgaagattgtaattttaaggagcttattctcgaaaaccactataatacttatgcaagcgctaagtggactcacaacggaggagagatgttcgtagcattaaatcagaagggcatacccgtgagggggaaaaagacaaagaaggaacagaagactgcacattttctccccatggctataaca

SEQ ID NO: 32703 - DNA, 582 bp, Artificial Sequence
  Description of Artificial Sequence: Synthetic coding sequence
atgcacaagtggatcttgacctggatcctgcccactctgctctaccgctcatgtttccacatcatatgccttgtgggtaccatctcactggcctgcaatgatatgactcccgaacaaatggctactaatgtcaactgcagctcgccagaaaggcataccaggagctacgactacatggaaggaggggatattagagtgcgccggctcttctgtagaacccagtggtaccttcgcattgataagcgtggaaaagtcaagggcacccaggagatgaaaaacaactacaatatcatggaaattcgcaccgtggctgtgggaatcgtcgcaatcaaaggagtggagtcagagttctacctcgcgatgaacaaggagggtaagctgtacgccaagaaggaatgcaatgaggactgtaacttcaaggagttgatcttggaaaatcactacaacacttatgcaagcgccaagtggactcataatggtggagagatgtttgtggcacttaaccagaaggggatccctgtgcggggaaagaaaactaagaaagaacaaaagactgctcacttcctgccaatggctattact

SEQ ID NO: 32704 - DNA, 582 bp, Artificial Sequence
  Description of Artificial Sequence: Synthetic coding sequence
atgcacaagtggatattgacttggattcttccaacacttctgtacagatcctgctttcacattatttgcctcgttggcaccatttctcttgcctgcaatgatatgacacccgagcagatggccactaacgtgaattgttcatctccagaacgacataccagatcttacgactacatggaaggaggcgacatccgtgttcgacgcttgttttgtcgtacacaatggtaccttagaatagataagcgtggcaaggtcaagggcacacaggaaatgaagaacaattacaatatcatggagatccgaaccgtggcggtcggaattgtggccatcaaaggagttgaaagcgaattttaccttgccatgaacaaagaggggaagctgtacgccaagaaggagtgtaatgaagactgcaacttcaaagaactcattctggaaaaccactataatacatacgcctctgcgaagtggactcataacggtggcgagatgtttgttgcattaaatcagaaaggcattccagtgaggggcaaaaaaaccaagaaggaacagaaaacagcgcactttctgcccatggctattacg

SEQ ID NO: 32705 - DNA, 582 bp, Artificial Sequence
  Description of Artificial Sequence: Synthetic coding sequence
atgcacaagtggatcctgacctggatccttccaaccctgctctacagatcgtgctttcatatcatctgcctggtcggaactatttccctggcctgcaacgacatgacgccagaacagatggcaactaatgtcaactgctcgtcgccggaacgtcacacccggtcatacgattacatggaaggaggtgatatccgcgtccggcgcctgttttgcagaactcagtggtacctccggatcgataagcggggaaaggtgaaaggcacgcaggaaatgaagaacaactacaacatcatggaaatccggactgtggcggtgggtatcgtggccatcaagggagtggagtccgaattctacctggcaatgaacaaggaaggcaagctgtacgccaagaaggaatgcaacgaagattgtaacttcaaggagctgatccttgagaaccactacaacacctacgcgtccgcaaaatggacccacaacgggggtgagatgttcgtcgccctgaatcagaagggaattccggtgcggggcaagaaaaccaagaaggaacaaaagactgctcacttcctcccgatggccatcacg

SEQ ID NO: 32706 - DNA, 582 bp, Artificial Sequence
  Description of Artificial Sequence: Synthetic coding sequence
atgcataaatggattttaacatggattcttcccacactcctgtatcggagttgcttccacattatctgcctcgtgggtacgataagccttgcatgcaacgacatgacacccgaacagatggctacaaacgtgaactgctccagtcccgagcgccatacacgtagctacgattatatggaaggaggcgatatacgcgttaggagattgttttgtagaacacagtggtacttacgcatcgacaagaggggaaaggtaaaaggaacacaggagatgaaaaacaattataacatcatggagattcggaccgtggcagtcggtatagtggctataaagggcgtggagtccgagttttatttggcaatgaataaagagggcaaattgtacgccaagaaggaatgcaacgaagactgtaattttaaggagctaattctcgagaatcattataatacatacgctagcgcaaagtggacacataacggaggagaaatgttcgtggcactaaaccagaaagggattcctgtccgcggcaaaaaaactaaaaaagaacagaagaccgcacattttctccccatggcaattact

SEQ ID NO: 32707 - DNA, 582 bp, Artificial Sequence
  Description of Artificial Sequence: Synthetic coding sequence
atgcacaagtggatcctgacatggatacttccgactctgctgtaccggagctgcttccacattatctgcctggttgggaccatctccttggcctgcaatgatatgacacctgaacaaatggccacgaatgttaactgcagttccccagagcgccatactcgcagttatgactacatggagggtggagatatccgggtgagaagactattttgccgcacccaatggtatctgcgcatcgacaagcgtggcaaggtgaaaggcactcaagaaatgaagaacaattacaacatcatggagattcgtactgttgccgtgggtatcgttgcgattaaaggcgtcgaatccgagttttatcttgcaatgaataaggaaggtaagctctatgccaagaaggagtgcaatgaagactgcaatttcaaagagctaatcctcgaaaaccattacaatacctacgctagcgccaaatggactcataatgggggggagatgttcgtagccctcaaccagaaaggtatccctgtaagaggaaagaaaaccaaaaaggaacagaaaactgcacactttctccccatggccatcacc

SEQ ID NO: 32708 - DNA, 582 bp, Artificial Sequence
  Description of Artificial Sequence: Synthetic coding sequence
atgcataagtggatacttacatggattctgcccacactcctgtaccgaagctgcttccatataatttgtctggttggaaccatttcactcgcctgcaatgacatgacacctgaacagatggctacaaatgtgaattgcagcagcccggaaaggcatacccgttcttacgactacatggaaggcggagacattagggtgcgtcggcttttctgccgaacgcaatggtacctccggatcgacaaaagagggaaagtaaaaggaacacaggaaatgaaaaacaactacaatattatggaaatccgcacagttgccgtcggcatagttgcgataaagggcgtggagagcgaattctacttggctatgaacaaagaggggaaactgtacgctaagaaagagtgtaacgaggattgcaattttaaggagttgatcctcgagaatcactacaacacatatgccagcgcaaagtggacacacaacggcggcgagatgtttgtcgctcttaaccaaaagggcattccggtccgcgggaaaaagaccaagaaggaacagaagaccgcccattttctccctatggccataacc

SEQ ID NO: 32709 - DNA, 582 bp, Artificial Sequence
  Description of Artificial Sequence: Synthetic coding sequence
atgcacaagtggatattaacgtggattttgccaacactgttatatcgttcctgttttcacataatttgcctcgtaggtacaatttctctagcctgcaatgacatgaccccagagcagatggctacaaatgtgaattgctcatctccagaaagacatacccgtagctatgactacatggagggcggcgatatacgcgtaaggcggctgttttgtcgcacacagtggtacctcagaatcgacaagaggggaaaggtgaagggaacacaggaaatgaaaaataactacaacataatggaaattcgcaccgtcgctgttggtatcgtggctataaaaggagtggaaagcgagttttacctcgcaatgaataaagaggggaagctgtatgctaaaaaggagtgcaacgaggattgcaacttcaaggaactgattctggagaaccattataacacgtatgcgagcgcgaaatggacacacaatggcggagagatgttcgtagccttgaaccagaagggcatcccagtgcgcggtaaaaaaacgaagaaagagcagaaaacagcgcacttcctgccaatggctattaca

SEQ ID NO: 32710 - DNA, 582 bp, Artificial Sequence
  Description of Artificial Sequence: Synthetic coding sequence
atgcacaaatggatcctgacatggattctgccaacccttttgtatcgcagttgtttccatattatctgtttggtgggaactatcagtctggcctgtaacgacatgacacctgagcagatggccacaaacgtgaactgttcctcgccagaacgtcacacacgttcctacgactacatggagggcggtgatattcgcgtgaggcgcctgttttgcagaactcagtggtaccttcggatcgacaaacgcggaaaggtgaaggggacccaggagatgaagaataactacaacattatggaaattcgcactgtcgccgtcgggattgtcgcaatcaaaggagtggagtccgaattttaccttgcgatgaacaaagaaggcaaattatatgcaaaaaaagagtgtaatgaagactgcaactttaaagagcttattctggaaaaccactacaacacctacgcatctgcaaaatggacccacaatggcggcgagatgtttgtggcactcaatcagaaaggaatacccgtgagaggcaaaaaaactaaaaaggagcaaaagacagcacacttcctgccaatggccattacc

SEQ ID NO: 32711 - DNA, 582 bp, Artificial Sequence
  Description of Artificial Sequence: Synthetic coding sequence
atgcataaatggatactcacatggatcttacccaccctcctgtataggtcctgctttcatatcatatgtctggttggcaccatatcattggcctgcaatgatatgacgcccgagcagatggccactaacgttaactgcagttcaccggagcggcatacacgatcctacgactacatggagggtggcgacattcgcgtcaggcgactcttctgcagaacccagtggtatctgcgcatagacaagcggggaaaggttaagggaacccaggagatgaaaaataactataatattatggaaataagaaccgttgcagtcggcattgtagcaattaaaggcgtggaaagcgaattttacttagccatgaataaggaggggaaactgtacgccaaaaaggagtgcaacgaggattgtaactttaaagagctgattctagagaatcactacaatacatacgcaagtgcgaagtggacgcataacggcggcgagatgtttgtggcgttgaaccagaaaggtatcccagtgcggggtaaaaagactaaaaaggaacagaaaacagcacacttccttcctatggcaattact

SEQ ID NO: 32712 - DNA, 582 bp, Artificial Sequence
  Description of Artificial Sequence: Synthetic coding sequence
atgcataagtggatcttgacttggatattgcccacactgttgtatagatcttgctttcacatcatttgtctggttgggactatttcactcgcttgtaatgatatgaccccggagcagatggcaactaatgtgaactgttcttcgccagagcgacacacgcggagctacgattacatggaaggtggagacattcgtgtgaggcgcctgttctgtcggacccaatggtatcttagaattgacaaacgcgggaaggtgaagggaacgcaggaaatgaagaataactacaacatcatggaaatccggacggttgccgtgggcatcgtagccattaagggagtcgagtcagaattttacctggccatgaacaaggaaggcaaactctatgctaaaaaggaatgtaacgaggactgtaactttaaagagctcatcctggagaaccattacaatacctatgccagcgctaagtggacccacaacgggggggagatgttcgtggcccttaatcagaaagggatcccagtgcgaggtaagaagaccaaaaaggaacagaagactgcccacttcctcccaatggcaatcacg

SEQ ID NO: 32713 - DNA, 582 bp, Artificial Sequence
  Description of Artificial Sequence: Synthetic coding sequence
atgcacaagtggatcctcacctggatactgccgacactgctgtatcggtcgtgctttcatataatctgcctggtgggcacgatttcgttagcatgcaacgatatgaccccagagcagatggccaccaacgtaaactgctcaagcccggagaggcacactaggtcttacgattacatggagggcggtgacatccgggttcgacgcttgttctgccgtacccaatggtacctaagaatcgataaacgcggcaaggtgaagggtacccaagaaatgaagaacaattataatatcatggagattcgtacagtggctgtgggaatcgtggccattaagggggtggaatccgaattttacctggcgatgaacaaagaaggtaaattgtacgccaagaaagaatgcaacgaggactgcaatttcaaggagttgattctggagaatcactacaatacgtatgcaagtgcgaagtggactcacaacggaggcgaaatgttcgtggcacttaaccagaagggcatacctgtgcgagggaagaagacaaaaaaggagcagaagacagcgcatttcctgccgatggccataacg

SEQ ID NO: 32714 - DNA, 582 bp, Artificial Sequence
  Description of Artificial Sequence: Synthetic coding sequence
atgcacaagtggatcctaacctggattttacccactctcttgtatagatcatgcttccatattatttgtctggtgggtaccatctcgctagcttgtaacgatatgacacccgagcaaatggctacgaacgtaaactgtagttctcccgaacgccacacacgctcctacgattatatggagggcggcgatattagggtgaggaggctcttctgccggactcagtggtatctgaggatcgacaaacgcggaaaggtaaagggaactcaggaaatgaaaaacaattacaatatcatggaaatccgaactgtggccgttggcattgtggccattaagggagtggagtccgagttctacctggctatgaacaaggaagggaaactgtatgccaagaaagagtgcaacgaagactgcaactttaaggagctcattcttgagaaccactataacacatacgcatcagccaaatggactcataatgggggcgaaatgttcgtagccctcaaccaaaaggggatccccgttagaggaaagaaaaccaaaaaggagcagaagacagctcacttcttgcccatggctattaca

SEQ ID NO: 32715 - DNA, 582 bp, Artificial Sequence
  Description of Artificial Sequence: Synthetic coding sequence
atgcacaagtggatccttacctggatactgcctactcttctgtacaggtcgtgctttcacatcatttgccttgtcggaaccattagcctcgcgtgtaatgacatgaccccagagcagatggcaactaacgtcaactgtagctcccccgaaagacatactaggtcctatgattacatggaaggaggagacattcgagtcagacgacttttctgtcgaacccaatggtacctcagaatcgataaaagaggcaaggtgaagggaacgcaagagatgaagaacaattacaacataatggagattcgcaccgtggcagtggggatcgtggccataaagggtgtcgaatcggaattctacttggcaatgaacaaggaaggaaagctgtacgcaaaaaaggaatgtaatgaagattgtaactttaaggagcttattcttgaaaaccattacaatacgtacgcctccgccaaatggacccataacggaggtgagatgttcgtggcactcaaccaaaagggaattccagtgagaggtaagaaaactaagaaagaacaaaagactgcccactttcttcctatggccattacc

SEQ ID NO: 32716 - DNA, 582 bp, Artificial Sequence
  Description of Artificial Sequence: Synthetic coding sequence
atgcataaatggatccttacttggatcttgcctaccctgctgtaccgatcgtgttttcatatcatctgcttggttggtaccatctccttggcatgtaacgatatgactccagaacaaatggccactaatgtgaattgcagctcacccgaacgccacactagatcctacgattacatggagggaggggatattagagtgcggcgtttgttttgcagaactcagtggtacctgcgaatcgataaacggggtaaggtgaagggaacccaagagatgaagaacaattacaacattatggaaattcggactgtcgcagtgggcattgtggccattaaaggggtcgaatcggaattctaccttgcaatgaacaaggagggcaaactgtacgccaagaaggaatgtaatgaagattgtaactttaaagaactcatactggaaaaccactacaatacctacgcatcggcgaaatggacgcacaatggtggagagatgttcgtggcgcttaatcaaaagggtattccagttcgaggaaagaaaactaagaaagaacaaaagaccgcacattttcttccaatggcaataacc

SEQ ID NO: 32717 - DNA, 582 bp, Artificial Sequence
  Description of Artificial Sequence: Synthetic coding sequence
atgcacaaatggatcctcacctggattcttcccactctcctatataggtcgtgttttcatatcatctgcctggtcggtaccatcagtctggcttgtaatgatatgactccagaacagatggctacaaatgtgaactgttcgtctccagagcgccacacacggtcctacgattacatggagggcggtgatatcagagtcagacggcttttctgcagaacgcagtggtaccttaggatagacaagcgcggaaaagttaaaggcacacaagagatgaaaaacaattataatataatggagattcggactgtcgccgtaggcatcgtagcaatcaagggcgtggaatcagagttctacctggccatgaataaggagggtaaactctatgctaagaaagagtgcaacgaagactgcaactttaaggagctgatccttgagaaccattacaacacctatgcttctgccaagtggacacataatgggggggagatgtttgtcgccctcaaccagaaaggcatacctgtcaggggaaaaaagactaaaaaggagcagaagacagcacacttcctgccaatggcaatcact

SEQ ID NO: 32718 - DNA, 582 bp, Artificial Sequence
  Description of Artificial Sequence: Synthetic coding sequence
atgcataagtggatactgacttggattcttcctaccctgttgtaccgatcgtgtttccatatcatctgccttgtcggtaccatctccctggcatgtaatgatatgactccagagcaaatggccaccaacgtgaactgttcgtctccagagagacataccagatcatacgattacatggaaggcggtgacattcgtgtcagaaggctgttttgcaggacccagtggtaccttagaatcgataagagggggaaggtgaagggcactcaagagatgaagaacaactacaatatcatggaaattagaactgtggcggtgggcatcgtcgcaattaagggcgtggaatcggagttttaccttgcaatgaataaggaaggaaagctctacgccaagaaggaatgcaacgaagattgcaactttaaagaactgattcttgaaaaccattacaatacgtacgcctcggccaaatggacccacaatgggggagaaatgtttgtggccctcaatcagaaaggcatccccgtccgggggaagaaaactaagaaggaacaaaaaacggcacactttcttccaatggcaatcact

SEQ ID NO: 32719 - DNA, 582 bp, Artificial Sequence
  Description of Artificial Sequence: Synthetic coding sequence
atgcataagtggatcctcacttggatattgccgaccctgctttatcggtcgtgttttcatataatctgcctcgtcggtacgatcagccttgcttgtaacgatatgacccctgaacagatggcgacaaacgtaaactgctcctcacccgaaaggcacacacggtcatatgattatatggaaggtggggacatccgggtcaggagactcttctgcagaacacagtggtacctgaggatcgacaagaggggtaaggtgaaagggactcaggagatgaagaataactacaatatcatggagatcagaacagtcgctgttggaattgtcgcaattaaaggagtggagtctgagttttatctggctatgaataaagaaggcaagctgtacgccaagaaagaatgcaatgaggattgcaactttaaggagctgatcctagaaaaccattataatacttatgcttccgcaaagtggactcataatggtggagagatgttcgtggctcttaaccagaaggggattccagtcaggggcaagaagaccaagaaggagcaaaagacagcacactttctgcctatggcaattact

SEQ ID NO: 32720 - DNA, 582 bp, Artificial Sequence
  Description of Artificial Sequence: Synthetic coding sequence
atgcataaatggatcctgacctggatactgcccaccttgttatacaggagctgctttcacatcatctgcctggtgggcacaatttcacttgcctgcaatgatatgacaccagaacagatggcaacaaacgtgaattgcagcagtcccgagcggcacacaagatcgtacgactatatggaaggtggagacattagagtacgtcgcctgttctgtaggactcaatggtatctaaggatcgataagcgcggtaaagtaaagggcactcaggaaatgaagaacaattataacatcatggagatccggaccgtcgctgtcggcatcgtggcaattaaaggtgttgagagcgaattctacctggcaatgaacaaggaagggaaactctatgcaaagaaggagtgcaacgaggactgcaacttcaaagagctaatcctcgaaaaccactataacacctacgcgagcgccaagtggacccacaacggaggagaaatgttcgtcgctctgaatcagaagggcattcccgttagaggcaagaaaaccaaaaaggagcagaaaactgcacattttctgccaatggctatcaca

SEQ ID NO: 32721 - DNA, 582 bp, Artificial Sequence
  Description of Artificial Sequence: Synthetic coding sequence
atgcacaaatggatcctgacctggattctgcctaccctgctctatagatcgtgctttcatatcatctgtctggtggggaccattagcctcgcctgcaacgacatgacccctgagcagatggccaccaacgttaactgctcgagccccgaacgccacactcgcagctacgactacatggagggaggagatatccgggtgagacggctcttctgccggacccagtggtacctcagaatcgacaagagaggaaaggtcaagggaactcaggagatgaagaacaactacaatatcatggagatccgcaccgtggccgtcggaatcgtggccatcaagggagtagaatccgagttctacctcgccatgaacaaggagggtaagctgtacgccaaaaaggaatgcaatgaagattgtaatttcaaggaattgattcttgaaaatcactacaacacctatgcatcggctaagtggactcacaacggcggagaaatgtttgtggcgctcaaccaaaagggaatcccggtgagaggtaagaaaactaagaaagaacaaaaaaccgctcatttcctgccaatggctatcacc

SEQ ID NO: 32722 - DNA, 582 bp, Artificial Sequence
  Description of Artificial Sequence: Synthetic coding sequence
atgcacaagtggatcctgacctggattctgcccaccctcctctacaggtcttgtttccatattatctgccttgttgggaccatctccctggcctgtaatgatatgaccccagaacaaatggctaccaacgttaactgcagttcccctgagaggcatacccggtcctacgactatatggagggaggtgatatcagggtccgccgcctcttctgcaggacccaatggtatctgagaatagataagagaggcaaggtgaaaggaacgcaggagatgaagaataattataatattatggaaattagaacagttgcagtcgggatcgtggctattaaaggcgttgaaagtgagttttaccttgcgatgaacaaggagggaaagctgtacgccaaaaaagagtgtaatgaagattgtaacttcaaagaactgattttggagaatcactataatacttatgcctccgcaaagtggacccacaatggaggggagatgttcgtggcccttaaccagaagggcatacccgtgagaggcaagaagacaaaaaaagagcagaagactgcccatttcctccccatggccatcact

SEQ ID NO: 32723 - DNA, 582 bp, Artificial Sequence
  Description of Artificial Sequence: Synthetic coding sequence
atgcataagtggattttaacttggattttaccaacacttttatatagatcatgttttcatataatatgtttggtaggaacaatttcattagcatgtaatgatatgacgccagaacaaatggctacaaatgttaattgtagttcaccagaaagacacacaagatcatatgattatatggaaggtggagatattagggttcgtagattgttttgtagaacacaatggtatttaagaattgataaaagaggaaaagttaaaggaacacaagaaatgaaaaacaattataatattatggaaattaggacagtggcagtaggaatcgttgctattaagggagttgaatcagaattttatcttgctatgaataaggaaggaaaactttacgcaaaaaaggaatgtaatgaagactgtaattttaaagaattaattttagaaaatcattataatacttatgctagtgcaaaatggacacacaatggaggagaaatgtttgttgctcttaatcaaaaaggaattccagttagaggtaaaaagacaaagaaagaacaaaaaactgcacatttccttcctatggctataaca

SEQ ID NO: 32724 - DNA, 582 bp, Artificial Sequence
  Description of Artificial Sequence: Synthetic coding sequence
atgcacaaatggattctcacgtggattctgcccactcttctgtatcgctcgtgtttccatatcatctgcttggttggaacgatcagtctcgcctgtaatgatatgaccccggaacagatggctactaatgttaattgttccagccccgagagacacactcgcagttatgactatatggagggtggtgacatacgagtgcggagactgttttgtaggactcagtggtaccttaggattgataaacgcgggaaggtaaagggtacccaggaaatgaagaacaattacaacatcatggagatcaggaccgtcgcagtcggcattgtcgcaattaagggggttgagtctgagttctatctggccatgaataaggaaggcaagctctatgccaagaaggagtgcaatgaagattgcaattttaaagaactaattttagagaatcattataatacctacgcctcagcaaagtggacacataacggcggagaaatgtttgtcgccctcaatcagaaagggatccccgtgcgcgggaagaaaaccaagaaagaacagaagacagctcactttttacccatggccatcaca

SEQ ID NO: 32725 - DNA, 582 bp, Artificial Sequence
  Description of Artificial Sequence: Synthetic coding sequence
atgcacaaatggatcctgacctggatcttgccaactctgctgtaccggagctgctttcacatcatctgtttagtgggcaccatcagtctcgcttgtaacgatatgacgccagaacagatggcgaccaatgttaattgtagcagcccagaacgccatacccgcagctatgactacatggagggtggcgacattagagttcgccggcttttttgtcgtacacagtggtatctgagaattgacaaacgaggtaaagtgaaaggtacccaagagatgaagaataattataacatcatggaaattcgcacggtcgctgtggggatcgttgcaattaagggcgtggagagtgagttttacctagcgatgaataaggagggtaaactatacgcaaagaaagaatgcaatgaagattgcaactttaaggagctgatcctggagaaccactacaatacttacgcctccgctaagtggacgcataatggtggcgaaatgttcgtcgccctgaaccaaaagggtatccctgtgcgtggtaagaagaccaagaaggaacagaagaccgctcatttcttgccaatggccattacg

SEQ ID NO: 32726 - DNA, 582 bp, Artificial Sequence
  Description of Artificial Sequence: Synthetic coding sequence
atgcataaatggatcttgacctggattctgcctaccctgctgtacaggtcctgttttcatatcatatgcctcgtcggcactatttcactggcatgcaacgacatgacccccgaacaaatggccactaatgttaactgttccagtccagaaagacatacgcgctcgtacgattacatggagggtggagacatcagagtgcgtagactcttttgtaggactcaatggtatctgcgtatcgataagcggggaaaagtcaaggggactcaagagatgaagaataactacaacattatggaaattcggactgtggctgtcgggatcgtggccataaaaggcgttgaaagcgaattctacttggccatgaacaaggaaggcaaactttacgcaaagaaggaatgtaacgaagattgcaacttcaaggaactgattcttgagaatcattacaacacctacgcgtcggcaaagtggacccacaatgggggagagatgtttgtagcactcaaccagaagggtataccagtcagagggaagaaaactaagaaggagcagaaaacggcacacttccttcctatggctatcacc

SEQ ID NO: 32727 - DNA, 582 bp, Artificial Sequence
  Description of Artificial Sequence: Synthetic coding sequence
atgcacaagtggatcttgacttggatcttacccaccctcttatatcgatcatgtttccatatcatttgtttggtaggtaccatctctttagcctgcaacgatatgactccggaacaaatggcaactaatgttaattgtagttctccagaacgccatactcgatcatacgactatatggaaggaggagacattcgtgtccgtcgattgttctgcaggactcaatggtacctcagaattgataaacgtggcaaagtcaaaggaacccaagaaatgaaaaataattacaatattatggaaatccgtaccgttgccgtcggtatagtggcaatcaagggcgtcgagtcggagttctacttggcaatgaacaaagagggaaaactttacgctaagaaggaatgtaacgaggattgcaattttaaagagttgattctcgagaatcattataacacatacgccagtgctaagtggacacacaatggaggggagatgttcgtagctcttaatcaaaaagggatccctgtgagaggtaagaagaccaaaaaggagcagaaaacagctcacttcctgccaatggctataacg

SEQ ID NO: 32728 - DNA, 582 bp, Artificial Sequence
  Description of Artificial Sequence: Synthetic coding sequence
atgcacaagtggatcctcacttggatcctgccgactctcctgtaccgctcttgcttccatatcatttgcctcgtgggcactatctcactggcttgcaatgacatgactccagaacagatggcaaccaacgtgaattgttcctcgccagagcggcacacgcgaagctacgactacatggaaggcggagacatccgggtgagacgcctgttctgcaggacccaatggtacttgcgcatcgataaaagaggaaaagtgaaaggcacgcaggagatgaagaacaactacaatatcatggagattcggactgtcgcagtgggtatcgtggccatcaagggtgtggagtcagagttctacctggcaatgaataaggaaggaaaactgtacgccaagaaggagtgcaatgaggattgtaacttcaaagaactgatcttggagaaccactataacacttacgcgtcagcaaagtggactcacaatgggggtgagatgttcgtggccctcaaccagaagggcatcccggtgcggggaaagaaaactaagaaggagcaaaaaaccgcacactttctgcctatggctattacc

SEQ ID NO: 32729 - DNA, 582 bp, Artificial Sequence
  Description of Artificial Sequence: Synthetic coding sequence
atgcataagtggatacttacttggatccttccgaccctgctttaccgtagctgtttccacataatctgtcttgtcggtaccatcagcctcgcttgtaacgatatgacccctgaacagatggcaactaacgtaaactgctcgagcccagaacgacataccagatcgtatgactacatggaaggtggcgatattcgggtgcggaggttgttttgcagaacgcagtggtacctcagaattgataagcgaggaaaggtgaagggaactcaagaaatgaaaaacaactacaacattatggaaatcagaaccgtggcggtgggaatcgtggctattaagggcgtggagtctgagttctacctggctatgaataaggaggggaaactctacgccaagaaagagtgtaatgaggactgtaactttaaggagctgattctggaaaaccattacaatacgtacgccagcgcgaaatggacccacaatggtggagaaatgtttgtcgccctgaaccaaaagggtatacctgtcagaggaaaaaagactaagaaagagcaaaaaactgcacattttctccccatggcaattacg

SEQ ID NO: 32730 - DNA, 582 bp, Artificial Sequence
  Description of Artificial Sequence: Synthetic coding sequence
atgcacaagtggatcctgacttggattctcccaaccttgttgtacaggtcttgtttccacatcatctgcttggtaggcaccatcagccttgcctgcaatgacatgaccccggagcagatggcgacgaacgtgaattgctccagcccggaacgccacacccggtcctacgactacatggagggcggagatatccgcgtgaggcgcctcttctgtagaacccagtggtacctgagaattgataagcgcggaaaggtcaaaggaacgcaagagatgaagaacaactacaacatcatggaaattcgcaccgtggccgttggtatagtcgctatcaagggagtggaatcagagttctatctggcgatgaacaaagagggaaaactgtatgccaaaaaagaatgcaacgaggactgcaactttaaggagctgatcttggagaaccattacaatacttacgcatccgcgaagtggactcacaacggcggtgaaatgttcgtggcactgaatcaaaagggtatccccgtgcggggaaagaaaacgaaaaaggaacagaaaactgcgcatttcctcccgatggctatcact

SEQ ID NO: 32731 - DNA, 582 bp, Artificial Sequence
  Description of Artificial Sequence: Synthetic coding sequence
atgcacaagtggatcctcacttggattctcccaacactcctttaccgtagctgtttccatatcatttgcctcgtgggcaccatttccctcgcttgcaacgacatgacccccgagcagatggccacgaacgtgaactgctcgtcgcctgagcggcacacccgaagctacgactacatggagggaggcgatatccgtgtccgccgcctcttctgccggacgcaatggtacttgcgcattgacaaacgtggaaaggtcaagggcactcaggaaatgaagaataactacaacatcatggaaatccgcactgtggctgtcggcatcgtggcaataaagggcgtcgaatcggagttctacctcgcgatgaacaaagaaggtaagctgtacgctaagaaagagtgcaatgaggattgcaacttcaaggagttgattctggagaaccattataacacttatgcctctgccaagtggacgcacaatggcggcgaaatgttcgtggcccttaatcaaaagggtattcctgtcaggggcaagaagaccaaaaaggagcagaagacggcccacttccttcccatggctatcact

SEQ ID NO: 32732 - DNA, 582 bp, Artificial Sequence
  Description of Artificial Sequence: Synthetic coding sequence
atgcataagtggatcctaacctggatcctcccaacgttattgtatcggtcgtgctttcacatcatctgtttggtgggcaccatatcccttgcatgtaatgacatgacaccagagcagatggcgacaaacgtgaactgttcctctccagaacggcataccaggtcatacgattatatggagggaggagatatcagggtgcggcgtctgttctgtcggacacagtggtacctgaggattgataagcggggcaaggtgaagggcactcaggagatgaagaataactacaacattatggagataaggactgtggccgtgggaattgtggcgatcaagggtgtcgagtcggaattctatctggccatgaacaaggagggtaaactctatgccaagaaggagtgcaatgaggactgcaatttcaaggagttaatactggagaaccactataatacctatgcgagcgctaagtggacgcacaacggaggcgagatgtttgtcgccctgaatcagaaagggatccctgtgaggggaaagaagactaaaaaggaacaaaagaccgctcacttccttccaatggccatcacc

SEQ ID NO: 32733 - DNA, 582 bp, Artificial Sequence
  Description of Artificial Sequence: Synthetic coding sequence
atgcataaatggatactgacctggattcttccaactttgctctacaggtcgtgtttccacataatctgcctggtgggtactatcagtctcgcctgcaacgatatgacccccgaacaaatggccacgaacgtgaactgttcgtcccctgaaagacacacccggtcctacgactacatggagggaggagatattagagttaggcggctgttttgcaggactcagtggtacctgcgcattgataaacgaggtaaggtgaagggcactcaggagatgaagaacaattacaacatcatggaaatcaggacggtcgccgtgggaattgtggcaattaagggagtcgaatctgagttttatcttgctatgaacaaggagggcaaattgtacgcgaaaaaggaatgtaacgaggactgtaacttcaaggaactgatcctggaaaatcattacaacacctacgcatcagcaaagtggacccataatggcggtgaaatgtttgtagcacttaatcaaaagggaatcccagtccgcggcaagaaaaccaagaaagaacaaaagaccgcgcactttctcccgatggcgattacg

SEQ ID NO: 32734 - DNA, 582 bp, Artificial Sequence
  Description of Artificial Sequence: Synthetic coding sequence
atgcataagtggatcctcacctggattttgcccacactcctttaccgtagctgcttccatattatttgtctagtagggaccatctcccttgcgtgtaacgacatgacccctgagcagatggctactaatgttaactgttcttctcccgaacgccatacaaggagctacgactacatggagggaggtgatattagggtccggagattattctgtagaacacagtggtacctgcggattgataaaagaggaaaagtgaaggggacccaagaaatgaaaaataattataatatcatggagatccggactgtcgccgttgggatcgtcgcgattaagggggttgagagtgagttctatctcgccatgaataaggaagggaaactgtacgctaagaaggagtgtaacgaggactgcaattttaaggagctgatattggagaatcactacaatacctatgcctccgccaagtggactcataatggtggggagatgttcgtagctctcaatcagaaggggatccctgtgcgaggcaaaaagactaagaaggagcagaagacagcacattttctcccaatggctataact

SEQ ID NO: 32735 - DNA, 582 bp, Artificial Sequence
  Description of Artificial Sequence: Synthetic coding sequence
atgcataagtggatcctcacctggatcctgccgaccttgctgtaccgctcatgctttcacatcatttgtctcgtcgggaccatcagcttggcttgcaatgatatgactcctgaacagatggcgaccaacgtgaattgctcttcccctgaacggcatactcgctcatacgattacatggaaggaggagatattagagtccgccgcctgttctgtcggacccagtggtacctgagaatcgacaaacggggcaaggtgaagggaacgcaggagatgaagaacaactacaatatcatggagatcagaactgtggcggtggggattgtggccattaagggggtcgagtccgaattctacctcgctatgaataaagagggaaaactgtacgccaaaaaagaatgcaacgaggattgcaacttcaaggagctgatcttggaaaaccattacaatacctacgcttccgcaaagtggacgcataacggaggggaaatgtttgttgcattgaaccaaaagggcatcccggtgcgcgggaaaaagactaagaaagagcaaaagaccgcccactttcttccaatggccatcact

SEQ ID NO: 32736 - DNA, 582 bp, Artificial Sequence
  Description of Artificial Sequence: Synthetic coding sequence
atgcacaagtggattctgacgtggatcctgccaaccctgctgtatcgatcatgctttcacatcatatgcttggtggggaccatctcgttggcctgcaatgacatgaccccagagcaaatggccaccaatgtcaactgttcctcaccagagcgccatactcggtcctacgactacatggaaggaggagatatccgcgtgcggcgcctcttttgcagaactcagtggtacctcagaattgacaagagagggaaggtgaagggcacgcaggaaatgaagaacaactacaacatcatggaaatccggaccgtggccgtcggaatcgtggcaatcaagggtgtggaaagcgagttttacctggcgatgaataaagagggaaaattgtatgccaaaaaggagtgtaatgaggattgtaatttcaaggaactgatcctggaaaatcactacaacacctacgccagcgcgaaatggacccacaatggtggagagatgtttgtggccctgaaccagaaggggatccctgtccggggaaaaaagactaagaaggaacagaaaaccgcccatttcctgccgatggctatcact

SEQ ID NO: 32737 - DNA, 582 bp, Artificial Sequence
  Description of Artificial Sequence: Synthetic coding sequence
atgcacaaatggatactgacctggatacttcctaccctgctctataggagctgttttcatatcatctgtctggtcggcactatctctctcgcttgcaatgacatgacacctgaacaaatggccaccaacgttaactgcagtagtccggagaggcatacaagatcttacgactatatggaaggcggagatattcgagtgaggagactgttctgtaggacccaatggtacctgcgcattgacaaacgcggtaaagtgaaaggcacacaagaaatgaagaataactataacatcatggaaatcagaaccgtggcagttggaatcgtggccatcaagggagtggagagtgagttttatcttgccatgaacaaagagggaaaactttacgctaagaaggaatgtaacgaagactgtaactttaaggaactgatactggagaatcattataatacatacgcatccgctaaatggacacacaacggcggcgaaatgtttgtcgcactcaatcagaaagggatccccgtgcgcggaaagaaaacaaaaaaggagcagaaaacagcccatttcctgcccatggctatcact

SEQ ID NO: 32738 - DNA, 582 bp, Artificial Sequence
  Description of Artificial Sequence: Synthetic coding sequence
atgcataaatggatcctcacatggattctgccgacactgctgtatcgttcttgcttccacataatttgcctcgtggggaccatatccctggcatgtaacgacatgaccccagagcaaatggcaaccaatgtgaattgctcatcccccgagagacacacccgctcctacgattatatggagggcggagatattcgcgttcggcggttgttctgcagaacccagtggtacttaaggatagacaaacggggaaaagttaaaggaacccaggagatgaagaataactacaacattatggagataagaacagtagcagtggggattgtggccatcaaaggcgtggagagcgaattctacctcgccatgaacaaggaaggcaagctttacgccaagaaggagtgtaacgaggactgcaattttaaagagctcattctggagaaccattacaatacttacgcttctgccaagtggacacataacgggggagaaatgtttgtagcgctcaaccagaagggaatccccgtccgcggcaagaaaaccaagaaagagcagaagaccgcccacttccttcccatggccattacc

SEQ ID NO: 32739 - DNA, 582 bp, Artificial Sequence
  Description of Artificial Sequence: Synthetic coding sequence
atgcacaagtggatcctaacttggattctacccaccctgctatacagaagttgtttccacatcatctgcctcgtgggcacaattagtctcgcctgtaatgatatgacaccagagcaaatggctaccaatgttaattgttcaagccctgagcgtcatacgcggtcatatgactacatggaaggtggcgacatccgggtgcggagactgttctgtcggacgcagtggtatctccggatcgacaaaagaggaaaagtgaaggggacacaggaaatgaaaaacaattataacattatggagataagaacagttgcagtgggcattgtcgccatcaaaggtgtggagtcagagttttatctcgcaatgaacaaggaggggaagctctatgccaagaaggagtgtaatgaggattgcaactttaaagaattgattctggagaatcactacaatacatacgccagcgccaaatggactcataacggtggcgaaatgtttgtcgctctgaatcaaaaaggaatccccgtgagagggaagaagacaaaaaaagagcagaagacggcgcatttcttacccatggctataact

SEQ ID NO: 32740 - DNA, 582 bp, Artificial Sequence
  Description of Artificial Sequence: Synthetic coding sequence
atgcataaatggatcctgacttggatactgccgacgctgttgtatagatcctgtttccatattatctgcctggtcggtaccattagtttggcctgcaacgacatgacacctgagcagatggctacgaatgtgaactgctccagccctgagcgccacacccgctcctacgattacatggagggcggtgacattagagtgcgccgcttgttctgtaggacacagtggtacctcagaatagacaaaagaggcaaagtcaagggaacccaagaaatgaagaataactacaacataatggagattagaaccgttgctgtgggtattgtggcgatcaagggcgtggaaagtgagttttacctggcaatgaacaaggagggcaaactgtacgcaaaaaaagagtgtaatgaagattgcaacttcaaggagcttatactggaaaaccattacaacacttatgcaagtgctaagtggacgcacaatggtggtgaaatgtttgtggctctgaatcagaagggaattcccgtcaggggcaagaagacgaagaaggagcagaagaccgctcattttctccctatggccataacc

SEQ ID NO: 32741 - DNA, 582 bp, Artificial Sequence
  Description of Artificial Sequence: Synthetic coding sequence
atgcataagtggattctcacttggatcctcccgactctcctgtatcgctcctgtttccacattatctgccttgtgggcactatctcccttgcctgtaacgacatgaccccagagcaaatggccaccaatgtcaattgctcgtcaccggaaaggcatacgcgctcctacgactacatggagggcggagatatccgcgttcggcgcctcttctgccgcactcaatggtacttgaggattgacaagaggggaaaagtgaagggaacccaggagatgaagaacaactacaatatcatggagatccggaccgtggcggtgggaatcgtcgccattaagggagtcgagtcagaattctaccttgctatgaacaaagaaggcaagttgtacgcgaagaaggaatgcaacgaagattgcaacttcaaagaactgatactggaaaaccactacaacacctacgcttcggcgaagtggacccacaatgggggcgagatgttcgtggctctcaatcagaagggaatcccagtgcgggggaagaaaaccaaaaaggagcaaaaaactgcacactttttgccgatggcaatcacc

SEQ ID NO: 32742 - DNA, 582 bp, Artificial Sequence; identical to SEQ ID NO: 32702
  Description of Artificial Sequence: Synthetic coding sequence

SEQ ID NO: 32743 - DNA, 582 bp, Artificial Sequence
  Description of Artificial Sequence: Synthetic coding sequence
atgcataaatggatattaacgtggatattaccgacgctattatatcgttcgtgttttcatataatatgtttagtaggtacgatatcgctagcgtgtaatgatatgacgccggaacaaatggcgacgaatgttaattgttcgtcgccggaacgtcatacgcgatcgtatgattatatggaaggtggtgatatacgtgttcgacgattattttgtcgtacgcaatggtatttacgtatagataaacgaggtaaagttaaaggtacgcaagaaatgaaaaataattataatataatggaaatacgaacggtagcggttggtatagtagcgataaaaggtgtagaatcggaattttatttagcgatgaataaagaaggtaaattatatgcgaaaaaagaatgtaatgaagattgtaattttaaagaactaatattagaaaatcattataatacgtatgcgtcggcgaaatggacgcataatggtggtgaaatgtttgttgcgttaaatcaaaaaggtataccggtacgtggtaaaaaaacgaaaaaagaacaaaaaacggcgcattttctaccgatggcgataacg

SEQ ID NO: 32744 - DNA, 582 bp, Artificial Sequence
  Description of Artificial Sequence: Synthetic coding sequence
atgcacaaatggatcctaacctggatactccccaccctgctgtaccgttcttgctttcatattatttgtctggtgggcaccatatctctggcatgtaacgatatgacacctgaacagatggccactaacgtgaactgtagttcccccgaacggcacacccggtcttacgactacatggaaggcggtgatattcgggtcagaagactgttttgtcgcactcagtggtacctgcggattgataaaagaggaaaggtcaagggcacccaggaaatgaaaaacaactacaacataatggaaattcggaccgtcgcagtgggtatcgtggcaatcaaaggcgtggaatccgaattctatctggccatgaacaaagagggaaaactgtatgccaagaaggagtgcaacgaagattgcaacttcaaagaattaatcctcgagaatcattataacacttatgcctctgcaaaatggacccacaatggtggcgagatgttcgtcgctctgaatcagaaagggattccggttcggggaaagaaaactaaaaaggaacagaagactgcccatttcttacctatggctattacc

SEQ ID NO: 32745 - DNA, 582 bp, Artificial Sequence
  Description of Artificial Sequence: Synthetic coding sequence
atgcataagtggattctcacttggattctgcctaccctgctgtatcggtcgtgttttcacatcatatgtctggtgggcacgataagcctcgcctgtaacgatatgactccagaacagatggcaactaacgtgaactgcagctctcccgagcgccacacgagatcctacgactacatggaaggcggggacattagggttaggagacttttctgccgaacccagtggtatctcagaattgacaaaagagggaaggtgaaaggcactcaggagatgaagaacaattacaacatcatggagattcgtactgtcgccgtgggaatcgtcgcgattaagggtgtagagtcagaattctacctggcaatgaataaggaaggaaagctgtatgcaaaaaaggaatgtaatgaggattgcaatttcaaggaactgattcttgaaaaccattacaacacttatgcatcggctaagtggacccataacggtggagaaatgtttgtggcattgaatcaaaaaggcatcccagtgcgtggcaagaaaactaagaaggaacaaaagaccgcacactttcttccaatggcaattacc

SEQ ID NO: 32746 - DNA, 582 bp, Artificial Sequence
  Description of Artificial Sequence: Synthetic coding sequence
atgcataaatggattcttacctggatcttaccaacgctcctttatcgcagttgctttcacatcatctgcctagtgggaactattagcttggcttgtaacgatatgacccccgaacagatggctaccaacgtaaattgctcctcccctgagaggcacacccgatcctacgattatatggagggtggagatattcgggttaggcggctgttctgccgcacgcagtggtatcttcggattgacaagcgaggcaaagtgaaagggacacaggagatgaaaaataattataacatcatggagatccgaaccgtggcagtgggaattgttgcaataaagggggttgaatcggagttctacctagcgatgaataaggaggggaagttatacgcgaaaaaagagtgcaacgaggactgcaacttcaaagagctcatcctggagaatcactacaacacgtacgcctcagcaaaatggacgcacaatggaggagaaatgtttgtggccctcaaccagaagggcattcctgtgcggggcaaaaaaactaagaaggagcagaaaacagcccattttcttccaatggctatcaca

SEQ ID NO: 32747 - DNA, 582 bp, Artificial Sequence
  Description of Artificial Sequence: Synthetic coding sequence
atgcacaagtggatcctgacatggatcttgcccaccctgctctataggagttgttttcacattatctgtttggtaggcacgatctccctggcctgtaatgatatgacaccagagcagatggccacaaatgtcaattgcagcagtccagagaggcacacaagatcttatgactatatggaagggggcgatataagggtgcgacggctgttctgccggacacagtggtatctgaggattgacaagcgcggcaaagtcaagggaacccaagagatgaaaaataattacaatattatggaaatcaggacagtagccgtggggatagtggcgattaagggtgtggaaagtgagttctacttggctatgaacaaggagggcaaactgtacgctaagaaagagtgcaatgaggactgcaatttcaaagaactgatcctggagaaccactacaacacttatgcgagtgcaaaatggacacacaacggtggagagatgtttgtagctctgaatcagaagggcatcccagtgcgggggaagaagactaagaaggagcagaaaactgcacactttctgcccatggccatcacc

SEQ ID NO: 32748 - DNA, 582 bp, Artificial Sequence
  Description of Artificial Sequence: Synthetic coding sequence
atgcataaatggatcctgacttggatccttcccactctcctatatcggtcttgttttcatataatctgccttgtgggaacaatttctctcgcgtgtaatgatatgactcctgagcagatggctactaatgtcaattgctcctctcccgaacggcatacaaggtcgtacgactatatggaagggggggacatcagagtccggcgactgttctgtaggacacagtggtacctccgaatagataaacgggggaaggttaaaggaactcaggaaatgaaaaataattataacatcatggaaatacgaactgtggccgtgggaatcgtggctatcaaaggggttgaatctgaattctacctagccatgaataaagagggaaaattgtatgcaaaaaaagaatgcaacgaagattgcaatttcaaagagctaatcctagagaatcattataatacttatgcctcagcaaagtggacacataatggaggagaaatgttcgtcgcactgaatcagaaagggataccagtacgggggaaaaaaacaaaaaaagagcaaaaaacagcacactttctgcccatggcaataact

SEQ ID NO: 32749 - DNA, 582 bp, Artificial Sequence
  Description of Artificial Sequence: Synthetic coding sequence
atgcataaatggatcctcacctggattctcccgaccctgctttacaggtcctgttttcacattatctgcctggtgggaactatctccctggcatgcaatgatatgaccccggagcaaatggcaacgaacgtcaattgttcatcgcctgagaggcataccagatcgtacgactacatggaagggggcgatattcgcgtcagacgcttgttttgtcgcactcagtggtacctgcgcattgacaagagaggaaaagtcaagggtacccaggaaatgaagaataactacaacatcatggaaattagaacggtcgcggtgggaatagtggccatcaagggcgtggagagcgaattctacctggcaatgaacaaggagggtaaactttacgcaaagaaagagtgtaatgaggattgcaactttaaggaactgattctggaaaaccattacaatacttacgcaagcgctaaatggacccacaatggaggtgaaatgtttgtcgctttgaaccaaaagggaataccagtccgcggtaagaaaactaagaaggaacaaaagactgcacactttctccctatggccattact

SEQ ID NO: 32750 - DNA, 582 bp, Artificial Sequence
  Description of Artificial Sequence: Synthetic coding sequence
atgcacaagtggatcctgacttggattctcccaaccctgctctacaggagctgttttcatataatctgtcttgttggaacgattagcctggcgtgcaatgatatgacaccggaacaaatggctactaatgtcaactgctcttcccccgagcggcacaccagatcatacgattatatggaagggggagacatccgagtacggcgtctcttttgccggactcagtggtacctgagaattgacaagcgcggcaaggtgaaaggcactcaggagatgaaaaacaactacaacattatggagattcgcaccgttgccgtgggcattgttgcaattaaaggagtggagtccgagttctatctagccatgaataaagagggcaaactgtatgctaaaaaagaatgtaacgaagactgcaacttcaaagaacttattctagagaatcactacaatacgtacgcctccgccaaatggacccacaacggaggtgaaatgttcgttgctctgaatcagaaggggattccggtgcggggaaaaaagactaaaaaggaacagaaaacagctcacttcctgcccatggccatcact

SEQ ID NO: 32751 - DNA, 582 bp, Artificial Sequence
  Description of Artificial Sequence: Synthetic coding sequence
atgcataaatggatccttacatggattctgcctacacttctgtacaggtcatgcttccatattatttgtttggtaggaactatttctctggcctgcaatgatatgaccccagagcaaatggctactaatgtgaattgctcgtcaccagagcggcataccagaagctacgattacatggaggggggggacattcgggtgcgccggctgttctgtagaacccagtggtacctgcggatcgacaagcggggcaaggtgaaaggcacacaagaaatgaaaaacaactataacatcatggaaatccgtacagtcgccgttggtattgtggcgatcaagggtgtcgagtcagagttctatctcgcaatgaataaggagggcaaattgtacgcaaaaaaggagtgtaatgaggattgtaattttaaggaactgatactcgagaatcattataacacctatgcctcagcgaaatggacccacaacggcggcgaaatgtttgttgccctgaaccagaaaggcattccggttcgcgggaagaagacaaaaaaggagcagaaaaccgcccatttcctccctatggcgattaca

SEQ ID NO: 32752 - DNA, 582 bp, Artificial Sequence
  Description of Artificial Sequence: Synthetic coding sequence
atgcataaatggatactgacctggatcctcccaacccttctttacagatcatgttttcacatcatctgccttgttggaactatctccttggcctgtaatgatatgacgccggaacaaatggcaactaacgtgaactgttcatctccagagcgacatactagaagctacgactacatggaagggggtgatattcgggtgcgccgtttgttttgcagaacccaatggtaccttcgcattgataaaaggggaaaagtgaagggtacccaagagatgaagaataactacaacattatggagattaggaccgtggcagtcgggattgtggctatcaagggagtggaatcggagttctacctcgccatgaacaaagaaggtaagctgtacgcgaagaaggaatgtaatgaggactgtaactttaaggagctgattctcgaaaaccactataacacttatgcatccgcaaagtggacgcataatggcggcgaaatgtttgttgcgctgaaccagaagggaataccggtccgtggcaaaaagacgaagaaggaacagaaaacggcacacttccttcctatggcaattact

SEQ ID NO: 32753 - DNA, 582 bp, Artificial Sequence
  Description of Artificial Sequence: Synthetic coding sequence
atgcacaaatggatcctgacctggatcctgcctactctgctctacagatcatgcttccacatcatttgcctcgtcggaactatctccctcgcctgtaatgacatgacccctgagcagatggctactaacgtcaattgctcgtcccccgaacgccataccagatcatacgattacatggaaggaggagatatccgggtgcgccggctcttctgccgaactcaatggtacctgcgcatcgataagagaggaaaggttaagggcactcaggaaatgaagaacaactacaacatcatggaaatccgcactgtggcagtgggtatcgtggcgattaagggcgtggagagcgaattctacctggccatgaacaaggagggaaagctgtacgcaaagaaggaatgcaacgaggactgcaatttcaaggaactgatcctggaaaatcactataacacctacgcaagcgccaaatggacgcataacggaggagagatgtttgtggccctgaaccagaaggggatcccggtgagaggcaagaaaactaagaaagagcagaaaactgcccatttcctgccgatggccatcacg

SEQ ID NO: 32754 - DNA, 582 bp, Artificial Sequence
  Description of Artificial Sequence: Synthetic coding sequence
atgcataagtggatactgacttggatccttccaactcttctctatagatcgtgctttcatattatttgtctggttggcactatttctttggcctgtaacgacatgactccggagcagatggctaccaacgtaaactgcagcagcccagaaaggcacacacggtcttacgactacatggaggggggcgatattcgtgtccgcagattattttgcaggacacagtggtacctgagaattgataaacgcgggaaggtgaagggtactcaggagatgaagaataactacaacataatggaaattagaacggtggcggtcggcatcgtggcaattaaaggagtggaatccgagttttacctggctatgaacaaagagggaaagctttacgccaagaaggagtgtaacgaggattgcaactttaaggaactgatcctcgagaatcactacaatacctatgcatccgcaaaatggacacacaatggtggggagatgtttgtggcactcaaccagaagggtattcctgtgagggggaaaaaaacaaagaaggagcagaagacagctcattttcttcccatggctatcacc

SEQ ID NO: 32755 - DNA, 582 bp, Artificial Sequence
  Description of Artificial Sequence: Synthetic coding sequence
atgcacaaatggattctgacctggatccttccaacgttgctctaccgctcttgttttcacattatctgtctcgtcggcacaatttctctggcatgcaacgacatgactcccgagcagatggctaccaatgtcaactgtagttctcctgagcgacatacccggtcttatgactatatggaaggcggagatataagggtgagaaggctgttttgtagaactcagtggtatctgagaatagataagcggggaaaagtgaaggggactcaggaaatgaaaaataattataacatcatggagatccggactgtcgcagtcgggattgttgcgatcaagggcgtggagagcgaattctatctggccatgaacaaagagggcaagctttacgccaaaaaagaatgtaatgaagattgcaactttaaagaactgattctggaaaatcactacaatacatacgcttccgctaaatggactcataatggtggtgagatgtttgtggcactgaatcagaaaggaatccccgtgagggggaaaaagaccaagaaagagcaaaaaacagctcactttctgcccatggctataacc

SEQ ID NO: 32756 - DNA, 582 bp, Artificial Sequence
  Description of Artificial Sequence: Synthetic coding sequence
atgcataaatggattcttacttggattttgccgactctcctgtaccgttcatgtttccatatcatctgcctggtggggactatcagcctggcgtgcaatgacatgaccccagaacaaatggccaccaacgtgaattgctccagccccgagcgccacaccagatcgtatgactacatggaggggggagacatccgagtgcggcgcctgttctgtcgcacgcagtggtacctccggattgataagcggggaaaggtgaaaggaacccaggagatgaagaataactacaatatcatggaaatccgtactgtcgccgtcggcatcgtggctatcaagggtgtggaaagcgaattctatctggccatgaataaggagggaaagctctacgccaaaaaagagtgcaacgaagattgtaactttaaagagctgatcctcgagaatcactacaacacctacgcctccgcaaagtggacccataacggaggcgaaatgtttgtggcgttgaaccagaagggaatcccagtgaggggcaaaaagactaagaaggaacaaaaaaccgctcacttcctgccgatggctatcact

SEQ ID NO: 32757 - DNA, 582 bp, Artificial Sequence
  Description of Artificial Sequence: Synthetic coding sequence
atgcacaagtggatactcacttggattcttcctacacttctgtatcgctcttgtttccatatcatctgccttgttgggactatctcgcttgcttgcaatgatatgacaccagagcagatggctactaatgtaaattgcagttctccagaaagacacacacgctcatatgattacatggaaggaggagatatccgagttaggagactcttttgcagaactcaatggtatctccgtatagataaacggggaaaagtaaaagggacacaagaaatgaaaaataactataatataatggaaattcgtactgtggctgtaggaatagttgccatcaaaggggttgaatctgagttctatcttgccatgaataaagaagggaaactctatgccaaaaaggaatgcaatgaagattgtaacttcaaagaactgatactggaaaatcactataacacttacgcttctgctaaatggactcataacgggggggaaatgttcgttgcactaaaccagaaaggaatacccgtgcgggggaaaaaaactaaaaaagaacagaaaactgctcacttcctgcctatggccattaca

SEQ ID NO: 32758 - DNA, 582 bp, Artificial Sequence
  Description of Artificial Sequence: Synthetic coding sequence
atgcataagtggattcttacatggattctcccaacccttctgtacaggtcatgttttcacatcatttgtctggtcggcaccatttccttggcctgcaatgatatgactccagagcaaatggccacaaacgtaaattgcagtagtcctgagaggcacacaagatcctatgactacatggagggtggtgatattagagtgaggagactattttgcaggacccagtggtatctgagaatcgataagcgggggaaagtgaagggcacccaggagatgaagaacaattacaacatcatggagattagaactgtagccgtgggcatagtggcaattaagggtgtcgaaagcgagttttatcttgctatgaataaagaaggtaagctctacgctaagaaagaatgcaatgaggactgcaattttaaagagctgatactagaaaaccattacaatacttatgcaagtgcaaagtggacccacaacggcggcgagatgttcgtagccctgaaccagaaagggatcccagtacggggcaagaagactaaaaaagaacagaagacggcccattttcttcctatggccatcacc

SEQ ID NO: 32759 - DNA, 582 bp, Artificial Sequence
  Description of Artificial Sequence: Synthetic coding sequence
atgcataagtggattctgacctggattctgcctactcttctttaccggtcatgttttcatatcatctgtcttgtgggaactatcagcttggcgtgtaacgatatgactccggaacaaatggccaccaacgtcaactgttcttcgccagagcggcatactcggagctacgactacatggagggcggtgatatccgcgtgagacgactgttctgccgtacccagtggtaccttcggatcgataagcggggtaaagtgaaggggacccaagaaatgaagaacaattacaacataatggagatcagaacggtggccgtcgggatcgtggccatcaagggagtggaatcggagttctacctggcaatgaataaagaagggaaactttacgcaaagaaggagtgtaatgaagattgcaactttaaggaactcatccttgaaaatcactacaatacttacgcctccgctaagtggacccataatggtggtgaaatgtttgtcgcactgaaccagaaaggtattcccgtgagaggcaaaaagaccaaaaaggaacagaaaaccgcacactttctgccgatggctattacc

SEQ ID NO: 32760 - DNA, 582 bp, Artificial Sequence
  Description of Artificial Sequence: Synthetic coding sequence
atgcacaaatggatacttacttggattcttccgaccctcctctaccggagctgcttccatatcatttgtttggtggggactatttcgcttgcatgtaacgacatgacccctgagcagatggccactaacgtgaactgttcatccccagaacgacacaccagatcgtacgattacatggaaggcggcgatatccgtgtcagacgacttttctgtagaacccagtggtacctgcgtatagacaagcggggtaaggtcaagggcactcaagagatgaagaacaactacaacattatggaaatcaggactgtcgccgtcggtattgtggcgatcaagggagtggaatcggagttttacctcgcgatgaacaaggagggaaagctgtacgcaaagaaagagtgcaacgaagattgtaactttaaggaactcatacttgagaatcattacaacacgtatgcatcagcaaagtggactcataatggaggtgaaatgtttgtggccctgaatcaaaaaggcatcccagtgcgtggcaaaaagaccaaaaaggagcaaaagaccgcacactttttgcctatggccattact

SEQ ID NO: 32761 - DNA, 582 bp, Artificial Sequence
  Description of Artificial Sequence: Synthetic coding sequence
atgcataaatggattctgacttggatccttccaactctcctgtacagatcgtgctttcacattatctgtctcgtgggtactatcagcctggcttgtaatgatatgaccccagaacaaatggccactaatgtgaattgtagctcgccagaaagacacactcgatcctacgattacatggagggtggagatattagggttcggcgcctgttctgtcgcactcagtggtaccttcgaattgataaacggggaaaggttaagggcacccaagagatgaaaaacaactacaatatcatggaaatacgaacggtcgccgtgggaattgtggcaatcaaaggtgtggagtccgagttctacttggccatgaataaggaaggaaaactttacgccaagaaagagtgtaacgaagattgtaatttcaaggaactgatacttgaaaaccattacaatacttatgcttcggcaaagtggacccataacggcggcgaaatgtttgtcgcgcttaaccagaaagggattccagtgaggggtaaaaagaccaagaaagaacaaaagacggcgcatttcttgcctatggcaattacc

SEQ ID NO: 32762 - DNA, 582 bp, Artificial Sequence
  Description of Artificial Sequence: Synthetic coding sequence
atgcataaatggatcttgacatggattttaccgaccttgctctatagaagttgttttcatatcatctgccttgtgggaacaatctcgttggcatgcaatgacatgacaccagagcaaatggccaccaacgttaactgctccagccctgaacgtcatacgagaagctacgattatatggaaggtggcgatattagagttcggagattattttgtcgtacgcagtggtatttgcgaatcgacaaacgaggtaaagtgaaaggtactcaagaaatgaaaaataattataatattatggaaatccggacagtagcggtaggaatcgtggctattaaaggagtcgaatcagaattttatctcgctatgaataaagaaggtaaattgtacgctaaaaaagagtgtaatgaggattgcaacttcaaagagttgattcttgaaaatcactacaatacatatgccagtgccaagtggacgcataatggaggtgagatgtttgtggcgcttaatcaaaaaggaattcctgtgaggggaaaaaaaacaaaaaaggaacagaaaacagcccatttcttgccgatggcgatcaca

SEQ ID NO: 32763 - DNA, 582 bp, Artificial Sequence
  Description of Artificial Sequence: Synthetic coding sequence
atgcacaagtggattctcacctggatcctgccgacccttctctacaggtcgtgctttcatatcatctgcttggtgggaaccatctcactcgcatgcaacgatatgactccggagcaaatggcgactaacgttaactgttcatccccggagcggcatacccgctcctacgactacatggagggcggagacatcagggtccgccggttgttctgcaggactcagtggtatctgagaattgataagagggggaaggtgaaaggcacccaggaaatgaagaacaattacaatatcatggaaatccggactgtggccgttggaatcgtcgcaatcaagggagtggaatccgaattctacctcgctatgaataaggaaggaaagctgtacgccaagaaggaatgtaatgaggattgtaacttcaaggagctcattttggaaaatcattacaacacctacgcctcggcgaagtggacgcataatggcggcgagatgttcgtggcgctcaaccaaaagggaattccagtgagagggaaaaagaccaagaaagagcagaaaaccgcccacttcctcccgatggccatcact

SEQ ID NO: 32764 - DNA, 582 bp, Artificial Sequence
  Description of Artificial Sequence: Synthetic coding sequence
atgcacaagtggatcctcacctggatcctccccaccctgctctacagatcatgctttcacattatctgtcttgtcggaacgatctcactggcttgtaatgatatgacgcctgaacagatggccactaacgtcaactgctcgtctcccgaaaggcacactaggagctacgattacatggagggaggagacatccgggtccgccgcctgttttgccggactcagtggtaccttcgcatcgacaaacgcggcaaggtgaaggggacccaggagatgaagaacaactacaatatcatggaaatccgtactgtggcagtcggaatcgtggctatcaagggggtggagagcgaattctacctggccatgaacaaggagggcaagctgtacgcaaagaaggagtgcaacgaggattgcaatttcaaagaacttattctcgaaaaccattacaacacctatgcgtctgcaaaatggactcataatggaggcgagatgttcgtggccctgaatcagaagggcatcccggtgagaggcaagaaaacgaaaaaagagcaaaagaccgctcacttcctgccgatggcgatcacc

SEQ ID NO: 32765 - DNA, 582 bp, Artificial Sequence
  Description of Artificial Sequence: Synthetic coding sequence
atgcacaaatggatcctgacgtggatcttgccaacgctcctttaccggagctgttttcacattatctgcctcgtgggcaccatctcactcgcctgcaacgacatgacccccgaacaaatggcgactaatgtgaattgctcgagcccagaaaggcacactcgatcgtacgactacatggagggtggagacattagagtgcggcgcctgttttgtagaacccagtggtatcttcggatcgacaagcgaggaaaggttaagggtacccaggaaatgaagaacaattacaacataatggagattaggacggtggcagtgggtatcgtcgcaatcaagggcgtcgaatccgaattctacctggccatgaataaggaaggaaagctgtacgcaaagaaggaatgtaatgaggactgcaacttcaaagaacttattcttgaaaaccattacaacacttatgcgtcggcaaaatggacccacaacggtggtgagatgttcgtggccttgaaccaaaaaggaattcctgtgcgtggaaagaaaaccaagaaggaacagaaaaccgcacacttccttccaatggcaattacc

SEQ ID NO: 32766 - DNA, 582 bp, Artificial Sequence
  Description of Artificial Sequence: Synthetic coding sequence
atgcacaaatggatcctcacgtggatcctgcctaccctcctgtatcggtcctgctttcacatcatttgccttgtaggcactatctcgcttgcttgtaacgatatgacccctgaacagatggccactaacgtaaactgttcgagccctgagcgccacacccgttcttacgactatatggagggaggtgatatccgagtccgtagacttttctgccgcacccaatggtatctaagaatcgacaagcgtggtaaggtaaagggaacgcaagaaatgaaaaacaattacaacatcatggagatccggactgtggccgtcggcattgttgctatcaagggcgtagaatcggagttctaccttgctatgaataaggaaggtaaactatatgctaagaaggaatgcaacgaggattgcaacttcaaggaacttattttggaaaaccattataacacgtatgcatccgcgaagtggacccacaacgggggagagatgttcgttgctttgaaccaaaagggtatccccgtgcgaggcaagaagacaaaaaaagaacagaaaacggctcactttctacccatggccattacc

SEQ ID NO: 32767 - DNA, 582 bp, Artificial Sequence
  Description of Artificial Sequence: Synthetic coding sequence
atgcataagtggatcctcacctggatcctgcccacattgctctacaggtcatgttttcatatcatctgcctggtggggaccatttccttggcttgcaatgacatgacacccgagcaaatggctacaaatgtgaactgcagcagccccgagcgacatacgcgaagctacgattacatggagggcggagatatcagggttagacggcttttttgtaggactcagtggtacctcaggatcgacaaacgaggcaaggtcaagggaacacaggagatgaaaaacaattataacatcatggaaattcgaaccgttgctgtgggcatagtagctataaagggcgtggagagcgaattttatctggccatgaacaaggaaggtaaactctacgccaagaaggagtgcaacgaggattgcaattttaaagaactgattctggagaaccactataatacctatgcgagtgctaaatggacccacaacggcggagagatgtttgtggcacttaaccaaaaagggatacccgtccgcggcaaaaaaaccaagaaagaacaaaaaacggcccattttttgcccatggccatcact

SEQ ID NO: 32768 - DNA, 582 bp, Artificial Sequence
  Description of Artificial Sequence: Synthetic coding sequence
atgcataaatggattttaacctggattcttcctacattgctctacaggtcgtgtttccatatcatatgcttagtcggtaccatttcattggcctgcaatgacatgacccctgaacagatggctacaaacgttaattgcagttcccctgaacgacataccaggtcctacgactacatggaagggggtgatattagagtgagaaggctcttctgtaggacccaatggtatctcagaatagataagcgaggtaaagtaaaagggacacaggaaatgaagaataactacaacattatggagatcaggacagttgcggtgggaattgtggccataaaaggagtggagtccgaattttatttagctatgaacaaggaaggtaagttgtatgctaagaaagaatgcaatgaggactgtaattttaaggagcttattctagagaatcattacaacacttatgcaagcgctaagtggactcataatgggggagaaatgtttgtggcattgaatcagaagggaattcccgttaggggtaagaaaacaaaaaaggagcagaaaactgcacattttctaccgatggcaattacg

SEQ ID NO: 32769 - DNA, 582 bp, Artificial Sequence
  Description of Artificial Sequence: Synthetic coding sequence
atgcacaagtggatactgacctggatactcccaaccttgttatatcgatcctgctttcatatcatttgtttggttgggactatatcactcgcctgtaatgacatgaccccagagcagatggccaccaatgtaaactgtagttcgcccgagcggcataccagatcttacgattatatggaaggcggagatatcagagtcagacgtttgttctgccggactcaatggtatctgcgtatcgacaagaggggaaaggtaaagggaacccaggagatgaaaaacaactataatattatggagatacgcactgtagcagttggcatcgttgctattaagggagttgaaagcgagttttacttagctatgaacaaggagggaaaactatatgctaaaaaagaatgcaacgaggattgtaattttaaagaactgatacttgagaatcactataatacctacgcatcagccaagtggacacataacggtggagagatgtttgtggccctgaaccagaaggggatccccgtacgcggaaagaaaactaaaaaggagcagaaaacagcacacttcctgcccatggcgattaca

SEQ ID NO: 32770 - DNA, 582 bp, Artificial Sequence
  Description of Artificial Sequence: Synthetic coding sequence
atgcacaagtggattctaacctggatactgcctacgctactgtacagaagctgcttccatatcatatgcttggtgggcactatcagtctagcatgtaatgatatgacccccgagcagatggccactaacgtcaactgcagttcccccgagaggcatacccgatcctacgactatatggaaggcggtgatatcagagtgcgcaggttgttctgcaggacccagtggtatctgcgaatcgacaaacggggaaaggtgaagggtacccaggagatgaagaacaattataacataatggaaatcaggacggttgctgttggtatcgtcgccatcaagggcgtagaaagcgaattctacttggctatgaataaggagggtaagctgtacgcgaagaaagaatgtaacgaggactgcaacttcaaggagctcattctggaaaatcactataacacatatgcttcggccaaatggacccataacggaggtgagatgtttgtagcactaaatcaaaaaggcatccctgtgcggggaaaaaaaaccaagaaggaacagaagacagcacactttcttccaatggcaattacc

SEQ ID NO: 32771 - DNA, 582 bp, Artificial Sequence
  Description of Artificial Sequence: Synthetic coding sequence
atgcacaaatggatactgacatggatactgcccacattgctgtataggagctgcttccatatcatctgtctggtaggtacaatcagcctcgcctgcaacgacatgacacccgaacagatggccactaatgtgaattgcagtagccctgagagacatacccgatcctatgattacatggaaggtggcgacatacgggtgcggcgcctgttttgccgcacccagtggtatctgcgcatcgataaacggggaaaagtaaagggaacgcaggagatgaagaataactacaacataatggaaatccgaacagttgcagtggggattgtggcaatcaagggagtggaatccgagttctatctcgccatgaataaggagggcaagctgtatgcaaaaaaagaatgcaatgaagattgtaattttaaggaattgattcttgagaaccattataacacatacgcaagtgcaaaatggacgcataatggtggagagatgtttgttgccctgaatcagaaggggatccctgtgcgagggaagaagaccaaaaaggaacagaagacagcacactttttgcctatggctattacc

SEQ ID NO: 32772 - DNA, 582 bp, Artificial Sequence
  Description of Artificial Sequence: Synthetic coding sequence
atgcataagtggatccttacttggattcttccgactctgctgtaccggtcgtgttttcatatcatctgtctcgtgggaaccatatccctggcgtgtaacgatatgacccctgaacaaatggcaactaacgtcaactgttcttccccagaacgtcatactagatcgtacgattacatggagggcggcgacatccgagtgcgacggcttttctgtcgaacccagtggtaccttagaattgacaaacgcggtaaggtcaagggaacccaagaaatgaagaacaactacaatatcatggaaattagaacggtggccgtgggcattgtggcgatcaaaggtgtcgagtccgaattctacctggcgatgaataaagagggtaaactgtacgctaagaaggaatgcaatgaggattgcaactttaaagaactcattctggaaaaccactacaacacctacgcctccgcgaagtggactcacaacggaggagagatgtttgtggcacttaaccaaaaaggaattcctgtgcgcggcaaaaagaccaagaaggaacaaaagacggcccacttccttcccatggcaattacc

SEQ ID NO: 32773 - DNA, 582 bp, Artificial Sequence
  Description of Artificial Sequence: Synthetic coding sequence
atgcacaagtggatcctcacctggattctcccaactcttctttaccggtcgtgtttccatatcatctgtcttgtgggaactatttcgctcgcatgtaacgatatgacccctgaacagatggcaaccaacgtcaactgttcctcgccagaaagacatacgagatcgtacgattacatggaaggaggtgacatacgggtgcgcagacttttctgtagaacccaatggtaccttagaattgacaaacggggaaaggttaagggaactcaagaaatgaagaacaactacaatatcatggaaattcgaaccgtggctgtggggattgtggccattaagggagtggagtcagaattctaccttgcaatgaacaaagaaggaaagttgtacgccaaaaaggaatgtaatgaagattgcaactttaaagaacttattctggagaaccactacaacacttacgccagcgccaagtggacccataacggaggtgaaatgttcgtggcactgaatcaaaaagggattcccgtgagggggaagaaaacgaagaaagagcaaaagactgcacatttcctccccatggcaataact

SEQ ID NO: 32774 - DNA, 582 bp, Artificial Sequence
  Description of Artificial Sequence: Synthetic coding sequence
atgcataagtggatccttacttggatcttgccaactctgttgtaccgcagttgttttcacatcatttgccttgtgggtaccattagcctggcttgcaacgatatgacacccgagcagatggccaccaacgtcaactgcagctcccctgagagacataccaggtcctatgattatatggagggaggcgacatccgtgtgcgccgcctgttctgcaggacccaatggtacctcagaattgacaaacgcggtaaagtcaaaggaactcaggagatgaagaataactacaacatcatggagatcaggaccgtagctgtgggcatcgtggctattaaaggtgtggagagtgagttttatctcgccatgaacaaggagggaaagctgtatgcaaagaaagaatgcaacgaagactgtaacttcaaggagctgatcctcgagaaccactacaacacctatgcttctgctaagtggacacataacggtggtgagatgtttgtggccctgaatcagaagggtattcccgtccgcggtaagaagactaagaaagaacagaagactgctcatttcctccccatggccatcacc

SEQ ID NO: 32775 - DNA, 582 bp, Artificial Sequence
  Description of Artificial Sequence: Synthetic coding sequence
atgcataagtggatcctcacctggatcctgcctactctgctctacaggagctgcttccatatcatctgcttggtcggtaccatttccctggcttgtaatgatatgactcctgaacaaatggcaaccaacgtgaactgctcgtcgccggaacgccatactcggtcgtacgactatatggaaggaggagacattcgcgtgcggcgcctcttttgtcgaacccagtggtacctgcggattgataaaagaggaaaggtgaagggaactcaggagatgaagaacaattacaacataatggaaatccggaccgtagcggtgggcatcgtggcgatcaagggagtcgagtccgagttttacttggcgatgaacaaagaaggaaagctctacgccaagaaggagtgcaatgaagattgtaatttcaaggaactgatcctggagaaccactacaatacctacgcctcggcaaagtggactcacaacggcggagagatgttcgtcgcactcaaccagaagggcattccggtgcggggcaaaaagactaaaaaggagcaaaagactgctcacttcctgccgatggcgatcacg

SEQ ID NO: 32776 - DNA, 582 bp, Artificial Sequence
  Description of Artificial Sequence: Synthetic coding sequence
atgcataagtggatcctgacttggatactgccaactctgctttaccgcagctgttttcacatcatatgtcttgtgggtaccatttcgttggcctgtaatgatatgactcccgaacagatggcaaccaatgtcaattgcagctcaccagagaggcacaccagatcttacgactatatggaagggggcgatattcgtgtgaggcgacttttctgccgaacccagtggtaccttagaatcgacaagcgtggaaaggtgaaaggaacccaggaaatgaaaaacaactataacatcatggaaattaggactgttgcagtcggcattgtggctattaagggtgtggaatcagagttctacctcgccatgaataaagaaggaaagctctacgctaagaaagagtgcaatgaggattgtaactttaaggaactgatcctggagaaccactacaatacctatgcatcagcgaagtggacccacaacggaggcgaaatgtttgtcgccctgaaccagaaggggatacctgtgcgtggaaaaaagaccaagaaggaacaaaagacggcacattttctcccgatggccataacc

SEQ ID NO: 32777 - DNA, 582 bp, Artificial Sequence
  Description of Artificial Sequence: Synthetic coding sequence
atgcacaaatggattctcacttggatcctgccgactctgctttacagatcctgctttcacataatctgcctggtgggcacgatcagccttgcctgcaacgacatgaccccagaacagatggccactaacgtcaactgttcgagcccggagagacatacccgatcatacgactacatggaaggcggagacatccgcgtgagacgtctgttctgcaggacgcagtggtacctgcggattgataagaggggcaaggtgaagggaactcaggagatgaagaacaattacaatatcatggaaatccgcaccgtggcagtggggatcgtggcgatcaagggcgtcgaaagcgagttctacctcgctatgaataaggagggtaagttgtacgcgaaaaaagagtgcaacgaggattgcaacttcaaggagctcattctggaaaaccactacaatacctacgccagcgccaaatggactcataatggaggagagatgttcgtggcgctgaaccagaaaggaatcccggtgagaggcaagaaaaccaagaaagagcaaaagaccgcacatttcctccccatggccataact

SEQ ID NO: 32778 - DNA, 582 bp, Artificial Sequence
  Description of Artificial Sequence: Synthetic coding sequence
atgcacaaatggatcttgacttggatcctcccaacccttttgtacagatcatgctttcacataatttgcctggtgggaacgatctcgctggcctgcaacgatatgactccagaacagatggcgaccaacgtcaactgttcctcccctgagagacatacgcgcagctacgactacatggagggcggagacattcgggtgagacgcctgttctgccgcacgcaatggtatctgcgcatcgacaagagaggaaaggtgaaaggcactcaagaaatgaagaacaattacaacatcatggagatacggaccgttgcggtggggatcgtggccatcaagggagtcgagagcgaattctacctcgcgatgaacaaggaggggaaattgtacgccaaaaaggagtgtaatgaagattgcaacttcaaggagctcatcctggagaatcattacaacacctatgcctcggcaaagtggactcacaacggtggcgagatgtttgtcgcactgaatcaaaagggcatccctgtgcgcggaaagaagactaagaaggaacagaagaccgcacacttccttcccatggctatcact

SEQ ID NO: 32779 - DNA, 582 bp, Artificial Sequence
  Description of Artificial Sequence: Synthetic coding sequence
atgcataaatggatcctgacctggatccttccgaccctcctgtaccggagctgttttcatatcatctgtttggtgggaaccatcagcctggcgtgcaatgacatgacgcctgaacaaatggccaccaatgtcaactgttcttcccctgaacggcacactcggagctatgattacatggaggggggtgatatccgggtgagaaggctcttctgtcgcactcagtggtacctgcgcatcgacaaaagagggaaggtgaagggaacccaagaaatgaagaataactacaacattatggagatccgcaccgtggcggtggggattgtcgccatcaagggcgttgaatcagaattctacctcgcaatgaacaaggagggaaagttgtatgcgaaaaaggaatgcaatgaggactgcaatttcaaagagctgatcctggagaatcattacaacacctacgcgtccgctaagtggacccacaacggcggcgaaatgttcgtcgccctcaatcaaaagggaatccctgtgaggggcaagaaaaccaagaaagagcaaaagactgctcattttctgcctatggccatcact

SEQ ID NO: 32780 - DNA, 582 bp, Artificial Sequence
  Description of Artificial Sequence: Synthetic coding sequence
atgcacaagtggatcctcacatggatcctcccgacgttactgtaccgatcttgtttccatatcatttgcctagttggcaccattagcctggcttgtaacgacatgacacctgagcagatggccacaaacgtaaactgctcttcccctgaacgccacactagatcctatgattatatggagggaggggacatccgcgtcaggcggttgttctgtcgcacccagtggtaccttcgaatagacaagcgcggcaaggtaaagggaacgcaggagatgaaaaataactacaatataatggagatcagaaccgtagccgtggggatcgtcgcgattaaaggagtggagagcgagttttatctggccatgaacaaagaggggaagttatacgctaaaaaggagtgcaatgaggattgcaatttcaaggaattaattcttgaaaaccactataacacgtatgccagcgcaaagtggacccataacggcggcgagatgttcgtggccctgaatcaaaaaggtatccctgtgcgggggaaaaagaccaaaaaggagcagaagaccgcccattttcttccaatggccatcaca

SEQ ID NO: 32781 - DNA, 582 bp, Artificial Sequence
  Description of Artificial Sequence: Synthetic coding sequence
atgcataaatggatcctgacctggattctccccaccctgctgtaccgctcatgtttccacattatctgcctggttggcactatctccctggcttgtaatgatatgacgccagaacagatggcgaccaatgtgaactgcagctcgcccgaacgccacactcgctcgtacgactacatggaaggtggagacatacgcgtgaggagactgttctgtaggacccagtggtaccttcgcatcgacaagagaggtaaggtcaaagggacccaagaaatgaagaacaactacaacattatggaaatccgcactgtcgctgtggggatcgtggcgatcaaaggagtggaatccgaattctacctggcgatgaataaggaaggcaagttgtacgcaaagaaggaatgcaatgaggactgcaacttcaaggagctcatcctcgaaaatcactataacacttacgcatcggcgaaatggactcataatggaggagaaatgttcgtggccctgaaccagaagggtattccggtgagggggaagaaaaccaaaaaagagcagaaaaccgcccactttctgccgatggcaatcact

SEQ ID NO: 32782 - DNA, 582 bp, Artificial Sequence
  Description of Artificial Sequence: Synthetic coding sequence
atgcataaatggattctcacttggattctccccaccttgctttataggtcttgttttcatattatatgtctggtgggcactataagtctggcctgcaacgacatgacccccgagcagatggccacaaacgtcaactgttcttcacccgaacgacacacacggtcttatgactatatggagggtggagacatacgcgtccgccgcctgttttgcagaacccagtggtacctccgcattgataagcgaggcaaagtgaaaggaactcaggagatgaagaataattacaatatcatggaaatacggactgtagctgtagggatcgtggcaatcaaaggggtcgagtctgagttctatctcgccatgaataaggaaggtaaactctatgcaaaaaaggaatgcaacgaagactgcaactttaaagagctgatcctggagaaccactacaacacctatgcctccgcaaagtggacacataacgggggcgaaatgtttgtcgcgctcaatcagaaaggtatccccgtgcgcggaaagaaaaccaagaaggaacaaaaaacagctcacttcctccccatggcaataacc

SEQ ID NO: 32783 - DNA, 582 bp, Artificial Sequence
  Description of Artificial Sequence: Synthetic coding sequence
atgcataaatggattctcacctggattctgcccactcttctgtaccggagctgttttcacattatctgtctggtgggcactatttcgctggcctgcaacgacatgacccccgaacagatggcaacgaatgtgaactgctcctcacctgagcgtcacaccagatcgtacgattacatggaaggaggagatatcagagtgagacgcctcttctgtcgtactcaatggtacttgagaatcgataagagagggaaggtcaaaggaactcaggagatgaagaataactataacatcatggaaatcaggactgttgctgtgggaattgtggccatcaagggggtggagtcagagttttacctcgcaatgaataaagaaggcaaactttacgccaagaaagagtgcaatgaagattgtaactttaaggaactgattctggaaaaccactacaacacctacgcttcggcaaagtggacccataacggcggcgaaatgttcgtggcacttaaccaaaagggcattccggtccgcgggaagaaaacgaagaaggaacaaaagacggcccactttctcccaatggctataacc

SEQ ID NO: 32784 - DNA, 582 bp, Artificial Sequence
  Description of Artificial Sequence: Synthetic coding sequence
atgcataagtggatccttacttggatcctgcctacgctcttgtaccgctcctgcttccacatcatttgcctcgtcgggaccatcagcctcgcctgtaatgacatgaccccggagcagatggcaactaatgtgaactgctcgtcgccggagcgccatactcggtcatacgattacatggaaggaggggatatccgcgtcagacggctgttttgccgcacccaatggtacctgcgaatcgacaagagaggtaaggttaagggaactcaggaaatgaaaaataactataacattatggaaatcaggaccgtggctgtcggaattgtggctatcaagggcgtggaatccgagttttacctggcaatgaacaaggaaggcaagctgtacgccaagaaagaatgtaacgaggactgcaacttcaaagagctgatcttggagaatcactacaacacctacgcgagcgccaaatggacccacaatggaggagaaatgttcgtggcgctgaaccagaagggaatccccgtgcggggcaagaaaacgaagaaagaacaaaagactgcccacttcctcccaatggcgatcacc

SEQ ID NO: 32785 - DNA, 582 bp, Artificial Sequence
  Description of Artificial Sequence: Synthetic coding sequence
atgcataagtggatcctaacctggatattgcctaccttattgtataggtcctgttttcatatcatttgcctagtggggaccatctccctagcctgcaatgacatgacccccgagcagatggccacaaatgtgaactgtagctccccggaacggcacacccgatcttacgattacatggagggaggcgacatacgcgttaggagattattctgtcgcacccaatggtatctgaggattgacaaacgagggaaagtgaagggaacacaggaaatgaaaaacaactataacatcatggagattcgcaccgtggcggtgggcatagtggccattaagggagtggagtccgagttctatctggcaatgaataaggagggaaagctgtacgccaagaaggaatgcaacgaggattgtaacttcaaggaactcatcctggagaaccactacaacacttacgcgtctgcaaaatggacccataatggtggtgagatgttcgtggcattgaaccagaaaggtataccggttcgtggtaaaaagactaaaaaggagcagaaaactgcacacttcctgcctatggcgattact

SEQ ID NO: 32786 - DNA, 582 bp, Artificial Sequence
  Description of Artificial Sequence: Synthetic coding sequence
atgcataaatggattctcacatggatactgccaactttattgtaccgaagttgtttccatatcatttgcttggttggcaccatatctctggcgtgcaacgatatgacaccagagcaaatggctacaaacgtcaattgcagttcccctgagcggcacacccgtagctacgactacatggagggcggcgacataagggtgcgacggctcttctgcagaacccagtggtatcttcgcattgacaagaggggaaaggtgaagggcactcaggagatgaagaataactacaacatcatggagatccggaccgtggctgtgggcatagtggccatcaagggggtagagtcagagttctacctcgccatgaataaagagggaaagctgtacgctaagaaagaatgtaacgaggattgtaattttaaggaactgattcttgagaaccattacaatacctacgcaagtgctaaatggacgcataacggaggtgagatgtttgttgcactcaaccaaaaggggatccctgtgcgagggaaaaagaccaagaaagagcagaagaccgcccattttctcccgatggccatcaca

SEQ ID NO: 32787 - DNA, 582 bp, Artificial Sequence
  Description of Artificial Sequence: Synthetic coding sequence
atgcataagtggatcctcacctggatactgcccaccctattatatagatcgtgttttcacataatctgcctggtggggactatctctttggcctgcaacgatatgaccccagagcagatggctaccaacgtgaactgttcctctccggaacgacataccagatcatacgactacatggaggggggagacattcgagttaggagactattctgtcgcacacagtggtatctgcgaattgacaagcgggggaaggttaaaggtactcaggagatgaaaaataattacaacatcatggagattaggactgttgccgtgggcatcgtggccattaagggcgtcgaatccgagttttacctggccatgaacaaagaaggcaagctgtatgcgaagaaggaatgcaacgaagactgtaactttaaagagctcatacttgaaaatcattacaacacgtacgctagcgccaagtggacgcacaacgggggagagatgtttgtggctctaaatcagaaaggtatacctgtgaggggaaaaaaaacaaaaaaggaacagaaaaccgcacacttcttgccgatggcgatcact

SEQ ID NO: 32788 - DNA, 582 bp, Artificial Sequence
  Description of Artificial Sequence: Synthetic coding sequence
atgcacaaatggatccttacttggatcctgcctactttgctgtaccggtcatgcttccacattatctgcctggttggcaccatttcccttgcttgtaatgacatgactccagaacagatggccaccaatgtgaactgctcgtccccggaacgccatacgcgctcatacgactacatggaaggcggggacatccgggtgagacgcctcttctgcagaacccagtggtacttgaggatagacaaacggggaaaagtcaagggaactcaggaaatgaagaacaattacaacatcatggaaattcggaccgtcgcagtggggatcgtggccatcaagggtgtggaatcagaattctacctggctatgaacaaggaggggaaactgtacgccaagaaagagtgtaatgaggactgcaactttaaagaactgatcttggaaaaccactacaacacgtacgcgtcggcgaagtggacccataacggtggcgaaatgttcgtggctctcaaccaaaaggggattcccgtccgaggaaagaaaaccaagaaggaacagaaaactgcgcatttccttccgatggccatcacg

SEQ ID NO: 32789 - DNA, 435 bp, Artificial Sequence
  Description of Artificial Sequence: Synthetic coding sequence
atggcaacctgggcactcttactcctcgccgcaatgttgctggggaatccgggtcttgtcttttctcgtttatccccagagtactacgatcttgcccgagctcacctgagggacgaggaaaagtcttgtccttgcctcgcgcaagaaggtccacaaggcgaccttcttaccaaaacacaggagctgggcagagattatcgaacctgcctgaccattgttcagaagctgaagaagatggtggacaaacctacccaacgtagtgtttctaatgcagccacacgtgtttgccgtacaggccgctcgcggtggagagatgtctgccgtaatttcatgaggcggtaccaaagtcgggttacgcaagggcttgtcgctggcgagactgcacagcaaatatgcgaagatttgcgtctttgtattcccagtacagggcctctc

SEQ ID NO: 32790 - DNA, 435 bp, Artificial Sequence
  Description of Artificial Sequence: Synthetic coding sequence
atggccacatgggccctgctgctgcttgctgccatgttgttggggaacccaggtctggtgttttccagactgtcgcccgagtactacgaccttgctagggcacacttgcgggacgaagaaaaatcttgtccctgtctggcgcaggagggtccccagggggacttgctgactaagacccaggagcttgggagggattacaggacatgtctgaccatcgtccagaaactaaagaagatggtagacaagccaacccagaggtcagtgagcaacgcagcaacacgggtctgcagaacagggcggagcaggtggagagatgtttgccggaattttatgagacgctatcagtcccgcgtcacgcaaggcctagtggcaggtgaaaccgctcagcaaatttgcgaggatctgcggctgtgtatcccatccacagggcctctg

SEQ ID NO: 32791 - DNA, 435 bp, Artificial Sequence
  Description of Artificial Sequence: Synthetic coding sequence
atggcgacttgggctctgctgctgctcgccgctatgctgctgggaaaccctggtctggtcttttcgcggctcagcccggagtactacgatctcgcgcgcgcccatctgcgggatgaagagaagagctgcccgtgcctggcccaagaggggccgcagggtgacctgcttaccaaaactcaggagttgggccgcgactaccgtacttgcctcaccatcgtgcaaaagctgaagaagatggtggacaagcctacccagcggtcggtgtccaacgcagcgactcgggtctgccggactggacggtcccggtggcgggacgtgtgcagaaatttcatgcgccggtaccagtcgcgggtcacccaaggactcgtggccggagaaacggcccaacagatctgcgaggacctcaggctctgtatcccgtccacgggcccactc

SEQ ID NO: 32792 - DNA, 435 bp, Artificial Sequence
  Description of Artificial Sequence: Synthetic coding sequence
atggccacttgggcgctcctgctcctggctgcaatgttgctcggcaacccaggcctcgtcttcagcaggctctccccagaatactatgatcttgccagagctcacctcagggacgaggagaaatcctgtccctgcctggctcaggaaggccctcaaggtgacctgctgaccaagacccaggagctgggccgcgactatcgcacgtgtctcactattgtgcagaagctgaagaagatggttgataaacctactcaaagatccgtgtccaacgcagctacccgcgtatgccgcacaggccgctccaggtggagggacgtgtgccgcaacttcatgcgccgctaccagagcagggtgactcagggcctggtggccggagagactgctcaacagatctgcgaggacctccgcctgtgtattccttctaccggccctctg

SEQ ID NO: 32793 - DNA, 435 bp, Artificial Sequence
  Description of Artificial Sequence: Synthetic coding sequence
atggctacttgggcgctgctgctcctggcagctatgctgttggggaaccctggtctggtgttctcacgcctgtcccctgagtactacgacttagctagggcccatctccgagatgaggagaagagttgcccgtgtctggcacaggaggggcctcaaggggatctcttaaccaaaactcaagagctggggagggactacaggacctgcttaacaatcgtgcagaaactcaagaagatggtggacaaaccaacccagcgctcggtaagcaatgctgctacccgggtgtgtaggactggacggtcacggtggcgcgatgtgtgcaggaatttcatgcgccggtatcagtcgagagtcacgcaggggctagtggccggggaaaccgcgcagcaaatatgcgaagacctcagattgtgcattccctccacgggtccgttg

SEQ ID NO: 32794 - DNA, 435 bp, Artificial Sequence
  Description of Artificial Sequence: Synthetic coding sequence
atggcgacttgggcattgctgctcctggccgcgatgctgctgggcaacccgggactggtgttctcccgtctctcgccagagtactacgatctcgcgcgcgcgcacctgagggacgaagagaagtcgtgcccgtgcctggcccaagaaggaccccagggagatctcttgaccaagactcaagaactcggccgcgactaccggacttgccttacgatcgtccaaaaactgaaaaagatggtggataagccaacccagcgctcagtctcaaacgccgctacccgcgtctgccggactgggcggagccgctggcgagacgtgtgtcggaacttcatgcgccgctaccagtcgagggtgacccagggactcgtggccggcgaaaccgcacagcaaatctgtgaggacctgagactgtgtattccgtccaccggacctctg

SEQ ID NO: 32795 - DNA, 435 bp, Artificial Sequence
  Description of Artificial Sequence: Synthetic coding sequence
atggcaacgtgggcacttctgctgctcgctgccatgttgcttggcaaccctggactcgtgttttccaggctgtctcctgagtactacgacctggcacgcgcgcacctgagagacgaagaaaagtcatgcccgtgtctcgcccaagagggccctcaaggtgacctgctcaccaagacccaggagttgggaagagattatcgcacctgcttgactatcgttcaaaagctcaagaaaatggtggataagccgactcagaggtcggtgtccaatgccgccacccgagtctgccgtacgggacgctcaaggtggcgcgacgtgtgccgcaacttcatgagacgctaccagagtagagtgactcaggggctcgtcgctggagaaactgcacagcagatctgtgaagatttgcgcctctgcattcctagcaccggtccgctc

SEQ ID NO: 32796 - DNA, 435 bp, Artificial Sequence
  Description of Artificial Sequence: Synthetic coding sequence
atggccacttgggctcttctgctactggcggcaatgctgttggggaacccaggcctggtattctctcgcctctcccccgagtattacgacctcgccagagcgcatcttcgcgatgaagaaaaaagttgcccttgtttggctcaggaagggcctcagggggatttactgaccaagactcaggagctgggtagggactaccgaacctgcctaacgattgtgcagaagttaaagaagatggtagacaagcccactcagaggagcgtctctaatgctgctacccgggtgtgcaggactggacgttcaaggtggcgcgatgtgtgtcgaaacttcatgcgcaggtaccagtccagggtgactcagggcttggtggcaggagagactgcccagcagatttgcgaggatttacgactttgtataccatccactggaccgctc

SEQ ID NO: 32797 - DNA, 435 bp, Artificial Sequence
  Description of Artificial Sequence: Synthetic coding sequence
atggctacctgggcacttttgctgctggccgctatgcttcttggaaatccgggtctggtcttttccagactttccccagaatactacgatctggccagagcacacctccgcgacgaagaaaagagctgtccttgtctggcacaagagggacctcagggagatctccttactaagactcaagaactcggccgcgattaccggacttgtctgaccattgtgcaaaagctgaaaaagatggtggataagccaactcaacgctcggtgagcaacgctgcaactagagtgtgtcgaactggtcgatcacgctggagggacgtgtgcagaaacttcatgaggaggtaccagtcaagagtgacccaaggtctggtcgccggagaaaccgcacagcagatatgtgaggaccttagactttgtattccttctaccgggcctctg

SEQ ID NO: 32798 - DNA, 435 bp, Artificial Sequence
  Description of Artificial Sequence: Synthetic coding sequence
atggcaacatgggcacttcttcttctggctgctatgctactcggaaaccctggactggtattttctcggcttagtccagaatattacgatttagcgagggcccatttaagagacgaagagaaatcttgcccctgcctggctcaagaaggaccacagggagacctcctgactaaaacacaggaattagggcgcgattataggacatgtcttactattgttcaaaagttaaagaagatggtagataaacccacacaacggtccgtatccaatgcagctacaagagtgtgccggacaggaaggtccagatggagagatgtctgtcggaatttcatgcgacgctatcagtcacgggtgacacagggattagtggcaggggagactgcgcagcagatttgcgaagaccttaggctgtgcatcccctcaactgggcccctc

SEQ ID NO: 32799 - DNA, 435 bp, Artificial Sequence
  Description of Artificial Sequence: Synthetic coding sequence
atggccacgtgggctctccttctgctcgccgccatgctcctgggtaatccagggctggtcttcagcagactctcgccagaatattatgacctggcacgcgcccatttgcgagatgaagaaaagtcgtgcccctgcctcgcgcaggagggtcctcagggagacctgctgacgaagacgcaggagttgggcagggattatcgcacgtgcctaaccattgtacagaaactgaaaaagatggtggataaacccacccaacgttcagtcagcaatgccgccacccgtgtgtgtcgcacaggccgctcgcgttggcgcgacgtgtgtcgaaacttcatgcggagataccagagcagagtgactcagggactcgttgccggcgaaaccgctcaacagatttgcgaggatctgcgactttgcatcccgtcgacaggccctctc

SEQ ID NO: 32800 - DNA, 435 bp, Artificial Sequence
  Description of Artificial Sequence: Synthetic coding sequence
atggcaacttgggcccttcttttgctcgcagcaatgctgctgggaaacccagggctcgtcttttcacgcctctcgccagagtactacgatctcgctagagcccatctgcgggacgaagaaaaatcctgtccttgcctggcacaggaaggacctcagggggatctgctcaccaagactcaagaactcggtcgagactaccggacctgtctgacgatagtccagaaactcaagaagatggtggataagcctacccagagaagcgtgtcgaacgccgcgacccgtgtgtgtcgaactggtcgtagccgctggagagatgtgtgtaggaatttcatgagacgataccagtcgcgggtcacccaaggactggtggcaggcgaaaccgcacagcaaatctgcgaggatttgagactctgtatcccgtcgaccgggcctctg

SEQ ID NO: 32801 - DNA, 435 bp, Artificial Sequence
  Description of Artificial Sequence: Synthetic coding sequence
atggcgacttgggcactccttctcctcgccgctatgcttctgggtaaccctggtcttgtcttttcaagactttcacctgagtactacgacctcgccagggcacatcttagagatgaggaaaaatcgtgcccttgtcttgcgcaggaagggcctcagggagatctgcttaccaagacccaggagttgggccgagattaccgcacttgcctgactattgtgcaaaagctgaagaagatggtcgacaaacccacccaacgaagcgtcagcaacgccgcgaccagggtctgcaggaccggcagatcgcgctggcgtgatgtgtgtcggaactttatgcgcagatatcagtcccgtgtcacccaagggctggtggcaggtgaaacggcacaacagatttgcgaggatcttcgcctttgtattccttccaccggacctctt

SEQ ID NO: 32802 - DNA, 435 bp, Artificial Sequence
  Description of Artificial Sequence: Synthetic coding sequence
atggccacctgggctctgctccttctggcagctatgctcctgggtaaccctggccttgtcttttcgagactgtcccctgagtactacgaccttgcacgtgcccatcttagagacgaggaaaagagctgcccctgcctggcccaagaaggaccccagggagatctgctgacgaaaactcaggaacttggaagagactacaggacctgcctcaccattgtgcaaaagctgaagaagatggtggacaaacctacgcagagatccgtgtcaaatgcagcaactcgggtttgtcgcactggaagaagcaggtggagagatgtgtgtaggaactttatgcgacgctaccaatccagagtgacccaaggccttgtcgccggcgaaaccgctcagcaaatctgtgaggatctgagactgtgtattccatcgaccggtcctctc

SEQ ID NO: 32803 - DNA, 435 bp, Artificial Sequence
  Description of Artificial Sequence: Synthetic coding sequence
atggcaacttgggccttactgctgctggccgcgatgctgttgggcaaccctggtttggttttctcgcgtctttccccagagtactacgacctggctcgagcacatctgcgcgacgaagagaagtcttgcccgtgcctcgctcaggaaggtccccaaggcgacctgctgactaagacacaagaactcgggagagactacaggacttgtctcaccatcgtgcagaagctgaaaaagatggttgacaaacccacgcagcgtagcgttagtaacgcggccaccagggtgtgtcgaacgggccgcagtcgctggcgggacgtttgccggaactttatgcgccggtatcagtcgcgggtcactcagggtctggtggccggtgaaactgctcaacaaatctgtgaggatctcagactttgtatcccatctaccggccctctg

SEQ ID NO: 32804 - DNA, 435 bp, Artificial Sequence
  Description of Artificial Sequence: Synthetic coding sequence
atggccacatgggctttgctgttgctggctgcgatgctgttagggaatccagggctcgtgttttcgcgactcagtccagaatattatgacctggcacgggcccatctgagagatgaagagaagagctgtccctgtctggcccaggaaggccctcagggtgacttactgactaaaacacaggaactaggtagggattacagaacatgcctgaccattgttcaaaaattgaagaaaatggtggacaaacctacccagcggtccgtgagcaacgcggcaacacgtgtttgtagaaccggacgttctcgctggagggatgtgtgtcgcaatttcatgcgtaggtatcaatcaagggttacccagggcctcgttgctggggaaacggcccagcaaatctgtgaagacctgcgcctgtgtataccttccactggtcctctg

SEQ ID NO: 32805 - DNA, 435 bp, Artificial Sequence
  Description of Artificial Sequence: Synthetic coding sequence
atggcaacttgggcgctccttctcctggccgccatgctcctcggaaacccgggacttgtcttttcgagactttcgccggaatactacgatcttgcgagagctcacctgcgcgatgaagaaaagtcgtgtccgtgcctggctcaagaggggccgcagggtgacctgcttaccaagacccaggaactgggccgcgactataggacctgcctgaccattgtccaaaaactgaagaaaatggtggacaagccgacgcagaggagcgtgtcaaatgcagccactcgcgtttgtcgcaccggccgctctcggtggcgggacgtctgccgcaatttcatgagacgctaccagtcgcgggtcactcagggactcgttgcgggtgaaaccgcccaacaaatctgtgaggacttgcgcctgtgcatcccatccaccggaccgctg

SEQ ID NO: 32806 - DNA, 435 bp, Artificial Sequence
  Description of Artificial Sequence: Synthetic coding sequence
atggccacatgggcgctgctgctgctggcagcaatgctattgggaaacccaggattggtttttagccgcctgagtccagaatattacgatctggccagagcgcacctgagagatgaagaaaaatcctgtccatgccttgcccaggaagggccacagggagacctgctcactaagacccaggagctaggtagggactatcgcacctgtttaacaattgtccagaaactgaagaaaatggtggacaagcctacccaaaggtctgtctcaaatgctgcgacgagggtgtgccgtacaggaagatcgaggtggcgtgacgtctgtaggaactttatgcgccgttatcagtctcgcgtgacgcagggtcttgtggcaggtgagactgcacagcagatatgcgaggatcttagactatgtattccgagtaccgggcccttg

SEQ ID NO: 32807 - DNA, 435 bp, Artificial Sequence
  Description of Artificial Sequence: Synthetic coding sequence
atggctacatgggctctgttgcttctggctgcaatgctgctgggcaaccctggattggtgttctctaggttgtctcccgaatactacgacctcgcacgtgctcacctcagagacgaagagaaaagttgcccatgcctggcacaagagggacctcaaggtgacctcttgacaaagactcaagaactgggaagggattaccgtacttgtctgaccatcgtgcagaaattgaagaagatggtcgacaaaccaactcaacgctccgtatccaacgcagccaccagagtttgtaggactggacgttcaaggtggcgcgatgtgtgccgcaactttatgagacgttaccagagccgcgttacccaaggacttgtggcaggcgagactgctcagcagatttgcgaggatctccgcctctgcatcccctccacaggccccttg

SEQ ID NO: 32808 - DNA, 435 bp, Artificial Sequence
  Description of Artificial Sequence: Synthetic coding sequence
atggctacgtgggccctcctcctgttggcggcaatgctgctgggaaatccgggtttggtcttttcacgcctgtccccagagtactacgatctggcacgcgcccaccttagagacgaggaaaagtcctgtccgtgcttggctcaggagggaccacaaggcgatctgcttaccaagactcaggaactcggtcgggactaccgcacttgcctcactattgtgcagaagctcaagaagatggtggacaagccgacccagcggtccgtgtcgaatgcggcaacccgggtgtgtcgaaccggaagatcacgctggagagacgtgtgtagaaacttcatgcggcggtatcaaagccgcgtgactcaggggctggtggctggagaaactgcgcaacagatctgcgaagatctgcggctctgcatcccatccactggtccactg

SEQ ID NO: 32809 - DNA, 435 bp, Artificial Sequence
  Description of Artificial Sequence: Synthetic coding sequence
atggccacgtgggctctgttgctcctagcagcaatgcttctcggtaatccgggtctggtgttctcaagactgtcgcctgagtattacgacctcgcacgggcccaccttagggatgaagaaaagagttgcccgtgcctggcgcaggagggtccacaaggggatctgctgaccaaaacccaggaacttgggcgcgactaccgaacttgtctgacaatcgtgcagaagctgaaaaagatggtcgacaaacccacacagcgtagtgtgtcaaacgcagccaccagagtttgccgtaccggacggtctagatggcgggatgtgtgcagaaacttcatgaggaggtaccaatccagggtaactcaggggctagtcgctggcgagacagcgcagcagatttgtgaagaccttcggctttgtataccatctaccggacctctt

SEQ ID NO: 32810 - DNA, 435 bp, Artificial Sequence
  Description of Artificial Sequence: Synthetic coding sequence
atggccacctgggcactcctcctgctggccgcaatgctcttgggaaaccccggactcgttttttctagactatccccagaatactacgaccttgctagagcgcacttgcgggacgaggagaagtcttgtccgtgccttgcccaggagggacctcagggcgaccttctgaccaagacccaagaacttgggcgggactaccgcacctgtttgaccatagtgcagaagttgaagaaaatggtagacaaacccacgcaaaggtccgtgagtaatgccgctacccgggtgtgcaggactgggaggtcccgatggagagatgtgtgtaggaactttatgcgtcgataccagagcagggtcacccagggacttgtcgcgggtgagacggcccaacagatttgtgaggaccttcggttgtgcataccatcaacgggccctctc

SEQ ID NO: 32811 - DNA, 435 bp, Artificial Sequence
  Description of Artificial Sequence: Synthetic coding sequence
atggcaacctgggcgctcttgcttctggctgcgatgctcctcggaaacccaggccttgttttttcccgcctgtcgccagaatactacgatctcgcgcgcgcccacctgcgggacgaagagaagtcgtgcccttgcttggcccaggaggggccgcagggcgacctcctgaccaaaacccaggaactcggtcgggattacaggacttgcctgactattgtgcaaaagctgaagaaaatggtcgacaagccgactcagcgcagcgtgtctaacgcagctacgagagtgtgccgaactgggagaagcagatggcgggatgtgtgccgcaatttcatgcggcggtaccaatcaagggtgacccagggactggtcgccggagaaaccgcccagcaaatctgtgaggacctgcgcctgtgtatcccgtccactggacccctg

SEQ ID NO: 32812 - DNA, 435 bp, Artificial Sequence
  Description of Artificial Sequence: Synthetic coding sequence
atggcaacatgggctctgctgctgctggcagctatgctcctgggaaaccccgggcttgttttcagccgccttagcccagagtattacgacctggcaagagcccaccttcgagatgaagaaaaatcttgtccatgtctggcccaggaagggcctcagggagacttgttaaccaagactcaggaactgggcagggactaccggacctgcctgacaatcgtgcaaaaactgaagaaaatggttgacaagcccacccaacgctctgtgtcaaatgccgccacacgggtttgccggaccgggcgttcccgttggcgggacgtgtgccgtaatttcatgcgcagataccagtccagagtaacccagggtctcgtagcgggtgaaacagcccagcaaatctgcgaggaccttaggctatgcataccttctacaggccctctc

SEQ ID NO: 32813 - DNA, 435 bp, Artificial Sequence
  Description of Artificial Sequence: Synthetic coding sequence
atggctacgtgggccctgcttctgctcgccgccatgctcctcgggaacccggggctggtgttctccagattgtcccccgagtactacgatttagccagagctcacctgcgggacgaggagaaaagttgcccatgcttggctcaggaaggcccacaaggggacctgctgactaaaacccaggagctgggaagagactacagaacctgtcttacgattgtacagaagcttaaaaaaatggtcgataaaccaacccagagatccgttagcaacgctgctactcgggtatgtcgtacgggaaggtctcgctggagggacgtgtgtcggaactttatgaggcgatatcaaagtcgggtgacacaaggcttggtcgctggcgagaccgcccagcagatctgcgaggatctgcggctctgcatccctagcactggaccactg

SEQ ID NO: 32814 - DNA, 435 bp, Artificial Sequence
  Description of Artificial Sequence: Synthetic coding sequence
atggccacttgggctttgttactgttggccgcgatgttactcgggaaccccggcttggtgtttagtcggctaagtccggagtactatgacctggctagggcccacctgagagacgaggagaagtcctgcccttgccttgctcaagagggcccacagggggacctgttgactaagacacaggaactgggtcgcgactatcggacatgtctgactatcgttcaaaaacttaaaaaaatggtggacaagccaactcagcgctccgtctctaatgctgctaccagggtttgtcggaccggacgctcacggtggagagacgtttgccggaattttatgcggagatatcagtctcgggttacccagggccttgtcgctggggagactgctcagcagatctgcgaagacctgagactatgcatcccttcaacagggcccctg

SEQ ID NO: 32815 - DNA, 435 bp, Artificial Sequence
  Description of Artificial Sequence: Synthetic coding sequence
atggctacctgggcccttctgctcctcgccgccatgctgctgggtaaccctggactggtgttcagtcgactgtctcctgaatattatgacctggctcgggcgcacctgcgggacgaagagaagtcctgtccatgccttgcacaggagggtccgcaaggggatttgctcacaaaaactcaggagttgggcagggattaccgcacctgtctaaccatcgtacaaaaactcaagaagatggttgacaagcccactcagaggagtgtgagtaatgccgcaacacgcgtatgccggaccggcagaagtagatggcgggacgtgtgtcgaaacttcatgcgccgctaccagtccagggtgacacaggggcttgtcgccggggagacagcacagcagatttgtgaagatctgaggctttgcatccccagcacaggcccctta

SEQ ID NO: 32816 - DNA, 435 bp, Artificial Sequence
  Description of Artificial Sequence: Synthetic coding sequence
atggctacctgggccctgctcttgctggccgcgatgctcctggggaatccgggtttggtgttcagcagactctcacctgaatactacgatttggcgcgtgcccatctccgcgatgaagagaagagctgcccatgcctcgctcaggaaggaccgcagggtgaccttctcactaagacccaagagctcggacgtgattacaggacctgtctgactatcgtgcagaagctgaaaaagatggtagacaaaccaacccaaaggtcagtgtcgaacgccgctactcgcgtgtgccggaccggacgctcccgctggcgcgacgtgtgtcggaacttcatgagaagataccaatcccgcgttacgcaaggattggtcgccggagaaactgctcagcagatttgcgaggacctccggctttgtatcccctcgacgggccctctt

SEQ ID NO: 32817 - DNA, 435 bp, Artificial Sequence
  Description of Artificial Sequence: Synthetic coding sequence
atggccacctgggctctactgcttcttgcagccatgctcctgggtaaccctggcctcgtattctcccggctctcacccgagtactatgacctggcccgagcgcacctgcgggacgaggaaaagagctgcccctgtttggcacaggaaggaccccagggcgaccttctaaccaagacccaggaactcggtagggactaccggacatgtctgacgatcgtccaaaagttgaagaagatggtggacaaaccaacacagcgatccgttagtaacgctgctactagggtgtgccggactggccgttctaggtggcgcgacgtctgtcgcaatttcatgaggcgataccagagccgcgtaacgcagggcttggtggcaggggagacggcacagcagatctgtgaggatttgagactgtgcatcccatccactggcccccta

SEQ ID NO: 32818 - DNA, 435 bp, Artificial Sequence
  Description of Artificial Sequence: Synthetic coding sequence
atggccacttgggctctgctcctcctcgctgccatgctgctgggaaacccgggcttggttttttctcggctctccccagagtactacgacctcgcgcgggcgcatttgcgggatgaagaaaaatcctgcccttgcttggcccaagaagggccacagggagatctgctgaccaagacgcaggaactgggacgagattacagaacttgcctcaccatcgtccagaagttgaagaagatggtggacaagccgactcaacggtcggtgtccaacgccgcaacccgggtctgcaggaccggcagatcacgctggcgagatgtgtgtcgcaatttcatgcgcaggtatcaatcgcgcgtgacgcagggactggtggccggggagacggcccaacagatctgtgaggacctccgcctctgcatcccgtctaccggcccgttg

SEQ ID NO: 32819 - DNA, 435 bp, Artificial Sequence
  Description of Artificial Sequence: Synthetic coding sequence
atggctacatgggctctgctgctgcttgctgcaatgttgttggggaaccccgggctggttttcagccggctgagtccggaatactatgatttggcccgagcacatctaagagacgaggaaaaatcctgtccttgcttagcacaggagggccctcagggcgatcttctgacgaaaacacaagagctgggtcgggactataggacttgcttaacaattgtccagaagctgaaaaagatggttgacaagccaactcaacgcagcgttagcaacgcagccacgagagtttgtcggactggccgctcacgttggcgtgatgtttgccgcaatttcatgcgacgctatcagtctcgggtgacgcagggccttgttgctggggaaacggcccagcagatctgcgaggacctacggctttgtattccctccaccggtcctctt

SEQ ID NO: 32820 - DNA, 435 bp, Artificial Sequence
  Description of Artificial Sequence: Synthetic coding sequence
atggcaacctgggcccttcttctcttggcagcgatgctgctggggaaccccggtctggtctttagccgcctctcccccgaatactacgatcttgcgagagcacatttgagagacgaagagaagtcttgtccgtgccttgctcaggaaggccctcaaggcgatcttctgaccaagactcaagaactgggacgcgattacagaacgtgcctcacgatcgtgcaaaagctgaaaaagatggtggacaaaccaactcagcggtcagtctctaatgcagccaccagggtttgtcggactggacggagcaggtggcgagatgtgtgccgcaacttcatgagacgctaccagtcgagagttactcaaggtcttgtggcaggagagactgcccagcaaatttgtgaggacttgcggctttgtattccttcaaccggtccactt

SEQ ID NO: 32821 - DNA, 435 bp, Artificial Sequence
  Description of Artificial Sequence: Synthetic coding sequence
atggcaacctgggcgcttctgctccttgctgctatgctcctgggcaacccagggctcgtattttcccgcctttcgcccgagtactacgacctggccagagcccatctgcgtgatgaagaaaaatcgtgtccttgcctggcgcaggagggcccgcaaggtgatttgttgactaagacccaagagctgggacgcgactatcgaacctgtcttaccatcgtacagaagttgaaaaagatggtcgataagcctactcaaagatcagtgagcaatgcagcaaccagagtctgccgaactggaagatcccggtggcgtgacgtgtgcaggaacttcatgaggcgttaccaaagccgggtgactcaaggacttgtggccggtgaaaccgcacagcagatttgtgaagatctccgactctgtattccatccactgggccactt

SEQ ID NO: 32822 - DNA, 435 bp, Artificial Sequence
  Description of Artificial Sequence: Synthetic coding sequence
atggcaacttgggcactgctccttctcgctgccatgctgctcggcaaccctgggttggtcttttctcgattgagcccggagtactatgatctggcacgggcccatcttcgggatgaagaaaagtcttgcccatgcctggctcaggagggtccccagggcgatctgctgaccaaaactcaggaactggggcgcgattatcggacgtgcctcaccatcgtgcagaaactgaagaagatggtagataagcccacacagagatccgtatctaatgcagccacgcgcgtgtgtaggactggacggagtcgctggcgggatgtctgcagaaatttcatgcgccggtaccaaagccgcgttacgcagggactcgtggctggcgagactgcacagcagatttgcgaggatctccgactgtgtattccgagtaccggccctctc

SEQ ID NO: 32823 - DNA, 435 bp, Artificial Sequence
  Description of Artificial Sequence: Synthetic coding sequence
atggcgacttgggccctgctcctactggcagcaatgctcttaggtaatccgggccttgtgtttagccgcctgtcccctgaatactacgatctagcacgtgctcacctgcgggatgaggaaaagtcatgtccatgtctggcccaggaaggacctcaaggtgatttgctcacgaagactcaggaactgggtagagattacaggacgtgcttaacgattgtgcagaaactgaaaaaaatggttgataagcctactcagaggtctgtgtcgaatgccgccacaagagtatgtcggaccggaaggagccgctggcgagatgtatgtagaaatttcatgaggcgctatcagtctcgcgttacacagggcttagtagcaggggaaactgcccaacagatatgcgaggacctgcggttgtgtatcccatcaaccggacctttg

SEQ ID NO: 32824 - DNA, 435 bp, Artificial Sequence
  Description of Artificial Sequence: Synthetic coding sequence
atggccacgtgggctcttttactacttgctgcaatgctcttaggaaaccctggactcgtgttttcccgtctttcccctgagtactacgatctagctagagcacacttgcgggatgaggaaaagtcatgtccgtgcctggcccaagaaggaccgcaaggtgatctgctgaccaaaacccaggagctgggaagggactaccgcacttgcctgacaatcgtgcagaagcttaagaagatggtcgacaagcccactcaaaggtcagtgtcaaacgcggcgaccagagtttgcaggacaggaagaagcagatggcgcgatgtgtgccgcaattttatgagaagatatcaaagccgtgtcactcagggtctggttgctggagagacagcgcaacagatctgtgaggacctgagactgtgcatccctagcactgggccgctg

SEQ ID NO: 32825 - DNA, 435 bp, Artificial Sequence; identical to SEQ ID NO: 32812
  Description of Artificial Sequence: Synthetic coding sequence

SEQ ID NO: 32826 - DNA, 435 bp, Artificial Sequence
  Description of Artificial Sequence: Synthetic coding sequence
atggccacctgggcactcctgcttctggcggccatgctgctggggaatcctggtctggtgttttcacggctgagccctgaatactacgatcttgcacgcgcgcacctgcgcgatgaggagaagtcgtgtccgtgcctcgcacaagaaggccctcagggagatctccttaccaaaactcaagaactcggcagagactacagaacttgccttaccatcgtgcaaaaactgaagaagatggtggataaacctacccaaagatcagtctctaacgcagcaacccgtgtgtgtcgaactgggagatcaagatggcgcgatgtgtgtcggaatttcatgagacggtaccagtcgcgtgtgacccagggactggtggcaggtgagactgcccaacaaatctgcgaggaccttcgactgtgtatcccatcgaccggccccctg

SEQ ID NO: 32827 - DNA, 435 bp, Artificial Sequence
  Description of Artificial Sequence: Synthetic coding sequence
atggcaacctgggcccttttgctcctggcagccatgctgctgggaaatcccggacttgtgttttcccgtctgtcgcctgaatactacgaccttgccagagcacatctgagagatgaagaaaagtcctgtccttgtctggcgcaagaaggtcctcaaggagatctgttgaccaagacccaagagttgggtagagattaccgaacctgcctcaccatcgtccagaagctgaagaagatggtggataagccaacccagcgctcggtgtcgaacgctgcgactcgcgtgtgtagaaccggaaggagccggtggcgggatgtgtgccggaactttatgcgcagataccagagccgagtcactcagggtctggtcgcaggagaaactgcacaacaaatttgtgaggacctgcggctttgtattccttcaactggtccgctg

SEQ ID NO: 32828 - DNA, 435 bp, Artificial Sequence
  Description of Artificial Sequence: Synthetic coding sequence
atggccacctgggcacttttgctgcttgcagcaatgcttcttggaaatcctggccttgttttctctcgactgtccccggagtactatgatctcgcgcgcgcacacttgagggacgaagaaaagagctgtccatgtctggcccaggaaggacctcagggtgatctgcttacgaaaacccaggaactgggacgtgattacagaacgtgtttgactattgtgcaaaaactgaagaagatggtggacaagccaactcaacgatcggtatcaaacgcagcgaccagagtgtgcaggactggtcggtcgcgctggcgagatgtgtgtagaaactttatgcgccggtaccaatcccgggtgactcagggtcttgtcgcaggcgagactgctcaacagatctgcgaggatcttcgactgtgcattccttcgaccggtcctctg

SEQ ID NO: 32829 - DNA, 435 bp, Artificial Sequence
  Description of Artificial Sequence: Synthetic coding sequence
atggcgacgtgggctttgctgctcctggcagcaatgctccttgggaacccaggactggtgttctctagactgagccctgagtactacgaccttgccagggcgcatctgcgggatgaagagaaaagctgtccctgcctggctcaagagggaccacagggagatctccttacaaagacacaggaattgggcagggactatcgcacttgcctcaccatcgtccagaaattgaaaaagatggttgacaaaccaacacagagaagtgtaagcaacgcagcgacaagggtatgtaggacagggagaagccgctggagggacgtttgcagaaactttatgagaaggtaccagagtcgagtcacgcaggggctggtggccggggagacggcgcaacaaatatgcgaagatctgcgcctgtgcattccaagtacaggtccactg

SEQ ID NO: 32830 - DNA, 435 bp, Artificial Sequence
  Description of Artificial Sequence: Synthetic coding sequence
atggcaacttgggccctgctgttactcgcggccatgctgttgggtaaccccggcctggtcttttccaggttgtcccccgaatattacgacctggctcgggcccacctacgggatgaggaaaaatcttgtccgtgcctcgcccaggaaggaccacagggagatctcctcaccaaaacccaggaactggggagagattataggacctgcctgacaatcgtgcaaaagctgaaaaagatggtcgacaaaccaacacagcggtcagtgagcaatgccgctaccagagtgtgcaggaccgggcggagccggtggagggacgtgtgcaggaactttatgagacgctatcagtcacgtgtcactcaggggctggtcgctggcgaaaccgctcaacagatatgcgaagacctcagactgtgtatcccctctacagggcccctg

SEQ ID NO: 32831 - DNA, 435 bp, Artificial Sequence
  Description of Artificial Sequence: Synthetic coding sequence
atggcaacctgggcgcttctccttctcgcagctatgctgctggggaaccctggcctggtgttttccaggttgagtcctgagtactatgatctcgcacgggcacatttgagagacgaggaaaagagctgtccctgtcttgcccaggaaggaccacagggtgaccttcttaccaagactcaagaactcgggcgcgactaccgcacctgccttacgattgttcagaaattgaaaaagatggtggataaaccgacccaacgatcagtctccaacgccgcaaccagagtgtgccgtaccggtcgttcaagatggagggatgtgtgtcgtaatttcatgcgccgctatcagtcaagagtgactcaaggactcgtcgccggtgaaactgctcagcaaatatgtgaagatctgcgtctttgcatcccatcgactggaccactg

SEQ ID NO: 32832 - DNA, 435 bp, Artificial Sequence
  Description of Artificial Sequence: Synthetic coding sequence
atggcaacttgggccctattgctgctcgctgcaatgctgttaggtaaccctggcttggtgttttccaggttgtccccagagtactacgatcttgccagagcacacctccgtgatgaagagaagagctgcccctgtctagcccaagaggggccgcagggtgaccttctaactaaaacacaagagttggggagggactataggacgtgcttgactatcgtgcagaagttgaaaaagatggttgataagcccacccagcgtagcgtgtcgaatgccgctacaagagtgtgtcggaccggaagatctaggtggcgagatgtgtgccggaatttcatgagaagatatcagtctcgtgtcactcaggggctggtagcgggcgaaacggctcagcaaatatgcgaggacctgcggctgtgcattccatctacggggcctctg

SEQ ID NO: 32833 - DNA, 435 bp, Artificial Sequence
  Description of Artificial Sequence: Synthetic coding sequence
atggccacttgggcccttctcctcctggcagccatgttgctggggaatcccggattggtctttagccgcctgtcccccgagtactatgacttggctcgcgcccacctccgagacgaggagaagtcatgcccttgcctggctcaggaggggcctcagggggatttgctgaccaagactcaggagttggggagggattacagaacgtgtcttacgatcgtgcagaagctgaagaaaatggtggacaagcctactcagaggagcgtgtcaaatgcagccactagggtgtgcaggaccggacgctcaaggtggagggatgtatgtagaaactttatgagaagatatcagtcacgcgtgacgcagggtttggtagctggtgagactgcacagcagatttgtgaggaccttcgactttgtattcccagtaccggtcctctt

SEQ ID NO: 32834 - DNA, 435 bp, Artificial Sequence
  Description of Artificial Sequence: Synthetic coding sequence
atggccacgtgggctctgctgctcctggccgcgatgctcctggggaacccgggtttggtgttcagcagattgtcgccagagtactacgacttggctcgcgctcatctgcgcgatgaggagaagtcctgcccctgtctcgcacaggagggaccacaaggagatctgctcactaagactcaggaactgggacgcgactaccgcacttgcctgactatcgtgcagaagttgaaaaagatggtggacaagcctacgcagcggagcgtctcgaacgcggccactagagtctgccggactggacgctcgcgctggcgggacgtgtgcagaaactttatgaggcggtaccagagccgcgtgacccagggcctggtcgccggagaaaccgcccaacagatttgcgaggacctgcgcctgtgtatcccgtcgactggacctctg

SEQ ID NO: 32835 - DNA, 435 bp, Artificial Sequence
  Description of Artificial Sequence: Synthetic coding sequence
atggccacttgggcgctgctgcttctggcagctatgctgctgggaaaccctgggctggtgttttcgcgcctgtcccctgagtactatgacctcgcccgcgctcatctgcgggacgaagagaaatcctgcccctgcttggcacaggaaggaccgcagggtgatcttctcaccaagacccaggaactcgggcgggactaccggacctgtcttaccatcgtccagaagctgaagaagatggttgacaagccgacgcaacgcagcgtgtcgaatgccgctacccgggtctgcagaactggacgctcacggtggcgcgacgtgtgtagaaactttatgagacgctaccaatccagagtcactcaggggctcgtggccggcgaaaccgcccagcagatttgcgaggacttgagactgtgcatcccttccaccggaccattg

SEQ ID NO: 32836 - DNA, 435 bp, Artificial Sequence
  Description of Artificial Sequence: Synthetic coding sequence
atggccacgtgggcgctgctgctcctggctgcgatgctgctgggaaaccccggtttggtcttttctcgcctgagccctgagtattatgatttggcccgagcgcatttgagggatgaagagaagtcctgtccttgcctggcgcaagagggaccccaaggtgatctcctaaccaagactcaggaactggggagggactaccgcacatgcctgactattgtgcagaaactgaagaagatggtcgacaagcctacacaacgtagcgtgtctaacgctgctacgcgggtctgtcggactggcaggtccagatggcgcgatgtctgcaggaactttatgcgccggtatcagtcccgtgtgacacagggccttgtggcaggagagacagcgcagcaaatctgcgaagacctgcggctgtgcatcccctcaactggacctctg

SEQ ID NO: 32837 - DNA, 435 bp, Artificial Sequence
  Description of Artificial Sequence: Synthetic coding sequence
atggcaacgtgggctctcctgctgctggcggccatgctgctgggcaatccggggctggtgttctcgcggctgtcgccggaatactatgacttggcaagggcgcacctccgcgacgaggagaagtcttgcccctgccttgctcaggaggggccacagggagatctgctgactaagacccaagaacttggtcgcgattacaggacctgtctgaccatcgtccaaaaactgaagaagatggttgataagcctacccagcgctcagtgtcgaacgcagctactcgcgtgtgtaggactggtagaagcaggtggcgggatgtgtgtagaaacttcatgcggagataccaaagccgagtgacccaggggctcgtggccggagagactgcccaacagatctgcgaggacctccggctctgcatcccgtcaacgggaccactc

SEQ ID NO: 32838 - DNA, 435 bp, Artificial Sequence
  Description of Artificial Sequence: Synthetic coding sequence
atggccacctgggccctgctgctgctcgccgctatgttgcttggaaaccctggactcgtgttcagcagactgtccccggaatactatgacctcgcgcgcgcgcatcttcgcgacgaagaaaaatcgtgcccatgcttggcccaagaggggccccaaggggacctcctcacgaaaacccaggaactgggcagagactacagaacttgcctgactatcgttcaaaaactcaaaaagatggtggacaagcccacccagagatccgtctccaatgctgccactagggtgtgccggaccggacgctcgcgctggcgggacgtgtgccgcaatttcatgcgccgctaccagtccagggtgacccagggactggtggccggcgagacggcccaacagatctgtgaggatctcagactgtgtatcccttccaccgggccactt

SEQ ID NO: 32839 - DNA, 435 bp, Artificial Sequence
  Description of Artificial Sequence: Synthetic coding sequence
atggccacctgggcacttctgctgttggcagccatgctgctaggaaatcctggtctcgttttctcccgcttatcccctgagtactacgatctggcccgtgcccacctgcgcgatgaggaaaaatcgtgcccgtgcctcgcacaagaaggtccccagggagatctgctgacaaaaactcaggagctgggtcgcgattatcggacatgcctcactattgtgcagaaactgaaaaagatggtcgataagccaacccaacgttcggtcagcaacgcggctacccgtgtgtgtcgcacgggtcgtagtcgctggcgcgatgtttgtaggaactttatgcgccgctatcagtcccgcgtcacgcaaggtctggtggcgggcgagacggcgcagcagatttgtgaggacctgcggttgtgcattcctagcacaggtccgtta

SEQ ID NO: 32840 - DNA, 435 bp, Artificial Sequence
  Description of Artificial Sequence: Synthetic coding sequence
atggctacctgggccctcttgcttcttgccgccatgttgctcggcaacccaggcctggtgttcagcaggctctcccccgagtactacgacctagctagggcccatctacgtgacgaagagaaaagctgcccttgtttggctcaagaaggtccacaaggcgatctgctgacaaagactcaggagttggggcgggactacagaacatgcctgacaatcgtgcaaaaactcaagaaaatggtggacaagcctacgcagcgatccgtgtctaatgcggccaccagggtgtgccggacagggcggagcagatggagggacgtgtgtaggaactttatgcgtcgctaccagagccgcgtgacccaaggattggttgcaggagagacggcacagcagatctgcgaggatctaagactgtgtatccctagcaccggcccactg

SEQ ID NO: 32841 - DNA, 435 bp, Artificial Sequence
  Description of Artificial Sequence: Synthetic coding sequence
atggccacatgggctttgcttctccttgccgctatgcttctggggaatccggggttggtgttctctagactatcgcctgagtactacgatctggcaagagcccacttgcgagatgaagagaaatcatgcccttgtctggcccaggagggtcctcagggtgatttactaaccaaaacccaggaactgggacgagactataggacttgtctgaccatagtgcagaaactgaaaaaaatggtggacaaaccgacgcagcgttccgtaagtaatgccgccactcgggtttgtaggaccggcagatccagatggcgggacgtctgcaggaatttcatgcggcgataccagtcccgggtgacccaaggtttggtagcgggagagactgcacagcagatatgcgaagacttgcggctctgtataccgagtaccgggcccctg

SEQ ID NO: 32842 - DNA, 435 bp, Artificial Sequence
  Description of Artificial Sequence: Synthetic coding sequence
atggcaacttgggcattgctgctgttggcagccatgctcctggggaatcctgggctggtgtttagccgtctgtcacccgaatactatgatcttgcacgggctcatcttcgcgatgaggaaaaatcctgtccttgcctggcgcaagaagggcctcagggcgatctgcttaccaagactcaagaacttggtcgagactacaggacttgcctgacgattgtgcagaagctgaagaagatggtggataaaccaactcaaagatcggttagcaatgcagcaacgcgagtctgtcgcactggacgatcaaggtggagagatgtttgtagaaactttatgaggcggtaccagagcagagtcacccaaggtttggtggcaggggaaactgcccaacagatttgcgaggatcttcgcctttgtatcccttctaccggtccactt

SEQ ID NO: 32843 - DNA, 435 bp, Artificial Sequence
  Description of Artificial Sequence: Synthetic coding sequence
atggcaacttgggctcttttacttcttgcagcaatgttactaggtaatccaggacttgttttcagtcgtttaagtccagaatattacgatttagcacgtgctcacttaagagatgaagaaaaatcgtgtccatgtttagctcaagaaggaccacaaggagatttattaactaagacacaagaactaggacgagattatagaacgtgtttaactattgttcaaaagttaaaaaagatggtagataaaccaacacaaagaagtgtaagtaatgctgctactcgtgtttgtcgaacaggaagatccagatggagagatgtttgtagaaactttatgagaagatatcaaagtcgtgttactcaaggacttgtagctggggaaacagcacaacaaatctgtgaagatttaaggctttgtattccatcaactggaccactt

SEQ ID NO: 32844 - DNA, 435 bp, Artificial Sequence
  Description of Artificial Sequence: Synthetic coding sequence
atggcgacttgggctctgctccttctggcagcgatgttgttgggtaatccgggcctggtgtttagccgcctctccccagaatactacgacctcgccagagcccatctgagggacgaggaaaagtcgtgcccctgcctggcccaggaaggaccccaaggagatctgctcactaagactcaggagcttggacgcgactaccggacctgcctgactatcgtccagaaactgaagaagatggtcgataaaccgacccagagatcggtgtccaacgctgcaacccgggtgtgtcggactggccgaagccgctggagagatgtgtgtcgcaacttcatgaggagataccagagccgcgtgacccagggactcgttgcaggggagactgcacaacagatctgcgaggatcttcgcctctgtataccgtccaccgggcccctg

SEQ ID NO: 32845 - DNA, 435 bp, Artificial Sequence
  Description of Artificial Sequence: Synthetic coding sequence
atggccacttgggcattactcctcctggcagccatgctgctcggtaacccaggactggtgttctctcggctgtccccagaatactacgaccttgcaagggcccatctgagagatgaagagaaaagctgtccatgtttagcccaggaaggcccgcagggggacctactaacgaaaacccaggagctgggtcgcgactatcgaacctgtctgaccatcgtccagaaactgaaaaaaatggtggacaaacccacacagaggtctgtcagtaatgccgctacacgtgtttgcagaaccggccgctcgagatggagggacgtgtgtagaaacttcatgcgtaggtaccagtcgagggttacgcagggcttggtcgcaggagaaactgcgcaacagatatgtgaggaccttagactgtgcattcccagcacgggtcccctc

SEQ ID NO: 32846 - DNA, 435 bp, Artificial Sequence
  Description of Artificial Sequence: Synthetic coding sequence
atggccacatgggctctccttctgctggctgccatgttgctaggcaacccaggcttggtcttctcccgactgagtcctgagtattatgatctggccagagctcacttaagggacgaagagaaatcatgcccctgcctagcccaggagggtccacaaggggacctgctaaccaagacccaggaactgggccgagattaccggacatgtctaacgatagttcagaagctgaagaaaatggtggacaagcccactcagcggtctgtctcgaacgcggccacacgcgtgtgtagaaccggtaggtctaggtggagagacgtgtgccgaaactttatgcggaggtatcagagccgtgttacgcagggcctcgtcgccggcgagaccgcacagcaaatttgtgaagacctaaggctttgtatcccatcaaccggacccctg

SEQ ID NO: 32847 - DNA, 435 bp, Artificial Sequence
  Description of Artificial Sequence: Synthetic coding sequence
atggctacctgggctctgcttctgctcgcagcaatgcttctcgggaatcctgggttagttttctctcgtttgagccccgagtactacgatttagccagagcacacctcagggacgaggagaagagttgtccttgcctcgcccaggaaggaccacagggagatctactcacaaagacccaggaactaggtcgcgactacagaacatgtttgaccattgtccaaaaacttaagaaaatggtagataagcccactcagaggtctgtttctaacgcggcaacacgagtgtgccgtaccggccggagtcgctggagggacgtgtgccgaaattttatgcgccgctatcagtctcgggtgacacaagggttggtggccggcgaaacagctcagcaaatctgtgaagatctccgactttgtatacccagcaccggcccactg

SEQ ID NO: 32848 - DNA, 435 bp, Artificial Sequence
  Description of Artificial Sequence: Synthetic coding sequence
atggctacttgggccctgctcctgctggccgccatgctactgggtaaccccggactggtcttttcccgacttagccccgaatattacgatcttgcccgggctcaccttcgggacgaggagaaatcctgcccatgccttgcccaggagggcccccagggcgatctattgactaagacacaggagttgggtagggactaccgcacttgcttgactatcgtccagaagctgaagaagatggtcgataagccgacacagaggtctgtttcaaatgccgccactcgagtgtgcagaacagggcgcagccggtggagagacgtctgcagaaatttcatgcggcgttaccaatctcgagtcacccagggattggtagcgggcgaaaccgctcaacagatttgtgaggatctcaggctgtgcatcccgtctactggaccgctg

SEQ ID NO: 32849 - DNA, 435 bp, Artificial Sequence
  Description of Artificial Sequence: Synthetic coding sequence
atggccacctgggcgctgttactgctggccgctatgttgctcggcaaccccggtctggtgttttcacgcctctcccctgagtactacgacttggccagagctcacttgcgggatgaggagaagtcctgcccgtgtctggcacaggaaggcccacaaggcgacctgttgacgaagacacaggagctgggccgagactatcgtacgtgcttgaccattgtgcagaaacttaaaaaaatggttgataaacctacacaaaggtctgtgagcaacgcggctactcgcgtgtgccgaaccggtagatcaaggtggcgagacgtgtgtcgtaactttatgaggaggtatcagtctcgtgttacacaaggacttgttgccggggaaaccgcacagcagatctgcgaggatttgagactctgtatcccgagcactggacctttg

SEQ ID NO: 32850 - DNA, 435 bp, Artificial Sequence
  Description of Artificial Sequence: Synthetic coding sequence
atggcaacctgggctctcctcctgttggccgctatgctgctgggaaaccccggcctcgttttctccagattgtccccggaatactacgacttggcccgcgcgcacctcagggatgaagagaagtcgtgcccgtgcctggctcaggaaggacctcagggggatcttctcactaaaactcaggaactgggcagggactatcggacttgtctcaccatcgtgcagaagttgaagaagatggtcgataaaccaacccaacgtagcgtgtccaatgcggcgacgcgcgtatgccgcaccggaagaagccgctggcgggacgtctgccggaactttatgcgtagataccagtcacgggtgacccaaggactggtggccggcgagactgcccagcaaatctgcgaggacctgcggctgtgcatcccgagtacgggaccgctg

SEQ ID NO: 32851 - DNA, 435 bp, Artificial Sequence
  Description of Artificial Sequence: Synthetic coding sequence
atggcgacttgggctctgctgctgctcgccgccatgcttctcggcaacccgggactcgttttctcgcgcctgtctccggaatactacgatctcgcacgcgcccacctgcgggacgaagagaaatcatgcccatgcctggcacaggaaggccctcagggcgatctgttgactaagactcaagagctgggacgggactacagaacttgcctcaccattgtccagaaattgaagaagatggtggataagccaacccagcggtccgtgtcgaatgctgccactagagtgtgccggaccgggaggtcgcgttggcgagacgtctgcagaaacttcatgcgacggtaccagagccgcgtgacccagggactcgtggcgggagaaaccgcacagcaaatctgcgaagatctccgcctgtgcatcccgtcgaccggcccactg

SEQ ID NO: 32852 - DNA, 435 bp, Artificial Sequence
  Description of Artificial Sequence: Synthetic coding sequence
atggcaacctgggcgctgctcctcctcgctgccatgctcctaggaaaccccggccttgtattcagtagattgagccctgagtattatgatcttgctcgggcccaccttcgcgacgaagagaaatcctgtccttgcctcgcccaggaagggccacagggagacttgctaactaaaacccaggagctggggagggactaccgcacatgtctcactattgtacagaagttaaagaaaatggtggataagccgactcagagaagtgttagtaacgcggcaacacgcgtgtgtaggaccgggagatcccgttggcgggatgtttgtcgaaattttatgagacgctatcagagccgagtgacacaaggcctggtcgctggggagaccgcccaacagatttgcgaagatttgcgtctttgtatcccctccactggaccactg

SEQ ID NO: 32853 - DNA, 435 bp, Artificial Sequence
  Description of Artificial Sequence: Synthetic coding sequence
atggcaacctgggcactgctgctgctcgcagcaatgttactggggaaccccggactggtgtttagtagactgagcccggaatattatgacctcgcccgtgcccaccttcgggacgaagaaaaatcttgtccctgcttggcacaagaagggccacagggagacctactgacaaaaactcaagaactgggccgggactacagaacatgcttgacaatcgtgcagaaactgaaaaaaatggtggataaacccacacaaagaagcgtcagtaatgccgctacacgagtctgtcgcacagggcgaagtcgctggagagacgtctgtagaaactttatgaggaggtaccagagcagagttacccaaggtctggtggcgggggagacagctcaacagatctgcgaggacttacgtctctgcattcctagcaccggcccctta

SEQ ID NO: 32854 - DNA, 435 bp, Artificial Sequence
  Description of Artificial Sequence: Synthetic coding sequence
atggctacttgggcccttctcttgctcgccgcaatgctcctggggaatccgggccttgtcttcagtcggctcagccctgagtactacgatctagcacgagctcatctgagagatgaagagaagtcatgcccttgccttgctcaagagggtccccagggcgacctgctcaccaaaacccaggagctgggtcgggattatcgcacctgtctgaccattgtccagaaactcaagaaaatggttgacaagcctacccagcgcagcgtgtctaacgcagccactcgggtgtgccggacaggacgctcgcggtggcgcgatgtatgtcggaacttcatgcgcagatatcagtcccgggttacgcagggactggtggcaggtgagacggcgcagcagatttgtgaagacttgagactatgtatccccagcactggcccactg

SEQ ID NO: 32855 - DNA, 435 bp, Artificial Sequence
  Description of Artificial Sequence: Synthetic coding sequence
atggccacctgggcactgctcttgctcgccgcgatgctcctggggaaccccgggctggtcttttcaagactgagcccagagtattacgatctggcaagggcccatctgagagatgaagagaagagctgcccatgcctggctcaagagggcccgcagggggacctgctcaccaaaacccaggaactgggacgggattaccgcacctgcctgaccatcgtgcagaaattgaagaagatggtggacaaacctacccagaggtccgtgtcgaatgccgcaacccgcgtgtgccggactggtagaagcagatggcgcgacgtgtgccgcaacttcatgcgccgctaccagtcccgcgtcacccagggactggtggccggggaaaccgcacaacaaatttgcgaggacctgcgcctctgcatcccgtcaactggtcctctg
